United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 98

SEQ ID NO: 3485274 - RNA, 15 nt, Pseudomonas aeruginosa PA01
ggucaggacagcgug

SEQ ID NO: 3485275 - RNA, 14 nt, Pseudomonas aeruginosa PA01
ggucaggccaagcu

SEQ ID NO: 3485276 - RNA, 12 nt, Pseudomonas aeruginosa PA01
ggucaggccgac

SEQ ID NO: 3485277 - RNA, 16 nt, Pseudomonas aeruginosa PA01
ggucaggccgagcagc

SEQ ID NO: 3485278 - RNA, 17 nt, Pseudomonas aeruginosa PA01
ggucaggccgagcagcg

SEQ ID NO: 3485279 - RNA, 22 nt, Pseudomonas aeruginosa PA01
ggucaggccgagcagcgccagc

SEQ ID NO: 3485280 - RNA, 23 nt, Pseudomonas aeruginosa PA01
ggucaggccgagcagcgccagcc

SEQ ID NO: 3485281 - RNA, 12 nt, Pseudomonas aeruginosa PA01
ggucaggccgau

SEQ ID NO: 3485282 - RNA, 15 nt, Pseudomonas aeruginosa PA01
ggucaggcgccagga

SEQ ID NO: 3485283 - RNA, 21 nt, Pseudomonas aeruginosa PA01
ggucaggcugacgucgacgca

SEQ ID NO: 3485284 - RNA, 14 nt, Pseudomonas aeruginosa PA01
ggucaggcugcgca

SEQ ID NO: 3485285 - RNA, 15 nt, Pseudomonas aeruginosa PA01
ggucaggcugcgcac

SEQ ID NO: 3485286 - RNA, 20 nt, Pseudomonas aeruginosa PA01
ggucaggcugcggcggaagg

SEQ ID NO: 3485287 - RNA, 18 nt, Pseudomonas aeruginosa PA01
ggucaggcuggccccggu

SEQ ID NO: 3485288 - RNA, 22 nt, Pseudomonas aeruginosa PA01
ggucagggucgagucgggucuu

SEQ ID NO: 3485289 - RNA, 12 nt, Pseudomonas aeruginosa PA01
ggucagggugcc

SEQ ID NO: 3485290 - RNA, 24 nt, Pseudomonas aeruginosa PA01
ggucagguaggcaucgacgccagc

SEQ ID NO: 3485291 - RNA, 23 nt, Pseudomonas aeruginosa PA01
ggucagguauucgccggccaggu

SEQ ID NO: 3485292 - RNA, 15 nt, Pseudomonas aeruginosa PA01
ggucagguugaccuu

SEQ ID NO: 3485293 - RNA, 17 nt, Pseudomonas aeruginosa PA01
ggucaguuccaggucgg

SEQ ID NO: 3485294 - RNA, 21 nt, Pseudomonas aeruginosa PA01
ggucaguuccaggucggcggc

SEQ ID NO: 3485295 - RNA, 22 nt, Pseudomonas aeruginosa PA01
ggucaguuccaggucggcggca

SEQ ID NO: 3485296 - RNA, 20 nt, Pseudomonas aeruginosa PA01
ggucaguucggcccagcagc

SEQ ID NO: 3485297 - RNA, 21 nt, Pseudomonas aeruginosa PA01
ggucaguucggcccagcagcg

SEQ ID NO: 3485298 - RNA, 14 nt, Pseudomonas aeruginosa PA01
ggucaguucguuga

SEQ ID NO: 3485299 - RNA, 22 nt, Pseudomonas aeruginosa PA01
ggucaucacgcuuuccggcuug

SEQ ID NO: 3485300 - RNA, 14 nt, Pseudomonas aeruginosa PA01
ggucaucaggauca

SEQ ID NO: 3485301 - RNA, 14 nt, Pseudomonas aeruginosa PA01
ggucauccgccggc

SEQ ID NO: 3485302 - RNA, 18 nt, Pseudomonas aeruginosa PA01
ggucaucgccggcgccga

SEQ ID NO: 3485303 - RNA, 15 nt, Pseudomonas aeruginosa PA01
ggucaucgcgccgcc

SEQ ID NO: 3485304 - RNA, 16 nt, Pseudomonas aeruginosa PA01
ggucaucggcccgacg

SEQ ID NO: 3485305 - RNA, 18 nt, Pseudomonas aeruginosa PA01
ggucaucggcccgacgcc

SEQ ID NO: 3485306 - RNA, 16 nt, Pseudomonas aeruginosa PA01
ggucaugagguucagg

SEQ ID NO: 3485307 - RNA, 19 nt, Pseudomonas aeruginosa PA01
ggucaugagguucaggccg

SEQ ID NO: 3485308 - RNA, 15 nt, Pseudomonas aeruginosa PA01
ggucaugcccaggcc

SEQ ID NO: 3485309 - RNA, 16 nt, Pseudomonas aeruginosa PA01
ggucaugcccaggccg

SEQ ID NO: 3485310 - RNA, 16 nt, Pseudomonas aeruginosa PA01
ggucaugcccuggccg

SEQ ID NO: 3485311 - RNA, 17 nt, Pseudomonas aeruginosa PA01
ggucaugcccuggccga

SEQ ID NO: 3485312 - RNA, 23 nt, Pseudomonas aeruginosa PA01
ggucaugccgaacuucuccgcca

SEQ ID NO: 3485313 - RNA, 23 nt, Pseudomonas aeruginosa PA01
ggucaugcucgggguuuccucga

SEQ ID NO: 3485314 - RNA, 13 nt, Pseudomonas aeruginosa PA01
ggucauggccagc

SEQ ID NO: 3485315 - RNA, 16 nt, Pseudomonas aeruginosa PA01
ggucauggccagcucg

SEQ ID NO: 3485316 - RNA, 14 nt, Pseudomonas aeruginosa PA01
ggucauggcgcaga

SEQ ID NO: 3485317 - RNA, 15 nt, Pseudomonas aeruginosa PA01
ggucauggcguccgg

SEQ ID NO: 3485318 - RNA, 17 nt, Pseudomonas aeruginosa PA01
ggucauggugccgagca

SEQ ID NO: 3485319 - RNA, 21 nt, Pseudomonas aeruginosa PA01
ggucauggugccgagcaggau

SEQ ID NO: 3485320 - RNA, 22 nt, Pseudomonas aeruginosa PA01
gguccaacccauguggcgcagc

SEQ ID NO: 3485321 - RNA, 21 nt, Pseudomonas aeruginosa PA01
gguccaaccgggcaucgccga

SEQ ID NO: 3485322 - RNA, 15 nt, Pseudomonas aeruginosa PA01
gguccaccagcccgc

SEQ ID NO: 3485323 - RNA, 22 nt, Pseudomonas aeruginosa PA01
gguccaccgcggccucgcuggc

SEQ ID NO: 3485324 - RNA, 19 nt, Pseudomonas aeruginosa PA01
gguccacguugcaguccag

SEQ ID NO: 3485325 - RNA, 20 nt, Pseudomonas aeruginosa PA01
gguccagaucgccaccccgc

SEQ ID NO: 3485326 - RNA, 17 nt, Pseudomonas aeruginosa PA01
gguccagcacgcuggcg

SEQ ID NO: 3485327 - RNA, 20 nt, Pseudomonas aeruginosa PA01
gguccagcacgcuggcgagg

SEQ ID NO: 3485328 - RNA, 21 nt, Pseudomonas aeruginosa PA01
gguccagcacgcuggcgagga

SEQ ID NO: 3485329 - RNA, 20 nt, Pseudomonas aeruginosa PA01
gguccagccagacguccggc

SEQ ID NO: 3485330 - RNA, 15 nt, Pseudomonas aeruginosa PA01
gguccagccagccgc

SEQ ID NO: 3485331 - RNA, 17 nt, Pseudomonas aeruginosa PA01
gguccagccagccgccu

SEQ ID NO: 3485332 - RNA, 22 nt, Pseudomonas aeruginosa PA01
gguccagcgagcgggcgagggc

SEQ ID NO: 3485333 - RNA, 17 nt, Pseudomonas aeruginosa PA01
gguccagcggccgcgcc

SEQ ID NO: 3485334 - RNA, 22 nt, Pseudomonas aeruginosa PA01
gguccagcucggucagcggcgc

SEQ ID NO: 3485335 - RNA, 19 nt, Pseudomonas aeruginosa PA01
gguccagcuggcgcagccg

SEQ ID NO: 3485336 - RNA, 22 nt, Pseudomonas aeruginosa PA01
gguccaggucaugcccuggccg

SEQ ID NO: 3485337 - RNA, 23 nt, Pseudomonas aeruginosa PA01
gguccaggucaugcccuggccga

SEQ ID NO: 3485338 - RNA, 20 nt, Pseudomonas aeruginosa PA01
gguccaguucagggcgagca

SEQ ID NO: 3485339 - RNA, 22 nt, Pseudomonas aeruginosa PA01
gguccaguucagggcgagcagg

SEQ ID NO: 3485340 - RNA, 19 nt, Pseudomonas aeruginosa PA01
ggucccaucagcaguccgc

SEQ ID NO: 3485341 - RNA, 16 nt, Pseudomonas aeruginosa PA01
ggucccgggcuccggg

SEQ ID NO: 3485342 - RNA, 15 nt, Pseudomonas aeruginosa PA01
ggucccuggaucugc

SEQ ID NO: 3485343 - RNA, 20 nt, Pseudomonas aeruginosa PA01
ggucccuucgugggccugcu

SEQ ID NO: 3485344 - RNA, 22 nt, Pseudomonas aeruginosa PA01
ggucccuucgugggccugcucg

SEQ ID NO: 3485345 - RNA, 23 nt, Pseudomonas aeruginosa PA01
ggucccuucgugggccugcucgg

SEQ ID NO: 3485346 - RNA, 11 nt, Pseudomonas aeruginosa PA01
gguccgcaccg

SEQ ID NO: 3485347 - RNA, 20 nt, Pseudomonas aeruginosa PA01
gguccgccacuucaagcugg

SEQ ID NO: 3485348 - RNA, 22 nt, Pseudomonas aeruginosa PA01
gguccgccacuucaagcuggcg

SEQ ID NO: 3485349 - RNA, 24 nt, Pseudomonas aeruginosa PA01
gguccgccacuucaagcuggcgca

SEQ ID NO: 3485350 - RNA, 13 nt, Pseudomonas aeruginosa PA01
gguccgccgcggg

SEQ ID NO: 3485351 - RNA, 16 nt, Pseudomonas aeruginosa PA01
gguccgccgcgggacg

SEQ ID NO: 3485352 - RNA, 19 nt, Pseudomonas aeruginosa PA01
gguccgccggucaccacug

SEQ ID NO: 3485353 - RNA, 19 nt, Pseudomonas aeruginosa PA01
gguccgcgaaccgcuggug

SEQ ID NO: 3485354 - RNA, 17 nt, Pseudomonas aeruginosa PA01
gguccggagggcccggg

SEQ ID NO: 3485355 - RNA, 18 nt, Pseudomonas aeruginosa PA01
gguccggcugucgacgca

SEQ ID NO: 3485356 - RNA, 20 nt, Pseudomonas aeruginosa PA01
gguccggguuggcgcaggcc

SEQ ID NO: 3485357 - RNA, 15 nt, Pseudomonas aeruginosa PA01
gguccguccagcgcg

SEQ ID NO: 3485358 - RNA, 18 nt, Pseudomonas aeruginosa PA01
gguccgucgcgcgcccgu

SEQ ID NO: 3485359 - RNA, 21 nt, Pseudomonas aeruginosa PA01
gguccugcagauaaagcugga

SEQ ID NO: 3485360 - RNA, 15 nt, Pseudomonas aeruginosa PA01
gguccugcggcggca

SEQ ID NO: 3485361 - RNA, 19 nt, Pseudomonas aeruginosa PA01
gguccuggaucacgcugag

SEQ ID NO: 3485362 - RNA, 20 nt, Pseudomonas aeruginosa PA01
gguccuggcgcgagaagcca

SEQ ID NO: 3485363 - RNA, 22 nt, Pseudomonas aeruginosa PA01
gguccuggcgcgagaagccagc

SEQ ID NO: 3485364 - RNA, 20 nt, Pseudomonas aeruginosa PA01
gguccuggguauagaccagc

SEQ ID NO: 3485365 - RNA, 23 nt, Pseudomonas aeruginosa PA01
gguccuggguauagaccagcacc

SEQ ID NO: 3485366 - RNA, 17 nt, Pseudomonas aeruginosa PA01
gguccuggugaucaucg

SEQ ID NO: 3485367 - RNA, 12 nt, Pseudomonas aeruginosa PA01
gguccuugggcc

SEQ ID NO: 3485368 - RNA, 14 nt, Pseudomonas aeruginosa PA01
gguccuugggccag

SEQ ID NO: 3485369 - RNA, 15 nt, Pseudomonas aeruginosa PA01
ggucgaaagccugcc

SEQ ID NO: 3485370 - RNA, 18 nt, Pseudomonas aeruginosa PA01
ggucgaaagccugccggg

SEQ ID NO: 3485371 - RNA, 20 nt, Pseudomonas aeruginosa PA01
ggucgaaagcuucgucgcgc

SEQ ID NO: 3485372 - RNA, 21 nt, Pseudomonas aeruginosa PA01
ggucgaacacuugaccgucgg

SEQ ID NO: 3485373 - RNA, 16 nt, Pseudomonas aeruginosa PA01
ggucgaacagcggcug

SEQ ID NO: 3485374 - RNA, 20 nt, Pseudomonas aeruginosa PA01
ggucgaacagcggcuggccc

SEQ ID NO: 3485375 - RNA, 18 nt, Pseudomonas aeruginosa PA01
ggucgaacugaccaccag

SEQ ID NO: 3485376 - RNA, 19 nt, Pseudomonas aeruginosa PA01
ggucgaacugaccaccagg

SEQ ID NO: 3485377 - RNA, 17 nt, Pseudomonas aeruginosa PA01
ggucgaacugcacccgc

SEQ ID NO: 3485378 - RNA, 18 nt, Pseudomonas aeruginosa PA01
ggucgaacugcacccgcc

SEQ ID NO: 3485379 - RNA, 12 nt, Pseudomonas aeruginosa PA01
ggucgaagcgga

SEQ ID NO: 3485380 - RNA, 15 nt, Pseudomonas aeruginosa PA01
ggucgaaggcgcggc

SEQ ID NO: 3485381 - RNA, 20 nt, Pseudomonas aeruginosa PA01
ggucgacauagcgcagcacc

SEQ ID NO: 3485382 - RNA, 21 nt, Pseudomonas aeruginosa PA01
ggucgacauagcgcagcaccg

SEQ ID NO: 3485383 - RNA, 22 nt, Pseudomonas aeruginosa PA01
ggucgacauagcgcagcaccgg

SEQ ID NO: 3485384 - RNA, 24 nt, Pseudomonas aeruginosa PA01
ggucgacauagcgcagcaccggcu

SEQ ID NO: 3485385 - RNA, 23 nt, Pseudomonas aeruginosa PA01
ggucgacaucgauaacaccagga

SEQ ID NO: 3485386 - RNA, 17 nt, Pseudomonas aeruginosa PA01
ggucgacaugcaggccg

SEQ ID NO: 3485387 - RNA, 14 nt, Pseudomonas aeruginosa PA01
ggucgaccagccag

SEQ ID NO: 3485388 - RNA, 17 nt, Pseudomonas aeruginosa PA01
ggucgaccuugccgacg

SEQ ID NO: 3485389 - RNA, 20 nt, Pseudomonas aeruginosa PA01
ggucgaccuugccgacgccg

SEQ ID NO: 3485390 - RNA, 13 nt, Pseudomonas aeruginosa PA01
ggucgacgccgcc

SEQ ID NO: 3485391 - RNA, 15 nt, Pseudomonas aeruginosa PA01
ggucgacgccgccga

SEQ ID NO: 3485392 - RNA, 19 nt, Pseudomonas aeruginosa PA01
ggucgacggcggccgccau

SEQ ID NO: 3485393 - RNA, 19 nt, Pseudomonas aeruginosa PA01
ggucgacgguucgaucccg

SEQ ID NO: 3485394 - RNA, 17 nt, Pseudomonas aeruginosa PA01
ggucgacguaggcggcg

SEQ ID NO: 3485395 - RNA, 13 nt, Pseudomonas aeruginosa PA01
ggucgacugcugg

SEQ ID NO: 3485396 - RNA, 17 nt, Pseudomonas aeruginosa PA01
ggucgacugcuggguac

SEQ ID NO: 3485397 - RNA, 20 nt, Pseudomonas aeruginosa PA01
ggucgacuucgcaccagccg

SEQ ID NO: 3485398 - RNA, 21 nt, Pseudomonas aeruginosa PA01
ggucgacuucgcaccagccgg

SEQ ID NO: 3485399 - RNA, 23 nt, Pseudomonas aeruginosa PA01
ggucgacuucgcaccagccggcc

SEQ ID NO: 3485400 - RNA, 17 nt, Pseudomonas aeruginosa PA01
ggucgagaaggcugccg

SEQ ID NO: 3485401 - RNA, 19 nt, Pseudomonas aeruginosa PA01
ggucgagaaggcugccggg

SEQ ID NO: 3485402 - RNA, 13 nt, Pseudomonas aeruginosa PA01
ggucgagacccgc

SEQ ID NO: 3485403 - RNA, 22 nt, Pseudomonas aeruginosa PA01
ggucgagcagaguuuagccgcc

SEQ ID NO: 3485404 - RNA, 16 nt, Pseudomonas aeruginosa PA01
ggucgagcagcgccgc

SEQ ID NO: 3485405 - RNA, 13 nt, Pseudomonas aeruginosa PA01
ggucgagccaggc

SEQ ID NO: 3485406 - RNA, 15 nt, Pseudomonas aeruginosa PA01
ggucgagccaggcgu

SEQ ID NO: 3485407 - RNA, 13 nt, Pseudomonas aeruginosa PA01
ggucgagcucggc

SEQ ID NO: 3485408 - RNA, 15 nt, Pseudomonas aeruginosa PA01
ggucgagcucggcca

SEQ ID NO: 3485409 - RNA, 16 nt, Pseudomonas aeruginosa PA01
ggucgagcucggccag

SEQ ID NO: 3485410 - RNA, 18 nt, Pseudomonas aeruginosa PA01
ggucgagcucggccaggc

SEQ ID NO: 3485411 - RNA, 21 nt, Pseudomonas aeruginosa PA01
ggucgagcucggccaggcaca

SEQ ID NO: 3485412 - RNA, 21 nt, Pseudomonas aeruginosa PA01
ggucgagcuuguuggccagca

SEQ ID NO: 3485413 - RNA, 20 nt, Pseudomonas aeruginosa PA01
ggucgaggcaaucugcccgg

SEQ ID NO: 3485414 - RNA, 12 nt, Pseudomonas aeruginosa PA01
ggucgaggcccu

SEQ ID NO: 3485415 - RNA, 14 nt, Pseudomonas aeruginosa PA01
ggucgaggccgcgg

SEQ ID NO: 3485416 - RNA, 18 nt, Pseudomonas aeruginosa PA01
ggucgaggccgcggagca

SEQ ID NO: 3485417 - RNA, 17 nt, Pseudomonas aeruginosa PA01
ggucgagggcaugaccg

SEQ ID NO: 3485418 - RNA, 22 nt, Pseudomonas aeruginosa PA01
ggucgagggugguuuccaggcu

SEQ ID NO: 3485419 - RNA, 19 nt, Pseudomonas aeruginosa PA01
ggucgagguucuccaggcu

SEQ ID NO: 3485420 - RNA, 14 nt, Pseudomonas aeruginosa PA01
ggucgagucggguc

SEQ ID NO: 3485421 - RNA, 16 nt, Pseudomonas aeruginosa PA01
ggucgauauagcccug

SEQ ID NO: 3485422 - RNA, 21 nt, Pseudomonas aeruginosa PA01
ggucgaucagcagcagcgcca

SEQ ID NO: 3485423 - RNA, 15 nt, Pseudomonas aeruginosa PA01
ggucgaucaggcgca

SEQ ID NO: 3485424 - RNA, 22 nt, Pseudomonas aeruginosa PA01
ggucgauccgaccuggggcggc

SEQ ID NO: 3485425 - RNA, 23 nt, Pseudomonas aeruginosa PA01
ggucgauccgaccuggggcggcc

SEQ ID NO: 3485426 - RNA, 15 nt, Pseudomonas aeruginosa PA01
ggucgauccgcgccu

SEQ ID NO: 3485427 - RNA, 23 nt, Pseudomonas aeruginosa PA01
ggucgaucuccuccucggcggcu

SEQ ID NO: 3485428 - RNA, 13 nt, Pseudomonas aeruginosa PA01
ggucgaucucguc

SEQ ID NO: 3485429 - RNA, 15 nt, Pseudomonas aeruginosa PA01
ggucgaucucgucga

SEQ ID NO: 3485430 - RNA, 18 nt, Pseudomonas aeruginosa PA01
ggucgaucucgucgaagc

SEQ ID NO: 3485431 - RNA, 20 nt, Pseudomonas aeruginosa PA01
ggucgaugacguugcugccc

SEQ ID NO: 3485432 - RNA, 17 nt, Pseudomonas aeruginosa PA01
ggucgaugaucuugucg

SEQ ID NO: 3485433 - RNA, 19 nt, Pseudomonas aeruginosa PA01
ggucgaugcccucgcggcg

SEQ ID NO: 3485434 - RNA, 22 nt, Pseudomonas aeruginosa PA01
ggucgaugcccucgcggcggca

SEQ ID NO: 3485435 - RNA, 15 nt, Pseudomonas aeruginosa PA01
ggucgaugggccgua

SEQ ID NO: 3485436 - RNA, 16 nt, Pseudomonas aeruginosa PA01
ggucgaugggcgagcg

SEQ ID NO: 3485437 - RNA, 14 nt, Pseudomonas aeruginosa PA01
ggucgauuccuguc

SEQ ID NO: 3485438 - RNA, 22 nt, Pseudomonas aeruginosa PA01
ggucgauuccugucuccgcacc

SEQ ID NO: 3485439 - RNA, 17 nt, Pseudomonas aeruginosa PA01
ggucgauugcugggugc

SEQ ID NO: 3485440 - RNA, 18 nt, Pseudomonas aeruginosa PA01
ggucgauugcugggugcg

SEQ ID NO: 3485441 - RNA, 12 nt, Pseudomonas aeruginosa PA01
ggucgcaccgcc

SEQ ID NO: 3485442 - RNA, 14 nt, Pseudomonas aeruginosa PA01
ggucgcaccgccag

SEQ ID NO: 3485443 - RNA, 15 nt, Pseudomonas aeruginosa PA01
ggucgcaccgccagc

SEQ ID NO: 3485444 - RNA, 16 nt, Pseudomonas aeruginosa PA01
ggucgcaccgccagca

SEQ ID NO: 3485445 - RNA, 17 nt, Pseudomonas aeruginosa PA01
ggucgcaccgccagcag

SEQ ID NO: 3485446 - RNA, 13 nt, Pseudomonas aeruginosa PA01
ggucgcacgcagc

SEQ ID NO: 3485447 - RNA, 16 nt, Pseudomonas aeruginosa PA01
ggucgcacgcagcgcc

SEQ ID NO: 3485448 - RNA, 16 nt, Pseudomonas aeruginosa PA01
ggucgcagcaggccgc

SEQ ID NO: 3485449 - RNA, 21 nt, Pseudomonas aeruginosa PA01
ggucgcagcaggccgcuggcg

SEQ ID NO: 3485450 - RNA, 15 nt, Pseudomonas aeruginosa PA01
ggucgcagccgcgca

SEQ ID NO: 3485451 - RNA, 19 nt, Pseudomonas aeruginosa PA01
ggucgcagcguuccagcgc

SEQ ID NO: 3485452 - RNA, 16 nt, Pseudomonas aeruginosa PA01
ggucgcagcuccagcg

SEQ ID NO: 3485453 - RNA, 13 nt, Pseudomonas aeruginosa PA01
ggucgcaggggcu

SEQ ID NO: 3485454 - RNA, 21 nt, Pseudomonas aeruginosa PA01
ggucgccagcagguagccagg

SEQ ID NO: 3485455 - RNA, 14 nt, Pseudomonas aeruginosa PA01
ggucgccauggucg

SEQ ID NO: 3485456 - RNA, 21 nt, Pseudomonas aeruginosa PA01
ggucgcccgugccucggcgga

SEQ ID NO: 3485457 - RNA, 14 nt, Pseudomonas aeruginosa PA01
ggucgcccucggcc

SEQ ID NO: 3485458 - RNA, 16 nt, Pseudomonas aeruginosa PA01
ggucgcccucggccag

SEQ ID NO: 3485459 - RNA, 18 nt, Pseudomonas aeruginosa PA01
ggucgcccucggccaggc

SEQ ID NO: 3485460 - RNA, 20 nt, Pseudomonas aeruginosa PA01
ggucgcccucggccaggcau

SEQ ID NO: 3485461 - RNA, 22 nt, Pseudomonas aeruginosa PA01
ggucgcccucggccaggcauuc

SEQ ID NO: 3485462 - RNA, 18 nt, Pseudomonas aeruginosa PA01
ggucgcccugcagcgcgc

SEQ ID NO: 3485463 - RNA, 23 nt, Pseudomonas aeruginosa PA01
ggucgcccugcagcgcgcgcugg

SEQ ID NO: 3485464 - RNA, 18 nt, Pseudomonas aeruginosa PA01
ggucgccgaacagccgcc

SEQ ID NO: 3485465 - RNA, 20 nt, Pseudomonas aeruginosa PA01
ggucgccgaaguacucgugu

SEQ ID NO: 3485466 - RNA, 11 nt, Pseudomonas aeruginosa PA01
ggucgccgaca

SEQ ID NO: 3485467 - RNA, 15 nt, Pseudomonas aeruginosa PA01
ggucgccgacacgug

SEQ ID NO: 3485468 - RNA, 12 nt, Pseudomonas aeruginosa PA01
ggucgccgcaca

SEQ ID NO: 3485469 - RNA, 16 nt, Pseudomonas aeruginosa PA01
ggucgccgcacaccgc

SEQ ID NO: 3485470 - RNA, 22 nt, Pseudomonas aeruginosa PA01
ggucgccgcacaccgcgcgcgc

SEQ ID NO: 3485471 - RNA, 13 nt, Pseudomonas aeruginosa PA01
ggucgccgcagcc

SEQ ID NO: 3485472 - RNA, 13 nt, Pseudomonas aeruginosa PA01
ggucgccgccagc

SEQ ID NO: 3485473 - RNA, 20 nt, Pseudomonas aeruginosa PA01
ggucgccgccagcuaccggc

SEQ ID NO: 3485474 - RNA, 22 nt, Pseudomonas aeruginosa PA01
ggucgccgccagcuaccggcag

SEQ ID NO: 3485475 - RNA, 12 nt, Pseudomonas aeruginosa PA01
ggucgccgccca

SEQ ID NO: 3485476 - RNA, 13 nt, Pseudomonas aeruginosa PA01
ggucgccgccgcc

SEQ ID NO: 3485477 - RNA, 18 nt, Pseudomonas aeruginosa PA01
ggucgccgcucauccgcu

SEQ ID NO: 3485478 - RNA, 20 nt, Pseudomonas aeruginosa PA01
ggucgccgcucauccgcugg

SEQ ID NO: 3485479 - RNA, 22 nt, Pseudomonas aeruginosa PA01
ggucgccgcucauccgcuggua

SEQ ID NO: 3485480 - RNA, 15 nt, Pseudomonas aeruginosa PA01
ggucgccggcgcgca

SEQ ID NO: 3485481 - RNA, 14 nt, Pseudomonas aeruginosa PA01
ggucgccgggcuca

SEQ ID NO: 3485482 - RNA, 18 nt, Pseudomonas aeruginosa PA01
ggucgccgggcucacucc

SEQ ID NO: 3485483 - RNA, 13 nt, Pseudomonas aeruginosa PA01
ggucgccggucgg

SEQ ID NO: 3485484 - RNA, 18 nt, Pseudomonas aeruginosa PA01
ggucgccguagaacagca

SEQ ID NO: 3485485 - RNA, 15 nt, Pseudomonas aeruginosa PA01
ggucgccguccuugu

SEQ ID NO: 3485486 - RNA, 17 nt, Pseudomonas aeruginosa PA01
ggucgccgugguggccg

SEQ ID NO: 3485487 - RNA, 18 nt, Pseudomonas aeruginosa PA01
ggucgccucgaacauggc

SEQ ID NO: 3485488 - RNA, 20 nt, Pseudomonas aeruginosa PA01
ggucgccucgaacauggcca

SEQ ID NO: 3485489 - RNA, 21 nt, Pseudomonas aeruginosa PA01
ggucgccucgggggugcccau

SEQ ID NO: 3485490 - RNA, 13 nt, Pseudomonas aeruginosa PA01
ggucgccugggua

SEQ ID NO: 3485491 - RNA, 20 nt, Pseudomonas aeruginosa PA01
ggucgccuugaccagcggcc

SEQ ID NO: 3485492 - RNA, 21 nt, Pseudomonas aeruginosa PA01
ggucgccuugaccagcggccc

SEQ ID NO: 3485493 - RNA, 18 nt, Pseudomonas aeruginosa PA01
ggucgcgagcagggcgau

SEQ ID NO: 3485494 - RNA, 15 nt, Pseudomonas aeruginosa PA01
ggucgcgaucaccgc

SEQ ID NO: 3485495 - RNA, 15 nt, Pseudomonas aeruginosa PA01
ggucgcgaucugcug

SEQ ID NO: 3485496 - RNA, 15 nt, Pseudomonas aeruginosa PA01
ggucgcgcagcggcu

SEQ ID NO: 3485497 - RNA, 13 nt, Pseudomonas aeruginosa PA01
ggucgcgcaggcg

SEQ ID NO: 3485498 - RNA, 22 nt, Pseudomonas aeruginosa PA01
ggucgcgcagggccagggcggc

SEQ ID NO: 3485499 - RNA, 12 nt, Pseudomonas aeruginosa PA01
ggucgcgcccgc

SEQ ID NO: 3485500 - RNA, 18 nt, Pseudomonas aeruginosa PA01
ggucgcgccgacgacccg

SEQ ID NO: 3485501 - RNA, 13 nt, Pseudomonas aeruginosa PA01
ggucgcgccgucc

SEQ ID NO: 3485502 - RNA, 23 nt, Pseudomonas aeruginosa PA01
ggucgcgccguccaucaggcguu

SEQ ID NO: 3485503 - RNA, 22 nt, Pseudomonas aeruginosa PA01
ggucgcgcgccuucagccccag

SEQ ID NO: 3485504 - RNA, 15 nt, Pseudomonas aeruginosa PA01
ggucgcgcgcggcca

SEQ ID NO: 3485505 - RNA, 18 nt, Pseudomonas aeruginosa PA01
ggucgcgcgcggccagcu

SEQ ID NO: 3485506 - RNA, 20 nt, Pseudomonas aeruginosa PA01
ggucgcgcgcggccagcucg

SEQ ID NO: 3485507 - RNA, 12 nt, Pseudomonas aeruginosa PA01
ggucgcgcggcg

SEQ ID NO: 3485508 - RNA, 14 nt, Pseudomonas aeruginosa PA01
ggucgcgcggcgcc

SEQ ID NO: 3485509 - RNA, 20 nt, Pseudomonas aeruginosa PA01
ggucgcgcgggugcggcugg

SEQ ID NO: 3485510 - RNA, 14 nt, Pseudomonas aeruginosa PA01
ggucgcgcucaggc

SEQ ID NO: 3485511 - RNA, 15 nt, Pseudomonas aeruginosa PA01
ggucgcgcucaggcg

SEQ ID NO: 3485512 - RNA, 17 nt, Pseudomonas aeruginosa PA01
ggucgcgcucaggcgca

SEQ ID NO: 3485513 - RNA, 15 nt, Pseudomonas aeruginosa PA01
ggucgcgcuggaccu

SEQ ID NO: 3485514 - RNA, 19 nt, Pseudomonas aeruginosa PA01
ggucgcgcuggaccuggcc

SEQ ID NO: 3485515 - RNA, 12 nt, Pseudomonas aeruginosa PA01
ggucgcgcuggg

SEQ ID NO: 3485516 - RNA, 18 nt, Pseudomonas aeruginosa PA01
ggucgcggaacucgauga

SEQ ID NO: 3485517 - RNA, 20 nt, Pseudomonas aeruginosa PA01
ggucgcggaacucgaugaaa

SEQ ID NO: 3485518 - RNA, 21 nt, Pseudomonas aeruginosa PA01
ggucgcggaagugcgggguga

SEQ ID NO: 3485519 - RNA, 15 nt, Pseudomonas aeruginosa PA01
ggucgcggaucaggc

SEQ ID NO: 3485520 - RNA, 16 nt, Pseudomonas aeruginosa PA01
ggucgcggaucaggcu

SEQ ID NO: 3485521 - RNA, 17 nt, Pseudomonas aeruginosa PA01
ggucgcggaucaggcug

SEQ ID NO: 3485522 - RNA, 14 nt, Pseudomonas aeruginosa PA01
ggucgcggcgaccu

SEQ ID NO: 3485523 - RNA, 17 nt, Pseudomonas aeruginosa PA01
ggucgcggcugcgcgcc

SEQ ID NO: 3485524 - RNA, 19 nt, Pseudomonas aeruginosa PA01
ggucgcggcugcgcgccgg

SEQ ID NO: 3485525 - RNA, 14 nt, Pseudomonas aeruginosa PA01
ggucgcggcuggcc

SEQ ID NO: 3485526 - RNA, 15 nt, Pseudomonas aeruginosa PA01
ggucgcggcuggccg

SEQ ID NO: 3485527 - RNA, 17 nt, Pseudomonas aeruginosa PA01
ggucgcggcuggccgcc

SEQ ID NO: 3485528 - RNA, 16 nt, Pseudomonas aeruginosa PA01
ggucgcgggccaggcc

SEQ ID NO: 3485529 - RNA, 18 nt, Pseudomonas aeruginosa PA01
ggucgcgggccaggcccu

SEQ ID NO: 3485530 - RNA, 17 nt, Pseudomonas aeruginosa PA01
ggucgcggucuggauga

SEQ ID NO: 3485531 - RNA, 23 nt, Pseudomonas aeruginosa PA01
ggucgcggugcaguucgccguuc

SEQ ID NO: 3485532 - RNA, 16 nt, Pseudomonas aeruginosa PA01
ggucgcguacagcggg

SEQ ID NO: 3485533 - RNA, 20 nt, Pseudomonas aeruginosa PA01
ggucgcguagaccaucgccg

SEQ ID NO: 3485534 - RNA, 17 nt, Pseudomonas aeruginosa PA01
ggucgcguuccagcucc

SEQ ID NO: 3485535 - RNA, 20 nt, Pseudomonas aeruginosa PA01
ggucgcguuccagcuccguc

SEQ ID NO: 3485536 - RNA, 21 nt, Pseudomonas aeruginosa PA01
ggucgcguucgucggccacca

SEQ ID NO: 3485537 - RNA, 16 nt, Pseudomonas aeruginosa PA01
ggucgcugaccagccc

SEQ ID NO: 3485538 - RNA, 17 nt, Pseudomonas aeruginosa PA01
ggucgcugaccagcccg

SEQ ID NO: 3485539 - RNA, 17 nt, Pseudomonas aeruginosa PA01
ggucgcugcccaucgcc

SEQ ID NO: 3485540 - RNA, 19 nt, Pseudomonas aeruginosa PA01
ggucgcugcccaucgccuc

SEQ ID NO: 3485541 - RNA, 14 nt, Pseudomonas aeruginosa PA01
ggucgcugcccucg

SEQ ID NO: 3485542 - RNA, 22 nt, Pseudomonas aeruginosa PA01
ggucgcugcccucgaccagguc

SEQ ID NO: 3485543 - RNA, 22 nt, Pseudomonas aeruginosa PA01
ggucgcugcucagggccgcgcc

SEQ ID NO: 3485544 - RNA, 21 nt, Pseudomonas aeruginosa PA01
ggucgcuggcaccggccaggc

SEQ ID NO: 3485545 - RNA, 18 nt, Pseudomonas aeruginosa PA01
ggucgcuggcgucgaccg

SEQ ID NO: 3485546 - RNA, 19 nt, Pseudomonas aeruginosa PA01
ggucgcuggcgucgaccgc

SEQ ID NO: 3485547 - RNA, 23 nt, Pseudomonas aeruginosa PA01
ggucgcuggcgucgaccgccugc

SEQ ID NO: 3485548 - RNA, 17 nt, Pseudomonas aeruginosa PA01
ggucgcuuccucggcac

SEQ ID NO: 3485549 - RNA, 23 nt, Pseudomonas aeruginosa PA01
ggucggaaagcagggcgauggcc

SEQ ID NO: 3485550 - RNA, 17 nt, Pseudomonas aeruginosa PA01
ggucggaacgaccacgc

SEQ ID NO: 3485551 - RNA, 17 nt, Pseudomonas aeruginosa PA01
ggucggacuccgcccag

SEQ ID NO: 3485552 - RNA, 18 nt, Pseudomonas aeruginosa PA01
ggucggacuccgcccagu

SEQ ID NO: 3485553 - RNA, 22 nt, Pseudomonas aeruginosa PA01
ggucggaucggauagccgugca

SEQ ID NO: 3485554 - RNA, 15 nt, Pseudomonas aeruginosa PA01
ggucggaucggccuu

SEQ ID NO: 3485555 - RNA, 15 nt, Pseudomonas aeruginosa PA01
ggucggaugcagcgc

SEQ ID NO: 3485556 - RNA, 18 nt, Pseudomonas aeruginosa PA01
ggucggcaccugcagacg

SEQ ID NO: 3485557 - RNA, 13 nt, Pseudomonas aeruginosa PA01
ggucggcacggcc

SEQ ID NO: 3485558 - RNA, 19 nt, Pseudomonas aeruginosa PA01
ggucggcagcagcuugccg

SEQ ID NO: 3485559 - RNA, 21 nt, Pseudomonas aeruginosa PA01
ggucggcagcagcuugccggc

SEQ ID NO: 3485560 - RNA, 22 nt, Pseudomonas aeruginosa PA01
ggucggcagcgucgagcuggcg

SEQ ID NO: 3485561 - RNA, 18 nt, Pseudomonas aeruginosa PA01
ggucggcauccggcaggc

SEQ ID NO: 3485562 - RNA, 18 nt, Pseudomonas aeruginosa PA01
ggucggcaucgcguaggg

SEQ ID NO: 3485563 - RNA, 13 nt, Pseudomonas aeruginosa PA01
ggucggccaggcg

SEQ ID NO: 3485564 - RNA, 20 nt, Pseudomonas aeruginosa PA01
ggucggccaggggagcgccg

SEQ ID NO: 3485565 - RNA, 22 nt, Pseudomonas aeruginosa PA01
ggucggccaggggagcgccggc

SEQ ID NO: 3485566 - RNA, 23 nt, Pseudomonas aeruginosa PA01
ggucggccaggggagcgccggcg

SEQ ID NO: 3485567 - RNA, 16 nt, Pseudomonas aeruginosa PA01
ggucggccaggucgcg

SEQ ID NO: 3485568 - RNA, 14 nt, Pseudomonas aeruginosa PA01
ggucggccaguucc

SEQ ID NO: 3485569 - RNA, 22 nt, Pseudomonas aeruginosa PA01
ggucggccaguuccuucacggc

SEQ ID NO: 3485570 - RNA, 17 nt, Pseudomonas aeruginosa PA01
ggucggccaucuggcug

SEQ ID NO: 3485571 - RNA, 17 nt, Pseudomonas aeruginosa PA01
ggucggccgccucgguc

SEQ ID NO: 3485572 - RNA, 15 nt, Pseudomonas aeruginosa PA01
ggucggccucggcga

SEQ ID NO: 3485573 - RNA, 18 nt, Pseudomonas aeruginosa PA01
ggucggccucggcgagga

SEQ ID NO: 3485574 - RNA, 14 nt, Pseudomonas aeruginosa PA01
ggucggccugcggg

SEQ ID NO: 3485575 - RNA, 21 nt, Pseudomonas aeruginosa PA01
ggucggccugcgguucgccuu

SEQ ID NO: 3485576 - RNA, 23 nt, Pseudomonas aeruginosa PA01
ggucggccugcugcucgaccgcc

SEQ ID NO: 3485577 - RNA, 17 nt, Pseudomonas aeruginosa PA01
ggucggccuggcugccg

SEQ ID NO: 3485578 - RNA, 22 nt, Pseudomonas aeruginosa PA01
ggucggccuguucgcccaaggc

SEQ ID NO: 3485579 - RNA, 18 nt, Pseudomonas aeruginosa PA01
ggucggcgaacagggugg

SEQ ID NO: 3485580 - RNA, 19 nt, Pseudomonas aeruginosa PA01
ggucggcgaaggcgaacca

SEQ ID NO: 3485581 - RNA, 18 nt, Pseudomonas aeruginosa PA01
ggucggcgaaguccacca

SEQ ID NO: 3485582 - RNA, 20 nt, Pseudomonas aeruginosa PA01
ggucggcgaaguccaccagg

SEQ ID NO: 3485583 - RNA, 12 nt, Pseudomonas aeruginosa PA01
ggucggcgaggg

SEQ ID NO: 3485584 - RNA, 17 nt, Pseudomonas aeruginosa PA01
ggucggcgagggcacca

SEQ ID NO: 3485585 - RNA, 17 nt, Pseudomonas aeruginosa PA01
ggucggcgccggugcug

SEQ ID NO: 3485586 - RNA, 16 nt, Pseudomonas aeruginosa PA01
ggucggcgccugcgga

SEQ ID NO: 3485587 - RNA, 13 nt, Pseudomonas aeruginosa PA01
ggucggcgcgacg

SEQ ID NO: 3485588 - RNA, 16 nt, Pseudomonas aeruginosa PA01
ggucggcgcgacggcc

SEQ ID NO: 3485589 - RNA, 17 nt, Pseudomonas aeruginosa PA01
ggucggcgcgcccggcg

SEQ ID NO: 3485590 - RNA, 12 nt, Pseudomonas aeruginosa PA01
ggucggcgcgcg

SEQ ID NO: 3485591 - RNA, 19 nt, Pseudomonas aeruginosa PA01
ggucggcggcagcugcggc

SEQ ID NO: 3485592 - RNA, 13 nt, Pseudomonas aeruginosa PA01
ggucggcggccuu

SEQ ID NO: 3485593 - RNA, 13 nt, Pseudomonas aeruginosa PA01
ggucggcggcggu

SEQ ID NO: 3485594 - RNA, 15 nt, Pseudomonas aeruginosa PA01
ggucggcgggcaccg

SEQ ID NO: 3485595 - RNA, 17 nt, Pseudomonas aeruginosa PA01
ggucggcgggcaccgcc

SEQ ID NO: 3485596 - RNA, 21 nt, Pseudomonas aeruginosa PA01
ggucggcggucucgaacgcca

SEQ ID NO: 3485597 - RNA, 21 nt, Pseudomonas aeruginosa PA01
ggucggcgguucgaucccguc

SEQ ID NO: 3485598 - RNA, 18 nt, Pseudomonas aeruginosa PA01
ggucggcucagccgacca

SEQ ID NO: 3485599 - RNA, 12 nt, Pseudomonas aeruginosa PA01
ggucggcuggca

SEQ ID NO: 3485600 - RNA, 17 nt, Pseudomonas aeruginosa PA01
ggucggcuuccgccgcc

SEQ ID NO: 3485601 - RNA, 19 nt, Pseudomonas aeruginosa PA01
ggucggcuuccgccgccag

SEQ ID NO: 3485602 - RNA, 21 nt, Pseudomonas aeruginosa PA01
ggucggcuuccgccgccaggu

SEQ ID NO: 3485603 - RNA, 14 nt, Pseudomonas aeruginosa PA01
ggucgggauggcga

SEQ ID NO: 3485604 - RNA, 17 nt, Pseudomonas aeruginosa PA01
ggucgggcagaugucca

SEQ ID NO: 3485605 - RNA, 12 nt, Pseudomonas aeruginosa PA01
ggucgggcgccg

SEQ ID NO: 3485606 - RNA, 14 nt, Pseudomonas aeruginosa PA01
ggucgggcgccgcg

SEQ ID NO: 3485607 - RNA, 19 nt, Pseudomonas aeruginosa PA01
ggucgggucgagcuugccg

SEQ ID NO: 3485608 - RNA, 22 nt, Pseudomonas aeruginosa PA01
ggucgggugaaggucugguagg

SEQ ID NO: 3485609 - RNA, 18 nt, Pseudomonas aeruginosa PA01
ggucgguagaaugcgccc

SEQ ID NO: 3485610 - RNA, 16 nt, Pseudomonas aeruginosa PA01
ggucgguccgccgaug

SEQ ID NO: 3485611 - RNA, 15 nt, Pseudomonas aeruginosa PA01
ggucggugacccgca

SEQ ID NO: 3485612 - RNA, 18 nt, Pseudomonas aeruginosa PA01
ggucggugagcacgccgc

SEQ ID NO: 3485613 - RNA, 20 nt, Pseudomonas aeruginosa PA01
ggucgguucgcccaguacca

SEQ ID NO: 3485614 - RNA, 18 nt, Pseudomonas aeruginosa PA01
ggucgguugcggccugau

SEQ ID NO: 3485615 - RNA, 15 nt, Pseudomonas aeruginosa PA01
ggucguacaccgcgc

SEQ ID NO: 3485616 - RNA, 17 nt, Pseudomonas aeruginosa PA01
ggucguacaccgcgcgg

SEQ ID NO: 3485617 - RNA, 22 nt, Pseudomonas aeruginosa PA01
ggucguacaccgcgcggcacag

SEQ ID NO: 3485618 - RNA, 18 nt, Pseudomonas aeruginosa PA01
ggucguacacguuggccg

SEQ ID NO: 3485619 - RNA, 19 nt, Pseudomonas aeruginosa PA01
ggucguagagguugcgccc

SEQ ID NO: 3485620 - RNA, 22 nt, Pseudomonas aeruginosa PA01
ggucguagcagguccgcgccuc

SEQ ID NO: 3485621 - RNA, 17 nt, Pseudomonas aeruginosa PA01
ggucguagggcgucagu

SEQ ID NO: 3485622 - RNA, 14 nt, Pseudomonas aeruginosa PA01
ggucguccugcgga

SEQ ID NO: 3485623 - RNA, 18 nt, Pseudomonas aeruginosa PA01
ggucgucgaagcgcagca

SEQ ID NO: 3485624 - RNA, 19 nt, Pseudomonas aeruginosa PA01
ggucgucgaagcgcagcag

SEQ ID NO: 3485625 - RNA, 16 nt, Pseudomonas aeruginosa PA01
ggucgucgcccuggcc

SEQ ID NO: 3485626 - RNA, 22 nt, Pseudomonas aeruginosa PA01
ggucgucgcgguacagccgguu

SEQ ID NO: 3485627 - RNA, 13 nt, Pseudomonas aeruginosa PA01
ggucgucggucgg

SEQ ID NO: 3485628 - RNA, 15 nt, Pseudomonas aeruginosa PA01
ggucgucggucggcc

SEQ ID NO: 3485629 - RNA, 17 nt, Pseudomonas aeruginosa PA01
ggucgucggucggccag

SEQ ID NO: 3485630 - RNA, 14 nt, Pseudomonas aeruginosa PA01
ggucgucuggguca

SEQ ID NO: 3485631 - RNA, 12 nt, Pseudomonas aeruginosa PA01
ggucgugcagca

SEQ ID NO: 3485632 - RNA, 18 nt, Pseudomonas aeruginosa PA01
ggucgugcagcacauaga

SEQ ID NO: 3485633 - RNA, 15 nt, Pseudomonas aeruginosa PA01
ggucgugcagcagcg

SEQ ID NO: 3485634 - RNA, 19 nt, Pseudomonas aeruginosa PA01
ggucgugcagcagcgccuu

SEQ ID NO: 3485635 - RNA, 12 nt, Pseudomonas aeruginosa PA01
ggucgugcagcc

SEQ ID NO: 3485636 - RNA, 14 nt, Pseudomonas aeruginosa PA01
ggucgugcuggacu

SEQ ID NO: 3485637 - RNA, 19 nt, Pseudomonas aeruginosa PA01
ggucgugcugggacgccuu

SEQ ID NO: 3485638 - RNA, 21 nt, Pseudomonas aeruginosa PA01
ggucgugcuugcagucgcgga

SEQ ID NO: 3485639 - RNA, 22 nt, Pseudomonas aeruginosa PA01
ggucgugcuugcagucgcggaa

SEQ ID NO: 3485640 - RNA, 15 nt, Pseudomonas aeruginosa PA01
ggucguggcggaagg

SEQ ID NO: 3485641 - RNA, 19 nt, Pseudomonas aeruginosa PA01
ggucguggcggaaggucag

SEQ ID NO: 3485642 - RNA, 21 nt, Pseudomonas aeruginosa PA01
ggucgugguccagcucgguca

SEQ ID NO: 3485643 - RNA, 22 nt, Pseudomonas aeruginosa PA01
ggucgugguccagcucggucag

SEQ ID NO: 3485644 - RNA, 12 nt, Pseudomonas aeruginosa PA01
ggucguggucga

SEQ ID NO: 3485645 - RNA, 17 nt, Pseudomonas aeruginosa PA01
ggucguggucgaaugga

SEQ ID NO: 3485646 - RNA, 15 nt, Pseudomonas aeruginosa PA01
ggucguuagcucagu

SEQ ID NO: 3485647 - RNA, 17 nt, Pseudomonas aeruginosa PA01
ggucguuagcucagucg

SEQ ID NO: 3485648 - RNA, 15 nt, Pseudomonas aeruginosa PA01
ggucguugccgucga

SEQ ID NO: 3485649 - RNA, 20 nt, Pseudomonas aeruginosa PA01
ggucguugccgucgagcacc

SEQ ID NO: 3485650 - RNA, 20 nt, Pseudomonas aeruginosa PA01
ggucguugcgcgccagcgcc

SEQ ID NO: 3485651 - RNA, 22 nt, Pseudomonas aeruginosa PA01
ggucguugcgcgccagcgccac

SEQ ID NO: 3485652 - RNA, 18 nt, Pseudomonas aeruginosa PA01
ggucguuggccaggcgcg

SEQ ID NO: 3485653 - RNA, 20 nt, Pseudomonas aeruginosa PA01
ggucguuggccaggcgcgac

SEQ ID NO: 3485654 - RNA, 20 nt, Pseudomonas aeruginosa PA01
ggucuacgugauccguggcg

SEQ ID NO: 3485655 - RNA, 16 nt, Pseudomonas aeruginosa PA01
ggucuagcgccccggc

SEQ ID NO: 3485656 - RNA, 20 nt, Pseudomonas aeruginosa PA01
ggucuagcgccccggccgcg

SEQ ID NO: 3485657 - RNA, 14 nt, Pseudomonas aeruginosa PA01
ggucuccaggacca

SEQ ID NO: 3485658 - RNA, 19 nt, Pseudomonas aeruginosa PA01
ggucuccgugcuggccggc

SEQ ID NO: 3485659 - RNA, 12 nt, Pseudomonas aeruginosa PA01
ggucuccuccuc

SEQ ID NO: 3485660 - RNA, 17 nt, Pseudomonas aeruginosa PA01
ggucucgaacgccaggc

SEQ ID NO: 3485661 - RNA, 11 nt, Pseudomonas aeruginosa PA01
ggucucgacgc

SEQ ID NO: 3485662 - RNA, 17 nt, Pseudomonas aeruginosa PA01
ggucucgaucagcgccg

SEQ ID NO: 3485663 - RNA, 18 nt, Pseudomonas aeruginosa PA01
ggucucgaucagcgccgg

SEQ ID NO: 3485664 - RNA, 15 nt, Pseudomonas aeruginosa PA01
ggucucgaucggccc

SEQ ID NO: 3485665 - RNA, 13 nt, Pseudomonas aeruginosa PA01
ggucucgauggca

SEQ ID NO: 3485666 - RNA, 14 nt, Pseudomonas aeruginosa PA01
ggucucgccacccc

SEQ ID NO: 3485667 - RNA, 16 nt, Pseudomonas aeruginosa PA01
ggucucgccaccccgc

SEQ ID NO: 3485668 - RNA, 22 nt, Pseudomonas aeruginosa PA01
ggucucgccgccgagcaggccc

SEQ ID NO: 3485669 - RNA, 17 nt, Pseudomonas aeruginosa PA01
ggucucguagcagccac

SEQ ID NO: 3485670 - RNA, 20 nt, Pseudomonas aeruginosa PA01
ggucucguagcagccacggg

SEQ ID NO: 3485671 - RNA, 19 nt, Pseudomonas aeruginosa PA01
ggucugccagcucuggccg

SEQ ID NO: 3485672 - RNA, 19 nt, Pseudomonas aeruginosa PA01
ggucugccccggcuuggcg

SEQ ID NO: 3485673 - RNA, 15 nt, Pseudomonas aeruginosa PA01
ggucugccucgccga

SEQ ID NO: 3485674 - RNA, 23 nt, Pseudomonas aeruginosa PA01
ggucugccucgccgaggcggaag

SEQ ID NO: 3485675 - RNA, 19 nt, Pseudomonas aeruginosa PA01
ggucugcgguauaggccuu

SEQ ID NO: 3485676 - RNA, 20 nt, Pseudomonas aeruginosa PA01
ggucugcucgcgcuucucga

SEQ ID NO: 3485677 - RNA, 15 nt, Pseudomonas aeruginosa PA01
ggucugcucggcgcc

SEQ ID NO: 3485678 - RNA, 20 nt, Pseudomonas aeruginosa PA01
ggucugcucggcgcccuggg

SEQ ID NO: 3485679 - RNA, 17 nt, Pseudomonas aeruginosa PA01
ggucugcuugcgcuggc

SEQ ID NO: 3485680 - RNA, 20 nt, Pseudomonas aeruginosa PA01
ggucugcuugcgcuggccgg

SEQ ID NO: 3485681 - RNA, 15 nt, Pseudomonas aeruginosa PA01
ggucuggaugaacga

SEQ ID NO: 3485682 - RNA, 22 nt, Pseudomonas aeruginosa PA01
ggucugguagcgauugaacucg

SEQ ID NO: 3485683 - RNA, 20 nt, Pseudomonas aeruginosa PA01
ggucugguaguaggcgcucu

SEQ ID NO: 3485684 - RNA, 16 nt, Pseudomonas aeruginosa PA01
ggucuguggaggcgca

SEQ ID NO: 3485685 - RNA, 23 nt, Pseudomonas aeruginosa PA01
ggucuguugguggggcgccggcu

SEQ ID NO: 3485686 - RNA, 21 nt, Pseudomonas aeruginosa PA01
ggucuucaggccgaguccgcg

SEQ ID NO: 3485687 - RNA, 14 nt, Pseudomonas aeruginosa PA01
ggucuucaggccgc

SEQ ID NO: 3485688 - RNA, 15 nt, Pseudomonas aeruginosa PA01
ggucuucaggccgca

SEQ ID NO: 3485689 - RNA, 15 nt, Pseudomonas aeruginosa PA01
ggucuucaggcgccg

SEQ ID NO: 3485690 - RNA, 14 nt, Pseudomonas aeruginosa PA01
ggucuucccagacc

SEQ ID NO: 3485691 - RNA, 20 nt, Pseudomonas aeruginosa PA01
ggucuucccguaaggccagg

SEQ ID NO: 3485692 - RNA, 22 nt, Pseudomonas aeruginosa PA01
ggucuucccguaaggccaggcu

SEQ ID NO: 3485693 - RNA, 14 nt, Pseudomonas aeruginosa PA01
ggucuuccgccgac

SEQ ID NO: 3485694 - RNA, 22 nt, Pseudomonas aeruginosa PA01
ggucuuccucggugucggccaa

SEQ ID NO: 3485695 - RNA, 20 nt, Pseudomonas aeruginosa PA01
ggucuucguuuucaggcgac

SEQ ID NO: 3485696 - RNA, 22 nt, Pseudomonas aeruginosa PA01
ggucuucguuuucaggcgacgc

SEQ ID NO: 3485697 - RNA, 16 nt, Pseudomonas aeruginosa PA01
ggucuugaucccaggg

SEQ ID NO: 3485698 - RNA, 17 nt, Pseudomonas aeruginosa PA01
ggucuugaucccaggga

SEQ ID NO: 3485699 - RNA, 14 nt, Pseudomonas aeruginosa PA01
ggucuugccgaccu

SEQ ID NO: 3485700 - RNA, 16 nt, Pseudomonas aeruginosa PA01
ggucuugccgauggcg

SEQ ID NO: 3485701 - RNA, 20 nt, Pseudomonas aeruginosa PA01
ggucuugccggcugcgccgc

SEQ ID NO: 3485702 - RNA, 17 nt, Pseudomonas aeruginosa PA01
ggucuuuuucgcgugcu

SEQ ID NO: 3485703 - RNA, 14 nt, Pseudomonas aeruginosa PA01
ggugaaaagcgcug

SEQ ID NO: 3485704 - RNA, 14 nt, Pseudomonas aeruginosa PA01
ggugaaccugacca

SEQ ID NO: 3485705 - RNA, 22 nt, Pseudomonas aeruginosa PA01
ggugaaccugaccaucgucgcu

SEQ ID NO: 3485706 - RNA, 19 nt, Pseudomonas aeruginosa PA01
ggugaacgagcccaggcag

SEQ ID NO: 3485707 - RNA, 13 nt, Pseudomonas aeruginosa PA01
ggugaacgccagg

SEQ ID NO: 3485708 - RNA, 15 nt, Pseudomonas aeruginosa PA01
ggugaacgccaggca

SEQ ID NO: 3485709 - RNA, 16 nt, Pseudomonas aeruginosa PA01
ggugaacgccaggcag

SEQ ID NO: 3485710 - RNA, 18 nt, Pseudomonas aeruginosa PA01
ggugaacucaugcaggcc

SEQ ID NO: 3485711 - RNA, 20 nt, Pseudomonas aeruginosa PA01
ggugaacucaugcaggccga

SEQ ID NO: 3485712 - RNA, 17 nt, Pseudomonas aeruginosa PA01
ggugaacuucuccaggu

SEQ ID NO: 3485713 - RNA, 14 nt, Pseudomonas aeruginosa PA01
ggugaagcccaggc

SEQ ID NO: 3485714 - RNA, 17 nt, Pseudomonas aeruginosa PA01
ggugaagcccaggcgcu

SEQ ID NO: 3485715 - RNA, 20 nt, Pseudomonas aeruginosa PA01
ggugaagcgcaggcggcugg

SEQ ID NO: 3485716 - RNA, 22 nt, Pseudomonas aeruginosa PA01
ggugaagcgcaggcggcuggcg

SEQ ID NO: 3485717 - RNA, 13 nt, Pseudomonas aeruginosa PA01
ggugaagcgcggc

SEQ ID NO: 3485718 - RNA, 17 nt, Pseudomonas aeruginosa PA01
ggugaagcgcggcggcg

SEQ ID NO: 3485719 - RNA, 20 nt, Pseudomonas aeruginosa PA01
ggugaagcgcggcggcgcgg

SEQ ID NO: 3485720 - RNA, 12 nt, Pseudomonas aeruginosa PA01
ggugaagcgcuc

SEQ ID NO: 3485721 - RNA, 14 nt, Pseudomonas aeruginosa PA01
ggugaaggcgaagu

SEQ ID NO: 3485722 - RNA, 14 nt, Pseudomonas aeruginosa PA01
ggugaagugaucga

SEQ ID NO: 3485723 - RNA, 13 nt, Pseudomonas aeruginosa PA01
ggugaccaccuug

SEQ ID NO: 3485724 - RNA, 20 nt, Pseudomonas aeruginosa PA01
ggugaccaccuugauccgcg

SEQ ID NO: 3485725 - RNA, 16 nt, Pseudomonas aeruginosa PA01
ggugacccacuccggc

SEQ ID NO: 3485726 - RNA, 21 nt, Pseudomonas aeruginosa PA01
ggugacccacuccggcaggcg

SEQ ID NO: 3485727 - RNA, 23 nt, Pseudomonas aeruginosa PA01
ggugacccacuccggcaggcgcu

SEQ ID NO: 3485728 - RNA, 21 nt, Pseudomonas aeruginosa PA01
ggugaccgcccagggggccgg

SEQ ID NO: 3485729 - RNA, 16 nt, Pseudomonas aeruginosa PA01
ggugaccuggccgccg

SEQ ID NO: 3485730 - RNA, 19 nt, Pseudomonas aeruginosa PA01
ggugaccugguagucgcgg

SEQ ID NO: 3485731 - RNA, 21 nt, Pseudomonas aeruginosa PA01
ggugacgacgugcccauuuuc

SEQ ID NO: 3485732 - RNA, 14 nt, Pseudomonas aeruginosa PA01
ggugacgcagggcg

SEQ ID NO: 3485733 - RNA, 16 nt, Pseudomonas aeruginosa PA01
ggugacgcagggcggu

SEQ ID NO: 3485734 - RNA, 22 nt, Pseudomonas aeruginosa PA01
ggugacgcucuucaccucgaug

SEQ ID NO: 3485735 - RNA, 18 nt, Pseudomonas aeruginosa PA01
ggugacggugaucgccgc

SEQ ID NO: 3485736 - RNA, 20 nt, Pseudomonas aeruginosa PA01
ggugacguugcgccgcagcg

SEQ ID NO: 3485737 - RNA, 15 nt, Pseudomonas aeruginosa PA01
ggugagauggucgaa

SEQ ID NO: 3485738 - RNA, 16 nt, Pseudomonas aeruginosa PA01
ggugagcacgccgcga

SEQ ID NO: 3485739 - RNA, 18 nt, Pseudomonas aeruginosa PA01
ggugagcacgccgcgacc

SEQ ID NO: 3485740 - RNA, 19 nt, Pseudomonas aeruginosa PA01
ggugagcacgccgcgaccg

SEQ ID NO: 3485741 - RNA, 14 nt, Pseudomonas aeruginosa PA01
ggugagcugaucgc

SEQ ID NO: 3485742 - RNA, 14 nt, Pseudomonas aeruginosa PA01
ggugaggaccuggc

SEQ ID NO: 3485743 - RNA, 16 nt, Pseudomonas aeruginosa PA01
ggugaggaccuggccg

SEQ ID NO: 3485744 - RNA, 14 nt, Pseudomonas aeruginosa PA01
ggugaggccgagcc

SEQ ID NO: 3485745 - RNA, 23 nt, Pseudomonas aeruginosa PA01
ggugaggccgagccgacauccug

SEQ ID NO: 3485746 - RNA, 16 nt, Pseudomonas aeruginosa PA01
ggugagggcgacggcg

SEQ ID NO: 3485747 - RNA, 19 nt, Pseudomonas aeruginosa PA01
ggugagguagaagcggccg

SEQ ID NO: 3485748 - RNA, 16 nt, Pseudomonas aeruginosa PA01
ggugagguugccgccg

SEQ ID NO: 3485749 - RNA, 17 nt, Pseudomonas aeruginosa PA01
ggugagguugccgccga

SEQ ID NO: 3485750 - RNA, 16 nt, Pseudomonas aeruginosa PA01
ggugauaccgccggcg

SEQ ID NO: 3485751 - RNA, 17 nt, Pseudomonas aeruginosa PA01
ggugauaccgccggcgg

SEQ ID NO: 3485752 - RNA, 18 nt, Pseudomonas aeruginosa PA01
ggugauaccgccggcggc

SEQ ID NO: 3485753 - RNA, 19 nt, Pseudomonas aeruginosa PA01
ggugauaccgccggcggcg

SEQ ID NO: 3485754 - RNA, 15 nt, Pseudomonas aeruginosa PA01
ggugauagagcacgc

SEQ ID NO: 3485755 - RNA, 13 nt, Pseudomonas aeruginosa PA01
ggugaucaccgcc

SEQ ID NO: 3485756 - RNA, 15 nt, Pseudomonas aeruginosa PA01
ggugaucaccgccuu

SEQ ID NO: 3485757 - RNA, 16 nt, Pseudomonas aeruginosa PA01
ggugaucacgucggcg

SEQ ID NO: 3485758 - RNA, 16 nt, Pseudomonas aeruginosa PA01
ggugaucagcggccga

SEQ ID NO: 3485759 - RNA, 16 nt, Pseudomonas aeruginosa PA01
ggugaucagucgucgu

SEQ ID NO: 3485760 - RNA, 13 nt, Pseudomonas aeruginosa PA01
ggugauccagcug

SEQ ID NO: 3485761 - RNA, 14 nt, Pseudomonas aeruginosa PA01
ggugauccaggcgu

SEQ ID NO: 3485762 - RNA, 14 nt, Pseudomonas aeruginosa PA01
ggugaucgagccgc

SEQ ID NO: 3485763 - RNA, 16 nt, Pseudomonas aeruginosa PA01
ggugaucgagccgccg

SEQ ID NO: 3485764 - RNA, 18 nt, Pseudomonas aeruginosa PA01
ggugaucgccgcgaggug

SEQ ID NO: 3485765 - RNA, 14 nt, Pseudomonas aeruginosa PA01
ggugaucucgcggc

SEQ ID NO: 3485766 - RNA, 15 nt, Pseudomonas aeruginosa PA01
ggugaucucgcggcg

SEQ ID NO: 3485767 - RNA, 19 nt, Pseudomonas aeruginosa PA01
ggugaucucgcggcgcggc

SEQ ID NO: 3485768 - RNA, 20 nt, Pseudomonas aeruginosa PA01
ggugaucucgcggcgcggcg

SEQ ID NO: 3485769 - RNA, 13 nt, Pseudomonas aeruginosa PA01
ggugaugaagaag

SEQ ID NO: 3485770 - RNA, 17 nt, Pseudomonas aeruginosa PA01
ggugaugaagucggcgu

SEQ ID NO: 3485771 - RNA, 16 nt, Pseudomonas aeruginosa PA01
ggugaugccgcggacg

SEQ ID NO: 3485772 - RNA, 14 nt, Pseudomonas aeruginosa PA01
ggugaugcgucgca

SEQ ID NO: 3485773 - RNA, 20 nt, Pseudomonas aeruginosa PA01
ggugaugguaucgccguccu

SEQ ID NO: 3485774 - RNA, 15 nt, Pseudomonas aeruginosa PA01
ggugauguaggccgc

SEQ ID NO: 3485775 - RNA, 17 nt, Pseudomonas aeruginosa PA01
ggugauguaggccgcuu

SEQ ID NO: 3485776 - RNA, 15 nt, Pseudomonas aeruginosa PA01
ggugaugucgcggca

SEQ ID NO: 3485777 - RNA, 19 nt, Pseudomonas aeruginosa PA01
ggugaugucgcggcaggcg

SEQ ID NO: 3485778 - RNA, 21 nt, Pseudomonas aeruginosa PA01
ggugaugucgcggcaggcggc

SEQ ID NO: 3485779 - RNA, 20 nt, Pseudomonas aeruginosa PA01
ggugauuccgaugcgacgca

SEQ ID NO: 3485780 - RNA, 18 nt, Pseudomonas aeruginosa PA01
ggugauuucuucagccug

SEQ ID NO: 3485781 - RNA, 21 nt, Pseudomonas aeruginosa PA01
ggugauuucuucagccugggg

SEQ ID NO: 3485782 - RNA, 15 nt, Pseudomonas aeruginosa PA01
ggugcaccaggcgau

SEQ ID NO: 3485783 - RNA, 21 nt, Pseudomonas aeruginosa PA01
ggugcaccaggcgaugcgccg

SEQ ID NO: 3485784 - RNA, 12 nt, Pseudomonas aeruginosa PA01
ggugcaccgcgc

SEQ ID NO: 3485785 - RNA, 14 nt, Pseudomonas aeruginosa PA01
ggugcaccuggcga

SEQ ID NO: 3485786 - RNA, 12 nt, Pseudomonas aeruginosa PA01
ggugcacgcgcc

SEQ ID NO: 3485787 - RNA, 14 nt, Pseudomonas aeruginosa PA01
ggugcacggccagg

SEQ ID NO: 3485788 - RNA, 15 nt, Pseudomonas aeruginosa PA01
ggugcacggccaggc

SEQ ID NO: 3485789 - RNA, 18 nt, Pseudomonas aeruginosa PA01
ggugcacggcgacccgcc

SEQ ID NO: 3485790 - RNA, 20 nt, Pseudomonas aeruginosa PA01
ggugcagaugaccagcgcau

SEQ ID NO: 3485791 - RNA, 18 nt, Pseudomonas aeruginosa PA01
ggugcagauggucgccgg

SEQ ID NO: 3485792 - RNA, 16 nt, Pseudomonas aeruginosa PA01
ggugcagccacccagc

SEQ ID NO: 3485793 - RNA, 21 nt, Pseudomonas aeruginosa PA01
ggugcagcccuggcguggccg

SEQ ID NO: 3485794 - RNA, 16 nt, Pseudomonas aeruginosa PA01
ggugcagcggaagccc

SEQ ID NO: 3485795 - RNA, 22 nt, Pseudomonas aeruginosa PA01
ggugcagcggaagcccugcugg

SEQ ID NO: 3485796 - RNA, 16 nt, Pseudomonas aeruginosa PA01
ggugcaggaacagcca

SEQ ID NO: 3485797 - RNA, 16 nt, Pseudomonas aeruginosa PA01
ggugcaggaagcgccg

SEQ ID NO: 3485798 - RNA, 17 nt, Pseudomonas aeruginosa PA01
ggugcaggaagcgccgg

SEQ ID NO: 3485799 - RNA, 15 nt, Pseudomonas aeruginosa PA01
ggugcaggccgagcu

SEQ ID NO: 3485800 - RNA, 12 nt, Pseudomonas aeruginosa PA01
ggugcaggccgc

SEQ ID NO: 3485801 - RNA, 13 nt, Pseudomonas aeruginosa PA01
ggugcaggggcgc

SEQ ID NO: 3485802 - RNA, 17 nt, Pseudomonas aeruginosa PA01
ggugcagguucaccgcc

SEQ ID NO: 3485803 - RNA, 17 nt, Pseudomonas aeruginosa PA01
ggugcauccgccgcaga

SEQ ID NO: 3485804 - RNA, 19 nt, Pseudomonas aeruginosa PA01
ggugcauccgccgcagacc

SEQ ID NO: 3485805 - RNA, 21 nt, Pseudomonas aeruginosa PA01
ggugcauccgccgcagaccag

SEQ ID NO: 3485806 - RNA, 16 nt, Pseudomonas aeruginosa PA01
ggugcaugaaggcgcu

SEQ ID NO: 3485807 - RNA, 20 nt, Pseudomonas aeruginosa PA01
ggugcaugaaggcgcugagc

SEQ ID NO: 3485808 - RNA, 21 nt, Pseudomonas aeruginosa PA01
ggugcauguagcgcuccucgc

SEQ ID NO: 3485809 - RNA, 18 nt, Pseudomonas aeruginosa PA01
ggugccagggcggucggc

SEQ ID NO: 3485810 - RNA, 22 nt, Pseudomonas aeruginosa PA01
ggugccagggcggucggccagg

SEQ ID NO: 3485811 - RNA, 15 nt, Pseudomonas aeruginosa PA01
ggugccauacagcgc

SEQ ID NO: 3485812 - RNA, 16 nt, Pseudomonas aeruginosa PA01
ggugccauacagcgcc

SEQ ID NO: 3485813 - RNA, 23 nt, Pseudomonas aeruginosa PA01
ggugccauccgcagucuucucgg

SEQ ID NO: 3485814 - RNA, 17 nt, Pseudomonas aeruginosa PA01
ggugccauggaucacca

SEQ ID NO: 3485815 - RNA, 19 nt, Pseudomonas aeruginosa PA01
ggugccauucggugcgcuc

SEQ ID NO: 3485816 - RNA, 13 nt, Pseudomonas aeruginosa PA01
ggugcccagcagg

SEQ ID NO: 3485817 - RNA, 17 nt, Pseudomonas aeruginosa PA01
ggugcccagcaggcugc

SEQ ID NO: 3485818 - RNA, 16 nt, Pseudomonas aeruginosa PA01
ggugcccagcggcgcc

SEQ ID NO: 3485819 - RNA, 21 nt, Pseudomonas aeruginosa PA01
ggugcccaucaggcucaggcg

SEQ ID NO: 3485820 - RNA, 16 nt, Pseudomonas aeruginosa PA01
ggugccccgcuggccc

SEQ ID NO: 3485821 - RNA, 20 nt, Pseudomonas aeruginosa PA01
ggugccccgcuggcccaaca

SEQ ID NO: 3485822 - RNA, 18 nt, Pseudomonas aeruginosa PA01
ggugcccgaugccgcgcc

SEQ ID NO: 3485823 - RNA, 14 nt, Pseudomonas aeruginosa PA01
ggugcccucgcgga

SEQ ID NO: 3485824 - RNA, 20 nt, Pseudomonas aeruginosa PA01
ggugcccuggaagccggcag

SEQ ID NO: 3485825 - RNA, 21 nt, Pseudomonas aeruginosa PA01
ggugcccuggaagccggcagg

SEQ ID NO: 3485826 - RNA, 15 nt, Pseudomonas aeruginosa PA01
ggugccgaucagccc

SEQ ID NO: 3485827 - RNA, 19 nt, Pseudomonas aeruginosa PA01
ggugccgcagacaucgccg

SEQ ID NO: 3485828 - RNA, 13 nt, Pseudomonas aeruginosa PA01
ggugccgccaguc

SEQ ID NO: 3485829 - RNA, 13 nt, Pseudomonas aeruginosa PA01
ggugccgcccggc

SEQ ID NO: 3485830 - RNA, 19 nt, Pseudomonas aeruginosa PA01
ggugccgcccggcgccacc

SEQ ID NO: 3485831 - RNA, 13 nt, Pseudomonas aeruginosa PA01
ggugccgccggcg

SEQ ID NO: 3485832 - RNA, 15 nt, Pseudomonas aeruginosa PA01
ggugccgccggcgcc

SEQ ID NO: 3485833 - RNA, 18 nt, Pseudomonas aeruginosa PA01
ggugccgccggcgccgcc

SEQ ID NO: 3485834 - RNA, 19 nt, Pseudomonas aeruginosa PA01
ggugccgcgcagcuugccu

SEQ ID NO: 3485835 - RNA, 17 nt, Pseudomonas aeruginosa PA01
ggugccgcgcagguuca

SEQ ID NO: 3485836 - RNA, 21 nt, Pseudomonas aeruginosa PA01
ggugccgcuguaggacagguu

SEQ ID NO: 3485837 - RNA, 19 nt, Pseudomonas aeruginosa PA01
ggugccggagaacgccgcc

SEQ ID NO: 3485838 - RNA, 13 nt, Pseudomonas aeruginosa PA01
ggugccggcggcg

SEQ ID NO: 3485839 - RNA, 14 nt, Pseudomonas aeruginosa PA01
ggugccggcggcgg

SEQ ID NO: 3485840 - RNA, 16 nt, Pseudomonas aeruginosa PA01
ggugccgggggcggcg

SEQ ID NO: 3485841 - RNA, 21 nt, Pseudomonas aeruginosa PA01
ggugccgucaugcacuucgac

SEQ ID NO: 3485842 - RNA, 17 nt, Pseudomonas aeruginosa PA01
ggugccguugcuaccgg

SEQ ID NO: 3485843 - RNA, 18 nt, Pseudomonas aeruginosa PA01
ggugccguugcuaccggc

SEQ ID NO: 3485844 - RNA, 21 nt, Pseudomonas aeruginosa PA01
ggugccguugcuaccggcgga

SEQ ID NO: 3485845 - RNA, 20 nt, Pseudomonas aeruginosa PA01
ggugccuuccgcgcccaggc

SEQ ID NO: 3485846 - RNA, 23 nt, Pseudomonas aeruginosa PA01
ggugccuuccgcgcccaggcugc

SEQ ID NO: 3485847 - RNA, 16 nt, Pseudomonas aeruginosa PA01
ggugccuucggcggcg

SEQ ID NO: 3485848 - RNA, 17 nt, Pseudomonas aeruginosa PA01
ggugccuucggcggcgc

SEQ ID NO: 3485849 - RNA, 18 nt, Pseudomonas aeruginosa PA01
ggugccuucggcggcgcc

SEQ ID NO: 3485850 - RNA, 19 nt, Pseudomonas aeruginosa PA01
ggugccuucggcggcgccu

SEQ ID NO: 3485851 - RNA, 23 nt, Pseudomonas aeruginosa PA01
ggugcgaaaaauacuccgcgacg

SEQ ID NO: 3485852 - RNA, 19 nt, Pseudomonas aeruginosa PA01
ggugcgagucaccccgacc

SEQ ID NO: 3485853 - RNA, 20 nt, Pseudomonas aeruginosa PA01
ggugcgcacgcaauggcgca

SEQ ID NO: 3485854 - RNA, 14 nt, Pseudomonas aeruginosa PA01
ggugcgcaggcgcu

SEQ ID NO: 3485855 - RNA, 16 nt, Pseudomonas aeruginosa PA01
ggugcgcaggcgcucg

SEQ ID NO: 3485856 - RNA, 21 nt, Pseudomonas aeruginosa PA01
ggugcgcaugucguccaggcu

SEQ ID NO: 3485857 - RNA, 16 nt, Pseudomonas aeruginosa PA01
ggugcgccgagcgcuc

SEQ ID NO: 3485858 - RNA, 13 nt, Pseudomonas aeruginosa PA01
ggugcgcgccacc

SEQ ID NO: 3485859 - RNA, 21 nt, Pseudomonas aeruginosa PA01
ggugcgcggcaggacccagaa

SEQ ID NO: 3485860 - RNA, 12 nt, Pseudomonas aeruginosa PA01
ggugcgcggcga

SEQ ID NO: 3485861 - RNA, 22 nt, Pseudomonas aeruginosa PA01
ggugcgcuccuguugcuggccg

SEQ ID NO: 3485862 - RNA, 20 nt, Pseudomonas aeruginosa PA01
ggugcgcucguugauccgcg

SEQ ID NO: 3485863 - RNA, 16 nt, Pseudomonas aeruginosa PA01
ggugcgcuggaacggc

SEQ ID NO: 3485864 - RNA, 19 nt, Pseudomonas aeruginosa PA01
ggugcgcuggaacggccag

SEQ ID NO: 3485865 - RNA, 14 nt, Pseudomonas aeruginosa PA01
ggugcgcugguugg

SEQ ID NO: 3485866 - RNA, 16 nt, Pseudomonas aeruginosa PA01
ggugcgcugguuggcg

SEQ ID NO: 3485867 - RNA, 18 nt, Pseudomonas aeruginosa PA01
ggugcggcaccagccagg

SEQ ID NO: 3485868 - RNA, 13 nt, Pseudomonas aeruginosa PA01
ggugcggcugccg

SEQ ID NO: 3485869 - RNA, 15 nt, Pseudomonas aeruginosa PA01
ggugcggcugcucau

SEQ ID NO: 3485870 - RNA, 17 nt, Pseudomonas aeruginosa PA01
ggugcgggcagacacca

SEQ ID NO: 3485871 - RNA, 22 nt, Pseudomonas aeruginosa PA01
ggugcgggccuugaccaccgcc

SEQ ID NO: 3485872 - RNA, 12 nt, Pseudomonas aeruginosa PA01
ggugcgggcgcg

SEQ ID NO: 3485873 - RNA, 16 nt, Pseudomonas aeruginosa PA01
ggugcgggcgcgggcg

SEQ ID NO: 3485874 - RNA, 18 nt, Pseudomonas aeruginosa PA01
ggugcggguggucgccgc

SEQ ID NO: 3485875 - RNA, 19 nt, Pseudomonas aeruginosa PA01
ggugcggguggucgccgcc

SEQ ID NO: 3485876 - RNA, 16 nt, Pseudomonas aeruginosa PA01
ggugcgguggcuggcg

SEQ ID NO: 3485877 - RNA, 18 nt, Pseudomonas aeruginosa PA01
ggugcgguggcuggcgua

SEQ ID NO: 3485878 - RNA, 20 nt, Pseudomonas aeruginosa PA01
ggugcggugggcgagggcgc

SEQ ID NO: 3485879 - RNA, 19 nt, Pseudomonas aeruginosa PA01
ggugcguacggucaugccg

SEQ ID NO: 3485880 - RNA, 22 nt, Pseudomonas aeruginosa PA01
ggugcguuaccgaaagaaacaa

SEQ ID NO: 3485881 - RNA, 16 nt, Pseudomonas aeruginosa PA01
ggugcguucgcgggcg

SEQ ID NO: 3485882 - RNA, 18 nt, Pseudomonas aeruginosa PA01
ggugcguucgcgggcgcc

SEQ ID NO: 3485883 - RNA, 16 nt, Pseudomonas aeruginosa PA01
ggugcuagcggguggc

SEQ ID NO: 3485884 - RNA, 17 nt, Pseudomonas aeruginosa PA01
ggugcuaugcgccgggc

SEQ ID NO: 3485885 - RNA, 20 nt, Pseudomonas aeruginosa PA01
ggugcuaugcgccgggccuc

SEQ ID NO: 3485886 - RNA, 14 nt, Pseudomonas aeruginosa PA01
ggugcucaggcggc

SEQ ID NO: 3485887 - RNA, 15 nt, Pseudomonas aeruginosa PA01
ggugcucaggcggcc

SEQ ID NO: 3485888 - RNA, 18 nt, Pseudomonas aeruginosa PA01
ggugcucaugccuugucg

SEQ ID NO: 3485889 - RNA, 12 nt, Pseudomonas aeruginosa PA01
ggugcugccgau

SEQ ID NO: 3485890 - RNA, 18 nt, Pseudomonas aeruginosa PA01
ggugcugcgcgcggccca

SEQ ID NO: 3485891 - RNA, 21 nt, Pseudomonas aeruginosa PA01
ggugcugcgcgcggcccacca

SEQ ID NO: 3485892 - RNA, 18 nt, Pseudomonas aeruginosa PA01
ggugcuggcgagcagggu

SEQ ID NO: 3485893 - RNA, 16 nt, Pseudomonas aeruginosa PA01
ggugcuggcgucgccu

SEQ ID NO: 3485894 - RNA, 19 nt, Pseudomonas aeruginosa PA01
ggugcuggcgucgccuucc

SEQ ID NO: 3485895 - RNA, 23 nt, Pseudomonas aeruginosa PA01
ggugcuggcgucgccuuccacca

SEQ ID NO: 3485896 - RNA, 23 nt, Pseudomonas aeruginosa PA01
ggugcuggugcggccgaugaucu

SEQ ID NO: 3485897 - RNA, 22 nt, Pseudomonas aeruginosa PA01
ggugcuguucagcgggugccga

SEQ ID NO: 3485898 - RNA, 16 nt, Pseudomonas aeruginosa PA01
ggugcuuggcaccgcg

SEQ ID NO: 3485899 - RNA, 19 nt, Pseudomonas aeruginosa PA01
ggugcuuggcuucgagcug

SEQ ID NO: 3485900 - RNA, 19 nt, Pseudomonas aeruginosa PA01
ggugcuuuccugcuccagc

SEQ ID NO: 3485901 - RNA, 21 nt, Pseudomonas aeruginosa PA01
ggugcuuuccugcuccagcag

SEQ ID NO: 3485902 - RNA, 23 nt, Pseudomonas aeruginosa PA01
ggugcuuuccugcuccagcaggg

SEQ ID NO: 3485903 - RNA, 17 nt, Pseudomonas aeruginosa PA01
ggugcuuugcauggccu

SEQ ID NO: 3485904 - RNA, 18 nt, Pseudomonas aeruginosa PA01
ggugcuuugcauggccug

SEQ ID NO: 3485905 - RNA, 23 nt, Pseudomonas aeruginosa PA01
ggugcuuugcauggccuguacca

SEQ ID NO: 3485906 - RNA, 13 nt, Pseudomonas aeruginosa PA01
gguggaacagcau

SEQ ID NO: 3485907 - RNA, 14 nt, Pseudomonas aeruginosa PA01
gguggaacagccgc

SEQ ID NO: 3485908 - RNA, 20 nt, Pseudomonas aeruginosa PA01
gguggaacccauggcgcgau

SEQ ID NO: 3485909 - RNA, 13 nt, Pseudomonas aeruginosa PA01
gguggaagcgcgc

SEQ ID NO: 3485910 - RNA, 17 nt, Pseudomonas aeruginosa PA01
gguggaauaccgcugcg

SEQ ID NO: 3485911 - RNA, 21 nt, Pseudomonas aeruginosa PA01
gguggaauaccgcugcgcggg

SEQ ID NO: 3485912 - RNA, 14 nt, Pseudomonas aeruginosa PA01
gguggaccagcgcc

SEQ ID NO: 3485913 - RNA, 15 nt, Pseudomonas aeruginosa PA01
gguggaccagcgccg

SEQ ID NO: 3485914 - RNA, 17 nt, Pseudomonas aeruginosa PA01
gguggaccagcgccgcc

SEQ ID NO: 3485915 - RNA, 18 nt, Pseudomonas aeruginosa PA01
gguggaccagcgccgcca

SEQ ID NO: 3485916 - RNA, 19 nt, Pseudomonas aeruginosa PA01
gguggacggucucgccgcc

SEQ ID NO: 3485917 - RNA, 20 nt, Pseudomonas aeruginosa PA01
gguggacggucucgccgccg

SEQ ID NO: 3485918 - RNA, 16 nt, Pseudomonas aeruginosa PA01
gguggacgucgucggc

SEQ ID NO: 3485919 - RNA, 20 nt, Pseudomonas aeruginosa PA01
gguggacgucgucggcgacc

SEQ ID NO: 3485920 - RNA, 15 nt, Pseudomonas aeruginosa PA01
gguggagaggcgugc

SEQ ID NO: 3485921 - RNA, 19 nt, Pseudomonas aeruginosa PA01
gguggagaggcgugcuggc

SEQ ID NO: 3485922 - RNA, 17 nt, Pseudomonas aeruginosa PA01
gguggagcacgucgagc

SEQ ID NO: 3485923 - RNA, 17 nt, Pseudomonas aeruginosa PA01
gguggaggccguggugg

SEQ ID NO: 3485924 - RNA, 15 nt, Pseudomonas aeruginosa PA01
gguggaggcggcggu

SEQ ID NO: 3485925 - RNA, 11 nt, Pseudomonas aeruginosa PA01
gguggaggcgu

SEQ ID NO: 3485926 - RNA, 23 nt, Pseudomonas aeruginosa PA01
gguggaugacccgcaccuugccc

SEQ ID NO: 3485927 - RNA, 17 nt, Pseudomonas aeruginosa PA01
gguggaugccgguggcg

SEQ ID NO: 3485928 - RNA, 17 nt, Pseudomonas aeruginosa PA01
gguggauguucgccgcc

SEQ ID NO: 3485929 - RNA, 20 nt, Pseudomonas aeruginosa PA01
gguggauguucgccgccacc

SEQ ID NO: 3485930 - RNA, 16 nt, Pseudomonas aeruginosa PA01
gguggcaacugccgcc

SEQ ID NO: 3485931 - RNA, 14 nt, Pseudomonas aeruginosa PA01
gguggcaggccugg

SEQ ID NO: 3485932 - RNA, 18 nt, Pseudomonas aeruginosa PA01
gguggcaugguguccggc

SEQ ID NO: 3485933 - RNA, 20 nt, Pseudomonas aeruginosa PA01
gguggccacgucgccccagg

SEQ ID NO: 3485934 - RNA, 13 nt, Pseudomonas aeruginosa PA01
gguggccaggcgc

SEQ ID NO: 3485935 - RNA, 19 nt, Pseudomonas aeruginosa PA01
gguggccaggcgcaccagc

SEQ ID NO: 3485936 - RNA, 21 nt, Pseudomonas aeruginosa PA01
gguggccaggcgcaccagcag

SEQ ID NO: 3485937 - RNA, 12 nt, Pseudomonas aeruginosa PA01
gguggccaggcu

SEQ ID NO: 3485938 - RNA, 17 nt, Pseudomonas aeruginosa PA01
gguggcccugggcggcg

SEQ ID NO: 3485939 - RNA, 18 nt, Pseudomonas aeruginosa PA01
gguggcccugggcggcga

SEQ ID NO: 3485940 - RNA, 23 nt, Pseudomonas aeruginosa PA01
gguggccgcguaccaguagcgac

SEQ ID NO: 3485941 - RNA, 13 nt, Pseudomonas aeruginosa PA01
gguggccguggcg

SEQ ID NO: 3485942 - RNA, 14 nt, Pseudomonas aeruginosa PA01
gguggccguugagc

SEQ ID NO: 3485943 - RNA, 14 nt, Pseudomonas aeruginosa PA01
gguggccuccugca

SEQ ID NO: 3485944 - RNA, 20 nt, Pseudomonas aeruginosa PA01
gguggccuccugcaacgccu

SEQ ID NO: 3485945 - RNA, 16 nt, Pseudomonas aeruginosa PA01
gguggcgaacagcacc

SEQ ID NO: 3485946 - RNA, 15 nt, Pseudomonas aeruginosa PA01
gguggcgaccaggac

SEQ ID NO: 3485947 - RNA, 17 nt, Pseudomonas aeruginosa PA01
gguggcgaccaggacag

SEQ ID NO: 3485948 - RNA, 19 nt, Pseudomonas aeruginosa PA01
gguggcgaccaggacagca

SEQ ID NO: 3485949 - RNA, 13 nt, Pseudomonas aeruginosa PA01
gguggcgaccgcc

SEQ ID NO: 3485950 - RNA, 15 nt, Pseudomonas aeruginosa PA01
gguggcgacgaagac

SEQ ID NO: 3485951 - RNA, 21 nt, Pseudomonas aeruginosa PA01
gguggcgacgaagacgcugcg

SEQ ID NO: 3485952 - RNA, 18 nt, Pseudomonas aeruginosa PA01
gguggcgacgccggucgg

SEQ ID NO: 3485953 - RNA, 14 nt, Pseudomonas aeruginosa PA01
gguggcgacgcgca

SEQ ID NO: 3485954 - RNA, 12 nt, Pseudomonas aeruginosa PA01
gguggcgaucac

SEQ ID NO: 3485955 - RNA, 17 nt, Pseudomonas aeruginosa PA01
gguggcgcacugccagg

SEQ ID NO: 3485956 - RNA, 21 nt, Pseudomonas aeruginosa PA01
gguggcgcacugccaggagca

SEQ ID NO: 3485957 - RNA, 14 nt, Pseudomonas aeruginosa PA01
gguggcgcccagcc

SEQ ID NO: 3485958 - RNA, 21 nt, Pseudomonas aeruginosa PA01
gguggcgcccaugccgcccgg

SEQ ID NO: 3485959 - RNA, 23 nt, Pseudomonas aeruginosa PA01
gguggcgcccaugccgcccggcc

SEQ ID NO: 3485960 - RNA, 16 nt, Pseudomonas aeruginosa PA01
gguggcgccgccggcg

SEQ ID NO: 3485961 - RNA, 14 nt, Pseudomonas aeruginosa PA01
gguggcgcgcacca

SEQ ID NO: 3485962 - RNA, 11 nt, Pseudomonas aeruginosa PA01
gguggcgcgga

SEQ ID NO: 3485963 - RNA, 12 nt, Pseudomonas aeruginosa PA01
gguggcgcggac

SEQ ID NO: 3485964 - RNA, 13 nt, Pseudomonas aeruginosa PA01
gguggcgcuggcc

SEQ ID NO: 3485965 - RNA, 14 nt, Pseudomonas aeruginosa PA01
gguggcgcuggcca

SEQ ID NO: 3485966 - RNA, 13 nt, Pseudomonas aeruginosa PA01
gguggcgcugucg

SEQ ID NO: 3485967 - RNA, 17 nt, Pseudomonas aeruginosa PA01
gguggcggacugguagg

SEQ ID NO: 3485968 - RNA, 14 nt, Pseudomonas aeruginosa PA01
gguggcggaucugc

SEQ ID NO: 3485969 - RNA, 11 nt, Pseudomonas aeruginosa PA01
gguggcggcga

SEQ ID NO: 3485970 - RNA, 13 nt, Pseudomonas aeruginosa PA01
gguggcggcgacg

SEQ ID NO: 3485971 - RNA, 14 nt, Pseudomonas aeruginosa PA01
gguggcggcggcga

SEQ ID NO: 3485972 - RNA, 15 nt, Pseudomonas aeruginosa PA01
gguggcggcggcgag

SEQ ID NO: 3485973 - RNA, 16 nt, Pseudomonas aeruginosa PA01
gguggcguacccgccc

SEQ ID NO: 3485974 - RNA, 13 nt, Pseudomonas aeruginosa PA01
gguggcgucgauc

SEQ ID NO: 3485975 - RNA, 20 nt, Pseudomonas aeruginosa PA01
gguggcguucucgaucaucg

SEQ ID NO: 3485976 - RNA, 22 nt, Pseudomonas aeruginosa PA01
gguggcucagcgcggcggcggc

SEQ ID NO: 3485977 - RNA, 15 nt, Pseudomonas aeruginosa PA01
gguggcugaagcccc

SEQ ID NO: 3485978 - RNA, 20 nt, Pseudomonas aeruginosa PA01
ggugggcagcagcgaacgcc

SEQ ID NO: 3485979 - RNA, 13 nt, Pseudomonas aeruginosa PA01
ggugggcgccgcu

SEQ ID NO: 3485980 - RNA, 13 nt, Pseudomonas aeruginosa PA01
ggugggcuugccg

SEQ ID NO: 3485981 - RNA, 14 nt, Pseudomonas aeruginosa PA01
gguggggccgccga

SEQ ID NO: 3485982 - RNA, 19 nt, Pseudomonas aeruginosa PA01
gguggggccgccgaugccg

SEQ ID NO: 3485983 - RNA, 22 nt, Pseudomonas aeruginosa PA01
gguggggccgccgaugccgacg

SEQ ID NO: 3485984 - RNA, 14 nt, Pseudomonas aeruginosa PA01
gguggggcgccggc

SEQ ID NO: 3485985 - RNA, 17 nt, Pseudomonas aeruginosa PA01
ggugggucacgucggcg

SEQ ID NO: 3485986 - RNA, 21 nt, Pseudomonas aeruginosa PA01
ggugguaagcgagcagacuga

SEQ ID NO: 3485987 - RNA, 16 nt, Pseudomonas aeruginosa PA01
ggugguagagcggcac

SEQ ID NO: 3485988 - RNA, 16 nt, Pseudomonas aeruginosa PA01
gguggucaccagcgug

SEQ ID NO: 3485989 - RNA, 21 nt, Pseudomonas aeruginosa PA01
gguggucagccagccgagcaa

SEQ ID NO: 3485990 - RNA, 21 nt, Pseudomonas aeruginosa PA01
gguggucgaucuccuccucgg

SEQ ID NO: 3485991 - RNA, 18 nt, Pseudomonas aeruginosa PA01
gguggucgccgcccacgc

SEQ ID NO: 3485992 - RNA, 20 nt, Pseudomonas aeruginosa PA01
gguggucgccgcccacgccu

SEQ ID NO: 3485993 - RNA, 14 nt, Pseudomonas aeruginosa PA01
gguggucuugcgca

SEQ ID NO: 3485994 - RNA, 18 nt, Pseudomonas aeruginosa PA01
gguggucuugcgcaggcg

SEQ ID NO: 3485995 - RNA, 17 nt, Pseudomonas aeruginosa PA01
gguggugaacaggcgga

SEQ ID NO: 3485996 - RNA, 17 nt, Pseudomonas aeruginosa PA01
gguggugaucagcggcc

SEQ ID NO: 3485997 - RNA, 22 nt, Pseudomonas aeruginosa PA01
gguggugaucagcggccgagca

SEQ ID NO: 3485998 - RNA, 14 nt, Pseudomonas aeruginosa PA01
gguguagaccacca

SEQ ID NO: 3485999 - RNA, 19 nt, Pseudomonas aeruginosa PA01
gguguagaccaccagcagg

SEQ ID NO: 3486000 - RNA, 14 nt, Pseudomonas aeruginosa PA01
gguguagccgagca

SEQ ID NO: 3486001 - RNA, 19 nt, Pseudomonas aeruginosa PA01
gguguagccguugagcacc

SEQ ID NO: 3486002 - RNA, 15 nt, Pseudomonas aeruginosa PA01
gguguagcugcagcg

SEQ ID NO: 3486003 - RNA, 18 nt, Pseudomonas aeruginosa PA01
gguguagcugcagcgccc

SEQ ID NO: 3486004 - RNA, 18 nt, Pseudomonas aeruginosa PA01
gguguagguauccgccgg

SEQ ID NO: 3486005 - RNA, 22 nt, Pseudomonas aeruginosa PA01
gguguaucggcggauaacgccg

SEQ ID NO: 3486006 - RNA, 14 nt, Pseudomonas aeruginosa PA01
ggugucaggccgag

SEQ ID NO: 3486007 - RNA, 13 nt, Pseudomonas aeruginosa PA01
gguguccaccacc

SEQ ID NO: 3486008 - RNA, 18 nt, Pseudomonas aeruginosa PA01
gguguccaccaccagcag

SEQ ID NO: 3486009 - RNA, 22 nt, Pseudomonas aeruginosa PA01
gguguccgauucuuggcucggc

SEQ ID NO: 3486010 - RNA, 15 nt, Pseudomonas aeruginosa PA01
gguguccgcggugcc

SEQ ID NO: 3486011 - RNA, 18 nt, Pseudomonas aeruginosa PA01
gguguccggcggcgauga

SEQ ID NO: 3486012 - RNA, 19 nt, Pseudomonas aeruginosa PA01
gguguccuuugccugaugc

SEQ ID NO: 3486013 - RNA, 15 nt, Pseudomonas aeruginosa PA01
ggugucgaccuccgc

SEQ ID NO: 3486014 - RNA, 13 nt, Pseudomonas aeruginosa PA01
ggugucgggugug

SEQ ID NO: 3486015 - RNA, 22 nt, Pseudomonas aeruginosa PA01
ggugucggugaugcgucgcacc

SEQ ID NO: 3486016 - RNA, 22 nt, Pseudomonas aeruginosa PA01
ggugucggugcccucgcggacg

SEQ ID NO: 3486017 - RNA, 17 nt, Pseudomonas aeruginosa PA01
ggugucguagaggcugu

SEQ ID NO: 3486018 - RNA, 19 nt, Pseudomonas aeruginosa PA01
ggugucguauuccaggggc

SEQ ID NO: 3486019 - RNA, 20 nt, Pseudomonas aeruginosa PA01
ggugucguuguugccgcgca

SEQ ID NO: 3486020 - RNA, 23 nt, Pseudomonas aeruginosa PA01
ggugugcaacggaaacacagcac

SEQ ID NO: 3486021 - RNA, 13 nt, Pseudomonas aeruginosa PA01
ggugugcagcagc

SEQ ID NO: 3486022 - RNA, 14 nt, Pseudomonas aeruginosa PA01
ggugugcagcagca

SEQ ID NO: 3486023 - RNA, 17 nt, Pseudomonas aeruginosa PA01
ggugugcagcagcacgg

SEQ ID NO: 3486024 - RNA, 15 nt, Pseudomonas aeruginosa PA01
ggugugccgucaggc

SEQ ID NO: 3486025 - RNA, 14 nt, Pseudomonas aeruginosa PA01
gguguucggcggcg

SEQ ID NO: 3486026 - RNA, 15 nt, Pseudomonas aeruginosa PA01
gguguugaaagccuu

SEQ ID NO: 3486027 - RNA, 22 nt, Pseudomonas aeruginosa PA01
gguguugauggucaccuugacc

SEQ ID NO: 3486028 - RNA, 18 nt, Pseudomonas aeruginosa PA01
gguguuucggccgcugcc

SEQ ID NO: 3486029 - RNA, 14 nt, Pseudomonas aeruginosa PA01
gguuaccggcgacc

SEQ ID NO: 3486030 - RNA, 19 nt, Pseudomonas aeruginosa PA01
gguuaccggcgaccaccgc

SEQ ID NO: 3486031 - RNA, 15 nt, Pseudomonas aeruginosa PA01
gguuauccgccgccg

SEQ ID NO: 3486032 - RNA, 18 nt, Pseudomonas aeruginosa PA01
gguuaucgaggcgucggc

SEQ ID NO: 3486033 - RNA, 14 nt, Pseudomonas aeruginosa PA01
gguuauucgcccua

SEQ ID NO: 3486034 - RNA, 21 nt, Pseudomonas aeruginosa PA01
gguuauucgcccuacccccca

SEQ ID NO: 3486035 - RNA, 20 nt, Pseudomonas aeruginosa PA01
gguucagcaggucgcggccc

SEQ ID NO: 3486036 - RNA, 16 nt, Pseudomonas aeruginosa PA01
gguucagcccgccgug

SEQ ID NO: 3486037 - RNA, 23 nt, Pseudomonas aeruginosa PA01
gguucagcccgccgugcgcuccg

SEQ ID NO: 3486038 - RNA, 11 nt, Pseudomonas aeruginosa PA01
gguucagcggg

SEQ ID NO: 3486039 - RNA, 18 nt, Pseudomonas aeruginosa PA01
gguucaggacgcuccugc

SEQ ID NO: 3486040 - RNA, 18 nt, Pseudomonas aeruginosa PA01
gguucaggguggcgauca

SEQ ID NO: 3486041 - RNA, 20 nt, Pseudomonas aeruginosa PA01
gguucaggguggcgaucacg

SEQ ID NO: 3486042 - RNA, 21 nt, Pseudomonas aeruginosa PA01
gguucaggucgaugcccagcc

SEQ ID NO: 3486043 - RNA, 16 nt, Pseudomonas aeruginosa PA01
gguucagucggccagg

SEQ ID NO: 3486044 - RNA, 21 nt, Pseudomonas aeruginosa PA01
gguucagucggccaggcgcca

SEQ ID NO: 3486045 - RNA, 21 nt, Pseudomonas aeruginosa PA01
gguucaucgagcggcggccgu

SEQ ID NO: 3486046 - RNA, 15 nt, Pseudomonas aeruginosa PA01
gguucaucgccgcca

SEQ ID NO: 3486047 - RNA, 13 nt, Pseudomonas aeruginosa PA01
gguuccagccccg

SEQ ID NO: 3486048 - RNA, 23 nt, Pseudomonas aeruginosa PA01
gguucccgcagcgaucagcacca

SEQ ID NO: 3486049 - RNA, 13 nt, Pseudomonas aeruginosa PA01
gguuccggucggg

SEQ ID NO: 3486050 - RNA, 19 nt, Pseudomonas aeruginosa PA01
gguuccuccugggccgacg

SEQ ID NO: 3486051 - RNA, 16 nt, Pseudomonas aeruginosa PA01
gguuccuggugucggg

SEQ ID NO: 3486052 - RNA, 16 nt, Pseudomonas aeruginosa PA01
gguucgaauccuccug

SEQ ID NO: 3486053 - RNA, 17 nt, Pseudomonas aeruginosa PA01
gguucgaauccuccuga

SEQ ID NO: 3486054 - RNA, 18 nt, Pseudomonas aeruginosa PA01
gguucgaaugcugcccgg

SEQ ID NO: 3486055 - RNA, 21 nt, Pseudomonas aeruginosa PA01
gguucgacacgcucagccccg

SEQ ID NO: 3486056 - RNA, 19 nt, Pseudomonas aeruginosa PA01
gguucgagucccguccgcu

SEQ ID NO: 3486057 - RNA, 20 nt, Pseudomonas aeruginosa PA01
gguucgagucccguccgcug

SEQ ID NO: 3486058 - RNA, 17 nt, Pseudomonas aeruginosa PA01
gguucgcaggccaggcg

SEQ ID NO: 3486059 - RNA, 15 nt, Pseudomonas aeruginosa PA01
gguucgcccaguacc

SEQ ID NO: 3486060 - RNA, 19 nt, Pseudomonas aeruginosa PA01
gguucgcccgcgggcagcu

SEQ ID NO: 3486061 - RNA, 23 nt, Pseudomonas aeruginosa PA01
gguucgccgagcgccgccaggca

SEQ ID NO: 3486062 - RNA, 17 nt, Pseudomonas aeruginosa PA01
gguucgcgcgcuggucg

SEQ ID NO: 3486063 - RNA, 13 nt, Pseudomonas aeruginosa PA01
gguucgcggcgca

SEQ ID NO: 3486064 - RNA, 15 nt, Pseudomonas aeruginosa PA01
gguucgcguggcccg

SEQ ID NO: 3486065 - RNA, 23 nt, Pseudomonas aeruginosa PA01
gguucgcguggcccggcgcggcg

SEQ ID NO: 3486066 - RNA, 15 nt, Pseudomonas aeruginosa PA01
gguucggcagcgccu

SEQ ID NO: 3486067 - RNA, 18 nt, Pseudomonas aeruginosa PA01
gguucggcagguugcucg

SEQ ID NO: 3486068 - RNA, 20 nt, Pseudomonas aeruginosa PA01
gguucggcgucuucggcggc

SEQ ID NO: 3486069 - RNA, 17 nt, Pseudomonas aeruginosa PA01
gguucggggaacagcgc

SEQ ID NO: 3486070 - RNA, 23 nt, Pseudomonas aeruginosa PA01
gguucggggaacagcgccagcgg

SEQ ID NO: 3486071 - RNA, 20 nt, Pseudomonas aeruginosa PA01
gguucguagaguucgcugag

SEQ ID NO: 3486072 - RNA, 18 nt, Pseudomonas aeruginosa PA01
gguucguccgcgcgaucg

SEQ ID NO: 3486073 - RNA, 17 nt, Pseudomonas aeruginosa PA01
gguucgugccaggcggc

SEQ ID NO: 3486074 - RNA, 22 nt, Pseudomonas aeruginosa PA01
gguucguugaccguccacaccg

SEQ ID NO: 3486075 - RNA, 22 nt, Pseudomonas aeruginosa PA01
gguucuccaggcuuugcggcaa

SEQ ID NO: 3486076 - RNA, 13 nt, Pseudomonas aeruginosa PA01
gguucucggccac

SEQ ID NO: 3486077 - RNA, 17 nt, Pseudomonas aeruginosa PA01
gguucucggccaccacc

SEQ ID NO: 3486078 - RNA, 15 nt, Pseudomonas aeruginosa PA01
gguucucggucgggc

SEQ ID NO: 3486079 - RNA, 16 nt, Pseudomonas aeruginosa PA01
gguucugccagagcgc

SEQ ID NO: 3486080 - RNA, 14 nt, Pseudomonas aeruginosa PA01
gguucugcuccugg

SEQ ID NO: 3486081 - RNA, 15 nt, Pseudomonas aeruginosa PA01
gguucuggucgccga

SEQ ID NO: 3486082 - RNA, 17 nt, Pseudomonas aeruginosa PA01
gguucuucguuccugau

SEQ ID NO: 3486083 - RNA, 20 nt, Pseudomonas aeruginosa PA01
gguucuugaugucagcguag

SEQ ID NO: 3486084 - RNA, 14 nt, Pseudomonas aeruginosa PA01
gguucuugcccagc

SEQ ID NO: 3486085 - RNA, 15 nt, Pseudomonas aeruginosa PA01
gguugaagagcagca

SEQ ID NO: 3486086 - RNA, 17 nt, Pseudomonas aeruginosa PA01
gguugacccagagccgc

SEQ ID NO: 3486087 - RNA, 13 nt, Pseudomonas aeruginosa PA01
gguugaccccgcg

SEQ ID NO: 3486088 - RNA, 21 nt, Pseudomonas aeruginosa PA01
gguugaccccgcggccgagga

SEQ ID NO: 3486089 - RNA, 19 nt, Pseudomonas aeruginosa PA01
gguugaccccgcggguggc

SEQ ID NO: 3486090 - RNA, 22 nt, Pseudomonas aeruginosa PA01
gguugaccuuguccuggccggc

SEQ ID NO: 3486091 - RNA, 23 nt, Pseudomonas aeruginosa PA01
gguugaccuuguccuggccggcg

SEQ ID NO: 3486092 - RNA, 21 nt, Pseudomonas aeruginosa PA01
gguugacgaugcggcccgccg

SEQ ID NO: 3486093 - RNA, 18 nt, Pseudomonas aeruginosa PA01
gguugagguagagcacgc

SEQ ID NO: 3486094 - RNA, 17 nt, Pseudomonas aeruginosa PA01
gguugaguugcaggccg

SEQ ID NO: 3486095 - RNA, 24 nt, Pseudomonas aeruginosa PA01
gguugaucgagaaauaggcgcugc

SEQ ID NO: 3486096 - RNA, 14 nt, Pseudomonas aeruginosa PA01
gguugaugccgacg

SEQ ID NO: 3486097 - RNA, 23 nt, Pseudomonas aeruginosa PA01
gguugaugugcaguucgaccucc

SEQ ID NO: 3486098 - RNA, 20 nt, Pseudomonas aeruginosa PA01
gguugauuuccgcaccgagg

SEQ ID NO: 3486099 - RNA, 14 nt, Pseudomonas aeruginosa PA01
gguugccaggccgg

SEQ ID NO: 3486100 - RNA, 16 nt, Pseudomonas aeruginosa PA01
gguugccgcagagcau

SEQ ID NO: 3486101 - RNA, 15 nt, Pseudomonas aeruginosa PA01
gguugccgccgauca

SEQ ID NO: 3486102 - RNA, 14 nt, Pseudomonas aeruginosa PA01
gguugccgcuggcc

SEQ ID NO: 3486103 - RNA, 20 nt, Pseudomonas aeruginosa PA01
gguugccggagacgauggcg

SEQ ID NO: 3486104 - RNA, 21 nt, Pseudomonas aeruginosa PA01
gguugccggagacgauggcga

SEQ ID NO: 3486105 - RNA, 15 nt, Pseudomonas aeruginosa PA01
gguugccggcgugca

SEQ ID NO: 3486106 - RNA, 16 nt, Pseudomonas aeruginosa PA01
gguugcgaggcccgua

SEQ ID NO: 3486107 - RNA, 19 nt, Pseudomonas aeruginosa PA01
gguugcgcaaccagcgcuc

SEQ ID NO: 3486108 - RNA, 16 nt, Pseudomonas aeruginosa PA01
gguugcgccauugccg

SEQ ID NO: 3486109 - RNA, 18 nt, Pseudomonas aeruginosa PA01
gguugcgcggcaggacga

SEQ ID NO: 3486110 - RNA, 23 nt, Pseudomonas aeruginosa PA01
gguugcgcuggcgcagcagcagg

SEQ ID NO: 3486111 - RNA, 14 nt, Pseudomonas aeruginosa PA01
gguugcggcgcccg

SEQ ID NO: 3486112 - RNA, 23 nt, Pseudomonas aeruginosa PA01
gguugcgggagcacugggaaucg

SEQ ID NO: 3486113 - RNA, 23 nt, Pseudomonas aeruginosa PA01
gguugcucugggcauggcuggcg

SEQ ID NO: 3486114 - RNA, 14 nt, Pseudomonas aeruginosa PA01
gguugcugcggcau

SEQ ID NO: 3486115 - RNA, 14 nt, Pseudomonas aeruginosa PA01
gguugcuguagaau

SEQ ID NO: 3486116 - RNA, 20 nt, Pseudomonas aeruginosa PA01
gguugcugugcacccagacc

SEQ ID NO: 3486117 - RNA, 23 nt, Pseudomonas aeruginosa PA01
gguuggaaaagccccgcuucggc

SEQ ID NO: 3486118 - RNA, 20 nt, Pseudomonas aeruginosa PA01
gguuggccaguuggcccuug

SEQ ID NO: 3486119 - RNA, 17 nt, Pseudomonas aeruginosa PA01
gguuggccccgccgagg

SEQ ID NO: 3486120 - RNA, 22 nt, Pseudomonas aeruginosa PA01
gguuggccgccuggcgcauggc

SEQ ID NO: 3486121 - RNA, 13 nt, Pseudomonas aeruginosa PA01
gguuggccuggcc

SEQ ID NO: 3486122 - RNA, 22 nt, Pseudomonas aeruginosa PA01
gguuggccuggcccggcgcacu

SEQ ID NO: 3486123 - RNA, 16 nt, Pseudomonas aeruginosa PA01
gguuggcgcaggccgg

SEQ ID NO: 3486124 - RNA, 20 nt, Pseudomonas aeruginosa PA01
gguuggcuuccagccagccc

SEQ ID NO: 3486125 - RNA, 12 nt, Pseudomonas aeruginosa PA01
gguugggcagcg

SEQ ID NO: 3486126 - RNA, 17 nt, Pseudomonas aeruginosa PA01
gguuggucggcaccagg

SEQ ID NO: 3486127 - RNA, 19 nt, Pseudomonas aeruginosa PA01
gguuggucugcucggcgau

SEQ ID NO: 3486128 - RNA, 19 nt, Pseudomonas aeruginosa PA01
gguuguacagguuguucgg

SEQ ID NO: 3486129 - RNA, 13 nt, Pseudomonas aeruginosa PA01
gguugugaucgac

SEQ ID NO: 3486130 - RNA, 13 nt, Pseudomonas aeruginosa PA01
gguuuccaguuca

SEQ ID NO: 3486131 - RNA, 19 nt, Pseudomonas aeruginosa PA01
gguuuccccguggcgccgc

SEQ ID NO: 3486132 - RNA, 13 nt, Pseudomonas aeruginosa PA01
gguuuccgcagcg

SEQ ID NO: 3486133 - RNA, 17 nt, Pseudomonas aeruginosa PA01
gguuuccgugugcagca

SEQ ID NO: 3486134 - RNA, 16 nt, Pseudomonas aeruginosa PA01
gguuuccugcccgacc

SEQ ID NO: 3486135 - RNA, 18 nt, Pseudomonas aeruginosa PA01
gguuucgcgccauggccg

SEQ ID NO: 3486136 - RNA, 18 nt, Pseudomonas aeruginosa PA01
gguuucgcuuuccucggu

SEQ ID NO: 3486137 - RNA, 22 nt, Pseudomonas aeruginosa PA01
gguuucugcuggccaccgcggc

SEQ ID NO: 3486138 - RNA, 18 nt, Pseudomonas aeruginosa PA01
gguuucuucgccuugccc

SEQ ID NO: 3486139 - RNA, 19 nt, Pseudomonas aeruginosa PA01
gguuucuucgccuugcccu

SEQ ID NO: 3486140 - RNA, 22 nt, Pseudomonas aeruginosa PA01
gguuucuucgccuugcccuggc

SEQ ID NO: 3486141 - RNA, 23 nt, Pseudomonas aeruginosa PA01
gguuucuucgccuugcccuggcc

SEQ ID NO: 3486142 - RNA, 17 nt, Pseudomonas aeruginosa PA01
gguuuggcgcccgccuu

SEQ ID NO: 3486143 - RNA, 14 nt, Pseudomonas aeruginosa PA01
gguuuuccugcccc

SEQ ID NO: 3486144 - RNA, 21 nt, Pseudomonas aeruginosa PA01
gguuuuuuuaugccucggcgg

SEQ ID NO: 3486145 - RNA, 23 nt, Pseudomonas aeruginosa PA01
guaaacgcgaaugcccggcagcg

SEQ ID NO: 3486146 - RNA, 17 nt, Pseudomonas aeruginosa PA01
guaacaagcauucugga

SEQ ID NO: 3486147 - RNA, 17 nt, Pseudomonas aeruginosa PA01
guaacgguagcggcagg

SEQ ID NO: 3486148 - RNA, 16 nt, Pseudomonas aeruginosa PA01
guaacuggccagggca

SEQ ID NO: 3486149 - RNA, 10 nt, Pseudomonas aeruginosa PA01
guaacuguac

SEQ ID NO: 3486150 - RNA, 18 nt, Pseudomonas aeruginosa PA01
guaagacuggugaucgca

SEQ ID NO: 3486151 - RNA, 13 nt, Pseudomonas aeruginosa PA01
guaagaucgauga

SEQ ID NO: 3486152 - RNA, 16 nt, Pseudomonas aeruginosa PA01
guaagcauuaacuuac

SEQ ID NO: 3486153 - RNA, 13 nt, Pseudomonas aeruginosa PA01
guaagugccgacc

SEQ ID NO: 3486154 - RNA, 14 nt, Pseudomonas aeruginosa PA01
guaagugccgacca

SEQ ID NO: 3486155 - RNA, 22 nt, Pseudomonas aeruginosa PA01
guaauaggcgaagcggcucggc

SEQ ID NO: 3486156 - RNA, 14 nt, Pseudomonas aeruginosa PA01
guaaucaccuuccu

SEQ ID NO: 3486157 - RNA, 17 nt, Pseudomonas aeruginosa PA01
guaauccacgcugugcg

SEQ ID NO: 3486158 - RNA, 23 nt, Pseudomonas aeruginosa PA01
guaauccacgcugugcggcagca

SEQ ID NO: 3486159 - RNA, 14 nt, Pseudomonas aeruginosa PA01
guaaugagaagguc

SEQ ID NO: 3486160 - RNA, 20 nt, Pseudomonas aeruginosa PA01
guaaugcaacccgccgcuga

SEQ ID NO: 3486161 - RNA, 16 nt, Pseudomonas aeruginosa PA01
guaauguucuccuccc

SEQ ID NO: 3486162 - RNA, 21 nt, Pseudomonas aeruginosa PA01
guaauucgcugacgaggacgc

SEQ ID NO: 3486163 - RNA, 23 nt, Pseudomonas aeruginosa PA01
guaauucgcugacgaggacgccg

SEQ ID NO: 3486164 - RNA, 15 nt, Pseudomonas aeruginosa PA01
guaauuggccaggcu

SEQ ID NO: 3486165 - RNA, 13 nt, Pseudomonas aeruginosa PA01
guacaaacgcucc

SEQ ID NO: 3486166 - RNA, 21 nt, Pseudomonas aeruginosa PA01
guacaccagauggcuggucag

SEQ ID NO: 3486167 - RNA, 23 nt, Pseudomonas aeruginosa PA01
guacaccagauggcuggucaggc

SEQ ID NO: 3486168 - RNA, 14 nt, Pseudomonas aeruginosa PA01
guacaccuuggcgc

SEQ ID NO: 3486169 - RNA, 17 nt, Pseudomonas aeruginosa PA01
guacaccuuggcgcgac

SEQ ID NO: 3486170 - RNA, 18 nt, Pseudomonas aeruginosa PA01
guacagaaacaaagagcc

SEQ ID NO: 3486171 - RNA, 22 nt, Pseudomonas aeruginosa PA01
guacagaaacaaagagcccgcc

SEQ ID NO: 3486172 - RNA, 16 nt, Pseudomonas aeruginosa PA01
guacagcacccaggcg

SEQ ID NO: 3486173 - RNA, 16 nt, Pseudomonas aeruginosa PA01
guacagcaggagcgcc

SEQ ID NO: 3486174 - RNA, 20 nt, Pseudomonas aeruginosa PA01
guacagcaggcaggcauggu

SEQ ID NO: 3486175 - RNA, 21 nt, Pseudomonas aeruginosa PA01
guacagccgguugcguuuccg

SEQ ID NO: 3486176 - RNA, 19 nt, Pseudomonas aeruginosa PA01
guacagcgccacggccagc

SEQ ID NO: 3486177 - RNA, 20 nt, Pseudomonas aeruginosa PA01
guacagcgccacggccagca

SEQ ID NO: 3486178 - RNA, 13 nt, Pseudomonas aeruginosa PA01
guacagcgccugg

SEQ ID NO: 3486179 - RNA, 21 nt, Pseudomonas aeruginosa PA01
guacagcgccuggucggcggc

SEQ ID NO: 3486180 - RNA, 14 nt, Pseudomonas aeruginosa PA01
guacagcgggccgg

SEQ ID NO: 3486181 - RNA, 15 nt, Pseudomonas aeruginosa PA01
guacagcgggccggg

SEQ ID NO: 3486182 - RNA, 17 nt, Pseudomonas aeruginosa PA01
guacagcgggccgggga

SEQ ID NO: 3486183 - RNA, 19 nt, Pseudomonas aeruginosa PA01
guacagcucaccccaggaa

SEQ ID NO: 3486184 - RNA, 16 nt, Pseudomonas aeruginosa PA01
guacagcucggcgccc

SEQ ID NO: 3486185 - RNA, 17 nt, Pseudomonas aeruginosa PA01
guacagcucggcgcccu

SEQ ID NO: 3486186 - RNA, 20 nt, Pseudomonas aeruginosa PA01
guacagcucggcgcccuggc

SEQ ID NO: 3486187 - RNA, 22 nt, Pseudomonas aeruginosa PA01
guacagcucggcgcccuggccg

SEQ ID NO: 3486188 - RNA, 18 nt, Pseudomonas aeruginosa PA01
guacaggcgcaccuggcg

SEQ ID NO: 3486189 - RNA, 12 nt, Pseudomonas aeruginosa PA01
guacaggcgguu

SEQ ID NO: 3486190 - RNA, 16 nt, Pseudomonas aeruginosa PA01
guacaggucggcgccg

SEQ ID NO: 3486191 - RNA, 20 nt, Pseudomonas aeruginosa PA01
guacaggucggcgccggugc

SEQ ID NO: 3486192 - RNA, 22 nt, Pseudomonas aeruginosa PA01
guacagguuguucggcgaguug

SEQ ID NO: 3486193 - RNA, 16 nt, Pseudomonas aeruginosa PA01
guacaguucaggcugg

SEQ ID NO: 3486194 - RNA, 13 nt, Pseudomonas aeruginosa PA01
guaccacgcagcc

SEQ ID NO: 3486195 - RNA, 16 nt, Pseudomonas aeruginosa PA01
guaccacgcagccacc

SEQ ID NO: 3486196 - RNA, 23 nt, Pseudomonas aeruginosa PA01
guaccacgcccgcgguauucucc

SEQ ID NO: 3486197 - RNA, 17 nt, Pseudomonas aeruginosa PA01
guaccagcaaugcccag

SEQ ID NO: 3486198 - RNA, 20 nt, Pseudomonas aeruginosa PA01
guaccagcaaugcccagcgc

SEQ ID NO: 3486199 - RNA, 21 nt, Pseudomonas aeruginosa PA01
guaccagcaaugcccagcgca

SEQ ID NO: 3486200 - RNA, 14 nt, Pseudomonas aeruginosa PA01
guaccagcagcgcc

SEQ ID NO: 3486201 - RNA, 15 nt, Pseudomonas aeruginosa PA01
guaccagcagcgccg

SEQ ID NO: 3486202 - RNA, 16 nt, Pseudomonas aeruginosa PA01
guaccagcagcgccga

SEQ ID NO: 3486203 - RNA, 22 nt, Pseudomonas aeruginosa PA01
guaccagcgcgauacccuggcc

SEQ ID NO: 3486204 - RNA, 15 nt, Pseudomonas aeruginosa PA01
guaccagcgcgcagc

SEQ ID NO: 3486205 - RNA, 17 nt, Pseudomonas aeruginosa PA01
guaccagcgcgcagcgg

SEQ ID NO: 3486206 - RNA, 18 nt, Pseudomonas aeruginosa PA01
guaccagggaagcgcgcg

SEQ ID NO: 3486207 - RNA, 20 nt, Pseudomonas aeruginosa PA01
guaccagggaagcgcgcgcc

SEQ ID NO: 3486208 - RNA, 22 nt, Pseudomonas aeruginosa PA01
guaccaggguguugucgcggcu

SEQ ID NO: 3486209 - RNA, 13 nt, Pseudomonas aeruginosa PA01
guaccaguagcga

SEQ ID NO: 3486210 - RNA, 17 nt, Pseudomonas aeruginosa PA01
guacccagcuugcuggc

SEQ ID NO: 3486211 - RNA, 17 nt, Pseudomonas aeruginosa PA01
guacccccaccgggcca

SEQ ID NO: 3486212 - RNA, 16 nt, Pseudomonas aeruginosa PA01
guacccgccggccaug

SEQ ID NO: 3486213 - RNA, 19 nt, Pseudomonas aeruginosa PA01
guacccggcagggccagcg

SEQ ID NO: 3486214 - RNA, 22 nt, Pseudomonas aeruginosa PA01
guacccggcagggccagcggaa

SEQ ID NO: 3486215 - RNA, 14 nt, Pseudomonas aeruginosa PA01
guacccggcggaca

SEQ ID NO: 3486216 - RNA, 22 nt, Pseudomonas aeruginosa PA01
guacccggcggacaaccaccau

SEQ ID NO: 3486217 - RNA, 18 nt, Pseudomonas aeruginosa PA01
guaccgaaacagggcgac

SEQ ID NO: 3486218 - RNA, 19 nt, Pseudomonas aeruginosa PA01
guaccgacggucggcaggu

SEQ ID NO: 3486219 - RNA, 23 nt, Pseudomonas aeruginosa PA01
guaccgccacguacagcgcgaca

SEQ ID NO: 3486220 - RNA, 13 nt, Pseudomonas aeruginosa PA01
guaccgcugcggc

SEQ ID NO: 3486221 - RNA, 17 nt, Pseudomonas aeruginosa PA01
guaccgcugcggccggc

SEQ ID NO: 3486222 - RNA, 19 nt, Pseudomonas aeruginosa PA01
guaccgcugcggccggcgc

SEQ ID NO: 3486223 - RNA, 20 nt, Pseudomonas aeruginosa PA01
guaccgcugcggccggcgcg

SEQ ID NO: 3486224 - RNA, 21 nt, Pseudomonas aeruginosa PA01
guaccgcugcggccggcgcgu

SEQ ID NO: 3486225 - RNA, 18 nt, Pseudomonas aeruginosa PA01
guaccgcugcgugccagg

SEQ ID NO: 3486226 - RNA, 21 nt, Pseudomonas aeruginosa PA01
guaccgcugcgugccagggcu

SEQ ID NO: 3486227 - RNA, 13 nt, Pseudomonas aeruginosa PA01
guaccgcuggcgc

SEQ ID NO: 3486228 - RNA, 23 nt, Pseudomonas aeruginosa PA01
guaccgcuuccugggcuucgucc

SEQ ID NO: 3486229 - RNA, 13 nt, Pseudomonas aeruginosa PA01
guaccggcagcgc

SEQ ID NO: 3486230 - RNA, 19 nt, Pseudomonas aeruginosa PA01
guaccggcagcgccgaggu

SEQ ID NO: 3486231 - RNA, 14 nt, Pseudomonas aeruginosa PA01
guaccggccaggcg

SEQ ID NO: 3486232 - RNA, 15 nt, Pseudomonas aeruginosa PA01
guaccggccaggcgg

SEQ ID NO: 3486233 - RNA, 15 nt, Pseudomonas aeruginosa PA01
guaccgggccaggca

SEQ ID NO: 3486234 - RNA, 16 nt, Pseudomonas aeruginosa PA01
guaccgggccaggcaa

SEQ ID NO: 3486235 - RNA, 16 nt, Pseudomonas aeruginosa PA01
guaccgugcuucaucg

SEQ ID NO: 3486236 - RNA, 14 nt, Pseudomonas aeruginosa PA01
guaccguugcgcag

SEQ ID NO: 3486237 - RNA, 15 nt, Pseudomonas aeruginosa PA01
guaccuacuguucgg

SEQ ID NO: 3486238 - RNA, 19 nt, Pseudomonas aeruginosa PA01
guaccuacuguucggucgg

SEQ ID NO: 3486239 - RNA, 15 nt, Pseudomonas aeruginosa PA01
guaccucgccaggcu

SEQ ID NO: 3486240 - RNA, 17 nt, Pseudomonas aeruginosa PA01
guaccugccggcacgcu

SEQ ID NO: 3486241 - RNA, 12 nt, Pseudomonas aeruginosa PA01
guaccugcucgc

SEQ ID NO: 3486242 - RNA, 15 nt, Pseudomonas aeruginosa PA01
guaccugcucgcggg

SEQ ID NO: 3486243 - RNA, 14 nt, Pseudomonas aeruginosa PA01
guaccuuccauuuc

SEQ ID NO: 3486244 - RNA, 17 nt, Pseudomonas aeruginosa PA01
guaccuucgagcaggag

SEQ ID NO: 3486245 - RNA, 21 nt, Pseudomonas aeruginosa PA01
guaccuuucuccccucaggcg

SEQ ID NO: 3486246 - RNA, 17 nt, Pseudomonas aeruginosa PA01
guacgacugacgaaggc

SEQ ID NO: 3486247 - RNA, 17 nt, Pseudomonas aeruginosa PA01
guacgaggggccgccgu

SEQ ID NO: 3486248 - RNA, 23 nt, Pseudomonas aeruginosa PA01
guacgaucagccagggcaacgcc

SEQ ID NO: 3486249 - RNA, 14 nt, Pseudomonas aeruginosa PA01
guacgcaccgcgua

SEQ ID NO: 3486250 - RNA, 13 nt, Pseudomonas aeruginosa PA01
guacgcccagcag

SEQ ID NO: 3486251 - RNA, 15 nt, Pseudomonas aeruginosa PA01
guacgcccagcagcg

SEQ ID NO: 3486252 - RNA, 19 nt, Pseudomonas aeruginosa PA01
guacgcccagcagcggcag

SEQ ID NO: 3486253 - RNA, 16 nt, Pseudomonas aeruginosa PA01
guacgcccccuccccu

SEQ ID NO: 3486254 - RNA, 22 nt, Pseudomonas aeruginosa PA01
guacgccgcgcugcgccaggcc

SEQ ID NO: 3486255 - RNA, 21 nt, Pseudomonas aeruginosa PA01
guacgcguacgacuucggcga

SEQ ID NO: 3486256 - RNA, 17 nt, Pseudomonas aeruginosa PA01
guacgcucaccaccacc

SEQ ID NO: 3486257 - RNA, 21 nt, Pseudomonas aeruginosa PA01
guacgcucaccaccaccgcgc

SEQ ID NO: 3486258 - RNA, 22 nt, Pseudomonas aeruginosa PA01
guacgcucaccaccaccgcgcc

SEQ ID NO: 3486259 - RNA, 12 nt, Pseudomonas aeruginosa PA01
guacgcugcaug

SEQ ID NO: 3486260 - RNA, 22 nt, Pseudomonas aeruginosa PA01
guacgcugcauguccgcaggca

SEQ ID NO: 3486261 - RNA, 23 nt, Pseudomonas aeruginosa PA01
guacgcugcauguccgcaggcag

SEQ ID NO: 3486262 - RNA, 14 nt, Pseudomonas aeruginosa PA01
guacgcugccaggu

SEQ ID NO: 3486263 - RNA, 15 nt, Pseudomonas aeruginosa PA01
guacggaugccgcga

SEQ ID NO: 3486264 - RNA, 14 nt, Pseudomonas aeruginosa PA01
guacggcaccacca

SEQ ID NO: 3486265 - RNA, 15 nt, Pseudomonas aeruginosa PA01
guacggcaccaccac

SEQ ID NO: 3486266 - RNA, 15 nt, Pseudomonas aeruginosa PA01
guacggcagcggcgu

SEQ ID NO: 3486267 - RNA, 15 nt, Pseudomonas aeruginosa PA01
guacggcgccgcugc

SEQ ID NO: 3486268 - RNA, 11 nt, Pseudomonas aeruginosa PA01
guacggcgcgg

SEQ ID NO: 3486269 - RNA, 22 nt, Pseudomonas aeruginosa PA01
guacggcugagaccuuccugcc

SEQ ID NO: 3486270 - RNA, 23 nt, Pseudomonas aeruginosa PA01
guacggcugagaccuuccugcca

SEQ ID NO: 3486271 - RNA, 21 nt, Pseudomonas aeruginosa PA01
guacggguuucgcugcugccg

SEQ ID NO: 3486272 - RNA, 16 nt, Pseudomonas aeruginosa PA01
guacgguuggccagcg

SEQ ID NO: 3486273 - RNA, 17 nt, Pseudomonas aeruginosa PA01
guacgguuggccagcga

SEQ ID NO: 3486274 - RNA, 18 nt, Pseudomonas aeruginosa PA01
guacgguuggccagcgaa

SEQ ID NO: 3486275 - RNA, 11 nt, Pseudomonas aeruginosa PA01
guacgucgaga

SEQ ID NO: 3486276 - RNA, 15 nt, Pseudomonas aeruginosa PA01
guacgucgagaccga

SEQ ID NO: 3486277 - RNA, 21 nt, Pseudomonas aeruginosa PA01
guacucaggccgggcggauga

SEQ ID NO: 3486278 - RNA, 23 nt, Pseudomonas aeruginosa PA01
guacucaggccgggcggaugacc

SEQ ID NO: 3486279 - RNA, 18 nt, Pseudomonas aeruginosa PA01
guacucauggccgcagcg

SEQ ID NO: 3486280 - RNA, 23 nt, Pseudomonas aeruginosa PA01
guacuccagcaacggcaucgcuc

SEQ ID NO: 3486281 - RNA, 17 nt, Pseudomonas aeruginosa PA01
guacuccgagggccgcg

SEQ ID NO: 3486282 - RNA, 19 nt, Pseudomonas aeruginosa PA01
guacuccgagggccgcgcc

SEQ ID NO: 3486283 - RNA, 23 nt, Pseudomonas aeruginosa PA01
guacuccggguugaccgccagac

SEQ ID NO: 3486284 - RNA, 13 nt, Pseudomonas aeruginosa PA01
guacuccuccagc

SEQ ID NO: 3486285 - RNA, 16 nt, Pseudomonas aeruginosa PA01
guacuccuggcauggc

SEQ ID NO: 3486286 - RNA, 20 nt, Pseudomonas aeruginosa PA01
guacucgaucugucgcagcg

SEQ ID NO: 3486287 - RNA, 17 nt, Pseudomonas aeruginosa PA01
guacucgauggucaggu

SEQ ID NO: 3486288 - RNA, 20 nt, Pseudomonas aeruginosa PA01
guacucgauggucagguagg

SEQ ID NO: 3486289 - RNA, 13 nt, Pseudomonas aeruginosa PA01
guacucgccggug

SEQ ID NO: 3486290 - RNA, 20 nt, Pseudomonas aeruginosa PA01
guacucggcccgggccuggu

SEQ ID NO: 3486291 - RNA, 19 nt, Pseudomonas aeruginosa PA01
guacucggcuacgaaccga

SEQ ID NO: 3486292 - RNA, 19 nt, Pseudomonas aeruginosa PA01
guacucguguuccggcagg

SEQ ID NO: 3486293 - RNA, 20 nt, Pseudomonas aeruginosa PA01
guacucguguuccggcagga

SEQ ID NO: 3486294 - RNA, 13 nt, Pseudomonas aeruginosa PA01
guacucuggccau

SEQ ID NO: 3486295 - RNA, 23 nt, Pseudomonas aeruginosa PA01
guacugccgcuaucgcuggcgca

SEQ ID NO: 3486296 - RNA, 23 nt, Pseudomonas aeruginosa PA01
guacugcucgguauggcugcugu

SEQ ID NO: 3486297 - RNA, 22 nt, Pseudomonas aeruginosa PA01
guacugguccggguuggcgcag

SEQ ID NO: 3486298 - RNA, 20 nt, Pseudomonas aeruginosa PA01
guacuugaaggugcccaggg

SEQ ID NO: 3486299 - RNA, 16 nt, Pseudomonas aeruginosa PA01
guacuugacggcgccg

SEQ ID NO: 3486300 - RNA, 14 nt, Pseudomonas aeruginosa PA01
guacuuggccacgc

SEQ ID NO: 3486301 - RNA, 19 nt, Pseudomonas aeruginosa PA01
guacuuggccacgccuucg

SEQ ID NO: 3486302 - RNA, 15 nt, Pseudomonas aeruginosa PA01
guacuuggcccggcg

SEQ ID NO: 3486303 - RNA, 20 nt, Pseudomonas aeruginosa PA01
guagaaaccgauguuggugu

SEQ ID NO: 3486304 - RNA, 23 nt, Pseudomonas aeruginosa PA01
guagaaacgcgccuccggcagcg

SEQ ID NO: 3486305 - RNA, 22 nt, Pseudomonas aeruginosa PA01
guagaaaugguggaccagcgcc

SEQ ID NO: 3486306 - RNA, 23 nt, Pseudomonas aeruginosa PA01
guagaacaggcgauagccgacca

SEQ ID NO: 3486307 - RNA, 16 nt, Pseudomonas aeruginosa PA01
guagaacaggcugccg

SEQ ID NO: 3486308 - RNA, 24 nt, Pseudomonas aeruginosa PA01
guagaacggguugaucagguucgg

SEQ ID NO: 3486309 - RNA, 14 nt, Pseudomonas aeruginosa PA01
guagaacucgcccu

SEQ ID NO: 3486310 - RNA, 20 nt, Pseudomonas aeruginosa PA01
guagaagucguccucgcccu

SEQ ID NO: 3486311 - RNA, 14 nt, Pseudomonas aeruginosa PA01
guagaccaccagca

SEQ ID NO: 3486312 - RNA, 15 nt, Pseudomonas aeruginosa PA01
guagaccaccagcag

SEQ ID NO: 3486313 - RNA, 17 nt, Pseudomonas aeruginosa PA01
guagaccaccagcagca

SEQ ID NO: 3486314 - RNA, 16 nt, Pseudomonas aeruginosa PA01
guagaccaccagcagg

SEQ ID NO: 3486315 - RNA, 14 nt, Pseudomonas aeruginosa PA01
guagaccaccagcg

SEQ ID NO: 3486316 - RNA, 16 nt, Pseudomonas aeruginosa PA01
guagaccaccagcgug

SEQ ID NO: 3486317 - RNA, 20 nt, Pseudomonas aeruginosa PA01
guagaccaccucgacggcga

SEQ ID NO: 3486318 - RNA, 17 nt, Pseudomonas aeruginosa PA01
guagaccacgcaggcca

SEQ ID NO: 3486319 - RNA, 21 nt, Pseudomonas aeruginosa PA01
guagaccacgcaggccagcgc

SEQ ID NO: 3486320 - RNA, 22 nt, Pseudomonas aeruginosa PA01
guagaccacgcaggccagcgcc

SEQ ID NO: 3486321 - RNA, 23 nt, Pseudomonas aeruginosa PA01
guagaccagauagaccaaggcau

SEQ ID NO: 3486322 - RNA, 13 nt, Pseudomonas aeruginosa PA01
guagaccagcuug

SEQ ID NO: 3486323 - RNA, 17 nt, Pseudomonas aeruginosa PA01
guagaccaucgccggcg

SEQ ID NO: 3486324 - RNA, 16 nt, Pseudomonas aeruginosa PA01
guagaccggcuccagg

SEQ ID NO: 3486325 - RNA, 20 nt, Pseudomonas aeruginosa PA01
guagaccggcuccagggcga

SEQ ID NO: 3486326 - RNA, 14 nt, Pseudomonas aeruginosa PA01
guagaccuguucgc

SEQ ID NO: 3486327 - RNA, 17 nt, Pseudomonas aeruginosa PA01
guagaccuucucguccu

SEQ ID NO: 3486328 - RNA, 16 nt, Pseudomonas aeruginosa PA01
guagaccuugcggccg

SEQ ID NO: 3486329 - RNA, 20 nt, Pseudomonas aeruginosa PA01
guagacgaaacucaucaggc

SEQ ID NO: 3486330 - RNA, 19 nt, Pseudomonas aeruginosa PA01
guagacgccucccaccgcg

SEQ ID NO: 3486331 - RNA, 23 nt, Pseudomonas aeruginosa PA01
guagacguccuccaccgcuccgg

SEQ ID NO: 3486332 - RNA, 17 nt, Pseudomonas aeruginosa PA01
guagacugucgcggggc

SEQ ID NO: 3486333 - RNA, 17 nt, Pseudomonas aeruginosa PA01
guagagaugcaccggcc

SEQ ID NO: 3486334 - RNA, 18 nt, Pseudomonas aeruginosa PA01
guagagaugcaccggcca

SEQ ID NO: 3486335 - RNA, 16 nt, Pseudomonas aeruginosa PA01
guagagaugcagcagg

SEQ ID NO: 3486336 - RNA, 21 nt, Pseudomonas aeruginosa PA01
guagagaugcagcagguagaa

SEQ ID NO: 3486337 - RNA, 19 nt, Pseudomonas aeruginosa PA01
guagagauucuuccggugc

SEQ ID NO: 3486338 - RNA, 20 nt, Pseudomonas aeruginosa PA01
guagagauuggguucaggcu

SEQ ID NO: 3486339 - RNA, 12 nt, Pseudomonas aeruginosa PA01
guagagcacgcc

SEQ ID NO: 3486340 - RNA, 13 nt, Pseudomonas aeruginosa PA01
guagagcacgccg

SEQ ID NO: 3486341 - RNA, 16 nt, Pseudomonas aeruginosa PA01
guagagcaggcugcua

SEQ ID NO: 3486342 - RNA, 13 nt, Pseudomonas aeruginosa PA01
guagagcgcggcg

SEQ ID NO: 3486343 - RNA, 20 nt, Pseudomonas aeruginosa PA01
guagagcgcggcgcaggcga

SEQ ID NO: 3486344 - RNA, 20 nt, Pseudomonas aeruginosa PA01
guagaggcucaacugguccu

SEQ ID NO: 3486345 - RNA, 19 nt, Pseudomonas aeruginosa PA01
guagaggucgccguccuug

SEQ ID NO: 3486346 - RNA, 20 nt, Pseudomonas aeruginosa PA01
guagaucauuuuccggguca

SEQ ID NO: 3486347 - RNA, 13 nt, Pseudomonas aeruginosa PA01
guagaucgacagc

SEQ ID NO: 3486348 - RNA, 17 nt, Pseudomonas aeruginosa PA01
guagaucggcagcauca

SEQ ID NO: 3486349 - RNA, 19 nt, Pseudomonas aeruginosa PA01
guagaucggcagcaucagc

SEQ ID NO: 3486350 - RNA, 21 nt, Pseudomonas aeruginosa PA01
guagaucggcagcaucagccg

SEQ ID NO: 3486351 - RNA, 16 nt, Pseudomonas aeruginosa PA01
guagaugccgcgucgg

SEQ ID NO: 3486352 - RNA, 14 nt, Pseudomonas aeruginosa PA01
guagaugccggugc

SEQ ID NO: 3486353 - RNA, 16 nt, Pseudomonas aeruginosa PA01
guagaugccggugcug

SEQ ID NO: 3486354 - RNA, 20 nt, Pseudomonas aeruginosa PA01
guagaugccggugcuggugc

SEQ ID NO: 3486355 - RNA, 19 nt, Pseudomonas aeruginosa PA01
guagauggacgguucccag

SEQ ID NO: 3486356 - RNA, 19 nt, Pseudomonas aeruginosa PA01
guagauggucagcaacugc

SEQ ID NO: 3486357 - RNA, 14 nt, Pseudomonas aeruginosa PA01
guagauguccagug

SEQ ID NO: 3486358 - RNA, 21 nt, Pseudomonas aeruginosa PA01
guagcagagggucgccagcga

SEQ ID NO: 3486359 - RNA, 19 nt, Pseudomonas aeruginosa PA01
guagcagccguccagcuug

SEQ ID NO: 3486360 - RNA, 13 nt, Pseudomonas aeruginosa PA01
guagcagguccgc

SEQ ID NO: 3486361 - RNA, 17 nt, Pseudomonas aeruginosa PA01
guagccacggcgagagc

SEQ ID NO: 3486362 - RNA, 16 nt, Pseudomonas aeruginosa PA01
guagccaggggucagg

SEQ ID NO: 3486363 - RNA, 20 nt, Pseudomonas aeruginosa PA01
guagccaggggucaggccga

SEQ ID NO: 3486364 - RNA, 23 nt, Pseudomonas aeruginosa PA01
guagccaggggucaggccgaugg

SEQ ID NO: 3486365 - RNA, 20 nt, Pseudomonas aeruginosa PA01
guagccaugcacacgcuccc

SEQ ID NO: 3486366 - RNA, 14 nt, Pseudomonas aeruginosa PA01
guagccauggcgga

SEQ ID NO: 3486367 - RNA, 14 nt, Pseudomonas aeruginosa PA01
guagcccaggggca

SEQ ID NO: 3486368 - RNA, 17 nt, Pseudomonas aeruginosa PA01
guagcccccgccgcuga

SEQ ID NO: 3486369 - RNA, 19 nt, Pseudomonas aeruginosa PA01
guagcccccgccgcugagg

SEQ ID NO: 3486370 - RNA, 19 nt, Pseudomonas aeruginosa PA01
guagccccggcccggcgug

SEQ ID NO: 3486371 - RNA, 13 nt, Pseudomonas aeruginosa PA01
guagcccggcagc

SEQ ID NO: 3486372 - RNA, 21 nt, Pseudomonas aeruginosa PA01
guagccgacccgcuugagcca

SEQ ID NO: 3486373 - RNA, 15 nt, Pseudomonas aeruginosa PA01
guagccgagaagcag

SEQ ID NO: 3486374 - RNA, 11 nt, Pseudomonas aeruginosa PA01
guagccgagca

SEQ ID NO: 3486375 - RNA, 14 nt, Pseudomonas aeruginosa PA01
guagccgaggcggc

SEQ ID NO: 3486376 - RNA, 15 nt, Pseudomonas aeruginosa PA01
guagccgaggcggcc

SEQ ID NO: 3486377 - RNA, 17 nt, Pseudomonas aeruginosa PA01
guagccgaggcggccga

SEQ ID NO: 3486378 - RNA, 21 nt, Pseudomonas aeruginosa PA01
guagccgaucaacgcggccag

SEQ ID NO: 3486379 - RNA, 23 nt, Pseudomonas aeruginosa PA01
guagccgcaguccagggcgaugg

SEQ ID NO: 3486380 - RNA, 18 nt, Pseudomonas aeruginosa PA01
guagccgcccaccgcggg

SEQ ID NO: 3486381 - RNA, 13 nt, Pseudomonas aeruginosa PA01
guagccgccggga

SEQ ID NO: 3486382 - RNA, 21 nt, Pseudomonas aeruginosa PA01
guagccgccuuguuccaggcg

SEQ ID NO: 3486383 - RNA, 11 nt, Pseudomonas aeruginosa PA01
guagccgcgcc

SEQ ID NO: 3486384 - RNA, 13 nt, Pseudomonas aeruginosa PA01
guagccgcgccgg

SEQ ID NO: 3486385 - RNA, 15 nt, Pseudomonas aeruginosa PA01
guagccgcgccggcc

SEQ ID NO: 3486386 - RNA, 14 nt, Pseudomonas aeruginosa PA01
guagccgcguacgg

SEQ ID NO: 3486387 - RNA, 13 nt, Pseudomonas aeruginosa PA01
guagccggccagg

SEQ ID NO: 3486388 - RNA, 14 nt, Pseudomonas aeruginosa PA01
guagccggccaggg

SEQ ID NO: 3486389 - RNA, 18 nt, Pseudomonas aeruginosa PA01
guagccggcgaucagcgc

SEQ ID NO: 3486390 - RNA, 19 nt, Pseudomonas aeruginosa PA01
guagccggcgauccgcugc

SEQ ID NO: 3486391 - RNA, 20 nt, Pseudomonas aeruginosa PA01
guagccggcgaugugcggcg

SEQ ID NO: 3486392 - RNA, 13 nt, Pseudomonas aeruginosa PA01
guagccggcgccg

SEQ ID NO: 3486393 - RNA, 14 nt, Pseudomonas aeruginosa PA01
guagccggcgcggc

SEQ ID NO: 3486394 - RNA, 15 nt, Pseudomonas aeruginosa PA01
guagccggcgcggcg

SEQ ID NO: 3486395 - RNA, 18 nt, Pseudomonas aeruginosa PA01
guagccggcgcggcgcag

SEQ ID NO: 3486396 - RNA, 20 nt, Pseudomonas aeruginosa PA01
guagccggcuuccucgcccu

SEQ ID NO: 3486397 - RNA, 15 nt, Pseudomonas aeruginosa PA01
guagccggucaggcg

SEQ ID NO: 3486398 - RNA, 20 nt, Pseudomonas aeruginosa PA01
guagccguagauggucagca

SEQ ID NO: 3486399 - RNA, 23 nt, Pseudomonas aeruginosa PA01
guagccguauucgaagcucggca

SEQ ID NO: 3486400 - RNA, 20 nt, Pseudomonas aeruginosa PA01
guagccgucgaacagcagcu

SEQ ID NO: 3486401 - RNA, 19 nt, Pseudomonas aeruginosa PA01
guagccgucguagcgcagc

SEQ ID NO: 3486402 - RNA, 15 nt, Pseudomonas aeruginosa PA01
guagccucccgccgc

SEQ ID NO: 3486403 - RNA, 13 nt, Pseudomonas aeruginosa PA01
guagccugcggcc

SEQ ID NO: 3486404 - RNA, 15 nt, Pseudomonas aeruginosa PA01
guagccugcggccag

SEQ ID NO: 3486405 - RNA, 16 nt, Pseudomonas aeruginosa PA01
guagccugcggccagc

SEQ ID NO: 3486406 - RNA, 19 nt, Pseudomonas aeruginosa PA01
guagccugcggccagcgcc

SEQ ID NO: 3486407 - RNA, 19 nt, Pseudomonas aeruginosa PA01
guagccuggauacgggcgc

SEQ ID NO: 3486408 - RNA, 21 nt, Pseudomonas aeruginosa PA01
guagccuuccuucucgaagcc

SEQ ID NO: 3486409 - RNA, 20 nt, Pseudomonas aeruginosa PA01
guagcgaaucugcagggcau

SEQ ID NO: 3486410 - RNA, 15 nt, Pseudomonas aeruginosa PA01
guagcgacaggcccu

SEQ ID NO: 3486411 - RNA, 17 nt, Pseudomonas aeruginosa PA01
guagcgacggaagcccu

SEQ ID NO: 3486412 - RNA, 18 nt, Pseudomonas aeruginosa PA01
guagcgcagcggcaggcc

SEQ ID NO: 3486413 - RNA, 20 nt, Pseudomonas aeruginosa PA01
guagcgcagcggcaggccac

SEQ ID NO: 3486414 - RNA, 21 nt, Pseudomonas aeruginosa PA01
guagcgcagcggcaggccacg

SEQ ID NO: 3486415 - RNA, 22 nt, Pseudomonas aeruginosa PA01
guagcgcagcggcaggccacgg

SEQ ID NO: 3486416 - RNA, 20 nt, Pseudomonas aeruginosa PA01
guagcgcaguucgccgccga

SEQ ID NO: 3486417 - RNA, 13 nt, Pseudomonas aeruginosa PA01
guagcgcaugccg

SEQ ID NO: 3486418 - RNA, 12 nt, Pseudomonas aeruginosa PA01
guagcgccaggc

SEQ ID NO: 3486419 - RNA, 20 nt, Pseudomonas aeruginosa PA01
guagcgccccuuggccagca

SEQ ID NO: 3486420 - RNA, 21 nt, Pseudomonas aeruginosa PA01
guagcgccccuuggccagcac

SEQ ID NO: 3486421 - RNA, 23 nt, Pseudomonas aeruginosa PA01
guagcgccccuuggccagcacca

SEQ ID NO: 3486422 - RNA, 22 nt, Pseudomonas aeruginosa PA01
guagcgccugguucugcuccgg

SEQ ID NO: 3486423 - RNA, 14 nt, Pseudomonas aeruginosa PA01
guagcgcgcggcga

SEQ ID NO: 3486424 - RNA, 16 nt, Pseudomonas aeruginosa PA01
guagcgcuccagcucc

SEQ ID NO: 3486425 - RNA, 21 nt, Pseudomonas aeruginosa PA01
guagcgcuccagcuccuccag

SEQ ID NO: 3486426 - RNA, 14 nt, Pseudomonas aeruginosa PA01
guagcgcuccuucu

SEQ ID NO: 3486427 - RNA, 21 nt, Pseudomonas aeruginosa PA01
guagcgcucgauagcguccag

SEQ ID NO: 3486428 - RNA, 17 nt, Pseudomonas aeruginosa PA01
guagcgcugcgcccgcu

SEQ ID NO: 3486429 - RNA, 13 nt, Pseudomonas aeruginosa PA01
guagcgcugggcu

SEQ ID NO: 3486430 - RNA, 20 nt, Pseudomonas aeruginosa PA01
guagcgcuucaucaggcugc

SEQ ID NO: 3486431 - RNA, 17 nt, Pseudomonas aeruginosa PA01
guagcgcuucccgcggc

SEQ ID NO: 3486432 - RNA, 18 nt, Pseudomonas aeruginosa PA01
guagcgcuucccgcggcu

SEQ ID NO: 3486433 - RNA, 18 nt, Pseudomonas aeruginosa PA01
guagcgcuucgcgcagcu

SEQ ID NO: 3486434 - RNA, 21 nt, Pseudomonas aeruginosa PA01
guagcggaagcacggcucggc

SEQ ID NO: 3486435 - RNA, 23 nt, Pseudomonas aeruginosa PA01
guagcggaagcacggcucggcga

SEQ ID NO: 3486436 - RNA, 16 nt, Pseudomonas aeruginosa PA01
guagcggaagccgucg

SEQ ID NO: 3486437 - RNA, 19 nt, Pseudomonas aeruginosa PA01
guagcggaagccgucggcg

SEQ ID NO: 3486438 - RNA, 20 nt, Pseudomonas aeruginosa PA01
guagcggaagccgucggcga

SEQ ID NO: 3486439 - RNA, 22 nt, Pseudomonas aeruginosa PA01
guagcggaucagccggcccauc

SEQ ID NO: 3486440 - RNA, 14 nt, Pseudomonas aeruginosa PA01
guagcggcaggagc

SEQ ID NO: 3486441 - RNA, 15 nt, Pseudomonas aeruginosa PA01
guagcggcaggagca

SEQ ID NO: 3486442 - RNA, 16 nt, Pseudomonas aeruginosa PA01
guagcggcaggagcau

SEQ ID NO: 3486443 - RNA, 21 nt, Pseudomonas aeruginosa PA01
guagcggcguucgccgagcaa

SEQ ID NO: 3486444 - RNA, 16 nt, Pseudomonas aeruginosa PA01
guagcggcucgccgaa

SEQ ID NO: 3486445 - RNA, 13 nt, Pseudomonas aeruginosa PA01
guagcgggccagc

SEQ ID NO: 3486446 - RNA, 20 nt, Pseudomonas aeruginosa PA01
guagcgggccagcagcuccg

SEQ ID NO: 3486447 - RNA, 16 nt, Pseudomonas aeruginosa PA01
guagcgggccaucagg

SEQ ID NO: 3486448 - RNA, 20 nt, Pseudomonas aeruginosa PA01
guagcgggccaucaggucca

SEQ ID NO: 3486449 - RNA, 14 nt, Pseudomonas aeruginosa PA01
guagcgguccucgg

SEQ ID NO: 3486450 - RNA, 21 nt, Pseudomonas aeruginosa PA01
guagcgguccucgggcaccag

SEQ ID NO: 3486451 - RNA, 22 nt, Pseudomonas aeruginosa PA01
guagcgguccucgggcaccagc

SEQ ID NO: 3486452 - RNA, 22 nt, Pseudomonas aeruginosa PA01
guagcguagggcgaauaaccgc

SEQ ID NO: 3486453 - RNA, 21 nt, Pseudomonas aeruginosa PA01
guagcguuaucgccgguccuc

SEQ ID NO: 3486454 - RNA, 16 nt, Pseudomonas aeruginosa PA01
guagcguuccuggcgc

SEQ ID NO: 3486455 - RNA, 15 nt, Pseudomonas aeruginosa PA01
guagcguugcaggca

SEQ ID NO: 3486456 - RNA, 16 nt, Pseudomonas aeruginosa PA01
guagcguuggaguagg

SEQ ID NO: 3486457 - RNA, 14 nt, Pseudomonas aeruginosa PA01
guagcuccaggccg

SEQ ID NO: 3486458 - RNA, 15 nt, Pseudomonas aeruginosa PA01
guagcugagcaggcc

SEQ ID NO: 3486459 - RNA, 15 nt, Pseudomonas aeruginosa PA01
guagcugcagcgccc

SEQ ID NO: 3486460 - RNA, 14 nt, Pseudomonas aeruginosa PA01
guagcugccggcgu

SEQ ID NO: 3486461 - RNA, 18 nt, Pseudomonas aeruginosa PA01
guagcugccggcgucguc

SEQ ID NO: 3486462 - RNA, 15 nt, Pseudomonas aeruginosa PA01
guagcugcgccgccu

SEQ ID NO: 3486463 - RNA, 16 nt, Pseudomonas aeruginosa PA01
guagcugcgccgccuu

SEQ ID NO: 3486464 - RNA, 16 nt, Pseudomonas aeruginosa PA01
guagcugcugccggcu

SEQ ID NO: 3486465 - RNA, 17 nt, Pseudomonas aeruginosa PA01
guagcugcugccggcuu

SEQ ID NO: 3486466 - RNA, 18 nt, Pseudomonas aeruginosa PA01
guagcuggcgcagggcgu

SEQ ID NO: 3486467 - RNA, 15 nt, Pseudomonas aeruginosa PA01
guagcuuuccgcggc

SEQ ID NO: 3486468 - RNA, 17 nt, Pseudomonas aeruginosa PA01
guaggacagggccaggc

SEQ ID NO: 3486469 - RNA, 20 nt, Pseudomonas aeruginosa PA01
guaggacagggccaggccga

SEQ ID NO: 3486470 - RNA, 24 nt, Pseudomonas aeruginosa PA01
guaggacagggccaggccgagcaa

SEQ ID NO: 3486471 - RNA, 17 nt, Pseudomonas aeruginosa PA01
guaggacgccucgucgg

SEQ ID NO: 3486472 - RNA, 14 nt, Pseudomonas aeruginosa PA01
guaggagccggcca

SEQ ID NO: 3486473 - RNA, 13 nt, Pseudomonas aeruginosa PA01
guaggagccgucg

SEQ ID NO: 3486474 - RNA, 15 nt, Pseudomonas aeruginosa PA01
guaggcacaggaccc

SEQ ID NO: 3486475 - RNA, 18 nt, Pseudomonas aeruginosa PA01
guaggcaucgacgccagc

SEQ ID NO: 3486476 - RNA, 21 nt, Pseudomonas aeruginosa PA01
guaggcaucgacgccagcggc

SEQ ID NO: 3486477 - RNA, 15 nt, Pseudomonas aeruginosa PA01
guaggcaucgaucuu

SEQ ID NO: 3486478 - RNA, 21 nt, Pseudomonas aeruginosa PA01
guaggccacuucccggcgcag

SEQ ID NO: 3486479 - RNA, 12 nt, Pseudomonas aeruginosa PA01
guaggccagcgg

SEQ ID NO: 3486480 - RNA, 12 nt, Pseudomonas aeruginosa PA01
guaggccaggca

SEQ ID NO: 3486481 - RNA, 15 nt, Pseudomonas aeruginosa PA01
guaggccgcuuccgg

SEQ ID NO: 3486482 - RNA, 14 nt, Pseudomonas aeruginosa PA01
guaggccuggccgc

SEQ ID NO: 3486483 - RNA, 21 nt, Pseudomonas aeruginosa PA01
guaggccugguagaucugugc

SEQ ID NO: 3486484 - RNA, 19 nt, Pseudomonas aeruginosa PA01
guaggcgaagcccagcgag

SEQ ID NO: 3486485 - RNA, 11 nt, Pseudomonas aeruginosa PA01
guaggcgacga

SEQ ID NO: 3486486 - RNA, 14 nt, Pseudomonas aeruginosa PA01
guaggcgagcagcg

SEQ ID NO: 3486487 - RNA, 23 nt, Pseudomonas aeruginosa PA01
guaggcgagcagcggcacgcucu

SEQ ID NO: 3486488 - RNA, 12 nt, Pseudomonas aeruginosa PA01
guaggcgaugcg

SEQ ID NO: 3486489 - RNA, 20 nt, Pseudomonas aeruginosa PA01
guaggcgauggccuggucgg

SEQ ID NO: 3486490 - RNA, 16 nt, Pseudomonas aeruginosa PA01
guaggcgcaccaggcc

SEQ ID NO: 3486491 - RNA, 22 nt, Pseudomonas aeruginosa PA01
guaggcgcaccaggccaggcug

SEQ ID NO: 3486492 - RNA, 20 nt, Pseudomonas aeruginosa PA01
guaggcgcgccaaggccgcc

SEQ ID NO: 3486493 - RNA, 17 nt, Pseudomonas aeruginosa PA01
guaggcgcgggcggcgg

SEQ ID NO: 3486494 - RNA, 14 nt, Pseudomonas aeruginosa PA01
guaggcgcgggugg

SEQ ID NO: 3486495 - RNA, 16 nt, Pseudomonas aeruginosa PA01
guaggcgcggguggcg

SEQ ID NO: 3486496 - RNA, 15 nt, Pseudomonas aeruginosa PA01
guaggcgguggccac

SEQ ID NO: 3486497 - RNA, 14 nt, Pseudomonas aeruginosa PA01
guaggcguccuggc

SEQ ID NO: 3486498 - RNA, 16 nt, Pseudomonas aeruginosa PA01
guaggcguccuggcga

SEQ ID NO: 3486499 - RNA, 17 nt, Pseudomonas aeruginosa PA01
guaggcgucgucgaccu

SEQ ID NO: 3486500 - RNA, 20 nt, Pseudomonas aeruginosa PA01
guaggcgucgucgaccucga

SEQ ID NO: 3486501 - RNA, 16 nt, Pseudomonas aeruginosa PA01
guaggcuuggucgggc

SEQ ID NO: 3486502 - RNA, 18 nt, Pseudomonas aeruginosa PA01
guaggcuuggucgggcgc

SEQ ID NO: 3486503 - RNA, 23 nt, Pseudomonas aeruginosa PA01
guagggacggugcaggccgacgu

SEQ ID NO: 3486504 - RNA, 20 nt, Pseudomonas aeruginosa PA01
guagggcaucgccgacaggu

SEQ ID NO: 3486505 - RNA, 23 nt, Pseudomonas aeruginosa PA01
guagggcaucgccgacaggucgg

SEQ ID NO: 3486506 - RNA, 20 nt, Pseudomonas aeruginosa PA01
guagggcgaacaaccgcucg

SEQ ID NO: 3486507 - RNA, 23 nt, Pseudomonas aeruginosa PA01
guagggcgaacaacgccgccggc

SEQ ID NO: 3486508 - RNA, 22 nt, Pseudomonas aeruginosa PA01
guagggcgaauaacgccacagg

SEQ ID NO: 3486509 - RNA, 21 nt, Pseudomonas aeruginosa PA01
guagggcgaauaucgcggcgc

SEQ ID NO: 3486510 - RNA, 17 nt, Pseudomonas aeruginosa PA01
guagggcgcauaaccgc

SEQ ID NO: 3486511 - RNA, 20 nt, Pseudomonas aeruginosa PA01
guagggcguauaaccgcucg

SEQ ID NO: 3486512 - RNA, 19 nt, Pseudomonas aeruginosa PA01
guaggggucguugccgucg

SEQ ID NO: 3486513 - RNA, 16 nt, Pseudomonas aeruginosa PA01
guagggguggccaggc

SEQ ID NO: 3486514 - RNA, 17 nt, Pseudomonas aeruginosa PA01
guagggguggccaggcg

SEQ ID NO: 3486515 - RNA, 15 nt, Pseudomonas aeruginosa PA01
guagggucgcagcag

SEQ ID NO: 3486516 - RNA, 17 nt, Pseudomonas aeruginosa PA01
guaggguucgccgacgu

SEQ ID NO: 3486517 - RNA, 21 nt, Pseudomonas aeruginosa PA01
guaggguucgccgacguccuc

SEQ ID NO: 3486518 - RNA, 15 nt, Pseudomonas aeruginosa PA01
guagguagcguugcg

SEQ ID NO: 3486519 - RNA, 19 nt, Pseudomonas aeruginosa PA01
guagguagcguugcgccag

SEQ ID NO: 3486520 - RNA, 15 nt, Pseudomonas aeruginosa PA01
guagguauccgccgg

SEQ ID NO: 3486521 - RNA, 16 nt, Pseudomonas aeruginosa PA01
guagguauccgccggc

SEQ ID NO: 3486522 - RNA, 14 nt, Pseudomonas aeruginosa PA01
guaggucaccgcgc

SEQ ID NO: 3486523 - RNA, 17 nt, Pseudomonas aeruginosa PA01
guaggucaccgcgccgg

SEQ ID NO: 3486524 - RNA, 18 nt, Pseudomonas aeruginosa PA01
guaggucaccgcgccggu

SEQ ID NO: 3486525 - RNA, 13 nt, Pseudomonas aeruginosa PA01
guagguccaggcg

SEQ ID NO: 3486526 - RNA, 15 nt, Pseudomonas aeruginosa PA01
guaggugaccgccca

SEQ ID NO: 3486527 - RNA, 17 nt, Pseudomonas aeruginosa PA01
guaggugcccggcggga

SEQ ID NO: 3486528 - RNA, 18 nt, Pseudomonas aeruginosa PA01
guaggugcgcuggcgcca

SEQ ID NO: 3486529 - RNA, 16 nt, Pseudomonas aeruginosa PA01
guagguggcgccgccg

SEQ ID NO: 3486530 - RNA, 17 nt, Pseudomonas aeruginosa PA01
guagguggcgccgccgg

SEQ ID NO: 3486531 - RNA, 19 nt, Pseudomonas aeruginosa PA01
guagguggcgccgccggcg

SEQ ID NO: 3486532 - RNA, 15 nt, Pseudomonas aeruginosa PA01
guagguguacccagg

SEQ ID NO: 3486533 - RNA, 15 nt, Pseudomonas aeruginosa PA01
guagguuuucguugg

SEQ ID NO: 3486534 - RNA, 21 nt, Pseudomonas aeruginosa PA01
guaguagaucagcuucucuuu

SEQ ID NO: 3486535 - RNA, 13 nt, Pseudomonas aeruginosa PA01
guaguaggcgcgg

SEQ ID NO: 3486536 - RNA, 16 nt, Pseudomonas aeruginosa PA01
guaguagggacggugc

SEQ ID NO: 3486537 - RNA, 20 nt, Pseudomonas aeruginosa PA01
guaguaggggaauuucacgc

SEQ ID NO: 3486538 - RNA, 13 nt, Pseudomonas aeruginosa PA01
guaguccagcagg

SEQ ID NO: 3486539 - RNA, 14 nt, Pseudomonas aeruginosa PA01
guaguccagccagu

SEQ ID NO: 3486540 - RNA, 21 nt, Pseudomonas aeruginosa PA01
guaguccagcgguaccagcag

SEQ ID NO: 3486541 - RNA, 23 nt, Pseudomonas aeruginosa PA01
guaguccagcgguaccagcagcg

SEQ ID NO: 3486542 - RNA, 14 nt, Pseudomonas aeruginosa PA01
guaguccaucaccg

SEQ ID NO: 3486543 - RNA, 17 nt, Pseudomonas aeruginosa PA01
guagucccagaccaccc

SEQ ID NO: 3486544 - RNA, 23 nt, Pseudomonas aeruginosa PA01
guaguccuccgcgcccaggcgca

SEQ ID NO: 3486545 - RNA, 18 nt, Pseudomonas aeruginosa PA01
guaguccugggccgguug

SEQ ID NO: 3486546 - RNA, 14 nt, Pseudomonas aeruginosa PA01
guagucgacgccgg

SEQ ID NO: 3486547 - RNA, 11 nt, Pseudomonas aeruginosa PA01
guagucgccca

SEQ ID NO: 3486548 - RNA, 14 nt, Pseudomonas aeruginosa PA01
guagucgcccagcg

SEQ ID NO: 3486549 - RNA, 16 nt, Pseudomonas aeruginosa PA01
guagucgcccagcgcc

SEQ ID NO: 3486550 - RNA, 17 nt, Pseudomonas aeruginosa PA01
guagucgcccagcgccu

SEQ ID NO: 3486551 - RNA, 18 nt, Pseudomonas aeruginosa PA01
guagucgcccagcgccug

SEQ ID NO: 3486552 - RNA, 13 nt, Pseudomonas aeruginosa PA01
guagucgccccgg

SEQ ID NO: 3486553 - RNA, 12 nt, Pseudomonas aeruginosa PA01
guagucgcccgg

SEQ ID NO: 3486554 - RNA, 15 nt, Pseudomonas aeruginosa PA01
guagucgcggggcgg

SEQ ID NO: 3486555 - RNA, 17 nt, Pseudomonas aeruginosa PA01
guagucgcugcuggcgc

SEQ ID NO: 3486556 - RNA, 23 nt, Pseudomonas aeruginosa PA01
guagucguucagcgccucgcggg

SEQ ID NO: 3486557 - RNA, 19 nt, Pseudomonas aeruginosa PA01
guagucuucgaugcgccgc

SEQ ID NO: 3486558 - RNA, 22 nt, Pseudomonas aeruginosa PA01
guagucuucgaugcgccgcagg

SEQ ID NO: 3486559 - RNA, 16 nt, Pseudomonas aeruginosa PA01
guagugcaacaccugg

SEQ ID NO: 3486560 - RNA, 15 nt, Pseudomonas aeruginosa PA01
guagugcaucagccu

SEQ ID NO: 3486561 - RNA, 22 nt, Pseudomonas aeruginosa PA01
guagugcaucagccuggccagc

SEQ ID NO: 3486562 - RNA, 13 nt, Pseudomonas aeruginosa PA01
guagugccgcccu

SEQ ID NO: 3486563 - RNA, 16 nt, Pseudomonas aeruginosa PA01
guagugcggcgggcgc

SEQ ID NO: 3486564 - RNA, 15 nt, Pseudomonas aeruginosa PA01
guagugcuccggggc

SEQ ID NO: 3486565 - RNA, 17 nt, Pseudomonas aeruginosa PA01
guagugcuccggggcgc

SEQ ID NO: 3486566 - RNA, 18 nt, Pseudomonas aeruginosa PA01
guagugcuccucgucgua

SEQ ID NO: 3486567 - RNA, 16 nt, Pseudomonas aeruginosa PA01
guagugcucggccagu

SEQ ID NO: 3486568 - RNA, 20 nt, Pseudomonas aeruginosa PA01
guaguggaagccguggcggg

SEQ ID NO: 3486569 - RNA, 19 nt, Pseudomonas aeruginosa PA01
guaguggcuuuucucgccu

SEQ ID NO: 3486570 - RNA, 14 nt, Pseudomonas aeruginosa PA01
guagugggcgaggc

SEQ ID NO: 3486571 - RNA, 19 nt, Pseudomonas aeruginosa PA01
guaguucgaaccguggcgg

SEQ ID NO: 3486572 - RNA, 19 nt, Pseudomonas aeruginosa PA01
guaguucuccaccgccacc

SEQ ID NO: 3486573 - RNA, 17 nt, Pseudomonas aeruginosa PA01
guaguugagccccaggu

SEQ ID NO: 3486574 - RNA, 20 nt, Pseudomonas aeruginosa PA01
guaguugagccccagguagg

SEQ ID NO: 3486575 - RNA, 18 nt, Pseudomonas aeruginosa PA01
guauagcucauggccagg

SEQ ID NO: 3486576 - RNA, 22 nt, Pseudomonas aeruginosa PA01
guauaggagccugcgugagcug

SEQ ID NO: 3486577 - RNA, 23 nt, Pseudomonas aeruginosa PA01
guauaggagccugcgugagcugg

SEQ ID NO: 3486578 - RNA, 23 nt, Pseudomonas aeruginosa PA01
guauaggcgcuggugcugcucca

SEQ ID NO: 3486579 - RNA, 21 nt, Pseudomonas aeruginosa PA01
guauccaagagagcgccagcg

SEQ ID NO: 3486580 - RNA, 18 nt, Pseudomonas aeruginosa PA01
guauccaccggacccggc

SEQ ID NO: 3486581 - RNA, 14 nt, Pseudomonas aeruginosa PA01
guauccaggcgguu

SEQ ID NO: 3486582 - RNA, 13 nt, Pseudomonas aeruginosa PA01
guaucccagcgcg

SEQ ID NO: 3486583 - RNA, 23 nt, Pseudomonas aeruginosa PA01
guaucccagcgcgugcaggcgcc

SEQ ID NO: 3486584 - RNA, 16 nt, Pseudomonas aeruginosa PA01
guaucccggcugagcg

SEQ ID NO: 3486585 - RNA, 22 nt, Pseudomonas aeruginosa PA01
guauccguacuggcgccaggcc

SEQ ID NO: 3486586 - RNA, 19 nt, Pseudomonas aeruginosa PA01
guaucgauccagccggggc

SEQ ID NO: 3486587 - RNA, 14 nt, Pseudomonas aeruginosa PA01
guaucgccguccug

SEQ ID NO: 3486588 - RNA, 11 nt, Pseudomonas aeruginosa PA01
guaucgcgcuu

SEQ ID NO: 3486589 - RNA, 16 nt, Pseudomonas aeruginosa PA01
guaucgcugggcgccu

SEQ ID NO: 3486590 - RNA, 22 nt, Pseudomonas aeruginosa PA01
guaucgcugggcgccucgucga

SEQ ID NO: 3486591 - RNA, 9 nt, Pseudomonas aeruginosa PA01
guaucggcg

SEQ ID NO: 3486592 - RNA, 13 nt, Pseudomonas aeruginosa PA01
guaucggcgcuca

SEQ ID NO: 3486593 - RNA, 20 nt, Pseudomonas aeruginosa PA01
guaucggcguuuagcgcccg

SEQ ID NO: 3486594 - RNA, 19 nt, Pseudomonas aeruginosa PA01
guaucggcuugccggcggc

SEQ ID NO: 3486595 - RNA, 20 nt, Pseudomonas aeruginosa PA01
guaucggcuugccggcggcg

SEQ ID NO: 3486596 - RNA, 15 nt, Pseudomonas aeruginosa PA01
guaugccgcaggcag

SEQ ID NO: 3486597 - RNA, 23 nt, Pseudomonas aeruginosa PA01
guaugccgcaggcaguggcgcca

SEQ ID NO: 3486598 - RNA, 19 nt, Pseudomonas aeruginosa PA01
guaugcgccuccagguaga

SEQ ID NO: 3486599 - RNA, 19 nt, Pseudomonas aeruginosa PA01
guauggccuucgcugaaau

SEQ ID NO: 3486600 - RNA, 24 nt, Pseudomonas aeruginosa PA01
guauggcgggccuugcgaccaggu

SEQ ID NO: 3486601 - RNA, 17 nt, Pseudomonas aeruginosa PA01
guauggcggucggccag

SEQ ID NO: 3486602 - RNA, 19 nt, Pseudomonas aeruginosa PA01
guauggcggucggccaggc

SEQ ID NO: 3486603 - RNA, 20 nt, Pseudomonas aeruginosa PA01
guauggcggucggccaggcg

SEQ ID NO: 3486604 - RNA, 14 nt, Pseudomonas aeruginosa PA01
guauggcugcugug

SEQ ID NO: 3486605 - RNA, 22 nt, Pseudomonas aeruginosa PA01
guauucaucggcggcaggcgca

SEQ ID NO: 3486606 - RNA, 13 nt, Pseudomonas aeruginosa PA01
guauuccaggcga

SEQ ID NO: 3486607 - RNA, 12 nt, Pseudomonas aeruginosa PA01
guauuccagggg

SEQ ID NO: 3486608 - RNA, 24 nt, Pseudomonas aeruginosa PA01
guauucgccgaagauccgcuccag

SEQ ID NO: 3486609 - RNA, 19 nt, Pseudomonas aeruginosa PA01
guauucggcgaccagcccg

SEQ ID NO: 3486610 - RNA, 18 nt, Pseudomonas aeruginosa PA01
guauugcgcccagaguuc

SEQ ID NO: 3486611 - RNA, 21 nt, Pseudomonas aeruginosa PA01
guauuuccccaacaucaaccc

SEQ ID NO: 3486612 - RNA, 16 nt, Pseudomonas aeruginosa PA01
gucaacaccagcgccg

SEQ ID NO: 3486613 - RNA, 17 nt, Pseudomonas aeruginosa PA01
gucaacaccagcgccgc

SEQ ID NO: 3486614 - RNA, 21 nt, Pseudomonas aeruginosa PA01
gucaacccuugcucccgccgc

SEQ ID NO: 3486615 - RNA, 16 nt, Pseudomonas aeruginosa PA01
gucaauaccacccuug

SEQ ID NO: 3486616 - RNA, 13 nt, Pseudomonas aeruginosa PA01
gucaccacccagc

SEQ ID NO: 3486617 - RNA, 19 nt, Pseudomonas aeruginosa PA01
gucaccacccagccgcggc

SEQ ID NO: 3486618 - RNA, 14 nt, Pseudomonas aeruginosa PA01
gucaccacuggaaa

SEQ ID NO: 3486619 - RNA, 19 nt, Pseudomonas aeruginosa PA01
gucaccagcaccacccggc

SEQ ID NO: 3486620 - RNA, 21 nt, Pseudomonas aeruginosa PA01
gucaccagcaccacccggcgc

SEQ ID NO: 3486621 - RNA, 15 nt, Pseudomonas aeruginosa PA01
gucaccagcgugggc

SEQ ID NO: 3486622 - RNA, 23 nt, Pseudomonas aeruginosa PA01
gucaccagcgugggcaacaggcc

SEQ ID NO: 3486623 - RNA, 13 nt, Pseudomonas aeruginosa PA01
gucaccaggguca

SEQ ID NO: 3486624 - RNA, 17 nt, Pseudomonas aeruginosa PA01
gucaccagggucacgcc

SEQ ID NO: 3486625 - RNA, 19 nt, Pseudomonas aeruginosa PA01
gucaccaggucgcggauca

SEQ ID NO: 3486626 - RNA, 14 nt, Pseudomonas aeruginosa PA01
gucaccagguugcc

SEQ ID NO: 3486627 - RNA, 17 nt, Pseudomonas aeruginosa PA01
gucaccaugaucaucgg

SEQ ID NO: 3486628 - RNA, 21 nt, Pseudomonas aeruginosa PA01
gucacccauucgaugccgcgc

SEQ ID NO: 3486629 - RNA, 22 nt, Pseudomonas aeruginosa PA01
gucacccauucgaugccgcgcg

SEQ ID NO: 3486630 - RNA, 14 nt, Pseudomonas aeruginosa PA01
gucaccccgaccag

SEQ ID NO: 3486631 - RNA, 15 nt, Pseudomonas aeruginosa PA01
gucaccccgaccagc

SEQ ID NO: 3486632 - RNA, 16 nt, Pseudomonas aeruginosa PA01
gucaccccgaccagcg

SEQ ID NO: 3486633 - RNA, 18 nt, Pseudomonas aeruginosa PA01
gucaccccgaccagcgcg

SEQ ID NO: 3486634 - RNA, 16 nt, Pseudomonas aeruginosa PA01
gucacccgcgccugca

SEQ ID NO: 3486635 - RNA, 18 nt, Pseudomonas aeruginosa PA01
gucacccgcgccugcagg

SEQ ID NO: 3486636 - RNA, 21 nt, Pseudomonas aeruginosa PA01
gucacccgcgccugcaggucg

SEQ ID NO: 3486637 - RNA, 22 nt, Pseudomonas aeruginosa PA01
gucacccgcgccugcaggucga

SEQ ID NO: 3486638 - RNA, 20 nt, Pseudomonas aeruginosa PA01
gucaccgauugcgcccuccc

SEQ ID NO: 3486639 - RNA, 15 nt, Pseudomonas aeruginosa PA01
gucaccgccagcggg

SEQ ID NO: 3486640 - RNA, 12 nt, Pseudomonas aeruginosa PA01
gucaccgcgccg

SEQ ID NO: 3486641 - RNA, 14 nt, Pseudomonas aeruginosa PA01
gucaccgcgccggu

SEQ ID NO: 3486642 - RNA, 15 nt, Pseudomonas aeruginosa PA01
gucaccgcgucggga

SEQ ID NO: 3486643 - RNA, 14 nt, Pseudomonas aeruginosa PA01
gucaccgcucgcca

SEQ ID NO: 3486644 - RNA, 12 nt, Pseudomonas aeruginosa PA01
gucaccggcagg

SEQ ID NO: 3486645 - RNA, 16 nt, Pseudomonas aeruginosa PA01
gucaccggcagggcga

SEQ ID NO: 3486646 - RNA, 23 nt, Pseudomonas aeruginosa PA01
gucaccguggagaggucgccgac

SEQ ID NO: 3486647 - RNA, 20 nt, Pseudomonas aeruginosa PA01
gucaccguggucauggcgca

SEQ ID NO: 3486648 - RNA, 13 nt, Pseudomonas aeruginosa PA01
gucaccucggcgc

SEQ ID NO: 3486649 - RNA, 16 nt, Pseudomonas aeruginosa PA01
gucaccuguucggcgc

SEQ ID NO: 3486650 - RNA, 17 nt, Pseudomonas aeruginosa PA01
gucaccuguucggcgcu

SEQ ID NO: 3486651 - RNA, 16 nt, Pseudomonas aeruginosa PA01
gucacgaaggcgauca

SEQ ID NO: 3486652 - RNA, 14 nt, Pseudomonas aeruginosa PA01
gucacgcaggcgcu

SEQ ID NO: 3486653 - RNA, 23 nt, Pseudomonas aeruginosa PA01
gucacgcaggcuuuccagcccgg

SEQ ID NO: 3486654 - RNA, 16 nt, Pseudomonas aeruginosa PA01
gucacgccgaaguucu

SEQ ID NO: 3486655 - RNA, 17 nt, Pseudomonas aeruginosa PA01
gucacgccgaggcugcg

SEQ ID NO: 3486656 - RNA, 14 nt, Pseudomonas aeruginosa PA01
gucacgccgagggc

SEQ ID NO: 3486657 - RNA, 16 nt, Pseudomonas aeruginosa PA01
gucacgccgagggcgc

SEQ ID NO: 3486658 - RNA, 21 nt, Pseudomonas aeruginosa PA01
gucacgccgagggcgcggcgc

SEQ ID NO: 3486659 - RNA, 20 nt, Pseudomonas aeruginosa PA01
gucacgccgaucccggcggc

SEQ ID NO: 3486660 - RNA, 13 nt, Pseudomonas aeruginosa PA01
gucacgccgcggc

SEQ ID NO: 3486661 - RNA, 16 nt, Pseudomonas aeruginosa PA01
gucacgcucggcaugg

SEQ ID NO: 3486662 - RNA, 16 nt, Pseudomonas aeruginosa PA01
gucacggacccgcucg

SEQ ID NO: 3486663 - RNA, 20 nt, Pseudomonas aeruginosa PA01
gucacggccuccgguggcgg

SEQ ID NO: 3486664 - RNA, 21 nt, Pseudomonas aeruginosa PA01
gucacggcgaaaccggccagc

SEQ ID NO: 3486665 - RNA, 22 nt, Pseudomonas aeruginosa PA01
gucacggcgaaaccggccagcg

SEQ ID NO: 3486666 - RNA, 15 nt, Pseudomonas aeruginosa PA01
gucacggcgugccgc

SEQ ID NO: 3486667 - RNA, 19 nt, Pseudomonas aeruginosa PA01
gucacggcgugccgcaggc

SEQ ID NO: 3486668 - RNA, 22 nt, Pseudomonas aeruginosa PA01
gucacgguaucccacuuccucg

SEQ ID NO: 3486669 - RNA, 13 nt, Pseudomonas aeruginosa PA01
gucacggucagcu

SEQ ID NO: 3486670 - RNA, 18 nt, Pseudomonas aeruginosa PA01
gucacggucuuggcggcg

SEQ ID NO: 3486671 - RNA, 19 nt, Pseudomonas aeruginosa PA01
gucacggucuuggcggcga

SEQ ID NO: 3486672 - RNA, 19 nt, Pseudomonas aeruginosa PA01
gucacggugacggugcagc

SEQ ID NO: 3486673 - RNA, 18 nt, Pseudomonas aeruginosa PA01
gucacggugaggaccugg

SEQ ID NO: 3486674 - RNA, 16 nt, Pseudomonas aeruginosa PA01
gucacguggccgccca

SEQ ID NO: 3486675 - RNA, 18 nt, Pseudomonas aeruginosa PA01
gucacucccaggcuggcg

SEQ ID NO: 3486676 - RNA, 17 nt, Pseudomonas aeruginosa PA01
gucacucgacaggccau

SEQ ID NO: 3486677 - RNA, 14 nt, Pseudomonas aeruginosa PA01
gucacucggccucg

SEQ ID NO: 3486678 - RNA, 18 nt, Pseudomonas aeruginosa PA01
gucacucggccucggcgu

SEQ ID NO: 3486679 - RNA, 13 nt, Pseudomonas aeruginosa PA01
gucacuggcgagg

SEQ ID NO: 3486680 - RNA, 18 nt, Pseudomonas aeruginosa PA01
gucacuguuuuccauggc

SEQ ID NO: 3486681 - RNA, 19 nt, Pseudomonas aeruginosa PA01
gucacuguuuuccauggcg

SEQ ID NO: 3486682 - RNA, 14 nt, Pseudomonas aeruginosa PA01
gucacuuccuugcg

SEQ ID NO: 3486683 - RNA, 23 nt, Pseudomonas aeruginosa PA01
gucagacacgaaaaagccggcgc

SEQ ID NO: 3486684 - RNA, 16 nt, Pseudomonas aeruginosa PA01
gucagaccagcccugg

SEQ ID NO: 3486685 - RNA, 21 nt, Pseudomonas aeruginosa PA01
gucagagacagguacucggcc

SEQ ID NO: 3486686 - RNA, 17 nt, Pseudomonas aeruginosa PA01
gucagaucugcgauugc

SEQ ID NO: 3486687 - RNA, 18 nt, Pseudomonas aeruginosa PA01
gucagcaacugccaaccg

SEQ ID NO: 3486688 - RNA, 20 nt, Pseudomonas aeruginosa PA01
gucagcaacugccaaccgcg

SEQ ID NO: 3486689 - RNA, 13 nt, Pseudomonas aeruginosa PA01
gucagcaccaggg

SEQ ID NO: 3486690 - RNA, 16 nt, Pseudomonas aeruginosa PA01
gucagcaccagggcca

SEQ ID NO: 3486691 - RNA, 22 nt, Pseudomonas aeruginosa PA01
gucagcaccagggccagggcga

SEQ ID NO: 3486692 - RNA, 16 nt, Pseudomonas aeruginosa PA01
gucagcacgccuucca

SEQ ID NO: 3486693 - RNA, 16 nt, Pseudomonas aeruginosa PA01
gucagcagcagggucg

SEQ ID NO: 3486694 - RNA, 14 nt, Pseudomonas aeruginosa PA01
gucagcaggcugcc

SEQ ID NO: 3486695 - RNA, 13 nt, Pseudomonas aeruginosa PA01
gucagccaccugc

SEQ ID NO: 3486696 - RNA, 16 nt, Pseudomonas aeruginosa PA01
gucagccagccgagca

SEQ ID NO: 3486697 - RNA, 22 nt, Pseudomonas aeruginosa PA01
gucagccagccgagcaacucgg

SEQ ID NO: 3486698 - RNA, 23 nt, Pseudomonas aeruginosa PA01
gucagccagccgagcaacucggc

SEQ ID NO: 3486699 - RNA, 12 nt, Pseudomonas aeruginosa PA01
gucagccaggcu

SEQ ID NO: 3486700 - RNA, 14 nt, Pseudomonas aeruginosa PA01
gucagccaggcugg

SEQ ID NO: 3486701 - RNA, 19 nt, Pseudomonas aeruginosa PA01
gucagccagguucuugaug

SEQ ID NO: 3486702 - RNA, 19 nt, Pseudomonas aeruginosa PA01
gucagcccauacaccaggc

SEQ ID NO: 3486703 - RNA, 23 nt, Pseudomonas aeruginosa PA01
gucagcccauacaccaggccggc

SEQ ID NO: 3486704 - RNA, 21 nt, Pseudomonas aeruginosa PA01
gucagcccguguucggccagc

SEQ ID NO: 3486705 - RNA, 15 nt, Pseudomonas aeruginosa PA01
gucagccgaugcucg

SEQ ID NO: 3486706 - RNA, 17 nt, Pseudomonas aeruginosa PA01
gucagccgaugcucgcg

SEQ ID NO: 3486707 - RNA, 15 nt, Pseudomonas aeruginosa PA01
gucagccgcaggccg

SEQ ID NO: 3486708 - RNA, 15 nt, Pseudomonas aeruginosa PA01
gucagccgcggccgg

SEQ ID NO: 3486709 - RNA, 18 nt, Pseudomonas aeruginosa PA01
gucagccgcggccgggga

SEQ ID NO: 3486710 - RNA, 16 nt, Pseudomonas aeruginosa PA01
gucagcgacuggcccu

SEQ ID NO: 3486711 - RNA, 18 nt, Pseudomonas aeruginosa PA01
gucagcgacuggcccugg

SEQ ID NO: 3486712 - RNA, 16 nt, Pseudomonas aeruginosa PA01
gucagcgaggcgggcg

SEQ ID NO: 3486713 - RNA, 20 nt, Pseudomonas aeruginosa PA01
gucagcgaggcgggcgcgga

SEQ ID NO: 3486714 - RNA, 18 nt, Pseudomonas aeruginosa PA01
gucagcgaguugaccuug

SEQ ID NO: 3486715 - RNA, 13 nt, Pseudomonas aeruginosa PA01
gucagcgccagca

SEQ ID NO: 3486716 - RNA, 18 nt, Pseudomonas aeruginosa PA01
gucagcgccagcaacccg

SEQ ID NO: 3486717 - RNA, 19 nt, Pseudomonas aeruginosa PA01
gucagcgcgccagcacggc

SEQ ID NO: 3486718 - RNA, 14 nt, Pseudomonas aeruginosa PA01
gucagcggcgcagc

SEQ ID NO: 3486719 - RNA, 20 nt, Pseudomonas aeruginosa PA01
gucagcggcgcagccucgcg

SEQ ID NO: 3486720 - RNA, 21 nt, Pseudomonas aeruginosa PA01
gucagcggcgcagccucgcgc

SEQ ID NO: 3486721 - RNA, 22 nt, Pseudomonas aeruginosa PA01
gucagcggcgcagccucgcgcu

SEQ ID NO: 3486722 - RNA, 22 nt, Pseudomonas aeruginosa PA01
gucagcggguuggcuuccagcc

SEQ ID NO: 3486723 - RNA, 18 nt, Pseudomonas aeruginosa PA01
gucagcgguaugccgcag

SEQ ID NO: 3486724 - RNA, 13 nt, Pseudomonas aeruginosa PA01
gucagcucgacag

SEQ ID NO: 3486725 - RNA, 14 nt, Pseudomonas aeruginosa PA01
gucagcuucgccgc

SEQ ID NO: 3486726 - RNA, 17 nt, Pseudomonas aeruginosa PA01
gucagcuucgccgcccu

SEQ ID NO: 3486727 - RNA, 16 nt, Pseudomonas aeruginosa PA01
gucagcuugcccucag

SEQ ID NO: 3486728 - RNA, 16 nt, Pseudomonas aeruginosa PA01
gucaggacagcgugcg

SEQ ID NO: 3486729 - RNA, 19 nt, Pseudomonas aeruginosa PA01
gucaggacagcgugcggcc

SEQ ID NO: 3486730 - RNA, 17 nt, Pseudomonas aeruginosa PA01
gucaggaucacaucgcc

SEQ ID NO: 3486731 - RNA, 20 nt, Pseudomonas aeruginosa PA01
gucaggaucacaucgcccgg

SEQ ID NO: 3486732 - RNA, 23 nt, Pseudomonas aeruginosa PA01
gucaggaucggcgcccagcacca

SEQ ID NO: 3486733 - RNA, 18 nt, Pseudomonas aeruginosa PA01
gucaggcaaucucccccu

SEQ ID NO: 3486734 - RNA, 13 nt, Pseudomonas aeruginosa PA01
gucaggcccugcu

SEQ ID NO: 3486735 - RNA, 16 nt, Pseudomonas aeruginosa PA01
gucaggccgaccagcg

SEQ ID NO: 3486736 - RNA, 20 nt, Pseudomonas aeruginosa PA01
gucaggccgaccagcgccga

SEQ ID NO: 3486737 - RNA, 22 nt, Pseudomonas aeruginosa PA01
gucaggccgaccagcgccgacu

SEQ ID NO: 3486738 - RNA, 22 nt, Pseudomonas aeruginosa PA01
gucaggccgagaaaccgccauc

SEQ ID NO: 3486739 - RNA, 16 nt, Pseudomonas aeruginosa PA01
gucaggccgaggcgcu

SEQ ID NO: 3486740 - RNA, 18 nt, Pseudomonas aeruginosa PA01
gucaggccgaggcgcuuc

SEQ ID NO: 3486741 - RNA, 21 nt, Pseudomonas aeruginosa PA01
gucaggccgaucaccaccagc

SEQ ID NO: 3486742 - RNA, 22 nt, Pseudomonas aeruginosa PA01
gucaggccgaucaccaccagcg

SEQ ID NO: 3486743 - RNA, 13 nt, Pseudomonas aeruginosa PA01
gucaggccgaugg

SEQ ID NO: 3486744 - RNA, 14 nt, Pseudomonas aeruginosa PA01
gucaggccgaugga

SEQ ID NO: 3486745 - RNA, 13 nt, Pseudomonas aeruginosa PA01
gucaggccggcgc

SEQ ID NO: 3486746 - RNA, 18 nt, Pseudomonas aeruginosa PA01
gucaggccuugacgcggg

SEQ ID NO: 3486747 - RNA, 18 nt, Pseudomonas aeruginosa PA01
gucaggccuugcgcggcg

SEQ ID NO: 3486748 - RNA, 19 nt, Pseudomonas aeruginosa PA01
gucaggccuugcgcggcgc

SEQ ID NO: 3486749 - RNA, 21 nt, Pseudomonas aeruginosa PA01
gucaggccuugcgcggcgccg

SEQ ID NO: 3486750 - RNA, 14 nt, Pseudomonas aeruginosa PA01
gucaggcgccagga

SEQ ID NO: 3486751 - RNA, 12 nt, Pseudomonas aeruginosa PA01
gucaggcgcccg

SEQ ID NO: 3486752 - RNA, 13 nt, Pseudomonas aeruginosa PA01
gucaggcgccggc

SEQ ID NO: 3486753 - RNA, 14 nt, Pseudomonas aeruginosa PA01
gucaggcgccggcc

SEQ ID NO: 3486754 - RNA, 12 nt, Pseudomonas aeruginosa PA01
gucaggcgcugg

SEQ ID NO: 3486755 - RNA, 13 nt, Pseudomonas aeruginosa PA01
gucaggcgcuggu

SEQ ID NO: 3486756 - RNA, 18 nt, Pseudomonas aeruginosa PA01
gucaggcucagcucggcg

SEQ ID NO: 3486757 - RNA, 19 nt, Pseudomonas aeruginosa PA01
gucaggcucagcucggcga

SEQ ID NO: 3486758 - RNA, 19 nt, Pseudomonas aeruginosa PA01
gucaggcugacgucgacgc

SEQ ID NO: 3486759 - RNA, 21 nt, Pseudomonas aeruginosa PA01
gucaggcugaucuugccgcug

SEQ ID NO: 3486760 - RNA, 15 nt, Pseudomonas aeruginosa PA01
gucaggcugcgcacc

SEQ ID NO: 3486761 - RNA, 21 nt, Pseudomonas aeruginosa PA01
gucaggcugcgcaccucggcc

SEQ ID NO: 3486762 - RNA, 14 nt, Pseudomonas aeruginosa PA01
gucaggcugcggcg

SEQ ID NO: 3486763 - RNA, 15 nt, Pseudomonas aeruginosa PA01
gucaggcugcggcgg

SEQ ID NO: 3486764 - RNA, 14 nt, Pseudomonas aeruginosa PA01
gucaggcuggcccc

SEQ ID NO: 3486765 - RNA, 19 nt, Pseudomonas aeruginosa PA01
gucaggcuggccccgguga

SEQ ID NO: 3486766 - RNA, 18 nt, Pseudomonas aeruginosa PA01
gucaggcuggugccgcug

SEQ ID NO: 3486767 - RNA, 22 nt, Pseudomonas aeruginosa PA01
gucaggcugguggucaccgcca

SEQ ID NO: 3486768 - RNA, 23 nt, Pseudomonas aeruginosa PA01
gucaggcuguagccucccgccgc

SEQ ID NO: 3486769 - RNA, 19 nt, Pseudomonas aeruginosa PA01
gucagggcuugcgcgccac

SEQ ID NO: 3486770 - RNA, 14 nt, Pseudomonas aeruginosa PA01
gucagggugccgau

SEQ ID NO: 3486771 - RNA, 17 nt, Pseudomonas aeruginosa PA01
gucagggugccgaugga

SEQ ID NO: 3486772 - RNA, 15 nt, Pseudomonas aeruginosa PA01
gucagguacaggcgg

SEQ ID NO: 3486773 - RNA, 20 nt, Pseudomonas aeruginosa PA01
gucagguaggcaucgacgcc

SEQ ID NO: 3486774 - RNA, 23 nt, Pseudomonas aeruginosa PA01
gucagguaggcaucgacgccagc

SEQ ID NO: 3486775 - RNA, 17 nt, Pseudomonas aeruginosa PA01
gucagguauucgccggc

SEQ ID NO: 3486776 - RNA, 18 nt, Pseudomonas aeruginosa PA01
gucagguauucgccggcc

SEQ ID NO: 3486777 - RNA, 22 nt, Pseudomonas aeruginosa PA01
gucagguauucgccggccaggu

SEQ ID NO: 3486778 - RNA, 13 nt, Pseudomonas aeruginosa PA01
gucagguccuugu

SEQ ID NO: 3486779 - RNA, 17 nt, Pseudomonas aeruginosa PA01
gucaggucgacgccgcc

SEQ ID NO: 3486780 - RNA, 21 nt, Pseudomonas aeruginosa PA01
gucaggucgacgccgccgagc

SEQ ID NO: 3486781 - RNA, 15 nt, Pseudomonas aeruginosa PA01
gucaggucguacacg

SEQ ID NO: 3486782 - RNA, 20 nt, Pseudomonas aeruginosa PA01
gucagguugaccuucugucc

SEQ ID NO: 3486783 - RNA, 16 nt, Pseudomonas aeruginosa PA01
gucagguuggacaggu

SEQ ID NO: 3486784 - RNA, 17 nt, Pseudomonas aeruginosa PA01
gucaguuccaggucggc

SEQ ID NO: 3486785 - RNA, 20 nt, Pseudomonas aeruginosa PA01
gucaguuccaggucggcggc

SEQ ID NO: 3486786 - RNA, 13 nt, Pseudomonas aeruginosa PA01
gucaguucggccc

SEQ ID NO: 3486787 - RNA, 20 nt, Pseudomonas aeruginosa PA01
gucaguucggcccagcagcg

SEQ ID NO: 3486788 - RNA, 14 nt, Pseudomonas aeruginosa PA01
gucaguucggugcc

SEQ ID NO: 3486789 - RNA, 18 nt, Pseudomonas aeruginosa PA01
gucaguucggugccgccg

SEQ ID NO: 3486790 - RNA, 21 nt, Pseudomonas aeruginosa PA01
gucaguucggugccgccggcg

SEQ ID NO: 3486791 - RNA, 21 nt, Pseudomonas aeruginosa PA01
gucauagcagcgccgcgccug

SEQ ID NO: 3486792 - RNA, 15 nt, Pseudomonas aeruginosa PA01
gucaucaccggcagg

SEQ ID NO: 3486793 - RNA, 18 nt, Pseudomonas aeruginosa PA01
gucaucaggcucaggccg

SEQ ID NO: 3486794 - RNA, 19 nt, Pseudomonas aeruginosa PA01
gucauccgcccugcgucgc

SEQ ID NO: 3486795 - RNA, 14 nt, Pseudomonas aeruginosa PA01
gucauccgccggcg

SEQ ID NO: 3486796 - RNA, 15 nt, Pseudomonas aeruginosa PA01
gucauccgccggcgc

SEQ ID NO: 3486797 - RNA, 12 nt, Pseudomonas aeruginosa PA01
gucauccgccuu

SEQ ID NO: 3486798 - RNA, 14 nt, Pseudomonas aeruginosa PA01
gucauccuggcccu

SEQ ID NO: 3486799 - RNA, 22 nt, Pseudomonas aeruginosa PA01
gucaucgagcaguuccaggcgu

SEQ ID NO: 3486800 - RNA, 13 nt, Pseudomonas aeruginosa PA01
gucaucgaggcca

SEQ ID NO: 3486801 - RNA, 17 nt, Pseudomonas aeruginosa PA01
gucaucgccggcgccga

SEQ ID NO: 3486802 - RNA, 16 nt, Pseudomonas aeruginosa PA01
gucaucgcgccgccga

SEQ ID NO: 3486803 - RNA, 14 nt, Pseudomonas aeruginosa PA01
gucaucgcugaccu

SEQ ID NO: 3486804 - RNA, 16 nt, Pseudomonas aeruginosa PA01
gucaucggcccgacgc

SEQ ID NO: 3486805 - RNA, 14 nt, Pseudomonas aeruginosa PA01
gucaucguccagcu

SEQ ID NO: 3486806 - RNA, 21 nt, Pseudomonas aeruginosa PA01
gucaugaaggaaaccggccag

SEQ ID NO: 3486807 - RNA, 17 nt, Pseudomonas aeruginosa PA01
gucaugaccagagccgc

SEQ ID NO: 3486808 - RNA, 20 nt, Pseudomonas aeruginosa PA01
gucaugaccagagccgccga

SEQ ID NO: 3486809 - RNA, 23 nt, Pseudomonas aeruginosa PA01
gucaugaccagagccgccgaaca

SEQ ID NO: 3486810 - RNA, 19 nt, Pseudomonas aeruginosa PA01
gucaugaugccuuucgggg

SEQ ID NO: 3486811 - RNA, 17 nt, Pseudomonas aeruginosa PA01
gucaugcacuucgacca

SEQ ID NO: 3486812 - RNA, 12 nt, Pseudomonas aeruginosa PA01
gucaugcccagg

SEQ ID NO: 3486813 - RNA, 15 nt, Pseudomonas aeruginosa PA01
gucaugcccuggccg

SEQ ID NO: 3486814 - RNA, 18 nt, Pseudomonas aeruginosa PA01
gucaugcccuggccgacg

SEQ ID NO: 3486815 - RNA, 19 nt, Pseudomonas aeruginosa PA01
gucaugcccuggccgacgc

SEQ ID NO: 3486816 - RNA, 22 nt, Pseudomonas aeruginosa PA01
gucaugcccuggccgacgcuga

SEQ ID NO: 3486817 - RNA, 22 nt, Pseudomonas aeruginosa PA01
gucaugccgaacuucuccgcca

SEQ ID NO: 3486818 - RNA, 22 nt, Pseudomonas aeruginosa PA01
gucaugccgccaucgaccagga

SEQ ID NO: 3486819 - RNA, 14 nt, Pseudomonas aeruginosa PA01
gucaugccgccguc

SEQ ID NO: 3486820 - RNA, 16 nt, Pseudomonas aeruginosa PA01
gucaugccgucuucga

SEQ ID NO: 3486821 - RNA, 20 nt, Pseudomonas aeruginosa PA01
gucaugcgcccuacgccacc

SEQ ID NO: 3486822 - RNA, 22 nt, Pseudomonas aeruginosa PA01
gucaugcgcccuacgccaccug

SEQ ID NO: 3486823 - RNA, 21 nt, Pseudomonas aeruginosa PA01
gucauggccagcucgaccuug

SEQ ID NO: 3486824 - RNA, 19 nt, Pseudomonas aeruginosa PA01
gucauggccagucaucgcg

SEQ ID NO: 3486825 - RNA, 14 nt, Pseudomonas aeruginosa PA01
gucauggcgggcgu

SEQ ID NO: 3486826 - RNA, 16 nt, Pseudomonas aeruginosa PA01
gucauggugccgagca

SEQ ID NO: 3486827 - RNA, 23 nt, Pseudomonas aeruginosa PA01
gucauggugcguuaccgaaagaa

SEQ ID NO: 3486828 - RNA, 22 nt, Pseudomonas aeruginosa PA01
gucauguuguucgcgcaccuug

SEQ ID NO: 3486829 - RNA, 15 nt, Pseudomonas aeruginosa PA01
gucauuggcgaaguu

SEQ ID NO: 3486830 - RNA, 21 nt, Pseudomonas aeruginosa PA01
gucauuggcgaaguugccgcc

SEQ ID NO: 3486831 - RNA, 18 nt, Pseudomonas aeruginosa PA01
guccaacccauguggcgc

SEQ ID NO: 3486832 - RNA, 21 nt, Pseudomonas aeruginosa PA01
guccaacccauguggcgcagc

SEQ ID NO: 3486833 - RNA, 13 nt, Pseudomonas aeruginosa PA01
guccaccaccagc

SEQ ID NO: 3486834 - RNA, 14 nt, Pseudomonas aeruginosa PA01
guccaccaccagca

SEQ ID NO: 3486835 - RNA, 13 nt, Pseudomonas aeruginosa PA01
guccaccaccgac

SEQ ID NO: 3486836 - RNA, 22 nt, Pseudomonas aeruginosa PA01
guccaccaccgacgggucgcca

SEQ ID NO: 3486837 - RNA, 22 nt, Pseudomonas aeruginosa PA01
guccaccaccgggggaagaacc

SEQ ID NO: 3486838 - RNA, 21 nt, Pseudomonas aeruginosa PA01
guccaccagccagcucggcga

SEQ ID NO: 3486839 - RNA, 20 nt, Pseudomonas aeruginosa PA01
guccaccagccaguagucuu

SEQ ID NO: 3486840 - RNA, 14 nt, Pseudomonas aeruginosa PA01
guccaccagcgccc

SEQ ID NO: 3486841 - RNA, 16 nt, Pseudomonas aeruginosa PA01
guccaccagcgcccgu

SEQ ID NO: 3486842 - RNA, 16 nt, Pseudomonas aeruginosa PA01
guccaccaggcgccgg

SEQ ID NO: 3486843 - RNA, 17 nt, Pseudomonas aeruginosa PA01
guccaccaggcgccggg

SEQ ID NO: 3486844 - RNA, 20 nt, Pseudomonas aeruginosa PA01
guccaccaggcgccgggucg

SEQ ID NO: 3486845 - RNA, 17 nt, Pseudomonas aeruginosa PA01
guccaccgaguggcgca

SEQ ID NO: 3486846 - RNA, 23 nt, Pseudomonas aeruginosa PA01
guccaccgaguggcgcagcgccc

SEQ ID NO: 3486847 - RNA, 13 nt, Pseudomonas aeruginosa PA01
guccaccgccgcc

SEQ ID NO: 3486848 - RNA, 18 nt, Pseudomonas aeruginosa PA01
guccaccgccgccagcaa

SEQ ID NO: 3486849 - RNA, 19 nt, Pseudomonas aeruginosa PA01
guccaccgccgccagcaac

SEQ ID NO: 3486850 - RNA, 21 nt, Pseudomonas aeruginosa PA01
guccaccgccgccagcaacag

SEQ ID NO: 3486851 - RNA, 16 nt, Pseudomonas aeruginosa PA01
guccaccgcggccucg

SEQ ID NO: 3486852 - RNA, 21 nt, Pseudomonas aeruginosa PA01
guccaccgcggccucgcuggc

SEQ ID NO: 3486853 - RNA, 14 nt, Pseudomonas aeruginosa PA01
guccaccuccaccu

SEQ ID NO: 3486854 - RNA, 16 nt, Pseudomonas aeruginosa PA01
guccaccuggcggcug

SEQ ID NO: 3486855 - RNA, 16 nt, Pseudomonas aeruginosa PA01
guccacgacgaacggc

SEQ ID NO: 3486856 - RNA, 21 nt, Pseudomonas aeruginosa PA01
guccacgccauaggcggcgca

SEQ ID NO: 3486857 - RNA, 20 nt, Pseudomonas aeruginosa PA01
guccacgccgaagucggcga

SEQ ID NO: 3486858 - RNA, 22 nt, Pseudomonas aeruginosa PA01
guccacgccgaagucggcgagc

SEQ ID NO: 3486859 - RNA, 16 nt, Pseudomonas aeruginosa PA01
guccacggagaagcgu

SEQ ID NO: 3486860 - RNA, 20 nt, Pseudomonas aeruginosa PA01
guccacggagaagcguccga

SEQ ID NO: 3486861 - RNA, 22 nt, Pseudomonas aeruginosa PA01
guccacggagaagcguccgagg

SEQ ID NO: 3486862 - RNA, 22 nt, Pseudomonas aeruginosa PA01
guccacgucguaggccgagccc

SEQ ID NO: 3486863 - RNA, 17 nt, Pseudomonas aeruginosa PA01
guccacguugagcauca

SEQ ID NO: 3486864 - RNA, 21 nt, Pseudomonas aeruginosa PA01
guccacguugagcaucaccgc

SEQ ID NO: 3486865 - RNA, 14 nt, Pseudomonas aeruginosa PA01
guccacuccggcag

SEQ ID NO: 3486866 - RNA, 22 nt, Pseudomonas aeruginosa PA01
guccacuccggcagcacccgca

SEQ ID NO: 3486867 - RNA, 19 nt, Pseudomonas aeruginosa PA01
guccacuggcccacggcgc

SEQ ID NO: 3486868 - RNA, 17 nt, Pseudomonas aeruginosa PA01
guccacugucucgccga

SEQ ID NO: 3486869 - RNA, 19 nt, Pseudomonas aeruginosa PA01
guccacugucucgccgaug

SEQ ID NO: 3486870 - RNA, 23 nt, Pseudomonas aeruginosa PA01
guccagaucgccaccccgccgcu

SEQ ID NO: 3486871 - RNA, 17 nt, Pseudomonas aeruginosa PA01
guccagcaaggugcggg

SEQ ID NO: 3486872 - RNA, 19 nt, Pseudomonas aeruginosa PA01
guccagcaaggugcgggcg

SEQ ID NO: 3486873 - RNA, 20 nt, Pseudomonas aeruginosa PA01
guccagcaaggugcgggcga

SEQ ID NO: 3486874 - RNA, 17 nt, Pseudomonas aeruginosa PA01
guccagcacgcuggcga

SEQ ID NO: 3486875 - RNA, 18 nt, Pseudomonas aeruginosa PA01
guccagcacgcuggcgag

SEQ ID NO: 3486876 - RNA, 14 nt, Pseudomonas aeruginosa PA01
guccagcacgguga

SEQ ID NO: 3486877 - RNA, 20 nt, Pseudomonas aeruginosa PA01
guccagcacggugaaccagg

SEQ ID NO: 3486878 - RNA, 16 nt, Pseudomonas aeruginosa PA01
guccagcaggcccagc

SEQ ID NO: 3486879 - RNA, 16 nt, Pseudomonas aeruginosa PA01
guccagcagguggcgc

SEQ ID NO: 3486880 - RNA, 15 nt, Pseudomonas aeruginosa PA01
guccagccagccgcc

SEQ ID NO: 3486881 - RNA, 15 nt, Pseudomonas aeruginosa PA01
guccagccagugcau

SEQ ID NO: 3486882 - RNA, 18 nt, Pseudomonas aeruginosa PA01
guccagccagugcaugcg

SEQ ID NO: 3486883 - RNA, 18 nt, Pseudomonas aeruginosa PA01
guccagccaguggcuggc

SEQ ID NO: 3486884 - RNA, 12 nt, Pseudomonas aeruginosa PA01
guccagccgccg

SEQ ID NO: 3486885 - RNA, 14 nt, Pseudomonas aeruginosa PA01
guccagccgccgcu

SEQ ID NO: 3486886 - RNA, 17 nt, Pseudomonas aeruginosa PA01
guccagccgccgcugca

SEQ ID NO: 3486887 - RNA, 13 nt, Pseudomonas aeruginosa PA01
guccagccggcgc

SEQ ID NO: 3486888 - RNA, 19 nt, Pseudomonas aeruginosa PA01
guccagccggcgcuucugc

SEQ ID NO: 3486889 - RNA, 19 nt, Pseudomonas aeruginosa PA01
guccagccgguaggggccg

SEQ ID NO: 3486890 - RNA, 22 nt, Pseudomonas aeruginosa PA01
guccagccgguaggggccgacg

SEQ ID NO: 3486891 - RNA, 23 nt, Pseudomonas aeruginosa PA01
guccagccgguaggggccgacga

SEQ ID NO: 3486892 - RNA, 16 nt, Pseudomonas aeruginosa PA01
guccagcgagcgggcg

SEQ ID NO: 3486893 - RNA, 18 nt, Pseudomonas aeruginosa PA01
guccagcgagcgggcgag

SEQ ID NO: 3486894 - RNA, 21 nt, Pseudomonas aeruginosa PA01
guccagcgaggcguggaaggg

SEQ ID NO: 3486895 - RNA, 12 nt, Pseudomonas aeruginosa PA01
guccagcgccga

SEQ ID NO: 3486896 - RNA, 14 nt, Pseudomonas aeruginosa PA01
guccagcgccgcgc

SEQ ID NO: 3486897 - RNA, 14 nt, Pseudomonas aeruginosa PA01
guccagcgcgcccg

SEQ ID NO: 3486898 - RNA, 19 nt, Pseudomonas aeruginosa PA01
guccagcgcgcccggcgcc

SEQ ID NO: 3486899 - RNA, 14 nt, Pseudomonas aeruginosa PA01
guccagcgcgccgc

SEQ ID NO: 3486900 - RNA, 15 nt, Pseudomonas aeruginosa PA01
guccagcgcgccgcg

SEQ ID NO: 3486901 - RNA, 22 nt, Pseudomonas aeruginosa PA01
guccagcgcuccuugcgccagg

SEQ ID NO: 3486902 - RNA, 23 nt, Pseudomonas aeruginosa PA01
guccagcgcuugaacgcgcgccu

SEQ ID NO: 3486903 - RNA, 11 nt, Pseudomonas aeruginosa PA01
guccagcggcc

SEQ ID NO: 3486904 - RNA, 15 nt, Pseudomonas aeruginosa PA01
guccagcggccgcgc

SEQ ID NO: 3486905 - RNA, 14 nt, Pseudomonas aeruginosa PA01
guccagcgggccca

SEQ ID NO: 3486906 - RNA, 19 nt, Pseudomonas aeruginosa PA01
guccagcgggcccauggcg

SEQ ID NO: 3486907 - RNA, 18 nt, Pseudomonas aeruginosa PA01
guccagcgguaccagcag

SEQ ID NO: 3486908 - RNA, 19 nt, Pseudomonas aeruginosa PA01
guccagcgguaccagcagc

SEQ ID NO: 3486909 - RNA, 17 nt, Pseudomonas aeruginosa PA01
guccagcuccaccaggc

SEQ ID NO: 3486910 - RNA, 19 nt, Pseudomonas aeruginosa PA01
guccagcuccaccaggcca

SEQ ID NO: 3486911 - RNA, 13 nt, Pseudomonas aeruginosa PA01
guccagcuccucg

SEQ ID NO: 3486912 - RNA, 14 nt, Pseudomonas aeruginosa PA01
guccagcuccucga

SEQ ID NO: 3486913 - RNA, 13 nt, Pseudomonas aeruginosa PA01
guccagcucggcc

SEQ ID NO: 3486914 - RNA, 21 nt, Pseudomonas aeruginosa PA01
guccagcucggccaucagcgc

SEQ ID NO: 3486915 - RNA, 23 nt, Pseudomonas aeruginosa PA01
guccagcucggccaucagcgcca

SEQ ID NO: 3486916 - RNA, 19 nt, Pseudomonas aeruginosa PA01
guccagcucggucagcggc

SEQ ID NO: 3486917 - RNA, 13 nt, Pseudomonas aeruginosa PA01
guccagcuggcgc

SEQ ID NO: 3486918 - RNA, 14 nt, Pseudomonas aeruginosa PA01
guccaggccgcagg

SEQ ID NO: 3486919 - RNA, 21 nt, Pseudomonas aeruginosa PA01
guccaggcgccagagcgcgcu

SEQ ID NO: 3486920 - RNA, 13 nt, Pseudomonas aeruginosa PA01
guccaggcgcugc

SEQ ID NO: 3486921 - RNA, 14 nt, Pseudomonas aeruginosa PA01
guccaggcgcugcu

SEQ ID NO: 3486922 - RNA, 19 nt, Pseudomonas aeruginosa PA01
guccaggcgggccagcugg

SEQ ID NO: 3486923 - RNA, 17 nt, Pseudomonas aeruginosa PA01
guccaggcgucggcgcc

SEQ ID NO: 3486924 - RNA, 20 nt, Pseudomonas aeruginosa PA01
guccaggcugaguucgucga

SEQ ID NO: 3486925 - RNA, 16 nt, Pseudomonas aeruginosa PA01
guccaggcugccgccu

SEQ ID NO: 3486926 - RNA, 16 nt, Pseudomonas aeruginosa PA01
guccaggcuguggcgc

SEQ ID NO: 3486927 - RNA, 19 nt, Pseudomonas aeruginosa PA01
guccaggcuguggcgcggc

SEQ ID NO: 3486928 - RNA, 20 nt, Pseudomonas aeruginosa PA01
guccaggcuguggcgcggcu

SEQ ID NO: 3486929 - RNA, 19 nt, Pseudomonas aeruginosa PA01
guccagggcauccaucgcc

SEQ ID NO: 3486930 - RNA, 20 nt, Pseudomonas aeruginosa PA01
guccagggccggaucggccu

SEQ ID NO: 3486931 - RNA, 17 nt, Pseudomonas aeruginosa PA01
guccagggcgaaccacu

SEQ ID NO: 3486932 - RNA, 22 nt, Pseudomonas aeruginosa PA01
guccagggcgaaccacucggcg

SEQ ID NO: 3486933 - RNA, 14 nt, Pseudomonas aeruginosa PA01
guccaggggccgau

SEQ ID NO: 3486934 - RNA, 19 nt, Pseudomonas aeruginosa PA01
guccagggucuucagugca

SEQ ID NO: 3486935 - RNA, 22 nt, Pseudomonas aeruginosa PA01
guccaggguuuccugguacucg

SEQ ID NO: 3486936 - RNA, 16 nt, Pseudomonas aeruginosa PA01
guccagguacaccagg

SEQ ID NO: 3486937 - RNA, 17 nt, Pseudomonas aeruginosa PA01
guccagguacaccaggg

SEQ ID NO: 3486938 - RNA, 20 nt, Pseudomonas aeruginosa PA01
guccagguacaccagggugg

SEQ ID NO: 3486939 - RNA, 23 nt, Pseudomonas aeruginosa PA01
guccagguacaccaggguggcgc

SEQ ID NO: 3486940 - RNA, 16 nt, Pseudomonas aeruginosa PA01
guccaggucaugcccu

SEQ ID NO: 3486941 - RNA, 16 nt, Pseudomonas aeruginosa PA01
guccaggucgcggagc

SEQ ID NO: 3486942 - RNA, 13 nt, Pseudomonas aeruginosa PA01
guccaggugcggc

SEQ ID NO: 3486943 - RNA, 17 nt, Pseudomonas aeruginosa PA01
guccagguugugcucga

SEQ ID NO: 3486944 - RNA, 16 nt, Pseudomonas aeruginosa PA01
guccaguagcgccugg

SEQ ID NO: 3486945 - RNA, 16 nt, Pseudomonas aeruginosa PA01
guccaguucagggcca

SEQ ID NO: 3486946 - RNA, 17 nt, Pseudomonas aeruginosa PA01
guccaguucagggcgag

SEQ ID NO: 3486947 - RNA, 18 nt, Pseudomonas aeruginosa PA01
guccaguucagggcgagc

SEQ ID NO: 3486948 - RNA, 19 nt, Pseudomonas aeruginosa PA01
guccaguucuuccaccgug

SEQ ID NO: 3486949 - RNA, 15 nt, Pseudomonas aeruginosa PA01
guccaucaccgcggu

SEQ ID NO: 3486950 - RNA, 19 nt, Pseudomonas aeruginosa PA01
guccaucaccgcgguuggc

SEQ ID NO: 3486951 - RNA, 16 nt, Pseudomonas aeruginosa PA01
guccaucagccgcgcg

SEQ ID NO: 3486952 - RNA, 20 nt, Pseudomonas aeruginosa PA01
guccaucagccgcgcgcugg

SEQ ID NO: 3486953 - RNA, 21 nt, Pseudomonas aeruginosa PA01
guccaucagccgcgcgcugga

SEQ ID NO: 3486954 - RNA, 18 nt, Pseudomonas aeruginosa PA01
guccaucccugcuucgac

SEQ ID NO: 3486955 - RNA, 21 nt, Pseudomonas aeruginosa PA01
guccaucccugcuucgaccag

SEQ ID NO: 3486956 - RNA, 23 nt, Pseudomonas aeruginosa PA01
guccaucccugcuucgaccaggg

SEQ ID NO: 3486957 - RNA, 20 nt, Pseudomonas aeruginosa PA01
guccaucccuucgugcuggc

SEQ ID NO: 3486958 - RNA, 23 nt, Pseudomonas aeruginosa PA01
guccaucccuucgugcuggcgga

SEQ ID NO: 3486959 - RNA, 17 nt, Pseudomonas aeruginosa PA01
guccaucgccaggccau

SEQ ID NO: 3486960 - RNA, 13 nt, Pseudomonas aeruginosa PA01
guccaucgccgcg

SEQ ID NO: 3486961 - RNA, 14 nt, Pseudomonas aeruginosa PA01
guccaucgccgcgg

SEQ ID NO: 3486962 - RNA, 18 nt, Pseudomonas aeruginosa PA01
guccaucguucaguugcc

SEQ ID NO: 3486963 - RNA, 21 nt, Pseudomonas aeruginosa PA01
guccaucguucaguugccucu

SEQ ID NO: 3486964 - RNA, 14 nt, Pseudomonas aeruginosa PA01
guccaucucgccgc

SEQ ID NO: 3486965 - RNA, 19 nt, Pseudomonas aeruginosa PA01
guccaucuguaccaccgcc

SEQ ID NO: 3486966 - RNA, 14 nt, Pseudomonas aeruginosa PA01
gucccacaggccgg

SEQ ID NO: 3486967 - RNA, 16 nt, Pseudomonas aeruginosa PA01
gucccagaaggccagg

SEQ ID NO: 3486968 - RNA, 17 nt, Pseudomonas aeruginosa PA01
gucccagaccacccggc

SEQ ID NO: 3486969 - RNA, 15 nt, Pseudomonas aeruginosa PA01
gucccagaccagcag

SEQ ID NO: 3486970 - RNA, 20 nt, Pseudomonas aeruginosa PA01
gucccagaccagcagcggca

SEQ ID NO: 3486971 - RNA, 22 nt, Pseudomonas aeruginosa PA01
gucccagucggcguccgccucg

SEQ ID NO: 3486972 - RNA, 17 nt, Pseudomonas aeruginosa PA01
gucccaguucaacugga

SEQ ID NO: 3486973 - RNA, 16 nt, Pseudomonas aeruginosa PA01
gucccaucacggcccc

SEQ ID NO: 3486974 - RNA, 16 nt, Pseudomonas aeruginosa PA01
gucccaucagcagucc

SEQ ID NO: 3486975 - RNA, 17 nt, Pseudomonas aeruginosa PA01
gucccaucagcaguccg

SEQ ID NO: 3486976 - RNA, 18 nt, Pseudomonas aeruginosa PA01
gucccauuccucggcguc

SEQ ID NO: 3486977 - RNA, 17 nt, Pseudomonas aeruginosa PA01
gucccauugcaucugcg

SEQ ID NO: 3486978 - RNA, 21 nt, Pseudomonas aeruginosa PA01
gucccauugcaucugcgccgg

SEQ ID NO: 3486979 - RNA, 13 nt, Pseudomonas aeruginosa PA01
guccccggccagc

SEQ ID NO: 3486980 - RNA, 19 nt, Pseudomonas aeruginosa PA01
guccccucacggcgcgaga

SEQ ID NO: 3486981 - RNA, 15 nt, Pseudomonas aeruginosa PA01
guccccuuccuccuc

SEQ ID NO: 3486982 - RNA, 17 nt, Pseudomonas aeruginosa PA01
guccccuuccuccucgc

SEQ ID NO: 3486983 - RNA, 20 nt, Pseudomonas aeruginosa PA01
guccccuuccuccucgccgc

SEQ ID NO: 3486984 - RNA, 21 nt, Pseudomonas aeruginosa PA01
guccccuuccuccucgccgcu

SEQ ID NO: 3486985 - RNA, 23 nt, Pseudomonas aeruginosa PA01
guccccuuccuccucgccgcucc

SEQ ID NO: 3486986 - RNA, 18 nt, Pseudomonas aeruginosa PA01
gucccgaaaggggcucga

SEQ ID NO: 3486987 - RNA, 15 nt, Pseudomonas aeruginosa PA01
gucccgagcaccggc

SEQ ID NO: 3486988 - RNA, 16 nt, Pseudomonas aeruginosa PA01
gucccgauuccgcgca

SEQ ID NO: 3486989 - RNA, 17 nt, Pseudomonas aeruginosa PA01
gucccgcaaagcccgcu

SEQ ID NO: 3486990 - RNA, 21 nt, Pseudomonas aeruginosa PA01
gucccgcaaagcccgcuccgc

SEQ ID NO: 3486991 - RNA, 14 nt, Pseudomonas aeruginosa PA01
gucccgcaguagcu

SEQ ID NO: 3486992 - RNA, 19 nt, Pseudomonas aeruginosa PA01
gucccgccaggcgccgauc

SEQ ID NO: 3486993 - RNA, 13 nt, Pseudomonas aeruginosa PA01
gucccgccgcgcc

SEQ ID NO: 3486994 - RNA, 14 nt, Pseudomonas aeruginosa PA01
gucccgcgcgccga

SEQ ID NO: 3486995 - RNA, 17 nt, Pseudomonas aeruginosa PA01
gucccgcgcgccgagcc

SEQ ID NO: 3486996 - RNA, 12 nt, Pseudomonas aeruginosa PA01
gucccgcgcggc

SEQ ID NO: 3486997 - RNA, 15 nt, Pseudomonas aeruginosa PA01
gucccgcgcggcccu

SEQ ID NO: 3486998 - RNA, 15 nt, Pseudomonas aeruginosa PA01
gucccgcuccagccg

SEQ ID NO: 3486999 - RNA, 17 nt, Pseudomonas aeruginosa PA01
gucccgcuccagccggc

SEQ ID NO: 3487000 - RNA, 19 nt, Pseudomonas aeruginosa PA01
gucccgcuccagccggcaa

SEQ ID NO: 3487001 - RNA, 22 nt, Pseudomonas aeruginosa PA01
gucccggacgacgaaagaagcc

SEQ ID NO: 3487002 - RNA, 19 nt, Pseudomonas aeruginosa PA01
gucccggccauuccuucca

SEQ ID NO: 3487003 - RNA, 20 nt, Pseudomonas aeruginosa PA01
gucccggccauuccuuccag

SEQ ID NO: 3487004 - RNA, 15 nt, Pseudomonas aeruginosa PA01
gucccggcuugccgg

SEQ ID NO: 3487005 - RNA, 19 nt, Pseudomonas aeruginosa PA01
gucccggcuugccggcagc

SEQ ID NO: 3487006 - RNA, 20 nt, Pseudomonas aeruginosa PA01
gucccggcuugccggcagcg

SEQ ID NO: 3487007 - RNA, 20 nt, Pseudomonas aeruginosa PA01
gucccgggaaaccaccagga

SEQ ID NO: 3487008 - RNA, 23 nt, Pseudomonas aeruginosa PA01
gucccggguguccuuugccugau

SEQ ID NO: 3487009 - RNA, 15 nt, Pseudomonas aeruginosa PA01
gucccugaccagcag

SEQ ID NO: 3487010 - RNA, 16 nt, Pseudomonas aeruginosa PA01
gucccugaccagcagg

SEQ ID NO: 3487011 - RNA, 17 nt, Pseudomonas aeruginosa PA01
gucccugaccagcaggg

SEQ ID NO: 3487012 - RNA, 16 nt, Pseudomonas aeruginosa PA01
gucccugccaggggcu

SEQ ID NO: 3487013 - RNA, 15 nt, Pseudomonas aeruginosa PA01
gucccuggagcaggg

SEQ ID NO: 3487014 - RNA, 16 nt, Pseudomonas aeruginosa PA01
gucccuggagcagggc

SEQ ID NO: 3487015 - RNA, 18 nt, Pseudomonas aeruginosa PA01
gucccuggagcagggcga

SEQ ID NO: 3487016 - RNA, 12 nt, Pseudomonas aeruginosa PA01
gucccuggccgg

SEQ ID NO: 3487017 - RNA, 14 nt, Pseudomonas aeruginosa PA01
gucccuggccggcg

SEQ ID NO: 3487018 - RNA, 15 nt, Pseudomonas aeruginosa PA01
gucccugggccaugu

SEQ ID NO: 3487019 - RNA, 16 nt, Pseudomonas aeruginosa PA01
gucccugggccugcag

SEQ ID NO: 3487020 - RNA, 17 nt, Pseudomonas aeruginosa PA01
gucccugggccugcagg

SEQ ID NO: 3487021 - RNA, 18 nt, Pseudomonas aeruginosa PA01
gucccugggccugcaggu

SEQ ID NO: 3487022 - RNA, 15 nt, Pseudomonas aeruginosa PA01
gucccugggcgcagg

SEQ ID NO: 3487023 - RNA, 16 nt, Pseudomonas aeruginosa PA01
gucccugggcgcaggg

SEQ ID NO: 3487024 - RNA, 17 nt, Pseudomonas aeruginosa PA01
gucccugggcgcagggg

SEQ ID NO: 3487025 - RNA, 23 nt, Pseudomonas aeruginosa PA01
gucccugucccgccgcgccgcuc

SEQ ID NO: 3487026 - RNA, 20 nt, Pseudomonas aeruginosa PA01
gucccuuccccgauccuucg

SEQ ID NO: 3487027 - RNA, 23 nt, Pseudomonas aeruginosa PA01
guccgaacagaggaaggcgccgg

SEQ ID NO: 3487028 - RNA, 21 nt, Pseudomonas aeruginosa PA01
guccgaacagggcgaaggcca

SEQ ID NO: 3487029 - RNA, 16 nt, Pseudomonas aeruginosa PA01
guccgacaaucagcgg

SEQ ID NO: 3487030 - RNA, 17 nt, Pseudomonas aeruginosa PA01
guccgacagcaggucgu

SEQ ID NO: 3487031 - RNA, 15 nt, Pseudomonas aeruginosa PA01
guccgaccauuuccc

SEQ ID NO: 3487032 - RNA, 16 nt, Pseudomonas aeruginosa PA01
guccgagaccggcagc

SEQ ID NO: 3487033 - RNA, 20 nt, Pseudomonas aeruginosa PA01
guccgagaccggcagccggg

SEQ ID NO: 3487034 - RNA, 15 nt, Pseudomonas aeruginosa PA01
guccgagagcagggc

SEQ ID NO: 3487035 - RNA, 14 nt, Pseudomonas aeruginosa PA01
guccgagcaggucg

SEQ ID NO: 3487036 - RNA, 21 nt, Pseudomonas aeruginosa PA01
guccgagguggcugaagcccc

SEQ ID NO: 3487037 - RNA, 17 nt, Pseudomonas aeruginosa PA01
guccgaugucguugcgc

SEQ ID NO: 3487038 - RNA, 19 nt, Pseudomonas aeruginosa PA01
guccgauucuuggcucggc

SEQ ID NO: 3487039 - RNA, 20 nt, Pseudomonas aeruginosa PA01
guccgcaccguagcggcugc

SEQ ID NO: 3487040 - RNA, 21 nt, Pseudomonas aeruginosa PA01
guccgcaccguagcggcugcg

SEQ ID NO: 3487041 - RNA, 14 nt, Pseudomonas aeruginosa PA01
guccgcagcacagc

SEQ ID NO: 3487042 - RNA, 23 nt, Pseudomonas aeruginosa PA01
guccgcagcgccacuuccagcuu

SEQ ID NO: 3487043 - RNA, 19 nt, Pseudomonas aeruginosa PA01
guccgcaguucgccccgcc

SEQ ID NO: 3487044 - RNA, 15 nt, Pseudomonas aeruginosa PA01
guccgcaguugaggc

SEQ ID NO: 3487045 - RNA, 15 nt, Pseudomonas aeruginosa PA01
guccgccaccacggc

SEQ ID NO: 3487046 - RNA, 18 nt, Pseudomonas aeruginosa PA01
guccgccacuucaagcug

SEQ ID NO: 3487047 - RNA, 15 nt, Pseudomonas aeruginosa PA01
guccgccagcaggcg

SEQ ID NO: 3487048 - RNA, 14 nt, Pseudomonas aeruginosa PA01
guccgccagccggc

SEQ ID NO: 3487049 - RNA, 16 nt, Pseudomonas aeruginosa PA01
guccgccagccggcug

SEQ ID NO: 3487050 - RNA, 19 nt, Pseudomonas aeruginosa PA01
guccgccagguccaggcuc

SEQ ID NO: 3487051 - RNA, 20 nt, Pseudomonas aeruginosa PA01
guccgcccaguucgccggcc

SEQ ID NO: 3487052 - RNA, 23 nt, Pseudomonas aeruginosa PA01
guccgcccaguucgccggccagc

SEQ ID NO: 3487053 - RNA, 22 nt, Pseudomonas aeruginosa PA01
guccgcccuuuuucgucgccag

SEQ ID NO: 3487054 - RNA, 11 nt, Pseudomonas aeruginosa PA01
guccgccgagg

SEQ ID NO: 3487055 - RNA, 20 nt, Pseudomonas aeruginosa PA01
guccgccgaggugcugcacc

SEQ ID NO: 3487056 - RNA, 22 nt, Pseudomonas aeruginosa PA01
guccgccgaggugcugcaccgg

SEQ ID NO: 3487057 - RNA, 16 nt, Pseudomonas aeruginosa PA01
guccgccgccgcggcg

SEQ ID NO: 3487058 - RNA, 21 nt, Pseudomonas aeruginosa PA01
guccgccggguccaccgcggc

SEQ ID NO: 3487059 - RNA, 22 nt, Pseudomonas aeruginosa PA01
guccgccggucaccacuggaaa

SEQ ID NO: 3487060 - RNA, 18 nt, Pseudomonas aeruginosa PA01
guccgccugguccagcag

SEQ ID NO: 3487061 - RNA, 12 nt, Pseudomonas aeruginosa PA01
guccgcgaugcg

SEQ ID NO: 3487062 - RNA, 23 nt, Pseudomonas aeruginosa PA01
guccgcgcaggcggucgccgaac

SEQ ID NO: 3487063 - RNA, 15 nt, Pseudomonas aeruginosa PA01
guccgcgccacgcag

SEQ ID NO: 3487064 - RNA, 18 nt, Pseudomonas aeruginosa PA01
guccgcgccaugccggcg

SEQ ID NO: 3487065 - RNA, 20 nt, Pseudomonas aeruginosa PA01
guccgcgccaugccggcgcc

SEQ ID NO: 3487066 - RNA, 13 nt, Pseudomonas aeruginosa PA01
guccgcgccgcgc

SEQ ID NO: 3487067 - RNA, 23 nt, Pseudomonas aeruginosa PA01
guccgcgccgcgcguucgcgcga

SEQ ID NO: 3487068 - RNA, 20 nt, Pseudomonas aeruginosa PA01
guccgcgccgcgucgccgcc

SEQ ID NO: 3487069 - RNA, 23 nt, Pseudomonas aeruginosa PA01
guccgcgccgcgucgccgccagc

SEQ ID NO: 3487070 - RNA, 22 nt, Pseudomonas aeruginosa PA01
guccgcgccucgcgcaacgccg

SEQ ID NO: 3487071 - RNA, 14 nt, Pseudomonas aeruginosa PA01
guccgcgcgcgcgc

SEQ ID NO: 3487072 - RNA, 15 nt, Pseudomonas aeruginosa PA01
guccgcgcgcgcgcu

SEQ ID NO: 3487073 - RNA, 16 nt, Pseudomonas aeruginosa PA01
guccgcgcgcuuccag

SEQ ID NO: 3487074 - RNA, 20 nt, Pseudomonas aeruginosa PA01
guccgcgcgcuuccaggcac

SEQ ID NO: 3487075 - RNA, 19 nt, Pseudomonas aeruginosa PA01
guccgcuggccugcagcag

SEQ ID NO: 3487076 - RNA, 16 nt, Pseudomonas aeruginosa PA01
guccgcuucagcgcgc

SEQ ID NO: 3487077 - RNA, 17 nt, Pseudomonas aeruginosa PA01
guccgcuucagcgcgcc

SEQ ID NO: 3487078 - RNA, 19 nt, Pseudomonas aeruginosa PA01
guccgcuucagcgcgccga

SEQ ID NO: 3487079 - RNA, 20 nt, Pseudomonas aeruginosa PA01
guccgcuucagcgcgccgag

SEQ ID NO: 3487080 - RNA, 23 nt, Pseudomonas aeruginosa PA01
guccgcuucagcgcgccgagcca

SEQ ID NO: 3487081 - RNA, 18 nt, Pseudomonas aeruginosa PA01
guccggaccgggcggcag

SEQ ID NO: 3487082 - RNA, 17 nt, Pseudomonas aeruginosa PA01
guccggagugaugccga

SEQ ID NO: 3487083 - RNA, 15 nt, Pseudomonas aeruginosa PA01
guccggauugccgcg

SEQ ID NO: 3487084 - RNA, 23 nt, Pseudomonas aeruginosa PA01
guccggcaccaccagcgcgcgcu

SEQ ID NO: 3487085 - RNA, 21 nt, Pseudomonas aeruginosa PA01
guccggcaccgcucugcagug

SEQ ID NO: 3487086 - RNA, 13 nt, Pseudomonas aeruginosa PA01
guccggcacuucc

SEQ ID NO: 3487087 - RNA, 13 nt, Pseudomonas aeruginosa PA01
guccggcagcacg

SEQ ID NO: 3487088 - RNA, 17 nt, Pseudomonas aeruginosa PA01
guccggcagcacggcga

SEQ ID NO: 3487089 - RNA, 13 nt, Pseudomonas aeruginosa PA01
guccggcagcgcc

SEQ ID NO: 3487090 - RNA, 15 nt, Pseudomonas aeruginosa PA01
guccggccagccugg

SEQ ID NO: 3487091 - RNA, 20 nt, Pseudomonas aeruginosa PA01
guccggccagccuggccagc

SEQ ID NO: 3487092 - RNA, 18 nt, Pseudomonas aeruginosa PA01
guccggcccggagcgcga

SEQ ID NO: 3487093 - RNA, 16 nt, Pseudomonas aeruginosa PA01
guccggccgcccgagc

SEQ ID NO: 3487094 - RNA, 20 nt, Pseudomonas aeruginosa PA01
guccggccgcccgagccgcu

SEQ ID NO: 3487095 - RNA, 21 nt, Pseudomonas aeruginosa PA01
guccggccgcccgagccgcug

SEQ ID NO: 3487096 - RNA, 20 nt, Pseudomonas aeruginosa PA01
guccggcgagaaaggcugcu

SEQ ID NO: 3487097 - RNA, 18 nt, Pseudomonas aeruginosa PA01
guccggcgagcacggcga

SEQ ID NO: 3487098 - RNA, 22 nt, Pseudomonas aeruginosa PA01
guccggcgccaacugcuugccg

SEQ ID NO: 3487099 - RNA, 14 nt, Pseudomonas aeruginosa PA01
guccggcgcugagc

SEQ ID NO: 3487100 - RNA, 16 nt, Pseudomonas aeruginosa PA01
guccggcgcugagcga

SEQ ID NO: 3487101 - RNA, 15 nt, Pseudomonas aeruginosa PA01
guccggcggcugcug

SEQ ID NO: 3487102 - RNA, 16 nt, Pseudomonas aeruginosa PA01
guccggcuccggcugc

SEQ ID NO: 3487103 - RNA, 19 nt, Pseudomonas aeruginosa PA01
guccggcugucgacgcagc

SEQ ID NO: 3487104 - RNA, 19 nt, Pseudomonas aeruginosa PA01
guccgggaaguccgggcgc

SEQ ID NO: 3487105 - RNA, 18 nt, Pseudomonas aeruginosa PA01
guccgggaaugcucagca

SEQ ID NO: 3487106 - RNA, 23 nt, Pseudomonas aeruginosa PA01
guccgggaaugcucagcacggcg

SEQ ID NO: 3487107 - RNA, 17 nt, Pseudomonas aeruginosa PA01
guccgggaugccggugc

SEQ ID NO: 3487108 - RNA, 19 nt, Pseudomonas aeruginosa PA01
guccgggaugccggugcug

SEQ ID NO: 3487109 - RNA, 21 nt, Pseudomonas aeruginosa PA01
guccgggcacgcauagcgcgc

SEQ ID NO: 3487110 - RNA, 13 nt, Pseudomonas aeruginosa PA01
guccgggcccugc

SEQ ID NO: 3487111 - RNA, 20 nt, Pseudomonas aeruginosa PA01
guccgggcgguacaggcgca

SEQ ID NO: 3487112 - RNA, 21 nt, Pseudomonas aeruginosa PA01
guccgggcgguacaggcgcac

SEQ ID NO: 3487113 - RNA, 19 nt, Pseudomonas aeruginosa PA01
guccggguaguccagcgag

SEQ ID NO: 3487114 - RNA, 15 nt, Pseudomonas aeruginosa PA01
guccgggugaugccc

SEQ ID NO: 3487115 - RNA, 13 nt, Pseudomonas aeruginosa PA01
guccggguugacc

SEQ ID NO: 3487116 - RNA, 20 nt, Pseudomonas aeruginosa PA01
guccggguugacccagagcc

SEQ ID NO: 3487117 - RNA, 17 nt, Pseudomonas aeruginosa PA01
guccggguugagcaccc

SEQ ID NO: 3487118 - RNA, 15 nt, Pseudomonas aeruginosa PA01
guccggguuggcgca

SEQ ID NO: 3487119 - RNA, 17 nt, Pseudomonas aeruginosa PA01
guccggguuggcgcagg

SEQ ID NO: 3487120 - RNA, 20 nt, Pseudomonas aeruginosa PA01
guccggguuggcgcaggccg

SEQ ID NO: 3487121 - RNA, 21 nt, Pseudomonas aeruginosa PA01
guccggguuggcgcaggccgg

SEQ ID NO: 3487122 - RNA, 19 nt, Pseudomonas aeruginosa PA01
guccggguugucguugcgc

SEQ ID NO: 3487123 - RNA, 22 nt, Pseudomonas aeruginosa PA01
guccggguugucguugcgcagc

SEQ ID NO: 3487124 - RNA, 17 nt, Pseudomonas aeruginosa PA01
guccgguacugcugggc

SEQ ID NO: 3487125 - RNA, 19 nt, Pseudomonas aeruginosa PA01
guccgguacugcugggccu

SEQ ID NO: 3487126 - RNA, 19 nt, Pseudomonas aeruginosa PA01
guccgguaggagcgagagc

SEQ ID NO: 3487127 - RNA, 23 nt, Pseudomonas aeruginosa PA01
guccggucagcagcagggucggg

SEQ ID NO: 3487128 - RNA, 17 nt, Pseudomonas aeruginosa PA01
guccggucgcaccgcca

SEQ ID NO: 3487129 - RNA, 18 nt, Pseudomonas aeruginosa PA01
guccggucgcaccgccag

SEQ ID NO: 3487130 - RNA, 21 nt, Pseudomonas aeruginosa PA01
guccggucgcaccgccagcag

SEQ ID NO: 3487131 - RNA, 18 nt, Pseudomonas aeruginosa PA01
guccggugaaccugacca

SEQ ID NO: 3487132 - RNA, 14 nt, Pseudomonas aeruginosa PA01
guccggugacgucg

SEQ ID NO: 3487133 - RNA, 21 nt, Pseudomonas aeruginosa PA01
guccguaaugcaacccgccgc

SEQ ID NO: 3487134 - RNA, 12 nt, Pseudomonas aeruginosa PA01
guccguccagcg

SEQ ID NO: 3487135 - RNA, 16 nt, Pseudomonas aeruginosa PA01
guccguccagcgcgcc

SEQ ID NO: 3487136 - RNA, 16 nt, Pseudomonas aeruginosa PA01
guccgucgcgcgcccg

SEQ ID NO: 3487137 - RNA, 21 nt, Pseudomonas aeruginosa PA01
guccguucaggcaaccgggua

SEQ ID NO: 3487138 - RNA, 15 nt, Pseudomonas aeruginosa PA01
guccguucggcgccc

SEQ ID NO: 3487139 - RNA, 17 nt, Pseudomonas aeruginosa PA01
guccguugaggcguucg

SEQ ID NO: 3487140 - RNA, 22 nt, Pseudomonas aeruginosa PA01
guccuacgaaggcauauccccu

SEQ ID NO: 3487141 - RNA, 22 nt, Pseudomonas aeruginosa PA01
guccucaauaccgaacaccagc

SEQ ID NO: 3487142 - RNA, 18 nt, Pseudomonas aeruginosa PA01
guccucagccucacccug

SEQ ID NO: 3487143 - RNA, 13 nt, Pseudomonas aeruginosa PA01
guccuccaaagcc

SEQ ID NO: 3487144 - RNA, 22 nt, Pseudomonas aeruginosa PA01
guccuccaccgcuccggcgccg

SEQ ID NO: 3487145 - RNA, 20 nt, Pseudomonas aeruginosa PA01
guccuccagcugcgccugca

SEQ ID NO: 3487146 - RNA, 14 nt, Pseudomonas aeruginosa PA01
guccuccaggacca

SEQ ID NO: 3487147 - RNA, 16 nt, Pseudomonas aeruginosa PA01
guccucccagugcgag

SEQ ID NO: 3487148 - RNA, 13 nt, Pseudomonas aeruginosa PA01
guccuccgcgccc

SEQ ID NO: 3487149 - RNA, 16 nt, Pseudomonas aeruginosa PA01
guccuccgcgcccagg

SEQ ID NO: 3487150 - RNA, 17 nt, Pseudomonas aeruginosa PA01
guccuccgcgcccaggc

SEQ ID NO: 3487151 - RNA, 20 nt, Pseudomonas aeruginosa PA01
guccuccgcgcccaggcgca

SEQ ID NO: 3487152 - RNA, 15 nt, Pseudomonas aeruginosa PA01
guccuccuccaguuc

SEQ ID NO: 3487153 - RNA, 19 nt, Pseudomonas aeruginosa PA01
guccuccucgaucacccgc

SEQ ID NO: 3487154 - RNA, 23 nt, Pseudomonas aeruginosa PA01
guccucgaaagccgccgccgcgc

SEQ ID NO: 3487155 - RNA, 20 nt, Pseudomonas aeruginosa PA01
guccucgcccgucacuucac

SEQ ID NO: 3487156 - RNA, 18 nt, Pseudomonas aeruginosa PA01
guccucgcgacaccgggc

SEQ ID NO: 3487157 - RNA, 14 nt, Pseudomonas aeruginosa PA01
guccucgcgccgcu

SEQ ID NO: 3487158 - RNA, 17 nt, Pseudomonas aeruginosa PA01
guccucggcgccgucga

SEQ ID NO: 3487159 - RNA, 14 nt, Pseudomonas aeruginosa PA01
guccucggcggcuc

SEQ ID NO: 3487160 - RNA, 19 nt, Pseudomonas aeruginosa PA01
guccucggcggcucaacgg

SEQ ID NO: 3487161 - RNA, 19 nt, Pseudomonas aeruginosa PA01
guccucggcguagccggcc

SEQ ID NO: 3487162 - RNA, 15 nt, Pseudomonas aeruginosa PA01
guccucgggcaccag

SEQ ID NO: 3487163 - RNA, 17 nt, Pseudomonas aeruginosa PA01
guccucgggcaccagca

SEQ ID NO: 3487164 - RNA, 21 nt, Pseudomonas aeruginosa PA01
guccucggggaagcgcggcuc

SEQ ID NO: 3487165 - RNA, 16 nt, Pseudomonas aeruginosa PA01
guccucguacaugcgc

SEQ ID NO: 3487166 - RNA, 18 nt, Pseudomonas aeruginosa PA01
guccucguacaugcgcga

SEQ ID NO: 3487167 - RNA, 20 nt, Pseudomonas aeruginosa PA01
guccucguacaugcgcgagu

SEQ ID NO: 3487168 - RNA, 15 nt, Pseudomonas aeruginosa PA01
guccugcaacugcuc

SEQ ID NO: 3487169 - RNA, 18 nt, Pseudomonas aeruginosa PA01
guccugcaacugcucgau

SEQ ID NO: 3487170 - RNA, 14 nt, Pseudomonas aeruginosa PA01
guccugcgcggcga

SEQ ID NO: 3487171 - RNA, 22 nt, Pseudomonas aeruginosa PA01
guccugcggauucaucggcggc

SEQ ID NO: 3487172 - RNA, 23 nt, Pseudomonas aeruginosa PA01
guccugcggauucaucggcggca

SEQ ID NO: 3487173 - RNA, 13 nt, Pseudomonas aeruginosa PA01
guccugcggccgc

SEQ ID NO: 3487174 - RNA, 17 nt, Pseudomonas aeruginosa PA01
guccugcggcggcaggu

SEQ ID NO: 3487175 - RNA, 16 nt, Pseudomonas aeruginosa PA01
guccugcucccuggcg

SEQ ID NO: 3487176 - RNA, 17 nt, Pseudomonas aeruginosa PA01
guccugcucccuggcgg

SEQ ID NO: 3487177 - RNA, 20 nt, Pseudomonas aeruginosa PA01
guccuggauaagccgcgcca

SEQ ID NO: 3487178 - RNA, 13 nt, Pseudomonas aeruginosa PA01
guccuggaucggc

SEQ ID NO: 3487179 - RNA, 19 nt, Pseudomonas aeruginosa PA01
guccuggaucggcagcucg

SEQ ID NO: 3487180 - RNA, 13 nt, Pseudomonas aeruginosa PA01
guccuggccgagc

SEQ ID NO: 3487181 - RNA, 14 nt, Pseudomonas aeruginosa PA01
guccuggccgagcc

SEQ ID NO: 3487182 - RNA, 19 nt, Pseudomonas aeruginosa PA01
guccuggcgcgagaagcca

SEQ ID NO: 3487183 - RNA, 22 nt, Pseudomonas aeruginosa PA01
guccuggcgcgagaagccagcc

SEQ ID NO: 3487184 - RNA, 22 nt, Pseudomonas aeruginosa PA01
guccuggcggcaaggcacacgc

SEQ ID NO: 3487185 - RNA, 19 nt, Pseudomonas aeruginosa PA01
guccuggcgguagcccggc

SEQ ID NO: 3487186 - RNA, 16 nt, Pseudomonas aeruginosa PA01
guccugggccaccugg

SEQ ID NO: 3487187 - RNA, 17 nt, Pseudomonas aeruginosa PA01
guccugggccaccuggc

SEQ ID NO: 3487188 - RNA, 21 nt, Pseudomonas aeruginosa PA01
guccugggccaccuggcucug

SEQ ID NO: 3487189 - RNA, 13 nt, Pseudomonas aeruginosa PA01
guccugggccggu

SEQ ID NO: 3487190 - RNA, 22 nt, Pseudomonas aeruginosa PA01
guccugggccgguugcggcgcc

SEQ ID NO: 3487191 - RNA, 21 nt, Pseudomonas aeruginosa PA01
guccuggguauagaccagcac

SEQ ID NO: 3487192 - RNA, 13 nt, Pseudomonas aeruginosa PA01
guccugggugucg

SEQ ID NO: 3487193 - RNA, 20 nt, Pseudomonas aeruginosa PA01
guccuggucgagcuuguugg

SEQ ID NO: 3487194 - RNA, 14 nt, Pseudomonas aeruginosa PA01
guccuggucgcuga

SEQ ID NO: 3487195 - RNA, 20 nt, Pseudomonas aeruginosa PA01
guccuggucgcugaggccgc

SEQ ID NO: 3487196 - RNA, 14 nt, Pseudomonas aeruginosa PA01
guccuguggauaaa

SEQ ID NO: 3487197 - RNA, 23 nt, Pseudomonas aeruginosa PA01
guccuucaugaacacauagacca

SEQ ID NO: 3487198 - RNA, 20 nt, Pseudomonas aeruginosa PA01
guccuucggccaguccuuga

SEQ ID NO: 3487199 - RNA, 13 nt, Pseudomonas aeruginosa PA01
guccuucggcgca

SEQ ID NO: 3487200 - RNA, 14 nt, Pseudomonas aeruginosa PA01
guccuucggcgcau

SEQ ID NO: 3487201 - RNA, 18 nt, Pseudomonas aeruginosa PA01
guccuucggcgcucuuca

SEQ ID NO: 3487202 - RNA, 22 nt, Pseudomonas aeruginosa PA01
guccuucuuguauaccagcggc

SEQ ID NO: 3487203 - RNA, 15 nt, Pseudomonas aeruginosa PA01
guccuugagcgccag

SEQ ID NO: 3487204 - RNA, 14 nt, Pseudomonas aeruginosa PA01
guccuugggaucgu

SEQ ID NO: 3487205 - RNA, 14 nt, Pseudomonas aeruginosa PA01
guccuugggccagg

SEQ ID NO: 3487206 - RNA, 16 nt, Pseudomonas aeruginosa PA01
guccuugggccaggca

SEQ ID NO: 3487207 - RNA, 16 nt, Pseudomonas aeruginosa PA01
guccuugugcugcucg

SEQ ID NO: 3487208 - RNA, 17 nt, Pseudomonas aeruginosa PA01
gucgaaacgcuggcggc

SEQ ID NO: 3487209 - RNA, 20 nt, Pseudomonas aeruginosa PA01
gucgaaacgcuggcggccga

SEQ ID NO: 3487210 - RNA, 13 nt, Pseudomonas aeruginosa PA01
gucgaaacgggcg

SEQ ID NO: 3487211 - RNA, 14 nt, Pseudomonas aeruginosa PA01
gucgaaacgggcgc

SEQ ID NO: 3487212 - RNA, 17 nt, Pseudomonas aeruginosa PA01
gucgaaacgggcgcucu

SEQ ID NO: 3487213 - RNA, 19 nt, Pseudomonas aeruginosa PA01
gucgaaagccugccgggca

SEQ ID NO: 3487214 - RNA, 19 nt, Pseudomonas aeruginosa PA01
gucgaaagcuucgucgcgc

SEQ ID NO: 3487215 - RNA, 23 nt, Pseudomonas aeruginosa PA01
gucgaaagcuucgucgcgcaggc

SEQ ID NO: 3487216 - RNA, 13 nt, Pseudomonas aeruginosa PA01
gucgaacacuuga

SEQ ID NO: 3487217 - RNA, 20 nt, Pseudomonas aeruginosa PA01
gucgaacagcagcucgccgc

SEQ ID NO: 3487218 - RNA, 16 nt, Pseudomonas aeruginosa PA01
gucgaacagcggcugg

SEQ ID NO: 3487219 - RNA, 14 nt, Pseudomonas aeruginosa PA01
gucgaacaggcccu

SEQ ID NO: 3487220 - RNA, 21 nt, Pseudomonas aeruginosa PA01
gucgaacagguggcuuuccag

SEQ ID NO: 3487221 - RNA, 16 nt, Pseudomonas aeruginosa PA01
gucgaaccagccgcgu

SEQ ID NO: 3487222 - RNA, 23 nt, Pseudomonas aeruginosa PA01
gucgaaccagcucagcuccaggc

SEQ ID NO: 3487223 - RNA, 20 nt, Pseudomonas aeruginosa PA01
gucgaaccagggacgcccgg

SEQ ID NO: 3487224 - RNA, 13 nt, Pseudomonas aeruginosa PA01
gucgaacugcucg

SEQ ID NO: 3487225 - RNA, 14 nt, Pseudomonas aeruginosa PA01
gucgaacugcucga

SEQ ID NO: 3487226 - RNA, 22 nt, Pseudomonas aeruginosa PA01
gucgaagaccuguugcagagcg

SEQ ID NO: 3487227 - RNA, 19 nt, Pseudomonas aeruginosa PA01
gucgaagcagcccagcgcu

SEQ ID NO: 3487228 - RNA, 14 nt, Pseudomonas aeruginosa PA01
gucgaagccaggca

SEQ ID NO: 3487229 - RNA, 14 nt, Pseudomonas aeruginosa PA01
gucgaagccuucga

SEQ ID NO: 3487230 - RNA, 15 nt, Pseudomonas aeruginosa PA01
gucgaagcucggcgc

SEQ ID NO: 3487231 - RNA, 17 nt, Pseudomonas aeruginosa PA01
gucgaagcucggcgcga

SEQ ID NO: 3487232 - RNA, 18 nt, Pseudomonas aeruginosa PA01
gucgaagcugucggcccg

SEQ ID NO: 3487233 - RNA, 20 nt, Pseudomonas aeruginosa PA01
gucgaagcugucguaguccu

SEQ ID NO: 3487234 - RNA, 17 nt, Pseudomonas aeruginosa PA01
gucgaaggccucgucgc

SEQ ID NO: 3487235 - RNA, 19 nt, Pseudomonas aeruginosa PA01
gucgaaggccucgucgccc

SEQ ID NO: 3487236 - RNA, 14 nt, Pseudomonas aeruginosa PA01
gucgaaggcgcggc

SEQ ID NO: 3487237 - RNA, 14 nt, Pseudomonas aeruginosa PA01
gucgaaggcggcgc

SEQ ID NO: 3487238 - RNA, 18 nt, Pseudomonas aeruginosa PA01
gucgaaggcggcgcggcg

SEQ ID NO: 3487239 - RNA, 19 nt, Pseudomonas aeruginosa PA01
gucgaaggcggcgcggcgg

SEQ ID NO: 3487240 - RNA, 13 nt, Pseudomonas aeruginosa PA01
gucgaagggcacg

SEQ ID NO: 3487241 - RNA, 17 nt, Pseudomonas aeruginosa PA01
gucgaagggcacgccgc

SEQ ID NO: 3487242 - RNA, 18 nt, Pseudomonas aeruginosa PA01
gucgaagggcacgccgcu

SEQ ID NO: 3487243 - RNA, 20 nt, Pseudomonas aeruginosa PA01
gucgaagggcacgccgcucu

SEQ ID NO: 3487244 - RNA, 17 nt, Pseudomonas aeruginosa PA01
gucgaagggccauuguu

SEQ ID NO: 3487245 - RNA, 22 nt, Pseudomonas aeruginosa PA01
gucgaaggugaagcugccgucg

SEQ ID NO: 3487246 - RNA, 23 nt, Pseudomonas aeruginosa PA01
gucgaaggugaagcugccgucga

SEQ ID NO: 3487247 - RNA, 14 nt, Pseudomonas aeruginosa PA01
gucgaaguacaccu

SEQ ID NO: 3487248 - RNA, 22 nt, Pseudomonas aeruginosa PA01
gucgaaguacaccuuggcgcga

SEQ ID NO: 3487249 - RNA, 23 nt, Pseudomonas aeruginosa PA01
gucgaaguacaccuuggcgcgac

SEQ ID NO: 3487250 - RNA, 18 nt, Pseudomonas aeruginosa PA01
gucgaagucgaagcagcc

SEQ ID NO: 3487251 - RNA, 21 nt, Pseudomonas aeruginosa PA01
gucgaagucgaagcagcccag

SEQ ID NO: 3487252 - RNA, 22 nt, Pseudomonas aeruginosa PA01
gucgaagucguugaagcggccg

SEQ ID NO: 3487253 - RNA, 17 nt, Pseudomonas aeruginosa PA01
gucgaauuggacagcag

SEQ ID NO: 3487254 - RNA, 20 nt, Pseudomonas aeruginosa PA01
gucgaauuggacagcaggcu

SEQ ID NO: 3487255 - RNA, 23 nt, Pseudomonas aeruginosa PA01
gucgacaccgaucaccuggccgg

SEQ ID NO: 3487256 - RNA, 15 nt, Pseudomonas aeruginosa PA01
gucgacaccuggcaa

SEQ ID NO: 3487257 - RNA, 22 nt, Pseudomonas aeruginosa PA01
gucgacaccuggcaacaaggca

SEQ ID NO: 3487258 - RNA, 22 nt, Pseudomonas aeruginosa PA01
gucgacacgagccgcugcggcu

SEQ ID NO: 3487259 - RNA, 21 nt, Pseudomonas aeruginosa PA01
gucgacacugauauccgcucu

SEQ ID NO: 3487260 - RNA, 22 nt, Pseudomonas aeruginosa PA01
gucgacacugauauccgcucug

SEQ ID NO: 3487261 - RNA, 17 nt, Pseudomonas aeruginosa PA01
gucgacauagcgcagca

SEQ ID NO: 3487262 - RNA, 22 nt, Pseudomonas aeruginosa PA01
gucgacaucgauaacaccagga

SEQ ID NO: 3487263 - RNA, 12 nt, Pseudomonas aeruginosa PA01
gucgacaugcag

SEQ ID NO: 3487264 - RNA, 16 nt, Pseudomonas aeruginosa PA01
gucgacaugcaggccg

SEQ ID NO: 3487265 - RNA, 17 nt, Pseudomonas aeruginosa PA01
gucgacaugcaggccgg

SEQ ID NO: 3487266 - RNA, 16 nt, Pseudomonas aeruginosa PA01
gucgaccaccgcgugg

SEQ ID NO: 3487267 - RNA, 23 nt, Pseudomonas aeruginosa PA01
gucgaccacgaagcuguuggcca

SEQ ID NO: 3487268 - RNA, 17 nt, Pseudomonas aeruginosa PA01
gucgaccagccagucgg

SEQ ID NO: 3487269 - RNA, 15 nt, Pseudomonas aeruginosa PA01
gucgaccagcggcgg

SEQ ID NO: 3487270 - RNA, 13 nt, Pseudomonas aeruginosa PA01
gucgaccaggcgu

SEQ ID NO: 3487271 - RNA, 17 nt, Pseudomonas aeruginosa PA01
gucgaccaucaccagcg

SEQ ID NO: 3487272 - RNA, 20 nt, Pseudomonas aeruginosa PA01
gucgaccaucaccagcgccg

SEQ ID NO: 3487273 - RNA, 22 nt, Pseudomonas aeruginosa PA01
gucgaccaucaccagcgccguc

SEQ ID NO: 3487274 - RNA, 22 nt, Pseudomonas aeruginosa PA01
gucgaccauucccacgacccgc

SEQ ID NO: 3487275 - RNA, 15 nt, Pseudomonas aeruginosa PA01
gucgacccaggccca

SEQ ID NO: 3487276 - RNA, 23 nt, Pseudomonas aeruginosa PA01
gucgacccaggcccagccgguga

SEQ ID NO: 3487277 - RNA, 21 nt, Pseudomonas aeruginosa PA01
gucgaccggaaucacgucgau

SEQ ID NO: 3487278 - RNA, 17 nt, Pseudomonas aeruginosa PA01
gucgaccgucgccacgc

SEQ ID NO: 3487279 - RNA, 14 nt, Pseudomonas aeruginosa PA01
gucgaccucgaugg

SEQ ID NO: 3487280 - RNA, 22 nt, Pseudomonas aeruginosa PA01
gucgaccuggguaccgacgguc

SEQ ID NO: 3487281 - RNA, 16 nt, Pseudomonas aeruginosa PA01
gucgaccuugccgacg

SEQ ID NO: 3487282 - RNA, 17 nt, Pseudomonas aeruginosa PA01
gucgacgaccggaaggu

SEQ ID NO: 3487283 - RNA, 21 nt, Pseudomonas aeruginosa PA01
gucgacgacgaaaggccgcgc

SEQ ID NO: 3487284 - RNA, 23 nt, Pseudomonas aeruginosa PA01
gucgacgcagcgcgcgucggcga

SEQ ID NO: 3487285 - RNA, 16 nt, Pseudomonas aeruginosa PA01
gucgacgcaucgacgg

SEQ ID NO: 3487286 - RNA, 20 nt, Pseudomonas aeruginosa PA01
gucgacgcaucgacggggcg

SEQ ID NO: 3487287 - RNA, 14 nt, Pseudomonas aeruginosa PA01
gucgacgccauggc

SEQ ID NO: 3487288 - RNA, 12 nt, Pseudomonas aeruginosa PA01
gucgacgcccug

SEQ ID NO: 3487289 - RNA, 17 nt, Pseudomonas aeruginosa PA01
gucgacgcccugggcga

SEQ ID NO: 3487290 - RNA, 20 nt, Pseudomonas aeruginosa PA01
gucgacgcccugggcgacgc

SEQ ID NO: 3487291 - RNA, 19 nt, Pseudomonas aeruginosa PA01
gucgacgccgaagccgcug

SEQ ID NO: 3487292 - RNA, 14 nt, Pseudomonas aeruginosa PA01
gucgacgccgccga

SEQ ID NO: 3487293 - RNA, 17 nt, Pseudomonas aeruginosa PA01
gucgacgccgccgagca

SEQ ID NO: 3487294 - RNA, 20 nt, Pseudomonas aeruginosa PA01
gucgacgcucagcacccugg

SEQ ID NO: 3487295 - RNA, 15 nt, Pseudomonas aeruginosa PA01
gucgacguaggcggc

SEQ ID NO: 3487296 - RNA, 17 nt, Pseudomonas aeruginosa PA01
gucgacguaggcggcga

SEQ ID NO: 3487297 - RNA, 19 nt, Pseudomonas aeruginosa PA01
gucgacguaggcggcgagg

SEQ ID NO: 3487298 - RNA, 16 nt, Pseudomonas aeruginosa PA01
gucgacucagcgggcg

SEQ ID NO: 3487299 - RNA, 12 nt, Pseudomonas aeruginosa PA01
gucgacugcugg

SEQ ID NO: 3487300 - RNA, 18 nt, Pseudomonas aeruginosa PA01
gucgacugcuggguacgg

SEQ ID NO: 3487301 - RNA, 17 nt, Pseudomonas aeruginosa PA01
gucgacuucgcaccagc

SEQ ID NO: 3487302 - RNA, 19 nt, Pseudomonas aeruginosa PA01
gucgacuucgcaccagccg

SEQ ID NO: 3487303 - RNA, 22 nt, Pseudomonas aeruginosa PA01
gucgacuucgcaccagccggcc

SEQ ID NO: 3487304 - RNA, 14 nt, Pseudomonas aeruginosa PA01
gucgacuucgucga

SEQ ID NO: 3487305 - RNA, 23 nt, Pseudomonas aeruginosa PA01
gucgacuugccgaucaugggggc

SEQ ID NO: 3487306 - RNA, 16 nt, Pseudomonas aeruginosa PA01
gucgagaaggcugccg

SEQ ID NO: 3487307 - RNA, 12 nt, Pseudomonas aeruginosa PA01
gucgagacccgc

SEQ ID NO: 3487308 - RNA, 15 nt, Pseudomonas aeruginosa PA01
gucgagacgccagcc

SEQ ID NO: 3487309 - RNA, 15 nt, Pseudomonas aeruginosa PA01
gucgagacgcgggcc

SEQ ID NO: 3487310 - RNA, 16 nt, Pseudomonas aeruginosa PA01
gucgagacgcgggccc

SEQ ID NO: 3487311 - RNA, 20 nt, Pseudomonas aeruginosa PA01
gucgagacgcgggcccagcg

SEQ ID NO: 3487312 - RNA, 17 nt, Pseudomonas aeruginosa PA01
gucgagagaauccgccg

SEQ ID NO: 3487313 - RNA, 21 nt, Pseudomonas aeruginosa PA01
gucgagagcggguagcgccgg

SEQ ID NO: 3487314 - RNA, 22 nt, Pseudomonas aeruginosa PA01
gucgagaugcugcgggcgccgc

SEQ ID NO: 3487315 - RNA, 14 nt, Pseudomonas aeruginosa PA01
gucgagcaccagca

SEQ ID NO: 3487316 - RNA, 16 nt, Pseudomonas aeruginosa PA01
gucgagcaccagcagg

SEQ ID NO: 3487317 - RNA, 18 nt, Pseudomonas aeruginosa PA01
gucgagcaccagcagguc

SEQ ID NO: 3487318 - RNA, 19 nt, Pseudomonas aeruginosa PA01
gucgagcaccagcaggucg

SEQ ID NO: 3487319 - RNA, 15 nt, Pseudomonas aeruginosa PA01
gucgagcaccaggcg

SEQ ID NO: 3487320 - RNA, 17 nt, Pseudomonas aeruginosa PA01
gucgagcaccaggcggu

SEQ ID NO: 3487321 - RNA, 15 nt, Pseudomonas aeruginosa PA01
gucgagcacgccguc

SEQ ID NO: 3487322 - RNA, 17 nt, Pseudomonas aeruginosa PA01
gucgagcacggcgcugg

SEQ ID NO: 3487323 - RNA, 22 nt, Pseudomonas aeruginosa PA01
gucgagcagaguuuagccgcca

SEQ ID NO: 3487324 - RNA, 13 nt, Pseudomonas aeruginosa PA01
gucgagcagcgcg

SEQ ID NO: 3487325 - RNA, 15 nt, Pseudomonas aeruginosa PA01
gucgagcagcgcgcg

SEQ ID NO: 3487326 - RNA, 16 nt, Pseudomonas aeruginosa PA01
gucgagcagcgcgcgg

SEQ ID NO: 3487327 - RNA, 17 nt, Pseudomonas aeruginosa PA01
gucgagcagcgcgcggc

SEQ ID NO: 3487328 - RNA, 19 nt, Pseudomonas aeruginosa PA01
gucgagcagcgcgcggcuc

SEQ ID NO: 3487329 - RNA, 23 nt, Pseudomonas aeruginosa PA01
gucgagcagcgcgcggcucggcg

SEQ ID NO: 3487330 - RNA, 19 nt, Pseudomonas aeruginosa PA01
gucgagcagggucgcgagc

SEQ ID NO: 3487331 - RNA, 23 nt, Pseudomonas aeruginosa PA01
gucgagcaugacgauaucggcgc

SEQ ID NO: 3487332 - RNA, 16 nt, Pseudomonas aeruginosa PA01
gucgagcaugccgagg

SEQ ID NO: 3487333 - RNA, 14 nt, Pseudomonas aeruginosa PA01
gucgagccagccca

SEQ ID NO: 3487334 - RNA, 18 nt, Pseudomonas aeruginosa PA01
gucgagccagcccagcgg

SEQ ID NO: 3487335 - RNA, 13 nt, Pseudomonas aeruginosa PA01
gucgagccaggcg

SEQ ID NO: 3487336 - RNA, 13 nt, Pseudomonas aeruginosa PA01
gucgagcgaagcg

SEQ ID NO: 3487337 - RNA, 13 nt, Pseudomonas aeruginosa PA01
gucgagcgcagcg

SEQ ID NO: 3487338 - RNA, 16 nt, Pseudomonas aeruginosa PA01
gucgagcgggcggucg

SEQ ID NO: 3487339 - RNA, 14 nt, Pseudomonas aeruginosa PA01
gucgagcucggcca

SEQ ID NO: 3487340 - RNA, 18 nt, Pseudomonas aeruginosa PA01
gucgagcucggccaggca

SEQ ID NO: 3487341 - RNA, 19 nt, Pseudomonas aeruginosa PA01
gucgagcucggccaggcac

SEQ ID NO: 3487342 - RNA, 14 nt, Pseudomonas aeruginosa PA01
gucgagcugcucgg

SEQ ID NO: 3487343 - RNA, 15 nt, Pseudomonas aeruginosa PA01
gucgagcugcucggc

SEQ ID NO: 3487344 - RNA, 16 nt, Pseudomonas aeruginosa PA01
gucgagcugcucggcg

SEQ ID NO: 3487345 - RNA, 17 nt, Pseudomonas aeruginosa PA01
gucgagcugcucggcgg

SEQ ID NO: 3487346 - RNA, 18 nt, Pseudomonas aeruginosa PA01
gucgagcugcucggcggu

SEQ ID NO: 3487347 - RNA, 16 nt, Pseudomonas aeruginosa PA01
gucgagcuggcgcagg

SEQ ID NO: 3487348 - RNA, 18 nt, Pseudomonas aeruginosa PA01
gucgagcuggcgcaggcc

SEQ ID NO: 3487349 - RNA, 19 nt, Pseudomonas aeruginosa PA01
gucgagcuggcgcaggccu

SEQ ID NO: 3487350 - RNA, 23 nt, Pseudomonas aeruginosa PA01
gucgagcugguggauguucgccg

SEQ ID NO: 3487351 - RNA, 19 nt, Pseudomonas aeruginosa PA01
gucgagcuuguuggccagc

SEQ ID NO: 3487352 - RNA, 20 nt, Pseudomonas aeruginosa PA01
gucgaggaacaggucgacgc

SEQ ID NO: 3487353 - RNA, 14 nt, Pseudomonas aeruginosa PA01
gucgaggaaggcca

SEQ ID NO: 3487354 - RNA, 17 nt, Pseudomonas aeruginosa PA01
gucgaggaaggccagca

SEQ ID NO: 3487355 - RNA, 16 nt, Pseudomonas aeruginosa PA01
gucgaggaaggccagg

SEQ ID NO: 3487356 - RNA, 18 nt, Pseudomonas aeruginosa PA01
gucgaggaucuucuccga

SEQ ID NO: 3487357 - RNA, 15 nt, Pseudomonas aeruginosa PA01
gucgaggauguacag

SEQ ID NO: 3487358 - RNA, 19 nt, Pseudomonas aeruginosa PA01
gucgaggcaaucugcccgg

SEQ ID NO: 3487359 - RNA, 16 nt, Pseudomonas aeruginosa PA01
gucgaggcccucggcg

SEQ ID NO: 3487360 - RNA, 20 nt, Pseudomonas aeruginosa PA01
gucgaggcccucggcggcga

SEQ ID NO: 3487361 - RNA, 22 nt, Pseudomonas aeruginosa PA01
gucgaggcccucggcggcgagc

SEQ ID NO: 3487362 - RNA, 23 nt, Pseudomonas aeruginosa PA01
gucgaggcccucggcggcgagcg

SEQ ID NO: 3487363 - RNA, 14 nt, Pseudomonas aeruginosa PA01
gucgaggccgcgga

SEQ ID NO: 3487364 - RNA, 13 nt, Pseudomonas aeruginosa PA01
gucgaggccucgu

SEQ ID NO: 3487365 - RNA, 16 nt, Pseudomonas aeruginosa PA01
gucgaggccucgucgu

SEQ ID NO: 3487366 - RNA, 14 nt, Pseudomonas aeruginosa PA01
gucgaggcgcucca

SEQ ID NO: 3487367 - RNA, 22 nt, Pseudomonas aeruginosa PA01
gucgaggcggagaagccgcuga

SEQ ID NO: 3487368 - RNA, 12 nt, Pseudomonas aeruginosa PA01
gucgaggcugcc

SEQ ID NO: 3487369 - RNA, 15 nt, Pseudomonas aeruginosa PA01
gucgaggcugccgaa

SEQ ID NO: 3487370 - RNA, 23 nt, Pseudomonas aeruginosa PA01
gucgaggcugccgaagccuucgu

SEQ ID NO: 3487371 - RNA, 14 nt, Pseudomonas aeruginosa PA01
gucgaggcugucgc

SEQ ID NO: 3487372 - RNA, 22 nt, Pseudomonas aeruginosa PA01
gucgaggcugucgcggacccgc

SEQ ID NO: 3487373 - RNA, 17 nt, Pseudomonas aeruginosa PA01
gucgagggcaaaggcgc

SEQ ID NO: 3487374 - RNA, 20 nt, Pseudomonas aeruginosa PA01
gucgagggcgcguugcccag

SEQ ID NO: 3487375 - RNA, 17 nt, Pseudomonas aeruginosa PA01
gucgagggucugcucga

SEQ ID NO: 3487376 - RNA, 19 nt, Pseudomonas aeruginosa PA01
gucgagggucugcucgacg

SEQ ID NO: 3487377 - RNA, 16 nt, Pseudomonas aeruginosa PA01
gucgagggucugcugg

SEQ ID NO: 3487378 - RNA, 23 nt, Pseudomonas aeruginosa PA01
gucgaggguggucagccagccga

SEQ ID NO: 3487379 - RNA, 21 nt, Pseudomonas aeruginosa PA01
gucgagggugguuuccaggcu

SEQ ID NO: 3487380 - RNA, 22 nt, Pseudomonas aeruginosa PA01
gucgaggguugucaccggcagg

SEQ ID NO: 3487381 - RNA, 14 nt, Pseudomonas aeruginosa PA01
gucgagguagauca

SEQ ID NO: 3487382 - RNA, 19 nt, Pseudomonas aeruginosa PA01
gucgagguagguccaggcg

SEQ ID NO: 3487383 - RNA, 20 nt, Pseudomonas aeruginosa PA01
gucgagguagguccaggcga

SEQ ID NO: 3487384 - RNA, 21 nt, Pseudomonas aeruginosa PA01
gucgaggucgacggcggccgc

SEQ ID NO: 3487385 - RNA, 14 nt, Pseudomonas aeruginosa PA01
gucgaggucggcga

SEQ ID NO: 3487386 - RNA, 16 nt, Pseudomonas aeruginosa PA01
gucgagguugcgcggc

SEQ ID NO: 3487387 - RNA, 23 nt, Pseudomonas aeruginosa PA01
gucgagguuguagcccugggcga

SEQ ID NO: 3487388 - RNA, 21 nt, Pseudomonas aeruginosa PA01
gucgaguaauuuuguggagua

SEQ ID NO: 3487389 - RNA, 15 nt, Pseudomonas aeruginosa PA01
gucgaguaccgcugc

SEQ ID NO: 3487390 - RNA, 20 nt, Pseudomonas aeruginosa PA01
gucgaguaccgcugcggccg

SEQ ID NO: 3487391 - RNA, 22 nt, Pseudomonas aeruginosa PA01
gucgaguaccgcugcggccggc

SEQ ID NO: 3487392 - RNA, 15 nt, Pseudomonas aeruginosa PA01
gucgauaccagcgcc

SEQ ID NO: 3487393 - RNA, 20 nt, Pseudomonas aeruginosa PA01
gucgauaccagcgccgcucc

SEQ ID NO: 3487394 - RNA, 19 nt, Pseudomonas aeruginosa PA01
gucgauacgcaucugcucg

SEQ ID NO: 3487395 - RNA, 23 nt, Pseudomonas aeruginosa PA01
gucgauauagcccugggcgccgc

SEQ ID NO: 3487396 - RNA, 15 nt, Pseudomonas aeruginosa PA01
gucgauauugccgcg

SEQ ID NO: 3487397 - RNA, 17 nt, Pseudomonas aeruginosa PA01
gucgaucagcagcagcg

SEQ ID NO: 3487398 - RNA, 19 nt, Pseudomonas aeruginosa PA01
gucgaucagcagcagcgcc

SEQ ID NO: 3487399 - RNA, 20 nt, Pseudomonas aeruginosa PA01
gucgaucagcagcagcgcca

SEQ ID NO: 3487400 - RNA, 22 nt, Pseudomonas aeruginosa PA01
gucgaucagcagcagcgccaug

SEQ ID NO: 3487401 - RNA, 23 nt, Pseudomonas aeruginosa PA01
gucgaucagcagcagcgccaugc

SEQ ID NO: 3487402 - RNA, 17 nt, Pseudomonas aeruginosa PA01
gucgaucagcgcgcgga

SEQ ID NO: 3487403 - RNA, 19 nt, Pseudomonas aeruginosa PA01
gucgaucaggaacgcgcca

SEQ ID NO: 3487404 - RNA, 17 nt, Pseudomonas aeruginosa PA01
gucgaucaggcgcaugc

SEQ ID NO: 3487405 - RNA, 18 nt, Pseudomonas aeruginosa PA01
gucgaucaggcgggcguc

SEQ ID NO: 3487406 - RNA, 19 nt, Pseudomonas aeruginosa PA01
gucgaucagguccuggccg

SEQ ID NO: 3487407 - RNA, 17 nt, Pseudomonas aeruginosa PA01
gucgaucaggucgccgc

SEQ ID NO: 3487408 - RNA, 20 nt, Pseudomonas aeruginosa PA01
gucgauccccaacccggcca

SEQ ID NO: 3487409 - RNA, 22 nt, Pseudomonas aeruginosa PA01
gucgauccccaacccggccagc

SEQ ID NO: 3487410 - RNA, 15 nt, Pseudomonas aeruginosa PA01
gucgauccgaccugg

SEQ ID NO: 3487411 - RNA, 21 nt, Pseudomonas aeruginosa PA01
gucgauccgaccuggggcggc

SEQ ID NO: 3487412 - RNA, 16 nt, Pseudomonas aeruginosa PA01
gucgauccgcgccugc

SEQ ID NO: 3487413 - RNA, 17 nt, Pseudomonas aeruginosa PA01
gucgauccgcggaucgu

SEQ ID NO: 3487414 - RNA, 22 nt, Pseudomonas aeruginosa PA01
gucgauccugaccccggccugg

SEQ ID NO: 3487415 - RNA, 18 nt, Pseudomonas aeruginosa PA01
gucgauccuucccacuug

SEQ ID NO: 3487416 - RNA, 21 nt, Pseudomonas aeruginosa PA01
gucgaucuccuccucggcggc

SEQ ID NO: 3487417 - RNA, 22 nt, Pseudomonas aeruginosa PA01
gucgaucuccuccucggcggcu

SEQ ID NO: 3487418 - RNA, 12 nt, Pseudomonas aeruginosa PA01
gucgaucugcuc

SEQ ID NO: 3487419 - RNA, 18 nt, Pseudomonas aeruginosa PA01
gucgaucugcucguccag

SEQ ID NO: 3487420 - RNA, 20 nt, Pseudomonas aeruginosa PA01
gucgaucugcucguccaggc

SEQ ID NO: 3487421 - RNA, 22 nt, Pseudomonas aeruginosa PA01
gucgaucugcucguccaggccg

SEQ ID NO: 3487422 - RNA, 13 nt, Pseudomonas aeruginosa PA01
gucgaugaagaag

SEQ ID NO: 3487423 - RNA, 17 nt, Pseudomonas aeruginosa PA01
gucgaugacgauggcgc

SEQ ID NO: 3487424 - RNA, 20 nt, Pseudomonas aeruginosa PA01
gucgaugacguugcugcccu

SEQ ID NO: 3487425 - RNA, 18 nt, Pseudomonas aeruginosa PA01
gucgaugaggucgcagcg

SEQ ID NO: 3487426 - RNA, 23 nt, Pseudomonas aeruginosa PA01
gucgaugaucgguucccgcccgc

SEQ ID NO: 3487427 - RNA, 20 nt, Pseudomonas aeruginosa PA01
gucgaugaucugcauggcgc

SEQ ID NO: 3487428 - RNA, 21 nt, Pseudomonas aeruginosa PA01
gucgaugcccagccagggccg

SEQ ID NO: 3487429 - RNA, 19 nt, Pseudomonas aeruginosa PA01
gucgaugcccucgcggcgg

SEQ ID NO: 3487430 - RNA, 20 nt, Pseudomonas aeruginosa PA01
gucgaugcccucgcggcggc

SEQ ID NO: 3487431 - RNA, 21 nt, Pseudomonas aeruginosa PA01
gucgaugcccucgcggcggca

SEQ ID NO: 3487432 - RNA, 12 nt, Pseudomonas aeruginosa PA01
gucgaugccgaa

SEQ ID NO: 3487433 - RNA, 15 nt, Pseudomonas aeruginosa PA01
gucgaugccgcccgg

SEQ ID NO: 3487434 - RNA, 20 nt, Pseudomonas aeruginosa PA01
gucgaugccuucggcggccg

SEQ ID NO: 3487435 - RNA, 14 nt, Pseudomonas aeruginosa PA01
gucgaugcgcccgc

SEQ ID NO: 3487436 - RNA, 19 nt, Pseudomonas aeruginosa PA01
gucgaugcgcccgccgcga

SEQ ID NO: 3487437 - RNA, 22 nt, Pseudomonas aeruginosa PA01
gucgaugcgcccgccgcgagcg

SEQ ID NO: 3487438 - RNA, 16 nt, Pseudomonas aeruginosa PA01
gucgaugcguccgcgc

SEQ ID NO: 3487439 - RNA, 22 nt, Pseudomonas aeruginosa PA01
gucgaugcuccaaugcaccugc

SEQ ID NO: 3487440 - RNA, 23 nt, Pseudomonas aeruginosa PA01
gucgaugcuccaaugcaccugcg

SEQ ID NO: 3487441 - RNA, 14 nt, Pseudomonas aeruginosa PA01
gucgaugcugccgu

SEQ ID NO: 3487442 - RNA, 19 nt, Pseudomonas aeruginosa PA01
gucgaugcugccguagcgc

SEQ ID NO: 3487443 - RNA, 17 nt, Pseudomonas aeruginosa PA01
gucgaugcuuucgagca

SEQ ID NO: 3487444 - RNA, 16 nt, Pseudomonas aeruginosa PA01
gucgaugggccguagg

SEQ ID NO: 3487445 - RNA, 16 nt, Pseudomonas aeruginosa PA01
gucgaugggcgacagc

SEQ ID NO: 3487446 - RNA, 16 nt, Pseudomonas aeruginosa PA01
gucgaugggcgagcga

SEQ ID NO: 3487447 - RNA, 17 nt, Pseudomonas aeruginosa PA01
gucgauggucaggauca

SEQ ID NO: 3487448 - RNA, 22 nt, Pseudomonas aeruginosa PA01
gucgauguauccguacuggcgc

SEQ ID NO: 3487449 - RNA, 19 nt, Pseudomonas aeruginosa PA01
gucgcacagccaggggcac

SEQ ID NO: 3487450 - RNA, 15 nt, Pseudomonas aeruginosa PA01
gucgcaccgccagca

SEQ ID NO: 3487451 - RNA, 17 nt, Pseudomonas aeruginosa PA01
gucgcaccgccagcagu

SEQ ID NO: 3487452 - RNA, 18 nt, Pseudomonas aeruginosa PA01
gucgcaccgggaggcgcc

SEQ ID NO: 3487453 - RNA, 20 nt, Pseudomonas aeruginosa PA01
gucgcaccgggaggcgccgc

SEQ ID NO: 3487454 - RNA, 19 nt, Pseudomonas aeruginosa PA01
gucgcaccuguuccagcaa

SEQ ID NO: 3487455 - RNA, 16 nt, Pseudomonas aeruginosa PA01
gucgcacgcagcgccg

SEQ ID NO: 3487456 - RNA, 11 nt, Pseudomonas aeruginosa PA01
gucgcacugcu

SEQ ID NO: 3487457 - RNA, 13 nt, Pseudomonas aeruginosa PA01
gucgcacuggucg

SEQ ID NO: 3487458 - RNA, 15 nt, Pseudomonas aeruginosa PA01
gucgcacuggucggc

SEQ ID NO: 3487459 - RNA, 19 nt, Pseudomonas aeruginosa PA01
gucgcagagacgcagcgcu

SEQ ID NO: 3487460 - RNA, 13 nt, Pseudomonas aeruginosa PA01
gucgcagcaggcc

SEQ ID NO: 3487461 - RNA, 14 nt, Pseudomonas aeruginosa PA01
gucgcagcaggccg

SEQ ID NO: 3487462 - RNA, 16 nt, Pseudomonas aeruginosa PA01
gucgcagcaggccgcu

SEQ ID NO: 3487463 - RNA, 13 nt, Pseudomonas aeruginosa PA01
gucgcagccgagc

SEQ ID NO: 3487464 - RNA, 18 nt, Pseudomonas aeruginosa PA01
gucgcagccgagccccca

SEQ ID NO: 3487465 - RNA, 13 nt, Pseudomonas aeruginosa PA01
gucgcagcggccg

SEQ ID NO: 3487466 - RNA, 14 nt, Pseudomonas aeruginosa PA01
gucgcagcggccgu

SEQ ID NO: 3487467 - RNA, 13 nt, Pseudomonas aeruginosa PA01
gucgcagcgggcu

SEQ ID NO: 3487468 - RNA, 17 nt, Pseudomonas aeruginosa PA01
gucgcagcguuccagcg

SEQ ID NO: 3487469 - RNA, 23 nt, Pseudomonas aeruginosa PA01
gucgcagcguuccagcgcuggca

SEQ ID NO: 3487470 - RNA, 15 nt, Pseudomonas aeruginosa PA01
gucgcagcuccagcg

SEQ ID NO: 3487471 - RNA, 21 nt, Pseudomonas aeruginosa PA01
gucgcaggccugguaggcguc

SEQ ID NO: 3487472 - RNA, 19 nt, Pseudomonas aeruginosa PA01
gucgcaggcgaugccgacg

SEQ ID NO: 3487473 - RNA, 19 nt, Pseudomonas aeruginosa PA01
gucgcaggcucaguucggc

SEQ ID NO: 3487474 - RNA, 13 nt, Pseudomonas aeruginosa PA01
gucgcaggggcuu

SEQ ID NO: 3487475 - RNA, 19 nt, Pseudomonas aeruginosa PA01
gucgcagguaacccgcggc

SEQ ID NO: 3487476 - RNA, 20 nt, Pseudomonas aeruginosa PA01
gucgcagguaacccgcggcg

SEQ ID NO: 3487477 - RNA, 18 nt, Pseudomonas aeruginosa PA01
gucgcauccaccagcggg

SEQ ID NO: 3487478 - RNA, 21 nt, Pseudomonas aeruginosa PA01
gucgccaaagaaaaggcccgc

SEQ ID NO: 3487479 - RNA, 15 nt, Pseudomonas aeruginosa PA01
gucgccaagcccggc

SEQ ID NO: 3487480 - RNA, 21 nt, Pseudomonas aeruginosa PA01
gucgccacgcaguucgcgggc

SEQ ID NO: 3487481 - RNA, 14 nt, Pseudomonas aeruginosa PA01
gucgccacgcccgc

SEQ ID NO: 3487482 - RNA, 15 nt, Pseudomonas aeruginosa PA01
gucgccacgcccgcc

SEQ ID NO: 3487483 - RNA, 17 nt, Pseudomonas aeruginosa PA01
gucgccacgcccgccgu

SEQ ID NO: 3487484 - RNA, 22 nt, Pseudomonas aeruginosa PA01
gucgccagcagguagccagggg

SEQ ID NO: 3487485 - RNA, 22 nt, Pseudomonas aeruginosa PA01
gucgccaggccguagaccacca

SEQ ID NO: 3487486 - RNA, 16 nt, Pseudomonas aeruginosa PA01
gucgccauccuggucg

SEQ ID NO: 3487487 - RNA, 18 nt, Pseudomonas aeruginosa PA01
gucgccaugcggcaggcc

SEQ ID NO: 3487488 - RNA, 15 nt, Pseudomonas aeruginosa PA01
gucgccauucggcga

SEQ ID NO: 3487489 - RNA, 16 nt, Pseudomonas aeruginosa PA01
gucgccauucggcgac

SEQ ID NO: 3487490 - RNA, 15 nt, Pseudomonas aeruginosa PA01
gucgcccaccuugcg

SEQ ID NO: 3487491 - RNA, 13 nt, Pseudomonas aeruginosa PA01
gucgcccagcgcc

SEQ ID NO: 3487492 - RNA, 14 nt, Pseudomonas aeruginosa PA01
gucgcccagcgccu

SEQ ID NO: 3487493 - RNA, 15 nt, Pseudomonas aeruginosa PA01
gucgcccagcgccug

SEQ ID NO: 3487494 - RNA, 13 nt, Pseudomonas aeruginosa PA01
gucgcccaggccg

SEQ ID NO: 3487495 - RNA, 15 nt, Pseudomonas aeruginosa PA01
gucgcccaggccgcu

SEQ ID NO: 3487496 - RNA, 19 nt, Pseudomonas aeruginosa PA01
gucgcccaggccgcuggcg

SEQ ID NO: 3487497 - RNA, 21 nt, Pseudomonas aeruginosa PA01
gucgcccaggccgcuggcggc

SEQ ID NO: 3487498 - RNA, 15 nt, Pseudomonas aeruginosa PA01
gucgcccaucucggu

SEQ ID NO: 3487499 - RNA, 23 nt, Pseudomonas aeruginosa PA01
gucgcccaucucgguguccacca

SEQ ID NO: 3487500 - RNA, 23 nt, Pseudomonas aeruginosa PA01
gucgcccaugugcuugaccgccg

SEQ ID NO: 3487501 - RNA, 18 nt, Pseudomonas aeruginosa PA01
gucgccccacagcggugg

SEQ ID NO: 3487502 - RNA, 19 nt, Pseudomonas aeruginosa PA01
gucgccccacagcgguggg

SEQ ID NO: 3487503 - RNA, 23 nt, Pseudomonas aeruginosa PA01
gucgccccacagcggugggaaga

SEQ ID NO: 3487504 - RNA, 19 nt, Pseudomonas aeruginosa PA01
gucgccccgguuggcgccc

SEQ ID NO: 3487505 - RNA, 12 nt, Pseudomonas aeruginosa PA01
gucgcccgccgg

SEQ ID NO: 3487506 - RNA, 15 nt, Pseudomonas aeruginosa PA01
gucgcccgccggcgu

SEQ ID NO: 3487507 - RNA, 21 nt, Pseudomonas aeruginosa PA01
gucgcccggauagacgccguc

SEQ ID NO: 3487508 - RNA, 17 nt, Pseudomonas aeruginosa PA01
gucgcccgggcgccacc

SEQ ID NO: 3487509 - RNA, 18 nt, Pseudomonas aeruginosa PA01
gucgcccgugccucggcg

SEQ ID NO: 3487510 - RNA, 19 nt, Pseudomonas aeruginosa PA01
gucgcccgugccucggcgg

SEQ ID NO: 3487511 - RNA, 16 nt, Pseudomonas aeruginosa PA01
gucgcccucgcggagc

SEQ ID NO: 3487512 - RNA, 17 nt, Pseudomonas aeruginosa PA01
gucgcccucgcggagcu

SEQ ID NO: 3487513 - RNA, 13 nt, Pseudomonas aeruginosa PA01
gucgcccucggcc

SEQ ID NO: 3487514 - RNA, 14 nt, Pseudomonas aeruginosa PA01
gucgcccucggcca

SEQ ID NO: 3487515 - RNA, 16 nt, Pseudomonas aeruginosa PA01
gucgcccucggccagg

SEQ ID NO: 3487516 - RNA, 17 nt, Pseudomonas aeruginosa PA01
gucgcccucggcgcugg

SEQ ID NO: 3487517 - RNA, 18 nt, Pseudomonas aeruginosa PA01
gucgcccugcagcgcgcg

SEQ ID NO: 3487518 - RNA, 19 nt, Pseudomonas aeruginosa PA01
gucgcccugcagcgcgcgc

SEQ ID NO: 3487519 - RNA, 22 nt, Pseudomonas aeruginosa PA01
gucgcccugcagcgcgcgcugg

SEQ ID NO: 3487520 - RNA, 14 nt, Pseudomonas aeruginosa PA01
gucgcccuggugca

SEQ ID NO: 3487521 - RNA, 17 nt, Pseudomonas aeruginosa PA01
gucgcccuucaggucga

SEQ ID NO: 3487522 - RNA, 16 nt, Pseudomonas aeruginosa PA01
gucgcccuucuuccag

SEQ ID NO: 3487523 - RNA, 20 nt, Pseudomonas aeruginosa PA01
gucgccgaacagccgcccca

SEQ ID NO: 3487524 - RNA, 18 nt, Pseudomonas aeruginosa PA01
gucgccgaacggcagcug

SEQ ID NO: 3487525 - RNA, 14 nt, Pseudomonas aeruginosa PA01
gucgccgaacuccg

SEQ ID NO: 3487526 - RNA, 19 nt, Pseudomonas aeruginosa PA01
gucgccgaacuccgagcag

SEQ ID NO: 3487527 - RNA, 14 nt, Pseudomonas aeruginosa PA01
gucgccgaccaggc

SEQ ID NO: 3487528 - RNA, 15 nt, Pseudomonas aeruginosa PA01
gucgccgaccaggcg

SEQ ID NO: 3487529 - RNA, 17 nt, Pseudomonas aeruginosa PA01
gucgccgaccaggcggc

SEQ ID NO: 3487530 - RNA, 18 nt, Pseudomonas aeruginosa PA01
gucgccgaccaggcggcc

SEQ ID NO: 3487531 - RNA, 17 nt, Pseudomonas aeruginosa PA01
gucgccgacccugcacc

SEQ ID NO: 3487532 - RNA, 17 nt, Pseudomonas aeruginosa PA01
gucgccgacuucggcaa

SEQ ID NO: 3487533 - RNA, 22 nt, Pseudomonas aeruginosa PA01
gucgccgacuucggcaagcacc

SEQ ID NO: 3487534 - RNA, 15 nt, Pseudomonas aeruginosa PA01
gucgccgaucugcag

SEQ ID NO: 3487535 - RNA, 17 nt, Pseudomonas aeruginosa PA01
gucgccgcacaccgcgc

SEQ ID NO: 3487536 - RNA, 21 nt, Pseudomonas aeruginosa PA01
gucgccgcacaccgcgcgcgc

SEQ ID NO: 3487537 - RNA, 14 nt, Pseudomonas aeruginosa PA01
gucgccgcaccggc

SEQ ID NO: 3487538 - RNA, 15 nt, Pseudomonas aeruginosa PA01
gucgccgcaccggcg

SEQ ID NO: 3487539 - RNA, 22 nt, Pseudomonas aeruginosa PA01
gucgccgcaccggcgauggccg

SEQ ID NO: 3487540 - RNA, 24 nt, Pseudomonas aeruginosa PA01
gucgccgcaccggcgauggccggc

SEQ ID NO: 3487541 - RNA, 12 nt, Pseudomonas aeruginosa PA01
gucgccgcagcc

SEQ ID NO: 3487542 - RNA, 14 nt, Pseudomonas aeruginosa PA01
gucgccgcaggucc

SEQ ID NO: 3487543 - RNA, 15 nt, Pseudomonas aeruginosa PA01
gucgccgcagguccg

SEQ ID NO: 3487544 - RNA, 14 nt, Pseudomonas aeruginosa PA01
gucgccgccagcau

SEQ ID NO: 3487545 - RNA, 13 nt, Pseudomonas aeruginosa PA01
gucgccgccagcg

SEQ ID NO: 3487546 - RNA, 21 nt, Pseudomonas aeruginosa PA01
gucgccgccagcgccggccau

SEQ ID NO: 3487547 - RNA, 23 nt, Pseudomonas aeruginosa PA01
gucgccgccagcgccggccauug

SEQ ID NO: 3487548 - RNA, 13 nt, Pseudomonas aeruginosa PA01
gucgccgccagcu

SEQ ID NO: 3487549 - RNA, 16 nt, Pseudomonas aeruginosa PA01
gucgccgccaguucgg

SEQ ID NO: 3487550 - RNA, 19 nt, Pseudomonas aeruginosa PA01
gucgccgccaguucggcca

SEQ ID NO: 3487551 - RNA, 13 nt, Pseudomonas aeruginosa PA01
gucgccgcccacg

SEQ ID NO: 3487552 - RNA, 14 nt, Pseudomonas aeruginosa PA01
gucgccgcccacgc

SEQ ID NO: 3487553 - RNA, 13 nt, Pseudomonas aeruginosa PA01
gucgccgcccggc

SEQ ID NO: 3487554 - RNA, 16 nt, Pseudomonas aeruginosa PA01
gucgccgcccggcagc

SEQ ID NO: 3487555 - RNA, 19 nt, Pseudomonas aeruginosa PA01
gucgccgcccggcagcggc

SEQ ID NO: 3487556 - RNA, 16 nt, Pseudomonas aeruginosa PA01
gucgccgccgaggcgc

SEQ ID NO: 3487557 - RNA, 17 nt, Pseudomonas aeruginosa PA01
gucgccgccgaggcgcg

SEQ ID NO: 3487558 - RNA, 22 nt, Pseudomonas aeruginosa PA01
gucgccgccgaggcgcgccacg

SEQ ID NO: 3487559 - RNA, 23 nt, Pseudomonas aeruginosa PA01
gucgccgccgaggcgcgccacgc

SEQ ID NO: 3487560 - RNA, 24 nt, Pseudomonas aeruginosa PA01
gucgccgccgaggcgcgccacgca

SEQ ID NO: 3487561 - RNA, 16 nt, Pseudomonas aeruginosa PA01
gucgccgccgcgggcg

SEQ ID NO: 3487562 - RNA, 16 nt, Pseudomonas aeruginosa PA01
gucgccgcggacggcc

SEQ ID NO: 3487563 - RNA, 19 nt, Pseudomonas aeruginosa PA01
gucgccgcggacggccggc

SEQ ID NO: 3487564 - RNA, 20 nt, Pseudomonas aeruginosa PA01
gucgccgcggacggccggcu

SEQ ID NO: 3487565 - RNA, 21 nt, Pseudomonas aeruginosa PA01
gucgccgcucauccgcuggua

SEQ ID NO: 3487566 - RNA, 17 nt, Pseudomonas aeruginosa PA01
gucgccgcugaugcgcu

SEQ ID NO: 3487567 - RNA, 22 nt, Pseudomonas aeruginosa PA01
gucgccgcugaugcgcuggucg

SEQ ID NO: 3487568 - RNA, 15 nt, Pseudomonas aeruginosa PA01
gucgccgcuggacga

SEQ ID NO: 3487569 - RNA, 16 nt, Pseudomonas aeruginosa PA01
gucgccgcugggcagc

SEQ ID NO: 3487570 - RNA, 17 nt, Pseudomonas aeruginosa PA01
gucgccgcugggcagca

SEQ ID NO: 3487571 - RNA, 17 nt, Pseudomonas aeruginosa PA01
gucgccggaggggcggc

SEQ ID NO: 3487572 - RNA, 18 nt, Pseudomonas aeruginosa PA01
gucgccggaggggcggcc

SEQ ID NO: 3487573 - RNA, 19 nt, Pseudomonas aeruginosa PA01
gucgccggaggggcggccg

SEQ ID NO: 3487574 - RNA, 20 nt, Pseudomonas aeruginosa PA01
gucgccggaggggcggccgc

SEQ ID NO: 3487575 - RNA, 23 nt, Pseudomonas aeruginosa PA01
gucgccggagucguagcgcgcgg

SEQ ID NO: 3487576 - RNA, 18 nt, Pseudomonas aeruginosa PA01
gucgccggcaucguggcc

SEQ ID NO: 3487577 - RNA, 21 nt, Pseudomonas aeruginosa PA01
gucgccggcaucguggccaug

SEQ ID NO: 3487578 - RNA, 13 nt, Pseudomonas aeruginosa PA01
gucgccggcaugg

SEQ ID NO: 3487579 - RNA, 15 nt, Pseudomonas aeruginosa PA01
gucgccggcauggau

SEQ ID NO: 3487580 - RNA, 21 nt, Pseudomonas aeruginosa PA01
gucgccgggaaacagggcgac

SEQ ID NO: 3487581 - RNA, 22 nt, Pseudomonas aeruginosa PA01
gucgccgggauuguugcggcgg

SEQ ID NO: 3487582 - RNA, 12 nt, Pseudomonas aeruginosa PA01
gucgccggggcc

SEQ ID NO: 3487583 - RNA, 22 nt, Pseudomonas aeruginosa PA01
gucgccgguaaugaaaagcccc

SEQ ID NO: 3487584 - RNA, 14 nt, Pseudomonas aeruginosa PA01
gucgccggucaggc

SEQ ID NO: 3487585 - RNA, 17 nt, Pseudomonas aeruginosa PA01
gucgccggucaggcugc

SEQ ID NO: 3487586 - RNA, 19 nt, Pseudomonas aeruginosa PA01
gucgccggucaggcugcgg

SEQ ID NO: 3487587 - RNA, 23 nt, Pseudomonas aeruginosa PA01
gucgccggucaggcugcggcgga

SEQ ID NO: 3487588 - RNA, 22 nt, Pseudomonas aeruginosa PA01
gucgccgguucaguucagccgg

SEQ ID NO: 3487589 - RNA, 17 nt, Pseudomonas aeruginosa PA01
gucgccguccaccaagc

SEQ ID NO: 3487590 - RNA, 16 nt, Pseudomonas aeruginosa PA01
gucgccguccugugga

SEQ ID NO: 3487591 - RNA, 16 nt, Pseudomonas aeruginosa PA01
gucgccguccuugucg

SEQ ID NO: 3487592 - RNA, 22 nt, Pseudomonas aeruginosa PA01
gucgccguccuugucgcagcgg

SEQ ID NO: 3487593 - RNA, 19 nt, Pseudomonas aeruginosa PA01
gucgccgugguggccgugg

SEQ ID NO: 3487594 - RNA, 22 nt, Pseudomonas aeruginosa PA01
gucgccgugguggccguggcgc

SEQ ID NO: 3487595 - RNA, 17 nt, Pseudomonas aeruginosa PA01
gucgccguuggccuuca

SEQ ID NO: 3487596 - RNA, 19 nt, Pseudomonas aeruginosa PA01
gucgccucgaacauggcca

SEQ ID NO: 3487597 - RNA, 22 nt, Pseudomonas aeruginosa PA01
gucgccucgaacauggccaccg

SEQ ID NO: 3487598 - RNA, 13 nt, Pseudomonas aeruginosa PA01
gucgccucggggg

SEQ ID NO: 3487599 - RNA, 16 nt, Pseudomonas aeruginosa PA01
gucgccugccaggcgg

SEQ ID NO: 3487600 - RNA, 13 nt, Pseudomonas aeruginosa PA01
gucgccuggcccu

SEQ ID NO: 3487601 - RNA, 20 nt, Pseudomonas aeruginosa PA01
gucgccuggcccuggaccuc

SEQ ID NO: 3487602 - RNA, 12 nt, Pseudomonas aeruginosa PA01
gucgccuuccac

SEQ ID NO: 3487603 - RNA, 13 nt, Pseudomonas aeruginosa PA01
gucgccuuccacc

SEQ ID NO: 3487604 - RNA, 19 nt, Pseudomonas aeruginosa PA01
gucgccuuccaccaccagg

SEQ ID NO: 3487605 - RNA, 15 nt, Pseudomonas aeruginosa PA01
gucgccuuccggcag

SEQ ID NO: 3487606 - RNA, 16 nt, Pseudomonas aeruginosa PA01
gucgccuuccucggcg

SEQ ID NO: 3487607 - RNA, 14 nt, Pseudomonas aeruginosa PA01
gucgccuugaccag

SEQ ID NO: 3487608 - RNA, 18 nt, Pseudomonas aeruginosa PA01
gucgccuugaccagcggc

SEQ ID NO: 3487609 - RNA, 22 nt, Pseudomonas aeruginosa PA01
gucgccuugaccagcggcccgg

SEQ ID NO: 3487610 - RNA, 21 nt, Pseudomonas aeruginosa PA01
gucgcgaccgguaacuggcca

SEQ ID NO: 3487611 - RNA, 14 nt, Pseudomonas aeruginosa PA01
gucgcgacugacca

SEQ ID NO: 3487612 - RNA, 17 nt, Pseudomonas aeruginosa PA01
gucgcgacugaccacgc

SEQ ID NO: 3487613 - RNA, 19 nt, Pseudomonas aeruginosa PA01
gucgcgacugaccacgcag

SEQ ID NO: 3487614 - RNA, 17 nt, Pseudomonas aeruginosa PA01
gucgcgagcagggcgau

SEQ ID NO: 3487615 - RNA, 23 nt, Pseudomonas aeruginosa PA01
gucgcgagcagggcgaugccgau

SEQ ID NO: 3487616 - RNA, 18 nt, Pseudomonas aeruginosa PA01
gucgcgagguuccgcggc

SEQ ID NO: 3487617 - RNA, 21 nt, Pseudomonas aeruginosa PA01
gucgcgauagacgccggcgac

SEQ ID NO: 3487618 - RNA, 13 nt, Pseudomonas aeruginosa PA01
gucgcgaucaccg

SEQ ID NO: 3487619 - RNA, 18 nt, Pseudomonas aeruginosa PA01
gucgcgaucaccgcgucc

SEQ ID NO: 3487620 - RNA, 14 nt, Pseudomonas aeruginosa PA01
gucgcgauccaccg

SEQ ID NO: 3487621 - RNA, 16 nt, Pseudomonas aeruginosa PA01
gucgcgauccaccgcc

SEQ ID NO: 3487622 - RNA, 20 nt, Pseudomonas aeruginosa PA01
gucgcgauccaccgccaggg

SEQ ID NO: 3487623 - RNA, 22 nt, Pseudomonas aeruginosa PA01
gucgcgauccaccgccagggcg

SEQ ID NO: 3487624 - RNA, 14 nt, Pseudomonas aeruginosa PA01
gucgcgaucugcug

SEQ ID NO: 3487625 - RNA, 18 nt, Pseudomonas aeruginosa PA01
gucgcgaucugcugguug

SEQ ID NO: 3487626 - RNA, 15 nt, Pseudomonas aeruginosa PA01
gucgcgcaccaccca

SEQ ID NO: 3487627 - RNA, 14 nt, Pseudomonas aeruginosa PA01
gucgcgcaccuggc

SEQ ID NO: 3487628 - RNA, 22 nt, Pseudomonas aeruginosa PA01
gucgcgcaccuggcggucgccg

SEQ ID NO: 3487629 - RNA, 13 nt, Pseudomonas aeruginosa PA01
gucgcgcagcgcc

SEQ ID NO: 3487630 - RNA, 15 nt, Pseudomonas aeruginosa PA01
gucgcgcagcgccuc

SEQ ID NO: 3487631 - RNA, 20 nt, Pseudomonas aeruginosa PA01
gucgcgcagcgccuccagcg

SEQ ID NO: 3487632 - RNA, 14 nt, Pseudomonas aeruginosa PA01
gucgcgcagcggcu

SEQ ID NO: 3487633 - RNA, 15 nt, Pseudomonas aeruginosa PA01
gucgcgcagcggcuc

SEQ ID NO: 3487634 - RNA, 14 nt, Pseudomonas aeruginosa PA01
gucgcgcagcuccu

SEQ ID NO: 3487635 - RNA, 17 nt, Pseudomonas aeruginosa PA01
gucgcgcagcuccucgg

SEQ ID NO: 3487636 - RNA, 18 nt, Pseudomonas aeruginosa PA01
gucgcgcaggcgggcggc

SEQ ID NO: 3487637 - RNA, 19 nt, Pseudomonas aeruginosa PA01
gucgcgcaggcgggcggcg

SEQ ID NO: 3487638 - RNA, 16 nt, Pseudomonas aeruginosa PA01
gucgcgcaggcggugg

SEQ ID NO: 3487639 - RNA, 19 nt, Pseudomonas aeruginosa PA01
gucgcgcaggcgguggagc

SEQ ID NO: 3487640 - RNA, 14 nt, Pseudomonas aeruginosa PA01
gucgcgcagggcag

SEQ ID NO: 3487641 - RNA, 20 nt, Pseudomonas aeruginosa PA01
gucgcgcagggcagcgcgau

SEQ ID NO: 3487642 - RNA, 16 nt, Pseudomonas aeruginosa PA01
gucgcgcagggccagg

SEQ ID NO: 3487643 - RNA, 12 nt, Pseudomonas aeruginosa PA01
gucgcgccagca

SEQ ID NO: 3487644 - RNA, 13 nt, Pseudomonas aeruginosa PA01
gucgcgccagcac

SEQ ID NO: 3487645 - RNA, 13 nt, Pseudomonas aeruginosa PA01
gucgcgccaggcg

SEQ ID NO: 3487646 - RNA, 19 nt, Pseudomonas aeruginosa PA01
gucgcgcccagugcccggc

SEQ ID NO: 3487647 - RNA, 16 nt, Pseudomonas aeruginosa PA01
gucgcgcccccaucug

SEQ ID NO: 3487648 - RNA, 14 nt, Pseudomonas aeruginosa PA01
gucgcgccccgcca

SEQ ID NO: 3487649 - RNA, 16 nt, Pseudomonas aeruginosa PA01
gucgcgccccgccagg

SEQ ID NO: 3487650 - RNA, 13 nt, Pseudomonas aeruginosa PA01
gucgcgcccgcug

SEQ ID NO: 3487651 - RNA, 18 nt, Pseudomonas aeruginosa PA01
gucgcgcccgcugugcgg

SEQ ID NO: 3487652 - RNA, 23 nt, Pseudomonas aeruginosa PA01
gucgcgccgcccggcucgccgcc

SEQ ID NO: 3487653 - RNA, 14 nt, Pseudomonas aeruginosa PA01
gucgcgccggccau

SEQ ID NO: 3487654 - RNA, 17 nt, Pseudomonas aeruginosa PA01
gucgcgccggccauucg

SEQ ID NO: 3487655 - RNA, 21 nt, Pseudomonas aeruginosa PA01
gucgcgccggccauucgcugu

SEQ ID NO: 3487656 - RNA, 14 nt, Pseudomonas aeruginosa PA01
gucgcgccgguggc

SEQ ID NO: 3487657 - RNA, 17 nt, Pseudomonas aeruginosa PA01
gucgcgccgguggcgua

SEQ ID NO: 3487658 - RNA, 23 nt, Pseudomonas aeruginosa PA01
gucgcgccgguggcguacccgcc

SEQ ID NO: 3487659 - RNA, 21 nt, Pseudomonas aeruginosa PA01
gucgcgcgaaagggucaggcc

SEQ ID NO: 3487660 - RNA, 16 nt, Pseudomonas aeruginosa PA01
gucgcgcgccggagcc

SEQ ID NO: 3487661 - RNA, 21 nt, Pseudomonas aeruginosa PA01
gucgcgcgcgcuucuugucgu

SEQ ID NO: 3487662 - RNA, 18 nt, Pseudomonas aeruginosa PA01
gucgcgcgcggccagcuc

SEQ ID NO: 3487663 - RNA, 14 nt, Pseudomonas aeruginosa PA01
gucgcgcggccagc

SEQ ID NO: 3487664 - RNA, 17 nt, Pseudomonas aeruginosa PA01
gucgcgcggccagcgug

SEQ ID NO: 3487665 - RNA, 18 nt, Pseudomonas aeruginosa PA01
gucgcgcggcgccugcug

SEQ ID NO: 3487666 - RNA, 19 nt, Pseudomonas aeruginosa PA01
gucgcgcggcgccugcugc

SEQ ID NO: 3487667 - RNA, 14 nt, Pseudomonas aeruginosa PA01
gucgcgcguccagc

SEQ ID NO: 3487668 - RNA, 16 nt, Pseudomonas aeruginosa PA01
gucgcgcguccagccg

SEQ ID NO: 3487669 - RNA, 16 nt, Pseudomonas aeruginosa PA01
gucgcgcgugccccgu

SEQ ID NO: 3487670 - RNA, 16 nt, Pseudomonas aeruginosa PA01
gucgcgcucaggcgca

SEQ ID NO: 3487671 - RNA, 17 nt, Pseudomonas aeruginosa PA01
gucgcgcucaggcgcag

SEQ ID NO: 3487672 - RNA, 19 nt, Pseudomonas aeruginosa PA01
gucgcgcucaggcgcagcg

SEQ ID NO: 3487673 - RNA, 16 nt, Pseudomonas aeruginosa PA01
gucgcgcucuggccca

SEQ ID NO: 3487674 - RNA, 17 nt, Pseudomonas aeruginosa PA01
gucgcgcuggaccuggc

SEQ ID NO: 3487675 - RNA, 20 nt, Pseudomonas aeruginosa PA01
gucgcgcuggaccuggccgg

SEQ ID NO: 3487676 - RNA, 22 nt, Pseudomonas aeruginosa PA01
gucgcgcuggaccuggccggcg

SEQ ID NO: 3487677 - RNA, 19 nt, Pseudomonas aeruginosa PA01
gucgcgcuguugccgcgcu

SEQ ID NO: 3487678 - RNA, 23 nt, Pseudomonas aeruginosa PA01
gucgcgcuugccuuccugggcgu

SEQ ID NO: 3487679 - RNA, 15 nt, Pseudomonas aeruginosa PA01
gucgcggaacucgau

SEQ ID NO: 3487680 - RNA, 15 nt, Pseudomonas aeruginosa PA01
gucgcggacccgcgc

SEQ ID NO: 3487681 - RNA, 19 nt, Pseudomonas aeruginosa PA01
gucgcggacccgcgccggc

SEQ ID NO: 3487682 - RNA, 22 nt, Pseudomonas aeruginosa PA01
gucgcggacccgcgccggcagc

SEQ ID NO: 3487683 - RNA, 17 nt, Pseudomonas aeruginosa PA01
gucgcggaccuccagcc

SEQ ID NO: 3487684 - RNA, 18 nt, Pseudomonas aeruginosa PA01
gucgcggaccuccagccg

SEQ ID NO: 3487685 - RNA, 23 nt, Pseudomonas aeruginosa PA01
gucgcggaccuccagccggccau

SEQ ID NO: 3487686 - RNA, 19 nt, Pseudomonas aeruginosa PA01
gucgcggacgaggaugguc

SEQ ID NO: 3487687 - RNA, 19 nt, Pseudomonas aeruginosa PA01
gucgcggacuccggaggcg

SEQ ID NO: 3487688 - RNA, 19 nt, Pseudomonas aeruginosa PA01
gucgcggagaauccgcucg

SEQ ID NO: 3487689 - RNA, 23 nt, Pseudomonas aeruginosa PA01
gucgcggaucaacgggcccugcc

SEQ ID NO: 3487690 - RNA, 19 nt, Pseudomonas aeruginosa PA01
gucgcggauguucaccagg

SEQ ID NO: 3487691 - RNA, 20 nt, Pseudomonas aeruginosa PA01
gucgcggauguucaccaggu

SEQ ID NO: 3487692 - RNA, 18 nt, Pseudomonas aeruginosa PA01
gucgcggccaucggcgaa

SEQ ID NO: 3487693 - RNA, 20 nt, Pseudomonas aeruginosa PA01
gucgcggccaucggcgaagc

SEQ ID NO: 3487694 - RNA, 15 nt, Pseudomonas aeruginosa PA01
gucgcggccccagca

SEQ ID NO: 3487695 - RNA, 14 nt, Pseudomonas aeruginosa PA01
gucgcggcccuggu

SEQ ID NO: 3487696 - RNA, 16 nt, Pseudomonas aeruginosa PA01
gucgcggcgccuggcg

SEQ ID NO: 3487697 - RNA, 18 nt, Pseudomonas aeruginosa PA01
gucgcggcugaagaagcu

SEQ ID NO: 3487698 - RNA, 19 nt, Pseudomonas aeruginosa PA01
gucgcggcugaaggccgaa

SEQ ID NO: 3487699 - RNA, 16 nt, Pseudomonas aeruginosa PA01
gucgcggcugcgcgcc

SEQ ID NO: 3487700 - RNA, 12 nt, Pseudomonas aeruginosa PA01
gucgcggcuggc

SEQ ID NO: 3487701 - RNA, 17 nt, Pseudomonas aeruginosa PA01
gucgcggcuggccgccu

SEQ ID NO: 3487702 - RNA, 20 nt, Pseudomonas aeruginosa PA01
gucgcggcuggccgccuggc

SEQ ID NO: 3487703 - RNA, 18 nt, Pseudomonas aeruginosa PA01
gucgcggcuuucuuccag

SEQ ID NO: 3487704 - RNA, 23 nt, Pseudomonas aeruginosa PA01
gucgcgggcaugcugcucggcau

SEQ ID NO: 3487705 - RNA, 17 nt, Pseudomonas aeruginosa PA01
gucgcgggccaggcccu

SEQ ID NO: 3487706 - RNA, 16 nt, Pseudomonas aeruginosa PA01
gucgcgggcgauggcc

SEQ ID NO: 3487707 - RNA, 17 nt, Pseudomonas aeruginosa PA01
gucgcggggcuugcgcc

SEQ ID NO: 3487708 - RNA, 19 nt, Pseudomonas aeruginosa PA01
gucgcgggucugcgaguug

SEQ ID NO: 3487709 - RNA, 17 nt, Pseudomonas aeruginosa PA01
gucgcgguacagccggu

SEQ ID NO: 3487710 - RNA, 16 nt, Pseudomonas aeruginosa PA01
gucgcggucaucgccg

SEQ ID NO: 3487711 - RNA, 17 nt, Pseudomonas aeruginosa PA01
gucgcggucaucgccgg

SEQ ID NO: 3487712 - RNA, 18 nt, Pseudomonas aeruginosa PA01
gucgcggucaucgccggc

SEQ ID NO: 3487713 - RNA, 20 nt, Pseudomonas aeruginosa PA01
gucgcggucaucgccggcgc

SEQ ID NO: 3487714 - RNA, 17 nt, Pseudomonas aeruginosa PA01
gucgcggucuuccgccg

SEQ ID NO: 3487715 - RNA, 20 nt, Pseudomonas aeruginosa PA01
gucgcggugcaguucgccgu

SEQ ID NO: 3487716 - RNA, 20 nt, Pseudomonas aeruginosa PA01
gucgcgguugccgaagcgcu

SEQ ID NO: 3487717 - RNA, 13 nt, Pseudomonas aeruginosa PA01
gucgcgguugcug

SEQ ID NO: 3487718 - RNA, 17 nt, Pseudomonas aeruginosa PA01
gucgcguacagcgggcc

SEQ ID NO: 3487719 - RNA, 19 nt, Pseudomonas aeruginosa PA01
gucgcguacagcgggccgg

SEQ ID NO: 3487720 - RNA, 22 nt, Pseudomonas aeruginosa PA01
gucgcguagaccaucgccggcg

SEQ ID NO: 3487721 - RNA, 16 nt, Pseudomonas aeruginosa PA01
gucgcguccggccagc

SEQ ID NO: 3487722 - RNA, 18 nt, Pseudomonas aeruginosa PA01
gucgcguccggccagccu

SEQ ID NO: 3487723 - RNA, 22 nt, Pseudomonas aeruginosa PA01
gucgcguccggccagccuggcc

SEQ ID NO: 3487724 - RNA, 23 nt, Pseudomonas aeruginosa PA01
gucgcguccggccagccuggcca

SEQ ID NO: 3487725 - RNA, 18 nt, Pseudomonas aeruginosa PA01
gucgcgucgcacccggcc

SEQ ID NO: 3487726 - RNA, 23 nt, Pseudomonas aeruginosa PA01
gucgcgucgcacccggcccaugg

SEQ ID NO: 3487727 - RNA, 15 nt, Pseudomonas aeruginosa PA01
gucgcgucggccugg

SEQ ID NO: 3487728 - RNA, 20 nt, Pseudomonas aeruginosa PA01
gucgcgucggccuggcgcag

SEQ ID NO: 3487729 - RNA, 14 nt, Pseudomonas aeruginosa PA01
gucgcguuccagcu

SEQ ID NO: 3487730 - RNA, 16 nt, Pseudomonas aeruginosa PA01
gucgcguuccagcucc

SEQ ID NO: 3487731 - RNA, 20 nt, Pseudomonas aeruginosa PA01
gucgcguucccacucgcgac

SEQ ID NO: 3487732 - RNA, 15 nt, Pseudomonas aeruginosa PA01
gucgcguucgucggc

SEQ ID NO: 3487733 - RNA, 17 nt, Pseudomonas aeruginosa PA01
gucgcguucgucggcca

SEQ ID NO: 3487734 - RNA, 16 nt, Pseudomonas aeruginosa PA01
gucgcguuggcgugcu

SEQ ID NO: 3487735 - RNA, 20 nt, Pseudomonas aeruginosa PA01
gucgcguuggcgugcucgcg

SEQ ID NO: 3487736 - RNA, 15 nt, Pseudomonas aeruginosa PA01
gucgcucagcgggcc

SEQ ID NO: 3487737 - RNA, 16 nt, Pseudomonas aeruginosa PA01
gucgcucagcgggccg

SEQ ID NO: 3487738 - RNA, 13 nt, Pseudomonas aeruginosa PA01
gucgcucauggcg

SEQ ID NO: 3487739 - RNA, 18 nt, Pseudomonas aeruginosa PA01
gucgcucauggcgccgcc

SEQ ID NO: 3487740 - RNA, 12 nt, Pseudomonas aeruginosa PA01
gucgcuccagac

SEQ ID NO: 3487741 - RNA, 21 nt, Pseudomonas aeruginosa PA01
gucgcuccagaccuccaggua

SEQ ID NO: 3487742 - RNA, 23 nt, Pseudomonas aeruginosa PA01
gucgcuccagaccuccagguagg

SEQ ID NO: 3487743 - RNA, 15 nt, Pseudomonas aeruginosa PA01
gucgcuccagcccca

SEQ ID NO: 3487744 - RNA, 11 nt, Pseudomonas aeruginosa PA01
gucgcuccggc

SEQ ID NO: 3487745 - RNA, 14 nt, Pseudomonas aeruginosa PA01
gucgcuccggcagc

SEQ ID NO: 3487746 - RNA, 23 nt, Pseudomonas aeruginosa PA01
gucgcucugggucuuggucacgg

SEQ ID NO: 3487747 - RNA, 18 nt, Pseudomonas aeruginosa PA01
gucgcugaccagcccggc

SEQ ID NO: 3487748 - RNA, 19 nt, Pseudomonas aeruginosa PA01
gucgcugaccagcccggcg

SEQ ID NO: 3487749 - RNA, 21 nt, Pseudomonas aeruginosa PA01
gucgcugaccagcccggcggc

SEQ ID NO: 3487750 - RNA, 18 nt, Pseudomonas aeruginosa PA01
gucgcugaccggccgcag

SEQ ID NO: 3487751 - RNA, 15 nt, Pseudomonas aeruginosa PA01
gucgcugagcggcug

SEQ ID NO: 3487752 - RNA, 16 nt, Pseudomonas aeruginosa PA01
gucgcugagcggcugg

SEQ ID NO: 3487753 - RNA, 14 nt, Pseudomonas aeruginosa PA01
gucgcugaggccgc

SEQ ID NO: 3487754 - RNA, 22 nt, Pseudomonas aeruginosa PA01
gucgcugaggccgcccuggccg

SEQ ID NO: 3487755 - RNA, 19 nt, Pseudomonas aeruginosa PA01
gucgcugcccaucgccucc

SEQ ID NO: 3487756 - RNA, 19 nt, Pseudomonas aeruginosa PA01
gucgcugcccucgaccagg

SEQ ID NO: 3487757 - RNA, 14 nt, Pseudomonas aeruginosa PA01
gucgcugccgagcu

SEQ ID NO: 3487758 - RNA, 13 nt, Pseudomonas aeruginosa PA01
gucgcugccgccg

SEQ ID NO: 3487759 - RNA, 16 nt, Pseudomonas aeruginosa PA01
gucgcugccgccgcgc

SEQ ID NO: 3487760 - RNA, 17 nt, Pseudomonas aeruginosa PA01
gucgcugccgccgcgcc

SEQ ID NO: 3487761 - RNA, 21 nt, Pseudomonas aeruginosa PA01
gucgcugccgccgcgcccggc

SEQ ID NO: 3487762 - RNA, 18 nt, Pseudomonas aeruginosa PA01
gucgcugcgcaacugccg

SEQ ID NO: 3487763 - RNA, 19 nt, Pseudomonas aeruginosa PA01
gucgcugcgcaacugccgg

SEQ ID NO: 3487764 - RNA, 15 nt, Pseudomonas aeruginosa PA01
gucgcugcucagggc

SEQ ID NO: 3487765 - RNA, 17 nt, Pseudomonas aeruginosa PA01
gucgcugcucagggccg

SEQ ID NO: 3487766 - RNA, 15 nt, Pseudomonas aeruginosa PA01
gucgcugcucggccu

SEQ ID NO: 3487767 - RNA, 20 nt, Pseudomonas aeruginosa PA01
gucgcugcucggccuugucc

SEQ ID NO: 3487768 - RNA, 13 nt, Pseudomonas aeruginosa PA01
gucgcugcuggcg

SEQ ID NO: 3487769 - RNA, 14 nt, Pseudomonas aeruginosa PA01
gucgcugcuggcgc

SEQ ID NO: 3487770 - RNA, 12 nt, Pseudomonas aeruginosa PA01
gucgcuggccag

SEQ ID NO: 3487771 - RNA, 11 nt, Pseudomonas aeruginosa PA01
gucgcuggccu

SEQ ID NO: 3487772 - RNA, 16 nt, Pseudomonas aeruginosa PA01
gucgcuggccugcagg

SEQ ID NO: 3487773 - RNA, 13 nt, Pseudomonas aeruginosa PA01
gucgcuggccugg

SEQ ID NO: 3487774 - RNA, 16 nt, Pseudomonas aeruginosa PA01
gucgcuguccuccagc

SEQ ID NO: 3487775 - RNA, 17 nt, Pseudomonas aeruginosa PA01
gucgcuguccuccagcg

SEQ ID NO: 3487776 - RNA, 16 nt, Pseudomonas aeruginosa PA01
gucgcuuccgcgcggc

SEQ ID NO: 3487777 - RNA, 16 nt, Pseudomonas aeruginosa PA01
gucgcuuccggcgcca

SEQ ID NO: 3487778 - RNA, 20 nt, Pseudomonas aeruginosa PA01
gucgcuuccggcgccaacca

SEQ ID NO: 3487779 - RNA, 13 nt, Pseudomonas aeruginosa PA01
gucgcuucgcccg

SEQ ID NO: 3487780 - RNA, 17 nt, Pseudomonas aeruginosa PA01
gucgcuucgcccgccgc

SEQ ID NO: 3487781 - RNA, 20 nt, Pseudomonas aeruginosa PA01
gucgcuucgcccgccgccug

SEQ ID NO: 3487782 - RNA, 23 nt, Pseudomonas aeruginosa PA01
gucgcuucgcccgccgccuggug

SEQ ID NO: 3487783 - RNA, 14 nt, Pseudomonas aeruginosa PA01
gucgcuuucgcgca

SEQ ID NO: 3487784 - RNA, 20 nt, Pseudomonas aeruginosa PA01
gucggaaagcagggcgaugg

SEQ ID NO: 3487785 - RNA, 15 nt, Pseudomonas aeruginosa PA01
gucggaacgaccacg

SEQ ID NO: 3487786 - RNA, 21 nt, Pseudomonas aeruginosa PA01
gucggaacgaccacgccugcc

SEQ ID NO: 3487787 - RNA, 24 nt, Pseudomonas aeruginosa PA01
gucggaagcgucagccgcggccgg

SEQ ID NO: 3487788 - RNA, 16 nt, Pseudomonas aeruginosa PA01
gucggacuugcggccc

SEQ ID NO: 3487789 - RNA, 17 nt, Pseudomonas aeruginosa PA01
gucggagauagccuccu

SEQ ID NO: 3487790 - RNA, 15 nt, Pseudomonas aeruginosa PA01
gucggaugccacucg

SEQ ID NO: 3487791 - RNA, 15 nt, Pseudomonas aeruginosa PA01
gucggcaaagccgcu

SEQ ID NO: 3487792 - RNA, 16 nt, Pseudomonas aeruginosa PA01
gucggcaaagccgcug

SEQ ID NO: 3487793 - RNA, 21 nt, Pseudomonas aeruginosa PA01
gucggcaacgauaccgccgcc

SEQ ID NO: 3487794 - RNA, 23 nt, Pseudomonas aeruginosa PA01
gucggcaacgauaccgccgccgg

SEQ ID NO: 3487795 - RNA, 17 nt, Pseudomonas aeruginosa PA01
gucggcaagcaggccgc

SEQ ID NO: 3487796 - RNA, 20 nt, Pseudomonas aeruginosa PA01
gucggcaauucuucaagguc

SEQ ID NO: 3487797 - RNA, 15 nt, Pseudomonas aeruginosa PA01
gucggcaccagggcu

SEQ ID NO: 3487798 - RNA, 20 nt, Pseudomonas aeruginosa PA01
gucggcaccagggcuucgcg

SEQ ID NO: 3487799 - RNA, 22 nt, Pseudomonas aeruginosa PA01
gucggcaccagggcuucgcgca

SEQ ID NO: 3487800 - RNA, 23 nt, Pseudomonas aeruginosa PA01
gucggcaccagggcuucgcgcag

SEQ ID NO: 3487801 - RNA, 15 nt, Pseudomonas aeruginosa PA01
gucggcaccgaucgc

SEQ ID NO: 3487802 - RNA, 18 nt, Pseudomonas aeruginosa PA01
gucggcaccgaucgcccg

SEQ ID NO: 3487803 - RNA, 13 nt, Pseudomonas aeruginosa PA01
gucggcaccugca

SEQ ID NO: 3487804 - RNA, 14 nt, Pseudomonas aeruginosa PA01
gucggcaccugcag

SEQ ID NO: 3487805 - RNA, 15 nt, Pseudomonas aeruginosa PA01
gucggcaccugcaga

SEQ ID NO: 3487806 - RNA, 16 nt, Pseudomonas aeruginosa PA01
gucggcacgaugucga

SEQ ID NO: 3487807 - RNA, 22 nt, Pseudomonas aeruginosa PA01
gucggcacgaugucgaccuggg

SEQ ID NO: 3487808 - RNA, 18 nt, Pseudomonas aeruginosa PA01
gucggcagcgucgagcug

SEQ ID NO: 3487809 - RNA, 17 nt, Pseudomonas aeruginosa PA01
gucggcaggaccgacuc

SEQ ID NO: 3487810 - RNA, 13 nt, Pseudomonas aeruginosa PA01
gucggcagucgcc

SEQ ID NO: 3487811 - RNA, 18 nt, Pseudomonas aeruginosa PA01
gucggcagucgccgcacc

SEQ ID NO: 3487812 - RNA, 16 nt, Pseudomonas aeruginosa PA01
gucggcauccggcagg

SEQ ID NO: 3487813 - RNA, 17 nt, Pseudomonas aeruginosa PA01
gucggcaucgaacucac

SEQ ID NO: 3487814 - RNA, 21 nt, Pseudomonas aeruginosa PA01
gucggcaucgaacucacagau

SEQ ID NO: 3487815 - RNA, 14 nt, Pseudomonas aeruginosa PA01
gucggcaucgcgua

SEQ ID NO: 3487816 - RNA, 15 nt, Pseudomonas aeruginosa PA01
gucggcaucgcguag

SEQ ID NO: 3487817 - RNA, 18 nt, Pseudomonas aeruginosa PA01
gucggcaucgcguagggc

SEQ ID NO: 3487818 - RNA, 23 nt, Pseudomonas aeruginosa PA01
gucggcauggcuguagggacagg

SEQ ID NO: 3487819 - RNA, 15 nt, Pseudomonas aeruginosa PA01
gucggccaacugggc

SEQ ID NO: 3487820 - RNA, 20 nt, Pseudomonas aeruginosa PA01
gucggccaacugggccuuga

SEQ ID NO: 3487821 - RNA, 13 nt, Pseudomonas aeruginosa PA01
gucggccaccagg

SEQ ID NO: 3487822 - RNA, 12 nt, Pseudomonas aeruginosa PA01
gucggccagcag

SEQ ID NO: 3487823 - RNA, 13 nt, Pseudomonas aeruginosa PA01
gucggccagcagc

SEQ ID NO: 3487824 - RNA, 14 nt, Pseudomonas aeruginosa PA01
gucggccagcagca

SEQ ID NO: 3487825 - RNA, 17 nt, Pseudomonas aeruginosa PA01
gucggccagccccugcg

SEQ ID NO: 3487826 - RNA, 12 nt, Pseudomonas aeruginosa PA01
gucggccaggcg

SEQ ID NO: 3487827 - RNA, 14 nt, Pseudomonas aeruginosa PA01
gucggccaggcgcc

SEQ ID NO: 3487828 - RNA, 15 nt, Pseudomonas aeruginosa PA01
gucggccaggcgcca

SEQ ID NO: 3487829 - RNA, 17 nt, Pseudomonas aeruginosa PA01
gucggccaggcggccga

SEQ ID NO: 3487830 - RNA, 22 nt, Pseudomonas aeruginosa PA01
gucggccaggggagcgccggcg

SEQ ID NO: 3487831 - RNA, 23 nt, Pseudomonas aeruginosa PA01
gucggccaggggagcgccggcgc

SEQ ID NO: 3487832 - RNA, 14 nt, Pseudomonas aeruginosa PA01
gucggccaucgccg

SEQ ID NO: 3487833 - RNA, 19 nt, Pseudomonas aeruginosa PA01
gucggccaucgccgucucg

SEQ ID NO: 3487834 - RNA, 17 nt, Pseudomonas aeruginosa PA01
gucggccaucuggcugc

SEQ ID NO: 3487835 - RNA, 19 nt, Pseudomonas aeruginosa PA01
gucggccaucuggcugccg

SEQ ID NO: 3487836 - RNA, 22 nt, Pseudomonas aeruginosa PA01
gucggccaucuggcugccgagg

SEQ ID NO: 3487837 - RNA, 14 nt, Pseudomonas aeruginosa PA01
gucggccauggcau

SEQ ID NO: 3487838 - RNA, 13 nt, Pseudomonas aeruginosa PA01
gucggcccgcgcc

SEQ ID NO: 3487839 - RNA, 14 nt, Pseudomonas aeruginosa PA01
gucggcccgcgcca

SEQ ID NO: 3487840 - RNA, 17 nt, Pseudomonas aeruginosa PA01
gucggcccgcgccaugu

SEQ ID NO: 3487841 - RNA, 22 nt, Pseudomonas aeruginosa PA01
gucggcccggagaccgugccgc

SEQ ID NO: 3487842 - RNA, 14 nt, Pseudomonas aeruginosa PA01
gucggcccuccccu

SEQ ID NO: 3487843 - RNA, 20 nt, Pseudomonas aeruginosa PA01
gucggcccuccccuggcccu

SEQ ID NO: 3487844 - RNA, 21 nt, Pseudomonas aeruginosa PA01
gucggccgcccagcggaugcg

SEQ ID NO: 3487845 - RNA, 14 nt, Pseudomonas aeruginosa PA01
gucggccgccucgg

SEQ ID NO: 3487846 - RNA, 12 nt, Pseudomonas aeruginosa PA01
gucggccgcucg

SEQ ID NO: 3487847 - RNA, 15 nt, Pseudomonas aeruginosa PA01
gucggccgcucggcc

SEQ ID NO: 3487848 - RNA, 21 nt, Pseudomonas aeruginosa PA01
gucggccggcagcuccggcgg

SEQ ID NO: 3487849 - RNA, 13 nt, Pseudomonas aeruginosa PA01
gucggccgggguc

SEQ ID NO: 3487850 - RNA, 18 nt, Pseudomonas aeruginosa PA01
gucggccggggucaggcc

SEQ ID NO: 3487851 - RNA, 19 nt, Pseudomonas aeruginosa PA01
gucggccggggucaggccg

SEQ ID NO: 3487852 - RNA, 18 nt, Pseudomonas aeruginosa PA01
gucggccguugcgggcga

SEQ ID NO: 3487853 - RNA, 13 nt, Pseudomonas aeruginosa PA01
gucggccucggcg

SEQ ID NO: 3487854 - RNA, 14 nt, Pseudomonas aeruginosa PA01
gucggccucggcga

SEQ ID NO: 3487855 - RNA, 16 nt, Pseudomonas aeruginosa PA01
gucggccucggcgagg

SEQ ID NO: 3487856 - RNA, 22 nt, Pseudomonas aeruginosa PA01
gucggccugcucgaacggcgga

SEQ ID NO: 3487857 - RNA, 14 nt, Pseudomonas aeruginosa PA01
gucggccugcugcu

SEQ ID NO: 3487858 - RNA, 15 nt, Pseudomonas aeruginosa PA01
gucggccugcugcuc

SEQ ID NO: 3487859 - RNA, 17 nt, Pseudomonas aeruginosa PA01
gucggccugcuugcagg

SEQ ID NO: 3487860 - RNA, 14 nt, Pseudomonas aeruginosa PA01
gucggccuggcgca

SEQ ID NO: 3487861 - RNA, 22 nt, Pseudomonas aeruginosa PA01
gucggccuggcgcagcggcagc

SEQ ID NO: 3487862 - RNA, 21 nt, Pseudomonas aeruginosa PA01
gucggccuggcgguugaugcc

SEQ ID NO: 3487863 - RNA, 23 nt, Pseudomonas aeruginosa PA01
gucggccuggcucaugucgugga

SEQ ID NO: 3487864 - RNA, 17 nt, Pseudomonas aeruginosa PA01
gucggccuggcugccga

SEQ ID NO: 3487865 - RNA, 18 nt, Pseudomonas aeruginosa PA01
gucggccuguucgcccaa

SEQ ID NO: 3487866 - RNA, 17 nt, Pseudomonas aeruginosa PA01
gucggccuugaacacgg

SEQ ID NO: 3487867 - RNA, 21 nt, Pseudomonas aeruginosa PA01
gucggcgaaauccucgcgcac

SEQ ID NO: 3487868 - RNA, 17 nt, Pseudomonas aeruginosa PA01
gucggcgaacccggcgc

SEQ ID NO: 3487869 - RNA, 22 nt, Pseudomonas aeruginosa PA01
gucggcgaacccggcgcggcgc

SEQ ID NO: 3487870 - RNA, 18 nt, Pseudomonas aeruginosa PA01
gucggcgaacuggccacc

SEQ ID NO: 3487871 - RNA, 19 nt, Pseudomonas aeruginosa PA01
gucggcgaacuggccaccg

SEQ ID NO: 3487872 - RNA, 21 nt, Pseudomonas aeruginosa PA01
gucggcgaagccugcggcgag

SEQ ID NO: 3487873 - RNA, 19 nt, Pseudomonas aeruginosa PA01
gucggcgaaguccaccagg

SEQ ID NO: 3487874 - RNA, 23 nt, Pseudomonas aeruginosa PA01
gucggcgaaguccaccaggcgcc

SEQ ID NO: 3487875 - RNA, 16 nt, Pseudomonas aeruginosa PA01
gucggcgacgaugccg

SEQ ID NO: 3487876 - RNA, 17 nt, Pseudomonas aeruginosa PA01
gucggcgacgaugccgc

SEQ ID NO: 3487877 - RNA, 18 nt, Pseudomonas aeruginosa PA01
gucggcgacgaugccgcc

SEQ ID NO: 3487878 - RNA, 20 nt, Pseudomonas aeruginosa PA01
gucggcgacgaugccgccgc

SEQ ID NO: 3487879 - RNA, 21 nt, Pseudomonas aeruginosa PA01
gucggcgacgaugccgccgcc

SEQ ID NO: 3487880 - RNA, 15 nt, Pseudomonas aeruginosa PA01
gucggcgagcaggcg

SEQ ID NO: 3487881 - RNA, 13 nt, Pseudomonas aeruginosa PA01
gucggcgagccgg

SEQ ID NO: 3487882 - RNA, 15 nt, Pseudomonas aeruginosa PA01
gucggcgagccggcg

SEQ ID NO: 3487883 - RNA, 23 nt, Pseudomonas aeruginosa PA01
gucggcgaucacguccuugacca

SEQ ID NO: 3487884 - RNA, 15 nt, Pseudomonas aeruginosa PA01
gucggcgaucaggcc

SEQ ID NO: 3487885 - RNA, 20 nt, Pseudomonas aeruginosa PA01
gucggcgaucaggccgaugc

SEQ ID NO: 3487886 - RNA, 23 nt, Pseudomonas aeruginosa PA01
gucggcgaucaggccgaugcgca

SEQ ID NO: 3487887 - RNA, 15 nt, Pseudomonas aeruginosa PA01
gucggcgaucgccag

SEQ ID NO: 3487888 - RNA, 20 nt, Pseudomonas aeruginosa PA01
gucggcgaucugugcgagcg

SEQ ID NO: 3487889 - RNA, 17 nt, Pseudomonas aeruginosa PA01
gucggcgaugcgcugga

SEQ ID NO: 3487890 - RNA, 19 nt, Pseudomonas aeruginosa PA01
gucggcgaugcgcuggaag

SEQ ID NO: 3487891 - RNA, 20 nt, Pseudomonas aeruginosa PA01
gucggcgauucguucgagca

SEQ ID NO: 3487892 - RNA, 14 nt, Pseudomonas aeruginosa PA01
gucggcgcccuucg

SEQ ID NO: 3487893 - RNA, 13 nt, Pseudomonas aeruginosa PA01
gucggcgcgacgg

SEQ ID NO: 3487894 - RNA, 15 nt, Pseudomonas aeruginosa PA01
gucggcgcgacggcc

SEQ ID NO: 3487895 - RNA, 19 nt, Pseudomonas aeruginosa PA01
gucggcgcgcaucuggugc

SEQ ID NO: 3487896 - RNA, 13 nt, Pseudomonas aeruginosa PA01
gucggcgcgcccg

SEQ ID NO: 3487897 - RNA, 12 nt, Pseudomonas aeruginosa PA01
gucggcgcgcgg

SEQ ID NO: 3487898 - RNA, 15 nt, Pseudomonas aeruginosa PA01
gucggcgcggccggc

SEQ ID NO: 3487899 - RNA, 17 nt, Pseudomonas aeruginosa PA01
gucggcgcggccggcgc

SEQ ID NO: 3487900 - RNA, 19 nt, Pseudomonas aeruginosa PA01
gucggcgcggccggcgccg

SEQ ID NO: 3487901 - RNA, 14 nt, Pseudomonas aeruginosa PA01
gucggcgcggcgcu

SEQ ID NO: 3487902 - RNA, 17 nt, Pseudomonas aeruginosa PA01
gucggcgcggcgcucca

SEQ ID NO: 3487903 - RNA, 20 nt, Pseudomonas aeruginosa PA01
gucggcgcggcgcuccaggc

SEQ ID NO: 3487904 - RNA, 21 nt, Pseudomonas aeruginosa PA01
gucggcgcggcgcuccaggcg

SEQ ID NO: 3487905 - RNA, 13 nt, Pseudomonas aeruginosa PA01
gucggcgcgggcg

SEQ ID NO: 3487906 - RNA, 23 nt, Pseudomonas aeruginosa PA01
gucggcgcggggcccggcuccag

SEQ ID NO: 3487907 - RNA, 15 nt, Pseudomonas aeruginosa PA01
gucggcgcggggcgu

SEQ ID NO: 3487908 - RNA, 13 nt, Pseudomonas aeruginosa PA01
gucggcgcugucg

SEQ ID NO: 3487909 - RNA, 16 nt, Pseudomonas aeruginosa PA01
gucggcgcugucgccg

SEQ ID NO: 3487910 - RNA, 19 nt, Pseudomonas aeruginosa PA01
gucggcgcugucgccguug

SEQ ID NO: 3487911 - RNA, 12 nt, Pseudomonas aeruginosa PA01
gucggcggcagc

SEQ ID NO: 3487912 - RNA, 14 nt, Pseudomonas aeruginosa PA01
gucggcggcagcug

SEQ ID NO: 3487913 - RNA, 19 nt, Pseudomonas aeruginosa PA01
gucggcggcagcugcggcg

SEQ ID NO: 3487914 - RNA, 21 nt, Pseudomonas aeruginosa PA01
gucggcggcagcugcggcggc

SEQ ID NO: 3487915 - RNA, 13 nt, Pseudomonas aeruginosa PA01
gucggcggccgcc

SEQ ID NO: 3487916 - RNA, 21 nt, Pseudomonas aeruginosa PA01
gucggcggccgccuugaccug

SEQ ID NO: 3487917 - RNA, 19 nt, Pseudomonas aeruginosa PA01
gucggcggcgccuucgccg

SEQ ID NO: 3487918 - RNA, 22 nt, Pseudomonas aeruginosa PA01
gucggcggcgccuucgccggaa

SEQ ID NO: 3487919 - RNA, 22 nt, Pseudomonas aeruginosa PA01
gucggcgggcaccgccagcccg

SEQ ID NO: 3487920 - RNA, 14 nt, Pseudomonas aeruginosa PA01
gucggcggggcgca

SEQ ID NO: 3487921 - RNA, 19 nt, Pseudomonas aeruginosa PA01
gucggcggggcgcaccgcc

SEQ ID NO: 3487922 - RNA, 20 nt, Pseudomonas aeruginosa PA01
gucggcggggcgcaccgccu

SEQ ID NO: 3487923 - RNA, 23 nt, Pseudomonas aeruginosa PA01
gucggcggucucgaacgccaggc

SEQ ID NO: 3487924 - RNA, 20 nt, Pseudomonas aeruginosa PA01
gucggcguaggccaguucgc

SEQ ID NO: 3487925 - RNA, 16 nt, Pseudomonas aeruginosa PA01
gucggcguagugcugg

SEQ ID NO: 3487926 - RNA, 14 nt, Pseudomonas aeruginosa PA01
gucggcguccaugg

SEQ ID NO: 3487927 - RNA, 16 nt, Pseudomonas aeruginosa PA01
gucggcguccauggcg

SEQ ID NO: 3487928 - RNA, 18 nt, Pseudomonas aeruginosa PA01
gucggcguccauggcggc

SEQ ID NO: 3487929 - RNA, 15 nt, Pseudomonas aeruginosa PA01
gucggcguccgccuc

SEQ ID NO: 3487930 - RNA, 16 nt, Pseudomonas aeruginosa PA01
gucggcgucggcugcg

SEQ ID NO: 3487931 - RNA, 22 nt, Pseudomonas aeruginosa PA01
gucggcgucuuccggcucgccg

SEQ ID NO: 3487932 - RNA, 20 nt, Pseudomonas aeruginosa PA01
gucggcgugguugccugcug

SEQ ID NO: 3487933 - RNA, 17 nt, Pseudomonas aeruginosa PA01
gucggcucagccgacca

SEQ ID NO: 3487934 - RNA, 15 nt, Pseudomonas aeruginosa PA01
gucggcuccgcucaa

SEQ ID NO: 3487935 - RNA, 18 nt, Pseudomonas aeruginosa PA01
gucggcucgcgccggcgc

SEQ ID NO: 3487936 - RNA, 15 nt, Pseudomonas aeruginosa PA01
gucggcugcgcuggg

SEQ ID NO: 3487937 - RNA, 20 nt, Pseudomonas aeruginosa PA01
gucggcugcgcugggcgccg

SEQ ID NO: 3487938 - RNA, 21 nt, Pseudomonas aeruginosa PA01
gucggcugcgcugggcgccga

SEQ ID NO: 3487939 - RNA, 19 nt, Pseudomonas aeruginosa PA01
gucggcuggcagggcgcgu

SEQ ID NO: 3487940 - RNA, 18 nt, Pseudomonas aeruginosa PA01
gucggcuuccgccgccag

SEQ ID NO: 3487941 - RNA, 19 nt, Pseudomonas aeruginosa PA01
gucggcuuccgccgccagg

SEQ ID NO: 3487942 - RNA, 21 nt, Pseudomonas aeruginosa PA01
gucggcuucgcccauggcacg

SEQ ID NO: 3487943 - RNA, 15 nt, Pseudomonas aeruginosa PA01
gucgggaaaggccgc

SEQ ID NO: 3487944 - RNA, 17 nt, Pseudomonas aeruginosa PA01
gucgggaaaggccgcca

SEQ ID NO: 3487945 - RNA, 15 nt, Pseudomonas aeruginosa PA01
gucgggacgcaugcg

SEQ ID NO: 3487946 - RNA, 14 nt, Pseudomonas aeruginosa PA01
gucgggaucgagca

SEQ ID NO: 3487947 - RNA, 16 nt, Pseudomonas aeruginosa PA01
gucgggcaacggcugg

SEQ ID NO: 3487948 - RNA, 21 nt, Pseudomonas aeruginosa PA01
gucgggcagauguccaggcag

SEQ ID NO: 3487949 - RNA, 22 nt, Pseudomonas aeruginosa PA01
gucgggcagauguccaggcagg

SEQ ID NO: 3487950 - RNA, 21 nt, Pseudomonas aeruginosa PA01
gucgggcaguuccgccagaug

SEQ ID NO: 3487951 - RNA, 14 nt, Pseudomonas aeruginosa PA01
gucgggcauggcga

SEQ ID NO: 3487952 - RNA, 12 nt, Pseudomonas aeruginosa PA01
gucgggccgcgc

SEQ ID NO: 3487953 - RNA, 13 nt, Pseudomonas aeruginosa PA01
gucgggccgcgcu

SEQ ID NO: 3487954 - RNA, 21 nt, Pseudomonas aeruginosa PA01
gucgggcgaaacggcaggcca

SEQ ID NO: 3487955 - RNA, 14 nt, Pseudomonas aeruginosa PA01
gucgggcgccgcgc

SEQ ID NO: 3487956 - RNA, 20 nt, Pseudomonas aeruginosa PA01
gucgggcgggaucaggucgc

SEQ ID NO: 3487957 - RNA, 17 nt, Pseudomonas aeruginosa PA01
gucgggcguagaccuug

SEQ ID NO: 3487958 - RNA, 18 nt, Pseudomonas aeruginosa PA01
gucgggcguagaccuugc

SEQ ID NO: 3487959 - RNA, 21 nt, Pseudomonas aeruginosa PA01
gucgggcucagaagucccagc

SEQ ID NO: 3487960 - RNA, 14 nt, Pseudomonas aeruginosa PA01
gucgggcucgacga

SEQ ID NO: 3487961 - RNA, 14 nt, Pseudomonas aeruginosa PA01
gucgggcuucagcg

SEQ ID NO: 3487962 - RNA, 17 nt, Pseudomonas aeruginosa PA01
gucgggcuucagcgccg

SEQ ID NO: 3487963 - RNA, 23 nt, Pseudomonas aeruginosa PA01
gucgggcuucgguguaucggcgg

SEQ ID NO: 3487964 - RNA, 15 nt, Pseudomonas aeruginosa PA01
gucggggcaggcgca

SEQ ID NO: 3487965 - RNA, 18 nt, Pseudomonas aeruginosa PA01
gucggggccggcgaugcg

SEQ ID NO: 3487966 - RNA, 19 nt, Pseudomonas aeruginosa PA01
gucggggcgcaaggccagc

SEQ ID NO: 3487967 - RNA, 21 nt, Pseudomonas aeruginosa PA01
gucggggcgcaaggccagcgg

SEQ ID NO: 3487968 - RNA, 23 nt, Pseudomonas aeruginosa PA01
gucggggugccgccagucggccu

SEQ ID NO: 3487969 - RNA, 22 nt, Pseudomonas aeruginosa PA01
gucggguccgggcccugcuucg

SEQ ID NO: 3487970 - RNA, 17 nt, Pseudomonas aeruginosa PA01
gucgggugaaggucugg

SEQ ID NO: 3487971 - RNA, 14 nt, Pseudomonas aeruginosa PA01
gucgguagaaaucc

SEQ ID NO: 3487972 - RNA, 19 nt, Pseudomonas aeruginosa PA01
gucgguagaaauccuccgg

SEQ ID NO: 3487973 - RNA, 20 nt, Pseudomonas aeruginosa PA01
gucggucaggacagcgugcg

SEQ ID NO: 3487974 - RNA, 14 nt, Pseudomonas aeruginosa PA01
gucggucaucacgc

SEQ ID NO: 3487975 - RNA, 23 nt, Pseudomonas aeruginosa PA01
gucggucauguccggggcgaucu

SEQ ID NO: 3487976 - RNA, 12 nt, Pseudomonas aeruginosa PA01
gucgguccgccg

SEQ ID NO: 3487977 - RNA, 14 nt, Pseudomonas aeruginosa PA01
gucgguccgccgau

SEQ ID NO: 3487978 - RNA, 14 nt, Pseudomonas aeruginosa PA01
gucggucgcgacgg

SEQ ID NO: 3487979 - RNA, 15 nt, Pseudomonas aeruginosa PA01
gucggucggccagga

SEQ ID NO: 3487980 - RNA, 13 nt, Pseudomonas aeruginosa PA01
gucggucggcggc

SEQ ID NO: 3487981 - RNA, 14 nt, Pseudomonas aeruginosa PA01
gucggucggcggcg

SEQ ID NO: 3487982 - RNA, 17 nt, Pseudomonas aeruginosa PA01
gucggucggcggcgguu

SEQ ID NO: 3487983 - RNA, 14 nt, Pseudomonas aeruginosa PA01
gucggucuggcggc

SEQ ID NO: 3487984 - RNA, 22 nt, Pseudomonas aeruginosa PA01
gucggucuggcggcccugguug

SEQ ID NO: 3487985 - RNA, 20 nt, Pseudomonas aeruginosa PA01
gucggugcccucgcggacgc

SEQ ID NO: 3487986 - RNA, 13 nt, Pseudomonas aeruginosa PA01
gucggugccgccc

SEQ ID NO: 3487987 - RNA, 14 nt, Pseudomonas aeruginosa PA01
gucggugccgcccg

SEQ ID NO: 3487988 - RNA, 18 nt, Pseudomonas aeruginosa PA01
gucggugccgcccggcgc

SEQ ID NO: 3487989 - RNA, 18 nt, Pseudomonas aeruginosa PA01
gucgguuagaauaccggc

SEQ ID NO: 3487990 - RNA, 19 nt, Pseudomonas aeruginosa PA01
gucgguuagaauaccggcc

SEQ ID NO: 3487991 - RNA, 13 nt, Pseudomonas aeruginosa PA01
gucgguucgccca

SEQ ID NO: 3487992 - RNA, 17 nt, Pseudomonas aeruginosa PA01
gucgguucgcggcgcag

SEQ ID NO: 3487993 - RNA, 14 nt, Pseudomonas aeruginosa PA01
gucgguucggucga

SEQ ID NO: 3487994 - RNA, 23 nt, Pseudomonas aeruginosa PA01
gucguacaccgcgcggcacagcg

SEQ ID NO: 3487995 - RNA, 14 nt, Pseudomonas aeruginosa PA01
gucguacuggcgga

SEQ ID NO: 3487996 - RNA, 15 nt, Pseudomonas aeruginosa PA01
gucguagacgcccgg

SEQ ID NO: 3487997 - RNA, 16 nt, Pseudomonas aeruginosa PA01
gucguagagcgugcgg

SEQ ID NO: 3487998 - RNA, 20 nt, Pseudomonas aeruginosa PA01
gucguagagguugccgugca

SEQ ID NO: 3487999 - RNA, 23 nt, Pseudomonas aeruginosa PA01
gucguagagguugcgcccgucga

SEQ ID NO: 3488000 - RNA, 14 nt, Pseudomonas aeruginosa PA01
gucguagccaggca

SEQ ID NO: 3488001 - RNA, 20 nt, Pseudomonas aeruginosa PA01
gucguagcccuucuccgcca

SEQ ID NO: 3488002 - RNA, 22 nt, Pseudomonas aeruginosa PA01
gucguagcccuucuccgccagc

SEQ ID NO: 3488003 - RNA, 23 nt, Pseudomonas aeruginosa PA01
gucguagcccuucuccgccagcc

SEQ ID NO: 3488004 - RNA, 18 nt, Pseudomonas aeruginosa PA01
gucguagccgcgcgccag

SEQ ID NO: 3488005 - RNA, 23 nt, Pseudomonas aeruginosa PA01
gucguagccgcgcgccagcaacg

SEQ ID NO: 3488006 - RNA, 14 nt, Pseudomonas aeruginosa PA01
gucguagcgcagcg

SEQ ID NO: 3488007 - RNA, 17 nt, Pseudomonas aeruginosa PA01
gucguagcgcagcggca

SEQ ID NO: 3488008 - RNA, 14 nt, Pseudomonas aeruginosa PA01
gucguagcgcgcgg

SEQ ID NO: 3488009 - RNA, 21 nt, Pseudomonas aeruginosa PA01
gucguaggaacgugcggccug

SEQ ID NO: 3488010 - RNA, 13 nt, Pseudomonas aeruginosa PA01
gucguaggcgcgg

SEQ ID NO: 3488011 - RNA, 19 nt, Pseudomonas aeruginosa PA01
gucguaggucugcccgacg

SEQ ID NO: 3488012 - RNA, 16 nt, Pseudomonas aeruginosa PA01
gucguagguucgaauc

SEQ ID NO: 3488013 - RNA, 18 nt, Pseudomonas aeruginosa PA01
gucguaguccugggccgg

SEQ ID NO: 3488014 - RNA, 16 nt, Pseudomonas aeruginosa PA01
gucguagucguagcgc

SEQ ID NO: 3488015 - RNA, 17 nt, Pseudomonas aeruginosa PA01
gucguaguggccgucga

SEQ ID NO: 3488016 - RNA, 16 nt, Pseudomonas aeruginosa PA01
gucguauaggcgcugg

SEQ ID NO: 3488017 - RNA, 17 nt, Pseudomonas aeruginosa PA01
gucguauaggcgcuggu

SEQ ID NO: 3488018 - RNA, 18 nt, Pseudomonas aeruginosa PA01
gucgucaccucggcgcca

SEQ ID NO: 3488019 - RNA, 19 nt, Pseudomonas aeruginosa PA01
gucgucaccucggcgccau

SEQ ID NO: 3488020 - RNA, 18 nt, Pseudomonas aeruginosa PA01
gucguccagcagguucgg

SEQ ID NO: 3488021 - RNA, 14 nt, Pseudomonas aeruginosa PA01
gucguccagcgccg

SEQ ID NO: 3488022 - RNA, 20 nt, Pseudomonas aeruginosa PA01
gucguccagcgccgagacga

SEQ ID NO: 3488023 - RNA, 15 nt, Pseudomonas aeruginosa PA01
gucguccagcggcuc

SEQ ID NO: 3488024 - RNA, 16 nt, Pseudomonas aeruginosa PA01
gucguccagcggcucg

SEQ ID NO: 3488025 - RNA, 14 nt, Pseudomonas aeruginosa PA01
gucguccagggcgc

SEQ ID NO: 3488026 - RNA, 17 nt, Pseudomonas aeruginosa PA01
gucguccagggcgcuuu

SEQ ID NO: 3488027 - RNA, 16 nt, Pseudomonas aeruginosa PA01
gucguccaucgccgcg

SEQ ID NO: 3488028 - RNA, 20 nt, Pseudomonas aeruginosa PA01
gucguccaucgccgcggcga

SEQ ID NO: 3488029 - RNA, 23 nt, Pseudomonas aeruginosa PA01
gucgucccacuuguccagagacu

SEQ ID NO: 3488030 - RNA, 13 nt, Pseudomonas aeruginosa PA01
gucguccggcgcc

SEQ ID NO: 3488031 - RNA, 20 nt, Pseudomonas aeruginosa PA01
gucguccggguucaugucgg

SEQ ID NO: 3488032 - RNA, 22 nt, Pseudomonas aeruginosa PA01
gucguccucgaaagccgccgcc

SEQ ID NO: 3488033 - RNA, 17 nt, Pseudomonas aeruginosa PA01
gucguccugcgcggcga

SEQ ID NO: 3488034 - RNA, 23 nt, Pseudomonas aeruginosa PA01
gucguccuggguaugcgcgguca

SEQ ID NO: 3488035 - RNA, 23 nt, Pseudomonas aeruginosa PA01
gucgucgaagcgcagcaggucuu

SEQ ID NO: 3488036 - RNA, 14 nt, Pseudomonas aeruginosa PA01
gucgucgaucggau

SEQ ID NO: 3488037 - RNA, 15 nt, Pseudomonas aeruginosa PA01
gucgucgcagccgaa

SEQ ID NO: 3488038 - RNA, 17 nt, Pseudomonas aeruginosa PA01
gucgucgcagccgaaua

SEQ ID NO: 3488039 - RNA, 16 nt, Pseudomonas aeruginosa PA01
gucgucgcaggccugg

SEQ ID NO: 3488040 - RNA, 20 nt, Pseudomonas aeruginosa PA01
gucgucgccaucgcucaccg

SEQ ID NO: 3488041 - RNA, 18 nt, Pseudomonas aeruginosa PA01
gucgucgcccuggccgau

SEQ ID NO: 3488042 - RNA, 17 nt, Pseudomonas aeruginosa PA01
gucgucgcgcagcuccu

SEQ ID NO: 3488043 - RNA, 21 nt, Pseudomonas aeruginosa PA01
gucgucgcgcagcuccucggc

SEQ ID NO: 3488044 - RNA, 18 nt, Pseudomonas aeruginosa PA01
gucgucgcggcgccuggc

SEQ ID NO: 3488045 - RNA, 14 nt, Pseudomonas aeruginosa PA01
gucgucgcugcgcg

SEQ ID NO: 3488046 - RNA, 20 nt, Pseudomonas aeruginosa PA01
gucgucggagauagccuccu

SEQ ID NO: 3488047 - RNA, 22 nt, Pseudomonas aeruginosa PA01
gucgucggcgaaagccggaccu

SEQ ID NO: 3488048 - RNA, 20 nt, Pseudomonas aeruginosa PA01
gucgucggcgaccuugucga

SEQ ID NO: 3488049 - RNA, 12 nt, Pseudomonas aeruginosa PA01
gucgucggcgcg

SEQ ID NO: 3488050 - RNA, 16 nt, Pseudomonas aeruginosa PA01
gucgucggcgcggccg

SEQ ID NO: 3488051 - RNA, 17 nt, Pseudomonas aeruginosa PA01
gucgucggcgcggccgg

SEQ ID NO: 3488052 - RNA, 14 nt, Pseudomonas aeruginosa PA01
gucgucgggaucga

SEQ ID NO: 3488053 - RNA, 14 nt, Pseudomonas aeruginosa PA01
gucgucgggcagag

SEQ ID NO: 3488054 - RNA, 18 nt, Pseudomonas aeruginosa PA01
gucgucgggcagaguggc

SEQ ID NO: 3488055 - RNA, 17 nt, Pseudomonas aeruginosa PA01
gucgucgucacgcaggc

SEQ ID NO: 3488056 - RNA, 14 nt, Pseudomonas aeruginosa PA01
gucgucguccaccg

SEQ ID NO: 3488057 - RNA, 20 nt, Pseudomonas aeruginosa PA01
gucgucguccaucgccgcgg

SEQ ID NO: 3488058 - RNA, 21 nt, Pseudomonas aeruginosa PA01
gucgucguccaucgccgcggc

SEQ ID NO: 3488059 - RNA, 16 nt, Pseudomonas aeruginosa PA01
gucgugaucuucgagu

SEQ ID NO: 3488060 - RNA, 23 nt, Pseudomonas aeruginosa PA01
gucgugaucuucgagugcuucug

SEQ ID NO: 3488061 - RNA, 14 nt, Pseudomonas aeruginosa PA01
gucgugcagcagcg

SEQ ID NO: 3488062 - RNA, 17 nt, Pseudomonas aeruginosa PA01
gucgugcagcagcgccu

SEQ ID NO: 3488063 - RNA, 19 nt, Pseudomonas aeruginosa PA01
gucgugcagcagcgccuuc

SEQ ID NO: 3488064 - RNA, 16 nt, Pseudomonas aeruginosa PA01
gucgugcagguguucg

SEQ ID NO: 3488065 - RNA, 15 nt, Pseudomonas aeruginosa PA01
gucgugccuccagcc

SEQ ID NO: 3488066 - RNA, 22 nt, Pseudomonas aeruginosa PA01
gucgugccuccagccucagcca

SEQ ID NO: 3488067 - RNA, 14 nt, Pseudomonas aeruginosa PA01
gucgugcgccggcc

SEQ ID NO: 3488068 - RNA, 15 nt, Pseudomonas aeruginosa PA01
gucgugcgccggccu

SEQ ID NO: 3488069 - RNA, 21 nt, Pseudomonas aeruginosa PA01
gucgugcuugcagucgcggaa

SEQ ID NO: 3488070 - RNA, 19 nt, Pseudomonas aeruginosa PA01
gucguggacauacaggcgc

SEQ ID NO: 3488071 - RNA, 21 nt, Pseudomonas aeruginosa PA01
gucguggacauacaggcgcgc

SEQ ID NO: 3488072 - RNA, 17 nt, Pseudomonas aeruginosa PA01
gucguggacgccgguga

SEQ ID NO: 3488073 - RNA, 17 nt, Pseudomonas aeruginosa PA01
gucguggauaggcggcg

SEQ ID NO: 3488074 - RNA, 22 nt, Pseudomonas aeruginosa PA01
gucguggccauagagccgcugg

SEQ ID NO: 3488075 - RNA, 14 nt, Pseudomonas aeruginosa PA01
gucgugguccagcu

SEQ ID NO: 3488076 - RNA, 22 nt, Pseudomonas aeruginosa PA01
gucgugguccagcucggucagc

SEQ ID NO: 3488077 - RNA, 13 nt, Pseudomonas aeruginosa PA01
gucguucccggcc

SEQ ID NO: 3488078 - RNA, 16 nt, Pseudomonas aeruginosa PA01
gucguuccggcucagc

SEQ ID NO: 3488079 - RNA, 12 nt, Pseudomonas aeruginosa PA01
gucguucgcccu

SEQ ID NO: 3488080 - RNA, 13 nt, Pseudomonas aeruginosa PA01
gucguucggcccg

SEQ ID NO: 3488081 - RNA, 23 nt, Pseudomonas aeruginosa PA01
gucguucggcuguuucaggccgg

SEQ ID NO: 3488082 - RNA, 23 nt, Pseudomonas aeruginosa PA01
gucguucucgcgcaucgcggaca

SEQ ID NO: 3488083 - RNA, 14 nt, Pseudomonas aeruginosa PA01
gucguucuugcgcg

SEQ ID NO: 3488084 - RNA, 16 nt, Pseudomonas aeruginosa PA01
gucguugaagacgcuc

SEQ ID NO: 3488085 - RNA, 16 nt, Pseudomonas aeruginosa PA01
gucguugacggugcug

SEQ ID NO: 3488086 - RNA, 19 nt, Pseudomonas aeruginosa PA01
gucguugagggcacggcca

SEQ ID NO: 3488087 - RNA, 22 nt, Pseudomonas aeruginosa PA01
gucguugccgucgagcaccagc

SEQ ID NO: 3488088 - RNA, 14 nt, Pseudomonas aeruginosa PA01
gucguugcgccggc

SEQ ID NO: 3488089 - RNA, 16 nt, Pseudomonas aeruginosa PA01
gucguugcgcgccagc

SEQ ID NO: 3488090 - RNA, 16 nt, Pseudomonas aeruginosa PA01
gucguuggccggcugc

SEQ ID NO: 3488091 - RNA, 18 nt, Pseudomonas aeruginosa PA01
gucguuggccggcugcuc

SEQ ID NO: 3488092 - RNA, 17 nt, Pseudomonas aeruginosa PA01
gucguuguacuggccga

SEQ ID NO: 3488093 - RNA, 17 nt, Pseudomonas aeruginosa PA01
gucguuguugccgcgca

SEQ ID NO: 3488094 - RNA, 19 nt, Pseudomonas aeruginosa PA01
gucguuuuguccggcggcu

SEQ ID NO: 3488095 - RNA, 16 nt, Pseudomonas aeruginosa PA01
gucuagcgcaggcgga

SEQ ID NO: 3488096 - RNA, 13 nt, Pseudomonas aeruginosa PA01
gucuagcgccccg

SEQ ID NO: 3488097 - RNA, 22 nt, Pseudomonas aeruginosa PA01
gucuagcgccccggccgcgcca

SEQ ID NO: 3488098 - RNA, 23 nt, Pseudomonas aeruginosa PA01
gucuagcgccccggccgcgccag

SEQ ID NO: 3488099 - RNA, 17 nt, Pseudomonas aeruginosa PA01
gucuaucccgugccggg

SEQ ID NO: 3488100 - RNA, 14 nt, Pseudomonas aeruginosa PA01
gucuaucugcgccg

SEQ ID NO: 3488101 - RNA, 16 nt, Pseudomonas aeruginosa PA01
gucucaccgcccugcg

SEQ ID NO: 3488102 - RNA, 20 nt, Pseudomonas aeruginosa PA01
gucucagcgguagaacaggc

SEQ ID NO: 3488103 - RNA, 14 nt, Pseudomonas aeruginosa PA01
gucucaggcgccag

SEQ ID NO: 3488104 - RNA, 16 nt, Pseudomonas aeruginosa PA01
gucucaggcgccaggc

SEQ ID NO: 3488105 - RNA, 17 nt, Pseudomonas aeruginosa PA01
gucucaggcgccaggcc

SEQ ID NO: 3488106 - RNA, 20 nt, Pseudomonas aeruginosa PA01
gucucaggggccgacgcgcu

SEQ ID NO: 3488107 - RNA, 23 nt, Pseudomonas aeruginosa PA01
gucucaggggccgacgcgcugcc

SEQ ID NO: 3488108 - RNA, 19 nt, Pseudomonas aeruginosa PA01
gucucauggaacagcagcc

SEQ ID NO: 3488109 - RNA, 17 nt, Pseudomonas aeruginosa PA01
gucuccagcaacccaug

SEQ ID NO: 3488110 - RNA, 20 nt, Pseudomonas aeruginosa PA01
gucuccaggcgcgccgugcg

SEQ ID NO: 3488111 - RNA, 14 nt, Pseudomonas aeruginosa PA01
gucuccugccgccg

SEQ ID NO: 3488112 - RNA, 14 nt, Pseudomonas aeruginosa PA01
gucuccugugccuu

SEQ ID NO: 3488113 - RNA, 17 nt, Pseudomonas aeruginosa PA01
gucucgaacgccaggca

SEQ ID NO: 3488114 - RNA, 20 nt, Pseudomonas aeruginosa PA01
gucucgaacgccaggcaggc

SEQ ID NO: 3488115 - RNA, 16 nt, Pseudomonas aeruginosa PA01
gucucgaucagcgccg

SEQ ID NO: 3488116 - RNA, 23 nt, Pseudomonas aeruginosa PA01
gucucgaucggcccgggcgccac

SEQ ID NO: 3488117 - RNA, 22 nt, Pseudomonas aeruginosa PA01
gucucgauggcagccuuggcca

SEQ ID NO: 3488118 - RNA, 23 nt, Pseudomonas aeruginosa PA01
gucucgauggcagccuuggccac

SEQ ID NO: 3488119 - RNA, 17 nt, Pseudomonas aeruginosa PA01
gucucgcagacggggcc

SEQ ID NO: 3488120 - RNA, 12 nt, Pseudomonas aeruginosa PA01
gucucgccgccg

SEQ ID NO: 3488121 - RNA, 22 nt, Pseudomonas aeruginosa PA01
gucucgcgggcgacgaagcccu

SEQ ID NO: 3488122 - RNA, 13 nt, Pseudomonas aeruginosa PA01
gucucgcgggcgu

SEQ ID NO: 3488123 - RNA, 21 nt, Pseudomonas aeruginosa PA01
gucucggcgggugcguggugc

SEQ ID NO: 3488124 - RNA, 20 nt, Pseudomonas aeruginosa PA01
gucucggugcucaggcggcc

SEQ ID NO: 3488125 - RNA, 22 nt, Pseudomonas aeruginosa PA01
gucucggugcucaggcggccga

SEQ ID NO: 3488126 - RNA, 20 nt, Pseudomonas aeruginosa PA01
gucucgucgagcgagggcgu

SEQ ID NO: 3488127 - RNA, 20 nt, Pseudomonas aeruginosa PA01
gucucucucugcauggcacc

SEQ ID NO: 3488128 - RNA, 22 nt, Pseudomonas aeruginosa PA01
gucugcaacccuuugauggcgc

SEQ ID NO: 3488129 - RNA, 18 nt, Pseudomonas aeruginosa PA01
gucugccgcucguuggcg

SEQ ID NO: 3488130 - RNA, 20 nt, Pseudomonas aeruginosa PA01
gucugccgcucguuggcggc

SEQ ID NO: 3488131 - RNA, 23 nt, Pseudomonas aeruginosa PA01
gucugccgcucguuggcggccag

SEQ ID NO: 3488132 - RNA, 14 nt, Pseudomonas aeruginosa PA01
gucugccgcuggcg

SEQ ID NO: 3488133 - RNA, 14 nt, Pseudomonas aeruginosa PA01
gucugccucgccga

SEQ ID NO: 3488134 - RNA, 21 nt, Pseudomonas aeruginosa PA01
gucugcgaguugaucggcgug

SEQ ID NO: 3488135 - RNA, 14 nt, Pseudomonas aeruginosa PA01
gucugcgccucgcu

SEQ ID NO: 3488136 - RNA, 20 nt, Pseudomonas aeruginosa PA01
gucugcgcggcguucgcccu

SEQ ID NO: 3488137 - RNA, 22 nt, Pseudomonas aeruginosa PA01
gucugcgcggcguucgcccugc

SEQ ID NO: 3488138 - RNA, 21 nt, Pseudomonas aeruginosa PA01
gucugcgguauaggccuugga

SEQ ID NO: 3488139 - RNA, 19 nt, Pseudomonas aeruginosa PA01
gucugcucauucggccagc

SEQ ID NO: 3488140 - RNA, 22 nt, Pseudomonas aeruginosa PA01
gucugcucggaaaccucgccgg

SEQ ID NO: 3488141 - RNA, 15 nt, Pseudomonas aeruginosa PA01
gucugcucggcgaug

SEQ ID NO: 3488142 - RNA, 16 nt, Pseudomonas aeruginosa PA01
gucugcucggcgcccu

SEQ ID NO: 3488143 - RNA, 12 nt, Pseudomonas aeruginosa PA01
gucugcuugcgc

SEQ ID NO: 3488144 - RNA, 18 nt, Pseudomonas aeruginosa PA01
gucugcuuguccuuccag

SEQ ID NO: 3488145 - RNA, 13 nt, Pseudomonas aeruginosa PA01
gucuggccggcga

SEQ ID NO: 3488146 - RNA, 16 nt, Pseudomonas aeruginosa PA01
gucuggcgcauccgcc

SEQ ID NO: 3488147 - RNA, 17 nt, Pseudomonas aeruginosa PA01
gucuggcgcauccgccc

SEQ ID NO: 3488148 - RNA, 12 nt, Pseudomonas aeruginosa PA01
gucuggcgccug

SEQ ID NO: 3488149 - RNA, 17 nt, Pseudomonas aeruginosa PA01
gucuggcgccuggccug

SEQ ID NO: 3488150 - RNA, 19 nt, Pseudomonas aeruginosa PA01
gucuggcgccuggccugga

SEQ ID NO: 3488151 - RNA, 18 nt, Pseudomonas aeruginosa PA01
gucugggacggcagccug

SEQ ID NO: 3488152 - RNA, 21 nt, Pseudomonas aeruginosa PA01
gucugggaguuccgcgcaacc

SEQ ID NO: 3488153 - RNA, 22 nt, Pseudomonas aeruginosa PA01
gucuggggaaauucgcgcugga

SEQ ID NO: 3488154 - RNA, 18 nt, Pseudomonas aeruginosa PA01
gucugguaguaggcgcuc

SEQ ID NO: 3488155 - RNA, 22 nt, Pseudomonas aeruginosa PA01
gucugugaucaggcuguccacg

SEQ ID NO: 3488156 - RNA, 22 nt, Pseudomonas aeruginosa PA01
gucugugccgugaucaccugga

SEQ ID NO: 3488157 - RNA, 21 nt, Pseudomonas aeruginosa PA01
gucuguucggccagggagucg

SEQ ID NO: 3488158 - RNA, 23 nt, Pseudomonas aeruginosa PA01
gucuguucggccagggagucgcu

SEQ ID NO: 3488159 - RNA, 16 nt, Pseudomonas aeruginosa PA01
gucuguugcgguggug

SEQ ID NO: 3488160 - RNA, 22 nt, Pseudomonas aeruginosa PA01
gucuguugguggggcgccggcu

SEQ ID NO: 3488161 - RNA, 18 nt, Pseudomonas aeruginosa PA01
gucuucacgccuugcugc

SEQ ID NO: 3488162 - RNA, 18 nt, Pseudomonas aeruginosa PA01
gucuucagcacauagcug

SEQ ID NO: 3488163 - RNA, 21 nt, Pseudomonas aeruginosa PA01
gucuucaguaggccagcggcu

SEQ ID NO: 3488164 - RNA, 18 nt, Pseudomonas aeruginosa PA01
gucuuccagggcggcgcg

SEQ ID NO: 3488165 - RNA, 21 nt, Pseudomonas aeruginosa PA01
gucuucccguaaggccaggcu

SEQ ID NO: 3488166 - RNA, 16 nt, Pseudomonas aeruginosa PA01
gucuuccggcucgccg

SEQ ID NO: 3488167 - RNA, 17 nt, Pseudomonas aeruginosa PA01
gucuuccggcucgccgc

SEQ ID NO: 3488168 - RNA, 14 nt, Pseudomonas aeruginosa PA01
gucuuccugcacgc

SEQ ID NO: 3488169 - RNA, 18 nt, Pseudomonas aeruginosa PA01
gucuucgaaguucaggga

SEQ ID NO: 3488170 - RNA, 19 nt, Pseudomonas aeruginosa PA01
gucuucgaugcgccgcagg

SEQ ID NO: 3488171 - RNA, 16 nt, Pseudomonas aeruginosa PA01
gucuucgauggcggcc

SEQ ID NO: 3488172 - RNA, 20 nt, Pseudomonas aeruginosa PA01
gucuucgauggcggccgcca

SEQ ID NO: 3488173 - RNA, 22 nt, Pseudomonas aeruginosa PA01
gucuucgauggcggccgccauu

SEQ ID NO: 3488174 - RNA, 13 nt, Pseudomonas aeruginosa PA01
gucuucgccggcc

SEQ ID NO: 3488175 - RNA, 14 nt, Pseudomonas aeruginosa PA01
gucuucgccggccu

SEQ ID NO: 3488176 - RNA, 18 nt, Pseudomonas aeruginosa PA01
gucuucgccggccugcgc

SEQ ID NO: 3488177 - RNA, 20 nt, Pseudomonas aeruginosa PA01
gucuucgcguuggcggugcc

SEQ ID NO: 3488178 - RNA, 13 nt, Pseudomonas aeruginosa PA01
gucuucgcuggcg

SEQ ID NO: 3488179 - RNA, 21 nt, Pseudomonas aeruginosa PA01
gucuucggccaguucgagcag

SEQ ID NO: 3488180 - RNA, 17 nt, Pseudomonas aeruginosa PA01
gucuucgguggcggcga

SEQ ID NO: 3488181 - RNA, 18 nt, Pseudomonas aeruginosa PA01
gucuucguuuucaggcga

SEQ ID NO: 3488182 - RNA, 18 nt, Pseudomonas aeruginosa PA01
gucuugcccaacuccagc

SEQ ID NO: 3488183 - RNA, 16 nt, Pseudomonas aeruginosa PA01
gucuugccgauggcgc

SEQ ID NO: 3488184 - RNA, 14 nt, Pseudomonas aeruginosa PA01
gucuugccgcugcg

SEQ ID NO: 3488185 - RNA, 15 nt, Pseudomonas aeruginosa PA01
gucuugccggcugcg

SEQ ID NO: 3488186 - RNA, 17 nt, Pseudomonas aeruginosa PA01
gucuugccggucugcug

SEQ ID NO: 3488187 - RNA, 21 nt, Pseudomonas aeruginosa PA01
gucuugcgcagggcggcgagc

SEQ ID NO: 3488188 - RNA, 20 nt, Pseudomonas aeruginosa PA01
gucuugcgcuugccggccgc

SEQ ID NO: 3488189 - RNA, 14 nt, Pseudomonas aeruginosa PA01
gucuuggcgcgcga

SEQ ID NO: 3488190 - RNA, 17 nt, Pseudomonas aeruginosa PA01
gucuuguccucaucggg

SEQ ID NO: 3488191 - RNA, 21 nt, Pseudomonas aeruginosa PA01
gucuuguccucaucggggcug

SEQ ID NO: 3488192 - RNA, 21 nt, Pseudomonas aeruginosa PA01
gucuuucacgguaaaacaagc

SEQ ID NO: 3488193 - RNA, 13 nt, Pseudomonas aeruginosa PA01
gucuuucagcuuc

SEQ ID NO: 3488194 - RNA, 20 nt, Pseudomonas aeruginosa PA01
gugaaaaucauccacaggcg

SEQ ID NO: 3488195 - RNA, 14 nt, Pseudomonas aeruginosa PA01
gugaaacgccagaa

SEQ ID NO: 3488196 - RNA, 17 nt, Pseudomonas aeruginosa PA01
gugaacagcggcccgag

SEQ ID NO: 3488197 - RNA, 15 nt, Pseudomonas aeruginosa PA01
gugaacgagcccagg

SEQ ID NO: 3488198 - RNA, 17 nt, Pseudomonas aeruginosa PA01
gugaacgagcccaggca

SEQ ID NO: 3488199 - RNA, 13 nt, Pseudomonas aeruginosa PA01
gugaacgccaggc

SEQ ID NO: 3488200 - RNA, 13 nt, Pseudomonas aeruginosa PA01
gugaacgcggcga

SEQ ID NO: 3488201 - RNA, 13 nt, Pseudomonas aeruginosa PA01
gugaacuggccgu

SEQ ID NO: 3488202 - RNA, 17 nt, Pseudomonas aeruginosa PA01
gugaagcccaggcgcuc

SEQ ID NO: 3488203 - RNA, 18 nt, Pseudomonas aeruginosa PA01
gugaagcccaggcgcucg

SEQ ID NO: 3488204 - RNA, 22 nt, Pseudomonas aeruginosa PA01
gugaagcccaggcgcucggcgg

SEQ ID NO: 3488205 - RNA, 23 nt, Pseudomonas aeruginosa PA01
gugaagcccuucugucuuguccu

SEQ ID NO: 3488206 - RNA, 12 nt, Pseudomonas aeruginosa PA01
gugaagccgccg

SEQ ID NO: 3488207 - RNA, 15 nt, Pseudomonas aeruginosa PA01
gugaagccgccgccc

SEQ ID NO: 3488208 - RNA, 15 nt, Pseudomonas aeruginosa PA01
gugaagcgcaggcgg

SEQ ID NO: 3488209 - RNA, 22 nt, Pseudomonas aeruginosa PA01
gugaagcgcaggcggcuggcgc

SEQ ID NO: 3488210 - RNA, 20 nt, Pseudomonas aeruginosa PA01
gugaagcgcggcggcgcgga

SEQ ID NO: 3488211 - RNA, 20 nt, Pseudomonas aeruginosa PA01
gugaagcuggagcagcagcg

SEQ ID NO: 3488212 - RNA, 22 nt, Pseudomonas aeruginosa PA01
gugaagcuggagcagcagcgcc

SEQ ID NO: 3488213 - RNA, 22 nt, Pseudomonas aeruginosa PA01
gugaaggucugguaggccauga

SEQ ID NO: 3488214 - RNA, 14 nt, Pseudomonas aeruginosa PA01
gugaaguagccgcc

SEQ ID NO: 3488215 - RNA, 15 nt, Pseudomonas aeruginosa PA01
gugaaguagccgccg

SEQ ID NO: 3488216 - RNA, 19 nt, Pseudomonas aeruginosa PA01
gugaauaaccgcuugcggu

SEQ ID NO: 3488217 - RNA, 12 nt, Pseudomonas aeruginosa PA01
gugacacccugc

SEQ ID NO: 3488218 - RNA, 15 nt, Pseudomonas aeruginosa PA01
gugacauucgacagc

SEQ ID NO: 3488219 - RNA, 18 nt, Pseudomonas aeruginosa PA01
gugacauucgacagcagg

SEQ ID NO: 3488220 - RNA, 15 nt, Pseudomonas aeruginosa PA01
gugaccaccaggcgg

SEQ ID NO: 3488221 - RNA, 16 nt, Pseudomonas aeruginosa PA01
gugaccaccaggcggu

SEQ ID NO: 3488222 - RNA, 23 nt, Pseudomonas aeruginosa PA01
gugaccaccuugauccgcgacga

SEQ ID NO: 3488223 - RNA, 17 nt, Pseudomonas aeruginosa PA01
gugaccagcagguucgg

SEQ ID NO: 3488224 - RNA, 17 nt, Pseudomonas aeruginosa PA01
gugaccagcauggcggg

SEQ ID NO: 3488225 - RNA, 18 nt, Pseudomonas aeruginosa PA01
gugaccagcauggcgggc

SEQ ID NO: 3488226 - RNA, 20 nt, Pseudomonas aeruginosa PA01
gugaccagcauggcgggcca

SEQ ID NO: 3488227 - RNA, 13 nt, Pseudomonas aeruginosa PA01
gugaccagcggca

SEQ ID NO: 3488228 - RNA, 16 nt, Pseudomonas aeruginosa PA01
gugacccgcacggcga

SEQ ID NO: 3488229 - RNA, 14 nt, Pseudomonas aeruginosa PA01
gugacccgcgcuuc

SEQ ID NO: 3488230 - RNA, 17 nt, Pseudomonas aeruginosa PA01
gugaccggcuuggucac

SEQ ID NO: 3488231 - RNA, 20 nt, Pseudomonas aeruginosa PA01
gugaccggcuuggucacgcc

SEQ ID NO: 3488232 - RNA, 22 nt, Pseudomonas aeruginosa PA01
gugaccggcuuggucacgccgu

SEQ ID NO: 3488233 - RNA, 23 nt, Pseudomonas aeruginosa PA01
gugaccguccagcgcgccgcgca

SEQ ID NO: 3488234 - RNA, 23 nt, Pseudomonas aeruginosa PA01
gugaccgugcgggucgaggccga

SEQ ID NO: 3488235 - RNA, 16 nt, Pseudomonas aeruginosa PA01
gugaccguuucgccgc

SEQ ID NO: 3488236 - RNA, 19 nt, Pseudomonas aeruginosa PA01
gugaccguuucgccgccgg

SEQ ID NO: 3488237 - RNA, 20 nt, Pseudomonas aeruginosa PA01
gugaccguuucgccgccggc

SEQ ID NO: 3488238 - RNA, 21 nt, Pseudomonas aeruginosa PA01
gugaccguuucgccgccggcc

SEQ ID NO: 3488239 - RNA, 22 nt, Pseudomonas aeruginosa PA01
gugaccguuucgccgccggcca

SEQ ID NO: 3488240 - RNA, 13 nt, Pseudomonas aeruginosa PA01
gugaccuggccgc

SEQ ID NO: 3488241 - RNA, 14 nt, Pseudomonas aeruginosa PA01
gugaccuucaacgg

SEQ ID NO: 3488242 - RNA, 17 nt, Pseudomonas aeruginosa PA01
gugacgaaaccggcguc

SEQ ID NO: 3488243 - RNA, 17 nt, Pseudomonas aeruginosa PA01
gugacgaacgaagcgcc

SEQ ID NO: 3488244 - RNA, 21 nt, Pseudomonas aeruginosa PA01
gugacgaacgaagcgcccucg

SEQ ID NO: 3488245 - RNA, 19 nt, Pseudomonas aeruginosa PA01
gugacgacgugcccauuuu

SEQ ID NO: 3488246 - RNA, 20 nt, Pseudomonas aeruginosa PA01
gugacgcugcucaccaggug

SEQ ID NO: 3488247 - RNA, 12 nt, Pseudomonas aeruginosa PA01
gugacggaucac

SEQ ID NO: 3488248 - RNA, 12 nt, Pseudomonas aeruginosa PA01
gugacggccggg

SEQ ID NO: 3488249 - RNA, 14 nt, Pseudomonas aeruginosa PA01
gugacggccggggc

SEQ ID NO: 3488250 - RNA, 15 nt, Pseudomonas aeruginosa PA01
gugacggccggggcg

SEQ ID NO: 3488251 - RNA, 23 nt, Pseudomonas aeruginosa PA01
gugacggugcagccacccagcag

SEQ ID NO: 3488252 - RNA, 23 nt, Pseudomonas aeruginosa PA01
gugacguugcgccgcagcggcgu

SEQ ID NO: 3488253 - RNA, 22 nt, Pseudomonas aeruginosa PA01
gugagauggucgaaccagcuca

SEQ ID NO: 3488254 - RNA, 15 nt, Pseudomonas aeruginosa PA01
gugagcacgccgcga

SEQ ID NO: 3488255 - RNA, 13 nt, Pseudomonas aeruginosa PA01
gugagcaggguga

SEQ ID NO: 3488256 - RNA, 19 nt, Pseudomonas aeruginosa PA01
gugagcauggcguugaggu

SEQ ID NO: 3488257 - RNA, 20 nt, Pseudomonas aeruginosa PA01
gugagccccggcgucggcgc

SEQ ID NO: 3488258 - RNA, 16 nt, Pseudomonas aeruginosa PA01
gugagcgacccgcuga

SEQ ID NO: 3488259 - RNA, 19 nt, Pseudomonas aeruginosa PA01
gugagcugggcaggcugaa

SEQ ID NO: 3488260 - RNA, 13 nt, Pseudomonas aeruginosa PA01
gugagcuugucca

SEQ ID NO: 3488261 - RNA, 14 nt, Pseudomonas aeruginosa PA01
gugaggaucacgca

SEQ ID NO: 3488262 - RNA, 13 nt, Pseudomonas aeruginosa PA01
gugaggccgagcc

SEQ ID NO: 3488263 - RNA, 20 nt, Pseudomonas aeruginosa PA01
gugaggcgcagcagcgccag

SEQ ID NO: 3488264 - RNA, 19 nt, Pseudomonas aeruginosa PA01
gugagggcgacccagcgcu

SEQ ID NO: 3488265 - RNA, 19 nt, Pseudomonas aeruginosa PA01
gugagggucgcgccgacga

SEQ ID NO: 3488266 - RNA, 15 nt, Pseudomonas aeruginosa PA01
gugaggugggcgcgc

SEQ ID NO: 3488267 - RNA, 17 nt, Pseudomonas aeruginosa PA01
gugaggugggcgcgccg

SEQ ID NO: 3488268 - RNA, 14 nt, Pseudomonas aeruginosa PA01
gugagguugccgcc

SEQ ID NO: 3488269 - RNA, 16 nt, Pseudomonas aeruginosa PA01
gugagguugccgccga

SEQ ID NO: 3488270 - RNA, 13 nt, Pseudomonas aeruginosa PA01
gugauaccgccgg

SEQ ID NO: 3488271 - RNA, 13 nt, Pseudomonas aeruginosa PA01
gugaucacaccga

SEQ ID NO: 3488272 - RNA, 14 nt, Pseudomonas aeruginosa PA01
gugaucaccgccuu

SEQ ID NO: 3488273 - RNA, 22 nt, Pseudomonas aeruginosa PA01
gugaucaccuggaucgccaggc

SEQ ID NO: 3488274 - RNA, 14 nt, Pseudomonas aeruginosa PA01
gugaucaggcuguc

SEQ ID NO: 3488275 - RNA, 15 nt, Pseudomonas aeruginosa PA01
gugauccagcuggcg

SEQ ID NO: 3488276 - RNA, 14 nt, Pseudomonas aeruginosa PA01
gugauccaggcguc

SEQ ID NO: 3488277 - RNA, 14 nt, Pseudomonas aeruginosa PA01
gugauccaggucga

SEQ ID NO: 3488278 - RNA, 22 nt, Pseudomonas aeruginosa PA01
gugauccauguagaaggcgucc

SEQ ID NO: 3488279 - RNA, 14 nt, Pseudomonas aeruginosa PA01
gugauccgcaggua

SEQ ID NO: 3488280 - RNA, 17 nt, Pseudomonas aeruginosa PA01
gugauccgcagguagcu

SEQ ID NO: 3488281 - RNA, 14 nt, Pseudomonas aeruginosa PA01
gugauccugcuggu

SEQ ID NO: 3488282 - RNA, 19 nt, Pseudomonas aeruginosa PA01
gugaucgaaaaaaggcgcc

SEQ ID NO: 3488283 - RNA, 20 nt, Pseudomonas aeruginosa PA01
gugaucgaccacacaugcag

SEQ ID NO: 3488284 - RNA, 19 nt, Pseudomonas aeruginosa PA01
gugaucgaccucgcgggcg

SEQ ID NO: 3488285 - RNA, 14 nt, Pseudomonas aeruginosa PA01
gugaucgagacgcc

SEQ ID NO: 3488286 - RNA, 15 nt, Pseudomonas aeruginosa PA01
gugaucgagccgccg

SEQ ID NO: 3488287 - RNA, 15 nt, Pseudomonas aeruginosa PA01
gugaucucgcggcgc

SEQ ID NO: 3488288 - RNA, 17 nt, Pseudomonas aeruginosa PA01
gugaucucgcggcgcgg

SEQ ID NO: 3488289 - RNA, 11 nt, Pseudomonas aeruginosa PA01
gugaucuggca

SEQ ID NO: 3488290 - RNA, 17 nt, Pseudomonas aeruginosa PA01
gugaucugguagcgggc

SEQ ID NO: 3488291 - RNA, 18 nt, Pseudomonas aeruginosa PA01
gugaucuguucgaccagu

SEQ ID NO: 3488292 - RNA, 19 nt, Pseudomonas aeruginosa PA01
gugaucuugaucugcaugc

SEQ ID NO: 3488293 - RNA, 15 nt, Pseudomonas aeruginosa PA01
gugaugaccccggcg

SEQ ID NO: 3488294 - RNA, 18 nt, Pseudomonas aeruginosa PA01
gugaugcccagcggcgcc

SEQ ID NO: 3488295 - RNA, 22 nt, Pseudomonas aeruginosa PA01
gugaugccgauggacaggcugg

SEQ ID NO: 3488296 - RNA, 18 nt, Pseudomonas aeruginosa PA01
gugaugccgcggacggca

SEQ ID NO: 3488297 - RNA, 21 nt, Pseudomonas aeruginosa PA01
gugaugccgcggacggcacgg

SEQ ID NO: 3488298 - RNA, 17 nt, Pseudomonas aeruginosa PA01
gugaugcgucgcaccag

SEQ ID NO: 3488299 - RNA, 22 nt, Pseudomonas aeruginosa PA01
gugaugcgucgcaccaggugcu

SEQ ID NO: 3488300 - RNA, 13 nt, Pseudomonas aeruginosa PA01
gugauggcgaucg

SEQ ID NO: 3488301 - RNA, 21 nt, Pseudomonas aeruginosa PA01
gugauguaagacuggugaucg

SEQ ID NO: 3488302 - RNA, 16 nt, Pseudomonas aeruginosa PA01
gugauguugcggucga

SEQ ID NO: 3488303 - RNA, 19 nt, Pseudomonas aeruginosa PA01
gugauguugcggucgaugu

SEQ ID NO: 3488304 - RNA, 14 nt, Pseudomonas aeruginosa PA01
gugcaccagcaacu

SEQ ID NO: 3488305 - RNA, 18 nt, Pseudomonas aeruginosa PA01
gugcaccaucgcauaggu

SEQ ID NO: 3488306 - RNA, 21 nt, Pseudomonas aeruginosa PA01
gugcaccaucgcauagguggg

SEQ ID NO: 3488307 - RNA, 22 nt, Pseudomonas aeruginosa PA01
gugcaccaucgcauagguggga

SEQ ID NO: 3488308 - RNA, 20 nt, Pseudomonas aeruginosa PA01
gugcacccagaccuuccagc

SEQ ID NO: 3488309 - RNA, 16 nt, Pseudomonas aeruginosa PA01
gugcaccgaggcgcgc

SEQ ID NO: 3488310 - RNA, 19 nt, Pseudomonas aeruginosa PA01
gugcaccgaggcgcgccga

SEQ ID NO: 3488311 - RNA, 15 nt, Pseudomonas aeruginosa PA01
gugcaccgcgcugga

SEQ ID NO: 3488312 - RNA, 18 nt, Pseudomonas aeruginosa PA01
gugcaccgcgcuggagac

SEQ ID NO: 3488313 - RNA, 13 nt, Pseudomonas aeruginosa PA01
gugcaccuggcga

SEQ ID NO: 3488314 - RNA, 15 nt, Pseudomonas aeruginosa PA01
gugcacgccgauggc

SEQ ID NO: 3488315 - RNA, 14 nt, Pseudomonas aeruginosa PA01
gugcacgccgugca

SEQ ID NO: 3488316 - RNA, 23 nt, Pseudomonas aeruginosa PA01
gugcacgccgugcaucaccggca

SEQ ID NO: 3488317 - RNA, 12 nt, Pseudomonas aeruginosa PA01
gugcacgcgccg

SEQ ID NO: 3488318 - RNA, 17 nt, Pseudomonas aeruginosa PA01
gugcacgcgccgggucg

SEQ ID NO: 3488319 - RNA, 18 nt, Pseudomonas aeruginosa PA01
gugcacggccaggccacg

SEQ ID NO: 3488320 - RNA, 18 nt, Pseudomonas aeruginosa PA01
gugcacggcgacccgccg

SEQ ID NO: 3488321 - RNA, 22 nt, Pseudomonas aeruginosa PA01
gugcacggcgacccgccguucg

SEQ ID NO: 3488322 - RNA, 17 nt, Pseudomonas aeruginosa PA01
gugcacggucugcucgg

SEQ ID NO: 3488323 - RNA, 15 nt, Pseudomonas aeruginosa PA01
gugcacguuccagcu

SEQ ID NO: 3488324 - RNA, 15 nt, Pseudomonas aeruginosa PA01
gugcagaagacgccc

SEQ ID NO: 3488325 - RNA, 23 nt, Pseudomonas aeruginosa PA01
gugcagaagacgcccagcagggc

SEQ ID NO: 3488326 - RNA, 17 nt, Pseudomonas aeruginosa PA01
gugcagagaggcuggcg

SEQ ID NO: 3488327 - RNA, 18 nt, Pseudomonas aeruginosa PA01
gugcagagaggcuggcgc

SEQ ID NO: 3488328 - RNA, 18 nt, Pseudomonas aeruginosa PA01
gugcagaugaccagcgca

SEQ ID NO: 3488329 - RNA, 18 nt, Pseudomonas aeruginosa PA01
gugcagcaagccgcagcg

SEQ ID NO: 3488330 - RNA, 21 nt, Pseudomonas aeruginosa PA01
gugcagcaagccgcagcgccc

SEQ ID NO: 3488331 - RNA, 23 nt, Pseudomonas aeruginosa PA01
gugcagcacauagagggucagcc

SEQ ID NO: 3488332 - RNA, 17 nt, Pseudomonas aeruginosa PA01
gugcagcagcacggugu

SEQ ID NO: 3488333 - RNA, 18 nt, Pseudomonas aeruginosa PA01
gugcagccacccagcagc

SEQ ID NO: 3488334 - RNA, 16 nt, Pseudomonas aeruginosa PA01
gugcagcccggucacg

SEQ ID NO: 3488335 - RNA, 18 nt, Pseudomonas aeruginosa PA01
gugcagcccuggcguggc

SEQ ID NO: 3488336 - RNA, 21 nt, Pseudomonas aeruginosa PA01
gugcagcgagucgccgugggc

SEQ ID NO: 3488337 - RNA, 21 nt, Pseudomonas aeruginosa PA01
gugcagcggaagcccugcugg

SEQ ID NO: 3488338 - RNA, 22 nt, Pseudomonas aeruginosa PA01
gugcagcggaagcccugcuggc

SEQ ID NO: 3488339 - RNA, 14 nt, Pseudomonas aeruginosa PA01
gugcagcggcagcg

SEQ ID NO: 3488340 - RNA, 15 nt, Pseudomonas aeruginosa PA01
gugcagcggcagcgu

SEQ ID NO: 3488341 - RNA, 13 nt, Pseudomonas aeruginosa PA01
gugcagcuccacc

SEQ ID NO: 3488342 - RNA, 15 nt, Pseudomonas aeruginosa PA01
gugcagcuccaccga

SEQ ID NO: 3488343 - RNA, 18 nt, Pseudomonas aeruginosa PA01
gugcagcuucuccaggga

SEQ ID NO: 3488344 - RNA, 22 nt, Pseudomonas aeruginosa PA01
gugcaggaagcgccgggccgca

SEQ ID NO: 3488345 - RNA, 16 nt, Pseudomonas aeruginosa PA01
gugcaggaucaccugc

SEQ ID NO: 3488346 - RNA, 14 nt, Pseudomonas aeruginosa PA01
gugcaggccgacgu

SEQ ID NO: 3488347 - RNA, 14 nt, Pseudomonas aeruginosa PA01
gugcaggccgauca

SEQ ID NO: 3488348 - RNA, 14 nt, Pseudomonas aeruginosa PA01
gugcaggccgcgcg

SEQ ID NO: 3488349 - RNA, 14 nt, Pseudomonas aeruginosa PA01
gugcaggcgcccug

SEQ ID NO: 3488350 - RNA, 15 nt, Pseudomonas aeruginosa PA01
gugcaggcgcccugg

SEQ ID NO: 3488351 - RNA, 18 nt, Pseudomonas aeruginosa PA01
gugcaggcgcccuggccg

SEQ ID NO: 3488352 - RNA, 21 nt, Pseudomonas aeruginosa PA01
gugcaggcgcccuggccgucg

SEQ ID NO: 3488353 - RNA, 13 nt, Pseudomonas aeruginosa PA01
gugcagggcagcg

SEQ ID NO: 3488354 - RNA, 18 nt, Pseudomonas aeruginosa PA01
gugcagggcagcggcccu

SEQ ID NO: 3488355 - RNA, 14 nt, Pseudomonas aeruginosa PA01
gugcagggcgucca

SEQ ID NO: 3488356 - RNA, 14 nt, Pseudomonas aeruginosa PA01
gugcaggggcgcag

SEQ ID NO: 3488357 - RNA, 22 nt, Pseudomonas aeruginosa PA01
gugcaggguauuuuccagcagg

SEQ ID NO: 3488358 - RNA, 22 nt, Pseudomonas aeruginosa PA01
gugcagggucacgcugggcagg

SEQ ID NO: 3488359 - RNA, 18 nt, Pseudomonas aeruginosa PA01
gugcagggucagucgagc

SEQ ID NO: 3488360 - RNA, 18 nt, Pseudomonas aeruginosa PA01
gugcagguagcagccguc

SEQ ID NO: 3488361 - RNA, 20 nt, Pseudomonas aeruginosa PA01
gugcagguagcagccgucca

SEQ ID NO: 3488362 - RNA, 16 nt, Pseudomonas aeruginosa PA01
gugcagguagccgcgc

SEQ ID NO: 3488363 - RNA, 19 nt, Pseudomonas aeruginosa PA01
gugcagguagccgcgccgg

SEQ ID NO: 3488364 - RNA, 16 nt, Pseudomonas aeruginosa PA01
gugcaggucgcgcggc

SEQ ID NO: 3488365 - RNA, 23 nt, Pseudomonas aeruginosa PA01
gugcagguguucggcggcgugca

SEQ ID NO: 3488366 - RNA, 16 nt, Pseudomonas aeruginosa PA01
gugcagguucaccgcc

SEQ ID NO: 3488367 - RNA, 21 nt, Pseudomonas aeruginosa PA01
gugcaguacuuggccagcagc

SEQ ID NO: 3488368 - RNA, 20 nt, Pseudomonas aeruginosa PA01
gugcaguucgaccuccaggc

SEQ ID NO: 3488369 - RNA, 22 nt, Pseudomonas aeruginosa PA01
gugcaguucgaccuccaggccg

SEQ ID NO: 3488370 - RNA, 22 nt, Pseudomonas aeruginosa PA01
gugcaguucgccguucagcucc

SEQ ID NO: 3488371 - RNA, 18 nt, Pseudomonas aeruginosa PA01
gugcaucagccuggccag

SEQ ID NO: 3488372 - RNA, 19 nt, Pseudomonas aeruginosa PA01
gugcaucagccuggccagc

SEQ ID NO: 3488373 - RNA, 13 nt, Pseudomonas aeruginosa PA01
gugcauccgccgc

SEQ ID NO: 3488374 - RNA, 14 nt, Pseudomonas aeruginosa PA01
gugcauccgccgca

SEQ ID NO: 3488375 - RNA, 18 nt, Pseudomonas aeruginosa PA01
gugcaucggccgccaggc

SEQ ID NO: 3488376 - RNA, 16 nt, Pseudomonas aeruginosa PA01
gugcaugaaggcgcug

SEQ ID NO: 3488377 - RNA, 12 nt, Pseudomonas aeruginosa PA01
gugcaugccggg

SEQ ID NO: 3488378 - RNA, 13 nt, Pseudomonas aeruginosa PA01
gugcaugccgggg

SEQ ID NO: 3488379 - RNA, 17 nt, Pseudomonas aeruginosa PA01
gugcaugcgugcauccu

SEQ ID NO: 3488380 - RNA, 15 nt, Pseudomonas aeruginosa PA01
gugcauggccgggcc

SEQ ID NO: 3488381 - RNA, 17 nt, Pseudomonas aeruginosa PA01
gugcauggccgggccga

SEQ ID NO: 3488382 - RNA, 12 nt, Pseudomonas aeruginosa PA01
gugccacaggcc

SEQ ID NO: 3488383 - RNA, 16 nt, Pseudomonas aeruginosa PA01
gugccacaggcccugg

SEQ ID NO: 3488384 - RNA, 14 nt, Pseudomonas aeruginosa PA01
gugccagaaaaucg

SEQ ID NO: 3488385 - RNA, 16 nt, Pseudomonas aeruginosa PA01
gugccagaaaaucgac

SEQ ID NO: 3488386 - RNA, 18 nt, Pseudomonas aeruginosa PA01
gugccagaaaaucgacaa

SEQ ID NO: 3488387 - RNA, 15 nt, Pseudomonas aeruginosa PA01
gugccagcaccuuca

SEQ ID NO: 3488388 - RNA, 14 nt, Pseudomonas aeruginosa PA01
gugccaggaccagc

SEQ ID NO: 3488389 - RNA, 14 nt, Pseudomonas aeruginosa PA01
gugccaggccuggg

SEQ ID NO: 3488390 - RNA, 15 nt, Pseudomonas aeruginosa PA01
gugccaggcgcucgc

SEQ ID NO: 3488391 - RNA, 12 nt, Pseudomonas aeruginosa PA01
gugccaggcggc

SEQ ID NO: 3488392 - RNA, 21 nt, Pseudomonas aeruginosa PA01
gugccaggcggcagccgcggc

SEQ ID NO: 3488393 - RNA, 18 nt, Pseudomonas aeruginosa PA01
gugccaggcucgccgcca

SEQ ID NO: 3488394 - RNA, 23 nt, Pseudomonas aeruginosa PA01
gugccaggcucgccgccagcagg

SEQ ID NO: 3488395 - RNA, 20 nt, Pseudomonas aeruginosa PA01
gugccagggcggucggccag

SEQ ID NO: 3488396 - RNA, 21 nt, Pseudomonas aeruginosa PA01
gugccagggcuucccaggcca

SEQ ID NO: 3488397 - RNA, 15 nt, Pseudomonas aeruginosa PA01
gugccaucaggccgc

SEQ ID NO: 3488398 - RNA, 20 nt, Pseudomonas aeruginosa PA01
gugccaucaggccgcggccc

SEQ ID NO: 3488399 - RNA, 21 nt, Pseudomonas aeruginosa PA01
gugccaucaggccgcggcccu

SEQ ID NO: 3488400 - RNA, 23 nt, Pseudomonas aeruginosa PA01
gugccauggaucaccagggucgg

SEQ ID NO: 3488401 - RNA, 16 nt, Pseudomonas aeruginosa PA01
gugccauucggugcgc

SEQ ID NO: 3488402 - RNA, 13 nt, Pseudomonas aeruginosa PA01
gugcccagcaggc

SEQ ID NO: 3488403 - RNA, 14 nt, Pseudomonas aeruginosa PA01
gugcccagcaggcu

SEQ ID NO: 3488404 - RNA, 19 nt, Pseudomonas aeruginosa PA01
gugcccagcaggcugcugc

SEQ ID NO: 3488405 - RNA, 14 nt, Pseudomonas aeruginosa PA01
gugcccagcggcgc

SEQ ID NO: 3488406 - RNA, 16 nt, Pseudomonas aeruginosa PA01
gugcccaggcgcuggc

SEQ ID NO: 3488407 - RNA, 17 nt, Pseudomonas aeruginosa PA01
gugcccaggcgcuggcg

SEQ ID NO: 3488408 - RNA, 21 nt, Pseudomonas aeruginosa PA01
gugcccaggcgcuggcgccga

SEQ ID NO: 3488409 - RNA, 15 nt, Pseudomonas aeruginosa PA01
gugcccaucaggcuc

SEQ ID NO: 3488410 - RNA, 19 nt, Pseudomonas aeruginosa PA01
gugcccaucaggcucaggc

SEQ ID NO: 3488411 - RNA, 19 nt, Pseudomonas aeruginosa PA01
gugcccauccgcucggcga

SEQ ID NO: 3488412 - RNA, 21 nt, Pseudomonas aeruginosa PA01
gugcccauuuuccaacuccac

SEQ ID NO: 3488413 - RNA, 12 nt, Pseudomonas aeruginosa PA01
gugccccaggca

SEQ ID NO: 3488414 - RNA, 17 nt, Pseudomonas aeruginosa PA01
gugccccaggcacggcu

SEQ ID NO: 3488415 - RNA, 14 nt, Pseudomonas aeruginosa PA01
gugccccaggccga

SEQ ID NO: 3488416 - RNA, 23 nt, Pseudomonas aeruginosa PA01
gugccccgacugucgugccucca

SEQ ID NO: 3488417 - RNA, 12 nt, Pseudomonas aeruginosa PA01
gugccccgcugg

SEQ ID NO: 3488418 - RNA, 14 nt, Pseudomonas aeruginosa PA01
gugccccgcuggcc

SEQ ID NO: 3488419 - RNA, 21 nt, Pseudomonas aeruginosa PA01
gugccccgcuggcccaacagc

SEQ ID NO: 3488420 - RNA, 14 nt, Pseudomonas aeruginosa PA01
gugccccguggcgg

SEQ ID NO: 3488421 - RNA, 18 nt, Pseudomonas aeruginosa PA01
gugccccguggcgggcca

SEQ ID NO: 3488422 - RNA, 22 nt, Pseudomonas aeruginosa PA01
gugccccguggcgggccagcag

SEQ ID NO: 3488423 - RNA, 16 nt, Pseudomonas aeruginosa PA01
gugcccgaugccgcgc

SEQ ID NO: 3488424 - RNA, 18 nt, Pseudomonas aeruginosa PA01
gugcccgaugccgcgccg

SEQ ID NO: 3488425 - RNA, 20 nt, Pseudomonas aeruginosa PA01
gugcccgaugccgcgccgga

SEQ ID NO: 3488426 - RNA, 14 nt, Pseudomonas aeruginosa PA01
gugcccgccggcgc

SEQ ID NO: 3488427 - RNA, 19 nt, Pseudomonas aeruginosa PA01
gugcccgccggcgcgccca

SEQ ID NO: 3488428 - RNA, 13 nt, Pseudomonas aeruginosa PA01
gugcccggcggga

SEQ ID NO: 3488429 - RNA, 20 nt, Pseudomonas aeruginosa PA01
gugcccucgcggacgcuggc

SEQ ID NO: 3488430 - RNA, 16 nt, Pseudomonas aeruginosa PA01
gugcccuggaagccgg

SEQ ID NO: 3488431 - RNA, 19 nt, Pseudomonas aeruginosa PA01
gugcccuggcagacgcugc

SEQ ID NO: 3488432 - RNA, 14 nt, Pseudomonas aeruginosa PA01
gugcccugggcggc

SEQ ID NO: 3488433 - RNA, 22 nt, Pseudomonas aeruginosa PA01
gugcccuugaugaucaggucgg

SEQ ID NO: 3488434 - RNA, 13 nt, Pseudomonas aeruginosa PA01
gugcccuugccgg

SEQ ID NO: 3488435 - RNA, 23 nt, Pseudomonas aeruginosa PA01
gugcccuuuuccuccagggugcc

SEQ ID NO: 3488436 - RNA, 20 nt, Pseudomonas aeruginosa PA01
gugccgaagaccaccauggu

SEQ ID NO: 3488437 - RNA, 21 nt, Pseudomonas aeruginosa PA01
gugccgaccuucaccaccagc

SEQ ID NO: 3488438 - RNA, 14 nt, Pseudomonas aeruginosa PA01
gugccgacuagauc

SEQ ID NO: 3488439 - RNA, 14 nt, Pseudomonas aeruginosa PA01
gugccgagcaggau

SEQ ID NO: 3488440 - RNA, 16 nt, Pseudomonas aeruginosa PA01
gugccgagcaggauga

SEQ ID NO: 3488441 - RNA, 14 nt, Pseudomonas aeruginosa PA01
gugccgaggccgcc

SEQ ID NO: 3488442 - RNA, 15 nt, Pseudomonas aeruginosa PA01
gugccgaggccgccg

SEQ ID NO: 3488443 - RNA, 16 nt, Pseudomonas aeruginosa PA01
gugccgaggccgccgc

SEQ ID NO: 3488444 - RNA, 13 nt, Pseudomonas aeruginosa PA01
gugccgaucagcc

SEQ ID NO: 3488445 - RNA, 16 nt, Pseudomonas aeruginosa PA01
gugccgaucagcccgu

SEQ ID NO: 3488446 - RNA, 21 nt, Pseudomonas aeruginosa PA01
gugccgcagacaucgccgagg

SEQ ID NO: 3488447 - RNA, 14 nt, Pseudomonas aeruginosa PA01
gugccgcaggccgc

SEQ ID NO: 3488448 - RNA, 15 nt, Pseudomonas aeruginosa PA01
gugccgcaggccgcg

SEQ ID NO: 3488449 - RNA, 17 nt, Pseudomonas aeruginosa PA01
gugccgcaggccgcggc

SEQ ID NO: 3488450 - RNA, 19 nt, Pseudomonas aeruginosa PA01
gugccgcaggccgcggccg

SEQ ID NO: 3488451 - RNA, 12 nt, Pseudomonas aeruginosa PA01
gugccgccaggc

SEQ ID NO: 3488452 - RNA, 13 nt, Pseudomonas aeruginosa PA01
gugccgccaggcc

SEQ ID NO: 3488453 - RNA, 18 nt, Pseudomonas aeruginosa PA01
gugccgccaggccuucca

SEQ ID NO: 3488454 - RNA, 18 nt, Pseudomonas aeruginosa PA01
gugccgccagucggccug

SEQ ID NO: 3488455 - RNA, 23 nt, Pseudomonas aeruginosa PA01
gugccgccauagagugcccaggc

SEQ ID NO: 3488456 - RNA, 22 nt, Pseudomonas aeruginosa PA01
gugccgccaucgccucgccggc

SEQ ID NO: 3488457 - RNA, 16 nt, Pseudomonas aeruginosa PA01
gugccgcccggcgcca

SEQ ID NO: 3488458 - RNA, 21 nt, Pseudomonas aeruginosa PA01
gugccgcccugcucuugccga

SEQ ID NO: 3488459 - RNA, 14 nt, Pseudomonas aeruginosa PA01
gugccgcccugggg

SEQ ID NO: 3488460 - RNA, 20 nt, Pseudomonas aeruginosa PA01
gugccgccggccaccagcag

SEQ ID NO: 3488461 - RNA, 22 nt, Pseudomonas aeruginosa PA01
gugccgccggccaccagcagca

SEQ ID NO: 3488462 - RNA, 13 nt, Pseudomonas aeruginosa PA01
gugccgccggcgc

SEQ ID NO: 3488463 - RNA, 15 nt, Pseudomonas aeruginosa PA01
gugccgccggcgccg

SEQ ID NO: 3488464 - RNA, 16 nt, Pseudomonas aeruginosa PA01
gugccgccggcgccgc

SEQ ID NO: 3488465 - RNA, 19 nt, Pseudomonas aeruginosa PA01
gugccgccggggcgcaggu

SEQ ID NO: 3488466 - RNA, 23 nt, Pseudomonas aeruginosa PA01
gugccgccggggcgcaggucgcu

SEQ ID NO: 3488467 - RNA, 19 nt, Pseudomonas aeruginosa PA01
gugccgccugggcggucgg

SEQ ID NO: 3488468 - RNA, 22 nt, Pseudomonas aeruginosa PA01
gugccgccugggcggucggcuc

SEQ ID NO: 3488469 - RNA, 19 nt, Pseudomonas aeruginosa PA01
gugccgcgaauguggugga

SEQ ID NO: 3488470 - RNA, 14 nt, Pseudomonas aeruginosa PA01
gugccgcggugcgg

SEQ ID NO: 3488471 - RNA, 13 nt, Pseudomonas aeruginosa PA01
gugccgcuggccg

SEQ ID NO: 3488472 - RNA, 14 nt, Pseudomonas aeruginosa PA01
gugccgcuggccga

SEQ ID NO: 3488473 - RNA, 16 nt, Pseudomonas aeruginosa PA01
gugccgcuggccgacc

SEQ ID NO: 3488474 - RNA, 19 nt, Pseudomonas aeruginosa PA01
gugccgcuguaggacaggu

SEQ ID NO: 3488475 - RNA, 12 nt, Pseudomonas aeruginosa PA01
gugccggcggcg

SEQ ID NO: 3488476 - RNA, 14 nt, Pseudomonas aeruginosa PA01
gugccggcggcgga

SEQ ID NO: 3488477 - RNA, 14 nt, Pseudomonas aeruginosa PA01
gugccgggaagcgc

SEQ ID NO: 3488478 - RNA, 18 nt, Pseudomonas aeruginosa PA01
gugccgggaagcgcaggc

SEQ ID NO: 3488479 - RNA, 19 nt, Pseudomonas aeruginosa PA01
gugccgggaagcgcaggcc

SEQ ID NO: 3488480 - RNA, 21 nt, Pseudomonas aeruginosa PA01
gugccgggaagcgcaggccgc

SEQ ID NO: 3488481 - RNA, 22 nt, Pseudomonas aeruginosa PA01
gugccgggaagcgcaggccgcc

SEQ ID NO: 3488482 - RNA, 13 nt, Pseudomonas aeruginosa PA01
gugccgggccagc

SEQ ID NO: 3488483 - RNA, 16 nt, Pseudomonas aeruginosa PA01
gugccgggccggccag

SEQ ID NO: 3488484 - RNA, 18 nt, Pseudomonas aeruginosa PA01
gugccgggccggccaggg

SEQ ID NO: 3488485 - RNA, 21 nt, Pseudomonas aeruginosa PA01
gugccgggcgucugcucauuc

SEQ ID NO: 3488486 - RNA, 14 nt, Pseudomonas aeruginosa PA01
gugccgggggcggc

SEQ ID NO: 3488487 - RNA, 20 nt, Pseudomonas aeruginosa PA01
gugccggguauccagcaccc

SEQ ID NO: 3488488 - RNA, 23 nt, Pseudomonas aeruginosa PA01
gugccggguauccagcacccgca

SEQ ID NO: 3488489 - RNA, 16 nt, Pseudomonas aeruginosa PA01
gugccggucgcgcagc

SEQ ID NO: 3488490 - RNA, 23 nt, Pseudomonas aeruginosa PA01
gugccggugcggguggucgccgc

SEQ ID NO: 3488491 - RNA, 24 nt, Pseudomonas aeruginosa PA01
gugccggugcggguggucgccgcc

SEQ ID NO: 3488492 - RNA, 19 nt, Pseudomonas aeruginosa PA01
gugccguacucauggccgc

SEQ ID NO: 3488493 - RNA, 22 nt, Pseudomonas aeruginosa PA01
gugccguacucauggccgcagc

SEQ ID NO: 3488494 - RNA, 14 nt, Pseudomonas aeruginosa PA01
gugccgucaggcac

SEQ ID NO: 3488495 - RNA, 20 nt, Pseudomonas aeruginosa PA01
gugccgucaggcaccucguc

SEQ ID NO: 3488496 - RNA, 16 nt, Pseudomonas aeruginosa PA01
gugccgucaugcacuu

SEQ ID NO: 3488497 - RNA, 18 nt, Pseudomonas aeruginosa PA01
gugccguggaccaacagc

SEQ ID NO: 3488498 - RNA, 13 nt, Pseudomonas aeruginosa PA01
gugccguggcucg

SEQ ID NO: 3488499 - RNA, 15 nt, Pseudomonas aeruginosa PA01
gugccguggcucggc

SEQ ID NO: 3488500 - RNA, 19 nt, Pseudomonas aeruginosa PA01
gugccguggcucggcggca

SEQ ID NO: 3488501 - RNA, 16 nt, Pseudomonas aeruginosa PA01
gugccguuccagcggc

SEQ ID NO: 3488502 - RNA, 17 nt, Pseudomonas aeruginosa PA01
gugccguuccagcggca

SEQ ID NO: 3488503 - RNA, 12 nt, Pseudomonas aeruginosa PA01
gugccuccagcc

SEQ ID NO: 3488504 - RNA, 14 nt, Pseudomonas aeruginosa PA01
gugccucccggcca

SEQ ID NO: 3488505 - RNA, 22 nt, Pseudomonas aeruginosa PA01
gugccugcaccacgcaggcgcg

SEQ ID NO: 3488506 - RNA, 21 nt, Pseudomonas aeruginosa PA01
gugccuguuccuccgccaggu

SEQ ID NO: 3488507 - RNA, 20 nt, Pseudomonas aeruginosa PA01
gugccuucccagccgaggca

SEQ ID NO: 3488508 - RNA, 23 nt, Pseudomonas aeruginosa PA01
gugccuuccgcgcccaggcugcc

SEQ ID NO: 3488509 - RNA, 22 nt, Pseudomonas aeruginosa PA01
gugccuucggcggcgccuugcg

SEQ ID NO: 3488510 - RNA, 23 nt, Pseudomonas aeruginosa PA01
gugcgaacacaccgaccgcgagu

SEQ ID NO: 3488511 - RNA, 12 nt, Pseudomonas aeruginosa PA01
gugcgacgcagc

SEQ ID NO: 3488512 - RNA, 14 nt, Pseudomonas aeruginosa PA01
gugcgacgcagcag

SEQ ID NO: 3488513 - RNA, 23 nt, Pseudomonas aeruginosa PA01
gugcgacuggggcaucucggcca

SEQ ID NO: 3488514 - RNA, 13 nt, Pseudomonas aeruginosa PA01
gugcgaggcuggc

SEQ ID NO: 3488515 - RNA, 17 nt, Pseudomonas aeruginosa PA01
gugcgagggcggcggcu

SEQ ID NO: 3488516 - RNA, 18 nt, Pseudomonas aeruginosa PA01
gugcgagggcggcggcuc

SEQ ID NO: 3488517 - RNA, 21 nt, Pseudomonas aeruginosa PA01
gugcgagucaccccgaccagc

SEQ ID NO: 3488518 - RNA, 18 nt, Pseudomonas aeruginosa PA01
gugcgauggaugcgcggc

SEQ ID NO: 3488519 - RNA, 20 nt, Pseudomonas aeruginosa PA01
gugcgcacgcaauggcgcag

SEQ ID NO: 3488520 - RNA, 13 nt, Pseudomonas aeruginosa PA01
gugcgcaggcgcu

SEQ ID NO: 3488521 - RNA, 14 nt, Pseudomonas aeruginosa PA01
gugcgcaggcgcuc

SEQ ID NO: 3488522 - RNA, 17 nt, Pseudomonas aeruginosa PA01
gugcgcaggcugccuuc

SEQ ID NO: 3488523 - RNA, 13 nt, Pseudomonas aeruginosa PA01
gugcgcaggcugg

SEQ ID NO: 3488524 - RNA, 16 nt, Pseudomonas aeruginosa PA01
gugcgcaggcuggccg

SEQ ID NO: 3488525 - RNA, 23 nt, Pseudomonas aeruginosa PA01
gugcgcaggcuggccgagcgccg

SEQ ID NO: 3488526 - RNA, 12 nt, Pseudomonas aeruginosa PA01
gugcgccagcuc

SEQ ID NO: 3488527 - RNA, 18 nt, Pseudomonas aeruginosa PA01
gugcgccagcucggccug

SEQ ID NO: 3488528 - RNA, 18 nt, Pseudomonas aeruginosa PA01
gugcgccaggccggugca

SEQ ID NO: 3488529 - RNA, 12 nt, Pseudomonas aeruginosa PA01
gugcgcccagca

SEQ ID NO: 3488530 - RNA, 14 nt, Pseudomonas aeruginosa PA01
gugcgcccagcagc

SEQ ID NO: 3488531 - RNA, 15 nt, Pseudomonas aeruginosa PA01
gugcgcccagcagca

SEQ ID NO: 3488532 - RNA, 20 nt, Pseudomonas aeruginosa PA01
gugcgcccagcagcaggccg

SEQ ID NO: 3488533 - RNA, 21 nt, Pseudomonas aeruginosa PA01
gugcgcccagcagcaggccgg

SEQ ID NO: 3488534 - RNA, 22 nt, Pseudomonas aeruginosa PA01
gugcgccccaggugcagcgagg

SEQ ID NO: 3488535 - RNA, 16 nt, Pseudomonas aeruginosa PA01
gugcgccgagcgcucg

SEQ ID NO: 3488536 - RNA, 20 nt, Pseudomonas aeruginosa PA01
gugcgccggcggccggcgca

SEQ ID NO: 3488537 - RNA, 16 nt, Pseudomonas aeruginosa PA01
gugcgccgggugccgg

SEQ ID NO: 3488538 - RNA, 20 nt, Pseudomonas aeruginosa PA01
gugcgccgguugcugcuugc

SEQ ID NO: 3488539 - RNA, 17 nt, Pseudomonas aeruginosa PA01
gugcgccuccaggaccu

SEQ ID NO: 3488540 - RNA, 13 nt, Pseudomonas aeruginosa PA01
gugcgcgaauggu

SEQ ID NO: 3488541 - RNA, 14 nt, Pseudomonas aeruginosa PA01
gugcgcgccaccug

SEQ ID NO: 3488542 - RNA, 14 nt, Pseudomonas aeruginosa PA01
gugcgcgcccucgg

SEQ ID NO: 3488543 - RNA, 18 nt, Pseudomonas aeruginosa PA01
gugcgcgcccucggugau

SEQ ID NO: 3488544 - RNA, 17 nt, Pseudomonas aeruginosa PA01
gugcgcgccgccgggcg

SEQ ID NO: 3488545 - RNA, 21 nt, Pseudomonas aeruginosa PA01
gugcgcgccgccgggcgcccg

SEQ ID NO: 3488546 - RNA, 22 nt, Pseudomonas aeruginosa PA01
gugcgcgcgcagauaaggcgug

SEQ ID NO: 3488547 - RNA, 14 nt, Pseudomonas aeruginosa PA01
gugcgcgcggccug

SEQ ID NO: 3488548 - RNA, 16 nt, Pseudomonas aeruginosa PA01
gugcgcuccgccaggc

SEQ ID NO: 3488549 - RNA, 20 nt, Pseudomonas aeruginosa PA01
gugcgcuccgccaggccgcg

SEQ ID NO: 3488550 - RNA, 19 nt, Pseudomonas aeruginosa PA01
gugcgcuccuguugcuggc

SEQ ID NO: 3488551 - RNA, 22 nt, Pseudomonas aeruginosa PA01
gugcgcuccuguugcuggccgg

SEQ ID NO: 3488552 - RNA, 15 nt, Pseudomonas aeruginosa PA01
gugcgcucgcggacc

SEQ ID NO: 3488553 - RNA, 19 nt, Pseudomonas aeruginosa PA01
gugcgcugcaucggcgcgc

SEQ ID NO: 3488554 - RNA, 21 nt, Pseudomonas aeruginosa PA01
gugcgcugcaucggcgcgccg

SEQ ID NO: 3488555 - RNA, 20 nt, Pseudomonas aeruginosa PA01
gugcgcuggaacggccaggu

SEQ ID NO: 3488556 - RNA, 13 nt, Pseudomonas aeruginosa PA01
gugcgcuggcgcc

SEQ ID NO: 3488557 - RNA, 17 nt, Pseudomonas aeruginosa PA01
gugcgcugguaccugcc

SEQ ID NO: 3488558 - RNA, 21 nt, Pseudomonas aeruginosa PA01
gugcgcugguaccugccggca

SEQ ID NO: 3488559 - RNA, 16 nt, Pseudomonas aeruginosa PA01
gugcggaaaccgcggc

SEQ ID NO: 3488560 - RNA, 18 nt, Pseudomonas aeruginosa PA01
gugcggaaaccgcggccg

SEQ ID NO: 3488561 - RNA, 17 nt, Pseudomonas aeruginosa PA01
gugcggcaccagccagg

SEQ ID NO: 3488562 - RNA, 13 nt, Pseudomonas aeruginosa PA01
gugcggcagcagg

SEQ ID NO: 3488563 - RNA, 15 nt, Pseudomonas aeruginosa PA01
gugcggcagcaggcu

SEQ ID NO: 3488564 - RNA, 18 nt, Pseudomonas aeruginosa PA01
gugcggcauuccgggcga

SEQ ID NO: 3488565 - RNA, 11 nt, Pseudomonas aeruginosa PA01
gugcggccagg

SEQ ID NO: 3488566 - RNA, 13 nt, Pseudomonas aeruginosa PA01
gugcggccaggcg

SEQ ID NO: 3488567 - RNA, 21 nt, Pseudomonas aeruginosa PA01
gugcggccauugcccgguggc

SEQ ID NO: 3488568 - RNA, 13 nt, Pseudomonas aeruginosa PA01
gugcggccgauca

SEQ ID NO: 3488569 - RNA, 17 nt, Pseudomonas aeruginosa PA01
gugcggccguucaggga

SEQ ID NO: 3488570 - RNA, 18 nt, Pseudomonas aeruginosa PA01
gugcggcguucgccgcgg

SEQ ID NO: 3488571 - RNA, 21 nt, Pseudomonas aeruginosa PA01
gugcggcuggcgcgcgcgcug

SEQ ID NO: 3488572 - RNA, 12 nt, Pseudomonas aeruginosa PA01
gugcggcugggu

SEQ ID NO: 3488573 - RNA, 14 nt, Pseudomonas aeruginosa PA01
gugcgggcaguccu

SEQ ID NO: 3488574 - RNA, 13 nt, Pseudomonas aeruginosa PA01
gugcgggccgucg

SEQ ID NO: 3488575 - RNA, 13 nt, Pseudomonas aeruginosa PA01
gugcgggcgacgc

SEQ ID NO: 3488576 - RNA, 13 nt, Pseudomonas aeruginosa PA01
gugcggugccgcg

SEQ ID NO: 3488577 - RNA, 15 nt, Pseudomonas aeruginosa PA01
gugcgguggcuggcg

SEQ ID NO: 3488578 - RNA, 17 nt, Pseudomonas aeruginosa PA01
gugcgguggcuggcgua

SEQ ID NO: 3488579 - RNA, 15 nt, Pseudomonas aeruginosa PA01
gugcggugggcgagg

SEQ ID NO: 3488580 - RNA, 22 nt, Pseudomonas aeruginosa PA01
gugcguacggucaugccgaacu

SEQ ID NO: 3488581 - RNA, 15 nt, Pseudomonas aeruginosa PA01
gugcguacuuggccc

SEQ ID NO: 3488582 - RNA, 13 nt, Pseudomonas aeruginosa PA01
gugcguauggauc

SEQ ID NO: 3488583 - RNA, 18 nt, Pseudomonas aeruginosa PA01
gugcguccauccaggcuu

SEQ ID NO: 3488584 - RNA, 15 nt, Pseudomonas aeruginosa PA01
gugcgucgagggccu

SEQ ID NO: 3488585 - RNA, 17 nt, Pseudomonas aeruginosa PA01
gugcguguucggcggcu

SEQ ID NO: 3488586 - RNA, 13 nt, Pseudomonas aeruginosa PA01
ggccgccgauccc

SEQ ID NO: 3488587 - RNA, 15 nt, Pseudomonas aeruginosa PA01
ggccgccgaucccga

SEQ ID NO: 3488588 - RNA, 14 nt, Pseudomonas aeruginosa PA01
ggccgccgaugccg

SEQ ID NO: 3488589 - RNA, 17 nt, Pseudomonas aeruginosa PA01
ggccgccgccgacaggu

SEQ ID NO: 3488590 - RNA, 13 nt, Pseudomonas aeruginosa PA01
ggccgccgccgcc

SEQ ID NO: 3488591 - RNA, 14 nt, Pseudomonas aeruginosa PA01
ggccgccgccgccg

SEQ ID NO: 3488592 - RNA, 16 nt, Pseudomonas aeruginosa PA01
ggccgccgccgccguc

SEQ ID NO: 3488593 - RNA, 12 nt, Pseudomonas aeruginosa PA01
ggccgccgccug

SEQ ID NO: 3488594 - RNA, 14 nt, Pseudomonas aeruginosa PA01
ggccgccgcgcagc

SEQ ID NO: 3488595 - RNA, 17 nt, Pseudomonas aeruginosa PA01
ggccgccgcgcagcacc

SEQ ID NO: 3488596 - RNA, 18 nt, Pseudomonas aeruginosa PA01
ggccgccgcgcagcacca

SEQ ID NO: 3488597 - RNA, 20 nt, Pseudomonas aeruginosa PA01
ggccgccgcgggcaaccgcg

SEQ ID NO: 3488598 - RNA, 21 nt, Pseudomonas aeruginosa PA01
ggccgccggcgaccgcgcgca

SEQ ID NO: 3488599 - RNA, 14 nt, Pseudomonas aeruginosa PA01
ggccgccggcgacg

SEQ ID NO: 3488600 - RNA, 15 nt, Pseudomonas aeruginosa PA01
ggccgccggcgacga

SEQ ID NO: 3488601 - RNA, 18 nt, Pseudomonas aeruginosa PA01
ggccgccggcgacgaggu

SEQ ID NO: 3488602 - RNA, 13 nt, Pseudomonas aeruginosa PA01
ggccgccggcgcc

SEQ ID NO: 3488603 - RNA, 15 nt, Pseudomonas aeruginosa PA01
ggccgccggcgcccu

SEQ ID NO: 3488604 - RNA, 13 nt, Pseudomonas aeruginosa PA01
ggccgccggcggc

SEQ ID NO: 3488605 - RNA, 14 nt, Pseudomonas aeruginosa PA01
ggccgccggcggcc

SEQ ID NO: 3488606 - RNA, 20 nt, Pseudomonas aeruginosa PA01
ggccgccggcggccagggcg

SEQ ID NO: 3488607 - RNA, 18 nt, Pseudomonas aeruginosa PA01
ggccgccguacaggccac

SEQ ID NO: 3488608 - RNA, 22 nt, Pseudomonas aeruginosa PA01
ggccgccguuguagcggauguc

SEQ ID NO: 3488609 - RNA, 23 nt, Pseudomonas aeruginosa PA01
ggccgccucgcgccgcgccagca

SEQ ID NO: 3488610 - RNA, 15 nt, Pseudomonas aeruginosa PA01
ggccgccugcucggc

SEQ ID NO: 3488611 - RNA, 15 nt, Pseudomonas aeruginosa PA01
ggccgccuggccggc

SEQ ID NO: 3488612 - RNA, 16 nt, Pseudomonas aeruginosa PA01
ggccgccuggccggcc

SEQ ID NO: 3488613 - RNA, 12 nt, Pseudomonas aeruginosa PA01
ggccgccuggcg

SEQ ID NO: 3488614 - RNA, 13 nt, Pseudomonas aeruginosa PA01
ggccgccuggcgu

SEQ ID NO: 3488615 - RNA, 21 nt, Pseudomonas aeruginosa PA01
ggccgccuggcgugccgccag

SEQ ID NO: 3488616 - RNA, 19 nt, Pseudomonas aeruginosa PA01
ggccgccuggucggggccg

SEQ ID NO: 3488617 - RNA, 21 nt, Pseudomonas aeruginosa PA01
ggccgccuggucggggccggc

SEQ ID NO: 3488618 - RNA, 24 nt, Pseudomonas aeruginosa PA01
ggccgccuggucggggccggcgau

SEQ ID NO: 3488619 - RNA, 17 nt, Pseudomonas aeruginosa PA01
ggccgccuuccucggcc

SEQ ID NO: 3488620 - RNA, 19 nt, Pseudomonas aeruginosa PA01
ggccgccuuccucggccgc

SEQ ID NO: 3488621 - RNA, 22 nt, Pseudomonas aeruginosa PA01
ggccgccuuccucggccgccag

SEQ ID NO: 3488622 - RNA, 22 nt, Pseudomonas aeruginosa PA01
ggccgccuugaccugcugggcc

SEQ ID NO: 3488623 - RNA, 19 nt, Pseudomonas aeruginosa PA01
ggccgcgaaccgggucguc

SEQ ID NO: 3488624 - RNA, 22 nt, Pseudomonas aeruginosa PA01
ggccgcgagagguucaccgacc

SEQ ID NO: 3488625 - RNA, 16 nt, Pseudomonas aeruginosa PA01
ggccgcgagcgcggcc

SEQ ID NO: 3488626 - RNA, 20 nt, Pseudomonas aeruginosa PA01
ggccgcgagcgcggccggcc

SEQ ID NO: 3488627 - RNA, 19 nt, Pseudomonas aeruginosa PA01
ggccgcgagguccggcucc

SEQ ID NO: 3488628 - RNA, 22 nt, Pseudomonas aeruginosa PA01
ggccgcgcacaaaaaagcccgc

SEQ ID NO: 3488629 - RNA, 13 nt, Pseudomonas aeruginosa PA01
ggccgcgcagcaa

SEQ ID NO: 3488630 - RNA, 14 nt, Pseudomonas aeruginosa PA01
ggccgcgcagcaac

SEQ ID NO: 3488631 - RNA, 16 nt, Pseudomonas aeruginosa PA01
ggccgcgcagucccgc

SEQ ID NO: 3488632 - RNA, 18 nt, Pseudomonas aeruginosa PA01
ggccgcgcagucccgcgc

SEQ ID NO: 3488633 - RNA, 20 nt, Pseudomonas aeruginosa PA01
ggccgcgcagucccgcgcgg

SEQ ID NO: 3488634 - RNA, 12 nt, Pseudomonas aeruginosa PA01
ggccgcgccagc

SEQ ID NO: 3488635 - RNA, 13 nt, Pseudomonas aeruginosa PA01
ggccgcgccagcc

SEQ ID NO: 3488636 - RNA, 14 nt, Pseudomonas aeruginosa PA01
ggccgcgccagcca

SEQ ID NO: 3488637 - RNA, 15 nt, Pseudomonas aeruginosa PA01
ggccgcgccagccac

SEQ ID NO: 3488638 - RNA, 12 nt, Pseudomonas aeruginosa PA01
ggccgcgcccca

SEQ ID NO: 3488639 - RNA, 17 nt, Pseudomonas aeruginosa PA01
ggccgcgccccacggcg

SEQ ID NO: 3488640 - RNA, 18 nt, Pseudomonas aeruginosa PA01
ggccgcgccccacggcgc

SEQ ID NO: 3488641 - RNA, 22 nt, Pseudomonas aeruginosa PA01
ggccgcgccccacggcgcggcc

SEQ ID NO: 3488642 - RNA, 14 nt, Pseudomonas aeruginosa PA01
ggccgcgccgaccc

SEQ ID NO: 3488643 - RNA, 21 nt, Pseudomonas aeruginosa PA01
ggccgcgccgacccagagcgc

SEQ ID NO: 3488644 - RNA, 21 nt, Pseudomonas aeruginosa PA01
ggccgcgccgagccggcugcc

SEQ ID NO: 3488645 - RNA, 12 nt, Pseudomonas aeruginosa PA01
ggccgcgccgcc

SEQ ID NO: 3488646 - RNA, 13 nt, Pseudomonas aeruginosa PA01
ggccgcgccgccc

SEQ ID NO: 3488647 - RNA, 14 nt, Pseudomonas aeruginosa PA01
ggccgcgccgcccu

SEQ ID NO: 3488648 - RNA, 17 nt, Pseudomonas aeruginosa PA01
ggccgcgccgcccuggc

SEQ ID NO: 3488649 - RNA, 19 nt, Pseudomonas aeruginosa PA01
ggccgcgccgcccuggccg

SEQ ID NO: 3488650 - RNA, 20 nt, Pseudomonas aeruginosa PA01
ggccgcgccgcccuggccgc

SEQ ID NO: 3488651 - RNA, 13 nt, Pseudomonas aeruginosa PA01
ggccgcgccggau

SEQ ID NO: 3488652 - RNA, 20 nt, Pseudomonas aeruginosa PA01
ggccgcgccuucagcgccag

SEQ ID NO: 3488653 - RNA, 21 nt, Pseudomonas aeruginosa PA01
ggccgcgccuuucgcucaggc

SEQ ID NO: 3488654 - RNA, 15 nt, Pseudomonas aeruginosa PA01
ggccgcgcgauggcc

SEQ ID NO: 3488655 - RNA, 18 nt, Pseudomonas aeruginosa PA01
ggccgcgcggcuugccgg

SEQ ID NO: 3488656 - RNA, 20 nt, Pseudomonas aeruginosa PA01
ggccgcgcggcuugccggcg

SEQ ID NO: 3488657 - RNA, 18 nt, Pseudomonas aeruginosa PA01
ggccgcgcuccaacaggc

SEQ ID NO: 3488658 - RNA, 20 nt, Pseudomonas aeruginosa PA01
ggccgcgcuccaacaggcau

SEQ ID NO: 3488659 - RNA, 14 nt, Pseudomonas aeruginosa PA01
ggccgcgcucgacg

SEQ ID NO: 3488660 - RNA, 17 nt, Pseudomonas aeruginosa PA01
ggccgcgcugcugccau

SEQ ID NO: 3488661 - RNA, 21 nt, Pseudomonas aeruginosa PA01
ggccgcgcugcugccauccgc

SEQ ID NO: 3488662 - RNA, 20 nt, Pseudomonas aeruginosa PA01
ggccgcgcugucggccucga

SEQ ID NO: 3488663 - RNA, 15 nt, Pseudomonas aeruginosa PA01
ggccgcggcccugcg

SEQ ID NO: 3488664 - RNA, 14 nt, Pseudomonas aeruginosa PA01
ggccgcggccgaaa

SEQ ID NO: 3488665 - RNA, 21 nt, Pseudomonas aeruginosa PA01
ggccgcggccgaaaucgaugu

SEQ ID NO: 3488666 - RNA, 16 nt, Pseudomonas aeruginosa PA01
ggccgcgggaggccgc

SEQ ID NO: 3488667 - RNA, 17 nt, Pseudomonas aeruginosa PA01
ggccgcgggaggccgcc

SEQ ID NO: 3488668 - RNA, 16 nt, Pseudomonas aeruginosa PA01
ggccgcggucgggcag

SEQ ID NO: 3488669 - RNA, 17 nt, Pseudomonas aeruginosa PA01
ggccgcggucgggcaga

SEQ ID NO: 3488670 - RNA, 22 nt, Pseudomonas aeruginosa PA01
ggccgcggugggcuccagcggg

SEQ ID NO: 3488671 - RNA, 19 nt, Pseudomonas aeruginosa PA01
ggccgcguaagcggccuuu

SEQ ID NO: 3488672 - RNA, 14 nt, Pseudomonas aeruginosa PA01
ggccgcgucgccca

SEQ ID NO: 3488673 - RNA, 16 nt, Pseudomonas aeruginosa PA01
ggccgcgucgcccagg

SEQ ID NO: 3488674 - RNA, 20 nt, Pseudomonas aeruginosa PA01
ggccgcgucgcccaggccgc

SEQ ID NO: 3488675 - RNA, 14 nt, Pseudomonas aeruginosa PA01
ggccgcguucgccg

SEQ ID NO: 3488676 - RNA, 17 nt, Pseudomonas aeruginosa PA01
ggccgcguucgccgagg

SEQ ID NO: 3488677 - RNA, 22 nt, Pseudomonas aeruginosa PA01
ggccgcguucgccgaggcggcg

SEQ ID NO: 3488678 - RNA, 15 nt, Pseudomonas aeruginosa PA01
ggccgcuacgcggcg

SEQ ID NO: 3488679 - RNA, 23 nt, Pseudomonas aeruginosa PA01
ggccgcucaccgccaccccgccg

SEQ ID NO: 3488680 - RNA, 15 nt, Pseudomonas aeruginosa PA01
ggccgcucgagggcg

SEQ ID NO: 3488681 - RNA, 17 nt, Pseudomonas aeruginosa PA01
ggccgcucgagggcgac

SEQ ID NO: 3488682 - RNA, 23 nt, Pseudomonas aeruginosa PA01
ggccgcucgagggcgaccgccag

SEQ ID NO: 3488683 - RNA, 14 nt, Pseudomonas aeruginosa PA01
ggccgcucgcgcgg

SEQ ID NO: 3488684 - RNA, 16 nt, Pseudomonas aeruginosa PA01
ggccgcucgcgcggca

SEQ ID NO: 3488685 - RNA, 18 nt, Pseudomonas aeruginosa PA01
ggccgcucggccuugagc

SEQ ID NO: 3488686 - RNA, 22 nt, Pseudomonas aeruginosa PA01
ggccgcucggccuugagcgccg

SEQ ID NO: 3488687 - RNA, 17 nt, Pseudomonas aeruginosa PA01
ggccgcugaaauagcgc

SEQ ID NO: 3488688 - RNA, 14 nt, Pseudomonas aeruginosa PA01
ggccgcugagcagc

SEQ ID NO: 3488689 - RNA, 16 nt, Pseudomonas aeruginosa PA01
ggccgcugagcagcag

SEQ ID NO: 3488690 - RNA, 14 nt, Pseudomonas aeruginosa PA01
ggccgcugccgccg

SEQ ID NO: 3488691 - RNA, 15 nt, Pseudomonas aeruginosa PA01
ggccgcugccgccgc

SEQ ID NO: 3488692 - RNA, 17 nt, Pseudomonas aeruginosa PA01
ggccgcugccgccgcgc

SEQ ID NO: 3488693 - RNA, 18 nt, Pseudomonas aeruginosa PA01
ggccgcugccgccgcgca

SEQ ID NO: 3488694 - RNA, 20 nt, Pseudomonas aeruginosa PA01
ggccgcugccgccgcgcagg

SEQ ID NO: 3488695 - RNA, 20 nt, Pseudomonas aeruginosa PA01
ggccgcugccgcucuggcug

SEQ ID NO: 3488696 - RNA, 22 nt, Pseudomonas aeruginosa PA01
ggccgcugccgcucuggcugcu

SEQ ID NO: 3488697 - RNA, 13 nt, Pseudomonas aeruginosa PA01
ggccgcugccggg

SEQ ID NO: 3488698 - RNA, 12 nt, Pseudomonas aeruginosa PA01
ggccgcugccgu

SEQ ID NO: 3488699 - RNA, 16 nt, Pseudomonas aeruginosa PA01
ggccgcugccguugca

SEQ ID NO: 3488700 - RNA, 22 nt, Pseudomonas aeruginosa PA01
ggccgcugccguugcaggccca

SEQ ID NO: 3488701 - RNA, 19 nt, Pseudomonas aeruginosa PA01
ggccgcugccugucgcagc

SEQ ID NO: 3488702 - RNA, 21 nt, Pseudomonas aeruginosa PA01
ggccgcugccugucgcagcgg

SEQ ID NO: 3488703 - RNA, 13 nt, Pseudomonas aeruginosa PA01
ggccgcugcgcag

SEQ ID NO: 3488704 - RNA, 18 nt, Pseudomonas aeruginosa PA01
ggccgcuggaugccgacc

SEQ ID NO: 3488705 - RNA, 19 nt, Pseudomonas aeruginosa PA01
ggccgcuggaugccgacca

SEQ ID NO: 3488706 - RNA, 13 nt, Pseudomonas aeruginosa PA01
ggccgcuggcgac

SEQ ID NO: 3488707 - RNA, 16 nt, Pseudomonas aeruginosa PA01
ggccgcuggcgaucuc

SEQ ID NO: 3488708 - RNA, 15 nt, Pseudomonas aeruginosa PA01
ggccgcuuacgcggc

SEQ ID NO: 3488709 - RNA, 16 nt, Pseudomonas aeruginosa PA01
ggccgcuuacgcggcc

SEQ ID NO: 3488710 - RNA, 17 nt, Pseudomonas aeruginosa PA01
ggccgcuuacgcggccu

SEQ ID NO: 3488711 - RNA, 19 nt, Pseudomonas aeruginosa PA01
ggccgcuuacgcggccuuu

SEQ ID NO: 3488712 - RNA, 16 nt, Pseudomonas aeruginosa PA01
ggccgcuucaagcggc

SEQ ID NO: 3488713 - RNA, 17 nt, Pseudomonas aeruginosa PA01
ggccgcuucaagcggcc

SEQ ID NO: 3488714 - RNA, 19 nt, Pseudomonas aeruginosa PA01
ggccgcuucaagcggccau

SEQ ID NO: 3488715 - RNA, 18 nt, Pseudomonas aeruginosa PA01
ggccgcuuccggcccggc

SEQ ID NO: 3488716 - RNA, 23 nt, Pseudomonas aeruginosa PA01
ggccgcuuccggcccggccaggu

SEQ ID NO: 3488717 - RNA, 13 nt, Pseudomonas aeruginosa PA01
ggccgcuucgccg

SEQ ID NO: 3488718 - RNA, 15 nt, Pseudomonas aeruginosa PA01
ggccgcuucgccgcc

SEQ ID NO: 3488719 - RNA, 20 nt, Pseudomonas aeruginosa PA01
ggccgcuucgccgcccucgc

SEQ ID NO: 3488720 - RNA, 18 nt, Pseudomonas aeruginosa PA01
ggccgcuugaagcggcca

SEQ ID NO: 3488721 - RNA, 13 nt, Pseudomonas aeruginosa PA01
ggccgcuugaucu

SEQ ID NO: 3488722 - RNA, 16 nt, Pseudomonas aeruginosa PA01
ggccgcuuggccaugg

SEQ ID NO: 3488723 - RNA, 18 nt, Pseudomonas aeruginosa PA01
ggccgcuuggccauggcg

SEQ ID NO: 3488724 - RNA, 20 nt, Pseudomonas aeruginosa PA01
ggccgcuuggccauggcgcu

SEQ ID NO: 3488725 - RNA, 15 nt, Pseudomonas aeruginosa PA01
ggccggacgcgacug

SEQ ID NO: 3488726 - RNA, 16 nt, Pseudomonas aeruginosa PA01
ggccggagcaggccau

SEQ ID NO: 3488727 - RNA, 17 nt, Pseudomonas aeruginosa PA01
ggccggagcaggccaug

SEQ ID NO: 3488728 - RNA, 13 nt, Pseudomonas aeruginosa PA01
ggccggagccgcg

SEQ ID NO: 3488729 - RNA, 17 nt, Pseudomonas aeruginosa PA01
ggccggagccgcguuca

SEQ ID NO: 3488730 - RNA, 13 nt, Pseudomonas aeruginosa PA01
ggccggaucggcc

SEQ ID NO: 3488731 - RNA, 15 nt, Pseudomonas aeruginosa PA01
ggccggaucggccuu

SEQ ID NO: 3488732 - RNA, 17 nt, Pseudomonas aeruginosa PA01
ggccggaucggccuugg

SEQ ID NO: 3488733 - RNA, 18 nt, Pseudomonas aeruginosa PA01
ggccggaucggccuuggc

SEQ ID NO: 3488734 - RNA, 14 nt, Pseudomonas aeruginosa PA01
ggccggaugccacc

SEQ ID NO: 3488735 - RNA, 15 nt, Pseudomonas aeruginosa PA01
ggccggaugccaccg

SEQ ID NO: 3488736 - RNA, 16 nt, Pseudomonas aeruginosa PA01
ggccggaugccaccgc

SEQ ID NO: 3488737 - RNA, 19 nt, Pseudomonas aeruginosa PA01
ggccggaugccaccgcucg

SEQ ID NO: 3488738 - RNA, 22 nt, Pseudomonas aeruginosa PA01
ggccggaugccaccgcucgagu

SEQ ID NO: 3488739 - RNA, 16 nt, Pseudomonas aeruginosa PA01
ggccggauggccgccg

SEQ ID NO: 3488740 - RNA, 13 nt, Pseudomonas aeruginosa PA01
ggccggcaccagc

SEQ ID NO: 3488741 - RNA, 16 nt, Pseudomonas aeruginosa PA01
ggccggcaccagcagu

SEQ ID NO: 3488742 - RNA, 12 nt, Pseudomonas aeruginosa PA01
ggccggcacccu

SEQ ID NO: 3488743 - RNA, 19 nt, Pseudomonas aeruginosa PA01
ggccggcacccugaccgcg

SEQ ID NO: 3488744 - RNA, 13 nt, Pseudomonas aeruginosa PA01
ggccggcagcagc

SEQ ID NO: 3488745 - RNA, 15 nt, Pseudomonas aeruginosa PA01
ggccggcagcagcgc

SEQ ID NO: 3488746 - RNA, 14 nt, Pseudomonas aeruginosa PA01
ggccggcagcgagc

SEQ ID NO: 3488747 - RNA, 16 nt, Pseudomonas aeruginosa PA01
ggccggcagcgagcgg

SEQ ID NO: 3488748 - RNA, 19 nt, Pseudomonas aeruginosa PA01
ggccggcagcuccggcggg

SEQ ID NO: 3488749 - RNA, 20 nt, Pseudomonas aeruginosa PA01
ggccggcaggaggaucgcgg

SEQ ID NO: 3488750 - RNA, 15 nt, Pseudomonas aeruginosa PA01
ggccggcaggccgau

SEQ ID NO: 3488751 - RNA, 17 nt, Pseudomonas aeruginosa PA01
ggccggcaggccgaugg

SEQ ID NO: 3488752 - RNA, 19 nt, Pseudomonas aeruginosa PA01
ggccggcaggccgauggcc

SEQ ID NO: 3488753 - RNA, 13 nt, Pseudomonas aeruginosa PA01
ggccggcaggcug

SEQ ID NO: 3488754 - RNA, 16 nt, Pseudomonas aeruginosa PA01
ggccggcaugcucagc

SEQ ID NO: 3488755 - RNA, 16 nt, Pseudomonas aeruginosa PA01
ggccggccacgcgacc

SEQ ID NO: 3488756 - RNA, 16 nt, Pseudomonas aeruginosa PA01
ggccggccagccaggc

SEQ ID NO: 3488757 - RNA, 14 nt, Pseudomonas aeruginosa PA01
ggccggccagccuu

SEQ ID NO: 3488758 - RNA, 19 nt, Pseudomonas aeruginosa PA01
ggccggccagggagcgcga

SEQ ID NO: 3488759 - RNA, 15 nt, Pseudomonas aeruginosa PA01
ggccggccaggucgu

SEQ ID NO: 3488760 - RNA, 14 nt, Pseudomonas aeruginosa PA01
ggccggccuccagc

SEQ ID NO: 3488761 - RNA, 16 nt, Pseudomonas aeruginosa PA01
ggccggccuccagcgc

SEQ ID NO: 3488762 - RNA, 17 nt, Pseudomonas aeruginosa PA01
ggccggccuccagcgcc

SEQ ID NO: 3488763 - RNA, 18 nt, Pseudomonas aeruginosa PA01
ggccggccuccagcgccu

SEQ ID NO: 3488764 - RNA, 15 nt, Pseudomonas aeruginosa PA01
ggccggccucggcgg

SEQ ID NO: 3488765 - RNA, 20 nt, Pseudomonas aeruginosa PA01
ggccggccucggcggcgcga

SEQ ID NO: 3488766 - RNA, 23 nt, Pseudomonas aeruginosa PA01
ggccggccucggcggcgcgaacc

SEQ ID NO: 3488767 - RNA, 12 nt, Pseudomonas aeruginosa PA01
ggccggcgaacc

SEQ ID NO: 3488768 - RNA, 17 nt, Pseudomonas aeruginosa PA01
ggccggcgaaccguggu

SEQ ID NO: 3488769 - RNA, 12 nt, Pseudomonas aeruginosa PA01
ggccggcgacca

SEQ ID NO: 3488770 - RNA, 16 nt, Pseudomonas aeruginosa PA01
ggccggcgaccagcgu

SEQ ID NO: 3488771 - RNA, 19 nt, Pseudomonas aeruginosa PA01
ggccggcgaccagcgucgc

SEQ ID NO: 3488772 - RNA, 15 nt, Pseudomonas aeruginosa PA01
ggccggcgaccagcu

SEQ ID NO: 3488773 - RNA, 21 nt, Pseudomonas aeruginosa PA01
ggccggcgaccuuguccaggc

SEQ ID NO: 3488774 - RNA, 12 nt, Pseudomonas aeruginosa PA01
ggccggcgagcc

SEQ ID NO: 3488775 - RNA, 14 nt, Pseudomonas aeruginosa PA01
ggccggcgagccag

SEQ ID NO: 3488776 - RNA, 16 nt, Pseudomonas aeruginosa PA01
ggccggcgagccaggu

SEQ ID NO: 3488777 - RNA, 13 nt, Pseudomonas aeruginosa PA01
ggccggcgaggcg

SEQ ID NO: 3488778 - RNA, 12 nt, Pseudomonas aeruginosa PA01
ggccggcgauca

SEQ ID NO: 3488779 - RNA, 15 nt, Pseudomonas aeruginosa PA01
ggccggcgauggccc

SEQ ID NO: 3488780 - RNA, 17 nt, Pseudomonas aeruginosa PA01
ggccggcgauggcccag

SEQ ID NO: 3488781 - RNA, 16 nt, Pseudomonas aeruginosa PA01
ggccggcgauggccgc

SEQ ID NO: 3488782 - RNA, 21 nt, Pseudomonas aeruginosa PA01
ggccggcgauggccgccugca

SEQ ID NO: 3488783 - RNA, 16 nt, Pseudomonas aeruginosa PA01
ggccggcgccagcagg

SEQ ID NO: 3488784 - RNA, 17 nt, Pseudomonas aeruginosa PA01
ggccggcgccagcaggc

SEQ ID NO: 3488785 - RNA, 15 nt, Pseudomonas aeruginosa PA01
ggccggcgcccuucg

SEQ ID NO: 3488786 - RNA, 14 nt, Pseudomonas aeruginosa PA01
ggccggcgccgcgg

SEQ ID NO: 3488787 - RNA, 21 nt, Pseudomonas aeruginosa PA01
ggccggcgccuugcgccaggc

SEQ ID NO: 3488788 - RNA, 22 nt, Pseudomonas aeruginosa PA01
ggccggcgcgauccuggcggca

SEQ ID NO: 3488789 - RNA, 21 nt, Pseudomonas aeruginosa PA01
ggccggcgcggacggccugcg

SEQ ID NO: 3488790 - RNA, 12 nt, Pseudomonas aeruginosa PA01
ggccggcgcggc

SEQ ID NO: 3488791 - RNA, 13 nt, Pseudomonas aeruginosa PA01
ggccggcgcggcg

SEQ ID NO: 3488792 - RNA, 16 nt, Pseudomonas aeruginosa PA01
ggccggcgcggcgcgu

SEQ ID NO: 3488793 - RNA, 22 nt, Pseudomonas aeruginosa PA01
ggccggcggccugagccggccg

SEQ ID NO: 3488794 - RNA, 11 nt, Pseudomonas aeruginosa PA01
ggccggcggcg

SEQ ID NO: 3488795 - RNA, 15 nt, Pseudomonas aeruginosa PA01
ggccggcgggcgcga

SEQ ID NO: 3488796 - RNA, 22 nt, Pseudomonas aeruginosa PA01
ggccggcggugagggcgacggc

SEQ ID NO: 3488797 - RNA, 22 nt, Pseudomonas aeruginosa PA01
ggccggcguacuucggcgcggu

SEQ ID NO: 3488798 - RNA, 22 nt, Pseudomonas aeruginosa PA01
ggccggcguaugguggaggaag

SEQ ID NO: 3488799 - RNA, 18 nt, Pseudomonas aeruginosa PA01
ggccggcgugcccauccg

SEQ ID NO: 3488800 - RNA, 22 nt, Pseudomonas aeruginosa PA01
ggccggcgugcccauccgcucg

SEQ ID NO: 3488801 - RNA, 22 nt, Pseudomonas aeruginosa PA01
ggccggcgugcccuuuuccucc

SEQ ID NO: 3488802 - RNA, 14 nt, Pseudomonas aeruginosa PA01
ggccggcucagcgc

SEQ ID NO: 3488803 - RNA, 16 nt, Pseudomonas aeruginosa PA01
ggccggcucagcgcuu

SEQ ID NO: 3488804 - RNA, 20 nt, Pseudomonas aeruginosa PA01
ggccggcugcuccgggcggc

SEQ ID NO: 3488805 - RNA, 15 nt, Pseudomonas aeruginosa PA01
ggccgggaaccagca

SEQ ID NO: 3488806 - RNA, 19 nt, Pseudomonas aeruginosa PA01
ggccgggagcuacagcgau

SEQ ID NO: 3488807 - RNA, 16 nt, Pseudomonas aeruginosa PA01
ggccgggauacagcag

SEQ ID NO: 3488808 - RNA, 18 nt, Pseudomonas aeruginosa PA01
ggccgggauacagcagcc

SEQ ID NO: 3488809 - RNA, 19 nt, Pseudomonas aeruginosa PA01
ggccgggauacagcagcca

SEQ ID NO: 3488810 - RNA, 22 nt, Pseudomonas aeruginosa PA01
ggccgggcaccccgagcggcgc

SEQ ID NO: 3488811 - RNA, 13 nt, Pseudomonas aeruginosa PA01
ggccgggcaggcc

SEQ ID NO: 3488812 - RNA, 16 nt, Pseudomonas aeruginosa PA01
ggccgggcaggccgag

SEQ ID NO: 3488813 - RNA, 14 nt, Pseudomonas aeruginosa PA01
ggccgggcccuggg

SEQ ID NO: 3488814 - RNA, 12 nt, Pseudomonas aeruginosa PA01
ggccgggccgau

SEQ ID NO: 3488815 - RNA, 15 nt, Pseudomonas aeruginosa PA01
ggccgggccgaucac

SEQ ID NO: 3488816 - RNA, 15 nt, Pseudomonas aeruginosa PA01
ggccgggccgaugcg

SEQ ID NO: 3488817 - RNA, 16 nt, Pseudomonas aeruginosa PA01
ggccgggccgaugcgc

SEQ ID NO: 3488818 - RNA, 17 nt, Pseudomonas aeruginosa PA01
ggccgggcggacgcugg

SEQ ID NO: 3488819 - RNA, 14 nt, Pseudomonas aeruginosa PA01
ggccgggcuggcca

SEQ ID NO: 3488820 - RNA, 18 nt, Pseudomonas aeruginosa PA01
ggccgggcuggccaccgc

SEQ ID NO: 3488821 - RNA, 15 nt, Pseudomonas aeruginosa PA01
ggccggggaacaggu

SEQ ID NO: 3488822 - RNA, 16 nt, Pseudomonas aeruginosa PA01
ggccggggaucggcau

SEQ ID NO: 3488823 - RNA, 13 nt, Pseudomonas aeruginosa PA01
ggccggggcgcgc

SEQ ID NO: 3488824 - RNA, 16 nt, Pseudomonas aeruginosa PA01
ggccggggcgcgcccg

SEQ ID NO: 3488825 - RNA, 17 nt, Pseudomonas aeruginosa PA01
ggccggggcgcgcccgc

SEQ ID NO: 3488826 - RNA, 21 nt, Pseudomonas aeruginosa PA01
ggccggggcggauucaggcgc

SEQ ID NO: 3488827 - RNA, 16 nt, Pseudomonas aeruginosa PA01
ggccgggggcggcgcc

SEQ ID NO: 3488828 - RNA, 19 nt, Pseudomonas aeruginosa PA01
ggccgggggcggcgccugg

SEQ ID NO: 3488829 - RNA, 19 nt, Pseudomonas aeruginosa PA01
ggccgggguauccgggcac

SEQ ID NO: 3488830 - RNA, 17 nt, Pseudomonas aeruginosa PA01
ggccggggucaggccga

SEQ ID NO: 3488831 - RNA, 20 nt, Pseudomonas aeruginosa PA01
ggccggggucaggccgaggc

SEQ ID NO: 3488832 - RNA, 17 nt, Pseudomonas aeruginosa PA01
ggccgggucaucaccgg

SEQ ID NO: 3488833 - RNA, 19 nt, Pseudomonas aeruginosa PA01
ggccgggucaucaccggca

SEQ ID NO: 3488834 - RNA, 16 nt, Pseudomonas aeruginosa PA01
ggccgggucgcagccg

SEQ ID NO: 3488835 - RNA, 19 nt, Pseudomonas aeruginosa PA01
ggccgggucguacaccaga

SEQ ID NO: 3488836 - RNA, 13 nt, Pseudomonas aeruginosa PA01
ggccgguagucgg

SEQ ID NO: 3488837 - RNA, 17 nt, Pseudomonas aeruginosa PA01
ggccgguagucggggca

SEQ ID NO: 3488838 - RNA, 21 nt, Pseudomonas aeruginosa PA01
ggccggugacauucgacagca

SEQ ID NO: 3488839 - RNA, 20 nt, Pseudomonas aeruginosa PA01
ggccggugacgaacgaagcg

SEQ ID NO: 3488840 - RNA, 22 nt, Pseudomonas aeruginosa PA01
ggccggugacgaacgaagcgcc

SEQ ID NO: 3488841 - RNA, 19 nt, Pseudomonas aeruginosa PA01
ggccggugaucucgcggcg

SEQ ID NO: 3488842 - RNA, 21 nt, Pseudomonas aeruginosa PA01
ggccggugaucucgcggcgcg

SEQ ID NO: 3488843 - RNA, 19 nt, Pseudomonas aeruginosa PA01
ggccggugccauacagcgc

SEQ ID NO: 3488844 - RNA, 20 nt, Pseudomonas aeruginosa PA01
ggccggugccauacagcgcc

SEQ ID NO: 3488845 - RNA, 13 nt, Pseudomonas aeruginosa PA01
ggccggugccgcc

SEQ ID NO: 3488846 - RNA, 15 nt, Pseudomonas aeruginosa PA01
ggccggugccgcccu

SEQ ID NO: 3488847 - RNA, 17 nt, Pseudomonas aeruginosa PA01
ggccggugccgcccugg

SEQ ID NO: 3488848 - RNA, 15 nt, Pseudomonas aeruginosa PA01
ggccggugccgccgg

SEQ ID NO: 3488849 - RNA, 17 nt, Pseudomonas aeruginosa PA01
ggccggugccgccggcc

SEQ ID NO: 3488850 - RNA, 22 nt, Pseudomonas aeruginosa PA01
ggccggugccuucggcggcgcc

SEQ ID NO: 3488851 - RNA, 23 nt, Pseudomonas aeruginosa PA01
ggccggugccuucggcggcgccu

SEQ ID NO: 3488852 - RNA, 20 nt, Pseudomonas aeruginosa PA01
ggccggugcgaaccggccuu

SEQ ID NO: 3488853 - RNA, 13 nt, Pseudomonas aeruginosa PA01
ggccgguggucgg

SEQ ID NO: 3488854 - RNA, 20 nt, Pseudomonas aeruginosa PA01
ggccgguugcgaccggccuu

SEQ ID NO: 3488855 - RNA, 17 nt, Pseudomonas aeruginosa PA01
ggccgguugcggcgccg

SEQ ID NO: 3488856 - RNA, 21 nt, Pseudomonas aeruginosa PA01
ggccgguuuuuuauugccagc

SEQ ID NO: 3488857 - RNA, 18 nt, Pseudomonas aeruginosa PA01
ggccguaccagucgcccg

SEQ ID NO: 3488858 - RNA, 20 nt, Pseudomonas aeruginosa PA01
ggccguaccagucgcccgcu

SEQ ID NO: 3488859 - RNA, 15 nt, Pseudomonas aeruginosa PA01
ggccguagaccacca

SEQ ID NO: 3488860 - RNA, 18 nt, Pseudomonas aeruginosa PA01
ggccguagaccaccagca

SEQ ID NO: 3488861 - RNA, 19 nt, Pseudomonas aeruginosa PA01
ggccguagaccaccagcag

SEQ ID NO: 3488862 - RNA, 20 nt, Pseudomonas aeruginosa PA01
ggccguagaccaccagcagc

SEQ ID NO: 3488863 - RNA, 23 nt, Pseudomonas aeruginosa PA01
ggccguagaccaccagcagcagc

SEQ ID NO: 3488864 - RNA, 18 nt, Pseudomonas aeruginosa PA01
ggccguagccggugccga

SEQ ID NO: 3488865 - RNA, 23 nt, Pseudomonas aeruginosa PA01
ggccguagccgucgaacagcagc

SEQ ID NO: 3488866 - RNA, 14 nt, Pseudomonas aeruginosa PA01
ggccguagcgcucg

SEQ ID NO: 3488867 - RNA, 17 nt, Pseudomonas aeruginosa PA01
ggccguaggcgauggcc

SEQ ID NO: 3488868 - RNA, 22 nt, Pseudomonas aeruginosa PA01
ggccguaguucgaaccguggcg

SEQ ID NO: 3488869 - RNA, 23 nt, Pseudomonas aeruginosa PA01
ggccguaguucgaaccguggcgg

SEQ ID NO: 3488870 - RNA, 16 nt, Pseudomonas aeruginosa PA01
ggccgucacggccucc

SEQ ID NO: 3488871 - RNA, 12 nt, Pseudomonas aeruginosa PA01
ggccguccaggc

SEQ ID NO: 3488872 - RNA, 14 nt, Pseudomonas aeruginosa PA01
ggccguccaggcug

SEQ ID NO: 3488873 - RNA, 15 nt, Pseudomonas aeruginosa PA01
ggccguccaggcugc

SEQ ID NO: 3488874 - RNA, 16 nt, Pseudomonas aeruginosa PA01
ggccgucccagguugg

SEQ ID NO: 3488875 - RNA, 21 nt, Pseudomonas aeruginosa PA01
ggccgucccagucggcguccg

SEQ ID NO: 3488876 - RNA, 22 nt, Pseudomonas aeruginosa PA01
ggccgucccagucggcguccgc

SEQ ID NO: 3488877 - RNA, 23 nt, Pseudomonas aeruginosa PA01
ggccgucccagucggcguccgcc

SEQ ID NO: 3488878 - RNA, 21 nt, Pseudomonas aeruginosa PA01
ggccgucccugaccagcaggg

SEQ ID NO: 3488879 - RNA, 13 nt, Pseudomonas aeruginosa PA01
ggccguccgccag

SEQ ID NO: 3488880 - RNA, 14 nt, Pseudomonas aeruginosa PA01
ggccguccgccagg

SEQ ID NO: 3488881 - RNA, 15 nt, Pseudomonas aeruginosa PA01
ggccguccucgggau

SEQ ID NO: 3488882 - RNA, 15 nt, Pseudomonas aeruginosa PA01
ggccguccucgucga

SEQ ID NO: 3488883 - RNA, 20 nt, Pseudomonas aeruginosa PA01
ggccguccugcggccguucg

SEQ ID NO: 3488884 - RNA, 19 nt, Pseudomonas aeruginosa PA01
ggccguccuugaguagcug

SEQ ID NO: 3488885 - RNA, 13 nt, Pseudomonas aeruginosa PA01
ggccgucgaaggg

SEQ ID NO: 3488886 - RNA, 14 nt, Pseudomonas aeruginosa PA01
ggccgucgaagugg

SEQ ID NO: 3488887 - RNA, 20 nt, Pseudomonas aeruginosa PA01
ggccgucgacccgccucacc

SEQ ID NO: 3488888 - RNA, 18 nt, Pseudomonas aeruginosa PA01
ggccgucgaggucggcga

SEQ ID NO: 3488889 - RNA, 12 nt, Pseudomonas aeruginosa PA01
ggccgucgcgca

SEQ ID NO: 3488890 - RNA, 15 nt, Pseudomonas aeruginosa PA01
ggccgucgcgcacca

SEQ ID NO: 3488891 - RNA, 17 nt, Pseudomonas aeruginosa PA01
ggccgucgcgcaccacc

SEQ ID NO: 3488892 - RNA, 14 nt, Pseudomonas aeruginosa PA01
ggccgucgcgccgc

SEQ ID NO: 3488893 - RNA, 16 nt, Pseudomonas aeruginosa PA01
ggccgucgcgccgcgg

SEQ ID NO: 3488894 - RNA, 14 nt, Pseudomonas aeruginosa PA01
ggccgucggccugc

SEQ ID NO: 3488895 - RNA, 23 nt, Pseudomonas aeruginosa PA01
ggccgucggccugcuugcaggag

SEQ ID NO: 3488896 - RNA, 16 nt, Pseudomonas aeruginosa PA01
ggccgucggccuggcg

SEQ ID NO: 3488897 - RNA, 12 nt, Pseudomonas aeruginosa PA01
ggccgucgggca

SEQ ID NO: 3488898 - RNA, 17 nt, Pseudomonas aeruginosa PA01
ggccgucgggcauggcg

SEQ ID NO: 3488899 - RNA, 18 nt, Pseudomonas aeruginosa PA01
ggccgucgggcauggcga

SEQ ID NO: 3488900 - RNA, 19 nt, Pseudomonas aeruginosa PA01
ggccgucguuuuguccggc

SEQ ID NO: 3488901 - RNA, 21 nt, Pseudomonas aeruginosa PA01
ggccgucguuuuguccggcgg

SEQ ID NO: 3488902 - RNA, 22 nt, Pseudomonas aeruginosa PA01
ggccgucguuuuguccggcggc

SEQ ID NO: 3488903 - RNA, 15 nt, Pseudomonas aeruginosa PA01
ggccgucuccaggcg

SEQ ID NO: 3488904 - RNA, 17 nt, Pseudomonas aeruginosa PA01
ggccgucuccaggcgcg

SEQ ID NO: 3488905 - RNA, 19 nt, Pseudomonas aeruginosa PA01
ggccgucuccaggcgcgcc

SEQ ID NO: 3488906 - RNA, 20 nt, Pseudomonas aeruginosa PA01
ggccgucuccaggcgcgccg

SEQ ID NO: 3488907 - RNA, 19 nt, Pseudomonas aeruginosa PA01
ggccgucuuccagggcggc

SEQ ID NO: 3488908 - RNA, 14 nt, Pseudomonas aeruginosa PA01
ggccgugagcacga

SEQ ID NO: 3488909 - RNA, 14 nt, Pseudomonas aeruginosa PA01
ggccgugcagcccu

SEQ ID NO: 3488910 - RNA, 16 nt, Pseudomonas aeruginosa PA01
ggccgugcagcccucg

SEQ ID NO: 3488911 - RNA, 22 nt, Pseudomonas aeruginosa PA01
ggccgugccucagagucgcacc

SEQ ID NO: 3488912 - RNA, 14 nt, Pseudomonas aeruginosa PA01
ggccguggcgcccc

SEQ ID NO: 3488913 - RNA, 20 nt, Pseudomonas aeruginosa PA01
ggccguggcgccccaggcgg

SEQ ID NO: 3488914 - RNA, 14 nt, Pseudomonas aeruginosa PA01
ggccgugggccgcc

SEQ ID NO: 3488915 - RNA, 15 nt, Pseudomonas aeruginosa PA01
ggccgugggccggcg

SEQ ID NO: 3488916 - RNA, 16 nt, Pseudomonas aeruginosa PA01
ggccgugggccggcgc

SEQ ID NO: 3488917 - RNA, 18 nt, Pseudomonas aeruginosa PA01
ggccgugugccugagcug

SEQ ID NO: 3488918 - RNA, 15 nt, Pseudomonas aeruginosa PA01
ggccguucaggcggg

SEQ ID NO: 3488919 - RNA, 17 nt, Pseudomonas aeruginosa PA01
ggccguucucgaagagc

SEQ ID NO: 3488920 - RNA, 16 nt, Pseudomonas aeruginosa PA01
ggccguugaccagcgc

SEQ ID NO: 3488921 - RNA, 16 nt, Pseudomonas aeruginosa PA01
ggccguugcgcaggcg

SEQ ID NO: 3488922 - RNA, 17 nt, Pseudomonas aeruginosa PA01
ggccguugcgcaggcgg

SEQ ID NO: 3488923 - RNA, 16 nt, Pseudomonas aeruginosa PA01
ggccguugcgggcgau

SEQ ID NO: 3488924 - RNA, 14 nt, Pseudomonas aeruginosa PA01
ggccguuggcgaac

SEQ ID NO: 3488925 - RNA, 17 nt, Pseudomonas aeruginosa PA01
ggccguuguagagacag

SEQ ID NO: 3488926 - RNA, 16 nt, Pseudomonas aeruginosa PA01
ggccuacccgcgcuuc

SEQ ID NO: 3488927 - RNA, 20 nt, Pseudomonas aeruginosa PA01
ggccuacccgcgcuucuucg

SEQ ID NO: 3488928 - RNA, 18 nt, Pseudomonas aeruginosa PA01
ggccuacugcuggacggc

SEQ ID NO: 3488929 - RNA, 19 nt, Pseudomonas aeruginosa PA01
ggccuacugcuggacggcg

SEQ ID NO: 3488930 - RNA, 22 nt, Pseudomonas aeruginosa PA01
ggccuacuucucgacgaaggcg

SEQ ID NO: 3488931 - RNA, 19 nt, Pseudomonas aeruginosa PA01
ggccuacuugaucagccgc

SEQ ID NO: 3488932 - RNA, 20 nt, Pseudomonas aeruginosa PA01
ggccuacuugaucagccgca

SEQ ID NO: 3488933 - RNA, 20 nt, Pseudomonas aeruginosa PA01
ggccucaacgaccgcccagg

SEQ ID NO: 3488934 - RNA, 14 nt, Pseudomonas aeruginosa PA01
ggccucaagcaagc

SEQ ID NO: 3488935 - RNA, 15 nt, Pseudomonas aeruginosa PA01
ggccucaauacccgu

SEQ ID NO: 3488936 - RNA, 14 nt, Pseudomonas aeruginosa PA01
ggccucaggccugg

SEQ ID NO: 3488937 - RNA, 13 nt, Pseudomonas aeruginosa PA01
ggccucagggcgc

SEQ ID NO: 3488938 - RNA, 15 nt, Pseudomonas aeruginosa PA01
ggccuccacccgcga

SEQ ID NO: 3488939 - RNA, 22 nt, Pseudomonas aeruginosa PA01
ggccuccacccgcgaagccugc

SEQ ID NO: 3488940 - RNA, 20 nt, Pseudomonas aeruginosa PA01
ggccuccagcacucgcuccu

SEQ ID NO: 3488941 - RNA, 21 nt, Pseudomonas aeruginosa PA01
ggccuccagcacucgcuccuc

SEQ ID NO: 3488942 - RNA, 13 nt, Pseudomonas aeruginosa PA01
ggccuccagcgcc

SEQ ID NO: 3488943 - RNA, 22 nt, Pseudomonas aeruginosa PA01
ggccuccagcgccucgccgagc

SEQ ID NO: 3488944 - RNA, 17 nt, Pseudomonas aeruginosa PA01
ggccuccagcgccuggc

SEQ ID NO: 3488945 - RNA, 18 nt, Pseudomonas aeruginosa PA01
ggccuccagcgccuggcg

SEQ ID NO: 3488946 - RNA, 20 nt, Pseudomonas aeruginosa PA01
ggccuccagcgccuggcgca

SEQ ID NO: 3488947 - RNA, 14 nt, Pseudomonas aeruginosa PA01
ggccuccaggcugg

SEQ ID NO: 3488948 - RNA, 17 nt, Pseudomonas aeruginosa PA01
ggccuccaggcuggccu

SEQ ID NO: 3488949 - RNA, 18 nt, Pseudomonas aeruginosa PA01
ggccuccaggcuggccuu

SEQ ID NO: 3488950 - RNA, 15 nt, Pseudomonas aeruginosa PA01
ggccuccggacgcug

SEQ ID NO: 3488951 - RNA, 23 nt, Pseudomonas aeruginosa PA01
ggccuccggacgcugcaugcgga

SEQ ID NO: 3488952 - RNA, 14 nt, Pseudomonas aeruginosa PA01
ggccuccgguggcg

SEQ ID NO: 3488953 - RNA, 11 nt, Pseudomonas aeruginosa PA01
ggccuccucgu

SEQ ID NO: 3488954 - RNA, 22 nt, Pseudomonas aeruginosa PA01
ggccuccugcaacgccuggugc

SEQ ID NO: 3488955 - RNA, 13 nt, Pseudomonas aeruginosa PA01
ggccuccuggcgg

SEQ ID NO: 3488956 - RNA, 20 nt, Pseudomonas aeruginosa PA01
ggccucgaagaacuccaucu

SEQ ID NO: 3488957 - RNA, 13 nt, Pseudomonas aeruginosa PA01
ggccucgacgcag

SEQ ID NO: 3488958 - RNA, 20 nt, Pseudomonas aeruginosa PA01
ggccucgacgcagagcgcca

SEQ ID NO: 3488959 - RNA, 18 nt, Pseudomonas aeruginosa PA01
ggccucgagcaucuccgg

SEQ ID NO: 3488960 - RNA, 19 nt, Pseudomonas aeruginosa PA01
ggccucgaggucggccugg

SEQ ID NO: 3488961 - RNA, 17 nt, Pseudomonas aeruginosa PA01
ggccucgagguucucga

SEQ ID NO: 3488962 - RNA, 20 nt, Pseudomonas aeruginosa PA01
ggccucgaucucguccucgg

SEQ ID NO: 3488963 - RNA, 18 nt, Pseudomonas aeruginosa PA01
ggccucgaugaucgccgg

SEQ ID NO: 3488964 - RNA, 21 nt, Pseudomonas aeruginosa PA01
ggccucgaugaucgccgggug

SEQ ID NO: 3488965 - RNA, 19 nt, Pseudomonas aeruginosa PA01
ggccucgaugauggugcgg

SEQ ID NO: 3488966 - RNA, 21 nt, Pseudomonas aeruginosa PA01
ggccucgcaauugaucaucca

SEQ ID NO: 3488967 - RNA, 22 nt, Pseudomonas aeruginosa PA01
ggccucgcaauugaucauccag

SEQ ID NO: 3488968 - RNA, 19 nt, Pseudomonas aeruginosa PA01
ggccucgccggucgcgcuc

SEQ ID NO: 3488969 - RNA, 18 nt, Pseudomonas aeruginosa PA01
ggccucgccugcggcgcc

SEQ ID NO: 3488970 - RNA, 16 nt, Pseudomonas aeruginosa PA01
ggccucgcgcaacugc

SEQ ID NO: 3488971 - RNA, 18 nt, Pseudomonas aeruginosa PA01
ggccucgcgugcgcuggu

SEQ ID NO: 3488972 - RNA, 18 nt, Pseudomonas aeruginosa PA01
ggccucgcugccgccgca

SEQ ID NO: 3488973 - RNA, 22 nt, Pseudomonas aeruginosa PA01
ggccucgcugccuggggacggc

SEQ ID NO: 3488974 - RNA, 15 nt, Pseudomonas aeruginosa PA01
ggccucgcugcgcag

SEQ ID NO: 3488975 - RNA, 18 nt, Pseudomonas aeruginosa PA01
ggccucgcugcgcagaug

SEQ ID NO: 3488976 - RNA, 19 nt, Pseudomonas aeruginosa PA01
ggccucggagucaggcucc

SEQ ID NO: 3488977 - RNA, 15 nt, Pseudomonas aeruginosa PA01
ggccucggcauccuc

SEQ ID NO: 3488978 - RNA, 11 nt, Pseudomonas aeruginosa PA01
ggccucggcca

SEQ ID NO: 3488979 - RNA, 12 nt, Pseudomonas aeruginosa PA01
ggccucggccag

SEQ ID NO: 3488980 - RNA, 14 nt, Pseudomonas aeruginosa PA01
ggccucggccagcg

SEQ ID NO: 3488981 - RNA, 17 nt, Pseudomonas aeruginosa PA01
ggccucggccagcgccg

SEQ ID NO: 3488982 - RNA, 18 nt, Pseudomonas aeruginosa PA01
ggccucggccagcgccgc

SEQ ID NO: 3488983 - RNA, 19 nt, Pseudomonas aeruginosa PA01
ggccucggccagcgccgcc

SEQ ID NO: 3488984 - RNA, 23 nt, Pseudomonas aeruginosa PA01
ggccucggccagcgccgccgcug

SEQ ID NO: 3488985 - RNA, 16 nt, Pseudomonas aeruginosa PA01
ggccucggccucgucg

SEQ ID NO: 3488986 - RNA, 17 nt, Pseudomonas aeruginosa PA01
ggccucggccucgucga

SEQ ID NO: 3488987 - RNA, 14 nt, Pseudomonas aeruginosa PA01
ggccucggccuggu

SEQ ID NO: 3488988 - RNA, 16 nt, Pseudomonas aeruginosa PA01
ggccucggccuggucg

SEQ ID NO: 3488989 - RNA, 13 nt, Pseudomonas aeruginosa PA01
ggccucggcgaag

SEQ ID NO: 3488990 - RNA, 18 nt, Pseudomonas aeruginosa PA01
ggccucggcgaagucgcc

SEQ ID NO: 3488991 - RNA, 20 nt, Pseudomonas aeruginosa PA01
ggccucggcgaagucgccgu

SEQ ID NO: 3488992 - RNA, 21 nt, Pseudomonas aeruginosa PA01
ggccucggcgaagucgccguc

SEQ ID NO: 3488993 - RNA, 23 nt, Pseudomonas aeruginosa PA01
ggccucggcgaggaucagucgcu

SEQ ID NO: 3488994 - RNA, 13 nt, Pseudomonas aeruginosa PA01
ggccucggcgauc

SEQ ID NO: 3488995 - RNA, 14 nt, Pseudomonas aeruginosa PA01
ggccucggcgaucg

SEQ ID NO: 3488996 - RNA, 17 nt, Pseudomonas aeruginosa PA01
ggccucggcgaucgcca

SEQ ID NO: 3488997 - RNA, 12 nt, Pseudomonas aeruginosa PA01
ggccucggcgcg

SEQ ID NO: 3488998 - RNA, 15 nt, Pseudomonas aeruginosa PA01
ggccucggcgcgggc

SEQ ID NO: 3488999 - RNA, 19 nt, Pseudomonas aeruginosa PA01
ggccucggcgcgggccuuc

SEQ ID NO: 3489000 - RNA, 13 nt, Pseudomonas aeruginosa PA01
ggccucggcggcg

SEQ ID NO: 3489001 - RNA, 17 nt, Pseudomonas aeruginosa PA01
ggccucggcgucgcgca

SEQ ID NO: 3489002 - RNA, 18 nt, Pseudomonas aeruginosa PA01
ggccucggcgucgcgcag

SEQ ID NO: 3489003 - RNA, 22 nt, Pseudomonas aeruginosa PA01
ggccucgggcgggaucuccgcg

SEQ ID NO: 3489004 - RNA, 14 nt, Pseudomonas aeruginosa PA01
ggccucggggccgu

SEQ ID NO: 3489005 - RNA, 24 nt, Pseudomonas aeruginosa PA01
ggccucggggccguccgccagguc

SEQ ID NO: 3489006 - RNA, 21 nt, Pseudomonas aeruginosa PA01
ggccucgucgagcaucugccg

SEQ ID NO: 3489007 - RNA, 17 nt, Pseudomonas aeruginosa PA01
ggccucgucgaucucgc

SEQ ID NO: 3489008 - RNA, 19 nt, Pseudomonas aeruginosa PA01
ggccucgucguucagccca

SEQ ID NO: 3489009 - RNA, 23 nt, Pseudomonas aeruginosa PA01
ggccucguugaucggcaacgagc

SEQ ID NO: 3489010 - RNA, 14 nt, Pseudomonas aeruginosa PA01
ggccucguuuuugg

SEQ ID NO: 3489011 - RNA, 23 nt, Pseudomonas aeruginosa PA01
ggccucuccgagacgcugcaccg

SEQ ID NO: 3489012 - RNA, 17 nt, Pseudomonas aeruginosa PA01
ggccucuucgucggcga

SEQ ID NO: 3489013 - RNA, 19 nt, Pseudomonas aeruginosa PA01
ggccucuucgucggcgaac

SEQ ID NO: 3489014 - RNA, 14 nt, Pseudomonas aeruginosa PA01
ggccucuugaaaac

SEQ ID NO: 3489015 - RNA, 21 nt, Pseudomonas aeruginosa PA01
ggccugacgcaagcgcucggc

SEQ ID NO: 3489016 - RNA, 23 nt, Pseudomonas aeruginosa PA01
ggccugacgcaagcgcucggccu

SEQ ID NO: 3489017 - RNA, 12 nt, Pseudomonas aeruginosa PA01
ggccugagccgg

SEQ ID NO: 3489018 - RNA, 17 nt, Pseudomonas aeruginosa PA01
ggccugaucaucugggc

SEQ ID NO: 3489019 - RNA, 19 nt, Pseudomonas aeruginosa PA01
ggccugaucaucugggcca

SEQ ID NO: 3489020 - RNA, 20 nt, Pseudomonas aeruginosa PA01
ggccugaucaucugggccau

SEQ ID NO: 3489021 - RNA, 22 nt, Pseudomonas aeruginosa PA01
ggccugaucaucugggccaucg

SEQ ID NO: 3489022 - RNA, 22 nt, Pseudomonas aeruginosa PA01
ggccugcaacacccaggccugg

SEQ ID NO: 3489023 - RNA, 16 nt, Pseudomonas aeruginosa PA01
ggccugcaacgccgcc

SEQ ID NO: 3489024 - RNA, 17 nt, Pseudomonas aeruginosa PA01
ggccugcaacgccgcca

SEQ ID NO: 3489025 - RNA, 18 nt, Pseudomonas aeruginosa PA01
ggccugcaccagccaguc

SEQ ID NO: 3489026 - RNA, 21 nt, Pseudomonas aeruginosa PA01
ggccugcaccugcucggggcc

SEQ ID NO: 3489027 - RNA, 16 nt, Pseudomonas aeruginosa PA01
ggccugcacguggagu

SEQ ID NO: 3489028 - RNA, 14 nt, Pseudomonas aeruginosa PA01
ggccugcagcaggu

SEQ ID NO: 3489029 - RNA, 17 nt, Pseudomonas aeruginosa PA01
ggccugcagcgacucca

SEQ ID NO: 3489030 - RNA, 19 nt, Pseudomonas aeruginosa PA01
ggccugcagcgacuccagc

SEQ ID NO: 3489031 - RNA, 21 nt, Pseudomonas aeruginosa PA01
ggccugcagcgacuccagcca

SEQ ID NO: 3489032 - RNA, 11 nt, Pseudomonas aeruginosa PA01
ggccugcaggu

SEQ ID NO: 3489033 - RNA, 15 nt, Pseudomonas aeruginosa PA01
ggccugccccgccgg

SEQ ID NO: 3489034 - RNA, 17 nt, Pseudomonas aeruginosa PA01
ggccugccccgccggcg

SEQ ID NO: 3489035 - RNA, 19 nt, Pseudomonas aeruginosa PA01
ggccugccccgccggcgcu

SEQ ID NO: 3489036 - RNA, 21 nt, Pseudomonas aeruginosa PA01
ggccugccccgccggcgcuuu

SEQ ID NO: 3489037 - RNA, 18 nt, Pseudomonas aeruginosa PA01
ggccugccgaugggccuu

SEQ ID NO: 3489038 - RNA, 15 nt, Pseudomonas aeruginosa PA01
ggccugccguugcac

SEQ ID NO: 3489039 - RNA, 13 nt, Pseudomonas aeruginosa PA01
ggccugcgccgga

SEQ ID NO: 3489040 - RNA, 16 nt, Pseudomonas aeruginosa PA01
ggccugcgccggacca

SEQ ID NO: 3489041 - RNA, 18 nt, Pseudomonas aeruginosa PA01
ggccugcgcgcaccaggc

SEQ ID NO: 3489042 - RNA, 19 nt, Pseudomonas aeruginosa PA01
ggccugcgcgcaccaggcc

SEQ ID NO: 3489043 - RNA, 23 nt, Pseudomonas aeruginosa PA01
ggccugcgcgcaccaggccuccc

SEQ ID NO: 3489044 - RNA, 20 nt, Pseudomonas aeruginosa PA01
ggccugcgcuuccggcagcc

SEQ ID NO: 3489045 - RNA, 23 nt, Pseudomonas aeruginosa PA01
ggccugcgcuuccggcagccagc

SEQ ID NO: 3489046 - RNA, 18 nt, Pseudomonas aeruginosa PA01
ggccugcggguucggcga

SEQ ID NO: 3489047 - RNA, 19 nt, Pseudomonas aeruginosa PA01
ggccugcggguucggcgag

SEQ ID NO: 3489048 - RNA, 11 nt, Pseudomonas aeruginosa PA01
ggccugcucag

SEQ ID NO: 3489049 - RNA, 13 nt, Pseudomonas aeruginosa PA01
ggccugcuccucg

SEQ ID NO: 3489050 - RNA, 15 nt, Pseudomonas aeruginosa PA01
ggccugcuccucggc

SEQ ID NO: 3489051 - RNA, 19 nt, Pseudomonas aeruginosa PA01
ggccugcuccucggcagcg

SEQ ID NO: 3489052 - RNA, 15 nt, Pseudomonas aeruginosa PA01
ggccugcucgcgcag

SEQ ID NO: 3489053 - RNA, 16 nt, Pseudomonas aeruginosa PA01
ggccugcucgcgcagc

SEQ ID NO: 3489054 - RNA, 22 nt, Pseudomonas aeruginosa PA01
ggccugcucgcgcagccaggcg

SEQ ID NO: 3489055 - RNA, 15 nt, Pseudomonas aeruginosa PA01
ggccugcucggcucg

SEQ ID NO: 3489056 - RNA, 18 nt, Pseudomonas aeruginosa PA01
ggccugcucggcucgcgg

SEQ ID NO: 3489057 - RNA, 17 nt, Pseudomonas aeruginosa PA01
ggccugcugcgccggca

SEQ ID NO: 3489058 - RNA, 17 nt, Pseudomonas aeruginosa PA01
ggccugcugcgggcgcu

SEQ ID NO: 3489059 - RNA, 12 nt, Pseudomonas aeruginosa PA01
ggccugcugcuc

SEQ ID NO: 3489060 - RNA, 22 nt, Pseudomonas aeruginosa PA01
ggccugcugcucgaccgccugc

SEQ ID NO: 3489061 - RNA, 16 nt, Pseudomonas aeruginosa PA01
ggccugcuugcaggag

SEQ ID NO: 3489062 - RNA, 16 nt, Pseudomonas aeruginosa PA01
ggccuggaacaccagg

SEQ ID NO: 3489063 - RNA, 23 nt, Pseudomonas aeruginosa PA01
ggccuggaacaccaggccgcaag

SEQ ID NO: 3489064 - RNA, 13 nt, Pseudomonas aeruginosa PA01
ggccuggagcgcc

SEQ ID NO: 3489065 - RNA, 14 nt, Pseudomonas aeruginosa PA01
ggccuggagcgccu

SEQ ID NO: 3489066 - RNA, 15 nt, Pseudomonas aeruginosa PA01
ggccuggagcgccuc

SEQ ID NO: 3489067 - RNA, 17 nt, Pseudomonas aeruginosa PA01
ggccuggagcgccucga

SEQ ID NO: 3489068 - RNA, 14 nt, Pseudomonas aeruginosa PA01
ggccuggaucgccu

SEQ ID NO: 3489069 - RNA, 18 nt, Pseudomonas aeruginosa PA01
ggccuggaucgccuugcg

SEQ ID NO: 3489070 - RNA, 23 nt, Pseudomonas aeruginosa PA01
ggccuggaucgccuugcgcgugc

SEQ ID NO: 3489071 - RNA, 17 nt, Pseudomonas aeruginosa PA01
ggccuggaucucggcgg

SEQ ID NO: 3489072 - RNA, 23 nt, Pseudomonas aeruginosa PA01
ggccuggccacccuuguggccga

SEQ ID NO: 3489073 - RNA, 13 nt, Pseudomonas aeruginosa PA01
ggccuggcccggc

SEQ ID NO: 3489074 - RNA, 16 nt, Pseudomonas aeruginosa PA01
ggccuggcccggcgca

SEQ ID NO: 3489075 - RNA, 21 nt, Pseudomonas aeruginosa PA01
ggccuggcccuggcgcaggcg

SEQ ID NO: 3489076 - RNA, 12 nt, Pseudomonas aeruginosa PA01
ggccuggccgcc

SEQ ID NO: 3489077 - RNA, 22 nt, Pseudomonas aeruginosa PA01
ggccuggccguugcgcaggcgg

SEQ ID NO: 3489078 - RNA, 11 nt, Pseudomonas aeruginosa PA01
ggccuggcgca

SEQ ID NO: 3489079 - RNA, 17 nt, Pseudomonas aeruginosa PA01
ggccuggcgcaacaggc

SEQ ID NO: 3489080 - RNA, 19 nt, Pseudomonas aeruginosa PA01
ggccuggcgcaacaggcgc

SEQ ID NO: 3489081 - RNA, 13 nt, Pseudomonas aeruginosa PA01
ggccuggcgcgcg

SEQ ID NO: 3489082 - RNA, 17 nt, Pseudomonas aeruginosa PA01
ggccuggcgcgcgcgcc

SEQ ID NO: 3489083 - RNA, 18 nt, Pseudomonas aeruginosa PA01
ggccuggcgcgcgcgcca

SEQ ID NO: 3489084 - RNA, 20 nt, Pseudomonas aeruginosa PA01
ggccuggcgcucagcgccgc

SEQ ID NO: 3489085 - RNA, 22 nt, Pseudomonas aeruginosa PA01
ggccuggcgcucagcgccgcuu

SEQ ID NO: 3489086 - RNA, 16 nt, Pseudomonas aeruginosa PA01
ggccuggcucaugucg

SEQ ID NO: 3489087 - RNA, 19 nt, Pseudomonas aeruginosa PA01
ggccuggcucgaucggcag

SEQ ID NO: 3489088 - RNA, 13 nt, Pseudomonas aeruginosa PA01
ggccuggcugccg

SEQ ID NO: 3489089 - RNA, 13 nt, Pseudomonas aeruginosa PA01
ggccuggcuggcc

SEQ ID NO: 3489090 - RNA, 15 nt, Pseudomonas aeruginosa PA01
ggccuggcuggccuu

SEQ ID NO: 3489091 - RNA, 17 nt, Pseudomonas aeruginosa PA01
ggccugggacggcgugg

SEQ ID NO: 3489092 - RNA, 21 nt, Pseudomonas aeruginosa PA01
ggccugggacggcguggucga

SEQ ID NO: 3489093 - RNA, 22 nt, Pseudomonas aeruginosa PA01
ggccugggcaagcugcacggcg

SEQ ID NO: 3489094 - RNA, 22 nt, Pseudomonas aeruginosa PA01
ggccugggccgaaggccaggcc

SEQ ID NO: 3489095 - RNA, 14 nt, Pseudomonas aeruginosa PA01
ggccugggcgaagu

SEQ ID NO: 3489096 - RNA, 13 nt, Pseudomonas aeruginosa PA01
ggccugggcgccg

SEQ ID NO: 3489097 - RNA, 14 nt, Pseudomonas aeruginosa PA01
ggccugggcgccgc

SEQ ID NO: 3489098 - RNA, 16 nt, Pseudomonas aeruginosa PA01
ggccugggcgccgcca

SEQ ID NO: 3489099 - RNA, 13 nt, Pseudomonas aeruginosa PA01
ggccuggggcucg

SEQ ID NO: 3489100 - RNA, 18 nt, Pseudomonas aeruginosa PA01
ggccugggguagccggcc

SEQ ID NO: 3489101 - RNA, 19 nt, Pseudomonas aeruginosa PA01
ggccugggguagccggccg

SEQ ID NO: 3489102 - RNA, 19 nt, Pseudomonas aeruginosa PA01
ggccuggguacgcaccggc

SEQ ID NO: 3489103 - RNA, 17 nt, Pseudomonas aeruginosa PA01
ggccugggucaccagca

SEQ ID NO: 3489104 - RNA, 18 nt, Pseudomonas aeruginosa PA01
ggccugggucaccagcac

SEQ ID NO: 3489105 - RNA, 20 nt, Pseudomonas aeruginosa PA01
ggccugggucaccagcacca

SEQ ID NO: 3489106 - RNA, 15 nt, Pseudomonas aeruginosa PA01
ggccugggugaacag

SEQ ID NO: 3489107 - RNA, 18 nt, Pseudomonas aeruginosa PA01
ggccugggugaacagcgg

SEQ ID NO: 3489108 - RNA, 21 nt, Pseudomonas aeruginosa PA01
ggccugggugaacagcggccc

SEQ ID NO: 3489109 - RNA, 20 nt, Pseudomonas aeruginosa PA01
ggccugggugauuucuucag

SEQ ID NO: 3489110 - RNA, 16 nt, Pseudomonas aeruginosa PA01
ggccugguaggccucg

SEQ ID NO: 3489111 - RNA, 19 nt, Pseudomonas aeruginosa PA01
ggccugguaggcgucgucg

SEQ ID NO: 3489112 - RNA, 16 nt, Pseudomonas aeruginosa PA01
ggccugguagucgccg

SEQ ID NO: 3489113 - RNA, 14 nt, Pseudomonas aeruginosa PA01
ggccugguccggca

SEQ ID NO: 3489114 - RNA, 22 nt, Pseudomonas aeruginosa PA01
ggccuggucgaaagccugccgg

SEQ ID NO: 3489115 - RNA, 15 nt, Pseudomonas aeruginosa PA01
ggccuggucggcgcg

SEQ ID NO: 3489116 - RNA, 15 nt, Pseudomonas aeruginosa PA01
ggccuggugcaccug

SEQ ID NO: 3489117 - RNA, 17 nt, Pseudomonas aeruginosa PA01
ggccuggugcaccuggc

SEQ ID NO: 3489118 - RNA, 19 nt, Pseudomonas aeruginosa PA01
ggccuggugcaccuggcga

SEQ ID NO: 3489119 - RNA, 19 nt, Pseudomonas aeruginosa PA01
ggccuggugcacgccgaug

SEQ ID NO: 3489120 - RNA, 22 nt, Pseudomonas aeruginosa PA01
ggccuggugcacgccgauggcg

SEQ ID NO: 3489121 - RNA, 20 nt, Pseudomonas aeruginosa PA01
ggccugguuguaggcgccgc

SEQ ID NO: 3489122 - RNA, 21 nt, Pseudomonas aeruginosa PA01
ggccugguuguaggcgccgcc

SEQ ID NO: 3489123 - RNA, 19 nt, Pseudomonas aeruginosa PA01
ggccuguaccaaggugcug

SEQ ID NO: 3489124 - RNA, 16 nt, Pseudomonas aeruginosa PA01
ggccuguaccgcuucc

SEQ ID NO: 3489125 - RNA, 17 nt, Pseudomonas aeruginosa PA01
ggccuguaccgcuuccu

SEQ ID NO: 3489126 - RNA, 20 nt, Pseudomonas aeruginosa PA01
ggccuguaccgcuuccuggg

SEQ ID NO: 3489127 - RNA, 16 nt, Pseudomonas aeruginosa PA01
ggccugucacgccggg

SEQ ID NO: 3489128 - RNA, 21 nt, Pseudomonas aeruginosa PA01
ggccugucacgccgggggucg

SEQ ID NO: 3489129 - RNA, 20 nt, Pseudomonas aeruginosa PA01
ggccuguccgaagacaggcc

SEQ ID NO: 3489130 - RNA, 22 nt, Pseudomonas aeruginosa PA01
ggccuguccgaagacaggccuu

SEQ ID NO: 3489131 - RNA, 22 nt, Pseudomonas aeruginosa PA01
ggccugucgggggcugcgcauc

SEQ ID NO: 3489132 - RNA, 20 nt, Pseudomonas aeruginosa PA01
ggccuguggauagaaaagca

SEQ ID NO: 3489133 - RNA, 21 nt, Pseudomonas aeruginosa PA01
ggccuguucgcccaaggccag

SEQ ID NO: 3489134 - RNA, 15 nt, Pseudomonas aeruginosa PA01
ggccuguucggccuu

SEQ ID NO: 3489135 - RNA, 15 nt, Pseudomonas aeruginosa PA01
ggccuuaaggugacg

SEQ ID NO: 3489136 - RNA, 15 nt, Pseudomonas aeruginosa PA01
ggccuucaccgcgcc

SEQ ID NO: 3489137 - RNA, 19 nt, Pseudomonas aeruginosa PA01
ggccuucaccgcgccgcgc

SEQ ID NO: 3489138 - RNA, 14 nt, Pseudomonas aeruginosa PA01
ggccuucaggcgcu

SEQ ID NO: 3489139 - RNA, 15 nt, Pseudomonas aeruginosa PA01
ggccuucaggcgcuc

SEQ ID NO: 3489140 - RNA, 14 nt, Pseudomonas aeruginosa PA01
ggccuucaggcugc

SEQ ID NO: 3489141 - RNA, 23 nt, Pseudomonas aeruginosa PA01
ggccuuccacgccuucgcggccg

SEQ ID NO: 3489142 - RNA, 20 nt, Pseudomonas aeruginosa PA01
ggccuuccagaacgccgcgc

SEQ ID NO: 3489143 - RNA, 20 nt, Pseudomonas aeruginosa PA01
ggccuucccacuccguccag

SEQ ID NO: 3489144 - RNA, 20 nt, Pseudomonas aeruginosa PA01
ggccuuccgggaagcggucg

SEQ ID NO: 3489145 - RNA, 19 nt, Pseudomonas aeruginosa PA01
ggccuucgacgguucgcga

SEQ ID NO: 3489146 - RNA, 14 nt, Pseudomonas aeruginosa PA01
ggccuucgccagcg

SEQ ID NO: 3489147 - RNA, 17 nt, Pseudomonas aeruginosa PA01
ggccuucgccagcggcc

SEQ ID NO: 3489148 - RNA, 15 nt, Pseudomonas aeruginosa PA01
ggccuucgccgacca

SEQ ID NO: 3489149 - RNA, 21 nt, Pseudomonas aeruginosa PA01
ggccuucgccuucggcgugca

SEQ ID NO: 3489150 - RNA, 16 nt, Pseudomonas aeruginosa PA01
ggccuucggcaggaag

SEQ ID NO: 3489151 - RNA, 14 nt, Pseudomonas aeruginosa PA01
ggccuucggcgccg

SEQ ID NO: 3489152 - RNA, 16 nt, Pseudomonas aeruginosa PA01
ggccuucggcgccgga

SEQ ID NO: 3489153 - RNA, 14 nt, Pseudomonas aeruginosa PA01
ggccuucgucggcu

SEQ ID NO: 3489154 - RNA, 14 nt, Pseudomonas aeruginosa PA01
ggccuucucgucgc

SEQ ID NO: 3489155 - RNA, 22 nt, Pseudomonas aeruginosa PA01
ggccuucucgucgccgcccggc

SEQ ID NO: 3489156 - RNA, 15 nt, Pseudomonas aeruginosa PA01
ggccuugaccaccgc

SEQ ID NO: 3489157 - RNA, 17 nt, Pseudomonas aeruginosa PA01
ggccuugagcaggcggc

SEQ ID NO: 3489158 - RNA, 16 nt, Pseudomonas aeruginosa PA01
ggccuugagcaggcgu

SEQ ID NO: 3489159 - RNA, 14 nt, Pseudomonas aeruginosa PA01
ggccuugagcgccg

SEQ ID NO: 3489160 - RNA, 16 nt, Pseudomonas aeruginosa PA01
ggccuugagcgccgaa

SEQ ID NO: 3489161 - RNA, 22 nt, Pseudomonas aeruginosa PA01
ggccuugagcgccgaaggcguc

SEQ ID NO: 3489162 - RNA, 15 nt, Pseudomonas aeruginosa PA01
ggccuugaggcgggc

SEQ ID NO: 3489163 - RNA, 20 nt, Pseudomonas aeruginosa PA01
ggccuugaucaccaccacgc

SEQ ID NO: 3489164 - RNA, 22 nt, Pseudomonas aeruginosa PA01
ggccuugcagcaacucgccgcc

SEQ ID NO: 3489165 - RNA, 24 nt, Pseudomonas aeruginosa PA01
ggccuugcagcaacucgccgccga

SEQ ID NO: 3489166 - RNA, 17 nt, Pseudomonas aeruginosa PA01
ggccuugcagggccgcc

SEQ ID NO: 3489167 - RNA, 21 nt, Pseudomonas aeruginosa PA01
ggccuugcagggccgccagcc

SEQ ID NO: 3489168 - RNA, 13 nt, Pseudomonas aeruginosa PA01
ggccuugccgcga

SEQ ID NO: 3489169 - RNA, 16 nt, Pseudomonas aeruginosa PA01
ggccuugccggcaucg

SEQ ID NO: 3489170 - RNA, 21 nt, Pseudomonas aeruginosa PA01
ggccuugccguccagccggcg

SEQ ID NO: 3489171 - RNA, 21 nt, Pseudomonas aeruginosa PA01
ggccuugcgaccagguccgga

SEQ ID NO: 3489172 - RNA, 15 nt, Pseudomonas aeruginosa PA01
ggccuugcgcggcgc

SEQ ID NO: 3489173 - RNA, 16 nt, Pseudomonas aeruginosa PA01
ggccuugcgcggcgcc

SEQ ID NO: 3489174 - RNA, 14 nt, Pseudomonas aeruginosa PA01
ggccuuggccaugc

SEQ ID NO: 3489175 - RNA, 16 nt, Pseudomonas aeruginosa PA01
ggccuuggccaugccc

SEQ ID NO: 3489176 - RNA, 14 nt, Pseudomonas aeruginosa PA01
ggccuuggcccggu

SEQ ID NO: 3489177 - RNA, 13 nt, Pseudomonas aeruginosa PA01
ggccuuggucucg

SEQ ID NO: 3489178 - RNA, 17 nt, Pseudomonas aeruginosa PA01
ggccuuguacagggcgc

SEQ ID NO: 3489179 - RNA, 22 nt, Pseudomonas aeruginosa PA01
ggccuuguagaguuugccgaac

SEQ ID NO: 3489180 - RNA, 19 nt, Pseudomonas aeruginosa PA01
ggccuuguccgcgcgcuuc

SEQ ID NO: 3489181 - RNA, 14 nt, Pseudomonas aeruginosa PA01
ggccuuguccggca

SEQ ID NO: 3489182 - RNA, 17 nt, Pseudomonas aeruginosa PA01
ggccuugugcgccagcu

SEQ ID NO: 3489183 - RNA, 17 nt, Pseudomonas aeruginosa PA01
ggccuuguucagggugg

SEQ ID NO: 3489184 - RNA, 20 nt, Pseudomonas aeruginosa PA01
ggccuuguucaggguggcga

SEQ ID NO: 3489185 - RNA, 23 nt, Pseudomonas aeruginosa PA01
ggccuuguucaggguggcgaccg

SEQ ID NO: 3489186 - RNA, 13 nt, Pseudomonas aeruginosa PA01
ggccuuucuucug

SEQ ID NO: 3489187 - RNA, 22 nt, Pseudomonas aeruginosa PA01
ggccuuucuuuucugccacccg

SEQ ID NO: 3489188 - RNA, 16 nt, Pseudomonas aeruginosa PA01
ggccuuuucggcggcc

SEQ ID NO: 3489189 - RNA, 17 nt, Pseudomonas aeruginosa PA01
ggcgaaaaucgaagggu

SEQ ID NO: 3489190 - RNA, 14 nt, Pseudomonas aeruginosa PA01
ggcgaaaccggcca

SEQ ID NO: 3489191 - RNA, 19 nt, Pseudomonas aeruginosa PA01
ggcgaaaccggccagcgcg

SEQ ID NO: 3489192 - RNA, 20 nt, Pseudomonas aeruginosa PA01
ggcgaaaccggccagcgcgg

SEQ ID NO: 3489193 - RNA, 21 nt, Pseudomonas aeruginosa PA01
ggcgaaaccggccagcgcggc

SEQ ID NO: 3489194 - RNA, 14 nt, Pseudomonas aeruginosa PA01
ggcgaaacggcagg

SEQ ID NO: 3489195 - RNA, 20 nt, Pseudomonas aeruginosa PA01
ggcgaaacggcaggccagca

SEQ ID NO: 3489196 - RNA, 22 nt, Pseudomonas aeruginosa PA01
ggcgaaacggcaggccagcagg

SEQ ID NO: 3489197 - RNA, 20 nt, Pseudomonas aeruginosa PA01
ggcgaaacguccggcguccc

SEQ ID NO: 3489198 - RNA, 17 nt, Pseudomonas aeruginosa PA01
ggcgaaacuccagcagg

SEQ ID NO: 3489199 - RNA, 15 nt, Pseudomonas aeruginosa PA01
ggcgaaagucggcgc

SEQ ID NO: 3489200 - RNA, 16 nt, Pseudomonas aeruginosa PA01
ggcgaaagucggcgcg

SEQ ID NO: 3489201 - RNA, 17 nt, Pseudomonas aeruginosa PA01
ggcgaaagucggcgcga

SEQ ID NO: 3489202 - RNA, 18 nt, Pseudomonas aeruginosa PA01
ggcgaaagucggcgcgac

SEQ ID NO: 3489203 - RNA, 12 nt, Pseudomonas aeruginosa PA01
ggcgaaauccuc

SEQ ID NO: 3489204 - RNA, 22 nt, Pseudomonas aeruginosa PA01
ggcgaaauccucgcgcaccgcc

SEQ ID NO: 3489205 - RNA, 18 nt, Pseudomonas aeruginosa PA01
ggcgaaaucgagcugcuc

SEQ ID NO: 3489206 - RNA, 17 nt, Pseudomonas aeruginosa PA01
ggcgaaaugcaggccgg

SEQ ID NO: 3489207 - RNA, 23 nt, Pseudomonas aeruginosa PA01
ggcgaaaugcaggccgguggucg

SEQ ID NO: 3489208 - RNA, 18 nt, Pseudomonas aeruginosa PA01
ggcgaaauugccuccgcu

SEQ ID NO: 3489209 - RNA, 17 nt, Pseudomonas aeruginosa PA01
ggcgaacaaccgcucgc

SEQ ID NO: 3489210 - RNA, 18 nt, Pseudomonas aeruginosa PA01
ggcgaacaaccgcucgcg

SEQ ID NO: 3489211 - RNA, 23 nt, Pseudomonas aeruginosa PA01
ggcgaacaaucggucgcccucgg

SEQ ID NO: 3489212 - RNA, 16 nt, Pseudomonas aeruginosa PA01
ggcgaacaccgggccg

SEQ ID NO: 3489213 - RNA, 18 nt, Pseudomonas aeruginosa PA01
ggcgaacaccgggccgcc

SEQ ID NO: 3489214 - RNA, 19 nt, Pseudomonas aeruginosa PA01
ggcgaacaccgggccgccg

SEQ ID NO: 3489215 - RNA, 21 nt, Pseudomonas aeruginosa PA01
ggcgaacaccgggccgccggc

SEQ ID NO: 3489216 - RNA, 20 nt, Pseudomonas aeruginosa PA01
ggcgaacacgucggcgcgca

SEQ ID NO: 3489217 - RNA, 17 nt, Pseudomonas aeruginosa PA01
ggcgaacagcacccagg

SEQ ID NO: 3489218 - RNA, 14 nt, Pseudomonas aeruginosa PA01
ggcgaacagcaccu

SEQ ID NO: 3489219 - RNA, 19 nt, Pseudomonas aeruginosa PA01
ggcgaacagcaccuuggcc

SEQ ID NO: 3489220 - RNA, 14 nt, Pseudomonas aeruginosa PA01
ggcgaacagcagcg

SEQ ID NO: 3489221 - RNA, 21 nt, Pseudomonas aeruginosa PA01
ggcgaacagcagcgguaggcg

SEQ ID NO: 3489222 - RNA, 14 nt, Pseudomonas aeruginosa PA01
ggcgaacagccagc

SEQ ID NO: 3489223 - RNA, 16 nt, Pseudomonas aeruginosa PA01
ggcgaacagccagcgg

SEQ ID NO: 3489224 - RNA, 17 nt, Pseudomonas aeruginosa PA01
ggcgaacagccagcggu

SEQ ID NO: 3489225 - RNA, 16 nt, Pseudomonas aeruginosa PA01
ggcgaacagcgagacc

SEQ ID NO: 3489226 - RNA, 17 nt, Pseudomonas aeruginosa PA01
ggcgaacagcgccgcgg

SEQ ID NO: 3489227 - RNA, 22 nt, Pseudomonas aeruginosa PA01
ggcgaacagcgccgcggcuggc

SEQ ID NO: 3489228 - RNA, 13 nt, Pseudomonas aeruginosa PA01
ggcgaacagcgcu

SEQ ID NO: 3489229 - RNA, 17 nt, Pseudomonas aeruginosa PA01
ggcgaacagcgcuuccu

SEQ ID NO: 3489230 - RNA, 13 nt, Pseudomonas aeruginosa PA01
ggcgaacaggcag

SEQ ID NO: 3489231 - RNA, 17 nt, Pseudomonas aeruginosa PA01
ggcgaacaggcagcggg

SEQ ID NO: 3489232 - RNA, 17 nt, Pseudomonas aeruginosa PA01
ggcgaacaugaagccgc

SEQ ID NO: 3489233 - RNA, 22 nt, Pseudomonas aeruginosa PA01
ggcgaacaugaagccgcgcgcc

SEQ ID NO: 3489234 - RNA, 23 nt, Pseudomonas aeruginosa PA01
ggcgaacaugaagccgcgcgccg

SEQ ID NO: 3489235 - RNA, 17 nt, Pseudomonas aeruginosa PA01
ggcgaaccaggcggccg

SEQ ID NO: 3489236 - RNA, 18 nt, Pseudomonas aeruginosa PA01
ggcgaaccaggcggccga

SEQ ID NO: 3489237 - RNA, 19 nt, Pseudomonas aeruginosa PA01
ggcgaaccaggcggccgaa

SEQ ID NO: 3489238 - RNA, 18 nt, Pseudomonas aeruginosa PA01
ggcgaaccaguccagcac

SEQ ID NO: 3489239 - RNA, 19 nt, Pseudomonas aeruginosa PA01
ggcgaaccagugcaccgcc

SEQ ID NO: 3489240 - RNA, 17 nt, Pseudomonas aeruginosa PA01
ggcgaacccggcgcggc

SEQ ID NO: 3489241 - RNA, 23 nt, Pseudomonas aeruginosa PA01
ggcgaaccgugguucucggucgg

SEQ ID NO: 3489242 - RNA, 16 nt, Pseudomonas aeruginosa PA01
ggcgaacgacagcacc

SEQ ID NO: 3489243 - RNA, 17 nt, Pseudomonas aeruginosa PA01
ggcgaacgacagcacca

SEQ ID NO: 3489244 - RNA, 23 nt, Pseudomonas aeruginosa PA01
ggcgaacgacagcaccaugcccu

SEQ ID NO: 3489245 - RNA, 21 nt, Pseudomonas aeruginosa PA01
ggcgaacgccgggucuucagu

SEQ ID NO: 3489246 - RNA, 16 nt, Pseudomonas aeruginosa PA01
ggcgaacggcuggucg

SEQ ID NO: 3489247 - RNA, 23 nt, Pseudomonas aeruginosa PA01
ggcgaacuccgccagcuuguccg

SEQ ID NO: 3489248 - RNA, 18 nt, Pseudomonas aeruginosa PA01
ggcgaacugccgacggcg

SEQ ID NO: 3489249 - RNA, 19 nt, Pseudomonas aeruginosa PA01
ggcgaacugccgacggcgg

SEQ ID NO: 3489250 - RNA, 20 nt, Pseudomonas aeruginosa PA01
ggcgaacugccgacggcggc

SEQ ID NO: 3489251 - RNA, 21 nt, Pseudomonas aeruginosa PA01
ggcgaacugccgacggcggcg

SEQ ID NO: 3489252 - RNA, 22 nt, Pseudomonas aeruginosa PA01
ggcgaacugccgacggcggcgg

SEQ ID NO: 3489253 - RNA, 19 nt, Pseudomonas aeruginosa PA01
ggcgaacuucaggccggcg

SEQ ID NO: 3489254 - RNA, 22 nt, Pseudomonas aeruginosa PA01
ggcgaacuucaggccggcgccg

SEQ ID NO: 3489255 - RNA, 22 nt, Pseudomonas aeruginosa PA01
ggcgaagaucucgccauggcgg

SEQ ID NO: 3489256 - RNA, 23 nt, Pseudomonas aeruginosa PA01
ggcgaagaucucgccauggcgga

SEQ ID NO: 3489257 - RNA, 20 nt, Pseudomonas aeruginosa PA01
ggcgaagccaaugcgugggu

SEQ ID NO: 3489258 - RNA, 14 nt, Pseudomonas aeruginosa PA01
ggcgaagcccagcg

SEQ ID NO: 3489259 - RNA, 17 nt, Pseudomonas aeruginosa PA01
ggcgaagcccagcgagc

SEQ ID NO: 3489260 - RNA, 20 nt, Pseudomonas aeruginosa PA01
ggcgaagccgauacccuggg

SEQ ID NO: 3489261 - RNA, 12 nt, Pseudomonas aeruginosa PA01
ggcgaagccgcg

SEQ ID NO: 3489262 - RNA, 14 nt, Pseudomonas aeruginosa PA01
ggcgaagccgcgcc

SEQ ID NO: 3489263 - RNA, 14 nt, Pseudomonas aeruginosa PA01
ggcgaagccggcgg

SEQ ID NO: 3489264 - RNA, 20 nt, Pseudomonas aeruginosa PA01
ggcgaagccggcggcgcggc

SEQ ID NO: 3489265 - RNA, 21 nt, Pseudomonas aeruginosa PA01
ggcgaagccggcggcgcggca

SEQ ID NO: 3489266 - RNA, 23 nt, Pseudomonas aeruginosa PA01
ggcgaagccguuguagaucggca

SEQ ID NO: 3489267 - RNA, 14 nt, Pseudomonas aeruginosa PA01
ggcgaagccugcgg

SEQ ID NO: 3489268 - RNA, 16 nt, Pseudomonas aeruginosa PA01
ggcgaagccugcggcg

SEQ ID NO: 3489269 - RNA, 13 nt, Pseudomonas aeruginosa PA01
ggcgaagcgcagg

SEQ ID NO: 3489270 - RNA, 15 nt, Pseudomonas aeruginosa PA01
ggcgaagcgcaggcu

SEQ ID NO: 3489271 - RNA, 21 nt, Pseudomonas aeruginosa PA01
ggcgaagcggaagcgcagcca

SEQ ID NO: 3489272 - RNA, 13 nt, Pseudomonas aeruginosa PA01
ggcgaagcggccc

SEQ ID NO: 3489273 - RNA, 14 nt, Pseudomonas aeruginosa PA01
ggcgaagcggcccu

SEQ ID NO: 3489274 - RNA, 14 nt, Pseudomonas aeruginosa PA01
ggcgaagcggcucg

SEQ ID NO: 3489275 - RNA, 16 nt, Pseudomonas aeruginosa PA01
ggcgaagcggcucggc

SEQ ID NO: 3489276 - RNA, 18 nt, Pseudomonas aeruginosa PA01
ggcgaagcggcucggcca

SEQ ID NO: 3489277 - RNA, 19 nt, Pseudomonas aeruginosa PA01
ggcgaagcggcucggccag

SEQ ID NO: 3489278 - RNA, 18 nt, Pseudomonas aeruginosa PA01
ggcgaagcggcuggccgc

SEQ ID NO: 3489279 - RNA, 15 nt, Pseudomonas aeruginosa PA01
ggcgaagcguugcag

SEQ ID NO: 3489280 - RNA, 15 nt, Pseudomonas aeruginosa PA01
ggcgaagcucggccg

SEQ ID NO: 3489281 - RNA, 12 nt, Pseudomonas aeruginosa PA01
ggcgaagcuggg

SEQ ID NO: 3489282 - RNA, 16 nt, Pseudomonas aeruginosa PA01
ggcgaagcuggggcug

SEQ ID NO: 3489283 - RNA, 17 nt, Pseudomonas aeruginosa PA01
ggcgaaggcaaugccgc

SEQ ID NO: 3489284 - RNA, 20 nt, Pseudomonas aeruginosa PA01
ggcgaaggcaaugccgcccu

SEQ ID NO: 3489285 - RNA, 14 nt, Pseudomonas aeruginosa PA01
ggcgaaggccacca

SEQ ID NO: 3489286 - RNA, 20 nt, Pseudomonas aeruginosa PA01
ggcgaaggccaccaucgcgg

SEQ ID NO: 3489287 - RNA, 21 nt, Pseudomonas aeruginosa PA01
ggcgaaggccaccaucgcggc

SEQ ID NO: 3489288 - RNA, 22 nt, Pseudomonas aeruginosa PA01
ggcgaaggccaccaucgcggcg

SEQ ID NO: 3489289 - RNA, 12 nt, Pseudomonas aeruginosa PA01
ggcgaaggccgc

SEQ ID NO: 3489290 - RNA, 16 nt, Pseudomonas aeruginosa PA01
ggcgaaggccucgucg

SEQ ID NO: 3489291 - RNA, 19 nt, Pseudomonas aeruginosa PA01
ggcgaaggccucgucgauc

SEQ ID NO: 3489292 - RNA, 14 nt, Pseudomonas aeruginosa PA01
ggcgaaggcgaacc

SEQ ID NO: 3489293 - RNA, 22 nt, Pseudomonas aeruginosa PA01
ggcgaaggcgaaccacaccagg

SEQ ID NO: 3489294 - RNA, 15 nt, Pseudomonas aeruginosa PA01
ggcgaaggcgauccc

SEQ ID NO: 3489295 - RNA, 14 nt, Pseudomonas aeruginosa PA01
ggcgaagggcaggc

SEQ ID NO: 3489296 - RNA, 12 nt, Pseudomonas aeruginosa PA01
ggcgaaggucug

SEQ ID NO: 3489297 - RNA, 22 nt, Pseudomonas aeruginosa PA01
ggcgaaggucugccccggcuug

SEQ ID NO: 3489298 - RNA, 16 nt, Pseudomonas aeruginosa PA01
ggcgaagguggcgacc

SEQ ID NO: 3489299 - RNA, 18 nt, Pseudomonas aeruginosa PA01
ggcgaagguggcgaccug

SEQ ID NO: 3489300 - RNA, 19 nt, Pseudomonas aeruginosa PA01
ggcgaagguggcgaccugg

SEQ ID NO: 3489301 - RNA, 18 nt, Pseudomonas aeruginosa PA01
ggcgaaguccaccaggcg

SEQ ID NO: 3489302 - RNA, 20 nt, Pseudomonas aeruginosa PA01
ggcgaaguccaccaggcgcc

SEQ ID NO: 3489303 - RNA, 22 nt, Pseudomonas aeruginosa PA01
ggcgaaguccaccaggcgccgg

SEQ ID NO: 3489304 - RNA, 22 nt, Pseudomonas aeruginosa PA01
ggcgaaguccggguugagcacc

SEQ ID NO: 3489305 - RNA, 13 nt, Pseudomonas aeruginosa PA01
ggcgaagucgccg

SEQ ID NO: 3489306 - RNA, 14 nt, Pseudomonas aeruginosa PA01
ggcgaagucgccgu

SEQ ID NO: 3489307 - RNA, 16 nt, Pseudomonas aeruginosa PA01
ggcgaagucgccgucg

SEQ ID NO: 3489308 - RNA, 14 nt, Pseudomonas aeruginosa PA01
ggcgaagucggcgc

SEQ ID NO: 3489309 - RNA, 15 nt, Pseudomonas aeruginosa PA01
ggcgaagucggcgcg

SEQ ID NO: 3489310 - RNA, 16 nt, Pseudomonas aeruginosa PA01
ggcgaagucggcgcgc

SEQ ID NO: 3489311 - RNA, 15 nt, Pseudomonas aeruginosa PA01
ggcgaagucugccug

SEQ ID NO: 3489312 - RNA, 20 nt, Pseudomonas aeruginosa PA01
ggcgaagucugccuguccgc

SEQ ID NO: 3489313 - RNA, 16 nt, Pseudomonas aeruginosa PA01
ggcgaaguucccgccg

SEQ ID NO: 3489314 - RNA, 17 nt, Pseudomonas aeruginosa PA01
ggcgaaguucccgccgc

SEQ ID NO: 3489315 - RNA, 21 nt, Pseudomonas aeruginosa PA01
ggcgaauaaccgcaucgcggu

SEQ ID NO: 3489316 - RNA, 17 nt, Pseudomonas aeruginosa PA01
ggcgaauaaccgcucgc

SEQ ID NO: 3489317 - RNA, 18 nt, Pseudomonas aeruginosa PA01
ggcgaauaaccgcucgcg

SEQ ID NO: 3489318 - RNA, 19 nt, Pseudomonas aeruginosa PA01
ggcgaauaaccgcucgcgg

SEQ ID NO: 3489319 - RNA, 16 nt, Pseudomonas aeruginosa PA01
ggcgaauaacgccaca

SEQ ID NO: 3489320 - RNA, 17 nt, Pseudomonas aeruginosa PA01
ggcgaauaacgccaccg

SEQ ID NO: 3489321 - RNA, 14 nt, Pseudomonas aeruginosa PA01
ggcgaauaacgccg

SEQ ID NO: 3489322 - RNA, 15 nt, Pseudomonas aeruginosa PA01
ggcgaauaacgccgc

SEQ ID NO: 3489323 - RNA, 19 nt, Pseudomonas aeruginosa PA01
ggcgaauaccagugccgcg

SEQ ID NO: 3489324 - RNA, 20 nt, Pseudomonas aeruginosa PA01
ggcgaauaccagugccgcgg

SEQ ID NO: 3489325 - RNA, 17 nt, Pseudomonas aeruginosa PA01
ggcgaauagccggcgcu

SEQ ID NO: 3489326 - RNA, 18 nt, Pseudomonas aeruginosa PA01
ggcgaauagccggcgcug

SEQ ID NO: 3489327 - RNA, 15 nt, Pseudomonas aeruginosa PA01
ggcgaauagcgccgc

SEQ ID NO: 3489328 - RNA, 16 nt, Pseudomonas aeruginosa PA01
ggcgaauagcgccgca

SEQ ID NO: 3489329 - RNA, 17 nt, Pseudomonas aeruginosa PA01
ggcgaauagcgccgcag

SEQ ID NO: 3489330 - RNA, 16 nt, Pseudomonas aeruginosa PA01
ggcgaauagcgccgcg

SEQ ID NO: 3489331 - RNA, 17 nt, Pseudomonas aeruginosa PA01
ggcgaauagcgccgcgg

SEQ ID NO: 3489332 - RNA, 18 nt, Pseudomonas aeruginosa PA01
ggcgaauauccucgucga

SEQ ID NO: 3489333 - RNA, 23 nt, Pseudomonas aeruginosa PA01
ggcgaauauccucgucgauccgc

SEQ ID NO: 3489334 - RNA, 14 nt, Pseudomonas aeruginosa PA01
ggcgaaucgucgau

SEQ ID NO: 3489335 - RNA, 14 nt, Pseudomonas aeruginosa PA01
ggcgaaugccuucg

SEQ ID NO: 3489336 - RNA, 21 nt, Pseudomonas aeruginosa PA01
ggcgaauggagggaucgcgcg

SEQ ID NO: 3489337 - RNA, 22 nt, Pseudomonas aeruginosa PA01
ggcgaauggagggaucgcgcgg

SEQ ID NO: 3489338 - RNA, 22 nt, Pseudomonas aeruginosa PA01
ggcgaauucgucgccgccgagg

SEQ ID NO: 3489339 - RNA, 17 nt, Pseudomonas aeruginosa PA01
ggcgaauuuccugcugg

SEQ ID NO: 3489340 - RNA, 15 nt, Pseudomonas aeruginosa PA01
ggcgacaaaucggca

SEQ ID NO: 3489341 - RNA, 12 nt, Pseudomonas aeruginosa PA01
ggcgacaccgcc

SEQ ID NO: 3489342 - RNA, 14 nt, Pseudomonas aeruginosa PA01
ggcgacaccgccag

SEQ ID NO: 3489343 - RNA, 15 nt, Pseudomonas aeruginosa PA01
ggcgacaccgccagc

SEQ ID NO: 3489344 - RNA, 17 nt, Pseudomonas aeruginosa PA01
ggcgacaccgccagcac

SEQ ID NO: 3489345 - RNA, 19 nt, Pseudomonas aeruginosa PA01
ggcgacagcaccacgccgc

SEQ ID NO: 3489346 - RNA, 21 nt, Pseudomonas aeruginosa PA01
ggcgacagcaccacgccgcug

SEQ ID NO: 3489347 - RNA, 16 nt, Pseudomonas aeruginosa PA01
ggcgacauagccggcg

SEQ ID NO: 3489348 - RNA, 21 nt, Pseudomonas aeruginosa PA01
ggcgacauagccggcgaacca

SEQ ID NO: 3489349 - RNA, 22 nt, Pseudomonas aeruginosa PA01
ggcgacauagccggcgaaccag

SEQ ID NO: 3489350 - RNA, 16 nt, Pseudomonas aeruginosa PA01
ggcgacauagcggcug

SEQ ID NO: 3489351 - RNA, 18 nt, Pseudomonas aeruginosa PA01
ggcgacauagcggcugcu

SEQ ID NO: 3489352 - RNA, 14 nt, Pseudomonas aeruginosa PA01
ggcgaccacccggc

SEQ ID NO: 3489353 - RNA, 16 nt, Pseudomonas aeruginosa PA01
ggcgaccacccggcgg

SEQ ID NO: 3489354 - RNA, 17 nt, Pseudomonas aeruginosa PA01
ggcgaccacccggcggu

SEQ ID NO: 3489355 - RNA, 14 nt, Pseudomonas aeruginosa PA01
ggcgaccaccgccg

SEQ ID NO: 3489356 - RNA, 15 nt, Pseudomonas aeruginosa PA01
ggcgaccaccgccgg

SEQ ID NO: 3489357 - RNA, 24 nt, Pseudomonas aeruginosa PA01
ggcgaccaccgccgggaccacgcu

SEQ ID NO: 3489358 - RNA, 21 nt, Pseudomonas aeruginosa PA01
ggcgaccaccgcgaauccgcg

SEQ ID NO: 3489359 - RNA, 22 nt, Pseudomonas aeruginosa PA01
ggcgaccaccgcgaauccgcgg

SEQ ID NO: 3489360 - RNA, 23 nt, Pseudomonas aeruginosa PA01
ggcgaccaccgcgaauccgcggc

SEQ ID NO: 3489361 - RNA, 13 nt, Pseudomonas aeruginosa PA01
ggcgaccagcauc

SEQ ID NO: 3489362 - RNA, 14 nt, Pseudomonas aeruginosa PA01
ggcgaccagcccgc

SEQ ID NO: 3489363 - RNA, 12 nt, Pseudomonas aeruginosa PA01
ggcgaccagcgc

SEQ ID NO: 3489364 - RNA, 13 nt, Pseudomonas aeruginosa PA01
ggcgaccagcgcg

SEQ ID NO: 3489365 - RNA, 16 nt, Pseudomonas aeruginosa PA01
ggcgaccagcgcgguc

SEQ ID NO: 3489366 - RNA, 12 nt, Pseudomonas aeruginosa PA01
ggcgaccagcgu

SEQ ID NO: 3489367 - RNA, 14 nt, Pseudomonas aeruginosa PA01
ggcgaccagcgucg

SEQ ID NO: 3489368 - RNA, 20 nt, Pseudomonas aeruginosa PA01
ggcgaccagcgucgcgcgug

SEQ ID NO: 3489369 - RNA, 18 nt, Pseudomonas aeruginosa PA01
ggcgaccaggacagcacg

SEQ ID NO: 3489370 - RNA, 16 nt, Pseudomonas aeruginosa PA01
ggcgaccauccagccu

SEQ ID NO: 3489371 - RNA, 20 nt, Pseudomonas aeruginosa PA01
ggcgaccauguucaccagcg

SEQ ID NO: 3489372 - RNA, 21 nt, Pseudomonas aeruginosa PA01
ggcgacccagaccugccgccc

SEQ ID NO: 3489373 - RNA, 11 nt, Pseudomonas aeruginosa PA01
ggcgacccagg

SEQ ID NO: 3489374 - RNA, 14 nt, Pseudomonas aeruginosa PA01
ggcgacccaggccg

SEQ ID NO: 3489375 - RNA, 17 nt, Pseudomonas aeruginosa PA01
ggcgacccaggccgaca

SEQ ID NO: 3489376 - RNA, 21 nt, Pseudomonas aeruginosa PA01
ggcgacccgccguucgcccgc

SEQ ID NO: 3489377 - RNA, 19 nt, Pseudomonas aeruginosa PA01
ggcgacccgggucaggccg

SEQ ID NO: 3489378 - RNA, 20 nt, Pseudomonas aeruginosa PA01
ggcgacccuggggucgccgu

SEQ ID NO: 3489379 - RNA, 15 nt, Pseudomonas aeruginosa PA01
ggcgaccgaacagcg

SEQ ID NO: 3489380 - RNA, 19 nt, Pseudomonas aeruginosa PA01
ggcgaccgaacagcgcgcc

SEQ ID NO: 3489381 - RNA, 20 nt, Pseudomonas aeruginosa PA01
ggcgaccgaacagcgcgcca

SEQ ID NO: 3489382 - RNA, 13 nt, Pseudomonas aeruginosa PA01
ggcgaccgccagg

SEQ ID NO: 3489383 - RNA, 15 nt, Pseudomonas aeruginosa PA01
ggcgaccgccaggcg

SEQ ID NO: 3489384 - RNA, 16 nt, Pseudomonas aeruginosa PA01
ggcgaccgcgcgcaug

SEQ ID NO: 3489385 - RNA, 23 nt, Pseudomonas aeruginosa PA01
ggcgaccgcgcgcauggucgcgc

SEQ ID NO: 3489386 - RNA, 14 nt, Pseudomonas aeruginosa PA01
ggcgaccgcuggac

SEQ ID NO: 3489387 - RNA, 21 nt, Pseudomonas aeruginosa PA01
ggcgaccgguuccgcgucgcc

SEQ ID NO: 3489388 - RNA, 22 nt, Pseudomonas aeruginosa PA01
ggcgaccgguuccgcgucgccu

SEQ ID NO: 3489389 - RNA, 23 nt, Pseudomonas aeruginosa PA01
ggcgaccgguuccgcgucgccuu

SEQ ID NO: 3489390 - RNA, 20 nt, Pseudomonas aeruginosa PA01
ggcgaccucagucgugcagg

SEQ ID NO: 3489391 - RNA, 14 nt, Pseudomonas aeruginosa PA01
ggcgaccugcggca

SEQ ID NO: 3489392 - RNA, 22 nt, Pseudomonas aeruginosa PA01
ggcgaccugcggugucccuucu

SEQ ID NO: 3489393 - RNA, 12 nt, Pseudomonas aeruginosa PA01
ggcgaccugcuc

SEQ ID NO: 3489394 - RNA, 13 nt, Pseudomonas aeruginosa PA01
ggcgaccugcucg

SEQ ID NO: 3489395 - RNA, 14 nt, Pseudomonas aeruginosa PA01
ggcgaccugcucga

SEQ ID NO: 3489396 - RNA, 17 nt, Pseudomonas aeruginosa PA01
ggcgaccugcucgcgca

SEQ ID NO: 3489397 - RNA, 18 nt, Pseudomonas aeruginosa PA01
ggcgaccugcucgcgcac

SEQ ID NO: 3489398 - RNA, 19 nt, Pseudomonas aeruginosa PA01
ggcgaccugcucgcgcacc

SEQ ID NO: 3489399 - RNA, 22 nt, Pseudomonas aeruginosa PA01
ggcgaccugcucgcgcaccgcg

SEQ ID NO: 3489400 - RNA, 20 nt, Pseudomonas aeruginosa PA01
ggcgaccugguggcgccggc

SEQ ID NO: 3489401 - RNA, 21 nt, Pseudomonas aeruginosa PA01
ggcgaccugguggcgccggcu

SEQ ID NO: 3489402 - RNA, 14 nt, Pseudomonas aeruginosa PA01
ggcgaccuugcgca

SEQ ID NO: 3489403 - RNA, 23 nt, Pseudomonas aeruginosa PA01
ggcgaccuuguccugcggccggg

SEQ ID NO: 3489404 - RNA, 14 nt, Pseudomonas aeruginosa PA01
ggcgaccuugucga

SEQ ID NO: 3489405 - RNA, 16 nt, Pseudomonas aeruginosa PA01
ggcgacgaaacggcuc

SEQ ID NO: 3489406 - RNA, 17 nt, Pseudomonas aeruginosa PA01
ggcgacgaaacggcucu

SEQ ID NO: 3489407 - RNA, 17 nt, Pseudomonas aeruginosa PA01
ggcgacgaagacgcugc

SEQ ID NO: 3489408 - RNA, 16 nt, Pseudomonas aeruginosa PA01
ggcgacgaagcccagg

SEQ ID NO: 3489409 - RNA, 17 nt, Pseudomonas aeruginosa PA01
ggcgacgaagcccaggc

SEQ ID NO: 3489410 - RNA, 12 nt, Pseudomonas aeruginosa PA01
ggcgacgaaggc

SEQ ID NO: 3489411 - RNA, 14 nt, Pseudomonas aeruginosa PA01
ggcgacgaaggccu

SEQ ID NO: 3489412 - RNA, 20 nt, Pseudomonas aeruginosa PA01
ggcgacgaaggccuggucga

SEQ ID NO: 3489413 - RNA, 20 nt, Pseudomonas aeruginosa PA01
ggcgacgaaggucggcggca

SEQ ID NO: 3489414 - RNA, 22 nt, Pseudomonas aeruginosa PA01
ggcgacgaaggucggcggcagc

SEQ ID NO: 3489415 - RNA, 12 nt, Pseudomonas aeruginosa PA01
ggcgacgacggg

SEQ ID NO: 3489416 - RNA, 13 nt, Pseudomonas aeruginosa PA01
ggcgacgagguag

SEQ ID NO: 3489417 - RNA, 19 nt, Pseudomonas aeruginosa PA01
ggcgacgaucacccccagc

SEQ ID NO: 3489418 - RNA, 19 nt, Pseudomonas aeruginosa PA01
ggcgacgaucagcccgccg

SEQ ID NO: 3489419 - RNA, 22 nt, Pseudomonas aeruginosa PA01
ggcgacgaucagcccgccggcg

SEQ ID NO: 3489420 - RNA, 23 nt, Pseudomonas aeruginosa PA01
ggcgacgaucagcccgccggcga

SEQ ID NO: 3489421 - RNA, 14 nt, Pseudomonas aeruginosa PA01
ggcgacgaugccgc

SEQ ID NO: 3489422 - RNA, 16 nt, Pseudomonas aeruginosa PA01
ggcgacgaugccgccg

SEQ ID NO: 3489423 - RNA, 19 nt, Pseudomonas aeruginosa PA01
ggcgacgaugcgccccagc

SEQ ID NO: 3489424 - RNA, 14 nt, Pseudomonas aeruginosa PA01
ggcgacgcaggacg

SEQ ID NO: 3489425 - RNA, 17 nt, Pseudomonas aeruginosa PA01
ggcgacgcaggacgucg

SEQ ID NO: 3489426 - RNA, 15 nt, Pseudomonas aeruginosa PA01
ggcgacgccacccgc

SEQ ID NO: 3489427 - RNA, 16 nt, Pseudomonas aeruginosa PA01
ggcgacgccacccgca

SEQ ID NO: 3489428 - RNA, 14 nt, Pseudomonas aeruginosa PA01
ggcgacgcccaugu

SEQ ID NO: 3489429 - RNA, 12 nt, Pseudomonas aeruginosa PA01
ggcgacgcccug

SEQ ID NO: 3489430 - RNA, 17 nt, Pseudomonas aeruginosa PA01
ggcgacgcccuguucgg

SEQ ID NO: 3489431 - RNA, 21 nt, Pseudomonas aeruginosa PA01
ggcgacgcccuguucggcggg

SEQ ID NO: 3489432 - RNA, 22 nt, Pseudomonas aeruginosa PA01
ggcgacgcccuguucggcggga

SEQ ID NO: 3489433 - RNA, 14 nt, Pseudomonas aeruginosa PA01
ggcgacgccgcgcu

SEQ ID NO: 3489434 - RNA, 15 nt, Pseudomonas aeruginosa PA01
ggcgacgccgcgcug

SEQ ID NO: 3489435 - RNA, 22 nt, Pseudomonas aeruginosa PA01
ggcgacgccgcgcugcaagggc

SEQ ID NO: 3489436 - RNA, 13 nt, Pseudomonas aeruginosa PA01
ggcgacgccgguc

SEQ ID NO: 3489437 - RNA, 16 nt, Pseudomonas aeruginosa PA01
ggcgacgcgcaggccg

SEQ ID NO: 3489438 - RNA, 13 nt, Pseudomonas aeruginosa PA01
ggcgacgcggaca

SEQ ID NO: 3489439 - RNA, 23 nt, Pseudomonas aeruginosa PA01
ggcgacgcggacagccugggcgg

SEQ ID NO: 3489440 - RNA, 15 nt, Pseudomonas aeruginosa PA01
ggcgacgcucuucag

SEQ ID NO: 3489441 - RNA, 23 nt, Pseudomonas aeruginosa PA01
ggcgacgcucuucagcgguccgc

SEQ ID NO: 3489442 - RNA, 23 nt, Pseudomonas aeruginosa PA01
ggcgacgcugaugaugccgcggc

SEQ ID NO: 3489443 - RNA, 14 nt, Pseudomonas aeruginosa PA01
ggcgacgcugaugc

SEQ ID NO: 3489444 - RNA, 22 nt, Pseudomonas aeruginosa PA01
ggcgacggaaacgacaggcugg

SEQ ID NO: 3489445 - RNA, 19 nt, Pseudomonas aeruginosa PA01
ggcgacggucaggccgagc

SEQ ID NO: 3489446 - RNA, 20 nt, Pseudomonas aeruginosa PA01
ggcgacggucaggccgagca

SEQ ID NO: 3489447 - RNA, 13 nt, Pseudomonas aeruginosa PA01
ggcgacguccugc

SEQ ID NO: 3489448 - RNA, 14 nt, Pseudomonas aeruginosa PA01
ggcgacgucgcccc

SEQ ID NO: 3489449 - RNA, 21 nt, Pseudomonas aeruginosa PA01
ggcgacgucgccccagccuug

SEQ ID NO: 3489450 - RNA, 18 nt, Pseudomonas aeruginosa PA01
ggcgacgugggccugcuc

SEQ ID NO: 3489451 - RNA, 19 nt, Pseudomonas aeruginosa PA01
ggcgacgugggccugcucc

SEQ ID NO: 3489452 - RNA, 23 nt, Pseudomonas aeruginosa PA01
ggcgacgugggccugcuccucgg

SEQ ID NO: 3489453 - RNA, 17 nt, Pseudomonas aeruginosa PA01
ggcgacguucugcucgc

SEQ ID NO: 3489454 - RNA, 16 nt, Pseudomonas aeruginosa PA01
ggcgacguugcgcagg

SEQ ID NO: 3489455 - RNA, 20 nt, Pseudomonas aeruginosa PA01
ggcgacguugcgcaggggcg

SEQ ID NO: 3489456 - RNA, 17 nt, Pseudomonas aeruginosa PA01
ggcgacguuuuucccgu

SEQ ID NO: 3489457 - RNA, 23 nt, Pseudomonas aeruginosa PA01
ggcgacuaccagguucugccaga

SEQ ID NO: 3489458 - RNA, 20 nt, Pseudomonas aeruginosa PA01
ggcgacuuccuugcgcgggc

SEQ ID NO: 3489459 - RNA, 20 nt, Pseudomonas aeruginosa PA01
ggcgacuucgcauuccaccu

SEQ ID NO: 3489460 - RNA, 21 nt, Pseudomonas aeruginosa PA01
ggcgagaaagucgaucagcgc

SEQ ID NO: 3489461 - RNA, 22 nt, Pseudomonas aeruginosa PA01
ggcgagaaagucgaucagcgcg

SEQ ID NO: 3489462 - RNA, 19 nt, Pseudomonas aeruginosa PA01
ggcgagaaucgccgaggcg

SEQ ID NO: 3489463 - RNA, 22 nt, Pseudomonas aeruginosa PA01
ggcgagaaucgccgaggcgucg

SEQ ID NO: 3489464 - RNA, 19 nt, Pseudomonas aeruginosa PA01
ggcgagaccggggaucagc

SEQ ID NO: 3489465 - RNA, 19 nt, Pseudomonas aeruginosa PA01
ggcgagagcgccgaccagc

SEQ ID NO: 3489466 - RNA, 23 nt, Pseudomonas aeruginosa PA01
ggcgagagcguccggcagggccu

SEQ ID NO: 3489467 - RNA, 12 nt, Pseudomonas aeruginosa PA01
ggcgagaggucg

SEQ ID NO: 3489468 - RNA, 15 nt, Pseudomonas aeruginosa PA01
ggcgagaggucggcg

SEQ ID NO: 3489469 - RNA, 19 nt, Pseudomonas aeruginosa PA01
ggcgagaggucggcgcgcc

SEQ ID NO: 3489470 - RNA, 21 nt, Pseudomonas aeruginosa PA01
ggcgagaggucggcgcgcccg

SEQ ID NO: 3489471 - RNA, 22 nt, Pseudomonas aeruginosa PA01
ggcgagaggucggcgcgcccgg

SEQ ID NO: 3489472 - RNA, 18 nt, Pseudomonas aeruginosa PA01
ggcgagaucuucaggccg

SEQ ID NO: 3489473 - RNA, 19 nt, Pseudomonas aeruginosa PA01
ggcgagaucuucaggccga

SEQ ID NO: 3489474 - RNA, 22 nt, Pseudomonas aeruginosa PA01
ggcgagcaaugaaaaaggcgau

SEQ ID NO: 3489475 - RNA, 17 nt, Pseudomonas aeruginosa PA01
ggcgagcacggcgaaca

SEQ ID NO: 3489476 - RNA, 18 nt, Pseudomonas aeruginosa PA01
ggcgagcacggcgaacac

SEQ ID NO: 3489477 - RNA, 13 nt, Pseudomonas aeruginosa PA01
ggcgagcagcggc

SEQ ID NO: 3489478 - RNA, 14 nt, Pseudomonas aeruginosa PA01
ggcgagcagcggca

SEQ ID NO: 3489479 - RNA, 15 nt, Pseudomonas aeruginosa PA01
ggcgagcagcggcac

SEQ ID NO: 3489480 - RNA, 17 nt, Pseudomonas aeruginosa PA01
ggcgagcagcggcacgc

SEQ ID NO: 3489481 - RNA, 22 nt, Pseudomonas aeruginosa PA01
ggcgagcagcggcacgcucugg

SEQ ID NO: 3489482 - RNA, 14 nt, Pseudomonas aeruginosa PA01
ggcgagcagcggcg

SEQ ID NO: 3489483 - RNA, 13 nt, Pseudomonas aeruginosa PA01
ggcgagcaggcgg

SEQ ID NO: 3489484 - RNA, 15 nt, Pseudomonas aeruginosa PA01
ggcgagcagggcgcu

SEQ ID NO: 3489485 - RNA, 20 nt, Pseudomonas aeruginosa PA01
ggcgagcagggcgcugagcg

SEQ ID NO: 3489486 - RNA, 22 nt, Pseudomonas aeruginosa PA01
ggcgagcagggcgcugagcgcg

SEQ ID NO: 3489487 - RNA, 14 nt, Pseudomonas aeruginosa PA01
ggcgagcaggguca

SEQ ID NO: 3489488 - RNA, 19 nt, Pseudomonas aeruginosa PA01
ggcgagcagguagaccgcc

SEQ ID NO: 3489489 - RNA, 17 nt, Pseudomonas aeruginosa PA01
ggcgagcaucucggcca

SEQ ID NO: 3489490 - RNA, 23 nt, Pseudomonas aeruginosa PA01
ggcgagcaucucggccaggcccu

SEQ ID NO: 3489491 - RNA, 19 nt, Pseudomonas aeruginosa PA01
ggcgagcauuccucagcgc

SEQ ID NO: 3489492 - RNA, 21 nt, Pseudomonas aeruginosa PA01
ggcgagcauuccucagcgccg

SEQ ID NO: 3489493 - RNA, 22 nt, Pseudomonas aeruginosa PA01
ggcgagcauuccucagcgccgg

SEQ ID NO: 3489494 - RNA, 12 nt, Pseudomonas aeruginosa PA01
ggcgagccgccg

SEQ ID NO: 3489495 - RNA, 16 nt, Pseudomonas aeruginosa PA01
ggcgagccgccgggcg

SEQ ID NO: 3489496 - RNA, 19 nt, Pseudomonas aeruginosa PA01
ggcgagccgccgggcggcg

SEQ ID NO: 3489497 - RNA, 17 nt, Pseudomonas aeruginosa PA01
ggcgagccgcgacggcu

SEQ ID NO: 3489498 - RNA, 19 nt, Pseudomonas aeruginosa PA01
ggcgagccgcgacggcugc

SEQ ID NO: 3489499 - RNA, 23 nt, Pseudomonas aeruginosa PA01
ggcgagccggcgcaucagcgccg

SEQ ID NO: 3489500 - RNA, 24 nt, Pseudomonas aeruginosa PA01
ggcgagccggcgcaucagcgccgg

SEQ ID NO: 3489501 - RNA, 19 nt, Pseudomonas aeruginosa PA01
ggcgagcgccgcggcgaac

SEQ ID NO: 3489502 - RNA, 15 nt, Pseudomonas aeruginosa PA01
ggcgagcgcgaucuc

SEQ ID NO: 3489503 - RNA, 16 nt, Pseudomonas aeruginosa PA01
ggcgagcgcgaucucu

SEQ ID NO: 3489504 - RNA, 12 nt, Pseudomonas aeruginosa PA01
ggcgagcgucga

SEQ ID NO: 3489505 - RNA, 14 nt, Pseudomonas aeruginosa PA01
ggcgagcgucgagu

SEQ ID NO: 3489506 - RNA, 20 nt, Pseudomonas aeruginosa PA01
ggcgagcgucgagucgcgca

SEQ ID NO: 3489507 - RNA, 14 nt, Pseudomonas aeruginosa PA01
ggcgagcugcacgu

SEQ ID NO: 3489508 - RNA, 21 nt, Pseudomonas aeruginosa PA01
ggcgagcugccccucguggcg

SEQ ID NO: 3489509 - RNA, 16 nt, Pseudomonas aeruginosa PA01
ggcgagcuggaucggc

SEQ ID NO: 3489510 - RNA, 22 nt, Pseudomonas aeruginosa PA01
ggcgagcuggaucggcaggcug

SEQ ID NO: 3489511 - RNA, 19 nt, Pseudomonas aeruginosa PA01
ggcgaggaaaaggaucgcc

SEQ ID NO: 3489512 - RNA, 14 nt, Pseudomonas aeruginosa PA01
ggcgaggaacagca

SEQ ID NO: 3489513 - RNA, 14 nt, Pseudomonas aeruginosa PA01
ggcgaggacgccgg

SEQ ID NO: 3489514 - RNA, 19 nt, Pseudomonas aeruginosa PA01
ggcgaggacgccgggcugg

SEQ ID NO: 3489515 - RNA, 15 nt, Pseudomonas aeruginosa PA01
ggcgaggaucacgca

SEQ ID NO: 3489516 - RNA, 14 nt, Pseudomonas aeruginosa PA01
ggcgaggaucgcca

SEQ ID NO: 3489517 - RNA, 15 nt, Pseudomonas aeruginosa PA01
ggcgaggaucgccag

SEQ ID NO: 3489518 - RNA, 14 nt, Pseudomonas aeruginosa PA01
ggcgaggaucgcgc

SEQ ID NO: 3489519 - RNA, 20 nt, Pseudomonas aeruginosa PA01
ggcgaggaucgcgcuggcca

SEQ ID NO: 3489520 - RNA, 21 nt, Pseudomonas aeruginosa PA01
ggcgaggaucgcucccaggcu

SEQ ID NO: 3489521 - RNA, 18 nt, Pseudomonas aeruginosa PA01
ggcgaggauggccguccu

SEQ ID NO: 3489522 - RNA, 19 nt, Pseudomonas aeruginosa PA01
ggcgaggauuuccggcuug

SEQ ID NO: 3489523 - RNA, 12 nt, Pseudomonas aeruginosa PA01
ggcgaggccggc

SEQ ID NO: 3489524 - RNA, 13 nt, Pseudomonas aeruginosa PA01
ggcgaggccggcg

SEQ ID NO: 3489525 - RNA, 12 nt, Pseudomonas aeruginosa PA01
ggcgaggcgcgc

SEQ ID NO: 3489526 - RNA, 15 nt, Pseudomonas aeruginosa PA01
ggcgaggcgcucgac

SEQ ID NO: 3489527 - RNA, 14 nt, Pseudomonas aeruginosa PA01
ggcgaggcguucca

SEQ ID NO: 3489528 - RNA, 14 nt, Pseudomonas aeruginosa PA01
ggcgagggcgccgg

SEQ ID NO: 3489529 - RNA, 13 nt, Pseudomonas aeruginosa PA01
ggcgagggcgcgc

SEQ ID NO: 3489530 - RNA, 14 nt, Pseudomonas aeruginosa PA01
ggcgagggcgcgca

SEQ ID NO: 3489531 - RNA, 15 nt, Pseudomonas aeruginosa PA01
ggcgagggcgcgcac

SEQ ID NO: 3489532 - RNA, 13 nt, Pseudomonas aeruginosa PA01
ggcgagggcggcg

SEQ ID NO: 3489533 - RNA, 15 nt, Pseudomonas aeruginosa PA01
ggcgagggcggcgac

SEQ ID NO: 3489534 - RNA, 18 nt, Pseudomonas aeruginosa PA01
ggcgagggcggcgaccug

SEQ ID NO: 3489535 - RNA, 14 nt, Pseudomonas aeruginosa PA01
ggcgagggcggcgc

SEQ ID NO: 3489536 - RNA, 16 nt, Pseudomonas aeruginosa PA01
ggcgagggcggcgcgg

SEQ ID NO: 3489537 - RNA, 22 nt, Pseudomonas aeruginosa PA01
ggcgagggugaacuggccgucg

SEQ ID NO: 3489538 - RNA, 12 nt, Pseudomonas aeruginosa PA01
ggcgaggguggc

SEQ ID NO: 3489539 - RNA, 14 nt, Pseudomonas aeruginosa PA01
ggcgaggucgcgga

SEQ ID NO: 3489540 - RNA, 21 nt, Pseudomonas aeruginosa PA01
ggcgaggucgcggacgaggau

SEQ ID NO: 3489541 - RNA, 15 nt, Pseudomonas aeruginosa PA01
ggcgaggucggccug

SEQ ID NO: 3489542 - RNA, 23 nt, Pseudomonas aeruginosa PA01
ggcgaggucggccugcggguucg

SEQ ID NO: 3489543 - RNA, 20 nt, Pseudomonas aeruginosa PA01
ggcgagguguucccggauca

SEQ ID NO: 3489544 - RNA, 22 nt, Pseudomonas aeruginosa PA01
ggcgagguguucccggaucagc

SEQ ID NO: 3489545 - RNA, 14 nt, Pseudomonas aeruginosa PA01
ggcgaguaagcgcg

SEQ ID NO: 3489546 - RNA, 23 nt, Pseudomonas aeruginosa PA01
ggcgaguaccaccgugcccgccg

SEQ ID NO: 3489547 - RNA, 21 nt, Pseudomonas aeruginosa PA01
ggcgagucgaucaggucgccg

SEQ ID NO: 3489548 - RNA, 23 nt, Pseudomonas aeruginosa PA01
ggcgagucgaucaggucgccgcc

SEQ ID NO: 3489549 - RNA, 15 nt, Pseudomonas aeruginosa PA01
ggcgagucguuacga

SEQ ID NO: 3489550 - RNA, 20 nt, Pseudomonas aeruginosa PA01
ggcgagucuugaggaagucg

SEQ ID NO: 3489551 - RNA, 17 nt, Pseudomonas aeruginosa PA01
ggcgaguucggcgagca

SEQ ID NO: 3489552 - RNA, 16 nt, Pseudomonas aeruginosa PA01
ggcgaguugcgcgagg

SEQ ID NO: 3489553 - RNA, 14 nt, Pseudomonas aeruginosa PA01
ggcgauacaccgca

SEQ ID NO: 3489554 - RNA, 17 nt, Pseudomonas aeruginosa PA01
ggcgauacccaggccgu

SEQ ID NO: 3489555 - RNA, 19 nt, Pseudomonas aeruginosa PA01
ggcgauacccaggccgucg

SEQ ID NO: 3489556 - RNA, 16 nt, Pseudomonas aeruginosa PA01
ggcgauaucccgccgc

SEQ ID NO: 3489557 - RNA, 17 nt, Pseudomonas aeruginosa PA01
ggcgauaucccgccgcc

SEQ ID NO: 3489558 - RNA, 19 nt, Pseudomonas aeruginosa PA01
ggcgauaucccgccgccgc

SEQ ID NO: 3489559 - RNA, 22 nt, Pseudomonas aeruginosa PA01
ggcgauaucccgccgccgcgcc

SEQ ID NO: 3489560 - RNA, 19 nt, Pseudomonas aeruginosa PA01
ggcgaucaccagggugcgc

SEQ ID NO: 3489561 - RNA, 22 nt, Pseudomonas aeruginosa PA01
ggcgaucaccagggugcgcucg

SEQ ID NO: 3489562 - RNA, 12 nt, Pseudomonas aeruginosa PA01
ggcgaucacccg

SEQ ID NO: 3489563 - RNA, 17 nt, Pseudomonas aeruginosa PA01
ggcgaucacgccgcgca

SEQ ID NO: 3489564 - RNA, 23 nt, Pseudomonas aeruginosa PA01
ggcgaucacgccgcgcaccagca

SEQ ID NO: 3489565 - RNA, 13 nt, Pseudomonas aeruginosa PA01
ggcgaucagcggg

SEQ ID NO: 3489566 - RNA, 16 nt, Pseudomonas aeruginosa PA01
ggcgaucagcgggcgg

SEQ ID NO: 3489567 - RNA, 20 nt, Pseudomonas aeruginosa PA01
ggcgaucagcgggcgguaga

SEQ ID NO: 3489568 - RNA, 23 nt, Pseudomonas aeruginosa PA01
ggcgaucagcgggcgguagaucu

SEQ ID NO: 3489569 - RNA, 15 nt, Pseudomonas aeruginosa PA01
ggcgaucagcucgcg

SEQ ID NO: 3489570 - RNA, 21 nt, Pseudomonas aeruginosa PA01
ggcgaucagcucgcgguaggc

SEQ ID NO: 3489571 - RNA, 17 nt, Pseudomonas aeruginosa PA01
ggcgaucaggcagcgcg

SEQ ID NO: 3489572 - RNA, 13 nt, Pseudomonas aeruginosa PA01
ggcgaucaggcca

SEQ ID NO: 3489573 - RNA, 14 nt, Pseudomonas aeruginosa PA01
ggcgaucaggccaa

SEQ ID NO: 3489574 - RNA, 16 nt, Pseudomonas aeruginosa PA01
ggcgaucaggccgaug

SEQ ID NO: 3489575 - RNA, 17 nt, Pseudomonas aeruginosa PA01
ggcgaucaggccgaugc

SEQ ID NO: 3489576 - RNA, 18 nt, Pseudomonas aeruginosa PA01
ggcgaucauccagccccc

SEQ ID NO: 3489577 - RNA, 20 nt, Pseudomonas aeruginosa PA01
ggcgaucaucgccaccggua

SEQ ID NO: 3489578 - RNA, 14 nt, Pseudomonas aeruginosa PA01
ggcgaucaugccuu

SEQ ID NO: 3489579 - RNA, 16 nt, Pseudomonas aeruginosa PA01
ggcgaucaugccuucg

SEQ ID NO: 3489580 - RNA, 22 nt, Pseudomonas aeruginosa PA01
ggcgaucaugccuucgaucuca

SEQ ID NO: 3489581 - RNA, 14 nt, Pseudomonas aeruginosa PA01
ggcgauccacagca

SEQ ID NO: 3489582 - RNA, 16 nt, Pseudomonas aeruginosa PA01
ggcgauccacagcagg

SEQ ID NO: 3489583 - RNA, 20 nt, Pseudomonas aeruginosa PA01
ggcgauccagaagaucagcg

SEQ ID NO: 3489584 - RNA, 21 nt, Pseudomonas aeruginosa PA01
ggcgauccagaagaucagcgc

SEQ ID NO: 3489585 - RNA, 13 nt, Pseudomonas aeruginosa PA01
ggcgauccagcgg

SEQ ID NO: 3489586 - RNA, 20 nt, Pseudomonas aeruginosa PA01
ggcgaucccguagaccggcu

SEQ ID NO: 3489587 - RNA, 22 nt, Pseudomonas aeruginosa PA01
ggcgauccgcgcauaggaggcg

SEQ ID NO: 3489588 - RNA, 13 nt, Pseudomonas aeruginosa PA01
ggcgauccgcgcu

SEQ ID NO: 3489589 - RNA, 24 nt, Pseudomonas aeruginosa PA01
ggcgauccgcgcuuccgcaucggc

SEQ ID NO: 3489590 - RNA, 13 nt, Pseudomonas aeruginosa PA01
ggcgauccgcugc

SEQ ID NO: 3489591 - RNA, 14 nt, Pseudomonas aeruginosa PA01
ggcgauccgcugca

SEQ ID NO: 3489592 - RNA, 17 nt, Pseudomonas aeruginosa PA01
ggcgaucgaaggaucgc

SEQ ID NO: 3489593 - RNA, 15 nt, Pseudomonas aeruginosa PA01
ggcgaucgaccugcc

SEQ ID NO: 3489594 - RNA, 21 nt, Pseudomonas aeruginosa PA01
ggcgaucgccaggcgauccag

SEQ ID NO: 3489595 - RNA, 15 nt, Pseudomonas aeruginosa PA01
ggcgaucgccaggug

SEQ ID NO: 3489596 - RNA, 22 nt, Pseudomonas aeruginosa PA01
ggcgaucgccagguggaagcgc

SEQ ID NO: 3489597 - RNA, 12 nt, Pseudomonas aeruginosa PA01
ggcgaucgccug

SEQ ID NO: 3489598 - RNA, 19 nt, Pseudomonas aeruginosa PA01
ggcgaucgucgagaugcug

SEQ ID NO: 3489599 - RNA, 22 nt, Pseudomonas aeruginosa PA01
ggcgaucgucgagaugcugcgg

SEQ ID NO: 3489600 - RNA, 20 nt, Pseudomonas aeruginosa PA01
ggcgaucuccgccaggcggc

SEQ ID NO: 3489601 - RNA, 18 nt, Pseudomonas aeruginosa PA01
ggcgaucuccucgauccg

SEQ ID NO: 3489602 - RNA, 13 nt, Pseudomonas aeruginosa PA01
ggcgaucucgcgg

SEQ ID NO: 3489603 - RNA, 19 nt, Pseudomonas aeruginosa PA01
ggcgaucucggcgcgggca

SEQ ID NO: 3489604 - RNA, 16 nt, Pseudomonas aeruginosa PA01
ggcgaucugugcgagc

SEQ ID NO: 3489605 - RNA, 22 nt, Pseudomonas aeruginosa PA01
ggcgaucuucagguaggcgcgg

SEQ ID NO: 3489606 - RNA, 19 nt, Pseudomonas aeruginosa PA01
ggcgaucuucaucucuucg

SEQ ID NO: 3489607 - RNA, 18 nt, Pseudomonas aeruginosa PA01
ggcgaucuucuccgccgc

SEQ ID NO: 3489608 - RNA, 16 nt, Pseudomonas aeruginosa PA01
ggcgaucuugaucgcc

SEQ ID NO: 3489609 - RNA, 21 nt, Pseudomonas aeruginosa PA01
ggcgaucuugaucgccagcgg

SEQ ID NO: 3489610 - RNA, 17 nt, Pseudomonas aeruginosa PA01
ggcgaugaagcugaugc

SEQ ID NO: 3489611 - RNA, 19 nt, Pseudomonas aeruginosa PA01
ggcgaugaccagcucggcg

SEQ ID NO: 3489612 - RNA, 20 nt, Pseudomonas aeruginosa PA01
ggcgaugaccagcucggcgg

SEQ ID NO: 3489613 - RNA, 21 nt, Pseudomonas aeruginosa PA01
ggcgaugaccagcucggcggg

SEQ ID NO: 3489614 - RNA, 24 nt, Pseudomonas aeruginosa PA01
ggcgaugaggcuguccagcaggcg

SEQ ID NO: 3489615 - RNA, 20 nt, Pseudomonas aeruginosa PA01
ggcgaugauggucaacacca

SEQ ID NO: 3489616 - RNA, 13 nt, Pseudomonas aeruginosa PA01
ggcgaugcccagg

SEQ ID NO: 3489617 - RNA, 19 nt, Pseudomonas aeruginosa PA01
ggcgaugcccaggccgccg

SEQ ID NO: 3489618 - RNA, 20 nt, Pseudomonas aeruginosa PA01
ggcgaugcccaggccgccga

SEQ ID NO: 3489619 - RNA, 22 nt, Pseudomonas aeruginosa PA01
ggcgaugcccaggccgccgauc

SEQ ID NO: 3489620 - RNA, 22 nt, Pseudomonas aeruginosa PA01
ggcgaugcccuggccgcugccg

SEQ ID NO: 3489621 - RNA, 13 nt, Pseudomonas aeruginosa PA01
ggcgaugccgacg

SEQ ID NO: 3489622 - RNA, 12 nt, Pseudomonas aeruginosa PA01
ggcgaugccgag

SEQ ID NO: 3489623 - RNA, 14 nt, Pseudomonas aeruginosa PA01
ggcgaugccgaugg

SEQ ID NO: 3489624 - RNA, 20 nt, Pseudomonas aeruginosa PA01
ggcgaugccgauggcgccgc

SEQ ID NO: 3489625 - RNA, 12 nt, Pseudomonas aeruginosa PA01
ggcgaugccgcc

SEQ ID NO: 3489626 - RNA, 16 nt, Pseudomonas aeruginosa PA01
ggcgaugccgcccagc

SEQ ID NO: 3489627 - RNA, 17 nt, Pseudomonas aeruginosa PA01
ggcgaugccgcccagca

SEQ ID NO: 3489628 - RNA, 20 nt, Pseudomonas aeruginosa PA01
ggcgaugccgcccagcaccg

SEQ ID NO: 3489629 - RNA, 17 nt, Pseudomonas aeruginosa PA01
ggcgaugccgccgggca

SEQ ID NO: 3489630 - RNA, 16 nt, Pseudomonas aeruginosa PA01
ggcgaugccgcgccag

SEQ ID NO: 3489631 - RNA, 20 nt, Pseudomonas aeruginosa PA01
ggcgaugccgcgccaggcgc

SEQ ID NO: 3489632 - RNA, 21 nt, Pseudomonas aeruginosa PA01
ggcgaugccgcgccaggcgca

SEQ ID NO: 3489633 - RNA, 14 nt, Pseudomonas aeruginosa PA01
ggcgaugccggaga

SEQ ID NO: 3489634 - RNA, 20 nt, Pseudomonas aeruginosa PA01
ggcgaugccggagagcagca

SEQ ID NO: 3489635 - RNA, 13 nt, Pseudomonas aeruginosa PA01
ggcgaugcgccgg

SEQ ID NO: 3489636 - RNA, 20 nt, Pseudomonas aeruginosa PA01
ggcgaugcgccggaucggcu

SEQ ID NO: 3489637 - RNA, 23 nt, Pseudomonas aeruginosa PA01
ggcgaugcgccggaucggcugac

SEQ ID NO: 3489638 - RNA, 13 nt, Pseudomonas aeruginosa PA01
ggcgaugcgcugg

SEQ ID NO: 3489639 - RNA, 20 nt, Pseudomonas aeruginosa PA01
ggcgaugcguuugucgaccu

SEQ ID NO: 3489640 - RNA, 19 nt, Pseudomonas aeruginosa PA01
ggcgaugcucagcgccggc

SEQ ID NO: 3489641 - RNA, 17 nt, Pseudomonas aeruginosa PA01
ggcgauggaugacccgc

SEQ ID NO: 3489642 - RNA, 14 nt, Pseudomonas aeruginosa PA01
ggcgauggccagcg

SEQ ID NO: 3489643 - RNA, 16 nt, Pseudomonas aeruginosa PA01
ggcgauggccagcgcg

SEQ ID NO: 3489644 - RNA, 17 nt, Pseudomonas aeruginosa PA01
ggcgauggccagcgcgu

SEQ ID NO: 3489645 - RNA, 14 nt, Pseudomonas aeruginosa PA01
ggcgauggccauca

SEQ ID NO: 3489646 - RNA, 20 nt, Pseudomonas aeruginosa PA01
ggcgauggccaucagggucg

SEQ ID NO: 3489647 - RNA, 13 nt, Pseudomonas aeruginosa PA01
ggcgauggcccag

SEQ ID NO: 3489648 - RNA, 21 nt, Pseudomonas aeruginosa PA01
ggcgauggcccguuccaccgc

SEQ ID NO: 3489649 - RNA, 12 nt, Pseudomonas aeruginosa PA01
ggcgauggccgc

SEQ ID NO: 3489650 - RNA, 18 nt, Pseudomonas aeruginosa PA01
ggcgauggccgccagcag

SEQ ID NO: 3489651 - RNA, 19 nt, Pseudomonas aeruginosa PA01
ggcgauggccgccagcagg

SEQ ID NO: 3489652 - RNA, 15 nt, Pseudomonas aeruginosa PA01
ggcgauggccgccug

SEQ ID NO: 3489653 - RNA, 19 nt, Pseudomonas aeruginosa PA01
ggcgauggccuggucggcg

SEQ ID NO: 3489654 - RNA, 23 nt, Pseudomonas aeruginosa PA01
ggcgauggccuggucggcgcggc

SEQ ID NO: 3489655 - RNA, 13 nt, Pseudomonas aeruginosa PA01
ggcgauggcgcgc

SEQ ID NO: 3489656 - RNA, 15 nt, Pseudomonas aeruginosa PA01
ggcgauggcgcgcgg

SEQ ID NO: 3489657 - RNA, 16 nt, Pseudomonas aeruginosa PA01
ggcgauggcggugacc

SEQ ID NO: 3489658 - RNA, 12 nt, Pseudomonas aeruginosa PA01
ggcgauggcgua

SEQ ID NO: 3489659 - RNA, 22 nt, Pseudomonas aeruginosa PA01
ggcgauggcguagaggcucggc

SEQ ID NO: 3489660 - RNA, 13 nt, Pseudomonas aeruginosa PA01
ggcgauggucagg

SEQ ID NO: 3489661 - RNA, 18 nt, Pseudomonas aeruginosa PA01
ggcgauggugcgcucgcg

SEQ ID NO: 3489662 - RNA, 19 nt, Pseudomonas aeruginosa PA01
ggcgauggugcgcucgcgg

SEQ ID NO: 3489663 - RNA, 20 nt, Pseudomonas aeruginosa PA01
ggcgauguaggucaccgcgc

SEQ ID NO: 3489664 - RNA, 20 nt, Pseudomonas aeruginosa PA01
ggcgauguccuggaucggca

SEQ ID NO: 3489665 - RNA, 22 nt, Pseudomonas aeruginosa PA01
ggcgauguccuggaucggcagc

SEQ ID NO: 3489666 - RNA, 23 nt, Pseudomonas aeruginosa PA01
ggcgauguccuggaucggcagcu

SEQ ID NO: 3489667 - RNA, 16 nt, Pseudomonas aeruginosa PA01
ggcgaugucgcgggca

SEQ ID NO: 3489668 - RNA, 15 nt, Pseudomonas aeruginosa PA01
ggcgaugucggccug

SEQ ID NO: 3489669 - RNA, 21 nt, Pseudomonas aeruginosa PA01
ggcgauguugaacagcgccgg

SEQ ID NO: 3489670 - RNA, 21 nt, Pseudomonas aeruginosa PA01
ggcgauguugacgauggcgcc

SEQ ID NO: 3489671 - RNA, 17 nt, Pseudomonas aeruginosa PA01
ggcgauguugcgcaggg

SEQ ID NO: 3489672 - RNA, 20 nt, Pseudomonas aeruginosa PA01
ggcgauguugcgcagggugc

SEQ ID NO: 3489673 - RNA, 21 nt, Pseudomonas aeruginosa PA01
ggcgauguugcgcagggugcc

SEQ ID NO: 3489674 - RNA, 14 nt, Pseudomonas aeruginosa PA01
ggcgauucgcggcg

SEQ ID NO: 3489675 - RNA, 17 nt, Pseudomonas aeruginosa PA01
ggcgauucgcggcgaca

SEQ ID NO: 3489676 - RNA, 20 nt, Pseudomonas aeruginosa PA01
ggcgauucguucgagcagcu

SEQ ID NO: 3489677 - RNA, 23 nt, Pseudomonas aeruginosa PA01
ggcgcaaaauguauaggagccug

SEQ ID NO: 3489678 - RNA, 18 nt, Pseudomonas aeruginosa PA01
ggcgcaacaccuugcgca

SEQ ID NO: 3489679 - RNA, 19 nt, Pseudomonas aeruginosa PA01
ggcgcaacaccuugcgcac

SEQ ID NO: 3489680 - RNA, 21 nt, Pseudomonas aeruginosa PA01
ggcgcaacaggcgcaugccau

SEQ ID NO: 3489681 - RNA, 14 nt, Pseudomonas aeruginosa PA01
ggcgcaaccagacc

SEQ ID NO: 3489682 - RNA, 16 nt, Pseudomonas aeruginosa PA01
ggcgcaaccagaccag

SEQ ID NO: 3489683 - RNA, 18 nt, Pseudomonas aeruginosa PA01
ggcgcaaccagaccagca

SEQ ID NO: 3489684 - RNA, 19 nt, Pseudomonas aeruginosa PA01
ggcgcaaccagaccagcag

SEQ ID NO: 3489685 - RNA, 21 nt, Pseudomonas aeruginosa PA01
ggcgcaacccugcccaguggg

SEQ ID NO: 3489686 - RNA, 22 nt, Pseudomonas aeruginosa PA01
ggcgcaacccugcccagugggc

SEQ ID NO: 3489687 - RNA, 14 nt, Pseudomonas aeruginosa PA01
ggcgcaacgccggc

SEQ ID NO: 3489688 - RNA, 15 nt, Pseudomonas aeruginosa PA01
ggcgcaacugcgcca

SEQ ID NO: 3489689 - RNA, 23 nt, Pseudomonas aeruginosa PA01
ggcgcaagcgguugaguagaaaa

SEQ ID NO: 3489690 - RNA, 13 nt, Pseudomonas aeruginosa PA01
ggcgcaaggccag

SEQ ID NO: 3489691 - RNA, 15 nt, Pseudomonas aeruginosa PA01
ggcgcaaggccagcg

SEQ ID NO: 3489692 - RNA, 18 nt, Pseudomonas aeruginosa PA01
ggcgcaaggccagcggca

SEQ ID NO: 3489693 - RNA, 16 nt, Pseudomonas aeruginosa PA01
ggcgcaagggcgccgc

SEQ ID NO: 3489694 - RNA, 17 nt, Pseudomonas aeruginosa PA01
ggcgcaaggugccgagg

SEQ ID NO: 3489695 - RNA, 21 nt, Pseudomonas aeruginosa PA01
ggcgcaauacaccgcugcgcc

SEQ ID NO: 3489696 - RNA, 17 nt, Pseudomonas aeruginosa PA01
ggcgcaaucagggcugg

SEQ ID NO: 3489697 - RNA, 15 nt, Pseudomonas aeruginosa PA01
ggcgcacaucacccg

SEQ ID NO: 3489698 - RNA, 12 nt, Pseudomonas aeruginosa PA01
ggcgcaccagca

SEQ ID NO: 3489699 - RNA, 16 nt, Pseudomonas aeruginosa PA01
ggcgcaccagcaggcg

SEQ ID NO: 3489700 - RNA, 12 nt, Pseudomonas aeruginosa PA01
ggcgcaccaggc

SEQ ID NO: 3489701 - RNA, 14 nt, Pseudomonas aeruginosa PA01
ggcgcaccaggcca

SEQ ID NO: 3489702 - RNA, 15 nt, Pseudomonas aeruginosa PA01
ggcgcaccaggccag

SEQ ID NO: 3489703 - RNA, 18 nt, Pseudomonas aeruginosa PA01
ggcgcaccaggccaggcu

SEQ ID NO: 3489704 - RNA, 21 nt, Pseudomonas aeruginosa PA01
ggcgcaccaggccaggcugcg

SEQ ID NO: 3489705 - RNA, 22 nt, Pseudomonas aeruginosa PA01
ggcgcaccaggccaggcugcgc

SEQ ID NO: 3489706 - RNA, 14 nt, Pseudomonas aeruginosa PA01
ggcgcaccgacgcc

SEQ ID NO: 3489707 - RNA, 15 nt, Pseudomonas aeruginosa PA01
ggcgcaccgacgccg

SEQ ID NO: 3489708 - RNA, 19 nt, Pseudomonas aeruginosa PA01
ggcgcacgccgcggaaggc

SEQ ID NO: 3489709 - RNA, 23 nt, Pseudomonas aeruginosa PA01
ggcgcacgccgcggaaggcccgc

SEQ ID NO: 3489710 - RNA, 14 nt, Pseudomonas aeruginosa PA01
ggcgcacgccggcc

SEQ ID NO: 3489711 - RNA, 14 nt, Pseudomonas aeruginosa PA01
ggcgcacgcgcagu

SEQ ID NO: 3489712 - RNA, 13 nt, Pseudomonas aeruginosa PA01
ggcgcacggccug

SEQ ID NO: 3489713 - RNA, 17 nt, Pseudomonas aeruginosa PA01
ggcgcacggccugcacc

SEQ ID NO: 3489714 - RNA, 17 nt, Pseudomonas aeruginosa PA01
ggcgcacuacgccguuc

SEQ ID NO: 3489715 - RNA, 17 nt, Pseudomonas aeruginosa PA01
ggcgcacugagggucag

SEQ ID NO: 3489716 - RNA, 14 nt, Pseudomonas aeruginosa PA01
ggcgcacugccagg

SEQ ID NO: 3489717 - RNA, 15 nt, Pseudomonas aeruginosa PA01
ggcgcagaacugccg

SEQ ID NO: 3489718 - RNA, 22 nt, Pseudomonas aeruginosa PA01
ggcgcagaacugccgggccagc

SEQ ID NO: 3489719 - RNA, 17 nt, Pseudomonas aeruginosa PA01
ggcgcagacaggccucc

SEQ ID NO: 3489720 - RNA, 21 nt, Pseudomonas aeruginosa PA01
ggcgcagacaggccuccagca

SEQ ID NO: 3489721 - RNA, 22 nt, Pseudomonas aeruginosa PA01
ggcgcagacgucuuccgggacc

SEQ ID NO: 3489722 - RNA, 16 nt, Pseudomonas aeruginosa PA01
ggcgcagaucgcggcg

SEQ ID NO: 3489723 - RNA, 18 nt, Pseudomonas aeruginosa PA01
ggcgcagaucgcggcgca

SEQ ID NO: 3489724 - RNA, 20 nt, Pseudomonas aeruginosa PA01
ggcgcagaucgcggcgcagg

SEQ ID NO: 3489725 - RNA, 21 nt, Pseudomonas aeruginosa PA01
ggcgcagaucgcggcgcaggc

SEQ ID NO: 3489726 - RNA, 18 nt, Pseudomonas aeruginosa PA01
ggcgcagcaacuguccga

SEQ ID NO: 3489727 - RNA, 12 nt, Pseudomonas aeruginosa PA01
ggcgcagcagcg

SEQ ID NO: 3489728 - RNA, 15 nt, Pseudomonas aeruginosa PA01
ggcgcagcagcgacu

SEQ ID NO: 3489729 - RNA, 18 nt, Pseudomonas aeruginosa PA01
ggcgcagcagcgccaguu

SEQ ID NO: 3489730 - RNA, 15 nt, Pseudomonas aeruginosa PA01
ggcgcagcaggaucu

SEQ ID NO: 3489731 - RNA, 15 nt, Pseudomonas aeruginosa PA01
ggcgcagcagggcgu

SEQ ID NO: 3489732 - RNA, 15 nt, Pseudomonas aeruginosa PA01
ggcgcagcaucaucu

SEQ ID NO: 3489733 - RNA, 12 nt, Pseudomonas aeruginosa PA01
ggcgcagccaga

SEQ ID NO: 3489734 - RNA, 15 nt, Pseudomonas aeruginosa PA01
ggcgcagccagagcu

SEQ ID NO: 3489735 - RNA, 12 nt, Pseudomonas aeruginosa PA01
ggcgcagccagg

SEQ ID NO: 3489736 - RNA, 14 nt, Pseudomonas aeruginosa PA01
ggcgcagccaggcg

SEQ ID NO: 3489737 - RNA, 18 nt, Pseudomonas aeruginosa PA01
ggcgcagccaggcgaugg

SEQ ID NO: 3489738 - RNA, 17 nt, Pseudomonas aeruginosa PA01
ggcgcagcccagccgcu

SEQ ID NO: 3489739 - RNA, 21 nt, Pseudomonas aeruginosa PA01
ggcgcagcccagccgcucgcg

SEQ ID NO: 3489740 - RNA, 21 nt, Pseudomonas aeruginosa PA01
ggcgcagcccuugcaaccgcc

SEQ ID NO: 3489741 - RNA, 19 nt, Pseudomonas aeruginosa PA01
ggcgcagccgcaaggccag

SEQ ID NO: 3489742 - RNA, 15 nt, Pseudomonas aeruginosa PA01
ggcgcagccgcugcu

SEQ ID NO: 3489743 - RNA, 16 nt, Pseudomonas aeruginosa PA01
ggcgcagccgcugggc

SEQ ID NO: 3489744 - RNA, 21 nt, Pseudomonas aeruginosa PA01
ggcgcagccucgcgcucggcg

SEQ ID NO: 3489745 - RNA, 12 nt, Pseudomonas aeruginosa PA01
ggcgcagcgccc

SEQ ID NO: 3489746 - RNA, 14 nt, Pseudomonas aeruginosa PA01
ggcgcagcgcccga

SEQ ID NO: 3489747 - RNA, 22 nt, Pseudomonas aeruginosa PA01
ggcgcagcgcccgauaggcgcc

SEQ ID NO: 3489748 - RNA, 12 nt, Pseudomonas aeruginosa PA01
ggcgcagcggca

SEQ ID NO: 3489749 - RNA, 14 nt, Pseudomonas aeruginosa PA01
ggcgcagcggcagc

SEQ ID NO: 3489750 - RNA, 15 nt, Pseudomonas aeruginosa PA01
ggcgcagcggcagcg

SEQ ID NO: 3489751 - RNA, 18 nt, Pseudomonas aeruginosa PA01
ggcgcagcggcagcgcca

SEQ ID NO: 3489752 - RNA, 19 nt, Pseudomonas aeruginosa PA01
ggcgcagcggcagcgccag

SEQ ID NO: 3489753 - RNA, 16 nt, Pseudomonas aeruginosa PA01
ggcgcagcggcgaacc

SEQ ID NO: 3489754 - RNA, 15 nt, Pseudomonas aeruginosa PA01
ggcgcagcguccugc

SEQ ID NO: 3489755 - RNA, 18 nt, Pseudomonas aeruginosa PA01
ggcgcagcguccugcccu

SEQ ID NO: 3489756 - RNA, 15 nt, Pseudomonas aeruginosa PA01
ggcgcaggaccgcca

SEQ ID NO: 3489757 - RNA, 18 nt, Pseudomonas aeruginosa PA01
ggcgcaggaccgccaugg

SEQ ID NO: 3489758 - RNA, 13 nt, Pseudomonas aeruginosa PA01
ggcgcaggccgag

SEQ ID NO: 3489759 - RNA, 14 nt, Pseudomonas aeruginosa PA01
ggcgcaggccgagg

SEQ ID NO: 3489760 - RNA, 19 nt, Pseudomonas aeruginosa PA01
ggcgcaggccgggcggacg

SEQ ID NO: 3489761 - RNA, 20 nt, Pseudomonas aeruginosa PA01
ggcgcaggccgggcggacgc

SEQ ID NO: 3489762 - RNA, 14 nt, Pseudomonas aeruginosa PA01
ggcgcaggcgaacu

SEQ ID NO: 3489763 - RNA, 16 nt, Pseudomonas aeruginosa PA01
ggcgcaggcgaacugc

SEQ ID NO: 3489764 - RNA, 12 nt, Pseudomonas aeruginosa PA01
ggcgcaggcgag

SEQ ID NO: 3489765 - RNA, 22 nt, Pseudomonas aeruginosa PA01
ggcgcaggcgaggauggccguc

SEQ ID NO: 3489766 - RNA, 21 nt, Pseudomonas aeruginosa PA01
ggcgcaggcggaucgcccggc

SEQ ID NO: 3489767 - RNA, 13 nt, Pseudomonas aeruginosa PA01
ggcgcaggcggcg

SEQ ID NO: 3489768 - RNA, 15 nt, Pseudomonas aeruginosa PA01
ggcgcaggcugucgg

SEQ ID NO: 3489769 - RNA, 17 nt, Pseudomonas aeruginosa PA01
ggcgcaggcugucggcc

SEQ ID NO: 3489770 - RNA, 19 nt, Pseudomonas aeruginosa PA01
ggcgcaggcugucggccag

SEQ ID NO: 3489771 - RNA, 21 nt, Pseudomonas aeruginosa PA01
ggcgcaggcugucggccagcc

SEQ ID NO: 3489772 - RNA, 12 nt, Pseudomonas aeruginosa PA01
ggcgcagggaga

SEQ ID NO: 3489773 - RNA, 13 nt, Pseudomonas aeruginosa PA01
ggcgcaggggcgc

SEQ ID NO: 3489774 - RNA, 14 nt, Pseudomonas aeruginosa PA01
ggcgcaggggcgcg

SEQ ID NO: 3489775 - RNA, 17 nt, Pseudomonas aeruginosa PA01
ggcgcaggggcgcgccg

SEQ ID NO: 3489776 - RNA, 12 nt, Pseudomonas aeruginosa PA01
ggcgcagguagu

SEQ ID NO: 3489777 - RNA, 18 nt, Pseudomonas aeruginosa PA01
ggcgcagguagucgcuca

SEQ ID NO: 3489778 - RNA, 17 nt, Pseudomonas aeruginosa PA01
ggcgcaggucgcuggcg

SEQ ID NO: 3489779 - RNA, 18 nt, Pseudomonas aeruginosa PA01
ggcgcaggucgcuggcgu

SEQ ID NO: 3489780 - RNA, 23 nt, Pseudomonas aeruginosa PA01
ggcgcaggucggccucggcgagg

SEQ ID NO: 3489781 - RNA, 18 nt, Pseudomonas aeruginosa PA01
ggcgcagguugagggccg

SEQ ID NO: 3489782 - RNA, 22 nt, Pseudomonas aeruginosa PA01
ggcgcagguugagggccgcgcu

SEQ ID NO: 3489783 - RNA, 18 nt, Pseudomonas aeruginosa PA01
ggcgcaguagucgaccgg

SEQ ID NO: 3489784 - RNA, 18 nt, Pseudomonas aeruginosa PA01
ggcgcauaaccgcucgcg

SEQ ID NO: 3489785 - RNA, 16 nt, Pseudomonas aeruginosa PA01
ggcgcauagccaccgc

SEQ ID NO: 3489786 - RNA, 17 nt, Pseudomonas aeruginosa PA01
ggcgcauagccaccgcc

SEQ ID NO: 3489787 - RNA, 20 nt, Pseudomonas aeruginosa PA01
ggcgcauagccaccgccgac

SEQ ID NO: 3489788 - RNA, 14 nt, Pseudomonas aeruginosa PA01
ggcgcauagcggcc

SEQ ID NO: 3489789 - RNA, 18 nt, Pseudomonas aeruginosa PA01
ggcgcauagcggccauug

SEQ ID NO: 3489790 - RNA, 14 nt, Pseudomonas aeruginosa PA01
ggcgcaucagcgcc

SEQ ID NO: 3489791 - RNA, 15 nt, Pseudomonas aeruginosa PA01
ggcgcauccgcccga

SEQ ID NO: 3489792 - RNA, 17 nt, Pseudomonas aeruginosa PA01
ggcgcauccgcccgauc

SEQ ID NO: 3489793 - RNA, 19 nt, Pseudomonas aeruginosa PA01
ggcgcauccgcccgaucgc

SEQ ID NO: 3489794 - RNA, 14 nt, Pseudomonas aeruginosa PA01
ggcgcaucggcgga

SEQ ID NO: 3489795 - RNA, 23 nt, Pseudomonas aeruginosa PA01
ggcgcaucgucgaaacgcuggcg

SEQ ID NO: 3489796 - RNA, 16 nt, Pseudomonas aeruginosa PA01
ggcgcaugaggccugg

SEQ ID NO: 3489797 - RNA, 17 nt, Pseudomonas aeruginosa PA01
ggcgcaugaggccuggu

SEQ ID NO: 3489798 - RNA, 18 nt, Pseudomonas aeruginosa PA01
ggcgcaugcccagggcca

SEQ ID NO: 3489799 - RNA, 20 nt, Pseudomonas aeruginosa PA01
ggcgcaugcccagggccagc

SEQ ID NO: 3489800 - RNA, 21 nt, Pseudomonas aeruginosa PA01
ggcgcaugcccagggccagca

SEQ ID NO: 3489801 - RNA, 14 nt, Pseudomonas aeruginosa PA01
ggcgcaugcgccgg

SEQ ID NO: 3489802 - RNA, 15 nt, Pseudomonas aeruginosa PA01
ggcgcaugcgccggc

SEQ ID NO: 3489803 - RNA, 16 nt, Pseudomonas aeruginosa PA01
ggcgcaugcgccggcu

SEQ ID NO: 3489804 - RNA, 14 nt, Pseudomonas aeruginosa PA01
ggcgcauggcgcuc

SEQ ID NO: 3489805 - RNA, 15 nt, Pseudomonas aeruginosa PA01
ggcgcauguccagcc

SEQ ID NO: 3489806 - RNA, 17 nt, Pseudomonas aeruginosa PA01
ggcgcauguccagccag

SEQ ID NO: 3489807 - RNA, 14 nt, Pseudomonas aeruginosa PA01
ggcgccaaccaugg

SEQ ID NO: 3489808 - RNA, 16 nt, Pseudomonas aeruginosa PA01
ggcgccaaccgggcag

SEQ ID NO: 3489809 - RNA, 17 nt, Pseudomonas aeruginosa PA01
ggcgccaaccgggcagc

SEQ ID NO: 3489810 - RNA, 22 nt, Pseudomonas aeruginosa PA01
ggcgccaaccgggcagcagccg

SEQ ID NO: 3489811 - RNA, 18 nt, Pseudomonas aeruginosa PA01
ggcgccaacucggccugg

SEQ ID NO: 3489812 - RNA, 22 nt, Pseudomonas aeruginosa PA01
ggcgccaauccgggcguagggc

SEQ ID NO: 3489813 - RNA, 13 nt, Pseudomonas aeruginosa PA01
ggcgccaccccgc

SEQ ID NO: 3489814 - RNA, 19 nt, Pseudomonas aeruginosa PA01
ggcgccaccccgccgcgca

SEQ ID NO: 3489815 - RNA, 20 nt, Pseudomonas aeruginosa PA01
ggcgccaccgauagcggcgc

SEQ ID NO: 3489816 - RNA, 19 nt, Pseudomonas aeruginosa PA01
ggcgccaccgauucgccgg

SEQ ID NO: 3489817 - RNA, 20 nt, Pseudomonas aeruginosa PA01
ggcgccaccgauucgccggc

SEQ ID NO: 3489818 - RNA, 15 nt, Pseudomonas aeruginosa PA01
ggcgccaccgcguug

SEQ ID NO: 3489819 - RNA, 21 nt, Pseudomonas aeruginosa PA01
ggcgccaccgcguugaccgug

SEQ ID NO: 3489820 - RNA, 14 nt, Pseudomonas aeruginosa PA01
ggcgccacgcucac

SEQ ID NO: 3489821 - RNA, 14 nt, Pseudomonas aeruginosa PA01
ggcgccacucggcg

SEQ ID NO: 3489822 - RNA, 21 nt, Pseudomonas aeruginosa PA01
ggcgccacucggcgugccggg

SEQ ID NO: 3489823 - RNA, 13 nt, Pseudomonas aeruginosa PA01
ggcgccagagcgc

SEQ ID NO: 3489824 - RNA, 12 nt, Pseudomonas aeruginosa PA01
ggcgccagccag

SEQ ID NO: 3489825 - RNA, 17 nt, Pseudomonas aeruginosa PA01
ggcgccagccagcccgg

SEQ ID NO: 3489826 - RNA, 22 nt, Pseudomonas aeruginosa PA01
ggcgccagccagcccggcggug

SEQ ID NO: 3489827 - RNA, 13 nt, Pseudomonas aeruginosa PA01
ggcgccagccgcc

SEQ ID NO: 3489828 - RNA, 15 nt, Pseudomonas aeruginosa PA01
ggcgccagccgccau

SEQ ID NO: 3489829 - RNA, 16 nt, Pseudomonas aeruginosa PA01
ggcgccagccgccauc

SEQ ID NO: 3489830 - RNA, 21 nt, Pseudomonas aeruginosa PA01
ggcgccagccgccaucaccag

SEQ ID NO: 3489831 - RNA, 22 nt, Pseudomonas aeruginosa PA01
ggcgccagccuacugggcgugg

SEQ ID NO: 3489832 - RNA, 14 nt, Pseudomonas aeruginosa PA01
ggcgccagcgcccc

SEQ ID NO: 3489833 - RNA, 21 nt, Pseudomonas aeruginosa PA01
ggcgccagcucggacaagggc

SEQ ID NO: 3489834 - RNA, 21 nt, Pseudomonas aeruginosa PA01
ggcgccaggacucgccaucgg

SEQ ID NO: 3489835 - RNA, 23 nt, Pseudomonas aeruginosa PA01
ggcgccaggacucgccaucggcc

SEQ ID NO: 3489836 - RNA, 22 nt, Pseudomonas aeruginosa PA01
ggcgccaggcccucggcgacca

SEQ ID NO: 3489837 - RNA, 12 nt, Pseudomonas aeruginosa PA01
ggcgccaggccg

SEQ ID NO: 3489838 - RNA, 13 nt, Pseudomonas aeruginosa PA01
ggcgccaggccgc

SEQ ID NO: 3489839 - RNA, 14 nt, Pseudomonas aeruginosa PA01
ggcgccaggccgcg

SEQ ID NO: 3489840 - RNA, 16 nt, Pseudomonas aeruginosa PA01
ggcgccaggccggagc

SEQ ID NO: 3489841 - RNA, 18 nt, Pseudomonas aeruginosa PA01
ggcgccaggccggagccg

SEQ ID NO: 3489842 - RNA, 15 nt, Pseudomonas aeruginosa PA01
ggcgccaggccggcg

SEQ ID NO: 3489843 - RNA, 12 nt, Pseudomonas aeruginosa PA01
ggcgccaggcgu

SEQ ID NO: 3489844 - RNA, 12 nt, Pseudomonas aeruginosa PA01
ggcgccaggcug

SEQ ID NO: 3489845 - RNA, 23 nt, Pseudomonas aeruginosa PA01
ggcgccaggcugaccgcgugggc

SEQ ID NO: 3489846 - RNA, 11 nt, Pseudomonas aeruginosa PA01
ggcgccaggga

SEQ ID NO: 3489847 - RNA, 15 nt, Pseudomonas aeruginosa PA01
ggcgccagggacgcg

SEQ ID NO: 3489848 - RNA, 19 nt, Pseudomonas aeruginosa PA01
ggcgccagggacgcgcagc

SEQ ID NO: 3489849 - RNA, 21 nt, Pseudomonas aeruginosa PA01
ggcgccagggacgcgcagcgg

SEQ ID NO: 3489850 - RNA, 13 nt, Pseudomonas aeruginosa PA01
ggcgccagggccg

SEQ ID NO: 3489851 - RNA, 15 nt, Pseudomonas aeruginosa PA01
ggcgccagggccggg

SEQ ID NO: 3489852 - RNA, 17 nt, Pseudomonas aeruginosa PA01
ggcgccagguagugccg

SEQ ID NO: 3489853 - RNA, 20 nt, Pseudomonas aeruginosa PA01
ggcgccaggugcaggaagcg

SEQ ID NO: 3489854 - RNA, 21 nt, Pseudomonas aeruginosa PA01
ggcgccaguaauggggaucgc

SEQ ID NO: 3489855 - RNA, 15 nt, Pseudomonas aeruginosa PA01
ggcgccaguucgccg

SEQ ID NO: 3489856 - RNA, 23 nt, Pseudomonas aeruginosa PA01
ggcgccauaccggcaaggcggcc

SEQ ID NO: 3489857 - RNA, 16 nt, Pseudomonas aeruginosa PA01
ggcgccauaggccagc

SEQ ID NO: 3489858 - RNA, 17 nt, Pseudomonas aeruginosa PA01
ggcgccauaggccagca

SEQ ID NO: 3489859 - RNA, 20 nt, Pseudomonas aeruginosa PA01
ggcgccauagggcacccggu

SEQ ID NO: 3489860 - RNA, 19 nt, Pseudomonas aeruginosa PA01
ggcgccauccuccagcgcc

SEQ ID NO: 3489861 - RNA, 20 nt, Pseudomonas aeruginosa PA01
ggcgccaucgaucagcagcg

SEQ ID NO: 3489862 - RNA, 23 nt, Pseudomonas aeruginosa PA01
ggcgccaucgaucagcagcgcca

SEQ ID NO: 3489863 - RNA, 18 nt, Pseudomonas aeruginosa PA01
ggcgcccaaugcaucggc

SEQ ID NO: 3489864 - RNA, 19 nt, Pseudomonas aeruginosa PA01
ggcgcccaaugcaucggcc

SEQ ID NO: 3489865 - RNA, 23 nt, Pseudomonas aeruginosa PA01
ggcgcccaaugcaucggccggga

SEQ ID NO: 3489866 - RNA, 17 nt, Pseudomonas aeruginosa PA01
ggcgcccacaaccugcc

SEQ ID NO: 3489867 - RNA, 17 nt, Pseudomonas aeruginosa PA01
ggcgcccacuccaacca

SEQ ID NO: 3489868 - RNA, 15 nt, Pseudomonas aeruginosa PA01
ggcgcccagaaaaaa

SEQ ID NO: 3489869 - RNA, 19 nt, Pseudomonas aeruginosa PA01
ggcgcccagaaaaaagccc

SEQ ID NO: 3489870 - RNA, 13 nt, Pseudomonas aeruginosa PA01
ggcgcccagcacc

SEQ ID NO: 3489871 - RNA, 18 nt, Pseudomonas aeruginosa PA01
ggcgcccagcaccacagc

SEQ ID NO: 3489872 - RNA, 13 nt, Pseudomonas aeruginosa PA01
ggcgcccagccag

SEQ ID NO: 3489873 - RNA, 14 nt, Pseudomonas aeruginosa PA01
ggcgcccaggcagc

SEQ ID NO: 3489874 - RNA, 20 nt, Pseudomonas aeruginosa PA01
ggcgcccagggcuucgcggu

SEQ ID NO: 3489875 - RNA, 22 nt, Pseudomonas aeruginosa PA01
ggcgcccagggcuucgcggugg

SEQ ID NO: 3489876 - RNA, 21 nt, Pseudomonas aeruginosa PA01
ggcgccccagaucgccagcgc

SEQ ID NO: 3489877 - RNA, 15 nt, Pseudomonas aeruginosa PA01
ggcgccccaggcgcc

SEQ ID NO: 3489878 - RNA, 19 nt, Pseudomonas aeruginosa PA01
ggcgccccaggcgcccagg

SEQ ID NO: 3489879 - RNA, 14 nt, Pseudomonas aeruginosa PA01
ggcgccccaggcgg

SEQ ID NO: 3489880 - RNA, 16 nt, Pseudomonas aeruginosa PA01
ggcgccccaggcgggc

SEQ ID NO: 3489881 - RNA, 15 nt, Pseudomonas aeruginosa PA01
ggcgccccgggucgg

SEQ ID NO: 3489882 - RNA, 19 nt, Pseudomonas aeruginosa PA01
ggcgccccugcggcgccgg

SEQ ID NO: 3489883 - RNA, 14 nt, Pseudomonas aeruginosa PA01
ggcgcccgagggcg

SEQ ID NO: 3489884 - RNA, 17 nt, Pseudomonas aeruginosa PA01
ggcgcccgagggcgccg

SEQ ID NO: 3489885 - RNA, 18 nt, Pseudomonas aeruginosa PA01
ggcgcccgccaaggcccu

SEQ ID NO: 3489886 - RNA, 19 nt, Pseudomonas aeruginosa PA01
ggcgcccgccaaggcccug

SEQ ID NO: 3489887 - RNA, 22 nt, Pseudomonas aeruginosa PA01
ggcgcccgccaaggcccugcug

SEQ ID NO: 3489888 - RNA, 21 nt, Pseudomonas aeruginosa PA01
ggcgcccgcccggaaccaccg

SEQ ID NO: 3489889 - RNA, 14 nt, Pseudomonas aeruginosa PA01
ggcgcccgccggcc

SEQ ID NO: 3489890 - RNA, 17 nt, Pseudomonas aeruginosa PA01
ggcgcccgccugcagga

SEQ ID NO: 3489891 - RNA, 14 nt, Pseudomonas aeruginosa PA01
ggcgcccgcgggcg

SEQ ID NO: 3489892 - RNA, 14 nt, Pseudomonas aeruginosa PA01
ggcgcccggucagg

SEQ ID NO: 3489893 - RNA, 15 nt, Pseudomonas aeruginosa PA01
ggcgcccggucaggu

SEQ ID NO: 3489894 - RNA, 16 nt, Pseudomonas aeruginosa PA01
ggcgcccucgccaauc

SEQ ID NO: 3489895 - RNA, 16 nt, Pseudomonas aeruginosa PA01
ggcgcccucgggcgcc

SEQ ID NO: 3489896 - RNA, 17 nt, Pseudomonas aeruginosa PA01
ggcgcccucgggcgccg

SEQ ID NO: 3489897 - RNA, 18 nt, Pseudomonas aeruginosa PA01
ggcgcccucugccggucg

SEQ ID NO: 3489898 - RNA, 20 nt, Pseudomonas aeruginosa PA01
ggcgcccucugccggucgga

SEQ ID NO: 3489899 - RNA, 13 nt, Pseudomonas aeruginosa PA01
ggcgcccugccgg

SEQ ID NO: 3489900 - RNA, 13 nt, Pseudomonas aeruginosa PA01
ggcgcccugcucu

SEQ ID NO: 3489901 - RNA, 14 nt, Pseudomonas aeruginosa PA01
ggcgcccugcucug

SEQ ID NO: 3489902 - RNA, 14 nt, Pseudomonas aeruginosa PA01
ggcgcccuggccgc

SEQ ID NO: 3489903 - RNA, 16 nt, Pseudomonas aeruginosa PA01
ggcgcccuggccgucg

SEQ ID NO: 3489904 - RNA, 21 nt, Pseudomonas aeruginosa PA01
ggcgcccuggccgucggccug

SEQ ID NO: 3489905 - RNA, 15 nt, Pseudomonas aeruginosa PA01
ggcgcccugggcgcg

SEQ ID NO: 3489906 - RNA, 17 nt, Pseudomonas aeruginosa PA01
ggcgcccuucagcgccu

SEQ ID NO: 3489907 - RNA, 23 nt, Pseudomonas aeruginosa PA01
ggcgcccuugacguucaggcugu

SEQ ID NO: 3489908 - RNA, 22 nt, Pseudomonas aeruginosa PA01
ggcgccgaaaaaaaggggcccg

SEQ ID NO: 3489909 - RNA, 23 nt, Pseudomonas aeruginosa PA01
ggcgccgaaaaaaaggggcccga

SEQ ID NO: 3489910 - RNA, 18 nt, Pseudomonas aeruginosa PA01
ggcgccgaacagggcgag

SEQ ID NO: 3489911 - RNA, 22 nt, Pseudomonas aeruginosa PA01
ggcgccgaacagggcgagcagg

SEQ ID NO: 3489912 - RNA, 12 nt, Pseudomonas aeruginosa PA01
ggcgccgaccac

SEQ ID NO: 3489913 - RNA, 18 nt, Pseudomonas aeruginosa PA01
ggcgccgaccacgaccgc

SEQ ID NO: 3489914 - RNA, 21 nt, Pseudomonas aeruginosa PA01
ggcgccgaccacgaccgcguc

SEQ ID NO: 3489915 - RNA, 13 nt, Pseudomonas aeruginosa PA01
ggcgccgaccagc

SEQ ID NO: 3489916 - RNA, 20 nt, Pseudomonas aeruginosa PA01
ggcgccgaccgcaccgccag

SEQ ID NO: 3489917 - RNA, 21 nt, Pseudomonas aeruginosa PA01
ggcgccgaccgcaccgccagc

SEQ ID NO: 3489918 - RNA, 23 nt, Pseudomonas aeruginosa PA01
ggcgccgaccgcaccgccagcgu

SEQ ID NO: 3489919 - RNA, 15 nt, Pseudomonas aeruginosa PA01
ggcgccgaccguggc

SEQ ID NO: 3489920 - RNA, 13 nt, Pseudomonas aeruginosa PA01
ggcgccgagcagc

SEQ ID NO: 3489921 - RNA, 17 nt, Pseudomonas aeruginosa PA01
ggcgccgagcagcggcg

SEQ ID NO: 3489922 - RNA, 16 nt, Pseudomonas aeruginosa PA01
ggcgccgaucaggcgu

SEQ ID NO: 3489923 - RNA, 15 nt, Pseudomonas aeruginosa PA01
ggcgccgaugcccag

SEQ ID NO: 3489924 - RNA, 16 nt, Pseudomonas aeruginosa PA01
ggcgccgaugcccagg

SEQ ID NO: 3489925 - RNA, 14 nt, Pseudomonas aeruginosa PA01
ggcgccgaugccgc

SEQ ID NO: 3489926 - RNA, 15 nt, Pseudomonas aeruginosa PA01
ggcgccgcagggccc

SEQ ID NO: 3489927 - RNA, 12 nt, Pseudomonas aeruginosa PA01
ggcgccgccagc

SEQ ID NO: 3489928 - RNA, 22 nt, Pseudomonas aeruginosa PA01
ggcgccgccagccagagcagcg

SEQ ID NO: 3489929 - RNA, 13 nt, Pseudomonas aeruginosa PA01
ggcgccgccgaac

SEQ ID NO: 3489930 - RNA, 19 nt, Pseudomonas aeruginosa PA01
ggcgccgccgaacaugccg

SEQ ID NO: 3489931 - RNA, 21 nt, Pseudomonas aeruginosa PA01
ggcgccgccgacgccaugggu

SEQ ID NO: 3489932 - RNA, 19 nt, Pseudomonas aeruginosa PA01
ggcgccgccgcuggcgagg

SEQ ID NO: 3489933 - RNA, 13 nt, Pseudomonas aeruginosa PA01
ggcgccgccggcg

SEQ ID NO: 3489934 - RNA, 17 nt, Pseudomonas aeruginosa PA01
ggcgccgccggcgaacg

SEQ ID NO: 3489935 - RNA, 20 nt, Pseudomonas aeruginosa PA01
ggcgccgccggggaucagcg

SEQ ID NO: 3489936 - RNA, 13 nt, Pseudomonas aeruginosa PA01
ggcgccgccggug

SEQ ID NO: 3489937 - RNA, 24 nt, Pseudomonas aeruginosa PA01
ggcgccgccggugaacagguagcu

SEQ ID NO: 3489938 - RNA, 20 nt, Pseudomonas aeruginosa PA01
ggcgccgccggugcaccagg

SEQ ID NO: 3489939 - RNA, 12 nt, Pseudomonas aeruginosa PA01
ggcgccgccguc

SEQ ID NO: 3489940 - RNA, 15 nt, Pseudomonas aeruginosa PA01
ggcgccgccuggccg

SEQ ID NO: 3489941 - RNA, 15 nt, Pseudomonas aeruginosa PA01
ggcgccgcgcaccug

SEQ ID NO: 3489942 - RNA, 18 nt, Pseudomonas aeruginosa PA01
ggcgccgcgcauccucgg

SEQ ID NO: 3489943 - RNA, 14 nt, Pseudomonas aeruginosa PA01
ggcgccgcgccagg

SEQ ID NO: 3489944 - RNA, 18 nt, Pseudomonas aeruginosa PA01
ggcgccgcgccagguuca

SEQ ID NO: 3489945 - RNA, 13 nt, Pseudomonas aeruginosa PA01
ggcgccgcgccuu

SEQ ID NO: 3489946 - RNA, 22 nt, Pseudomonas aeruginosa PA01
ggcgccgcgggucugcucggcg

SEQ ID NO: 3489947 - RNA, 22 nt, Pseudomonas aeruginosa PA01
ggcgccgcggucgaugucgcgg

SEQ ID NO: 3489948 - RNA, 20 nt, Pseudomonas aeruginosa PA01
ggcgccgcuagggcgcccuc

SEQ ID NO: 3489949 - RNA, 19 nt, Pseudomonas aeruginosa PA01
ggcgccgcucgaugcccgc

SEQ ID NO: 3489950 - RNA, 23 nt, Pseudomonas aeruginosa PA01
ggcgccgcucgaugcccgccagc

SEQ ID NO: 3489951 - RNA, 13 nt, Pseudomonas aeruginosa PA01
ggcgccgcuggcg

SEQ ID NO: 3489952 - RNA, 11 nt, Pseudomonas aeruginosa PA01
ggcgccgcugu

SEQ ID NO: 3489953 - RNA, 20 nt, Pseudomonas aeruginosa PA01
ggcgccgcuugagaccuucg

SEQ ID NO: 3489954 - RNA, 19 nt, Pseudomonas aeruginosa PA01
ggcgccggcagguagaccu

SEQ ID NO: 3489955 - RNA, 18 nt, Pseudomonas aeruginosa PA01
ggcgccggcauugccgac

SEQ ID NO: 3489956 - RNA, 13 nt, Pseudomonas aeruginosa PA01
ggcgccggccucc

SEQ ID NO: 3489957 - RNA, 15 nt, Pseudomonas aeruginosa PA01
ggcgccggccuccag

SEQ ID NO: 3489958 - RNA, 20 nt, Pseudomonas aeruginosa PA01
ggcgccggccuccagcgccu

SEQ ID NO: 3489959 - RNA, 20 nt, Pseudomonas aeruginosa PA01
ggcgccggcgcgcaggguga

SEQ ID NO: 3489960 - RNA, 15 nt, Pseudomonas aeruginosa PA01
ggcgccggcgcgcgg

SEQ ID NO: 3489961 - RNA, 19 nt, Pseudomonas aeruginosa PA01
ggcgccggcgcgcuugccg

SEQ ID NO: 3489962 - RNA, 19 nt, Pseudomonas aeruginosa PA01
ggcgccggcggaucagccc

SEQ ID NO: 3489963 - RNA, 14 nt, Pseudomonas aeruginosa PA01
ggcgccggcucgcc

SEQ ID NO: 3489964 - RNA, 15 nt, Pseudomonas aeruginosa PA01
ggcgccggcucgccc

SEQ ID NO: 3489965 - RNA, 18 nt, Pseudomonas aeruginosa PA01
ggcgccggcucgcccagc

SEQ ID NO: 3489966 - RNA, 23 nt, Pseudomonas aeruginosa PA01
ggcgccggcucgcccagcaggcg

SEQ ID NO: 3489967 - RNA, 13 nt, Pseudomonas aeruginosa PA01
ggcgccggcugac

SEQ ID NO: 3489968 - RNA, 14 nt, Pseudomonas aeruginosa PA01
ggcgccggcugacg

SEQ ID NO: 3489969 - RNA, 16 nt, Pseudomonas aeruginosa PA01
ggcgccggcugacgcu

SEQ ID NO: 3489970 - RNA, 20 nt, Pseudomonas aeruginosa PA01
ggcgccggcugacgcuggcg

SEQ ID NO: 3489971 - RNA, 21 nt, Pseudomonas aeruginosa PA01
ggcgccggcugacgcuggcga

SEQ ID NO: 3489972 - RNA, 13 nt, Pseudomonas aeruginosa PA01
ggcgccgggcgcg

SEQ ID NO: 3489973 - RNA, 23 nt, Pseudomonas aeruginosa PA01
ggcgccgggcgcgaugccgaugc

SEQ ID NO: 3489974 - RNA, 14 nt, Pseudomonas aeruginosa PA01
ggcgccgggcugcc

SEQ ID NO: 3489975 - RNA, 16 nt, Pseudomonas aeruginosa PA01
ggcgccgggcugccga

SEQ ID NO: 3489976 - RNA, 18 nt, Pseudomonas aeruginosa PA01
ggcgccgggcugccgaac

SEQ ID NO: 3489977 - RNA, 13 nt, Pseudomonas aeruginosa PA01
ggcgccgggucga

SEQ ID NO: 3489978 - RNA, 18 nt, Pseudomonas aeruginosa PA01
ggcgccgggucgaugggc

SEQ ID NO: 3489979 - RNA, 19 nt, Pseudomonas aeruginosa PA01
ggcgccggugaggcgcagc

SEQ ID NO: 3489980 - RNA, 21 nt, Pseudomonas aeruginosa PA01
ggcgccggugaggcgcagcag

SEQ ID NO: 3489981 - RNA, 18 nt, Pseudomonas aeruginosa PA01
ggcgccggugcaugaagg

SEQ ID NO: 3489982 - RNA, 21 nt, Pseudomonas aeruginosa PA01
ggcgccggugcaugaaggcgc

SEQ ID NO: 3489983 - RNA, 20 nt, Pseudomonas aeruginosa PA01
ggcgccggugcuggcgagca

SEQ ID NO: 3489984 - RNA, 13 nt, Pseudomonas aeruginosa PA01
ggcgccgguugcu

SEQ ID NO: 3489985 - RNA, 19 nt, Pseudomonas aeruginosa PA01
ggcgccgucaucgcugacc

SEQ ID NO: 3489986 - RNA, 17 nt, Pseudomonas aeruginosa PA01
ggcgccgucgaucaggu

SEQ ID NO: 3489987 - RNA, 15 nt, Pseudomonas aeruginosa PA01
ggcgccuagacccug

SEQ ID NO: 3489988 - RNA, 16 nt, Pseudomonas aeruginosa PA01
ggcgccuagacccugg

SEQ ID NO: 3489989 - RNA, 17 nt, Pseudomonas aeruginosa PA01
ggcgccucccagggucg

SEQ ID NO: 3489990 - RNA, 13 nt, Pseudomonas aeruginosa PA01
ggcgccucgaagc

SEQ ID NO: 3489991 - RNA, 13 nt, Pseudomonas aeruginosa PA01
ggcgccucgauga

SEQ ID NO: 3489992 - RNA, 23 nt, Pseudomonas aeruginosa PA01
ggcgccucgaugauccacuugcc

SEQ ID NO: 3489993 - RNA, 12 nt, Pseudomonas aeruginosa PA01
ggcgccucgccg

SEQ ID NO: 3489994 - RNA, 13 nt, Pseudomonas aeruginosa PA01
ggcgccucgccgc

SEQ ID NO: 3489995 - RNA, 17 nt, Pseudomonas aeruginosa PA01
ggcgccucgccgcggca

SEQ ID NO: 3489996 - RNA, 15 nt, Pseudomonas aeruginosa PA01
ggcgccugcgcuucg

SEQ ID NO: 3489997 - RNA, 17 nt, Pseudomonas aeruginosa PA01
ggcgccugcggaccaca

SEQ ID NO: 3489998 - RNA, 16 nt, Pseudomonas aeruginosa PA01
ggcgccugcugcgcgg

SEQ ID NO: 3489999 - RNA, 14 nt, Pseudomonas aeruginosa PA01
ggcgccuggccugg

SEQ ID NO: 3490000 - RNA, 15 nt, Pseudomonas aeruginosa PA01
ggcgccuggccugga

SEQ ID NO: 3490001 - RNA, 18 nt, Pseudomonas aeruginosa PA01
ggcgccuggccuggaacu

SEQ ID NO: 3490002 - RNA, 12 nt, Pseudomonas aeruginosa PA01
ggcgccuggcgu

SEQ ID NO: 3490003 - RNA, 21 nt, Pseudomonas aeruginosa PA01
ggcgccuucagagcaggguga

SEQ ID NO: 3490004 - RNA, 16 nt, Pseudomonas aeruginosa PA01
ggcgccuucagcgccg

SEQ ID NO: 3490005 - RNA, 18 nt, Pseudomonas aeruginosa PA01
ggcgccuucagcgccgcc

SEQ ID NO: 3490006 - RNA, 19 nt, Pseudomonas aeruginosa PA01
ggcgccuucagcgccgcca

SEQ ID NO: 3490007 - RNA, 22 nt, Pseudomonas aeruginosa PA01
ggcgccuucagcgccgccaggc

SEQ ID NO: 3490008 - RNA, 19 nt, Pseudomonas aeruginosa PA01
ggcgccuuccaggcgugcc

SEQ ID NO: 3490009 - RNA, 22 nt, Pseudomonas aeruginosa PA01
ggcgccuucccagauaccggcg

SEQ ID NO: 3490010 - RNA, 19 nt, Pseudomonas aeruginosa PA01
ggcgccuucgccggaagcu

SEQ ID NO: 3490011 - RNA, 16 nt, Pseudomonas aeruginosa PA01
ggcgccuucggcgaca

SEQ ID NO: 3490012 - RNA, 16 nt, Pseudomonas aeruginosa PA01
ggcgccuucgggcgcc

SEQ ID NO: 3490013 - RNA, 19 nt, Pseudomonas aeruginosa PA01
ggcgccuugcgccaggccu

SEQ ID NO: 3490014 - RNA, 19 nt, Pseudomonas aeruginosa PA01
ggcgccuuuuucauggccu

SEQ ID NO: 3490015 - RNA, 21 nt, Pseudomonas aeruginosa PA01
ggcgccuuuuucauggccugg

SEQ ID NO: 3490016 - RNA, 22 nt, Pseudomonas aeruginosa PA01
ggcgccuuuuucauggccuggc

SEQ ID NO: 3490017 - RNA, 23 nt, Pseudomonas aeruginosa PA01
ggcgccuuuuuucauccugcgga

SEQ ID NO: 3490018 - RNA, 15 nt, Pseudomonas aeruginosa PA01
ggcgcgaaccagcag

SEQ ID NO: 3490019 - RNA, 16 nt, Pseudomonas aeruginosa PA01
ggcgcgaaccagcagc

SEQ ID NO: 3490020 - RNA, 19 nt, Pseudomonas aeruginosa PA01
ggcgcgaaccagcagcagg

SEQ ID NO: 3490021 - RNA, 17 nt, Pseudomonas aeruginosa PA01
ggcgcgaagucgcaguc

SEQ ID NO: 3490022 - RNA, 14 nt, Pseudomonas aeruginosa PA01
ggcgcgacagcucg

SEQ ID NO: 3490023 - RNA, 16 nt, Pseudomonas aeruginosa PA01
ggcgcgaccgcccgcc

SEQ ID NO: 3490024 - RNA, 18 nt, Pseudomonas aeruginosa PA01
ggcgcgaccgcccgccuc

SEQ ID NO: 3490025 - RNA, 14 nt, Pseudomonas aeruginosa PA01
ggcgcgaccgucgg

SEQ ID NO: 3490026 - RNA, 15 nt, Pseudomonas aeruginosa PA01
ggcgcgaccgucggc

SEQ ID NO: 3490027 - RNA, 16 nt, Pseudomonas aeruginosa PA01
ggcgcgaccgucggcc

SEQ ID NO: 3490028 - RNA, 16 nt, Pseudomonas aeruginosa PA01
ggcgcgacgaggcgcg

SEQ ID NO: 3490029 - RNA, 17 nt, Pseudomonas aeruginosa PA01
ggcgcgacgaggcgcgg

SEQ ID NO: 3490030 - RNA, 19 nt, Pseudomonas aeruginosa PA01
ggcgcgacgaggcgcggcg

SEQ ID NO: 3490031 - RNA, 21 nt, Pseudomonas aeruginosa PA01
ggcgcgacgaggcgcggcgga

SEQ ID NO: 3490032 - RNA, 15 nt, Pseudomonas aeruginosa PA01
ggcgcgacggcccac

SEQ ID NO: 3490033 - RNA, 16 nt, Pseudomonas aeruginosa PA01
ggcgcgacugucgagc

SEQ ID NO: 3490034 - RNA, 13 nt, Pseudomonas aeruginosa PA01
ggcgcgagaaaaa

SEQ ID NO: 3490035 - RNA, 14 nt, Pseudomonas aeruginosa PA01
ggcgcgagaaaaac

SEQ ID NO: 3490036 - RNA, 16 nt, Pseudomonas aeruginosa PA01
ggcgcgagaagccagc

SEQ ID NO: 3490037 - RNA, 19 nt, Pseudomonas aeruginosa PA01
ggcgcgagaugaagcgccg

SEQ ID NO: 3490038 - RNA, 17 nt, Pseudomonas aeruginosa PA01
ggcgcgauauccgccag

SEQ ID NO: 3490039 - RNA, 14 nt, Pseudomonas aeruginosa PA01
ggcgcgauccgcgc

SEQ ID NO: 3490040 - RNA, 19 nt, Pseudomonas aeruginosa PA01
ggcgcgauccuccgccagc

SEQ ID NO: 3490041 - RNA, 16 nt, Pseudomonas aeruginosa PA01
ggcgcgauccuggcgg

SEQ ID NO: 3490042 - RNA, 19 nt, Pseudomonas aeruginosa PA01
ggcgcgauccuggcggcac

SEQ ID NO: 3490043 - RNA, 17 nt, Pseudomonas aeruginosa PA01
ggcgcgaucgcguucca

SEQ ID NO: 3490044 - RNA, 15 nt, Pseudomonas aeruginosa PA01
ggcgcgaucggggca

SEQ ID NO: 3490045 - RNA, 16 nt, Pseudomonas aeruginosa PA01
ggcgcgaucggggcag

SEQ ID NO: 3490046 - RNA, 18 nt, Pseudomonas aeruginosa PA01
ggcgcgaugaugccgccg

SEQ ID NO: 3490047 - RNA, 15 nt, Pseudomonas aeruginosa PA01
ggcgcgaugcucccg

SEQ ID NO: 3490048 - RNA, 18 nt, Pseudomonas aeruginosa PA01
ggcgcgcaaaaaaagggg

SEQ ID NO: 3490049 - RNA, 22 nt, Pseudomonas aeruginosa PA01
ggcgcgcaacgcuuccagcacc

SEQ ID NO: 3490050 - RNA, 14 nt, Pseudomonas aeruginosa PA01
ggcgcgcaccaccu

SEQ ID NO: 3490051 - RNA, 18 nt, Pseudomonas aeruginosa PA01
ggcgcgcaccaccuggca

SEQ ID NO: 3490052 - RNA, 19 nt, Pseudomonas aeruginosa PA01
ggcgcgcaccaccuggcag

SEQ ID NO: 3490053 - RNA, 23 nt, Pseudomonas aeruginosa PA01
ggcgcgcaccaccuggcagguau

SEQ ID NO: 3490054 - RNA, 13 nt, Pseudomonas aeruginosa PA01
ggcgcgcaccagc

SEQ ID NO: 3490055 - RNA, 18 nt, Pseudomonas aeruginosa PA01
ggcgcgcacggaggcgcu

SEQ ID NO: 3490056 - RNA, 22 nt, Pseudomonas aeruginosa PA01
ggcgcgcacggaggcgcucagg

SEQ ID NO: 3490057 - RNA, 13 nt, Pseudomonas aeruginosa PA01
ggcgcgcacuucc

SEQ ID NO: 3490058 - RNA, 17 nt, Pseudomonas aeruginosa PA01
ggcgcgcacuuccucgg

SEQ ID NO: 3490059 - RNA, 20 nt, Pseudomonas aeruginosa PA01
ggcgcgcacuuccucggcga

SEQ ID NO: 3490060 - RNA, 21 nt, Pseudomonas aeruginosa PA01
ggcgcgcacuuccucggcgac

SEQ ID NO: 3490061 - RNA, 22 nt, Pseudomonas aeruginosa PA01
ggcgcgcacuuccucggcgacc

SEQ ID NO: 3490062 - RNA, 20 nt, Pseudomonas aeruginosa PA01
ggcgcgcagcagguagugcg

SEQ ID NO: 3490063 - RNA, 14 nt, Pseudomonas aeruginosa PA01
ggcgcgcagcgaac

SEQ ID NO: 3490064 - RNA, 18 nt, Pseudomonas aeruginosa PA01
ggcgcgcagcgaacgggc

SEQ ID NO: 3490065 - RNA, 14 nt, Pseudomonas aeruginosa PA01
ggcgcgcagggcca

SEQ ID NO: 3490066 - RNA, 17 nt, Pseudomonas aeruginosa PA01
ggcgcgcagggccagca

SEQ ID NO: 3490067 - RNA, 19 nt, Pseudomonas aeruginosa PA01
ggcgcgcagggccagcaac

SEQ ID NO: 3490068 - RNA, 14 nt, Pseudomonas aeruginosa PA01
ggcgcgcagggccg

SEQ ID NO: 3490069 - RNA, 15 nt, Pseudomonas aeruginosa PA01
ggcgcgcagggccgc

SEQ ID NO: 3490070 - RNA, 16 nt, Pseudomonas aeruginosa PA01
ggcgcgcagggccgcg

SEQ ID NO: 3490071 - RNA, 19 nt, Pseudomonas aeruginosa PA01
ggcgcgcagggccgcggcg

SEQ ID NO: 3490072 - RNA, 15 nt, Pseudomonas aeruginosa PA01
ggcgcgcaucuggug

SEQ ID NO: 3490073 - RNA, 13 nt, Pseudomonas aeruginosa PA01
ggcgcgccaaggc

SEQ ID NO: 3490074 - RNA, 20 nt, Pseudomonas aeruginosa PA01
ggcgcgccaaggccgccagg

SEQ ID NO: 3490075 - RNA, 17 nt, Pseudomonas aeruginosa PA01
ggcgcgccagaagcggc

SEQ ID NO: 3490076 - RNA, 18 nt, Pseudomonas aeruginosa PA01
ggcgcgcccaggcccagc

SEQ ID NO: 3490077 - RNA, 17 nt, Pseudomonas aeruginosa PA01
ggcgcgcccgccagguc

SEQ ID NO: 3490078 - RNA, 12 nt, Pseudomonas aeruginosa PA01
ggcgcgcccggc

SEQ ID NO: 3490079 - RNA, 12 nt, Pseudomonas aeruginosa PA01
ggcgcgccgaca

SEQ ID NO: 3490080 - RNA, 22 nt, Pseudomonas aeruginosa PA01
ggcgcgccgcaguacgaggggc

SEQ ID NO: 3490081 - RNA, 23 nt, Pseudomonas aeruginosa PA01
ggcgcgccggacaggccacccgc

SEQ ID NO: 3490082 - RNA, 15 nt, Pseudomonas aeruginosa PA01
ggcgcgccggcccgg

SEQ ID NO: 3490083 - RNA, 19 nt, Pseudomonas aeruginosa PA01
ggcgcgccggcuuggcuca

SEQ ID NO: 3490084 - RNA, 12 nt, Pseudomonas aeruginosa PA01
ggcgcgccggug

SEQ ID NO: 3490085 - RNA, 22 nt, Pseudomonas aeruginosa PA01
ggcgcgccggugaucgagccgc

SEQ ID NO: 3490086 - RNA, 12 nt, Pseudomonas aeruginosa PA01
ggcgcgccgguu

SEQ ID NO: 3490087 - RNA, 14 nt, Pseudomonas aeruginosa PA01
ggcgcgccgugcgg

SEQ ID NO: 3490088 - RNA, 17 nt, Pseudomonas aeruginosa PA01
ggcgcgccgugcggcgu

SEQ ID NO: 3490089 - RNA, 14 nt, Pseudomonas aeruginosa PA01
ggcgcgccugagcu

SEQ ID NO: 3490090 - RNA, 18 nt, Pseudomonas aeruginosa PA01
ggcgcgccugagcuggcc

SEQ ID NO: 3490091 - RNA, 19 nt, Pseudomonas aeruginosa PA01
ggcgcgccugagcuggccc

SEQ ID NO: 3490092 - RNA, 20 nt, Pseudomonas aeruginosa PA01
ggcgcgccuggaucagcgcc

SEQ ID NO: 3490093 - RNA, 22 nt, Pseudomonas aeruginosa PA01
ggcgcgccuggaucagcgccuc

SEQ ID NO: 3490094 - RNA, 14 nt, Pseudomonas aeruginosa PA01
ggcgcgccugguau

SEQ ID NO: 3490095 - RNA, 16 nt, Pseudomonas aeruginosa PA01
ggcgcgccuucagcgc

SEQ ID NO: 3490096 - RNA, 20 nt, Pseudomonas aeruginosa PA01
ggcgcgccuucagcgccucc

SEQ ID NO: 3490097 - RNA, 20 nt, Pseudomonas aeruginosa PA01
ggcgcgcgacacauggucgg

SEQ ID NO: 3490098 - RNA, 13 nt, Pseudomonas aeruginosa PA01
ggcgcgcgacaga

SEQ ID NO: 3490099 - RNA, 11 nt, Pseudomonas aeruginosa PA01
ggcgcgcgccc

SEQ ID NO: 3490100 - RNA, 12 nt, Pseudomonas aeruginosa PA01
ggcgcgcgcccc

SEQ ID NO: 3490101 - RNA, 13 nt, Pseudomonas aeruginosa PA01
ggcgcgcgccccc

SEQ ID NO: 3490102 - RNA, 12 nt, Pseudomonas aeruginosa PA01
ggcgcgcgcccu

SEQ ID NO: 3490103 - RNA, 14 nt, Pseudomonas aeruginosa PA01
ggcgcgcgccgaac

SEQ ID NO: 3490104 - RNA, 15 nt, Pseudomonas aeruginosa PA01
ggcgcgcgccgaacu

SEQ ID NO: 3490105 - RNA, 14 nt, Pseudomonas aeruginosa PA01
ggcgcgcgccgggc

SEQ ID NO: 3490106 - RNA, 17 nt, Pseudomonas aeruginosa PA01
ggcgcgcgccgggcuca

SEQ ID NO: 3490107 - RNA, 19 nt, Pseudomonas aeruginosa PA01
ggcgcgcgccucagcggcu

SEQ ID NO: 3490108 - RNA, 22 nt, Pseudomonas aeruginosa PA01
ggcgcgcgccucagcggcuggc

SEQ ID NO: 3490109 - RNA, 16 nt, Pseudomonas aeruginosa PA01
ggcgcgcgcgccaggu

SEQ ID NO: 3490110 - RNA, 16 nt, Pseudomonas aeruginosa PA01
ggcgcgcggcagcacc

SEQ ID NO: 3490111 - RNA, 14 nt, Pseudomonas aeruginosa PA01
ggcgcgcggccagc

SEQ ID NO: 3490112 - RNA, 15 nt, Pseudomonas aeruginosa PA01
ggcgcgcggccagcg

SEQ ID NO: 3490113 - RNA, 18 nt, Pseudomonas aeruginosa PA01
ggcgcgcggccagcgcgg

SEQ ID NO: 3490114 - RNA, 19 nt, Pseudomonas aeruginosa PA01
ggcgcgcggccagcgcggc

SEQ ID NO: 3490115 - RNA, 14 nt, Pseudomonas aeruginosa PA01
ggcgcgcgggccuu

SEQ ID NO: 3490116 - RNA, 15 nt, Pseudomonas aeruginosa PA01
ggcgcgcgggccuuc

SEQ ID NO: 3490117 - RNA, 18 nt, Pseudomonas aeruginosa PA01
ggcgcgcgggccuucgcc

SEQ ID NO: 3490118 - RNA, 20 nt, Pseudomonas aeruginosa PA01
ggcgcgcggggucuggccgg

SEQ ID NO: 3490119 - RNA, 20 nt, Pseudomonas aeruginosa PA01
ggcgcgcggucuucaucacc

SEQ ID NO: 3490120 - RNA, 22 nt, Pseudomonas aeruginosa PA01
ggcgcgcggucuucaucaccuu

SEQ ID NO: 3490121 - RNA, 14 nt, Pseudomonas aeruginosa PA01
ggcgcgcgucgaug

SEQ ID NO: 3490122 - RNA, 15 nt, Pseudomonas aeruginosa PA01
ggcgcgcgucgaugc

SEQ ID NO: 3490123 - RNA, 18 nt, Pseudomonas aeruginosa PA01
ggcgcgcuccggcgcgcc

SEQ ID NO: 3490124 - RNA, 19 nt, Pseudomonas aeruginosa PA01
ggcgcgcugcgugcgccgc

SEQ ID NO: 3490125 - RNA, 11 nt, Pseudomonas aeruginosa PA01
ggcgcgcuggc

SEQ ID NO: 3490126 - RNA, 18 nt, Pseudomonas aeruginosa PA01
ggcgcgcuggcagaacgc

SEQ ID NO: 3490127 - RNA, 22 nt, Pseudomonas aeruginosa PA01
ggcgcgcugguuuagcucggcg

SEQ ID NO: 3490128 - RNA, 17 nt, Pseudomonas aeruginosa PA01
ggcgcgcuuccuccagu

SEQ ID NO: 3490129 - RNA, 16 nt, Pseudomonas aeruginosa PA01
ggcgcgcuugccgcug

SEQ ID NO: 3490130 - RNA, 18 nt, Pseudomonas aeruginosa PA01
ggcgcgcuuuccggcgcg

SEQ ID NO: 3490131 - RNA, 21 nt, Pseudomonas aeruginosa PA01
ggcgcgcuuuccggcgcggcc

SEQ ID NO: 3490132 - RNA, 22 nt, Pseudomonas aeruginosa PA01
ggcgcgcuuuccggcgcggccu

SEQ ID NO: 3490133 - RNA, 24 nt, Pseudomonas aeruginosa PA01
ggcgcgcuuuccggcgcggccugc

SEQ ID NO: 3490134 - RNA, 17 nt, Pseudomonas aeruginosa PA01
ggcgcggaagcgccugc

SEQ ID NO: 3490135 - RNA, 21 nt, Pseudomonas aeruginosa PA01
ggcgcggaagcgccugcggug

SEQ ID NO: 3490136 - RNA, 22 nt, Pseudomonas aeruginosa PA01
ggcgcggaauacguacucgucg

SEQ ID NO: 3490137 - RNA, 18 nt, Pseudomonas aeruginosa PA01
ggcgcggacaagcccagc

SEQ ID NO: 3490138 - RNA, 17 nt, Pseudomonas aeruginosa PA01
ggcgcggacauggcgcu

SEQ ID NO: 3490139 - RNA, 23 nt, Pseudomonas aeruginosa PA01
ggcgcggacauggcgcucgagcu

SEQ ID NO: 3490140 - RNA, 13 nt, Pseudomonas aeruginosa PA01
ggcgcggaccgca

SEQ ID NO: 3490141 - RNA, 20 nt, Pseudomonas aeruginosa PA01
ggcgcggacgauggucgccg

SEQ ID NO: 3490142 - RNA, 22 nt, Pseudomonas aeruginosa PA01
ggcgcggacgauggucgccgcg

SEQ ID NO: 3490143 - RNA, 16 nt, Pseudomonas aeruginosa PA01
ggcgcggacggccugc

SEQ ID NO: 3490144 - RNA, 17 nt, Pseudomonas aeruginosa PA01
ggcgcggacgggccgcg

SEQ ID NO: 3490145 - RNA, 20 nt, Pseudomonas aeruginosa PA01
ggcgcggagagucggaagcu

SEQ ID NO: 3490146 - RNA, 22 nt, Pseudomonas aeruginosa PA01
ggcgcggagauccccuccucca

SEQ ID NO: 3490147 - RNA, 13 nt, Pseudomonas aeruginosa PA01
ggcgcggaucggc

SEQ ID NO: 3490148 - RNA, 22 nt, Pseudomonas aeruginosa PA01
ggcgcggaugucgggcucgacg

SEQ ID NO: 3490149 - RNA, 19 nt, Pseudomonas aeruginosa PA01
ggcgcggccagcuucucca

SEQ ID NO: 3490150 - RNA, 17 nt, Pseudomonas aeruginosa PA01
ggcgcggcccguccgcg

SEQ ID NO: 3490151 - RNA, 22 nt, Pseudomonas aeruginosa PA01
ggcgcggcccguccgcgccacg

SEQ ID NO: 3490152 - RNA, 14 nt, Pseudomonas aeruginosa PA01
ggcgcggccgaacu

SEQ ID NO: 3490153 - RNA, 15 nt, Pseudomonas aeruginosa PA01
ggcgcggccgaacuc

SEQ ID NO: 3490154 - RNA, 15 nt, Pseudomonas aeruginosa PA01
ggcgcggccggcgcc

SEQ ID NO: 3490155 - RNA, 13 nt, Pseudomonas aeruginosa PA01
ggcgcggccugca

SEQ ID NO: 3490156 - RNA, 22 nt, Pseudomonas aeruginosa PA01
ggcgcggccugcagcgacucca

SEQ ID NO: 3490157 - RNA, 21 nt, Pseudomonas aeruginosa PA01
ggcgcggccuucuugcugccg

SEQ ID NO: 3490158 - RNA, 18 nt, Pseudomonas aeruginosa PA01
ggcgcggcgcaaucaggg

SEQ ID NO: 3490159 - RNA, 22 nt, Pseudomonas aeruginosa PA01
ggcgcggcgcaaucagggcugg

SEQ ID NO: 3490160 - RNA, 24 nt, Pseudomonas aeruginosa PA01
ggcgcggcgcagccagagcuccag

SEQ ID NO: 3490161 - RNA, 17 nt, Pseudomonas aeruginosa PA01
ggcgcggcgcagcggcg

SEQ ID NO: 3490162 - RNA, 12 nt, Pseudomonas aeruginosa PA01
ggcgcggcgcca

SEQ ID NO: 3490163 - RNA, 14 nt, Pseudomonas aeruginosa PA01
ggcgcggcgccagc

SEQ ID NO: 3490164 - RNA, 18 nt, Pseudomonas aeruginosa PA01
ggcgcggcgccagcgccc

SEQ ID NO: 3490165 - RNA, 21 nt, Pseudomonas aeruginosa PA01
ggcgcggcgccagcgccccac

SEQ ID NO: 3490166 - RNA, 21 nt, Pseudomonas aeruginosa PA01
ggcgcggcgccuucagcgccg

SEQ ID NO: 3490167 - RNA, 13 nt, Pseudomonas aeruginosa PA01
ggcgcggcgcgga

SEQ ID NO: 3490168 - RNA, 16 nt, Pseudomonas aeruginosa PA01
ggcgcggcgcuccagg

SEQ ID NO: 3490169 - RNA, 13 nt, Pseudomonas aeruginosa PA01
ggcgcggcggccg

SEQ ID NO: 3490170 - RNA, 14 nt, Pseudomonas aeruginosa PA01
ggcgcggcggccgc

SEQ ID NO: 3490171 - RNA, 17 nt, Pseudomonas aeruginosa PA01
ggcgcggcggccgccuc

SEQ ID NO: 3490172 - RNA, 19 nt, Pseudomonas aeruginosa PA01
ggcgcggcguaccagccgc

SEQ ID NO: 3490173 - RNA, 22 nt, Pseudomonas aeruginosa PA01
ggcgcggcguaccagccgcggu

SEQ ID NO: 3490174 - RNA, 12 nt, Pseudomonas aeruginosa PA01
ggcgcggcgucg

SEQ ID NO: 3490175 - RNA, 16 nt, Pseudomonas aeruginosa PA01
ggcgcggcugaucggc

SEQ ID NO: 3490176 - RNA, 13 nt, Pseudomonas aeruginosa PA01
ggcgcgggccuuc

SEQ ID NO: 3490177 - RNA, 18 nt, Pseudomonas aeruginosa PA01
ggcgcgggccuucaggcu

SEQ ID NO: 3490178 - RNA, 16 nt, Pseudomonas aeruginosa PA01
ggcgcgggcgaagcgc

SEQ ID NO: 3490179 - RNA, 16 nt, Pseudomonas aeruginosa PA01
ggcgcgggcgaaggcc

SEQ ID NO: 3490180 - RNA, 18 nt, Pseudomonas aeruginosa PA01
ggcgcgggcgaaggccuc

SEQ ID NO: 3490181 - RNA, 23 nt, Pseudomonas aeruginosa PA01
ggcgcgggcgaaggccucgucga

SEQ ID NO: 3490182 - RNA, 13 nt, Pseudomonas aeruginosa PA01
ggcgcgggcgccg

SEQ ID NO: 3490183 - RNA, 23 nt, Pseudomonas aeruginosa PA01
ggcgcgggcgccgaugccggccg

SEQ ID NO: 3490184 - RNA, 14 nt, Pseudomonas aeruginosa PA01
ggcgcgggcgcgcg

SEQ ID NO: 3490185 - RNA, 16 nt, Pseudomonas aeruginosa PA01
ggcgcgggcgcgcgcc

SEQ ID NO: 3490186 - RNA, 13 nt, Pseudomonas aeruginosa PA01
ggcgcgggcggcc

SEQ ID NO: 3490187 - RNA, 14 nt, Pseudomonas aeruginosa PA01
ggcgcgggcggccu

SEQ ID NO: 3490188 - RNA, 15 nt, Pseudomonas aeruginosa PA01
ggcgcgggcuggcca

SEQ ID NO: 3490189 - RNA, 16 nt, Pseudomonas aeruginosa PA01
ggcgcggggccccggc

SEQ ID NO: 3490190 - RNA, 22 nt, Pseudomonas aeruginosa PA01
ggcgcggggcgaggucggccug

SEQ ID NO: 3490191 - RNA, 21 nt, Pseudomonas aeruginosa PA01
ggcgcgggucaucggcccgac

SEQ ID NO: 3490192 - RNA, 20 nt, Pseudomonas aeruginosa PA01
ggcgcgggucugcucgcgcu

SEQ ID NO: 3490193 - RNA, 20 nt, Pseudomonas aeruginosa PA01
ggcgcgggucuucaggccgc

SEQ ID NO: 3490194 - RNA, 19 nt, Pseudomonas aeruginosa PA01
ggcgcggguucgugccagg

SEQ ID NO: 3490195 - RNA, 23 nt, Pseudomonas aeruginosa PA01
ggcgcgguagggaucgucgccaa

SEQ ID NO: 3490196 - RNA, 15 nt, Pseudomonas aeruginosa PA01
ggcgcgguccgcggu

SEQ ID NO: 3490197 - RNA, 16 nt, Pseudomonas aeruginosa PA01
ggcgcgguccgcggua

SEQ ID NO: 3490198 - RNA, 18 nt, Pseudomonas aeruginosa PA01
ggcgcggucggguccggg

SEQ ID NO: 3490199 - RNA, 19 nt, Pseudomonas aeruginosa PA01
ggcgcggugagggcgacgu

SEQ ID NO: 3490200 - RNA, 16 nt, Pseudomonas aeruginosa PA01
ggcgcgguugccgcug

SEQ ID NO: 3490201 - RNA, 21 nt, Pseudomonas aeruginosa PA01
ggcgcgguugccgcugcggcg

SEQ ID NO: 3490202 - RNA, 19 nt, Pseudomonas aeruginosa PA01
ggcgcgguuucgcagcgcu

SEQ ID NO: 3490203 - RNA, 18 nt, Pseudomonas aeruginosa PA01
ggcgcguacgcccgcagc

SEQ ID NO: 3490204 - RNA, 20 nt, Pseudomonas aeruginosa PA01
ggcgcguacgcccgcagcca

SEQ ID NO: 3490205 - RNA, 15 nt, Pseudomonas aeruginosa PA01
ggcgcguacuugcca

SEQ ID NO: 3490206 - RNA, 20 nt, Pseudomonas aeruginosa PA01
ggcgcguacuugccagggca

SEQ ID NO: 3490207 - RNA, 21 nt, Pseudomonas aeruginosa PA01
ggcgcguacuugccagggcag

SEQ ID NO: 3490208 - RNA, 22 nt, Pseudomonas aeruginosa PA01
ggcgcguacuugccagggcagg

SEQ ID NO: 3490209 - RNA, 13 nt, Pseudomonas aeruginosa PA01
ggcgcguaggcga

SEQ ID NO: 3490210 - RNA, 16 nt, Pseudomonas aeruginosa PA01
ggcgcguaggcgaaca

SEQ ID NO: 3490211 - RNA, 14 nt, Pseudomonas aeruginosa PA01
ggcgcgucaugccg

SEQ ID NO: 3490212 - RNA, 17 nt, Pseudomonas aeruginosa PA01
ggcgcgucaugccgccg

SEQ ID NO: 3490213 - RNA, 14 nt, Pseudomonas aeruginosa PA01
ggcgcguccaccug

SEQ ID NO: 3490214 - RNA, 13 nt, Pseudomonas aeruginosa PA01
ggcgcguccagcu

SEQ ID NO: 3490215 - RNA, 15 nt, Pseudomonas aeruginosa PA01
ggcgcgucgaccacg

SEQ ID NO: 3490216 - RNA, 14 nt, Pseudomonas aeruginosa PA01
ggcgcgucgcggcc

SEQ ID NO: 3490217 - RNA, 15 nt, Pseudomonas aeruginosa PA01
ggcgcgucgcggccu

SEQ ID NO: 3490218 - RNA, 16 nt, Pseudomonas aeruginosa PA01
ggcgcgucgcggccuc

SEQ ID NO: 3490219 - RNA, 20 nt, Pseudomonas aeruginosa PA01
ggcgcgucgcucauccgcga

SEQ ID NO: 3490220 - RNA, 14 nt, Pseudomonas aeruginosa PA01
ggcgcgucgcugcc

SEQ ID NO: 3490221 - RNA, 15 nt, Pseudomonas aeruginosa PA01
ggcgcgucgcugccg

SEQ ID NO: 3490222 - RNA, 22 nt, Pseudomonas aeruginosa PA01
ggcgcgucgcugccgccgcgcc

SEQ ID NO: 3490223 - RNA, 23 nt, Pseudomonas aeruginosa PA01
ggcgcgucgcugccgccgcgccc

SEQ ID NO: 3490224 - RNA, 22 nt, Pseudomonas aeruginosa PA01
ggcgcgucgcugcgcaacugcc

SEQ ID NO: 3490225 - RNA, 14 nt, Pseudomonas aeruginosa PA01
ggcgcgucggugcc

SEQ ID NO: 3490226 - RNA, 19 nt, Pseudomonas aeruginosa PA01
ggcgcgucggugccgcccg

SEQ ID NO: 3490227 - RNA, 21 nt, Pseudomonas aeruginosa PA01
ggcgcgucuccagcucggcga

SEQ ID NO: 3490228 - RNA, 17 nt, Pseudomonas aeruginosa PA01
ggcgcgucuccaugcgg

SEQ ID NO: 3490229 - RNA, 18 nt, Pseudomonas aeruginosa PA01
ggcgcguucacuccacga

SEQ ID NO: 3490230 - RNA, 19 nt, Pseudomonas aeruginosa PA01
ggcgcguucucccugagcc

SEQ ID NO: 3490231 - RNA, 20 nt, Pseudomonas aeruginosa PA01
ggcgcguugcuuccaggcac

SEQ ID NO: 3490232 - RNA, 21 nt, Pseudomonas aeruginosa PA01
ggcgcguugcuuccaggcacc

SEQ ID NO: 3490233 - RNA, 16 nt, Pseudomonas aeruginosa PA01
ggcgcguuggcuggcg

SEQ ID NO: 3490234 - RNA, 19 nt, Pseudomonas aeruginosa PA01
ggcgcguugugccgccacc

SEQ ID NO: 3490235 - RNA, 20 nt, Pseudomonas aeruginosa PA01
ggcgcguuuuuccgcgagga

SEQ ID NO: 3490236 - RNA, 13 nt, Pseudomonas aeruginosa PA01
ggcgcuaccgcgc

SEQ ID NO: 3490237 - RNA, 22 nt, Pseudomonas aeruginosa PA01
ggcgcuaccgcgcauggcggcg

SEQ ID NO: 3490238 - RNA, 20 nt, Pseudomonas aeruginosa PA01
ggcgcuacgaaggcgugccg

SEQ ID NO: 3490239 - RNA, 15 nt, Pseudomonas aeruginosa PA01
ggcgcuacgccaauc

SEQ ID NO: 3490240 - RNA, 21 nt, Pseudomonas aeruginosa PA01
ggcgcuacgccaauccaugau

SEQ ID NO: 3490241 - RNA, 16 nt, Pseudomonas aeruginosa PA01
ggcgcuacgcucgccg

SEQ ID NO: 3490242 - RNA, 17 nt, Pseudomonas aeruginosa PA01
ggcgcuacgcucgccga

SEQ ID NO: 3490243 - RNA, 18 nt, Pseudomonas aeruginosa PA01
ggcgcuacgcucgccgac

SEQ ID NO: 3490244 - RNA, 22 nt, Pseudomonas aeruginosa PA01
ggcgcuagcccuuccuacaucu

SEQ ID NO: 3490245 - RNA, 15 nt, Pseudomonas aeruginosa PA01
ggcgcuaugcgccgu

SEQ ID NO: 3490246 - RNA, 14 nt, Pseudomonas aeruginosa PA01
ggcgcucaacgccu

SEQ ID NO: 3490247 - RNA, 19 nt, Pseudomonas aeruginosa PA01
ggcgcucaacgccucgcgg

SEQ ID NO: 3490248 - RNA, 22 nt, Pseudomonas aeruginosa PA01
ggcgcucaacgccucgcggcua

SEQ ID NO: 3490249 - RNA, 16 nt, Pseudomonas aeruginosa PA01
ggcgcucacccacaug

SEQ ID NO: 3490250 - RNA, 15 nt, Pseudomonas aeruginosa PA01
ggcgcucaccgaggc

SEQ ID NO: 3490251 - RNA, 16 nt, Pseudomonas aeruginosa PA01
ggcgcucagcaucagc

SEQ ID NO: 3490252 - RNA, 13 nt, Pseudomonas aeruginosa PA01
ggcgcucagcgcc

SEQ ID NO: 3490253 - RNA, 14 nt, Pseudomonas aeruginosa PA01
ggcgcuccaacagc

SEQ ID NO: 3490254 - RNA, 17 nt, Pseudomonas aeruginosa PA01
ggcgcuccaacagcagg

SEQ ID NO: 3490255 - RNA, 18 nt, Pseudomonas aeruginosa PA01
ggcgcuccaacagcaggu

SEQ ID NO: 3490256 - RNA, 20 nt, Pseudomonas aeruginosa PA01
ggcgcuccaacagcagguag

SEQ ID NO: 3490257 - RNA, 12 nt, Pseudomonas aeruginosa PA01
ggcgcuccacca

SEQ ID NO: 3490258 - RNA, 13 nt, Pseudomonas aeruginosa PA01
ggcgcuccaccag

SEQ ID NO: 3490259 - RNA, 18 nt, Pseudomonas aeruginosa PA01
ggcgcuccaccagggccu

SEQ ID NO: 3490260 - RNA, 19 nt, Pseudomonas aeruginosa PA01
ggcgcuccaccagggccuc

SEQ ID NO: 3490261 - RNA, 14 nt, Pseudomonas aeruginosa PA01
ggcgcuccaccgcc

SEQ ID NO: 3490262 - RNA, 14 nt, Pseudomonas aeruginosa PA01
ggcgcuccaggcgg

SEQ ID NO: 3490263 - RNA, 18 nt, Pseudomonas aeruginosa PA01
ggcgcuccgccgaacgcc

SEQ ID NO: 3490264 - RNA, 18 nt, Pseudomonas aeruginosa PA01
ggcgcuccggaacgccug

SEQ ID NO: 3490265 - RNA, 19 nt, Pseudomonas aeruginosa PA01
ggcgcuccggaacgccugc

SEQ ID NO: 3490266 - RNA, 17 nt, Pseudomonas aeruginosa PA01
ggcgcuccuccagcgcc

SEQ ID NO: 3490267 - RNA, 18 nt, Pseudomonas aeruginosa PA01
ggcgcuccuccagcgccg

SEQ ID NO: 3490268 - RNA, 20 nt, Pseudomonas aeruginosa PA01
ggcgcuccuccagcgccgcc

SEQ ID NO: 3490269 - RNA, 21 nt, Pseudomonas aeruginosa PA01
ggcgcuccuccagcgccgcca

SEQ ID NO: 3490270 - RNA, 23 nt, Pseudomonas aeruginosa PA01
ggcgcuccuccagcgccgccagg

SEQ ID NO: 3490271 - RNA, 15 nt, Pseudomonas aeruginosa PA01
ggcgcuccuccucga

SEQ ID NO: 3490272 - RNA, 20 nt, Pseudomonas aeruginosa PA01
ggcgcuccuggagguucggc

SEQ ID NO: 3490273 - RNA, 20 nt, Pseudomonas aeruginosa PA01
ggcgcuccuggugcggcacc

SEQ ID NO: 3490274 - RNA, 21 nt, Pseudomonas aeruginosa PA01
ggcgcuccuggugcggcacca

SEQ ID NO: 3490275 - RNA, 17 nt, Pseudomonas aeruginosa PA01
ggcgcuccuugagcagc

SEQ ID NO: 3490276 - RNA, 20 nt, Pseudomonas aeruginosa PA01
ggcgcucgaagcuccagcgu

SEQ ID NO: 3490277 - RNA, 14 nt, Pseudomonas aeruginosa PA01
ggcgcucgacgauc

SEQ ID NO: 3490278 - RNA, 20 nt, Pseudomonas aeruginosa PA01
ggcgcucgagcuugaggucg

SEQ ID NO: 3490279 - RNA, 14 nt, Pseudomonas aeruginosa PA01
ggcgcucgaggggc

SEQ ID NO: 3490280 - RNA, 18 nt, Pseudomonas aeruginosa PA01
ggcgcucgcccuugcgcc

SEQ ID NO: 3490281 - RNA, 20 nt, Pseudomonas aeruginosa PA01
ggcgcucgcccuugcgccgc

SEQ ID NO: 3490282 - RNA, 13 nt, Pseudomonas aeruginosa PA01
ggcgcucgcgcug

SEQ ID NO: 3490283 - RNA, 14 nt, Pseudomonas aeruginosa PA01
ggcgcucgcgcugc

SEQ ID NO: 3490284 - RNA, 17 nt, Pseudomonas aeruginosa PA01
ggcgcucgcgggccgcc

SEQ ID NO: 3490285 - RNA, 13 nt, Pseudomonas aeruginosa PA01
ggcgcucgcugcg

SEQ ID NO: 3490286 - RNA, 17 nt, Pseudomonas aeruginosa PA01
ggcgcucgcugcgugcg

SEQ ID NO: 3490287 - RNA, 14 nt, Pseudomonas aeruginosa PA01
ggcgcucggccagg

SEQ ID NO: 3490288 - RNA, 12 nt, Pseudomonas aeruginosa PA01
ggcgcucggcga

SEQ ID NO: 3490289 - RNA, 14 nt, Pseudomonas aeruginosa PA01
ggcgcucggcgacc

SEQ ID NO: 3490290 - RNA, 15 nt, Pseudomonas aeruginosa PA01
ggcgcucggcgaccu

SEQ ID NO: 3490291 - RNA, 16 nt, Pseudomonas aeruginosa PA01
ggcgcucggcgacgcg

SEQ ID NO: 3490292 - RNA, 18 nt, Pseudomonas aeruginosa PA01
ggcgcucggcgacgcgga

SEQ ID NO: 3490293 - RNA, 14 nt, Pseudomonas aeruginosa PA01
ggcgcucggcggcg

SEQ ID NO: 3490294 - RNA, 17 nt, Pseudomonas aeruginosa PA01
ggcgcucggcggcgcgc

SEQ ID NO: 3490295 - RNA, 17 nt, Pseudomonas aeruginosa PA01
ggcgcucguugcgccgc

SEQ ID NO: 3490296 - RNA, 20 nt, Pseudomonas aeruginosa PA01
ggcgcucguugcgccgcucc

SEQ ID NO: 3490297 - RNA, 15 nt, Pseudomonas aeruginosa PA01
ggcgcucucgccgcc

SEQ ID NO: 3490298 - RNA, 12 nt, Pseudomonas aeruginosa PA01
ggcgcucuggcc

SEQ ID NO: 3490299 - RNA, 15 nt, Pseudomonas aeruginosa PA01
ggcgcucuggccgcg

SEQ ID NO: 3490300 - RNA, 17 nt, Pseudomonas aeruginosa PA01
ggcgcucuggccgcgcu

SEQ ID NO: 3490301 - RNA, 16 nt, Pseudomonas aeruginosa PA01
ggcgcucuucacuucc

SEQ ID NO: 3490302 - RNA, 20 nt, Pseudomonas aeruginosa PA01
ggcgcucuucacuuccagcu

SEQ ID NO: 3490303 - RNA, 22 nt, Pseudomonas aeruginosa PA01
ggcgcugaacaagcccuggugg

SEQ ID NO: 3490304 - RNA, 18 nt, Pseudomonas aeruginosa PA01
ggcgcugaacagcuggcg

SEQ ID NO: 3490305 - RNA, 20 nt, Pseudomonas aeruginosa PA01
ggcgcugaacagcuggcgcg

SEQ ID NO: 3490306 - RNA, 16 nt, Pseudomonas aeruginosa PA01
ggcgcugaagcggccg

SEQ ID NO: 3490307 - RNA, 12 nt, Pseudomonas aeruginosa PA01
ggcgcugaccag

SEQ ID NO: 3490308 - RNA, 17 nt, Pseudomonas aeruginosa PA01
ggcgcugaccaggucgu

SEQ ID NO: 3490309 - RNA, 16 nt, Pseudomonas aeruginosa PA01
ggcgcugaccgcuccc

SEQ ID NO: 3490310 - RNA, 21 nt, Pseudomonas aeruginosa PA01
ggcgcugaccgcucccaggca

SEQ ID NO: 3490311 - RNA, 21 nt, Pseudomonas aeruginosa PA01
ggcgcugaccucgauggcgug

SEQ ID NO: 3490312 - RNA, 14 nt, Pseudomonas aeruginosa PA01
ggcgcugagcgaga

SEQ ID NO: 3490313 - RNA, 16 nt, Pseudomonas aeruginosa PA01
ggcgcugagcgagacc

SEQ ID NO: 3490314 - RNA, 23 nt, Pseudomonas aeruginosa PA01
ggcgcugagcgccucgaucgccu

SEQ ID NO: 3490315 - RNA, 17 nt, Pseudomonas aeruginosa PA01
ggcgcugagcgcgguca

SEQ ID NO: 3490316 - RNA, 13 nt, Pseudomonas aeruginosa PA01
ggcgcugaggaag

SEQ ID NO: 3490317 - RNA, 19 nt, Pseudomonas aeruginosa PA01
ggcgcugaggaagagcagc

SEQ ID NO: 3490318 - RNA, 20 nt, Pseudomonas aeruginosa PA01
ggcgcugaggaagagcagcg

SEQ ID NO: 3490319 - RNA, 21 nt, Pseudomonas aeruginosa PA01
ggcgcugaggaagagcagcgc

SEQ ID NO: 3490320 - RNA, 23 nt, Pseudomonas aeruginosa PA01
ggcgcugaggaagagcagcgcgg

SEQ ID NO: 3490321 - RNA, 22 nt, Pseudomonas aeruginosa PA01
ggcgcugaggaucagccagccg

SEQ ID NO: 3490322 - RNA, 19 nt, Pseudomonas aeruginosa PA01
ggcgcugcaaucgcugccg

SEQ ID NO: 3490323 - RNA, 12 nt, Pseudomonas aeruginosa PA01
ggcgcugcagcc

SEQ ID NO: 3490324 - RNA, 19 nt, Pseudomonas aeruginosa PA01
ggcgcugcaugggcucgcg

SEQ ID NO: 3490325 - RNA, 22 nt, Pseudomonas aeruginosa PA01
ggcgcugcaugggcucgcgcgg

SEQ ID NO: 3490326 - RNA, 22 nt, Pseudomonas aeruginosa PA01
ggcgcugcccggguugagguag

SEQ ID NO: 3490327 - RNA, 13 nt, Pseudomonas aeruginosa PA01
ggcgcugccgaac

SEQ ID NO: 3490328 - RNA, 17 nt, Pseudomonas aeruginosa PA01
ggcgcugccgaacagca

SEQ ID NO: 3490329 - RNA, 14 nt, Pseudomonas aeruginosa PA01
ggcgcugccgauca

SEQ ID NO: 3490330 - RNA, 16 nt, Pseudomonas aeruginosa PA01
ggcgcugccgaucagc

SEQ ID NO: 3490331 - RNA, 17 nt, Pseudomonas aeruginosa PA01
ggcgcugccgaucagcc

SEQ ID NO: 3490332 - RNA, 16 nt, Pseudomonas aeruginosa PA01
ggcgcugccggccagg

SEQ ID NO: 3490333 - RNA, 13 nt, Pseudomonas aeruginosa PA01
ggcgcugccuucg

SEQ ID NO: 3490334 - RNA, 14 nt, Pseudomonas aeruginosa PA01
ggcgcugcgagcgc

SEQ ID NO: 3490335 - RNA, 15 nt, Pseudomonas aeruginosa PA01
ggcgcugcgagcgcu

SEQ ID NO: 3490336 - RNA, 16 nt, Pseudomonas aeruginosa PA01
ggcgcugcgcggccug

SEQ ID NO: 3490337 - RNA, 17 nt, Pseudomonas aeruginosa PA01
ggcgcugcgcggccugc

SEQ ID NO: 3490338 - RNA, 18 nt, Pseudomonas aeruginosa PA01
ggcgcugcgcggccugcg

SEQ ID NO: 3490339 - RNA, 14 nt, Pseudomonas aeruginosa PA01
ggcgcugcgcggcg

SEQ ID NO: 3490340 - RNA, 19 nt, Pseudomonas aeruginosa PA01
ggcgcugcgguaccagcgc

SEQ ID NO: 3490341 - RNA, 20 nt, Pseudomonas aeruginosa PA01
ggcgcugcgguaccagcgca

SEQ ID NO: 3490342 - RNA, 20 nt, Pseudomonas aeruginosa PA01
ggcgcugcucgauggccuug

SEQ ID NO: 3490343 - RNA, 20 nt, Pseudomonas aeruginosa PA01
ggcgcugcugguggacgucg

SEQ ID NO: 3490344 - RNA, 13 nt, Pseudomonas aeruginosa PA01
ggcgcugcuucuu

SEQ ID NO: 3490345 - RNA, 18 nt, Pseudomonas aeruginosa PA01
ggcgcugcuucuugucga

SEQ ID NO: 3490346 - RNA, 15 nt, Pseudomonas aeruginosa PA01
ggcgcuggaacagcg

SEQ ID NO: 3490347 - RNA, 14 nt, Pseudomonas aeruginosa PA01
ggcgcuggccagcg

SEQ ID NO: 3490348 - RNA, 15 nt, Pseudomonas aeruginosa PA01
ggcgcuggccaggua

SEQ ID NO: 3490349 - RNA, 13 nt, Pseudomonas aeruginosa PA01
ggcgcuggccgaa

SEQ ID NO: 3490350 - RNA, 12 nt, Pseudomonas aeruginosa PA01
ggcgcuggccgc

SEQ ID NO: 3490351 - RNA, 15 nt, Pseudomonas aeruginosa PA01
ggcgcuggccgcgcg

SEQ ID NO: 3490352 - RNA, 17 nt, Pseudomonas aeruginosa PA01
ggcgcuggccgcgcgac

SEQ ID NO: 3490353 - RNA, 18 nt, Pseudomonas aeruginosa PA01
ggcgcuggccgcgcgacc

SEQ ID NO: 3490354 - RNA, 21 nt, Pseudomonas aeruginosa PA01
ggcgcuggccgcgcgaccgcg

SEQ ID NO: 3490355 - RNA, 23 nt, Pseudomonas aeruginosa PA01
ggcgcuggccgcgcgaccgcggc

SEQ ID NO: 3490356 - RNA, 12 nt, Pseudomonas aeruginosa PA01
ggcgcuggcgcg

SEQ ID NO: 3490357 - RNA, 12 nt, Pseudomonas aeruginosa PA01
ggcgcuggcggg

SEQ ID NO: 3490358 - RNA, 18 nt, Pseudomonas aeruginosa PA01
ggcgcugggcggcuggcc

SEQ ID NO: 3490359 - RNA, 17 nt, Pseudomonas aeruginosa PA01
ggcgcugggucaugcuc

SEQ ID NO: 3490360 - RNA, 20 nt, Pseudomonas aeruginosa PA01
ggcgcugggucaugcucggg

SEQ ID NO: 3490361 - RNA, 15 nt, Pseudomonas aeruginosa PA01
ggcgcugguccagca

SEQ ID NO: 3490362 - RNA, 16 nt, Pseudomonas aeruginosa PA01
ggcgcugguccagcac

SEQ ID NO: 3490363 - RNA, 19 nt, Pseudomonas aeruginosa PA01
ggcgcugguccuucagcug

SEQ ID NO: 3490364 - RNA, 20 nt, Pseudomonas aeruginosa PA01
ggcgcugguccuugaucgga

SEQ ID NO: 3490365 - RNA, 17 nt, Pseudomonas aeruginosa PA01
ggcgcuguaggcgagca

SEQ ID NO: 3490366 - RNA, 19 nt, Pseudomonas aeruginosa PA01
ggcgcuguaggcgagcagc

SEQ ID NO: 3490367 - RNA, 17 nt, Pseudomonas aeruginosa PA01
ggcgcuguccuguggcg

SEQ ID NO: 3490368 - RNA, 14 nt, Pseudomonas aeruginosa PA01
ggcgcugucgcccg

SEQ ID NO: 3490369 - RNA, 17 nt, Pseudomonas aeruginosa PA01
ggcgcugucgcccgggc

SEQ ID NO: 3490370 - RNA, 20 nt, Pseudomonas aeruginosa PA01
ggcgcugucgcccgggcgcc

SEQ ID NO: 3490371 - RNA, 13 nt, Pseudomonas aeruginosa PA01
ggcgcugucgccg

SEQ ID NO: 3490372 - RNA, 15 nt, Pseudomonas aeruginosa PA01
ggcgcugucgccggu

SEQ ID NO: 3490373 - RNA, 21 nt, Pseudomonas aeruginosa PA01
ggcgcugucgccggucaggcu

SEQ ID NO: 3490374 - RNA, 19 nt, Pseudomonas aeruginosa PA01
ggcgcugucgccguuggcc

SEQ ID NO: 3490375 - RNA, 22 nt, Pseudomonas aeruginosa PA01
ggcgcuguuugcggcgcaggcg

SEQ ID NO: 3490376 - RNA, 13 nt, Pseudomonas aeruginosa PA01
ggcgcuucagcgc

SEQ ID NO: 3490377 - RNA, 19 nt, Pseudomonas aeruginosa PA01
ggcgcuucagcgccucgac

SEQ ID NO: 3490378 - RNA, 22 nt, Pseudomonas aeruginosa PA01
ggcgcuucagcgccucgaccug

SEQ ID NO: 3490379 - RNA, 18 nt, Pseudomonas aeruginosa PA01
ggcgcuucugcgagccgc

SEQ ID NO: 3490380 - RNA, 15 nt, Pseudomonas aeruginosa PA01
ggcgcuucugcucgg

SEQ ID NO: 3490381 - RNA, 16 nt, Pseudomonas aeruginosa PA01
ggcgcuucugcucggc

SEQ ID NO: 3490382 - RNA, 17 nt, Pseudomonas aeruginosa PA01
ggcgcuugaagccggcg

SEQ ID NO: 3490383 - RNA, 17 nt, Pseudomonas aeruginosa PA01
ggcgcuugagcagccag

SEQ ID NO: 3490384 - RNA, 19 nt, Pseudomonas aeruginosa PA01
ggcgcuugagcagccaggc

SEQ ID NO: 3490385 - RNA, 20 nt, Pseudomonas aeruginosa PA01
ggcgcuugagcagccaggcg

SEQ ID NO: 3490386 - RNA, 14 nt, Pseudomonas aeruginosa PA01
ggcgcuugccgcgc

SEQ ID NO: 3490387 - RNA, 18 nt, Pseudomonas aeruginosa PA01
ggcgcuugccgcgcccgg

SEQ ID NO: 3490388 - RNA, 17 nt, Pseudomonas aeruginosa PA01
ggcgcuugcgggcgcgc

SEQ ID NO: 3490389 - RNA, 18 nt, Pseudomonas aeruginosa PA01
ggcgcuugcgggcgcgcc

SEQ ID NO: 3490390 - RNA, 23 nt, Pseudomonas aeruginosa PA01
ggcgcuugcucuccacuaccgcc

SEQ ID NO: 3490391 - RNA, 24 nt, Pseudomonas aeruginosa PA01
ggcgcuugcucuccacuaccgccg

SEQ ID NO: 3490392 - RNA, 14 nt, Pseudomonas aeruginosa PA01
ggcgcuugggcgcg

SEQ ID NO: 3490393 - RNA, 21 nt, Pseudomonas aeruginosa PA01
ggcgcuuguagcccaggggca

SEQ ID NO: 3490394 - RNA, 22 nt, Pseudomonas aeruginosa PA01
ggcgcuuguagcccaggggcac

SEQ ID NO: 3490395 - RNA, 21 nt, Pseudomonas aeruginosa PA01
ggcgcuuguccgagaccggca

SEQ ID NO: 3490396 - RNA, 22 nt, Pseudomonas aeruginosa PA01
ggcgcuuguccgagaccggcag

SEQ ID NO: 3490397 - RNA, 19 nt, Pseudomonas aeruginosa PA01
ggcgcuuucaucaggcgcu

SEQ ID NO: 3490398 - RNA, 20 nt, Pseudomonas aeruginosa PA01
ggcgcuuucaucaggcgcuu

SEQ ID NO: 3490399 - RNA, 16 nt, Pseudomonas aeruginosa PA01
ggcgcuuuccacucgg

SEQ ID NO: 3490400 - RNA, 18 nt, Pseudomonas aeruginosa PA01
ggcgcuuucgcucugguc

SEQ ID NO: 3490401 - RNA, 15 nt, Pseudomonas aeruginosa PA01
ggcggaaaaagcgcg

SEQ ID NO: 3490402 - RNA, 19 nt, Pseudomonas aeruginosa PA01
ggcggaaaaagcgcggagg

SEQ ID NO: 3490403 - RNA, 21 nt, Pseudomonas aeruginosa PA01
ggcggaaaccugugcugcgcg

SEQ ID NO: 3490404 - RNA, 16 nt, Pseudomonas aeruginosa PA01
ggcggaaauacggcuc

SEQ ID NO: 3490405 - RNA, 20 nt, Pseudomonas aeruginosa PA01
ggcggaaauacggcuccggc

SEQ ID NO: 3490406 - RNA, 15 nt, Pseudomonas aeruginosa PA01
ggcggaacagcucgg

SEQ ID NO: 3490407 - RNA, 16 nt, Pseudomonas aeruginosa PA01
ggcggaacggcucgcg

SEQ ID NO: 3490408 - RNA, 19 nt, Pseudomonas aeruginosa PA01
ggcggaacuugucgccgcu

SEQ ID NO: 3490409 - RNA, 23 nt, Pseudomonas aeruginosa PA01
ggcggaagaaaagaaggcggaug

SEQ ID NO: 3490410 - RNA, 13 nt, Pseudomonas aeruginosa PA01
ggcggaaggccuc

SEQ ID NO: 3490411 - RNA, 13 nt, Pseudomonas aeruginosa PA01
ggcggaaggcggc

SEQ ID NO: 3490412 - RNA, 18 nt, Pseudomonas aeruginosa PA01
ggcggaaggcggcgaagu

SEQ ID NO: 3490413 - RNA, 15 nt, Pseudomonas aeruginosa PA01
ggcggaaggucaggu

SEQ ID NO: 3490414 - RNA, 19 nt, Pseudomonas aeruginosa PA01
ggcggacaacccggcgcug

SEQ ID NO: 3490415 - RNA, 20 nt, Pseudomonas aeruginosa PA01
ggcggacaacccggcgcugg

SEQ ID NO: 3490416 - RNA, 21 nt, Pseudomonas aeruginosa PA01
ggcggacaacccggcgcuggc

SEQ ID NO: 3490417 - RNA, 22 nt, Pseudomonas aeruginosa PA01
ggcggacaacccggcgcuggcc

SEQ ID NO: 3490418 - RNA, 17 nt, Pseudomonas aeruginosa PA01
ggcggacacgcaggcgc

SEQ ID NO: 3490419 - RNA, 19 nt, Pseudomonas aeruginosa PA01
ggcggacagcccgcgcucg

SEQ ID NO: 3490420 - RNA, 20 nt, Pseudomonas aeruginosa PA01
ggcggacagcccgcgcucgg

SEQ ID NO: 3490421 - RNA, 17 nt, Pseudomonas aeruginosa PA01
ggcggacagcggaaacg

SEQ ID NO: 3490422 - RNA, 14 nt, Pseudomonas aeruginosa PA01
ggcggacaggcagc

SEQ ID NO: 3490423 - RNA, 16 nt, Pseudomonas aeruginosa PA01
ggcggacaggcagccg

SEQ ID NO: 3490424 - RNA, 17 nt, Pseudomonas aeruginosa PA01
ggcggacaggcagccgg

SEQ ID NO: 3490425 - RNA, 16 nt, Pseudomonas aeruginosa PA01
ggcggacauguugcag

SEQ ID NO: 3490426 - RNA, 19 nt, Pseudomonas aeruginosa PA01
ggcggaccuccgccagguc

SEQ ID NO: 3490427 - RNA, 16 nt, Pseudomonas aeruginosa PA01
ggcggacgcaggccga

SEQ ID NO: 3490428 - RNA, 14 nt, Pseudomonas aeruginosa PA01
ggcggacgcugggc

SEQ ID NO: 3490429 - RNA, 18 nt, Pseudomonas aeruginosa PA01
ggcggacgcugggcuggg

SEQ ID NO: 3490430 - RNA, 23 nt, Pseudomonas aeruginosa PA01
ggcggacgcugggcugggucggc

SEQ ID NO: 3490431 - RNA, 22 nt, Pseudomonas aeruginosa PA01
ggcggacugcucgccgccggcg

SEQ ID NO: 3490432 - RNA, 23 nt, Pseudomonas aeruginosa PA01
ggcggacugguaggacagggcca

SEQ ID NO: 3490433 - RNA, 15 nt, Pseudomonas aeruginosa PA01
ggcggagaagccgcu

SEQ ID NO: 3490434 - RNA, 15 nt, Pseudomonas aeruginosa PA01
ggcggagcagccuca

SEQ ID NO: 3490435 - RNA, 23 nt, Pseudomonas aeruginosa PA01
ggcggaggccuacuucucgacga

SEQ ID NO: 3490436 - RNA, 12 nt, Pseudomonas aeruginosa PA01
ggcggaggcgag

SEQ ID NO: 3490437 - RNA, 14 nt, Pseudomonas aeruginosa PA01
ggcggaggcgaggu

SEQ ID NO: 3490438 - RNA, 16 nt, Pseudomonas aeruginosa PA01
ggcggaggcgaggucg

SEQ ID NO: 3490439 - RNA, 19 nt, Pseudomonas aeruginosa PA01
ggcggaggcgaggucgccg

SEQ ID NO: 3490440 - RNA, 13 nt, Pseudomonas aeruginosa PA01
ggcggaguagccg

SEQ ID NO: 3490441 - RNA, 19 nt, Pseudomonas aeruginosa PA01
ggcggaguagccggcggcg

SEQ ID NO: 3490442 - RNA, 18 nt, Pseudomonas aeruginosa PA01
ggcggagucguagcgcau

SEQ ID NO: 3490443 - RNA, 19 nt, Pseudomonas aeruginosa PA01
ggcggauaaccgcgagcgg

SEQ ID NO: 3490444 - RNA, 20 nt, Pseudomonas aeruginosa PA01
ggcggauaaccgcguugcgg

SEQ ID NO: 3490445 - RNA, 13 nt, Pseudomonas aeruginosa PA01
ggcggauaacgcc

SEQ ID NO: 3490446 - RNA, 16 nt, Pseudomonas aeruginosa PA01
ggcggauaacgcccgc

SEQ ID NO: 3490447 - RNA, 19 nt, Pseudomonas aeruginosa PA01
ggcggauaacgcccgcggc

SEQ ID NO: 3490448 - RNA, 20 nt, Pseudomonas aeruginosa PA01
ggcggauaacgcccgcggcg

SEQ ID NO: 3490449 - RNA, 17 nt, Pseudomonas aeruginosa PA01
ggcggauaacgccgcug

SEQ ID NO: 3490450 - RNA, 20 nt, Pseudomonas aeruginosa PA01
ggcggauaacgccgcuggcg

SEQ ID NO: 3490451 - RNA, 20 nt, Pseudomonas aeruginosa PA01
ggcggauaacgccgguggcg

SEQ ID NO: 3490452 - RNA, 20 nt, Pseudomonas aeruginosa PA01
ggcggauaacgccguuggcg

SEQ ID NO: 3490453 - RNA, 16 nt, Pseudomonas aeruginosa PA01
ggcggauaacgccugc

SEQ ID NO: 3490454 - RNA, 19 nt, Pseudomonas aeruginosa PA01
ggcggauaacgccuguggc

SEQ ID NO: 3490455 - RNA, 20 nt, Pseudomonas aeruginosa PA01
ggcggauaacgccuguggcg

SEQ ID NO: 3490456 - RNA, 17 nt, Pseudomonas aeruginosa PA01
ggcggauaaucgcagcg

SEQ ID NO: 3490457 - RNA, 23 nt, Pseudomonas aeruginosa PA01
ggcggauaaucgcagcgcgguca

SEQ ID NO: 3490458 - RNA, 20 nt, Pseudomonas aeruginosa PA01
ggcggauacaggcgcagcag

SEQ ID NO: 3490459 - RNA, 21 nt, Pseudomonas aeruginosa PA01
ggcggauacaggcgcagcagc

SEQ ID NO: 3490460 - RNA, 23 nt, Pseudomonas aeruginosa PA01
ggcggauacaggcgcagcagcau

SEQ ID NO: 3490461 - RNA, 17 nt, Pseudomonas aeruginosa PA01
ggcggauagcgcgcagg

SEQ ID NO: 3490462 - RNA, 19 nt, Pseudomonas aeruginosa PA01
ggcggauagcgcgcaggcg

SEQ ID NO: 3490463 - RNA, 20 nt, Pseudomonas aeruginosa PA01
ggcggauagcgcgcaggcgc

SEQ ID NO: 3490464 - RNA, 17 nt, Pseudomonas aeruginosa PA01
ggcggauaucgcgccgc

SEQ ID NO: 3490465 - RNA, 19 nt, Pseudomonas aeruginosa PA01
ggcggauaucgcgugguga

SEQ ID NO: 3490466 - RNA, 16 nt, Pseudomonas aeruginosa PA01
ggcggauaucggccuc

SEQ ID NO: 3490467 - RNA, 14 nt, Pseudomonas aeruginosa PA01
ggcggaucacaggc

SEQ ID NO: 3490468 - RNA, 17 nt, Pseudomonas aeruginosa PA01
ggcggaucaccggcugg

SEQ ID NO: 3490469 - RNA, 20 nt, Pseudomonas aeruginosa PA01
ggcggaucaccggcuggccc

SEQ ID NO: 3490470 - RNA, 21 nt, Pseudomonas aeruginosa PA01
ggcggaucaccggcuggcccu

SEQ ID NO: 3490471 - RNA, 15 nt, Pseudomonas aeruginosa PA01
ggcggaucagcccgc

SEQ ID NO: 3490472 - RNA, 16 nt, Pseudomonas aeruginosa PA01
ggcggaucagcccgcu

SEQ ID NO: 3490473 - RNA, 17 nt, Pseudomonas aeruginosa PA01
ggcggaucagcucgauc

SEQ ID NO: 3490474 - RNA, 18 nt, Pseudomonas aeruginosa PA01
ggcggaucagcucgauca

SEQ ID NO: 3490475 - RNA, 20 nt, Pseudomonas aeruginosa PA01
ggcggaucagcucgaucagc

SEQ ID NO: 3490476 - RNA, 16 nt, Pseudomonas aeruginosa PA01
ggcggaucgagcagcg

SEQ ID NO: 3490477 - RNA, 20 nt, Pseudomonas aeruginosa PA01
ggcggaucgagcagcggcgc

SEQ ID NO: 3490478 - RNA, 21 nt, Pseudomonas aeruginosa PA01
ggcggaucgagcagcggcgcc

SEQ ID NO: 3490479 - RNA, 22 nt, Pseudomonas aeruginosa PA01
ggcggaucgagcagcggcgcca

SEQ ID NO: 3490480 - RNA, 18 nt, Pseudomonas aeruginosa PA01
ggcggaucgaucagcagc

SEQ ID NO: 3490481 - RNA, 19 nt, Pseudomonas aeruginosa PA01
ggcggaucgaucagcagca

SEQ ID NO: 3490482 - RNA, 16 nt, Pseudomonas aeruginosa PA01
ggcggaucgcccggcg

SEQ ID NO: 3490483 - RNA, 18 nt, Pseudomonas aeruginosa PA01
ggcggaucgcccggcgcu

SEQ ID NO: 3490484 - RNA, 14 nt, Pseudomonas aeruginosa PA01
ggcggaucgccgcc

SEQ ID NO: 3490485 - RNA, 14 nt, Pseudomonas aeruginosa PA01
ggcggaucugcucg

SEQ ID NO: 3490486 - RNA, 15 nt, Pseudomonas aeruginosa PA01
ggcggaucugcucga

SEQ ID NO: 3490487 - RNA, 17 nt, Pseudomonas aeruginosa PA01
ggcggaucugcucgacg

SEQ ID NO: 3490488 - RNA, 18 nt, Pseudomonas aeruginosa PA01
ggcggaucugcucgacgu

SEQ ID NO: 3490489 - RNA, 22 nt, Pseudomonas aeruginosa PA01
ggcggaucugcucgacgucguc

SEQ ID NO: 3490490 - RNA, 21 nt, Pseudomonas aeruginosa PA01
ggcggaugaacucgacuucuu

SEQ ID NO: 3490491 - RNA, 18 nt, Pseudomonas aeruginosa PA01
ggcggaugacguucccgu

SEQ ID NO: 3490492 - RNA, 19 nt, Pseudomonas aeruginosa PA01
ggcggaugagccgcugguc

SEQ ID NO: 3490493 - RNA, 20 nt, Pseudomonas aeruginosa PA01
ggcggauguaguccagcgcc

SEQ ID NO: 3490494 - RNA, 21 nt, Pseudomonas aeruginosa PA01
ggcggauguaguccagcgccg

SEQ ID NO: 3490495 - RNA, 22 nt, Pseudomonas aeruginosa PA01
ggcggauguaguccagcgccgc

SEQ ID NO: 3490496 - RNA, 17 nt, Pseudomonas aeruginosa PA01
ggcggauucaggcgcgc

SEQ ID NO: 3490497 - RNA, 18 nt, Pseudomonas aeruginosa PA01
ggcggauucaggcgcgcu

SEQ ID NO: 3490498 - RNA, 19 nt, Pseudomonas aeruginosa PA01
ggcggauucaggcgcgcuc

SEQ ID NO: 3490499 - RNA, 20 nt, Pseudomonas aeruginosa PA01
ggcggauugacgauggccag

SEQ ID NO: 3490500 - RNA, 21 nt, Pseudomonas aeruginosa PA01
ggcggauugacgauggccagc

SEQ ID NO: 3490501 - RNA, 19 nt, Pseudomonas aeruginosa PA01
ggcggauuuccugcggcac

SEQ ID NO: 3490502 - RNA, 20 nt, Pseudomonas aeruginosa PA01
ggcggauuuccugcggcacg

SEQ ID NO: 3490503 - RNA, 15 nt, Pseudomonas aeruginosa PA01
ggcggauuugccgcc

SEQ ID NO: 3490504 - RNA, 19 nt, Pseudomonas aeruginosa PA01
ggcggauuugccgccgagg

SEQ ID NO: 3490505 - RNA, 21 nt, Pseudomonas aeruginosa PA01
ggcggauuugccgccgagggc

SEQ ID NO: 3490506 - RNA, 21 nt, Pseudomonas aeruginosa PA01
ggcggcaacgacgaggccugg

SEQ ID NO: 3490507 - RNA, 22 nt, Pseudomonas aeruginosa PA01
ggcggcaaggcacacgcccggc

SEQ ID NO: 3490508 - RNA, 14 nt, Pseudomonas aeruginosa PA01
ggcggcaagggcac

SEQ ID NO: 3490509 - RNA, 21 nt, Pseudomonas aeruginosa PA01
ggcggcaagggcacgugcagc

SEQ ID NO: 3490510 - RNA, 17 nt, Pseudomonas aeruginosa PA01
ggcggcaccacgugcag

SEQ ID NO: 3490511 - RNA, 20 nt, Pseudomonas aeruginosa PA01
ggcggcaccacgugcagcag

SEQ ID NO: 3490512 - RNA, 22 nt, Pseudomonas aeruginosa PA01
ggcggcacccucuuccgcgcug

SEQ ID NO: 3490513 - RNA, 23 nt, Pseudomonas aeruginosa PA01
ggcggcacgaccacaucggccag

SEQ ID NO: 3490514 - RNA, 15 nt, Pseudomonas aeruginosa PA01
ggcggcacgguggac

SEQ ID NO: 3490515 - RNA, 19 nt, Pseudomonas aeruginosa PA01
ggcggcacuccaggaacca

SEQ ID NO: 3490516 - RNA, 14 nt, Pseudomonas aeruginosa PA01
ggcggcacucggcg

SEQ ID NO: 3490517 - RNA, 15 nt, Pseudomonas aeruginosa PA01
ggcggcacucggcga

SEQ ID NO: 3490518 - RNA, 17 nt, Pseudomonas aeruginosa PA01
ggcggcacucggcgacc

SEQ ID NO: 3490519 - RNA, 13 nt, Pseudomonas aeruginosa PA01
ggcggcagccgcg

SEQ ID NO: 3490520 - RNA, 18 nt, Pseudomonas aeruginosa PA01
ggcggcagccgcggcugu

SEQ ID NO: 3490521 - RNA, 16 nt, Pseudomonas aeruginosa PA01
ggcggcagcugcggcg

SEQ ID NO: 3490522 - RNA, 20 nt, Pseudomonas aeruginosa PA01
ggcggcagcugcggcggcac

SEQ ID NO: 3490523 - RNA, 21 nt, Pseudomonas aeruginosa PA01
ggcggcagcugcggcggcacc

SEQ ID NO: 3490524 - RNA, 13 nt, Pseudomonas aeruginosa PA01
ggcggcaggccga

SEQ ID NO: 3490525 - RNA, 13 nt, Pseudomonas aeruginosa PA01
ggcggcaggcugc

SEQ ID NO: 3490526 - RNA, 15 nt, Pseudomonas aeruginosa PA01
ggcggcaggcugcgc

SEQ ID NO: 3490527 - RNA, 22 nt, Pseudomonas aeruginosa PA01
ggcggcaggcugcgccgcugcg

SEQ ID NO: 3490528 - RNA, 14 nt, Pseudomonas aeruginosa PA01
ggcggcaggucgga

SEQ ID NO: 3490529 - RNA, 17 nt, Pseudomonas aeruginosa PA01
ggcggcauaggcccggc

SEQ ID NO: 3490530 - RNA, 14 nt, Pseudomonas aeruginosa PA01
ggcggcaucgcgua

SEQ ID NO: 3490531 - RNA, 14 nt, Pseudomonas aeruginosa PA01
ggcggcaucggcgc

SEQ ID NO: 3490532 - RNA, 15 nt, Pseudomonas aeruginosa PA01
ggcggcaucggcgcc

SEQ ID NO: 3490533 - RNA, 16 nt, Pseudomonas aeruginosa PA01
ggcggcaucggcgccg

SEQ ID NO: 3490534 - RNA, 17 nt, Pseudomonas aeruginosa PA01
ggcggcaucggcgccgc

SEQ ID NO: 3490535 - RNA, 20 nt, Pseudomonas aeruginosa PA01
ggcggcaucggcgccgcgca

SEQ ID NO: 3490536 - RNA, 21 nt, Pseudomonas aeruginosa PA01
ggcggcaugccguugggccag

SEQ ID NO: 3490537 - RNA, 13 nt, Pseudomonas aeruginosa PA01
ggcggcaugggca

SEQ ID NO: 3490538 - RNA, 17 nt, Pseudomonas aeruginosa PA01
ggcggcauugagcgcca

SEQ ID NO: 3490539 - RNA, 20 nt, Pseudomonas aeruginosa PA01
ggcggcauugagcgccagca

SEQ ID NO: 3490540 - RNA, 17 nt, Pseudomonas aeruginosa PA01
ggcggccaaccucuccc

SEQ ID NO: 3490541 - RNA, 22 nt, Pseudomonas aeruginosa PA01
ggcggccaaccucuccccagac

SEQ ID NO: 3490542 - RNA, 23 nt, Pseudomonas aeruginosa PA01
ggcggccaccaccgugaccagca

SEQ ID NO: 3490543 - RNA, 13 nt, Pseudomonas aeruginosa PA01
ggcggccacccga

SEQ ID NO: 3490544 - RNA, 15 nt, Pseudomonas aeruginosa PA01
ggcggccacccgaag

SEQ ID NO: 3490545 - RNA, 13 nt, Pseudomonas aeruginosa PA01
ggcggccagcagc

SEQ ID NO: 3490546 - RNA, 15 nt, Pseudomonas aeruginosa PA01
ggcggccagcagcac

SEQ ID NO: 3490547 - RNA, 16 nt, Pseudomonas aeruginosa PA01
ggcggccagcagcacg

SEQ ID NO: 3490548 - RNA, 16 nt, Pseudomonas aeruginosa PA01
ggcggccagccuuccu

SEQ ID NO: 3490549 - RNA, 12 nt, Pseudomonas aeruginosa PA01
ggcggccagcgg

SEQ ID NO: 3490550 - RNA, 21 nt, Pseudomonas aeruginosa PA01
ggcggccagcggaugcuggcg

SEQ ID NO: 3490551 - RNA, 23 nt, Pseudomonas aeruginosa PA01
ggcggccagcggaugcuggcgga

SEQ ID NO: 3490552 - RNA, 12 nt, Pseudomonas aeruginosa PA01
ggcggccaggcg

SEQ ID NO: 3490553 - RNA, 13 nt, Pseudomonas aeruginosa PA01
ggcggccaggcgc

SEQ ID NO: 3490554 - RNA, 14 nt, Pseudomonas aeruginosa PA01
ggcggccaggcgcu

SEQ ID NO: 3490555 - RNA, 15 nt, Pseudomonas aeruginosa PA01
ggcggccaggcgcuc

SEQ ID NO: 3490556 - RNA, 16 nt, Pseudomonas aeruginosa PA01
ggcggccaggcgcucg

SEQ ID NO: 3490557 - RNA, 12 nt, Pseudomonas aeruginosa PA01
ggcggccagggc

SEQ ID NO: 3490558 - RNA, 17 nt, Pseudomonas aeruginosa PA01
ggcggccaucaggcgcu

SEQ ID NO: 3490559 - RNA, 14 nt, Pseudomonas aeruginosa PA01
ggcggccauugccg

SEQ ID NO: 3490560 - RNA, 18 nt, Pseudomonas aeruginosa PA01
ggcggccauugccgcggg

SEQ ID NO: 3490561 - RNA, 22 nt, Pseudomonas aeruginosa PA01
ggcggcccaugcggaucgccuc

SEQ ID NO: 3490562 - RNA, 21 nt, Pseudomonas aeruginosa PA01
ggcggccccuucagcuccagc

SEQ ID NO: 3490563 - RNA, 22 nt, Pseudomonas aeruginosa PA01
ggcggccccuucagcuccagca

SEQ ID NO: 3490564 - RNA, 15 nt, Pseudomonas aeruginosa PA01
ggcggccgaacugga

SEQ ID NO: 3490565 - RNA, 21 nt, Pseudomonas aeruginosa PA01
ggcggccgaagaacaccacgc

SEQ ID NO: 3490566 - RNA, 20 nt, Pseudomonas aeruginosa PA01
ggcggccgaauccuccagcc

SEQ ID NO: 3490567 - RNA, 23 nt, Pseudomonas aeruginosa PA01
ggcggccgaauccuccagccggc

SEQ ID NO: 3490568 - RNA, 14 nt, Pseudomonas aeruginosa PA01
ggcggccgacgugc

SEQ ID NO: 3490569 - RNA, 22 nt, Pseudomonas aeruginosa PA01
ggcggccgacgugcacccgcug

SEQ ID NO: 3490570 - RNA, 13 nt, Pseudomonas aeruginosa PA01
ggcggccgagggc

SEQ ID NO: 3490571 - RNA, 14 nt, Pseudomonas aeruginosa PA01
ggcggccgagggcg

SEQ ID NO: 3490572 - RNA, 24 nt, Pseudomonas aeruginosa PA01
ggcggccgaguucgcgcaggcgcu

SEQ ID NO: 3490573 - RNA, 12 nt, Pseudomonas aeruginosa PA01
ggcggccgcaug

SEQ ID NO: 3490574 - RNA, 15 nt, Pseudomonas aeruginosa PA01
ggcggccgcaugccg

SEQ ID NO: 3490575 - RNA, 15 nt, Pseudomonas aeruginosa PA01
ggcggccgccgagca

SEQ ID NO: 3490576 - RNA, 13 nt, Pseudomonas aeruginosa PA01
ggcggccgccggc

SEQ ID NO: 3490577 - RNA, 14 nt, Pseudomonas aeruginosa PA01
ggcggccgccggcg

SEQ ID NO: 3490578 - RNA, 16 nt, Pseudomonas aeruginosa PA01
ggcggccgccggcgcc

SEQ ID NO: 3490579 - RNA, 12 nt, Pseudomonas aeruginosa PA01
ggcggccgccuc

SEQ ID NO: 3490580 - RNA, 22 nt, Pseudomonas aeruginosa PA01
ggcggccgccuugaccugcugg

SEQ ID NO: 3490581 - RNA, 14 nt, Pseudomonas aeruginosa PA01
ggcggccgcuggcg

SEQ ID NO: 3490582 - RNA, 15 nt, Pseudomonas aeruginosa PA01
ggcggccgcuggcga

SEQ ID NO: 3490583 - RNA, 14 nt, Pseudomonas aeruginosa PA01
ggcggccggauggc

SEQ ID NO: 3490584 - RNA, 22 nt, Pseudomonas aeruginosa PA01
ggcggccggauggccgccguuc

SEQ ID NO: 3490585 - RNA, 14 nt, Pseudomonas aeruginosa PA01
ggcggccggcgcgg

SEQ ID NO: 3490586 - RNA, 15 nt, Pseudomonas aeruginosa PA01
ggcggccggcgcgga

SEQ ID NO: 3490587 - RNA, 17 nt, Pseudomonas aeruginosa PA01
ggcggccgggucgaggu

SEQ ID NO: 3490588 - RNA, 19 nt, Pseudomonas aeruginosa PA01
ggcggccgggucgaggucg

SEQ ID NO: 3490589 - RNA, 13 nt, Pseudomonas aeruginosa PA01
ggcggccggugcc

SEQ ID NO: 3490590 - RNA, 12 nt, Pseudomonas aeruginosa PA01
ggcggccgucgc

SEQ ID NO: 3490591 - RNA, 17 nt, Pseudomonas aeruginosa PA01
ggcggccgucggccugg

SEQ ID NO: 3490592 - RNA, 19 nt, Pseudomonas aeruginosa PA01
ggcggccgucggccuggcg

SEQ ID NO: 3490593 - RNA, 18 nt, Pseudomonas aeruginosa PA01
ggcggccucgaggucggc

SEQ ID NO: 3490594 - RNA, 16 nt, Pseudomonas aeruginosa PA01
ggcggccucggccucg

SEQ ID NO: 3490595 - RNA, 20 nt, Pseudomonas aeruginosa PA01
ggcggccucggccucgucga

SEQ ID NO: 3490596 - RNA, 14 nt, Pseudomonas aeruginosa PA01
ggcggccucguagg

SEQ ID NO: 3490597 - RNA, 18 nt, Pseudomonas aeruginosa PA01
ggcggccugagccggccg

SEQ ID NO: 3490598 - RNA, 15 nt, Pseudomonas aeruginosa PA01
ggcggccugcucgcg

SEQ ID NO: 3490599 - RNA, 22 nt, Pseudomonas aeruginosa PA01
ggcggccugcucgcgcagccag

SEQ ID NO: 3490600 - RNA, 23 nt, Pseudomonas aeruginosa PA01
ggcggccugcucgcgcagccagg

SEQ ID NO: 3490601 - RNA, 14 nt, Pseudomonas aeruginosa PA01
ggcggccuggguga

SEQ ID NO: 3490602 - RNA, 12 nt, Pseudomonas aeruginosa PA01
ggcggccuggua

SEQ ID NO: 3490603 - RNA, 22 nt, Pseudomonas aeruginosa PA01
ggcggccugguagucgccgguc

SEQ ID NO: 3490604 - RNA, 15 nt, Pseudomonas aeruginosa PA01
ggcggccuucggcgu

SEQ ID NO: 3490605 - RNA, 17 nt, Pseudomonas aeruginosa PA01
ggcggccuucggcgucg

SEQ ID NO: 3490606 - RNA, 21 nt, Pseudomonas aeruginosa PA01
ggcggccuuuucggcggccag

SEQ ID NO: 3490607 - RNA, 17 nt, Pseudomonas aeruginosa PA01
ggcggcgaacggaccga

SEQ ID NO: 3490608 - RNA, 13 nt, Pseudomonas aeruginosa PA01
ggcggcgaaggcc

SEQ ID NO: 3490609 - RNA, 16 nt, Pseudomonas aeruginosa PA01
ggcggcgaaggccgcu

SEQ ID NO: 3490610 - RNA, 16 nt, Pseudomonas aeruginosa PA01
ggcggcgaagucugcc

SEQ ID NO: 3490611 - RNA, 19 nt, Pseudomonas aeruginosa PA01
ggcggcgaagucugccugu

SEQ ID NO: 3490612 - RNA, 21 nt, Pseudomonas aeruginosa PA01
ggcggcgaccauccagccugc

SEQ ID NO: 3490613 - RNA, 14 nt, Pseudomonas aeruginosa PA01
ggcggcgacccaga

SEQ ID NO: 3490614 - RNA, 20 nt, Pseudomonas aeruginosa PA01
ggcggcgacccagaccugcc

SEQ ID NO: 3490615 - RNA, 16 nt, Pseudomonas aeruginosa PA01
ggcggcgaccccgauc

SEQ ID NO: 3490616 - RNA, 20 nt, Pseudomonas aeruginosa PA01
ggcggcgaccgaacagcgcg

SEQ ID NO: 3490617 - RNA, 19 nt, Pseudomonas aeruginosa PA01
ggcggcgaccugcggcaag

SEQ ID NO: 3490618 - RNA, 20 nt, Pseudomonas aeruginosa PA01
ggcggcgacgaagcccaggc

SEQ ID NO: 3490619 - RNA, 16 nt, Pseudomonas aeruginosa PA01
ggcggcgacgcuggcg

SEQ ID NO: 3490620 - RNA, 14 nt, Pseudomonas aeruginosa PA01
ggcggcgagcgccg

SEQ ID NO: 3490621 - RNA, 15 nt, Pseudomonas aeruginosa PA01
ggcggcgagcggguc

SEQ ID NO: 3490622 - RNA, 23 nt, Pseudomonas aeruginosa PA01
ggcggcgagcguucggaucggcc

SEQ ID NO: 3490623 - RNA, 16 nt, Pseudomonas aeruginosa PA01
ggcggcgagcuggauc

SEQ ID NO: 3490624 - RNA, 18 nt, Pseudomonas aeruginosa PA01
ggcggcgagcuggaucgg

SEQ ID NO: 3490625 - RNA, 21 nt, Pseudomonas aeruginosa PA01
ggcggcgagcuggaucggcag

SEQ ID NO: 3490626 - RNA, 16 nt, Pseudomonas aeruginosa PA01
ggcggcgaggccgacc

SEQ ID NO: 3490627 - RNA, 15 nt, Pseudomonas aeruginosa PA01
ggcggcgauggacuc

SEQ ID NO: 3490628 - RNA, 13 nt, Pseudomonas aeruginosa PA01
ggcggcgcagacg

SEQ ID NO: 3490629 - RNA, 10 nt, Pseudomonas aeruginosa PA01
ggcggcgcca

SEQ ID NO: 3490630 - RNA, 12 nt, Pseudomonas aeruginosa PA01
ggcggcgccagg

SEQ ID NO: 3490631 - RNA, 18 nt, Pseudomonas aeruginosa PA01
ggcggcgccaggccggcg

SEQ ID NO: 3490632 - RNA, 19 nt, Pseudomonas aeruginosa PA01
ggcggcgccaggccggcga

SEQ ID NO: 3490633 - RNA, 12 nt, Pseudomonas aeruginosa PA01
ggcggcgccgaa

SEQ ID NO: 3490634 - RNA, 23 nt, Pseudomonas aeruginosa PA01
ggcggcgccgaacagggcgagca

SEQ ID NO: 3490635 - RNA, 15 nt, Pseudomonas aeruginosa PA01
ggcggcgccggcagg

SEQ ID NO: 3490636 - RNA, 22 nt, Pseudomonas aeruginosa PA01
ggcggcgccggugaggcgcagc

SEQ ID NO: 3490637 - RNA, 18 nt, Pseudomonas aeruginosa PA01
ggcggcgccuucgccgga

SEQ ID NO: 3490638 - RNA, 19 nt, Pseudomonas aeruginosa PA01
ggcggcgccuucgccggaa

SEQ ID NO: 3490639 - RNA, 18 nt, Pseudomonas aeruginosa PA01
ggcggcgccuugcggucc

SEQ ID NO: 3490640 - RNA, 13 nt, Pseudomonas aeruginosa PA01
ggcggcgcgaacc

SEQ ID NO: 3490641 - RNA, 20 nt, Pseudomonas aeruginosa PA01
ggcggcgcgaaccagcagca

SEQ ID NO: 3490642 - RNA, 14 nt, Pseudomonas aeruginosa PA01
ggcggcgcgcagcg

SEQ ID NO: 3490643 - RNA, 13 nt, Pseudomonas aeruginosa PA01
ggcggcgcgcugc

SEQ ID NO: 3490644 - RNA, 14 nt, Pseudomonas aeruginosa PA01
ggcggcgcgcugcg

SEQ ID NO: 3490645 - RNA, 13 nt, Pseudomonas aeruginosa PA01
ggcggcgcggcag

SEQ ID NO: 3490646 - RNA, 14 nt, Pseudomonas aeruginosa PA01
ggcggcgcggcggg

SEQ ID NO: 3490647 - RNA, 18 nt, Pseudomonas aeruginosa PA01
ggcggcgcggcggguggc

SEQ ID NO: 3490648 - RNA, 19 nt, Pseudomonas aeruginosa PA01
ggcggcgcggcggguggcg

SEQ ID NO: 3490649 - RNA, 16 nt, Pseudomonas aeruginosa PA01
ggcggcgcgggcgcgc

SEQ ID NO: 3490650 - RNA, 16 nt, Pseudomonas aeruginosa PA01
ggcggcgcguccaccu

SEQ ID NO: 3490651 - RNA, 20 nt, Pseudomonas aeruginosa PA01
ggcggcgcguuccacguccu

SEQ ID NO: 3490652 - RNA, 21 nt, Pseudomonas aeruginosa PA01
ggcggcgcuauccgccgcuac

SEQ ID NO: 3490653 - RNA, 14 nt, Pseudomonas aeruginosa PA01
ggcggcggaccucc

SEQ ID NO: 3490654 - RNA, 19 nt, Pseudomonas aeruginosa PA01
ggcggcggaccuccgccag

SEQ ID NO: 3490655 - RNA, 20 nt, Pseudomonas aeruginosa PA01
ggcggcggaccuccgccagg

SEQ ID NO: 3490656 - RNA, 14 nt, Pseudomonas aeruginosa PA01
ggcggcggacgcag

SEQ ID NO: 3490657 - RNA, 13 nt, Pseudomonas aeruginosa PA01
ggcggcggagucg

SEQ ID NO: 3490658 - RNA, 23 nt, Pseudomonas aeruginosa PA01
ggcggcggagucguagcgcaugc

SEQ ID NO: 3490659 - RNA, 15 nt, Pseudomonas aeruginosa PA01
ggcggcggauaaccg

SEQ ID NO: 3490660 - RNA, 17 nt, Pseudomonas aeruginosa PA01
ggcggcggauaacgccu

SEQ ID NO: 3490661 - RNA, 13 nt, Pseudomonas aeruginosa PA01
ggcggcggccagc

SEQ ID NO: 3490662 - RNA, 14 nt, Pseudomonas aeruginosa PA01
ggcggcggccagca

SEQ ID NO: 3490663 - RNA, 14 nt, Pseudomonas aeruginosa PA01
ggcggcggcccgca

SEQ ID NO: 3490664 - RNA, 18 nt, Pseudomonas aeruginosa PA01
ggcggcggcccgcacagg

SEQ ID NO: 3490665 - RNA, 15 nt, Pseudomonas aeruginosa PA01
ggcggcggccgcaug

SEQ ID NO: 3490666 - RNA, 13 nt, Pseudomonas aeruginosa PA01
ggcggcggccugc

SEQ ID NO: 3490667 - RNA, 19 nt, Pseudomonas aeruginosa PA01
ggcggcggcuaccagcgcu

SEQ ID NO: 3490668 - RNA, 14 nt, Pseudomonas aeruginosa PA01
ggcggcgggccggc

SEQ ID NO: 3490669 - RNA, 16 nt, Pseudomonas aeruginosa PA01
ggcggcgggccggcgu

SEQ ID NO: 3490670 - RNA, 18 nt, Pseudomonas aeruginosa PA01
ggcggcgggccggcgucc

SEQ ID NO: 3490671 - RNA, 20 nt, Pseudomonas aeruginosa PA01
ggcggcgggccggcguccag

SEQ ID NO: 3490672 - RNA, 18 nt, Pseudomonas aeruginosa PA01
ggcggcggggaaggcguc

SEQ ID NO: 3490673 - RNA, 18 nt, Pseudomonas aeruginosa PA01
ggcggcgguagccgaggc

SEQ ID NO: 3490674 - RNA, 19 nt, Pseudomonas aeruginosa PA01
ggcggcggucgcgaucugc

SEQ ID NO: 3490675 - RNA, 15 nt, Pseudomonas aeruginosa PA01
ggcggcgguucgccg

SEQ ID NO: 3490676 - RNA, 18 nt, Pseudomonas aeruginosa PA01
ggcggcgguucgccgagc

SEQ ID NO: 3490677 - RNA, 19 nt, Pseudomonas aeruginosa PA01
ggcggcgguucgccgagcg

SEQ ID NO: 3490678 - RNA, 22 nt, Pseudomonas aeruginosa PA01
ggcggcgguucgccgagcgccg

SEQ ID NO: 3490679 - RNA, 20 nt, Pseudomonas aeruginosa PA01
ggcggcguauucgccgaaga

SEQ ID NO: 3490680 - RNA, 18 nt, Pseudomonas aeruginosa PA01
ggcggcgucgucgcugcg

SEQ ID NO: 3490681 - RNA, 22 nt, Pseudomonas aeruginosa PA01
ggcggcgucgucgcugcgcggg

SEQ ID NO: 3490682 - RNA, 14 nt, Pseudomonas aeruginosa PA01
ggcggcgugcaggg

SEQ ID NO: 3490683 - RNA, 17 nt, Pseudomonas aeruginosa PA01
ggcggcgugcaggguau

SEQ ID NO: 3490684 - RNA, 21 nt, Pseudomonas aeruginosa PA01
ggcggcguggcucgaucagcc

SEQ ID NO: 3490685 - RNA, 16 nt, Pseudomonas aeruginosa PA01
ggcggcucaggccgcc

SEQ ID NO: 3490686 - RNA, 17 nt, Pseudomonas aeruginosa PA01
ggcggcucaggccgccg

SEQ ID NO: 3490687 - RNA, 21 nt, Pseudomonas aeruginosa PA01
ggcggcucaggccgccgcguc

SEQ ID NO: 3490688 - RNA, 15 nt, Pseudomonas aeruginosa PA01
ggcggcuccggcgcc

SEQ ID NO: 3490689 - RNA, 17 nt, Pseudomonas aeruginosa PA01
ggcggcuccggcgccag

SEQ ID NO: 3490690 - RNA, 17 nt, Pseudomonas aeruginosa PA01
ggcggcucggcuccagg

SEQ ID NO: 3490691 - RNA, 15 nt, Pseudomonas aeruginosa PA01
ggcggcucggcugcu

SEQ ID NO: 3490692 - RNA, 19 nt, Pseudomonas aeruginosa PA01
ggcggcucuuuccggguca

SEQ ID NO: 3490693 - RNA, 16 nt, Pseudomonas aeruginosa PA01
ggcggcuggccgagga

SEQ ID NO: 3490694 - RNA, 13 nt, Pseudomonas aeruginosa PA01
ggcggcuggcgcg

SEQ ID NO: 3490695 - RNA, 16 nt, Pseudomonas aeruginosa PA01
ggcggcuggcgcgauc

SEQ ID NO: 3490696 - RNA, 14 nt, Pseudomonas aeruginosa PA01
ggcggcuggcgugg

SEQ ID NO: 3490697 - RNA, 15 nt, Pseudomonas aeruginosa PA01
ggcggcuggcguggg

SEQ ID NO: 3490698 - RNA, 16 nt, Pseudomonas aeruginosa PA01
ggcggcugggcugcgg

SEQ ID NO: 3490699 - RNA, 21 nt, Pseudomonas aeruginosa PA01
ggcggcuguagcggaucaggc

SEQ ID NO: 3490700 - RNA, 12 nt, Pseudomonas aeruginosa PA01
ggcggcuguugc

SEQ ID NO: 3490701 - RNA, 15 nt, Pseudomonas aeruginosa PA01
ggcggcuguugccgu

SEQ ID NO: 3490702 - RNA, 23 nt, Pseudomonas aeruginosa PA01
ggcggcuucagccagaccggcag

SEQ ID NO: 3490703 - RNA, 15 nt, Pseudomonas aeruginosa PA01
ggcggcuuccuccau

SEQ ID NO: 3490704 - RNA, 20 nt, Pseudomonas aeruginosa PA01
ggcggcuucgcgcuccaggc

SEQ ID NO: 3490705 - RNA, 23 nt, Pseudomonas aeruginosa PA01
ggcggcuuuuucauuucuucggg

SEQ ID NO: 3490706 - RNA, 21 nt, Pseudomonas aeruginosa PA01
ggcggcuuuuuucauggcggu

SEQ ID NO: 3490707 - RNA, 18 nt, Pseudomonas aeruginosa PA01
ggcgggaaacgcagcgac

SEQ ID NO: 3490708 - RNA, 17 nt, Pseudomonas aeruginosa PA01
ggcgggagagggcggcg

SEQ ID NO: 3490709 - RNA, 20 nt, Pseudomonas aeruginosa PA01
ggcgggagagggcggcgacc

SEQ ID NO: 3490710 - RNA, 22 nt, Pseudomonas aeruginosa PA01
ggcgggagagggcggcgaccgg

SEQ ID NO: 3490711 - RNA, 14 nt, Pseudomonas aeruginosa PA01
ggcgggaggucaca

SEQ ID NO: 3490712 - RNA, 14 nt, Pseudomonas aeruginosa PA01
ggcgggaucgacgc

SEQ ID NO: 3490713 - RNA, 18 nt, Pseudomonas aeruginosa PA01
ggcgggaucgacgccgcu

SEQ ID NO: 3490714 - RNA, 19 nt, Pseudomonas aeruginosa PA01
ggcgggaucgacgccgcug

SEQ ID NO: 3490715 - RNA, 23 nt, Pseudomonas aeruginosa PA01
ggcgggaucgaguaagugccgac

SEQ ID NO: 3490716 - RNA, 21 nt, Pseudomonas aeruginosa PA01
ggcgggaucuucuaccuggcg

SEQ ID NO: 3490717 - RNA, 23 nt, Pseudomonas aeruginosa PA01
ggcgggaucuucuaccuggcgcu

SEQ ID NO: 3490718 - RNA, 18 nt, Pseudomonas aeruginosa PA01
ggcgggauugucgccgcc

SEQ ID NO: 3490719 - RNA, 23 nt, Pseudomonas aeruginosa PA01
ggcgggauugucgccgccgagua

SEQ ID NO: 3490720 - RNA, 15 nt, Pseudomonas aeruginosa PA01
ggcgggcaccgccag

SEQ ID NO: 3490721 - RNA, 14 nt, Pseudomonas aeruginosa PA01
ggcgggccagcagg

SEQ ID NO: 3490722 - RNA, 15 nt, Pseudomonas aeruginosa PA01
ggcgggccagcaggc

SEQ ID NO: 3490723 - RNA, 18 nt, Pseudomonas aeruginosa PA01
ggcgggccagcaggcgcu

SEQ ID NO: 3490724 - RNA, 20 nt, Pseudomonas aeruginosa PA01
ggcgggccagcaggcgcucg

SEQ ID NO: 3490725 - RNA, 22 nt, Pseudomonas aeruginosa PA01
ggcgggccagcaggguggccag

SEQ ID NO: 3490726 - RNA, 15 nt, Pseudomonas aeruginosa PA01
ggcgggccagcuggc

SEQ ID NO: 3490727 - RNA, 16 nt, Pseudomonas aeruginosa PA01
ggcgggccagcuggcg

SEQ ID NO: 3490728 - RNA, 17 nt, Pseudomonas aeruginosa PA01
ggcgggccagcuggcga

SEQ ID NO: 3490729 - RNA, 15 nt, Pseudomonas aeruginosa PA01
ggcgggccaugcgcu

SEQ ID NO: 3490730 - RNA, 23 nt, Pseudomonas aeruginosa PA01
ggcgggccaugcgcucggggucg

SEQ ID NO: 3490731 - RNA, 17 nt, Pseudomonas aeruginosa PA01
ggcgggccauugcaggu

SEQ ID NO: 3490732 - RNA, 12 nt, Pseudomonas aeruginosa PA01
ggcgggccgcgc

SEQ ID NO: 3490733 - RNA, 19 nt, Pseudomonas aeruginosa PA01
ggcgggccgcgccuuucgc

SEQ ID NO: 3490734 - RNA, 15 nt, Pseudomonas aeruginosa PA01
ggcgggccgcucagg

SEQ ID NO: 3490735 - RNA, 13 nt, Pseudomonas aeruginosa PA01
ggcgggccgcucg

SEQ ID NO: 3490736 - RNA, 17 nt, Pseudomonas aeruginosa PA01
ggcgggccgcucgcgcg

SEQ ID NO: 3490737 - RNA, 13 nt, Pseudomonas aeruginosa PA01
ggcgggcgcccgc

SEQ ID NO: 3490738 - RNA, 12 nt, Pseudomonas aeruginosa PA01
ggcgggcgcgga

SEQ ID NO: 3490739 - RNA, 12 nt, Pseudomonas aeruginosa PA01
ggcgggcggccc

SEQ ID NO: 3490740 - RNA, 15 nt, Pseudomonas aeruginosa PA01
ggcgggcggcgucga

SEQ ID NO: 3490741 - RNA, 14 nt, Pseudomonas aeruginosa PA01
ggcgggcgucggcg

SEQ ID NO: 3490742 - RNA, 12 nt, Pseudomonas aeruginosa PA01
ggcgggcuccgc

SEQ ID NO: 3490743 - RNA, 17 nt, Pseudomonas aeruginosa PA01
ggcgggcuccgccgccg

SEQ ID NO: 3490744 - RNA, 23 nt, Pseudomonas aeruginosa PA01
ggcgggcuccgccgccgugaucu

SEQ ID NO: 3490745 - RNA, 21 nt, Pseudomonas aeruginosa PA01
ggcgggcucgcaaucagcgcg

SEQ ID NO: 3490746 - RNA, 13 nt, Pseudomonas aeruginosa PA01
ggcgggcucgccc

SEQ ID NO: 3490747 - RNA, 14 nt, Pseudomonas aeruginosa PA01
ggcgggcucgccca

SEQ ID NO: 3490748 - RNA, 15 nt, Pseudomonas aeruginosa PA01
ggcgggcucgcccau

SEQ ID NO: 3490749 - RNA, 19 nt, Pseudomonas aeruginosa PA01
ggcgggcucuaugcgcggg

SEQ ID NO: 3490750 - RNA, 16 nt, Pseudomonas aeruginosa PA01
ggcgggcugccgcgga

SEQ ID NO: 3490751 - RNA, 16 nt, Pseudomonas aeruginosa PA01
ggcgggcuggaaaacg

SEQ ID NO: 3490752 - RNA, 13 nt, Pseudomonas aeruginosa PA01
ggcggggaacagc

SEQ ID NO: 3490753 - RNA, 21 nt, Pseudomonas aeruginosa PA01
ggcggggccaucagugccugc

SEQ ID NO: 3490754 - RNA, 17 nt, Pseudomonas aeruginosa PA01
ggcggggcgcagcagga

SEQ ID NO: 3490755 - RNA, 21 nt, Pseudomonas aeruginosa PA01
ggcggggcguauagcccgggu

SEQ ID NO: 3490756 - RNA, 21 nt, Pseudomonas aeruginosa PA01
ggcggggucgcgccgguggcg

SEQ ID NO: 3490757 - RNA, 21 nt, Pseudomonas aeruginosa PA01
ggcggguaaagcgcccgcgca

SEQ ID NO: 3490758 - RNA, 22 nt, Pseudomonas aeruginosa PA01
ggcggguaguguuugcgcaggg

SEQ ID NO: 3490759 - RNA, 16 nt, Pseudomonas aeruginosa PA01
ggcggguauccgccgg

SEQ ID NO: 3490760 - RNA, 17 nt, Pseudomonas aeruginosa PA01
ggcgggucacgccgagg

SEQ ID NO: 3490761 - RNA, 21 nt, Pseudomonas aeruginosa PA01
ggcgggucacgccgagggcgc

SEQ ID NO: 3490762 - RNA, 13 nt, Pseudomonas aeruginosa PA01
ggcgggucggcgg

SEQ ID NO: 3490763 - RNA, 21 nt, Pseudomonas aeruginosa PA01
ggcgggugaacucaugcaggc

SEQ ID NO: 3490764 - RNA, 23 nt, Pseudomonas aeruginosa PA01
ggcgggugaacucaugcaggccg

SEQ ID NO: 3490765 - RNA, 16 nt, Pseudomonas aeruginosa PA01
ggcgggugauacggcu

SEQ ID NO: 3490766 - RNA, 12 nt, Pseudomonas aeruginosa PA01
ggcgggugaucu

SEQ ID NO: 3490767 - RNA, 18 nt, Pseudomonas aeruginosa PA01
ggcgggugaucuugaucu

SEQ ID NO: 3490768 - RNA, 16 nt, Pseudomonas aeruginosa PA01
ggcggguucagcccgc

SEQ ID NO: 3490769 - RNA, 22 nt, Pseudomonas aeruginosa PA01
ggcggguucagcccgccgugcg

SEQ ID NO: 3490770 - RNA, 16 nt, Pseudomonas aeruginosa PA01
ggcgguacaggcgcac

SEQ ID NO: 3490771 - RNA, 18 nt, Pseudomonas aeruginosa PA01
ggcgguacauggccuucu

SEQ ID NO: 3490772 - RNA, 19 nt, Pseudomonas aeruginosa PA01
ggcgguacgcccuccagca

SEQ ID NO: 3490773 - RNA, 16 nt, Pseudomonas aeruginosa PA01
ggcgguacgccgcgcu

SEQ ID NO: 3490774 - RNA, 22 nt, Pseudomonas aeruginosa PA01
ggcgguacgccgcgcugcgcca

SEQ ID NO: 3490775 - RNA, 18 nt, Pseudomonas aeruginosa PA01
ggcgguagccgaggcggc

SEQ ID NO: 3490776 - RNA, 21 nt, Pseudomonas aeruginosa PA01
ggcgguagccgaggcggccga

SEQ ID NO: 3490777 - RNA, 14 nt, Pseudomonas aeruginosa PA01
ggcgguagcgccgc

SEQ ID NO: 3490778 - RNA, 15 nt, Pseudomonas aeruginosa PA01
ggcgguagcgccgcg

SEQ ID NO: 3490779 - RNA, 21 nt, Pseudomonas aeruginosa PA01
ggcgguagcgggccagcagcu

SEQ ID NO: 3490780 - RNA, 19 nt, Pseudomonas aeruginosa PA01
ggcgguagcuccaggccga

SEQ ID NO: 3490781 - RNA, 22 nt, Pseudomonas aeruginosa PA01
ggcgguagcuccaggccgaaga

SEQ ID NO: 3490782 - RNA, 23 nt, Pseudomonas aeruginosa PA01
ggcgguagcuccaggccgaagaa

SEQ ID NO: 3490783 - RNA, 17 nt, Pseudomonas aeruginosa PA01
ggcgguaggcguugauc

SEQ ID NO: 3490784 - RNA, 21 nt, Pseudomonas aeruginosa PA01
ggcgguaggugagcgacccgc

SEQ ID NO: 3490785 - RNA, 20 nt, Pseudomonas aeruginosa PA01
ggcgguaguaggguucgccg

SEQ ID NO: 3490786 - RNA, 21 nt, Pseudomonas aeruginosa PA01
ggcgguaguaggguucgccga

SEQ ID NO: 3490787 - RNA, 23 nt, Pseudomonas aeruginosa PA01
ggcgguaguaggguucgccgacg

SEQ ID NO: 3490788 - RNA, 20 nt, Pseudomonas aeruginosa PA01
ggcgguaguguugaagccgc

SEQ ID NO: 3490789 - RNA, 15 nt, Pseudomonas aeruginosa PA01
ggcgguaugccggag

SEQ ID NO: 3490790 - RNA, 20 nt, Pseudomonas aeruginosa PA01
ggcgguaugccggagugccg

SEQ ID NO: 3490791 - RNA, 18 nt, Pseudomonas aeruginosa PA01
ggcggucagcaguugccg

SEQ ID NO: 3490792 - RNA, 12 nt, Pseudomonas aeruginosa PA01
ggcggucagcgc

SEQ ID NO: 3490793 - RNA, 13 nt, Pseudomonas aeruginosa PA01
ggcggucagcgcg

SEQ ID NO: 3490794 - RNA, 14 nt, Pseudomonas aeruginosa PA01
ggcggucaggccaa

SEQ ID NO: 3490795 - RNA, 16 nt, Pseudomonas aeruginosa PA01
ggcggucaggccaagc

SEQ ID NO: 3490796 - RNA, 23 nt, Pseudomonas aeruginosa PA01
ggcggucaggcucagcucggcga

SEQ ID NO: 3490797 - RNA, 11 nt, Pseudomonas aeruginosa PA01
ggcggucaggu

SEQ ID NO: 3490798 - RNA, 17 nt, Pseudomonas aeruginosa PA01
ggcggucaucgcgccgc

SEQ ID NO: 3490799 - RNA, 15 nt, Pseudomonas aeruginosa PA01
ggcggucaugcgccc

SEQ ID NO: 3490800 - RNA, 18 nt, Pseudomonas aeruginosa PA01
ggcggucccagaccagca

SEQ ID NO: 3490801 - RNA, 20 nt, Pseudomonas aeruginosa PA01
ggcggucccagaccagcagc

SEQ ID NO: 3490802 - RNA, 21 nt, Pseudomonas aeruginosa PA01
ggcggucccagaccagcagcg

SEQ ID NO: 3490803 - RNA, 15 nt, Pseudomonas aeruginosa PA01
ggcggucccaucagc

SEQ ID NO: 3490804 - RNA, 19 nt, Pseudomonas aeruginosa PA01
ggcggucccaucagcaguc

SEQ ID NO: 3490805 - RNA, 22 nt, Pseudomonas aeruginosa PA01
ggcggucccuucgugggccugc

SEQ ID NO: 3490806 - RNA, 18 nt, Pseudomonas aeruginosa PA01
ggcgguccgccgcgggac

SEQ ID NO: 3490807 - RNA, 13 nt, Pseudomonas aeruginosa PA01
ggcggucgaggcc

SEQ ID NO: 3490808 - RNA, 15 nt, Pseudomonas aeruginosa PA01
ggcggucgaggcccu

SEQ ID NO: 3490809 - RNA, 17 nt, Pseudomonas aeruginosa PA01
ggcggucgaggcccucg

SEQ ID NO: 3490810 - RNA, 21 nt, Pseudomonas aeruginosa PA01
ggcggucgaggcccucggcgg

SEQ ID NO: 3490811 - RNA, 23 nt, Pseudomonas aeruginosa PA01
ggcggucgaggcccucggcggcg

SEQ ID NO: 3490812 - RNA, 14 nt, Pseudomonas aeruginosa PA01
ggcggucgccgaac

SEQ ID NO: 3490813 - RNA, 13 nt, Pseudomonas aeruginosa PA01
ggcggucgccgcc

SEQ ID NO: 3490814 - RNA, 15 nt, Pseudomonas aeruginosa PA01
ggcggucgccgccgg

SEQ ID NO: 3490815 - RNA, 17 nt, Pseudomonas aeruginosa PA01
ggcggucgccgccggcg

SEQ ID NO: 3490816 - RNA, 16 nt, Pseudomonas aeruginosa PA01
ggcggucgcgaucugc

SEQ ID NO: 3490817 - RNA, 20 nt, Pseudomonas aeruginosa PA01
ggcggucggaaagcagggcg

SEQ ID NO: 3490818 - RNA, 14 nt, Pseudomonas aeruginosa PA01
ggcggucggccagg

SEQ ID NO: 3490819 - RNA, 17 nt, Pseudomonas aeruginosa PA01
ggcggucggccaggcgg

SEQ ID NO: 3490820 - RNA, 20 nt, Pseudomonas aeruginosa PA01
ggcggucggccaggcggccg

SEQ ID NO: 3490821 - RNA, 17 nt, Pseudomonas aeruginosa PA01
ggcggucggccagggga

SEQ ID NO: 3490822 - RNA, 13 nt, Pseudomonas aeruginosa PA01
ggcggucggccau

SEQ ID NO: 3490823 - RNA, 13 nt, Pseudomonas aeruginosa PA01
ggcggucggcuca

SEQ ID NO: 3490824 - RNA, 17 nt, Pseudomonas aeruginosa PA01
ggcggucggcucagccg

SEQ ID NO: 3490825 - RNA, 20 nt, Pseudomonas aeruginosa PA01
ggcggucggcucagccgacc

SEQ ID NO: 3490826 - RNA, 15 nt, Pseudomonas aeruginosa PA01
ggcggucgucgccau

SEQ ID NO: 3490827 - RNA, 22 nt, Pseudomonas aeruginosa PA01
ggcggucgucgccaucgcucac

SEQ ID NO: 3490828 - RNA, 17 nt, Pseudomonas aeruginosa PA01
ggcggucucgaacgcca

SEQ ID NO: 3490829 - RNA, 23 nt, Pseudomonas aeruginosa PA01
ggcggucucgaacgccaggcagg

SEQ ID NO: 3490830 - RNA, 23 nt, Pseudomonas aeruginosa PA01
ggcggucuugaucacguccaggu

SEQ ID NO: 3490831 - RNA, 21 nt, Pseudomonas aeruginosa PA01
ggcggugaccguuucgccgcc

SEQ ID NO: 3490832 - RNA, 22 nt, Pseudomonas aeruginosa PA01
ggcggugaccguuucgccgccg

SEQ ID NO: 3490833 - RNA, 19 nt, Pseudomonas aeruginosa PA01
ggcggugagguugccgccg

SEQ ID NO: 3490834 - RNA, 13 nt, Pseudomonas aeruginosa PA01
ggcggugcagcgg

SEQ ID NO: 3490835 - RNA, 22 nt, Pseudomonas aeruginosa PA01
ggcggugcagcggaagcccugc

SEQ ID NO: 3490836 - RNA, 15 nt, Pseudomonas aeruginosa PA01
ggcggugcgccggcg

SEQ ID NO: 3490837 - RNA, 13 nt, Pseudomonas aeruginosa PA01
ggcggugcggaag

SEQ ID NO: 3490838 - RNA, 13 nt, Pseudomonas aeruginosa PA01
ggcggugcggucg

SEQ ID NO: 3490839 - RNA, 18 nt, Pseudomonas aeruginosa PA01
ggcggugcggucggcgcc

SEQ ID NO: 3490840 - RNA, 13 nt, Pseudomonas aeruginosa PA01
ggcgguggccacg

SEQ ID NO: 3490841 - RNA, 21 nt, Pseudomonas aeruginosa PA01
ggcgguggccgugggccgccg

SEQ ID NO: 3490842 - RNA, 12 nt, Pseudomonas aeruginosa PA01
ggcgguggggcc

SEQ ID NO: 3490843 - RNA, 16 nt, Pseudomonas aeruginosa PA01
ggcgguggggccgccg

SEQ ID NO: 3490844 - RNA, 23 nt, Pseudomonas aeruginosa PA01
ggcgguguagaccaccagcagga

SEQ ID NO: 3490845 - RNA, 16 nt, Pseudomonas aeruginosa PA01
ggcgguuaccaggucu

SEQ ID NO: 3490846 - RNA, 23 nt, Pseudomonas aeruginosa PA01
ggcgguuaccaggucuguggagg

SEQ ID NO: 3490847 - RNA, 15 nt, Pseudomonas aeruginosa PA01
ggcgguucgccgagc

SEQ ID NO: 3490848 - RNA, 19 nt, Pseudomonas aeruginosa PA01
ggcgguucgccgagcgccg

SEQ ID NO: 3490849 - RNA, 17 nt, Pseudomonas aeruginosa PA01
ggcgguucucgucgaug

SEQ ID NO: 3490850 - RNA, 19 nt, Pseudomonas aeruginosa PA01
ggcgguuguucagcgggcg

SEQ ID NO: 3490851 - RNA, 20 nt, Pseudomonas aeruginosa PA01
ggcgguuguucagcgggcgc

SEQ ID NO: 3490852 - RNA, 21 nt, Pseudomonas aeruginosa PA01
ggcgguuguucagcgggcgcu

SEQ ID NO: 3490853 - RNA, 12 nt, Pseudomonas aeruginosa PA01
ggcgguuuccag

SEQ ID NO: 3490854 - RNA, 16 nt, Pseudomonas aeruginosa PA01
ggcgguuucgccgagg

SEQ ID NO: 3490855 - RNA, 23 nt, Pseudomonas aeruginosa PA01
ggcgguuucgucgaagcccaggg

SEQ ID NO: 3490856 - RNA, 17 nt, Pseudomonas aeruginosa PA01
ggcguaacggcucgccg

SEQ ID NO: 3490857 - RNA, 18 nt, Pseudomonas aeruginosa PA01
ggcguaacggcucgccgg

SEQ ID NO: 3490858 - RNA, 18 nt, Pseudomonas aeruginosa PA01
ggcguaacggcuugucgg

SEQ ID NO: 3490859 - RNA, 13 nt, Pseudomonas aeruginosa PA01
ggcguaagcuggg

SEQ ID NO: 3490860 - RNA, 23 nt, Pseudomonas aeruginosa PA01
ggcguaagcuggguaggaucgcu

SEQ ID NO: 3490861 - RNA, 21 nt, Pseudomonas aeruginosa PA01
ggcguaaucgcgccaggccgc

SEQ ID NO: 3490862 - RNA, 16 nt, Pseudomonas aeruginosa PA01
ggcguacaggccccag

SEQ ID NO: 3490863 - RNA, 18 nt, Pseudomonas aeruginosa PA01
ggcguaccucgccaggcu

SEQ ID NO: 3490864 - RNA, 16 nt, Pseudomonas aeruginosa PA01
ggcguaccuucgagca

SEQ ID NO: 3490865 - RNA, 20 nt, Pseudomonas aeruginosa PA01
ggcguacgucgauauugccg

SEQ ID NO: 3490866 - RNA, 15 nt, Pseudomonas aeruginosa PA01
ggcguacuucggcgc

SEQ ID NO: 3490867 - RNA, 17 nt, Pseudomonas aeruginosa PA01
ggcguagaaacgcgccu

SEQ ID NO: 3490868 - RNA, 16 nt, Pseudomonas aeruginosa PA01
ggcguagaccuucucg

SEQ ID NO: 3490869 - RNA, 19 nt, Pseudomonas aeruginosa PA01
ggcguagaccuugcggccg

SEQ ID NO: 3490870 - RNA, 17 nt, Pseudomonas aeruginosa PA01
ggcguagaggcucggcg

SEQ ID NO: 3490871 - RNA, 19 nt, Pseudomonas aeruginosa PA01
ggcguagaggcucggcggc

SEQ ID NO: 3490872 - RNA, 20 nt, Pseudomonas aeruginosa PA01
ggcguagaggcucggcggcc

SEQ ID NO: 3490873 - RNA, 14 nt, Pseudomonas aeruginosa PA01
ggcguagccggcca

SEQ ID NO: 3490874 - RNA, 13 nt, Pseudomonas aeruginosa PA01
ggcguagccggcg

SEQ ID NO: 3490875 - RNA, 14 nt, Pseudomonas aeruginosa PA01
ggcguagccggcga

SEQ ID NO: 3490876 - RNA, 19 nt, Pseudomonas aeruginosa PA01
ggcguagccuuccuucucg

SEQ ID NO: 3490877 - RNA, 14 nt, Pseudomonas aeruginosa PA01
ggcguagcgcaggg

SEQ ID NO: 3490878 - RNA, 17 nt, Pseudomonas aeruginosa PA01
ggcguagcgcagggucg

SEQ ID NO: 3490879 - RNA, 17 nt, Pseudomonas aeruginosa PA01
ggcguagcgcggcagcg

SEQ ID NO: 3490880 - RNA, 22 nt, Pseudomonas aeruginosa PA01
ggcguagcgcggcagcgccauc

SEQ ID NO: 3490881 - RNA, 16 nt, Pseudomonas aeruginosa PA01
ggcguagcggaagccg

SEQ ID NO: 3490882 - RNA, 19 nt, Pseudomonas aeruginosa PA01
ggcguagcggaagccgucg

SEQ ID NO: 3490883 - RNA, 20 nt, Pseudomonas aeruginosa PA01
ggcguagcggaagccgucgg

SEQ ID NO: 3490884 - RNA, 19 nt, Pseudomonas aeruginosa PA01
ggcguagcguugcgcgagc

SEQ ID NO: 3490885 - RNA, 23 nt, Pseudomonas aeruginosa PA01
ggcguagcguugcgcgagcaccg

SEQ ID NO: 3490886 - RNA, 21 nt, Pseudomonas aeruginosa PA01
ggcguaggccgucgcugccga

SEQ ID NO: 3490887 - RNA, 13 nt, Pseudomonas aeruginosa PA01
ggcguaggcgcgc

SEQ ID NO: 3490888 - RNA, 13 nt, Pseudomonas aeruginosa PA01
ggcguaggcgucg

SEQ ID NO: 3490889 - RNA, 19 nt, Pseudomonas aeruginosa PA01
ggcguagggcgaauaacgc

SEQ ID NO: 3490890 - RNA, 16 nt, Pseudomonas aeruginosa PA01
ggcguagggggccggg

SEQ ID NO: 3490891 - RNA, 17 nt, Pseudomonas aeruginosa PA01
ggcguagugcaucagcc

SEQ ID NO: 3490892 - RNA, 20 nt, Pseudomonas aeruginosa PA01
ggcguaguggugccacaggu

SEQ ID NO: 3490893 - RNA, 16 nt, Pseudomonas aeruginosa PA01
ggcguauccucggcca

SEQ ID NO: 3490894 - RNA, 17 nt, Pseudomonas aeruginosa PA01
ggcguauucggcgacca

SEQ ID NO: 3490895 - RNA, 23 nt, Pseudomonas aeruginosa PA01
ggcgucacgccgaucccggcggc

SEQ ID NO: 3490896 - RNA, 17 nt, Pseudomonas aeruginosa PA01
ggcgucaguuccacgcg

SEQ ID NO: 3490897 - RNA, 22 nt, Pseudomonas aeruginosa PA01
ggcgucaguuccgcaucggcca

SEQ ID NO: 3490898 - RNA, 19 nt, Pseudomonas aeruginosa PA01
ggcgucauagcagcgccgc

SEQ ID NO: 3490899 - RNA, 18 nt, Pseudomonas aeruginosa PA01
ggcguccaccgcuucgcg

SEQ ID NO: 3490900 - RNA, 12 nt, Pseudomonas aeruginosa PA01
ggcguccaccgg

SEQ ID NO: 3490901 - RNA, 14 nt, Pseudomonas aeruginosa PA01
ggcguccaccggcg

SEQ ID NO: 3490902 - RNA, 19 nt, Pseudomonas aeruginosa PA01
ggcguccacuccggcagca

SEQ ID NO: 3490903 - RNA, 13 nt, Pseudomonas aeruginosa PA01
ggcguccagcagg

SEQ ID NO: 3490904 - RNA, 14 nt, Pseudomonas aeruginosa PA01
ggcguccagcaggu

SEQ ID NO: 3490905 - RNA, 23 nt, Pseudomonas aeruginosa PA01
ggcguccagcagguacagcgacu

SEQ ID NO: 3490906 - RNA, 17 nt, Pseudomonas aeruginosa PA01
ggcguccaguagcgccu

SEQ ID NO: 3490907 - RNA, 14 nt, Pseudomonas aeruginosa PA01
ggcgucccauggcg

SEQ ID NO: 3490908 - RNA, 18 nt, Pseudomonas aeruginosa PA01
ggcguccccaugcccggc

SEQ ID NO: 3490909 - RNA, 23 nt, Pseudomonas aeruginosa PA01
ggcguccccuuccuccucgccgc

SEQ ID NO: 3490910 - RNA, 22 nt, Pseudomonas aeruginosa PA01
ggcgucccgcaguagcucgccg

SEQ ID NO: 3490911 - RNA, 16 nt, Pseudomonas aeruginosa PA01
ggcgucccgcuccagc

SEQ ID NO: 3490912 - RNA, 17 nt, Pseudomonas aeruginosa PA01
ggcgucccgcuccagcc

SEQ ID NO: 3490913 - RNA, 21 nt, Pseudomonas aeruginosa PA01
ggcgucccgcuccagccggca

SEQ ID NO: 3490914 - RNA, 14 nt, Pseudomonas aeruginosa PA01
ggcgucccgcugcg

SEQ ID NO: 3490915 - RNA, 16 nt, Pseudomonas aeruginosa PA01
ggcgucccggcgccgc

SEQ ID NO: 3490916 - RNA, 18 nt, Pseudomonas aeruginosa PA01
ggcgucccggcgccgccc

SEQ ID NO: 3490917 - RNA, 19 nt, Pseudomonas aeruginosa PA01
ggcgucccggguucugcuc

SEQ ID NO: 3490918 - RNA, 19 nt, Pseudomonas aeruginosa PA01
ggcgucccguuccggcgca

SEQ ID NO: 3490919 - RNA, 17 nt, Pseudomonas aeruginosa PA01
ggcgucccuggagcagg

SEQ ID NO: 3490920 - RNA, 20 nt, Pseudomonas aeruginosa PA01
ggcgucccuggagcagggcg

SEQ ID NO: 3490921 - RNA, 12 nt, Pseudomonas aeruginosa PA01
ggcguccgccuc

SEQ ID NO: 3490922 - RNA, 14 nt, Pseudomonas aeruginosa PA01
ggcguccgccucgc

SEQ ID NO: 3490923 - RNA, 14 nt, Pseudomonas aeruginosa PA01
ggcguccgcggccu

SEQ ID NO: 3490924 - RNA, 16 nt, Pseudomonas aeruginosa PA01
ggcguccgcggccugc

SEQ ID NO: 3490925 - RNA, 17 nt, Pseudomonas aeruginosa PA01
ggcguccgcggccugcu

SEQ ID NO: 3490926 - RNA, 22 nt, Pseudomonas aeruginosa PA01
ggcguccgcggccugcucggcu

SEQ ID NO: 3490927 - RNA, 14 nt, Pseudomonas aeruginosa PA01
ggcguccgcuggcc

SEQ ID NO: 3490928 - RNA, 15 nt, Pseudomonas aeruginosa PA01
ggcguccgcuggccu

SEQ ID NO: 3490929 - RNA, 21 nt, Pseudomonas aeruginosa PA01
ggcguccgcuggccugcagca

SEQ ID NO: 3490930 - RNA, 14 nt, Pseudomonas aeruginosa PA01
ggcguccggcgagc

SEQ ID NO: 3490931 - RNA, 20 nt, Pseudomonas aeruginosa PA01
ggcguccggcgagcacggcg

SEQ ID NO: 3490932 - RNA, 19 nt, Pseudomonas aeruginosa PA01
ggcguccgggugccccagg

SEQ ID NO: 3490933 - RNA, 15 nt, Pseudomonas aeruginosa PA01
ggcguccgguaggag

SEQ ID NO: 3490934 - RNA, 21 nt, Pseudomonas aeruginosa PA01
ggcguccugcucccuggcgga

SEQ ID NO: 3490935 - RNA, 20 nt, Pseudomonas aeruginosa PA01
ggcguccuggcgaguggcga

SEQ ID NO: 3490936 - RNA, 13 nt, Pseudomonas aeruginosa PA01
ggcguccuugccg

SEQ ID NO: 3490937 - RNA, 18 nt, Pseudomonas aeruginosa PA01
ggcguccuugggaucguc

SEQ ID NO: 3490938 - RNA, 20 nt, Pseudomonas aeruginosa PA01
ggcguccuugggaucgucga

SEQ ID NO: 3490939 - RNA, 18 nt, Pseudomonas aeruginosa PA01
ggcgucgaaacgggcgcu

SEQ ID NO: 3490940 - RNA, 22 nt, Pseudomonas aeruginosa PA01
ggcgucgaaacgggcgcucugg

SEQ ID NO: 3490941 - RNA, 23 nt, Pseudomonas aeruginosa PA01
ggcgucgaaacgggcgcucuggc

SEQ ID NO: 3490942 - RNA, 19 nt, Pseudomonas aeruginosa PA01
ggcgucgaaaugcucgugc

SEQ ID NO: 3490943 - RNA, 20 nt, Pseudomonas aeruginosa PA01
ggcgucgaacaccggcgccg

SEQ ID NO: 3490944 - RNA, 15 nt, Pseudomonas aeruginosa PA01
ggcgucgaaggccuc

SEQ ID NO: 3490945 - RNA, 20 nt, Pseudomonas aeruginosa PA01
ggcgucgaaggccucgucgc

SEQ ID NO: 3490946 - RNA, 16 nt, Pseudomonas aeruginosa PA01
ggcgucgaaggcggcg

SEQ ID NO: 3490947 - RNA, 19 nt, Pseudomonas aeruginosa PA01
ggcgucgaaggcggcgcgg

SEQ ID NO: 3490948 - RNA, 20 nt, Pseudomonas aeruginosa PA01
ggcgucgaaggcggcgcggc

SEQ ID NO: 3490949 - RNA, 21 nt, Pseudomonas aeruginosa PA01
ggcgucgaaggcggcgcggcg

SEQ ID NO: 3490950 - RNA, 15 nt, Pseudomonas aeruginosa PA01
ggcgucgaccacggc

SEQ ID NO: 3490951 - RNA, 14 nt, Pseudomonas aeruginosa PA01
ggcgucgaccgccu

SEQ ID NO: 3490952 - RNA, 15 nt, Pseudomonas aeruginosa PA01
ggcgucgaccgccug

SEQ ID NO: 3490953 - RNA, 21 nt, Pseudomonas aeruginosa PA01
ggcgucgacgaacggaucgcu

SEQ ID NO: 3490954 - RNA, 17 nt, Pseudomonas aeruginosa PA01
ggcgucgaucaggcggg

SEQ ID NO: 3490955 - RNA, 20 nt, Pseudomonas aeruginosa PA01
ggcgucgaucccgaucgcca

SEQ ID NO: 3490956 - RNA, 16 nt, Pseudomonas aeruginosa PA01
ggcgucgaugccgaau

SEQ ID NO: 3490957 - RNA, 23 nt, Pseudomonas aeruginosa PA01
ggcgucgaugcgccucagcggcc

SEQ ID NO: 3490958 - RNA, 15 nt, Pseudomonas aeruginosa PA01
ggcgucgcaccuggg

SEQ ID NO: 3490959 - RNA, 17 nt, Pseudomonas aeruginosa PA01
ggcgucgcccucggcgc

SEQ ID NO: 3490960 - RNA, 20 nt, Pseudomonas aeruginosa PA01
ggcgucgcccucggcgcugg

SEQ ID NO: 3490961 - RNA, 24 nt, Pseudomonas aeruginosa PA01
ggcgucgcccucggcgcuggccag

SEQ ID NO: 3490962 - RNA, 23 nt, Pseudomonas aeruginosa PA01
ggcgucgccgacuucggcaagca

SEQ ID NO: 3490963 - RNA, 19 nt, Pseudomonas aeruginosa PA01
ggcgucgccuuccaccacc

SEQ ID NO: 3490964 - RNA, 20 nt, Pseudomonas aeruginosa PA01
ggcgucgccuuccaccacca

SEQ ID NO: 3490965 - RNA, 13 nt, Pseudomonas aeruginosa PA01
ggcgucgcgccag

SEQ ID NO: 3490966 - RNA, 14 nt, Pseudomonas aeruginosa PA01
ggcgucgcgccagc

SEQ ID NO: 3490967 - RNA, 18 nt, Pseudomonas aeruginosa PA01
ggcgucgcgccagcaccg

SEQ ID NO: 3490968 - RNA, 22 nt, Pseudomonas aeruginosa PA01
ggcgucgcggagaauccgcucg

SEQ ID NO: 3490969 - RNA, 20 nt, Pseudomonas aeruginosa PA01
ggcgucgcuguagcggcucg

SEQ ID NO: 3490970 - RNA, 17 nt, Pseudomonas aeruginosa PA01
ggcgucggcgagcaggc

SEQ ID NO: 3490971 - RNA, 12 nt, Pseudomonas aeruginosa PA01
ggcgucggcgcc

SEQ ID NO: 3490972 - RNA, 14 nt, Pseudomonas aeruginosa PA01
ggcgucggcgcggg

SEQ ID NO: 3490973 - RNA, 17 nt, Pseudomonas aeruginosa PA01
ggcgucggcgcgggcgc

SEQ ID NO: 3490974 - RNA, 14 nt, Pseudomonas aeruginosa PA01
ggcgucggcgcuuu

SEQ ID NO: 3490975 - RNA, 18 nt, Pseudomonas aeruginosa PA01
ggcgucggcugcgcuggg

SEQ ID NO: 3490976 - RNA, 20 nt, Pseudomonas aeruginosa PA01
ggcgucgggcgaaacggcag

SEQ ID NO: 3490977 - RNA, 21 nt, Pseudomonas aeruginosa PA01
ggcgucgggcgaaacggcagg

SEQ ID NO: 3490978 - RNA, 20 nt, Pseudomonas aeruginosa PA01
ggcgucguagagguugccgu

SEQ ID NO: 3490979 - RNA, 16 nt, Pseudomonas aeruginosa PA01
ggcgucgucgaccucg

SEQ ID NO: 3490980 - RNA, 20 nt, Pseudomonas aeruginosa PA01
ggcgucgucgaggcugucgc

SEQ ID NO: 3490981 - RNA, 13 nt, Pseudomonas aeruginosa PA01
ggcgucgucgauc

SEQ ID NO: 3490982 - RNA, 14 nt, Pseudomonas aeruginosa PA01
ggcgucgucgcugc

SEQ ID NO: 3490983 - RNA, 21 nt, Pseudomonas aeruginosa PA01
ggcgucgucgcugcgcggguc

SEQ ID NO: 3490984 - RNA, 20 nt, Pseudomonas aeruginosa PA01
ggcgucucauggaacagcag

SEQ ID NO: 3490985 - RNA, 17 nt, Pseudomonas aeruginosa PA01
ggcgucuccugccgccg

SEQ ID NO: 3490986 - RNA, 20 nt, Pseudomonas aeruginosa PA01
ggcgucuccugccgccgaua

SEQ ID NO: 3490987 - RNA, 20 nt, Pseudomonas aeruginosa PA01
ggcgucugcccgguccaacc

SEQ ID NO: 3490988 - RNA, 16 nt, Pseudomonas aeruginosa PA01
ggcgucugcucauucg

SEQ ID NO: 3490989 - RNA, 18 nt, Pseudomonas aeruginosa PA01
ggcgucugggacggcagc

SEQ ID NO: 3490990 - RNA, 19 nt, Pseudomonas aeruginosa PA01
ggcgucugggacggcagcc

SEQ ID NO: 3490991 - RNA, 18 nt, Pseudomonas aeruginosa PA01
ggcgucuuccggcucgcc

SEQ ID NO: 3490992 - RNA, 19 nt, Pseudomonas aeruginosa PA01
ggcgucuuccggcucgccg

SEQ ID NO: 3490993 - RNA, 16 nt, Pseudomonas aeruginosa PA01
ggcgucuucggcggcg

SEQ ID NO: 3490994 - RNA, 17 nt, Pseudomonas aeruginosa PA01
ggcgucuucggcggcgc

SEQ ID NO: 3490995 - RNA, 18 nt, Pseudomonas aeruginosa PA01
ggcgucuucggcggcgcc

SEQ ID NO: 3490996 - RNA, 20 nt, Pseudomonas aeruginosa PA01
ggcgucuucggcggcgccgg

SEQ ID NO: 3490997 - RNA, 22 nt, Pseudomonas aeruginosa PA01
ggcgucuucggcggcgccggug

SEQ ID NO: 3490998 - RNA, 19 nt, Pseudomonas aeruginosa PA01
ggcgucuugucgaagcccg

SEQ ID NO: 3490999 - RNA, 15 nt, Pseudomonas aeruginosa PA01
ggcgugaacgcggcg

SEQ ID NO: 3491000 - RNA, 15 nt, Pseudomonas aeruginosa PA01
ggcgugaagccgccg

SEQ ID NO: 3491001 - RNA, 19 nt, Pseudomonas aeruginosa PA01
ggcgugaaguagccgccgg

SEQ ID NO: 3491002 - RNA, 23 nt, Pseudomonas aeruginosa PA01
ggcgugacugcaaucgaccauca

SEQ ID NO: 3491003 - RNA, 16 nt, Pseudomonas aeruginosa PA01
ggcgugagcagggccg

SEQ ID NO: 3491004 - RNA, 20 nt, Pseudomonas aeruginosa PA01
ggcgugcaggccgaucagga

SEQ ID NO: 3491005 - RNA, 14 nt, Pseudomonas aeruginosa PA01
ggcgugcaggccgc

SEQ ID NO: 3491006 - RNA, 15 nt, Pseudomonas aeruginosa PA01
ggcgugcaggccgcc

SEQ ID NO: 3491007 - RNA, 16 nt, Pseudomonas aeruginosa PA01
ggcgugcaggccgccg

SEQ ID NO: 3491008 - RNA, 12 nt, Pseudomonas aeruginosa PA01
ggcgugcagggu

SEQ ID NO: 3491009 - RNA, 19 nt, Pseudomonas aeruginosa PA01
ggcgugcaucaccuugucg

SEQ ID NO: 3491010 - RNA, 16 nt, Pseudomonas aeruginosa PA01
ggcgugcauggccggg

SEQ ID NO: 3491011 - RNA, 15 nt, Pseudomonas aeruginosa PA01
ggcgugccaggagcu

SEQ ID NO: 3491012 - RNA, 21 nt, Pseudomonas aeruginosa PA01
ggcgugcccuuuuccuccagg

SEQ ID NO: 3491013 - RNA, 18 nt, Pseudomonas aeruginosa PA01
ggcgugccgcaggccgcg

SEQ ID NO: 3491014 - RNA, 21 nt, Pseudomonas aeruginosa PA01
ggcgugccgccaggccuucca

SEQ ID NO: 3491015 - RNA, 17 nt, Pseudomonas aeruginosa PA01
ggcgugccgcuggccga

SEQ ID NO: 3491016 - RNA, 19 nt, Pseudomonas aeruginosa PA01
ggcgugccgcuggccgacc

SEQ ID NO: 3491017 - RNA, 20 nt, Pseudomonas aeruginosa PA01
ggcgugccgcuggccgacca

SEQ ID NO: 3491018 - RNA, 14 nt, Pseudomonas aeruginosa PA01
ggcgugccgggcag

SEQ ID NO: 3491019 - RNA, 18 nt, Pseudomonas aeruginosa PA01
ggcgugccgggccggcca

SEQ ID NO: 3491020 - RNA, 20 nt, Pseudomonas aeruginosa PA01
ggcgugccgggccggccagg

SEQ ID NO: 3491021 - RNA, 19 nt, Pseudomonas aeruginosa PA01
ggcgugccguggcucggcg

SEQ ID NO: 3491022 - RNA, 19 nt, Pseudomonas aeruginosa PA01
ggcgugccuguuccuccgc

SEQ ID NO: 3491023 - RNA, 21 nt, Pseudomonas aeruginosa PA01
ggcgugcuccagcaccguggc

SEQ ID NO: 3491024 - RNA, 14 nt, Pseudomonas aeruginosa PA01
ggcgugcucggcga

SEQ ID NO: 3491025 - RNA, 16 nt, Pseudomonas aeruginosa PA01
ggcgugcucggcgauc

SEQ ID NO: 3491026 - RNA, 20 nt, Pseudomonas aeruginosa PA01
ggcgugcucggcgaucucgc

SEQ ID NO: 3491027 - RNA, 21 nt, Pseudomonas aeruginosa PA01
ggcgugcuggcuauucgccca

SEQ ID NO: 3491028 - RNA, 20 nt, Pseudomonas aeruginosa PA01
ggcgugcuuggcgaggcgcg

SEQ ID NO: 3491029 - RNA, 21 nt, Pseudomonas aeruginosa PA01
ggcgugcuuggcgaggcgcgc

SEQ ID NO: 3491030 - RNA, 15 nt, Pseudomonas aeruginosa PA01
ggcguggaaggccac

SEQ ID NO: 3491031 - RNA, 19 nt, Pseudomonas aeruginosa PA01
ggcguggccggcgaccagc

SEQ ID NO: 3491032 - RNA, 19 nt, Pseudomonas aeruginosa PA01
ggcguggcgaucaggcagc

SEQ ID NO: 3491033 - RNA, 23 nt, Pseudomonas aeruginosa PA01
ggcguggcgaucaggcagcgcgc

SEQ ID NO: 3491034 - RNA, 14 nt, Pseudomonas aeruginosa PA01
ggcguggcggccgc

SEQ ID NO: 3491035 - RNA, 15 nt, Pseudomonas aeruginosa PA01
ggcguggcggccgcc

SEQ ID NO: 3491036 - RNA, 19 nt, Pseudomonas aeruginosa PA01
ggcguggcggccgccggcg

SEQ ID NO: 3491037 - RNA, 18 nt, Pseudomonas aeruginosa PA01
ggcguggcucgaucagcc

SEQ ID NO: 3491038 - RNA, 22 nt, Pseudomonas aeruginosa PA01
ggcguggcucgaucagccggcg

SEQ ID NO: 3491039 - RNA, 16 nt, Pseudomonas aeruginosa PA01
ggcgugggcgccggcg

SEQ ID NO: 3491040 - RNA, 18 nt, Pseudomonas aeruginosa PA01
ggcgugggcggucggcga

SEQ ID NO: 3491041 - RNA, 20 nt, Pseudomonas aeruginosa PA01
ggcguggggaagacggccag

SEQ ID NO: 3491042 - RNA, 18 nt, Pseudomonas aeruginosa PA01
ggcguggucggcggccuc

SEQ ID NO: 3491043 - RNA, 20 nt, Pseudomonas aeruginosa PA01
ggcguggucuccgugcuggc

SEQ ID NO: 3491044 - RNA, 17 nt, Pseudomonas aeruginosa PA01
ggcguggucuuccucgg

SEQ ID NO: 3491045 - RNA, 11 nt, Pseudomonas aeruginosa PA01
ggcgugguggc

SEQ ID NO: 3491046 - RNA, 16 nt, Pseudomonas aeruginosa PA01
ggcgugguggcgggga

SEQ ID NO: 3491047 - RNA, 21 nt, Pseudomonas aeruginosa PA01
ggcgugucgaggaaggccagc

SEQ ID NO: 3491048 - RNA, 22 nt, Pseudomonas aeruginosa PA01
ggcgugucgaggaaggccagca

SEQ ID NO: 3491049 - RNA, 14 nt, Pseudomonas aeruginosa PA01
ggcgugucgagggc

SEQ ID NO: 3491050 - RNA, 16 nt, Pseudomonas aeruginosa PA01
ggcguguucgucgauc

SEQ ID NO: 3491051 - RNA, 14 nt, Pseudomonas aeruginosa PA01
ggcguuagccgccu

SEQ ID NO: 3491052 - RNA, 18 nt, Pseudomonas aeruginosa PA01
ggcguuagccgccugcgg

SEQ ID NO: 3491053 - RNA, 17 nt, Pseudomonas aeruginosa PA01
ggcguuauccgccgaua

SEQ ID NO: 3491054 - RNA, 17 nt, Pseudomonas aeruginosa PA01
ggcguuauccgccgcuc

SEQ ID NO: 3491055 - RNA, 23 nt, Pseudomonas aeruginosa PA01
ggcguuauccgccgcucacccug

SEQ ID NO: 3491056 - RNA, 15 nt, Pseudomonas aeruginosa PA01
ggcguuaugcgcccu

SEQ ID NO: 3491057 - RNA, 15 nt, Pseudomonas aeruginosa PA01
ggcguuauucgcccu

SEQ ID NO: 3491058 - RNA, 15 nt, Pseudomonas aeruginosa PA01
ggcguuccaccaggc

SEQ ID NO: 3491059 - RNA, 16 nt, Pseudomonas aeruginosa PA01
ggcguuccaggcggcg

SEQ ID NO: 3491060 - RNA, 20 nt, Pseudomonas aeruginosa PA01
ggcguuccaguucggccgcg

SEQ ID NO: 3491061 - RNA, 15 nt, Pseudomonas aeruginosa PA01
ggcguuccucgacga

SEQ ID NO: 3491062 - RNA, 18 nt, Pseudomonas aeruginosa PA01
ggcguuccuucaacagcg

SEQ ID NO: 3491063 - RNA, 22 nt, Pseudomonas aeruginosa PA01
ggcguucgaggguacuccuggc

SEQ ID NO: 3491064 - RNA, 18 nt, Pseudomonas aeruginosa PA01
ggcguucgaucuccucgc

SEQ ID NO: 3491065 - RNA, 13 nt, Pseudomonas aeruginosa PA01
ggcguucgcccug

SEQ ID NO: 3491066 - RNA, 17 nt, Pseudomonas aeruginosa PA01
ggcguucggaccugucc

SEQ ID NO: 3491067 - RNA, 20 nt, Pseudomonas aeruginosa PA01
ggcguucggaccugucccga

SEQ ID NO: 3491068 - RNA, 21 nt, Pseudomonas aeruginosa PA01
ggcguucggaccugucccgau

SEQ ID NO: 3491069 - RNA, 15 nt, Pseudomonas aeruginosa PA01
ggcguucggggcccu

SEQ ID NO: 3491070 - RNA, 15 nt, Pseudomonas aeruginosa PA01
ggcguucgucgaccu

SEQ ID NO: 3491071 - RNA, 20 nt, Pseudomonas aeruginosa PA01
ggcguucgucguggccauag

SEQ ID NO: 3491072 - RNA, 13 nt, Pseudomonas aeruginosa PA01
ggcguucucgauc

SEQ ID NO: 3491073 - RNA, 22 nt, Pseudomonas aeruginosa PA01
ggcguucucgaucaucgccagc

SEQ ID NO: 3491074 - RNA, 16 nt, Pseudomonas aeruginosa PA01
ggcguucucguccucg

SEQ ID NO: 3491075 - RNA, 22 nt, Pseudomonas aeruginosa PA01
ggcguucugcuucucggcuacc

SEQ ID NO: 3491076 - RNA, 18 nt, Pseudomonas aeruginosa PA01
ggcguucuucacccgcag

SEQ ID NO: 3491077 - RNA, 14 nt, Pseudomonas aeruginosa PA01
ggcguucuuggccg

SEQ ID NO: 3491078 - RNA, 17 nt, Pseudomonas aeruginosa PA01
ggcguugaacugcccgc

SEQ ID NO: 3491079 - RNA, 21 nt, Pseudomonas aeruginosa PA01
ggcguugcagggugcguacgg

SEQ ID NO: 3491080 - RNA, 18 nt, Pseudomonas aeruginosa PA01
ggcguugcagugcgccgc

SEQ ID NO: 3491081 - RNA, 19 nt, Pseudomonas aeruginosa PA01
ggcguugcagugcgccgca

SEQ ID NO: 3491082 - RNA, 20 nt, Pseudomonas aeruginosa PA01
ggcguugcccaugaucgcca

SEQ ID NO: 3491083 - RNA, 19 nt, Pseudomonas aeruginosa PA01
ggcguugccgugccggucg

SEQ ID NO: 3491084 - RNA, 15 nt, Pseudomonas aeruginosa PA01
ggcguugcgcgccuc

SEQ ID NO: 3491085 - RNA, 14 nt, Pseudomonas aeruginosa PA01
ggcguuggccagcg

SEQ ID NO: 3491086 - RNA, 15 nt, Pseudomonas aeruginosa PA01
ggcguuggccagcgc

SEQ ID NO: 3491087 - RNA, 17 nt, Pseudomonas aeruginosa PA01
ggcguuggccagcgcca

SEQ ID NO: 3491088 - RNA, 19 nt, Pseudomonas aeruginosa PA01
ggcguuggccgaggaggcc

SEQ ID NO: 3491089 - RNA, 20 nt, Pseudomonas aeruginosa PA01
ggcguuggcuccgggccgag

SEQ ID NO: 3491090 - RNA, 21 nt, Pseudomonas aeruginosa PA01
ggcguuggcuccgggccgagg

SEQ ID NO: 3491091 - RNA, 21 nt, Pseudomonas aeruginosa PA01
ggcguugguacagcucgcgca

SEQ ID NO: 3491092 - RNA, 19 nt, Pseudomonas aeruginosa PA01
ggcguuguagaucugcacc

SEQ ID NO: 3491093 - RNA, 22 nt, Pseudomonas aeruginosa PA01
ggcguuguagaucugcaccgcc

SEQ ID NO: 3491094 - RNA, 22 nt, Pseudomonas aeruginosa PA01
ggcguuguaggaauagaucgca

SEQ ID NO: 3491095 - RNA, 16 nt, Pseudomonas aeruginosa PA01
ggcguugucggcaacc

SEQ ID NO: 3491096 - RNA, 17 nt, Pseudomonas aeruginosa PA01
ggcguugucggccagca

SEQ ID NO: 3491097 - RNA, 18 nt, Pseudomonas aeruginosa PA01
ggcguugucggccagcag

SEQ ID NO: 3491098 - RNA, 19 nt, Pseudomonas aeruginosa PA01
ggcguugucggccagcagc

SEQ ID NO: 3491099 - RNA, 19 nt, Pseudomonas aeruginosa PA01
ggcguuguugccgccgaag

SEQ ID NO: 3491100 - RNA, 19 nt, Pseudomonas aeruginosa PA01
ggcguuguuggucaggcug

SEQ ID NO: 3491101 - RNA, 12 nt, Pseudomonas aeruginosa PA01
ggcguuucgccg

SEQ ID NO: 3491102 - RNA, 19 nt, Pseudomonas aeruginosa PA01
ggcguuuucguugccgcgc

SEQ ID NO: 3491103 - RNA, 23 nt, Pseudomonas aeruginosa PA01
ggcguuuucguuggcggccauca

SEQ ID NO: 3491104 - RNA, 21 nt, Pseudomonas aeruginosa PA01
ggcguuuuucauggcggcauc

SEQ ID NO: 3491105 - RNA, 22 nt, Pseudomonas aeruginosa PA01
ggcguuuuucauggcggcauca

SEQ ID NO: 3491106 - RNA, 22 nt, Pseudomonas aeruginosa PA01
ggcguuuuucauuccgguccca

SEQ ID NO: 3491107 - RNA, 21 nt, Pseudomonas aeruginosa PA01
ggcguuuuuucuuuccagcgc

SEQ ID NO: 3491108 - RNA, 22 nt, Pseudomonas aeruginosa PA01
ggcuaaccgccuucgcguucgc

SEQ ID NO: 3491109 - RNA, 19 nt, Pseudomonas aeruginosa PA01
ggcuacaucgucugcgcgg

SEQ ID NO: 3491110 - RNA, 23 nt, Pseudomonas aeruginosa PA01
ggcuaccaggaagcucggcagca

SEQ ID NO: 3491111 - RNA, 16 nt, Pseudomonas aeruginosa PA01
ggcuacccgcagggcu

SEQ ID NO: 3491112 - RNA, 23 nt, Pseudomonas aeruginosa PA01
ggcuacccgcagggcucgugcca

SEQ ID NO: 3491113 - RNA, 24 nt, Pseudomonas aeruginosa PA01
ggcuacccgcagggcucgugccau

SEQ ID NO: 3491114 - RNA, 16 nt, Pseudomonas aeruginosa PA01
ggcuacccucucccca

SEQ ID NO: 3491115 - RNA, 16 nt, Pseudomonas aeruginosa PA01
ggcuacuucgccgggu

SEQ ID NO: 3491116 - RNA, 15 nt, Pseudomonas aeruginosa PA01
ggcuagucgcgcagc

SEQ ID NO: 3491117 - RNA, 16 nt, Pseudomonas aeruginosa PA01
ggcuagucgcgcagcg

SEQ ID NO: 3491118 - RNA, 15 nt, Pseudomonas aeruginosa PA01
ggcuauccuccaggc

SEQ ID NO: 3491119 - RNA, 19 nt, Pseudomonas aeruginosa PA01
ggcuauccuccaggccgcc

SEQ ID NO: 3491120 - RNA, 22 nt, Pseudomonas aeruginosa PA01
ggcuaucgaucacugccuggca

SEQ ID NO: 3491121 - RNA, 15 nt, Pseudomonas aeruginosa PA01
ggcuaucgcuuucag

SEQ ID NO: 3491122 - RNA, 19 nt, Pseudomonas aeruginosa PA01
ggcuauguauucggcgguc

SEQ ID NO: 3491123 - RNA, 18 nt, Pseudomonas aeruginosa PA01
ggcuauucccgccgcucc

SEQ ID NO: 3491124 - RNA, 14 nt, Pseudomonas aeruginosa PA01
ggcucaacuggucc

SEQ ID NO: 3491125 - RNA, 15 nt, Pseudomonas aeruginosa PA01
ggcucaacugguugg

SEQ ID NO: 3491126 - RNA, 12 nt, Pseudomonas aeruginosa PA01
ggcucacgcccc

SEQ ID NO: 3491127 - RNA, 17 nt, Pseudomonas aeruginosa PA01
ggcucacgccccagcgc

SEQ ID NO: 3491128 - RNA, 19 nt, Pseudomonas aeruginosa PA01
ggcucacgccccagcgcau

SEQ ID NO: 3491129 - RNA, 12 nt, Pseudomonas aeruginosa PA01
ggcucacucccg

SEQ ID NO: 3491130 - RNA, 19 nt, Pseudomonas aeruginosa PA01
ggcucacucccguccagcg

SEQ ID NO: 3491131 - RNA, 20 nt, Pseudomonas aeruginosa PA01
ggcucacucccguccagcgc

SEQ ID NO: 3491132 - RNA, 21 nt, Pseudomonas aeruginosa PA01
ggcucacucccguccagcgcu

SEQ ID NO: 3491133 - RNA, 16 nt, Pseudomonas aeruginosa PA01
ggcucagaagucccag

SEQ ID NO: 3491134 - RNA, 17 nt, Pseudomonas aeruginosa PA01
ggcucagaagucccagc

SEQ ID NO: 3491135 - RNA, 22 nt, Pseudomonas aeruginosa PA01
ggcucagauuaucugcgacuga

SEQ ID NO: 3491136 - RNA, 14 nt, Pseudomonas aeruginosa PA01
ggcucagcccaggc

SEQ ID NO: 3491137 - RNA, 16 nt, Pseudomonas aeruginosa PA01
ggcucagcccaggcgc

SEQ ID NO: 3491138 - RNA, 17 nt, Pseudomonas aeruginosa PA01
ggcucagcccaggcgcc

SEQ ID NO: 3491139 - RNA, 19 nt, Pseudomonas aeruginosa PA01
ggcucagcccaggcgccgc

SEQ ID NO: 3491140 - RNA, 22 nt, Pseudomonas aeruginosa PA01
ggcucagcccaggcgccgcucg

SEQ ID NO: 3491141 - RNA, 16 nt, Pseudomonas aeruginosa PA01
ggcucagccgaccacc

SEQ ID NO: 3491142 - RNA, 14 nt, Pseudomonas aeruginosa PA01
ggcucagccgcugg

SEQ ID NO: 3491143 - RNA, 17 nt, Pseudomonas aeruginosa PA01
ggcucagccgcuggcgu

SEQ ID NO: 3491144 - RNA, 12 nt, Pseudomonas aeruginosa PA01
ggcucagcgcgc

SEQ ID NO: 3491145 - RNA, 23 nt, Pseudomonas aeruginosa PA01
ggcucagcgcgccgaguucgccg

SEQ ID NO: 3491146 - RNA, 20 nt, Pseudomonas aeruginosa PA01
ggcucagcgcggcggcggcc

SEQ ID NO: 3491147 - RNA, 15 nt, Pseudomonas aeruginosa PA01
ggcucagcucggcga

SEQ ID NO: 3491148 - RNA, 21 nt, Pseudomonas aeruginosa PA01
ggcucagcucggcgaugccgc

SEQ ID NO: 3491149 - RNA, 16 nt, Pseudomonas aeruginosa PA01
ggcucagcucucccga

SEQ ID NO: 3491150 - RNA, 20 nt, Pseudomonas aeruginosa PA01
ggcucagcucucccgaggcg

SEQ ID NO: 3491151 - RNA, 14 nt, Pseudomonas aeruginosa PA01
ggcucaggccgccg

SEQ ID NO: 3491152 - RNA, 16 nt, Pseudomonas aeruginosa PA01
ggcucaggccgccgcg

SEQ ID NO: 3491153 - RNA, 12 nt, Pseudomonas aeruginosa PA01
ggcucaggccgg

SEQ ID NO: 3491154 - RNA, 15 nt, Pseudomonas aeruginosa PA01
ggcucaggccuuggc

SEQ ID NO: 3491155 - RNA, 22 nt, Pseudomonas aeruginosa PA01
ggcucaggcucuuugcgacuga

SEQ ID NO: 3491156 - RNA, 17 nt, Pseudomonas aeruginosa PA01
ggcucagggucucgcgg

SEQ ID NO: 3491157 - RNA, 18 nt, Pseudomonas aeruginosa PA01
ggcucaguucggccagcg

SEQ ID NO: 3491158 - RNA, 23 nt, Pseudomonas aeruginosa PA01
ggcucauggccgggguucuucgu

SEQ ID NO: 3491159 - RNA, 17 nt, Pseudomonas aeruginosa PA01
ggcucaugggcgaugcg

SEQ ID NO: 3491160 - RNA, 15 nt, Pseudomonas aeruginosa PA01
ggcuccacugcuugg

SEQ ID NO: 3491161 - RNA, 16 nt, Pseudomonas aeruginosa PA01
ggcuccagcaccagca

SEQ ID NO: 3491162 - RNA, 22 nt, Pseudomonas aeruginosa PA01
ggcuccagcaccagcacgcccu

SEQ ID NO: 3491163 - RNA, 18 nt, Pseudomonas aeruginosa PA01
ggcuccagccaggcccgg

SEQ ID NO: 3491164 - RNA, 19 nt, Pseudomonas aeruginosa PA01
ggcuccagccaggcccggu

SEQ ID NO: 3491165 - RNA, 13 nt, Pseudomonas aeruginosa PA01
ggcuccagccgcu

SEQ ID NO: 3491166 - RNA, 15 nt, Pseudomonas aeruginosa PA01
ggcuccagccgggcu

SEQ ID NO: 3491167 - RNA, 21 nt, Pseudomonas aeruginosa PA01
ggcuccagccgggcuccgccg

SEQ ID NO: 3491168 - RNA, 13 nt, Pseudomonas aeruginosa PA01
ggcuccagcggga

SEQ ID NO: 3491169 - RNA, 19 nt, Pseudomonas aeruginosa PA01
ggcuccagcuugucgucgg

SEQ ID NO: 3491170 - RNA, 17 nt, Pseudomonas aeruginosa PA01
ggcuccaggaccggcag

SEQ ID NO: 3491171 - RNA, 22 nt, Pseudomonas aeruginosa PA01
ggcuccaggaccggcaggucgg

SEQ ID NO: 3491172 - RNA, 23 nt, Pseudomonas aeruginosa PA01
ggcuccaggaccggcaggucggg

SEQ ID NO: 3491173 - RNA, 13 nt, Pseudomonas aeruginosa PA01
ggcuccaggggag

SEQ ID NO: 3491174 - RNA, 18 nt, Pseudomonas aeruginosa PA01
ggcuccaggggagccccg

SEQ ID NO: 3491175 - RNA, 14 nt, Pseudomonas aeruginosa PA01
ggcuccaguugcag

SEQ ID NO: 3491176 - RNA, 20 nt, Pseudomonas aeruginosa PA01
ggcuccgaugaagcaggcgg

SEQ ID NO: 3491177 - RNA, 22 nt, Pseudomonas aeruginosa PA01
ggcuccgaugaagcaggcggag

SEQ ID NO: 3491178 - RNA, 13 nt, Pseudomonas aeruginosa PA01
ggcuccgccgccg

SEQ ID NO: 3491179 - RNA, 12 nt, Pseudomonas aeruginosa PA01
ggcuccgccgcg

SEQ ID NO: 3491180 - RNA, 15 nt, Pseudomonas aeruginosa PA01
ggcuccgcgcacgga

SEQ ID NO: 3491181 - RNA, 21 nt, Pseudomonas aeruginosa PA01
ggcuccgcgcacggaucgcgc

SEQ ID NO: 3491182 - RNA, 18 nt, Pseudomonas aeruginosa PA01
ggcuccgcgcguucagcc

SEQ ID NO: 3491183 - RNA, 15 nt, Pseudomonas aeruginosa PA01
ggcuccgcugcucag

SEQ ID NO: 3491184 - RNA, 13 nt, Pseudomonas aeruginosa PA01
ggcuccggauggc

SEQ ID NO: 3491185 - RNA, 19 nt, Pseudomonas aeruginosa PA01
ggcuccggauggcugaccc

SEQ ID NO: 3491186 - RNA, 17 nt, Pseudomonas aeruginosa PA01
ggcuccggcuccgcgca

SEQ ID NO: 3491187 - RNA, 22 nt, Pseudomonas aeruginosa PA01
ggcuccgggccgagggcugaga

SEQ ID NO: 3491188 - RNA, 18 nt, Pseudomonas aeruginosa PA01
ggcuccggguacuggcgc

SEQ ID NO: 3491189 - RNA, 13 nt, Pseudomonas aeruginosa PA01
ggcuccucggccu

SEQ ID NO: 3491190 - RNA, 21 nt, Pseudomonas aeruginosa PA01
ggcuccuugaaggcuuccugg

SEQ ID NO: 3491191 - RNA, 14 nt, Pseudomonas aeruginosa PA01
ggcucgacgaggaa

SEQ ID NO: 3491192 - RNA, 14 nt, Pseudomonas aeruginosa PA01
ggcucgaggccgag

SEQ ID NO: 3491193 - RNA, 16 nt, Pseudomonas aeruginosa PA01
ggcucgaggccgagcc

SEQ ID NO: 3491194 - RNA, 20 nt, Pseudomonas aeruginosa PA01
ggcucgaggccgagccggca

SEQ ID NO: 3491195 - RNA, 19 nt, Pseudomonas aeruginosa PA01
ggcucgaucagccggcgcg

SEQ ID NO: 3491196 - RNA, 20 nt, Pseudomonas aeruginosa PA01
ggcucgaucagccggcgcgc

SEQ ID NO: 3491197 - RNA, 17 nt, Pseudomonas aeruginosa PA01
ggcucgaucggcagggc

SEQ ID NO: 3491198 - RNA, 21 nt, Pseudomonas aeruginosa PA01
ggcucgaucggcagggcgccg

SEQ ID NO: 3491199 - RNA, 18 nt, Pseudomonas aeruginosa PA01
ggcucgcaaucagcgcga

SEQ ID NO: 3491200 - RNA, 18 nt, Pseudomonas aeruginosa PA01
ggcucgcccagcaggcgc

SEQ ID NO: 3491201 - RNA, 18 nt, Pseudomonas aeruginosa PA01
ggcucgccccggcggcga

SEQ ID NO: 3491202 - RNA, 19 nt, Pseudomonas aeruginosa PA01
ggcucgccccggcggcgau

SEQ ID NO: 3491203 - RNA, 20 nt, Pseudomonas aeruginosa PA01
ggcucgccccggcggcgauc

SEQ ID NO: 3491204 - RNA, 15 nt, Pseudomonas aeruginosa PA01
ggcucgccgaaaggc

SEQ ID NO: 3491205 - RNA, 12 nt, Pseudomonas aeruginosa PA01
ggcucgccgacu

SEQ ID NO: 3491206 - RNA, 18 nt, Pseudomonas aeruginosa PA01
ggcucgccgccgggcgcg

SEQ ID NO: 3491207 - RNA, 13 nt, Pseudomonas aeruginosa PA01
ggcucgccgcgcu

SEQ ID NO: 3491208 - RNA, 16 nt, Pseudomonas aeruginosa PA01
ggcucgccggguuguc

SEQ ID NO: 3491209 - RNA, 21 nt, Pseudomonas aeruginosa PA01
ggcucgccggguuguccaggc

SEQ ID NO: 3491210 - RNA, 16 nt, Pseudomonas aeruginosa PA01
ggcucgcgcagcggcg

SEQ ID NO: 3491211 - RNA, 14 nt, Pseudomonas aeruginosa PA01
ggcucgcgccggcg

SEQ ID NO: 3491212 - RNA, 18 nt, Pseudomonas aeruginosa PA01
ggcucgcgcggggcgcgc

SEQ ID NO: 3491213 - RNA, 15 nt, Pseudomonas aeruginosa PA01
ggcucgcggcgcucg

SEQ ID NO: 3491214 - RNA, 16 nt, Pseudomonas aeruginosa PA01
ggcucgcggcgcucgu

SEQ ID NO: 3491215 - RNA, 19 nt, Pseudomonas aeruginosa PA01
ggcucgcggcgcucgucgg

SEQ ID NO: 3491216 - RNA, 18 nt, Pseudomonas aeruginosa PA01
ggcucgcgggucaccagc

SEQ ID NO: 3491217 - RNA, 18 nt, Pseudomonas aeruginosa PA01
ggcucgcgguucgaggac

SEQ ID NO: 3491218 - RNA, 13 nt, Pseudomonas aeruginosa PA01
ggcucgcucucga

SEQ ID NO: 3491219 - RNA, 21 nt, Pseudomonas aeruginosa PA01
ggcucgcucucgaacaccggc

SEQ ID NO: 3491220 - RNA, 22 nt, Pseudomonas aeruginosa PA01
ggcucgcugaaauccaccagca

SEQ ID NO: 3491221 - RNA, 13 nt, Pseudomonas aeruginosa PA01
ggcucggcaagcg

SEQ ID NO: 3491222 - RNA, 18 nt, Pseudomonas aeruginosa PA01
ggcucggcacgcguggcg

SEQ ID NO: 3491223 - RNA, 19 nt, Pseudomonas aeruginosa PA01
ggcucggcacgcguggcga

SEQ ID NO: 3491224 - RNA, 22 nt, Pseudomonas aeruginosa PA01
ggcucggcacgcguggcgagug

SEQ ID NO: 3491225 - RNA, 16 nt, Pseudomonas aeruginosa PA01
ggcucggcagcggauc

SEQ ID NO: 3491226 - RNA, 20 nt, Pseudomonas aeruginosa PA01
ggcucggccagggccgcucg

SEQ ID NO: 3491227 - RNA, 20 nt, Pseudomonas aeruginosa PA01
ggcucggcgagcgaaggauc

SEQ ID NO: 3491228 - RNA, 15 nt, Pseudomonas aeruginosa PA01
ggcucggcggcaggc

SEQ ID NO: 3491229 - RNA, 13 nt, Pseudomonas aeruginosa PA01
ggcucggcggcca

SEQ ID NO: 3491230 - RNA, 18 nt, Pseudomonas aeruginosa PA01
ggcucggcgggcugccgc

SEQ ID NO: 3491231 - RNA, 17 nt, Pseudomonas aeruginosa PA01
ggcucggcugcuugccg

SEQ ID NO: 3491232 - RNA, 13 nt, Pseudomonas aeruginosa PA01
ggcucggcuucca

SEQ ID NO: 3491233 - RNA, 18 nt, Pseudomonas aeruginosa PA01
ggcucggcuuccaucacc

SEQ ID NO: 3491234 - RNA, 20 nt, Pseudomonas aeruginosa PA01
ggcucgguuccagcucgucg

SEQ ID NO: 3491235 - RNA, 20 nt, Pseudomonas aeruginosa PA01
ggcucgucaucguccagcuc

SEQ ID NO: 3491236 - RNA, 20 nt, Pseudomonas aeruginosa PA01
ggcucgucggcguugcugau

SEQ ID NO: 3491237 - RNA, 22 nt, Pseudomonas aeruginosa PA01
ggcucgugccaucaggccgcgg

SEQ ID NO: 3491238 - RNA, 20 nt, Pseudomonas aeruginosa PA01
ggcucguucaugucggcucc

SEQ ID NO: 3491239 - RNA, 20 nt, Pseudomonas aeruginosa PA01
ggcucguucguucuguucgu

SEQ ID NO: 3491240 - RNA, 15 nt, Pseudomonas aeruginosa PA01
ggcucguugaugaua

SEQ ID NO: 3491241 - RNA, 14 nt, Pseudomonas aeruginosa PA01
ggcucucgcgcagc

SEQ ID NO: 3491242 - RNA, 18 nt, Pseudomonas aeruginosa PA01
ggcucucgcgcagcagga

SEQ ID NO: 3491243 - RNA, 22 nt, Pseudomonas aeruginosa PA01
ggcucugcuccagcaaugccag

SEQ ID NO: 3491244 - RNA, 17 nt, Pseudomonas aeruginosa PA01
ggcucugcuucuguccc

SEQ ID NO: 3491245 - RNA, 22 nt, Pseudomonas aeruginosa PA01
ggcucuggaugcggcgcugcca

SEQ ID NO: 3491246 - RNA, 12 nt, Pseudomonas aeruginosa PA01
ggcucuggcgca

SEQ ID NO: 3491247 - RNA, 16 nt, Pseudomonas aeruginosa PA01
ggcucuggcgcaggga

SEQ ID NO: 3491248 - RNA, 13 nt, Pseudomonas aeruginosa PA01
ggcucugggccau

SEQ ID NO: 3491249 - RNA, 21 nt, Pseudomonas aeruginosa PA01
ggcucugguagccgcagucca

SEQ ID NO: 3491250 - RNA, 18 nt, Pseudomonas aeruginosa PA01
ggcucuguuccucggcgg

SEQ ID NO: 3491251 - RNA, 19 nt, Pseudomonas aeruginosa PA01
ggcucuguuccucggcggc

SEQ ID NO: 3491252 - RNA, 13 nt, Pseudomonas aeruginosa PA01
ggcucuuggucgc

SEQ ID NO: 3491253 - RNA, 22 nt, Pseudomonas aeruginosa PA01
ggcucuuugcgacugacgcuca

SEQ ID NO: 3491254 - RNA, 22 nt, Pseudomonas aeruginosa PA01
ggcucuuuucuauuccggggac

SEQ ID NO: 3491255 - RNA, 14 nt, Pseudomonas aeruginosa PA01
ggcugaacagcgcc

SEQ ID NO: 3491256 - RNA, 17 nt, Pseudomonas aeruginosa PA01
ggcugaacagcgccacc

SEQ ID NO: 3491257 - RNA, 18 nt, Pseudomonas aeruginosa PA01
ggcugaacagcgccacca

SEQ ID NO: 3491258 - RNA, 19 nt, Pseudomonas aeruginosa PA01
ggcugaacagcgccaccag

SEQ ID NO: 3491259 - RNA, 23 nt, Pseudomonas aeruginosa PA01
ggcugaacagcgccaccagcaug

SEQ ID NO: 3491260 - RNA, 18 nt, Pseudomonas aeruginosa PA01
ggcugaagaagcugcccc

SEQ ID NO: 3491261 - RNA, 15 nt, Pseudomonas aeruginosa PA01
ggcugaagcggccgc

SEQ ID NO: 3491262 - RNA, 16 nt, Pseudomonas aeruginosa PA01
ggcugaagcggccgcc

SEQ ID NO: 3491263 - RNA, 15 nt, Pseudomonas aeruginosa PA01
ggcugaaggccgaac

SEQ ID NO: 3491264 - RNA, 17 nt, Pseudomonas aeruginosa PA01
ggcugaauaccacgugg

SEQ ID NO: 3491265 - RNA, 23 nt, Pseudomonas aeruginosa PA01
ggcugaauaccacguggccggcg

SEQ ID NO: 3491266 - RNA, 21 nt, Pseudomonas aeruginosa PA01
ggcugacccgcuguccgccgg

SEQ ID NO: 3491267 - RNA, 21 nt, Pseudomonas aeruginosa PA01
ggcugaccgcgugggccggca

SEQ ID NO: 3491268 - RNA, 15 nt, Pseudomonas aeruginosa PA01
ggcugaccuucgccg

SEQ ID NO: 3491269 - RNA, 13 nt, Pseudomonas aeruginosa PA01
ggcugacgcuggc

SEQ ID NO: 3491270 - RNA, 19 nt, Pseudomonas aeruginosa PA01
ggcugacgcuggcgaaggc

SEQ ID NO: 3491271 - RNA, 16 nt, Pseudomonas aeruginosa PA01
ggcugacgucgacgca

SEQ ID NO: 3491272 - RNA, 22 nt, Pseudomonas aeruginosa PA01
ggcugacgucgacgcagcgcgc

SEQ ID NO: 3491273 - RNA, 22 nt, Pseudomonas aeruginosa PA01
ggcugagaccuuccugccagcg

SEQ ID NO: 3491274 - RNA, 23 nt, Pseudomonas aeruginosa PA01
ggcugagaccuuccugccagcgc

SEQ ID NO: 3491275 - RNA, 14 nt, Pseudomonas aeruginosa PA01
ggcugagacgcugc

SEQ ID NO: 3491276 - RNA, 16 nt, Pseudomonas aeruginosa PA01
ggcugagacgcugccg

SEQ ID NO: 3491277 - RNA, 17 nt, Pseudomonas aeruginosa PA01
ggcugagacgcugccgu

SEQ ID NO: 3491278 - RNA, 15 nt, Pseudomonas aeruginosa PA01
ggcugagcgccaggc

SEQ ID NO: 3491279 - RNA, 16 nt, Pseudomonas aeruginosa PA01
ggcugagcgccaggcg

SEQ ID NO: 3491280 - RNA, 17 nt, Pseudomonas aeruginosa PA01
ggcugagcgccaggcgc

SEQ ID NO: 3491281 - RNA, 20 nt, Pseudomonas aeruginosa PA01
ggcugaggccgacgaacagc

SEQ ID NO: 3491282 - RNA, 22 nt, Pseudomonas aeruginosa PA01
ggcugaggccgacgaacagcca

SEQ ID NO: 3491283 - RNA, 12 nt, Pseudomonas aeruginosa PA01
ggcugaggcugg

SEQ ID NO: 3491284 - RNA, 15 nt, Pseudomonas aeruginosa PA01
ggcugaggcuggcga

SEQ ID NO: 3491285 - RNA, 16 nt, Pseudomonas aeruginosa PA01
ggcugaggcuggcgac

SEQ ID NO: 3491286 - RNA, 15 nt, Pseudomonas aeruginosa PA01
ggcugaucagcccgc

SEQ ID NO: 3491287 - RNA, 14 nt, Pseudomonas aeruginosa PA01
ggcugaucggccgc

SEQ ID NO: 3491288 - RNA, 15 nt, Pseudomonas aeruginosa PA01
ggcugaucggccgcc

SEQ ID NO: 3491289 - RNA, 18 nt, Pseudomonas aeruginosa PA01
ggcugaucggcgcgccgg

SEQ ID NO: 3491290 - RNA, 19 nt, Pseudomonas aeruginosa PA01
ggcugaucggcgcgccggc

SEQ ID NO: 3491291 - RNA, 17 nt, Pseudomonas aeruginosa PA01
ggcugaucucggccaug

SEQ ID NO: 3491292 - RNA, 18 nt, Pseudomonas aeruginosa PA01
ggcugaucucggccaugg

SEQ ID NO: 3491293 - RNA, 18 nt, Pseudomonas aeruginosa PA01
ggcugaucuugccgcugg

SEQ ID NO: 3491294 - RNA, 16 nt, Pseudomonas aeruginosa PA01
ggcugaugccgcggua

SEQ ID NO: 3491295 - RNA, 21 nt, Pseudomonas aeruginosa PA01
ggcugcaacgagaggaagucg

SEQ ID NO: 3491296 - RNA, 14 nt, Pseudomonas aeruginosa PA01
ggcugcaacgccgc

SEQ ID NO: 3491297 - RNA, 15 nt, Pseudomonas aeruginosa PA01
ggcugcaacgccgcg

SEQ ID NO: 3491298 - RNA, 18 nt, Pseudomonas aeruginosa PA01
ggcugcaacgccgcgggu

SEQ ID NO: 3491299 - RNA, 15 nt, Pseudomonas aeruginosa PA01
ggcugcaacgccggc

SEQ ID NO: 3491300 - RNA, 16 nt, Pseudomonas aeruginosa PA01
ggcugcaacgccggcc

SEQ ID NO: 3491301 - RNA, 13 nt, Pseudomonas aeruginosa PA01
ggcugcagguagg

SEQ ID NO: 3491302 - RNA, 21 nt, Pseudomonas aeruginosa PA01
ggcugcagguaggcgguggcg

SEQ ID NO: 3491303 - RNA, 15 nt, Pseudomonas aeruginosa PA01
ggcugcaucggcucg

SEQ ID NO: 3491304 - RNA, 16 nt, Pseudomonas aeruginosa PA01
ggcugcaucggcucgg

SEQ ID NO: 3491305 - RNA, 17 nt, Pseudomonas aeruginosa PA01
ggcugcaucggcucggc

SEQ ID NO: 3491306 - RNA, 22 nt, Pseudomonas aeruginosa PA01
ggcugcaugccgggguccgccg

SEQ ID NO: 3491307 - RNA, 15 nt, Pseudomonas aeruginosa PA01
ggcugcauguccgcc

SEQ ID NO: 3491308 - RNA, 17 nt, Pseudomonas aeruginosa PA01
ggcugcauguccgccag

SEQ ID NO: 3491309 - RNA, 20 nt, Pseudomonas aeruginosa PA01
ggcugccaccgagggcagga

SEQ ID NO: 3491310 - RNA, 18 nt, Pseudomonas aeruginosa PA01
ggcugcccaacuggcgga

SEQ ID NO: 3491311 - RNA, 23 nt, Pseudomonas aeruginosa PA01
ggcugcccaacuggcggaugcgu

SEQ ID NO: 3491312 - RNA, 12 nt, Pseudomonas aeruginosa PA01
ggcugcccacca

SEQ ID NO: 3491313 - RNA, 13 nt, Pseudomonas aeruginosa PA01
ggcugcccaggcu

SEQ ID NO: 3491314 - RNA, 24 nt, Pseudomonas aeruginosa PA01
ggcugcccagguagccggcgagcg

SEQ ID NO: 3491315 - RNA, 21 nt, Pseudomonas aeruginosa PA01
ggcugcccaguugcgcggcga

SEQ ID NO: 3491316 - RNA, 20 nt, Pseudomonas aeruginosa PA01
ggcugccccucacaccacca

SEQ ID NO: 3491317 - RNA, 21 nt, Pseudomonas aeruginosa PA01
ggcugccccucacaccaccag

SEQ ID NO: 3491318 - RNA, 15 nt, Pseudomonas aeruginosa PA01
ggcugcccucgacga

SEQ ID NO: 3491319 - RNA, 18 nt, Pseudomonas aeruginosa PA01
ggcugccgaacaggcguc

SEQ ID NO: 3491320 - RNA, 19 nt, Pseudomonas aeruginosa PA01
ggcugccgagaaucugccc

SEQ ID NO: 3491321 - RNA, 11 nt, Pseudomonas aeruginosa PA01
ggcugccgagc

SEQ ID NO: 3491322 - RNA, 14 nt, Pseudomonas aeruginosa PA01
ggcugccgagcagg

SEQ ID NO: 3491323 - RNA, 21 nt, Pseudomonas aeruginosa PA01
ggcugccgaggguguagagga

SEQ ID NO: 3491324 - RNA, 15 nt, Pseudomonas aeruginosa PA01
ggcugccgcagauca

SEQ ID NO: 3491325 - RNA, 20 nt, Pseudomonas aeruginosa PA01
ggcugccgcaguagaugccg

SEQ ID NO: 3491326 - RNA, 19 nt, Pseudomonas aeruginosa PA01
ggcugccgccagcucaugg

SEQ ID NO: 3491327 - RNA, 13 nt, Pseudomonas aeruginosa PA01
ggcugccgcccgg

SEQ ID NO: 3491328 - RNA, 13 nt, Pseudomonas aeruginosa PA01
ggcugccgccgcc

SEQ ID NO: 3491329 - RNA, 15 nt, Pseudomonas aeruginosa PA01
ggcugccgccgccgu

SEQ ID NO: 3491330 - RNA, 16 nt, Pseudomonas aeruginosa PA01
ggcugccgccgccguc

SEQ ID NO: 3491331 - RNA, 22 nt, Pseudomonas aeruginosa PA01
ggcugccgccuucgcgggccag

SEQ ID NO: 3491332 - RNA, 17 nt, Pseudomonas aeruginosa PA01
ggcugccggacgcgauc

SEQ ID NO: 3491333 - RNA, 15 nt, Pseudomonas aeruginosa PA01
ggcugccggcccucg

SEQ ID NO: 3491334 - RNA, 12 nt, Pseudomonas aeruginosa PA01
ggcugccgggcu

SEQ ID NO: 3491335 - RNA, 19 nt, Pseudomonas aeruginosa PA01
ggcugccgggcucugguag

SEQ ID NO: 3491336 - RNA, 18 nt, Pseudomonas aeruginosa PA01
ggcugccguugcggcccu

SEQ ID NO: 3491337 - RNA, 18 nt, Pseudomonas aeruginosa PA01
ggcugcgcaccucggcca

SEQ ID NO: 3491338 - RNA, 19 nt, Pseudomonas aeruginosa PA01
ggcugcgcaccucggccag

SEQ ID NO: 3491339 - RNA, 13 nt, Pseudomonas aeruginosa PA01
ggcugcgccgcgu

SEQ ID NO: 3491340 - RNA, 23 nt, Pseudomonas aeruginosa PA01
ggcugcgccgcguucgccgagcu

SEQ ID NO: 3491341 - RNA, 16 nt, Pseudomonas aeruginosa PA01
ggcugcgccgcugcgg

SEQ ID NO: 3491342 - RNA, 17 nt, Pseudomonas aeruginosa PA01
ggcugcgccgcugcggc

SEQ ID NO: 3491343 - RNA, 12 nt, Pseudomonas aeruginosa PA01
ggcugcgcgcca

SEQ ID NO: 3491344 - RNA, 14 nt, Pseudomonas aeruginosa PA01
ggcugcgcgccacc

SEQ ID NO: 3491345 - RNA, 17 nt, Pseudomonas aeruginosa PA01
ggcugcgcggaguggau

SEQ ID NO: 3491346 - RNA, 12 nt, Pseudomonas aeruginosa PA01
ggcugcgcucac

SEQ ID NO: 3491347 - RNA, 14 nt, Pseudomonas aeruginosa PA01
ggcugcgcucggcg

SEQ ID NO: 3491348 - RNA, 16 nt, Pseudomonas aeruginosa PA01
ggcugcgcucggcgcu

SEQ ID NO: 3491349 - RNA, 13 nt, Pseudomonas aeruginosa PA01
ggcugcgcugggc

SEQ ID NO: 3491350 - RNA, 22 nt, Pseudomonas aeruginosa PA01
ggcugcggagcgucggaagcgu

SEQ ID NO: 3491351 - RNA, 12 nt, Pseudomonas aeruginosa PA01
ggcugcggccuc

SEQ ID NO: 3491352 - RNA, 13 nt, Pseudomonas aeruginosa PA01
ggcugcggccucg

SEQ ID NO: 3491353 - RNA, 20 nt, Pseudomonas aeruginosa PA01
ggcugcggcggaaggcggcg

SEQ ID NO: 3491354 - RNA, 18 nt, Pseudomonas aeruginosa PA01
ggcugcgucguuggccgg

SEQ ID NO: 3491355 - RNA, 12 nt, Pseudomonas aeruginosa PA01
ggcugcgugcca

SEQ ID NO: 3491356 - RNA, 16 nt, Pseudomonas aeruginosa PA01
ggcugcgugccagcac

SEQ ID NO: 3491357 - RNA, 13 nt, Pseudomonas aeruginosa PA01
ggcugcuccggau

SEQ ID NO: 3491358 - RNA, 18 nt, Pseudomonas aeruginosa PA01
ggcugcuccggaucgcgc

SEQ ID NO: 3491359 - RNA, 12 nt, Pseudomonas aeruginosa PA01
ggcugcucgccu

SEQ ID NO: 3491360 - RNA, 20 nt, Pseudomonas aeruginosa PA01
ggcugcucgccucgggccau

SEQ ID NO: 3491361 - RNA, 22 nt, Pseudomonas aeruginosa PA01
ggcugcucgccucgggccauga

SEQ ID NO: 3491362 - RNA, 14 nt, Pseudomonas aeruginosa PA01
ggcugcugcgccug

SEQ ID NO: 3491363 - RNA, 19 nt, Pseudomonas aeruginosa PA01
ggcugcugcgccuggccgc

SEQ ID NO: 3491364 - RNA, 14 nt, Pseudomonas aeruginosa PA01
ggcugcugcugcgg

SEQ ID NO: 3491365 - RNA, 15 nt, Pseudomonas aeruginosa PA01
ggcugcugcugcggc

SEQ ID NO: 3491366 - RNA, 17 nt, Pseudomonas aeruginosa PA01
ggcugcugcugcggcuu

SEQ ID NO: 3491367 - RNA, 12 nt, Pseudomonas aeruginosa PA01
ggcugcuggcga

SEQ ID NO: 3491368 - RNA, 14 nt, Pseudomonas aeruginosa PA01
ggcugcuggcgaag

SEQ ID NO: 3491369 - RNA, 19 nt, Pseudomonas aeruginosa PA01
ggcugcuggcgaagcuggg

SEQ ID NO: 3491370 - RNA, 22 nt, Pseudomonas aeruginosa PA01
ggcugcuggcgaagcuggggcu

SEQ ID NO: 3491371 - RNA, 14 nt, Pseudomonas aeruginosa PA01
ggcugcuguccagc

SEQ ID NO: 3491372 - RNA, 16 nt, Pseudomonas aeruginosa PA01
ggcugcuucggcagcc

SEQ ID NO: 3491373 - RNA, 16 nt, Pseudomonas aeruginosa PA01
ggcugcuugccgcuca

SEQ ID NO: 3491374 - RNA, 13 nt, Pseudomonas aeruginosa PA01
ggcugcuugccgg

SEQ ID NO: 3491375 - RNA, 18 nt, Pseudomonas aeruginosa PA01
ggcugcuugccggugcca

SEQ ID NO: 3491376 - RNA, 13 nt, Pseudomonas aeruginosa PA01
ggcugcuuggcca

SEQ ID NO: 3491377 - RNA, 21 nt, Pseudomonas aeruginosa PA01
ggcugcuuggccaggucgcgc

SEQ ID NO: 3491378 - RNA, 16 nt, Pseudomonas aeruginosa PA01
ggcuggaagccgcgcu

SEQ ID NO: 3491379 - RNA, 21 nt, Pseudomonas aeruginosa PA01
ggcuggaagccgcgcucgcgg

SEQ ID NO: 3491380 - RNA, 15 nt, Pseudomonas aeruginosa PA01
ggcuggaccuccugg

SEQ ID NO: 3491381 - RNA, 22 nt, Pseudomonas aeruginosa PA01
ggcuggacgugcaggaucaccu

SEQ ID NO: 3491382 - RNA, 19 nt, Pseudomonas aeruginosa PA01
ggcuggaucgaucucgucg

SEQ ID NO: 3491383 - RNA, 22 nt, Pseudomonas aeruginosa PA01
ggcuggaucgaucucgucggcg

SEQ ID NO: 3491384 - RNA, 14 nt, Pseudomonas aeruginosa PA01
ggcuggcagggcgc

SEQ ID NO: 3491385 - RNA, 19 nt, Pseudomonas aeruginosa PA01
ggcuggcagggcgcgucca

SEQ ID NO: 3491386 - RNA, 20 nt, Pseudomonas aeruginosa PA01
ggcuggcaggugccgcucgu

SEQ ID NO: 3491387 - RNA, 15 nt, Pseudomonas aeruginosa PA01
ggcuggccaccagca

SEQ ID NO: 3491388 - RNA, 15 nt, Pseudomonas aeruginosa PA01
ggcuggccaccgcca

SEQ ID NO: 3491389 - RNA, 21 nt, Pseudomonas aeruginosa PA01
ggcuggccaccgccaggaccu

SEQ ID NO: 3491390 - RNA, 23 nt, Pseudomonas aeruginosa PA01
ggcuggccagaauuccagcaggu

SEQ ID NO: 3491391 - RNA, 12 nt, Pseudomonas aeruginosa PA01
ggcuggccagca

SEQ ID NO: 3491392 - RNA, 21 nt, Pseudomonas aeruginosa PA01
ggcuggccagcaauacccgcc

SEQ ID NO: 3491393 - RNA, 13 nt, Pseudomonas aeruginosa PA01
ggcuggccagcag

SEQ ID NO: 3491394 - RNA, 15 nt, Pseudomonas aeruginosa PA01
ggcuggccagcaggc

SEQ ID NO: 3491395 - RNA, 21 nt, Pseudomonas aeruginosa PA01
ggcuggccagcaggcuggcgg

SEQ ID NO: 3491396 - RNA, 14 nt, Pseudomonas aeruginosa PA01
ggcuggccagcccu

SEQ ID NO: 3491397 - RNA, 15 nt, Pseudomonas aeruginosa PA01
ggcuggccagcccug

SEQ ID NO: 3491398 - RNA, 22 nt, Pseudomonas aeruginosa PA01
ggcuggccauccgcccugcggg

SEQ ID NO: 3491399 - RNA, 23 nt, Pseudomonas aeruginosa PA01
ggcuggccaugauccggugcagg

SEQ ID NO: 3491400 - RNA, 13 nt, Pseudomonas aeruginosa PA01
ggcuggccccggu

SEQ ID NO: 3491401 - RNA, 14 nt, Pseudomonas aeruginosa PA01
ggcuggcccucggc

SEQ ID NO: 3491402 - RNA, 13 nt, Pseudomonas aeruginosa PA01
ggcuggccgagga

SEQ ID NO: 3491403 - RNA, 14 nt, Pseudomonas aeruginosa PA01
ggcuggccgaggac

SEQ ID NO: 3491404 - RNA, 21 nt, Pseudomonas aeruginosa PA01
ggcuggccgaggacccggcgg

SEQ ID NO: 3491405 - RNA, 15 nt, Pseudomonas aeruginosa PA01
ggcuggccgagggcg

SEQ ID NO: 3491406 - RNA, 19 nt, Pseudomonas aeruginosa PA01
ggcuggccgagggcgcgca

SEQ ID NO: 3491407 - RNA, 13 nt, Pseudomonas aeruginosa PA01
ggcuggccgccuc

SEQ ID NO: 3491408 - RNA, 15 nt, Pseudomonas aeruginosa PA01
ggcuggccgcgacgu

SEQ ID NO: 3491409 - RNA, 13 nt, Pseudomonas aeruginosa PA01
ggcuggccgcggu

SEQ ID NO: 3491410 - RNA, 13 nt, Pseudomonas aeruginosa PA01
ggcuggccgucga

SEQ ID NO: 3491411 - RNA, 19 nt, Pseudomonas aeruginosa PA01
ggcuggccgucgacccgcc

SEQ ID NO: 3491412 - RNA, 12 nt, Pseudomonas aeruginosa PA01
ggcuggccucgg

SEQ ID NO: 3491413 - RNA, 14 nt, Pseudomonas aeruginosa PA01
ggcuggccucggcg

SEQ ID NO: 3491414 - RNA, 15 nt, Pseudomonas aeruginosa PA01
ggcuggccucggcga

SEQ ID NO: 3491415 - RNA, 13 nt, Pseudomonas aeruginosa PA01
ggcuggccuuggc

SEQ ID NO: 3491416 - RNA, 15 nt, Pseudomonas aeruginosa PA01
ggcuggccuuggcca

SEQ ID NO: 3491417 - RNA, 12 nt, Pseudomonas aeruginosa PA01
ggcuggcgaacc

SEQ ID NO: 3491418 - RNA, 18 nt, Pseudomonas aeruginosa PA01
ggcuggcgaccggguccu

SEQ ID NO: 3491419 - RNA, 19 nt, Pseudomonas aeruginosa PA01
ggcuggcgcaggaccgcca

SEQ ID NO: 3491420 - RNA, 16 nt, Pseudomonas aeruginosa PA01
ggcuggcgccgcgggu

SEQ ID NO: 3491421 - RNA, 12 nt, Pseudomonas aeruginosa PA01
ggcuggcgcgau

SEQ ID NO: 3491422 - RNA, 17 nt, Pseudomonas aeruginosa PA01
ggcuggcgcuugccgcg

SEQ ID NO: 3491423 - RNA, 16 nt, Pseudomonas aeruginosa PA01
ggcuggcggcauaggc

SEQ ID NO: 3491424 - RNA, 19 nt, Pseudomonas aeruginosa PA01
ggcuggcggcaucggcgcc

SEQ ID NO: 3491425 - RNA, 20 nt, Pseudomonas aeruginosa PA01
ggcuggcggcaucggcgccg

SEQ ID NO: 3491426 - RNA, 21 nt, Pseudomonas aeruginosa PA01
ggcuggcggcaucggcgccgc

SEQ ID NO: 3491427 - RNA, 12 nt, Pseudomonas aeruginosa PA01
ggcuggcggcca

SEQ ID NO: 3491428 - RNA, 14 nt, Pseudomonas aeruginosa PA01
ggcuggcggcucgg

SEQ ID NO: 3491429 - RNA, 15 nt, Pseudomonas aeruginosa PA01
ggcuggcggcucggc

SEQ ID NO: 3491430 - RNA, 13 nt, Pseudomonas aeruginosa PA01
ggcuggcgggguc

SEQ ID NO: 3491431 - RNA, 19 nt, Pseudomonas aeruginosa PA01
ggcuggcggggucgcgccg

SEQ ID NO: 3491432 - RNA, 17 nt, Pseudomonas aeruginosa PA01
ggcuggcuccccccugg

SEQ ID NO: 3491433 - RNA, 19 nt, Pseudomonas aeruginosa PA01
ggcuggcugcccucgacga

SEQ ID NO: 3491434 - RNA, 20 nt, Pseudomonas aeruginosa PA01
ggcuggcugguaacgggcga

SEQ ID NO: 3491435 - RNA, 15 nt, Pseudomonas aeruginosa PA01
ggcugggcagcgccg

SEQ ID NO: 3491436 - RNA, 18 nt, Pseudomonas aeruginosa PA01
ggcugggcagcgccgccg

SEQ ID NO: 3491437 - RNA, 14 nt, Pseudomonas aeruginosa PA01
ggcugggcgcccuu

SEQ ID NO: 3491438 - RNA, 17 nt, Pseudomonas aeruginosa PA01
ggcugggguugcggcgc

SEQ ID NO: 3491439 - RNA, 18 nt, Pseudomonas aeruginosa PA01
ggcugggguugcggcgcc

SEQ ID NO: 3491440 - RNA, 15 nt, Pseudomonas aeruginosa PA01
ggcugggucggcugg

SEQ ID NO: 3491441 - RNA, 16 nt, Pseudomonas aeruginosa PA01
ggcuggguucggcgag

SEQ ID NO: 3491442 - RNA, 20 nt, Pseudomonas aeruginosa PA01
ggcugguaugcagcaacccg

SEQ ID NO: 3491443 - RNA, 15 nt, Pseudomonas aeruginosa PA01
ggcuggucaggcuga

SEQ ID NO: 3491444 - RNA, 18 nt, Pseudomonas aeruginosa PA01
ggcuggucaguucggccc

SEQ ID NO: 3491445 - RNA, 19 nt, Pseudomonas aeruginosa PA01
ggcuggucaguucggccca

SEQ ID NO: 3491446 - RNA, 15 nt, Pseudomonas aeruginosa PA01
ggcuggucggcuucc

SEQ ID NO: 3491447 - RNA, 14 nt, Pseudomonas aeruginosa PA01
ggcuggugccgcug

SEQ ID NO: 3491448 - RNA, 15 nt, Pseudomonas aeruginosa PA01
ggcuggugccgcugu

SEQ ID NO: 3491449 - RNA, 14 nt, Pseudomonas aeruginosa PA01
ggcuggugccguac

SEQ ID NO: 3491450 - RNA, 13 nt, Pseudomonas aeruginosa PA01
ggcuggugcgggu

SEQ ID NO: 3491451 - RNA, 22 nt, Pseudomonas aeruginosa PA01
ggcugguggccguugagcaccu

SEQ ID NO: 3491452 - RNA, 18 nt, Pseudomonas aeruginosa PA01
ggcugguggucaccgcca

SEQ ID NO: 3491453 - RNA, 21 nt, Pseudomonas aeruginosa PA01
ggcugguggucaccgccagcg

SEQ ID NO: 3491454 - RNA, 23 nt, Pseudomonas aeruginosa PA01
ggcugguggucaccgccagcggg

SEQ ID NO: 3491455 - RNA, 16 nt, Pseudomonas aeruginosa PA01
ggcugguucagcgggu

SEQ ID NO: 3491456 - RNA, 18 nt, Pseudomonas aeruginosa PA01
ggcugguucagcggguuc

SEQ ID NO: 3491457 - RNA, 16 nt, Pseudomonas aeruginosa PA01
ggcugguugccagcag

SEQ ID NO: 3491458 - RNA, 17 nt, Pseudomonas aeruginosa PA01
ggcugguugccagcagc

SEQ ID NO: 3491459 - RNA, 18 nt, Pseudomonas aeruginosa PA01
ggcugguugccagcagcg

SEQ ID NO: 3491460 - RNA, 15 nt, Pseudomonas aeruginosa PA01
ggcuguaaucgccgc

SEQ ID NO: 3491461 - RNA, 19 nt, Pseudomonas aeruginosa PA01
ggcuguaaucgccgcuucg

SEQ ID NO: 3491462 - RNA, 21 nt, Pseudomonas aeruginosa PA01
ggcuguacagcaggagcgcca

SEQ ID NO: 3491463 - RNA, 18 nt, Pseudomonas aeruginosa PA01
ggcuguagccucccgccg

SEQ ID NO: 3491464 - RNA, 14 nt, Pseudomonas aeruginosa PA01
ggcuguagcgcucc

SEQ ID NO: 3491465 - RNA, 21 nt, Pseudomonas aeruginosa PA01
ggcuguagcgcuccuguucgu

SEQ ID NO: 3491466 - RNA, 22 nt, Pseudomonas aeruginosa PA01
ggcuguagcucugcuggcugua

SEQ ID NO: 3491467 - RNA, 19 nt, Pseudomonas aeruginosa PA01
ggcuguagggacaggcuag

SEQ ID NO: 3491468 - RNA, 14 nt, Pseudomonas aeruginosa PA01
ggcuguagggcgaa

SEQ ID NO: 3491469 - RNA, 14 nt, Pseudomonas aeruginosa PA01
ggcuguccagcagg

SEQ ID NO: 3491470 - RNA, 21 nt, Pseudomonas aeruginosa PA01
ggcuguccagcaggcguuccu

SEQ ID NO: 3491471 - RNA, 14 nt, Pseudomonas aeruginosa PA01
ggcugucgacgcag

SEQ ID NO: 3491472 - RNA, 17 nt, Pseudomonas aeruginosa PA01
ggcugucgacgcagccg

SEQ ID NO: 3491473 - RNA, 23 nt, Pseudomonas aeruginosa PA01
ggcugucgacgcagccgggccgc

SEQ ID NO: 3491474 - RNA, 18 nt, Pseudomonas aeruginosa PA01
ggcugucgccgaucugca

SEQ ID NO: 3491475 - RNA, 13 nt, Pseudomonas aeruginosa PA01
ggcugucgcggac

SEQ ID NO: 3491476 - RNA, 19 nt, Pseudomonas aeruginosa PA01
ggcugucgcggacccgcgc

SEQ ID NO: 3491477 - RNA, 22 nt, Pseudomonas aeruginosa PA01
ggcugucgcggacccgcgccgg

SEQ ID NO: 3491478 - RNA, 15 nt, Pseudomonas aeruginosa PA01
ggcugucggccagcc

SEQ ID NO: 3491479 - RNA, 17 nt, Pseudomonas aeruginosa PA01
ggcugucggccagcccc

SEQ ID NO: 3491480 - RNA, 19 nt, Pseudomonas aeruginosa PA01
ggcugucggccagccccug

SEQ ID NO: 3491481 - RNA, 13 nt, Pseudomonas aeruginosa PA01
ggcugucggccau

SEQ ID NO: 3491482 - RNA, 18 nt, Pseudomonas aeruginosa PA01
ggcugucggccaucgccg

SEQ ID NO: 3491483 - RNA, 20 nt, Pseudomonas aeruginosa PA01
ggcugucggccaucgccguc

SEQ ID NO: 3491484 - RNA, 15 nt, Pseudomonas aeruginosa PA01
ggcugucguccuggg

SEQ ID NO: 3491485 - RNA, 12 nt, Pseudomonas aeruginosa PA01
ggcugugcaggg

SEQ ID NO: 3491486 - RNA, 20 nt, Pseudomonas aeruginosa PA01
ggcugugcagggcagcggcc

SEQ ID NO: 3491487 - RNA, 14 nt, Pseudomonas aeruginosa PA01
ggcugugcaucugc

SEQ ID NO: 3491488 - RNA, 19 nt, Pseudomonas aeruginosa PA01
ggcugugcaucugcgacau

SEQ ID NO: 3491489 - RNA, 22 nt, Pseudomonas aeruginosa PA01
ggcugugccauuccugggcccc

SEQ ID NO: 3491490 - RNA, 14 nt, Pseudomonas aeruginosa PA01
ggcugugcgccagg

SEQ ID NO: 3491491 - RNA, 15 nt, Pseudomonas aeruginosa PA01
ggcugugcgccaggc

SEQ ID NO: 3491492 - RNA, 22 nt, Pseudomonas aeruginosa PA01
ggcugugcucgaggaagcgccc

SEQ ID NO: 3491493 - RNA, 15 nt, Pseudomonas aeruginosa PA01
ggcugugcuggccac

SEQ ID NO: 3491494 - RNA, 14 nt, Pseudomonas aeruginosa PA01
ggcuguggcgcggc

SEQ ID NO: 3491495 - RNA, 18 nt, Pseudomonas aeruginosa PA01
ggcugugggucgggucgg

SEQ ID NO: 3491496 - RNA, 14 nt, Pseudomonas aeruginosa PA01
ggcuguugcccugg

SEQ ID NO: 3491497 - RNA, 15 nt, Pseudomonas aeruginosa PA01
ggcuguugcugggcu

SEQ ID NO: 3491498 - RNA, 14 nt, Pseudomonas aeruginosa PA01
ggcuguuucaggcc

SEQ ID NO: 3491499 - RNA, 18 nt, Pseudomonas aeruginosa PA01
ggcuguuucaggccggcg

SEQ ID NO: 3491500 - RNA, 22 nt, Pseudomonas aeruginosa PA01
ggcuuacccgcgaccacaggcg

SEQ ID NO: 3491501 - RNA, 11 nt, Pseudomonas aeruginosa PA01
ggcuucaacgc

SEQ ID NO: 3491502 - RNA, 14 nt, Pseudomonas aeruginosa PA01
ggcuucagcaacuc

SEQ ID NO: 3491503 - RNA, 23 nt, Pseudomonas aeruginosa PA01
ggcuucagccagaccggcagcgc

SEQ ID NO: 3491504 - RNA, 16 nt, Pseudomonas aeruginosa PA01
ggcuucagcgccaggc

SEQ ID NO: 3491505 - RNA, 19 nt, Pseudomonas aeruginosa PA01
ggcuucagcgccaggccga

SEQ ID NO: 3491506 - RNA, 22 nt, Pseudomonas aeruginosa PA01
ggcuucagcgccaggccgauca

SEQ ID NO: 3491507 - RNA, 13 nt, Pseudomonas aeruginosa PA01
ggcuucagcuucu

SEQ ID NO: 3491508 - RNA, 23 nt, Pseudomonas aeruginosa PA01
ggcuuccagccagcccucgggga

SEQ ID NO: 3491509 - RNA, 21 nt, Pseudomonas aeruginosa PA01
ggcuuccagguacggcccgcg

SEQ ID NO: 3491510 - RNA, 12 nt, Pseudomonas aeruginosa PA01
ggcuuccaucac

SEQ ID NO: 3491511 - RNA, 18 nt, Pseudomonas aeruginosa PA01
ggcuuccgccgccagguc

SEQ ID NO: 3491512 - RNA, 14 nt, Pseudomonas aeruginosa PA01
ggcuuccggcucca

SEQ ID NO: 3491513 - RNA, 21 nt, Pseudomonas aeruginosa PA01
ggcuuccuccaucgccucgcg

SEQ ID NO: 3491514 - RNA, 23 nt, Pseudomonas aeruginosa PA01
ggcuuccuccaucgccucgcgga

SEQ ID NO: 3491515 - RNA, 15 nt, Pseudomonas aeruginosa PA01
ggcuuccucgcccuc

SEQ ID NO: 3491516 - RNA, 14 nt, Pseudomonas aeruginosa PA01
ggcuuccuggcgcc

SEQ ID NO: 3491517 - RNA, 23 nt, Pseudomonas aeruginosa PA01
ggcuuccugguggaacagccgca

SEQ ID NO: 3491518 - RNA, 13 nt, Pseudomonas aeruginosa PA01
ggcuucgagcugc

SEQ ID NO: 3491519 - RNA, 17 nt, Pseudomonas aeruginosa PA01
ggcuucgcgcagauagu

SEQ ID NO: 3491520 - RNA, 16 nt, Pseudomonas aeruginosa PA01
ggcuucgcgcuccagg

SEQ ID NO: 3491521 - RNA, 19 nt, Pseudomonas aeruginosa PA01
ggcuucgcgcuccaggccc

SEQ ID NO: 3491522 - RNA, 18 nt, Pseudomonas aeruginosa PA01
ggcuucgcgguggaugcc

SEQ ID NO: 3491523 - RNA, 13 nt, Pseudomonas aeruginosa PA01
ggcuucgcgugcc

SEQ ID NO: 3491524 - RNA, 21 nt, Pseudomonas aeruginosa PA01
ggcuucgcguugcaggcgacg

SEQ ID NO: 3491525 - RNA, 12 nt, Pseudomonas aeruginosa PA01
ggcuucgcugau

SEQ ID NO: 3491526 - RNA, 13 nt, Pseudomonas aeruginosa PA01
ggcuucggcggcg

SEQ ID NO: 3491527 - RNA, 22 nt, Pseudomonas aeruginosa PA01
ggcuucgggaucguaggcgcgc

SEQ ID NO: 3491528 - RNA, 23 nt, Pseudomonas aeruginosa PA01
ggcuucguccagcgaggcgugga

SEQ ID NO: 3491529 - RNA, 15 nt, Pseudomonas aeruginosa PA01
ggcuucguccgccug

SEQ ID NO: 3491530 - RNA, 22 nt, Pseudomonas aeruginosa PA01
ggcuucguccugcugcuggccu

SEQ ID NO: 3491531 - RNA, 19 nt, Pseudomonas aeruginosa PA01
ggcuucugguucguccgcg

SEQ ID NO: 3491532 - RNA, 20 nt, Pseudomonas aeruginosa PA01
ggcuucuucaccaggccgaa

SEQ ID NO: 3491533 - RNA, 11 nt, Pseudomonas aeruginosa PA01
ggcuucuucag

SEQ ID NO: 3491534 - RNA, 17 nt, Pseudomonas aeruginosa PA01
ggcuucuuccuggccgg

SEQ ID NO: 3491535 - RNA, 18 nt, Pseudomonas aeruginosa PA01
ggcuucuuccuggccggg

SEQ ID NO: 3491536 - RNA, 16 nt, Pseudomonas aeruginosa PA01
ggcuugaccgccgccg

SEQ ID NO: 3491537 - RNA, 18 nt, Pseudomonas aeruginosa PA01
ggcuugaccgccgccgcc

SEQ ID NO: 3491538 - RNA, 15 nt, Pseudomonas aeruginosa PA01
ggcuugacuggcagu

SEQ ID NO: 3491539 - RNA, 19 nt, Pseudomonas aeruginosa PA01
ggcuugaggaaguggccgg

SEQ ID NO: 3491540 - RNA, 21 nt, Pseudomonas aeruginosa PA01
ggcuugaucgagucgccggcg

SEQ ID NO: 3491541 - RNA, 18 nt, Pseudomonas aeruginosa PA01
ggcuugcaguucagccac

SEQ ID NO: 3491542 - RNA, 16 nt, Pseudomonas aeruginosa PA01
ggcuugcccugcucgu

SEQ ID NO: 3491543 - RNA, 23 nt, Pseudomonas aeruginosa PA01
ggcuugccgaugucgccggcaug

SEQ ID NO: 3491544 - RNA, 14 nt, Pseudomonas aeruginosa PA01
ggcuugccggcgcg

SEQ ID NO: 3491545 - RNA, 23 nt, Pseudomonas aeruginosa PA01
ggcuugccggcgcgcgguuucuu

SEQ ID NO: 3491546 - RNA, 15 nt, Pseudomonas aeruginosa PA01
ggcuugccggggucg

SEQ ID NO: 3491547 - RNA, 17 nt, Pseudomonas aeruginosa PA01
ggcuugccgucgguguc

SEQ ID NO: 3491548 - RNA, 15 nt, Pseudomonas aeruginosa PA01
ggcuugcgcgccacc

SEQ ID NO: 3491549 - RNA, 21 nt, Pseudomonas aeruginosa PA01
ggcuugcgcgccaccagcgug

SEQ ID NO: 3491550 - RNA, 20 nt, Pseudomonas aeruginosa PA01
ggcuugcguucgcuccaguc

SEQ ID NO: 3491551 - RNA, 13 nt, Pseudomonas aeruginosa PA01
ggcuugcugacga

SEQ ID NO: 3491552 - RNA, 14 nt, Pseudomonas aeruginosa PA01
ggcuugcugcaggu

SEQ ID NO: 3491553 - RNA, 15 nt, Pseudomonas aeruginosa PA01
ggcuuggcccugcgc

SEQ ID NO: 3491554 - RNA, 19 nt, Pseudomonas aeruginosa PA01
ggcuuggucgggcgccgcg

SEQ ID NO: 3491555 - RNA, 18 nt, Pseudomonas aeruginosa PA01
ggcuuguccuuggccucc

SEQ ID NO: 3491556 - RNA, 19 nt, Pseudomonas aeruginosa PA01
ggcuuguucagcucggcgu

SEQ ID NO: 3491557 - RNA, 17 nt, Pseudomonas aeruginosa PA01
ggcuuuccaccgccagc

SEQ ID NO: 3491558 - RNA, 20 nt, Pseudomonas aeruginosa PA01
ggcuuuccaccgccagcacc

SEQ ID NO: 3491559 - RNA, 22 nt, Pseudomonas aeruginosa PA01
ggcuuuccaccgccagcaccca

SEQ ID NO: 3491560 - RNA, 19 nt, Pseudomonas aeruginosa PA01
ggcuuuccagcaggcgcuc

SEQ ID NO: 3491561 - RNA, 20 nt, Pseudomonas aeruginosa PA01
ggcuuuccagcaggcgcucg

SEQ ID NO: 3491562 - RNA, 14 nt, Pseudomonas aeruginosa PA01
ggcuuuccagcauu

SEQ ID NO: 3491563 - RNA, 18 nt, Pseudomonas aeruginosa PA01
ggcuuuccagggccuggc

SEQ ID NO: 3491564 - RNA, 21 nt, Pseudomonas aeruginosa PA01
ggcuuucccuguagcguuccg

SEQ ID NO: 3491565 - RNA, 20 nt, Pseudomonas aeruginosa PA01
ggcuuuccgucucaggcgcc

SEQ ID NO: 3491566 - RNA, 15 nt, Pseudomonas aeruginosa PA01
ggcuuuccucggcca

SEQ ID NO: 3491567 - RNA, 17 nt, Pseudomonas aeruginosa PA01
ggcuuucuucgccuggc

SEQ ID NO: 3491568 - RNA, 19 nt, Pseudomonas aeruginosa PA01
ggcuuuucauuaccggcga

SEQ ID NO: 3491569 - RNA, 21 nt, Pseudomonas aeruginosa PA01
ggcuuuucauuuaucgcugcg

SEQ ID NO: 3491570 - RNA, 19 nt, Pseudomonas aeruginosa PA01
ggcuuuuucaugagcgccc

SEQ ID NO: 3491571 - RNA, 19 nt, Pseudomonas aeruginosa PA01
ggcuuuuucaugggcgcgc

SEQ ID NO: 3491572 - RNA, 23 nt, Pseudomonas aeruginosa PA01
ggcuuuuucguuuccggcaggcu

SEQ ID NO: 3491573 - RNA, 16 nt, Pseudomonas aeruginosa PA01
ggcuuuuucucgucgc

SEQ ID NO: 3491574 - RNA, 17 nt, Pseudomonas aeruginosa PA01
ggcuuuuucucgucgcg

SEQ ID NO: 3491575 - RNA, 23 nt, Pseudomonas aeruginosa PA01
gggaaaagcccagguggcaggcc

SEQ ID NO: 3491576 - RNA, 20 nt, Pseudomonas aeruginosa PA01
gggaaaauggaacagucgcg

SEQ ID NO: 3491577 - RNA, 17 nt, Pseudomonas aeruginosa PA01
gggaaacaccaggccga

SEQ ID NO: 3491578 - RNA, 22 nt, Pseudomonas aeruginosa PA01
gggaaaccuucgguggcgacca

SEQ ID NO: 3491579 - RNA, 18 nt, Pseudomonas aeruginosa PA01
gggaaaucaccgccaccu

SEQ ID NO: 3491580 - RNA, 22 nt, Pseudomonas aeruginosa PA01
gggaaaucccggagaucggcug

SEQ ID NO: 3491581 - RNA, 19 nt, Pseudomonas aeruginosa PA01
gggaaauccuugagcaccc

SEQ ID NO: 3491582 - RNA, 20 nt, Pseudomonas aeruginosa PA01
gggaaaucgguugccgcgcc

SEQ ID NO: 3491583 - RNA, 14 nt, Pseudomonas aeruginosa PA01
gggaacacgcgcug

SEQ ID NO: 3491584 - RNA, 17 nt, Pseudomonas aeruginosa PA01
gggaacagcauggugaa

SEQ ID NO: 3491585 - RNA, 15 nt, Pseudomonas aeruginosa PA01
gggaacagcgccagc

SEQ ID NO: 3491586 - RNA, 17 nt, Pseudomonas aeruginosa PA01
gggaacagcgccagcgg

SEQ ID NO: 3491587 - RNA, 18 nt, Pseudomonas aeruginosa PA01
gggaacagcgccagcggc

SEQ ID NO: 3491588 - RNA, 22 nt, Pseudomonas aeruginosa PA01
gggaacagcgccagcggcagcg

SEQ ID NO: 3491589 - RNA, 18 nt, Pseudomonas aeruginosa PA01
gggaacauugccaccacc

SEQ ID NO: 3491590 - RNA, 15 nt, Pseudomonas aeruginosa PA01
gggaaccacaccugc

SEQ ID NO: 3491591 - RNA, 19 nt, Pseudomonas aeruginosa PA01
gggaacccgcggcgcgccu

SEQ ID NO: 3491592 - RNA, 22 nt, Pseudomonas aeruginosa PA01
gggaacgaguugggcgaccugc

SEQ ID NO: 3491593 - RNA, 19 nt, Pseudomonas aeruginosa PA01
gggaacgaugccgcaggca

SEQ ID NO: 3491594 - RNA, 21 nt, Pseudomonas aeruginosa PA01
gggaacgccgggcaacgccag

SEQ ID NO: 3491595 - RNA, 22 nt, Pseudomonas aeruginosa PA01
gggaacgccgggcaacgccagg

SEQ ID NO: 3491596 - RNA, 15 nt, Pseudomonas aeruginosa PA01
gggaacgucuggcca

SEQ ID NO: 3491597 - RNA, 12 nt, Pseudomonas aeruginosa PA01
gggaacuggcgu

SEQ ID NO: 3491598 - RNA, 15 nt, Pseudomonas aeruginosa PA01
gggaacugggcgagc

SEQ ID NO: 3491599 - RNA, 18 nt, Pseudomonas aeruginosa PA01
gggaacuuggcgcgcagg

SEQ ID NO: 3491600 - RNA, 13 nt, Pseudomonas aeruginosa PA01
gggaagcgcaggc

SEQ ID NO: 3491601 - RNA, 20 nt, Pseudomonas aeruginosa PA01
gggaagcgcgcgccaguccc

SEQ ID NO: 3491602 - RNA, 16 nt, Pseudomonas aeruginosa PA01
gggaagcgcggcucgg

SEQ ID NO: 3491603 - RNA, 22 nt, Pseudomonas aeruginosa PA01
gggaagcggucguagcccaugg

SEQ ID NO: 3491604 - RNA, 16 nt, Pseudomonas aeruginosa PA01
gggaagcugccuucca

SEQ ID NO: 3491605 - RNA, 13 nt, Pseudomonas aeruginosa PA01
gggaagggccgga

SEQ ID NO: 3491606 - RNA, 19 nt, Pseudomonas aeruginosa PA01
gggaaggucggcagcagcu

SEQ ID NO: 3491607 - RNA, 21 nt, Pseudomonas aeruginosa PA01
gggaagucguucccggccugg

SEQ ID NO: 3491608 - RNA, 13 nt, Pseudomonas aeruginosa PA01
gggaaucgccagc

SEQ ID NO: 3491609 - RNA, 14 nt, Pseudomonas aeruginosa PA01
gggaaucgccagca

SEQ ID NO: 3491610 - RNA, 20 nt, Pseudomonas aeruginosa PA01
gggaaucgccagcaggcugu

SEQ ID NO: 3491611 - RNA, 16 nt, Pseudomonas aeruginosa PA01
gggaaucgucacggcg

SEQ ID NO: 3491612 - RNA, 22 nt, Pseudomonas aeruginosa PA01
gggaaucgucacggcgugccgc

SEQ ID NO: 3491613 - RNA, 16 nt, Pseudomonas aeruginosa PA01
gggaaugcucagcacg

SEQ ID NO: 3491614 - RNA, 19 nt, Pseudomonas aeruginosa PA01
gggaaugcucagcacggcg

SEQ ID NO: 3491615 - RNA, 18 nt, Pseudomonas aeruginosa PA01
gggaauggagaugccgaa

SEQ ID NO: 3491616 - RNA, 20 nt, Pseudomonas aeruginosa PA01
gggaauggaugcgcggcagc

SEQ ID NO: 3491617 - RNA, 13 nt, Pseudomonas aeruginosa PA01
gggaauggcggau

SEQ ID NO: 3491618 - RNA, 14 nt, Pseudomonas aeruginosa PA01
gggaauucuuccgg

SEQ ID NO: 3491619 - RNA, 18 nt, Pseudomonas aeruginosa PA01
gggaauuucacgccgaag

SEQ ID NO: 3491620 - RNA, 14 nt, Pseudomonas aeruginosa PA01
gggacacggcgacc

SEQ ID NO: 3491621 - RNA, 20 nt, Pseudomonas aeruginosa PA01
gggacaggaagagcaggcgg

SEQ ID NO: 3491622 - RNA, 17 nt, Pseudomonas aeruginosa PA01
gggacagggcggcagcg

SEQ ID NO: 3491623 - RNA, 20 nt, Pseudomonas aeruginosa PA01
gggacagggcggcagcgugc

SEQ ID NO: 3491624 - RNA, 14 nt, Pseudomonas aeruginosa PA01
gggacagguugucg

SEQ ID NO: 3491625 - RNA, 20 nt, Pseudomonas aeruginosa PA01
gggacagguuucgcaagggu

SEQ ID NO: 3491626 - RNA, 16 nt, Pseudomonas aeruginosa PA01
gggacaucaccacgcg

SEQ ID NO: 3491627 - RNA, 18 nt, Pseudomonas aeruginosa PA01
gggacauggagaccuggc

SEQ ID NO: 3491628 - RNA, 14 nt, Pseudomonas aeruginosa PA01
gggacaugucgagg

SEQ ID NO: 3491629 - RNA, 21 nt, Pseudomonas aeruginosa PA01
gggaccggcugcuuggccagg

SEQ ID NO: 3491630 - RNA, 22 nt, Pseudomonas aeruginosa PA01
gggaccggcugcuuggccaggu

SEQ ID NO: 3491631 - RNA, 23 nt, Pseudomonas aeruginosa PA01
gggacgaagccgauugccagagu

SEQ ID NO: 3491632 - RNA, 19 nt, Pseudomonas aeruginosa PA01
gggacgaagcggaagccgg

SEQ ID NO: 3491633 - RNA, 20 nt, Pseudomonas aeruginosa PA01
gggacgaagcggaagccggg

SEQ ID NO: 3491634 - RNA, 13 nt, Pseudomonas aeruginosa PA01
gggacgcgcagcg

SEQ ID NO: 3491635 - RNA, 14 nt, Pseudomonas aeruginosa PA01
gggacgcgcagcgg

SEQ ID NO: 3491636 - RNA, 19 nt, Pseudomonas aeruginosa PA01
gggacgcgcaugcagggcg

SEQ ID NO: 3491637 - RNA, 16 nt, Pseudomonas aeruginosa PA01
gggacgcgccggcgga

SEQ ID NO: 3491638 - RNA, 21 nt, Pseudomonas aeruginosa PA01
gggacgcgccggcggaucaca

SEQ ID NO: 3491639 - RNA, 20 nt, Pseudomonas aeruginosa PA01
gggacggaacgucggccugg

SEQ ID NO: 3491640 - RNA, 15 nt, Pseudomonas aeruginosa PA01
gggacggcggcuggu

SEQ ID NO: 3491641 - RNA, 19 nt, Pseudomonas aeruginosa PA01
gggacggcugcccaacugg

SEQ ID NO: 3491642 - RNA, 15 nt, Pseudomonas aeruginosa PA01
gggacggugcaggcc

SEQ ID NO: 3491643 - RNA, 15 nt, Pseudomonas aeruginosa PA01
gggacuggggcaugg

SEQ ID NO: 3491644 - RNA, 12 nt, Pseudomonas aeruginosa PA01
gggagaacagca

SEQ ID NO: 3491645 - RNA, 21 nt, Pseudomonas aeruginosa PA01
gggagaacuuuucccagcggc

SEQ ID NO: 3491646 - RNA, 14 nt, Pseudomonas aeruginosa PA01
gggagcaggacgcc

SEQ ID NO: 3491647 - RNA, 16 nt, Pseudomonas aeruginosa PA01
gggagcaucuggcccg

SEQ ID NO: 3491648 - RNA, 14 nt, Pseudomonas aeruginosa PA01
gggagccaggcggc

SEQ ID NO: 3491649 - RNA, 22 nt, Pseudomonas aeruginosa PA01
gggagccuaccauuagaggaac

SEQ ID NO: 3491650 - RNA, 22 nt, Pseudomonas aeruginosa PA01
gggagcgacaccaugcuccgcc

SEQ ID NO: 3491651 - RNA, 14 nt, Pseudomonas aeruginosa PA01
gggagcgccggcgc

SEQ ID NO: 3491652 - RNA, 14 nt, Pseudomonas aeruginosa PA01
gggagcgccuggcg

SEQ ID NO: 3491653 - RNA, 13 nt, Pseudomonas aeruginosa PA01
gggagcgcucgcg

SEQ ID NO: 3491654 - RNA, 11 nt, Pseudomonas aeruginosa PA01
gggagcggccg

SEQ ID NO: 3491655 - RNA, 15 nt, Pseudomonas aeruginosa PA01
gggaggaacccaggu

SEQ ID NO: 3491656 - RNA, 16 nt, Pseudomonas aeruginosa PA01
gggaggaagcuccccg

SEQ ID NO: 3491657 - RNA, 13 nt, Pseudomonas aeruginosa PA01
gggaggcgccgcg

SEQ ID NO: 3491658 - RNA, 15 nt, Pseudomonas aeruginosa PA01
gggaggcgcuggcca

SEQ ID NO: 3491659 - RNA, 17 nt, Pseudomonas aeruginosa PA01
gggaggcgcuggccagc

SEQ ID NO: 3491660 - RNA, 18 nt, Pseudomonas aeruginosa PA01
gggaggucgcacgcagcg

SEQ ID NO: 3491661 - RNA, 22 nt, Pseudomonas aeruginosa PA01
gggaggucgcacgcagcgccgc

SEQ ID NO: 3491662 - RNA, 15 nt, Pseudomonas aeruginosa PA01
gggaggugcggcggu

SEQ ID NO: 3491663 - RNA, 16 nt, Pseudomonas aeruginosa PA01
gggaggugcggcggug

SEQ ID NO: 3491664 - RNA, 14 nt, Pseudomonas aeruginosa PA01
gggaguccaggcgg

SEQ ID NO: 3491665 - RNA, 16 nt, Pseudomonas aeruginosa PA01
gggaguccaggcgggc

SEQ ID NO: 3491666 - RNA, 15 nt, Pseudomonas aeruginosa PA01
gggagucgcuggcca

SEQ ID NO: 3491667 - RNA, 14 nt, Pseudomonas aeruginosa PA01
gggaguuccgcgca

SEQ ID NO: 3491668 - RNA, 16 nt, Pseudomonas aeruginosa PA01
gggauaaacggcggau

SEQ ID NO: 3491669 - RNA, 14 nt, Pseudomonas aeruginosa PA01
gggauacagcagcc

SEQ ID NO: 3491670 - RNA, 24 nt, Pseudomonas aeruginosa PA01
gggauaccggccaucagcaccagg

SEQ ID NO: 3491671 - RNA, 14 nt, Pseudomonas aeruginosa PA01
gggauagcuuucca

SEQ ID NO: 3491672 - RNA, 19 nt, Pseudomonas aeruginosa PA01
gggaucacgaagcggucgc

SEQ ID NO: 3491673 - RNA, 16 nt, Pseudomonas aeruginosa PA01
gggaucacucgccgcc

SEQ ID NO: 3491674 - RNA, 13 nt, Pseudomonas aeruginosa PA01
gggaucagcgaga

SEQ ID NO: 3491675 - RNA, 23 nt, Pseudomonas aeruginosa PA01
gggaucagcgagagcuguccggc

SEQ ID NO: 3491676 - RNA, 19 nt, Pseudomonas aeruginosa PA01
gggaucagcggcggggcca

SEQ ID NO: 3491677 - RNA, 20 nt, Pseudomonas aeruginosa PA01
gggaucaggucgccagcgcc

SEQ ID NO: 3491678 - RNA, 17 nt, Pseudomonas aeruginosa PA01
gggaucaggucgccgcu

SEQ ID NO: 3491679 - RNA, 23 nt, Pseudomonas aeruginosa PA01
gggaucgacgccgcuggcggcgc

SEQ ID NO: 3491680 - RNA, 17 nt, Pseudomonas aeruginosa PA01
gggaucgccacgccggc

SEQ ID NO: 3491681 - RNA, 18 nt, Pseudomonas aeruginosa PA01
gggaucgccacgccggcg

SEQ ID NO: 3491682 - RNA, 19 nt, Pseudomonas aeruginosa PA01
gggaucgccacgccggcgc

SEQ ID NO: 3491683 - RNA, 20 nt, Pseudomonas aeruginosa PA01
gggaucgccacgccggcgcu

SEQ ID NO: 3491684 - RNA, 23 nt, Pseudomonas aeruginosa PA01
gggaucgccacgccggcgcuccu

SEQ ID NO: 3491685 - RNA, 19 nt, Pseudomonas aeruginosa PA01
gggaucgcgaagaacacgc

SEQ ID NO: 3491686 - RNA, 17 nt, Pseudomonas aeruginosa PA01
gggaucgcgcggcuggc

SEQ ID NO: 3491687 - RNA, 17 nt, Pseudomonas aeruginosa PA01
gggaucggcgaucagcg

SEQ ID NO: 3491688 - RNA, 16 nt, Pseudomonas aeruginosa PA01
gggaucguaggcgcgc

SEQ ID NO: 3491689 - RNA, 20 nt, Pseudomonas aeruginosa PA01
gggaucguaggcgcgcaccu

SEQ ID NO: 3491690 - RNA, 18 nt, Pseudomonas aeruginosa PA01
gggaucuccucgacggcg

SEQ ID NO: 3491691 - RNA, 22 nt, Pseudomonas aeruginosa PA01
gggaucuggcccugcaacagga

SEQ ID NO: 3491692 - RNA, 15 nt, Pseudomonas aeruginosa PA01
gggaugcccggccgc

SEQ ID NO: 3491693 - RNA, 17 nt, Pseudomonas aeruginosa PA01
gggaugcccggccgcag

SEQ ID NO: 3491694 - RNA, 19 nt, Pseudomonas aeruginosa PA01
gggaugcccggccgcaggc

SEQ ID NO: 3491695 - RNA, 15 nt, Pseudomonas aeruginosa PA01
gggaugcccgucagg

SEQ ID NO: 3491696 - RNA, 18 nt, Pseudomonas aeruginosa PA01
gggaugccgccggcaucc

SEQ ID NO: 3491697 - RNA, 14 nt, Pseudomonas aeruginosa PA01
gggaugccggcggc

SEQ ID NO: 3491698 - RNA, 15 nt, Pseudomonas aeruginosa PA01
gggaugccggcggca

SEQ ID NO: 3491699 - RNA, 23 nt, Pseudomonas aeruginosa PA01
gggaugccuucgggagagcccgg

SEQ ID NO: 3491700 - RNA, 17 nt, Pseudomonas aeruginosa PA01
gggaugcgcgaggucug

SEQ ID NO: 3491701 - RNA, 15 nt, Pseudomonas aeruginosa PA01
gggauggccggcgcg

SEQ ID NO: 3491702 - RNA, 13 nt, Pseudomonas aeruginosa PA01
gggauggcgcggu

SEQ ID NO: 3491703 - RNA, 15 nt, Pseudomonas aeruginosa PA01
gggauggucgagggc

SEQ ID NO: 3491704 - RNA, 15 nt, Pseudomonas aeruginosa PA01
gggauguccgccgcc

SEQ ID NO: 3491705 - RNA, 16 nt, Pseudomonas aeruginosa PA01
gggauguuccaggccc

SEQ ID NO: 3491706 - RNA, 18 nt, Pseudomonas aeruginosa PA01
gggauuccgggucgaggc

SEQ ID NO: 3491707 - RNA, 22 nt, Pseudomonas aeruginosa PA01
gggauuccgggucgaggcugcc

SEQ ID NO: 3491708 - RNA, 15 nt, Pseudomonas aeruginosa PA01
gggauuccuugguca

SEQ ID NO: 3491709 - RNA, 17 nt, Pseudomonas aeruginosa PA01
gggauuguugcggcggg

SEQ ID NO: 3491710 - RNA, 17 nt, Pseudomonas aeruginosa PA01
gggcaaacagcuccggu

SEQ ID NO: 3491711 - RNA, 15 nt, Pseudomonas aeruginosa PA01
gggcaaaggcgcgca

SEQ ID NO: 3491712 - RNA, 17 nt, Pseudomonas aeruginosa PA01
gggcaaaggcgcgcagg

SEQ ID NO: 3491713 - RNA, 19 nt, Pseudomonas aeruginosa PA01
gggcaaaggcgcgcagggc

SEQ ID NO: 3491714 - RNA, 15 nt, Pseudomonas aeruginosa PA01
gggcaacaggccgau

SEQ ID NO: 3491715 - RNA, 14 nt, Pseudomonas aeruginosa PA01
gggcaacgccaggc

SEQ ID NO: 3491716 - RNA, 17 nt, Pseudomonas aeruginosa PA01
gggcaacgccaggccgc

SEQ ID NO: 3491717 - RNA, 18 nt, Pseudomonas aeruginosa PA01
gggcaacgccaggccgcu

SEQ ID NO: 3491718 - RNA, 19 nt, Pseudomonas aeruginosa PA01
gggcaacgcgcagaggcgc

SEQ ID NO: 3491719 - RNA, 20 nt, Pseudomonas aeruginosa PA01
gggcaacgcgcagaggcgcu

SEQ ID NO: 3491720 - RNA, 14 nt, Pseudomonas aeruginosa PA01
gggcaagcucgacg

SEQ ID NO: 3491721 - RNA, 12 nt, Pseudomonas aeruginosa PA01
gggcaccacgga

SEQ ID NO: 3491722 - RNA, 19 nt, Pseudomonas aeruginosa PA01
gggcaccaguggcgccgcc

SEQ ID NO: 3491723 - RNA, 17 nt, Pseudomonas aeruginosa PA01
gggcaccgccagcccgc

SEQ ID NO: 3491724 - RNA, 20 nt, Pseudomonas aeruginosa PA01
gggcaccgccgaggaacauc

SEQ ID NO: 3491725 - RNA, 14 nt, Pseudomonas aeruginosa PA01
gggcaccgcgccgg

SEQ ID NO: 3491726 - RNA, 13 nt, Pseudomonas aeruginosa PA01
gggcaccggcgga

SEQ ID NO: 3491727 - RNA, 20 nt, Pseudomonas aeruginosa PA01
gggcaccgucaccuguucgg

SEQ ID NO: 3491728 - RNA, 18 nt, Pseudomonas aeruginosa PA01
gggcacgaucugcgccgc

SEQ ID NO: 3491729 - RNA, 17 nt, Pseudomonas aeruginosa PA01
gggcacgcauagcgcgc

SEQ ID NO: 3491730 - RNA, 19 nt, Pseudomonas aeruginosa PA01
gggcacgcauagcgcgcug

SEQ ID NO: 3491731 - RNA, 13 nt, Pseudomonas aeruginosa PA01
gggcacgccgcuc

SEQ ID NO: 3491732 - RNA, 20 nt, Pseudomonas aeruginosa PA01
gggcacgccgguggccaggc

SEQ ID NO: 3491733 - RNA, 14 nt, Pseudomonas aeruginosa PA01
gggcacgcuggcga

SEQ ID NO: 3491734 - RNA, 12 nt, Pseudomonas aeruginosa PA01
gggcacggccag

SEQ ID NO: 3491735 - RNA, 21 nt, Pseudomonas aeruginosa PA01
gggcacggccagucgcguugg

SEQ ID NO: 3491736 - RNA, 14 nt, Pseudomonas aeruginosa PA01
gggcacgucgcgga

SEQ ID NO: 3491737 - RNA, 22 nt, Pseudomonas aeruginosa PA01
gggcacgugcagcggcagcguc

SEQ ID NO: 3491738 - RNA, 17 nt, Pseudomonas aeruginosa PA01
gggcacguugggaucgc

SEQ ID NO: 3491739 - RNA, 19 nt, Pseudomonas aeruginosa PA01
gggcacguugggaucgcug

SEQ ID NO: 3491740 - RNA, 23 nt, Pseudomonas aeruginosa PA01
gggcacuucguccaggccgccua

SEQ ID NO: 3491741 - RNA, 22 nt, Pseudomonas aeruginosa PA01
gggcacuucucgaacagcuccu

SEQ ID NO: 3491742 - RNA, 22 nt, Pseudomonas aeruginosa PA01
gggcacuuguugguauggcagc

SEQ ID NO: 3491743 - RNA, 19 nt, Pseudomonas aeruginosa PA01
gggcagacaccaccagguu

SEQ ID NO: 3491744 - RNA, 21 nt, Pseudomonas aeruginosa PA01
gggcagaccuggugggcggcg

SEQ ID NO: 3491745 - RNA, 16 nt, Pseudomonas aeruginosa PA01
gggcagaguggcgcgg

SEQ ID NO: 3491746 - RNA, 17 nt, Pseudomonas aeruginosa PA01
gggcagaguggcgcggc

SEQ ID NO: 3491747 - RNA, 21 nt, Pseudomonas aeruginosa PA01
gggcagaguggcgcggcugau

SEQ ID NO: 3491748 - RNA, 19 nt, Pseudomonas aeruginosa PA01
gggcagauguccaggcagg

SEQ ID NO: 3491749 - RNA, 20 nt, Pseudomonas aeruginosa PA01
gggcagauguccaggcaggc

SEQ ID NO: 3491750 - RNA, 14 nt, Pseudomonas aeruginosa PA01
gggcagcacgcugg

SEQ ID NO: 3491751 - RNA, 22 nt, Pseudomonas aeruginosa PA01
gggcagcacgcuggcgucgggc

SEQ ID NO: 3491752 - RNA, 23 nt, Pseudomonas aeruginosa PA01
gggcagcagccggaccagccguc

SEQ ID NO: 3491753 - RNA, 14 nt, Pseudomonas aeruginosa PA01
gggcagcaggucgc

SEQ ID NO: 3491754 - RNA, 12 nt, Pseudomonas aeruginosa PA01
gggcagccccuu

SEQ ID NO: 3491755 - RNA, 13 nt, Pseudomonas aeruginosa PA01
gggcagccgccgc

SEQ ID NO: 3491756 - RNA, 14 nt, Pseudomonas aeruginosa PA01
gggcagcgccgccg

SEQ ID NO: 3491757 - RNA, 22 nt, Pseudomonas aeruginosa PA01
gggcagcgcgauaucgcaggcc

SEQ ID NO: 3491758 - RNA, 12 nt, Pseudomonas aeruginosa PA01
gggcagcggccc

SEQ ID NO: 3491759 - RNA, 11 nt, Pseudomonas aeruginosa PA01
gggcagcggcg

SEQ ID NO: 3491760 - RNA, 14 nt, Pseudomonas aeruginosa PA01
gggcagcggcgagu

SEQ ID NO: 3491761 - RNA, 22 nt, Pseudomonas aeruginosa PA01
gggcagcucguugcacagcgcc

SEQ ID NO: 3491762 - RNA, 17 nt, Pseudomonas aeruginosa PA01
gggcagcuuggcgguca

SEQ ID NO: 3491763 - RNA, 23 nt, Pseudomonas aeruginosa PA01
gggcagcuuggcggucagcgacu

SEQ ID NO: 3491764 - RNA, 19 nt, Pseudomonas aeruginosa PA01
gggcaggauaucgcccagg

SEQ ID NO: 3491765 - RNA, 12 nt, Pseudomonas aeruginosa PA01
gggcaggcaugc

SEQ ID NO: 3491766 - RNA, 14 nt, Pseudomonas aeruginosa PA01
gggcaggcaugcgg

SEQ ID NO: 3491767 - RNA, 18 nt, Pseudomonas aeruginosa PA01
gggcaggcaugcggcccc

SEQ ID NO: 3491768 - RNA, 16 nt, Pseudomonas aeruginosa PA01
gggcaggccgaucauc

SEQ ID NO: 3491769 - RNA, 14 nt, Pseudomonas aeruginosa PA01
gggcaggcgcaggc

SEQ ID NO: 3491770 - RNA, 15 nt, Pseudomonas aeruginosa PA01
gggcagggaguccgc

SEQ ID NO: 3491771 - RNA, 17 nt, Pseudomonas aeruginosa PA01
gggcagggaguccgcca

SEQ ID NO: 3491772 - RNA, 19 nt, Pseudomonas aeruginosa PA01
gggcagggaguccgccagc

SEQ ID NO: 3491773 - RNA, 15 nt, Pseudomonas aeruginosa PA01
gggcagggcagccgc

SEQ ID NO: 3491774 - RNA, 16 nt, Pseudomonas aeruginosa PA01
gggcagggcagccgcc

SEQ ID NO: 3491775 - RNA, 13 nt, Pseudomonas aeruginosa PA01
gggcagggugucg

SEQ ID NO: 3491776 - RNA, 14 nt, Pseudomonas aeruginosa PA01
gggcagguggacgg

SEQ ID NO: 3491777 - RNA, 21 nt, Pseudomonas aeruginosa PA01
gggcagguguucgcaaagcuc

SEQ ID NO: 3491778 - RNA, 15 nt, Pseudomonas aeruginosa PA01
gggcaguacguggcg

SEQ ID NO: 3491779 - RNA, 22 nt, Pseudomonas aeruginosa PA01
gggcaguacucaugaccgccgc

SEQ ID NO: 3491780 - RNA, 14 nt, Pseudomonas aeruginosa PA01
gggcaucagccccu

SEQ ID NO: 3491781 - RNA, 23 nt, Pseudomonas aeruginosa PA01
gggcaucagccccucggccagga

SEQ ID NO: 3491782 - RNA, 14 nt, Pseudomonas aeruginosa PA01
gggcauccagcgga

SEQ ID NO: 3491783 - RNA, 15 nt, Pseudomonas aeruginosa PA01
gggcauccaucgcca

SEQ ID NO: 3491784 - RNA, 16 nt, Pseudomonas aeruginosa PA01
gggcauccaucgccag

SEQ ID NO: 3491785 - RNA, 20 nt, Pseudomonas aeruginosa PA01
gggcaucgaccagacgcagc

SEQ ID NO: 3491786 - RNA, 14 nt, Pseudomonas aeruginosa PA01
gggcaucgccgaca

SEQ ID NO: 3491787 - RNA, 13 nt, Pseudomonas aeruginosa PA01
gggcaucgcgcau

SEQ ID NO: 3491788 - RNA, 13 nt, Pseudomonas aeruginosa PA01
gggcaucggccau

SEQ ID NO: 3491789 - RNA, 19 nt, Pseudomonas aeruginosa PA01
gggcaugaccgauggcgcc

SEQ ID NO: 3491790 - RNA, 13 nt, Pseudomonas aeruginosa PA01
gggcaugccgugg

SEQ ID NO: 3491791 - RNA, 21 nt, Pseudomonas aeruginosa PA01
gggcaugccgugggcgccgcc

SEQ ID NO: 3491792 - RNA, 18 nt, Pseudomonas aeruginosa PA01
gggcaugcucggccaggu

SEQ ID NO: 3491793 - RNA, 15 nt, Pseudomonas aeruginosa PA01
gggcaugcugcucgg

SEQ ID NO: 3491794 - RNA, 16 nt, Pseudomonas aeruginosa PA01
gggcauggcuggcgcu

SEQ ID NO: 3491795 - RNA, 13 nt, Pseudomonas aeruginosa PA01
gggcaugggcgcg

SEQ ID NO: 3491796 - RNA, 13 nt, Pseudomonas aeruginosa PA01
gggcaugggucag

SEQ ID NO: 3491797 - RNA, 18 nt, Pseudomonas aeruginosa PA01
gggcaugggucagcgcca

SEQ ID NO: 3491798 - RNA, 21 nt, Pseudomonas aeruginosa PA01
gggcaugggucagcgccagca

SEQ ID NO: 3491799 - RNA, 14 nt, Pseudomonas aeruginosa PA01
gggcauucguccag

SEQ ID NO: 3491800 - RNA, 19 nt, Pseudomonas aeruginosa PA01
gggcauugucccugcggga

SEQ ID NO: 3491801 - RNA, 14 nt, Pseudomonas aeruginosa PA01
gggcauuuccuggg

SEQ ID NO: 3491802 - RNA, 16 nt, Pseudomonas aeruginosa PA01
gggccaccuggcucug

SEQ ID NO: 3491803 - RNA, 21 nt, Pseudomonas aeruginosa PA01
gggccaccuggcucuguuccu

SEQ ID NO: 3491804 - RNA, 21 nt, Pseudomonas aeruginosa PA01
gggccacguucugcaggacga

SEQ ID NO: 3491805 - RNA, 20 nt, Pseudomonas aeruginosa PA01
gggccacuucgcgguccagg

SEQ ID NO: 3491806 - RNA, 16 nt, Pseudomonas aeruginosa PA01
gggccagcaacaggca

SEQ ID NO: 3491807 - RNA, 16 nt, Pseudomonas aeruginosa PA01
gggccagcagcgcugc

SEQ ID NO: 3491808 - RNA, 19 nt, Pseudomonas aeruginosa PA01
gggccagcagcggcggcgc

SEQ ID NO: 3491809 - RNA, 15 nt, Pseudomonas aeruginosa PA01
gggccagcaggccga

SEQ ID NO: 3491810 - RNA, 15 nt, Pseudomonas aeruginosa PA01
gggccagcaggcgcu

SEQ ID NO: 3491811 - RNA, 13 nt, Pseudomonas aeruginosa PA01
gggccagcagggc

SEQ ID NO: 3491812 - RNA, 16 nt, Pseudomonas aeruginosa PA01
gggccagcagggccgc

SEQ ID NO: 3491813 - RNA, 17 nt, Pseudomonas aeruginosa PA01
gggccagcagggccgcc

SEQ ID NO: 3491814 - RNA, 21 nt, Pseudomonas aeruginosa PA01
gggccagcagggccgccgagg

SEQ ID NO: 3491815 - RNA, 22 nt, Pseudomonas aeruginosa PA01
gggccagcaggguggccagggu

SEQ ID NO: 3491816 - RNA, 16 nt, Pseudomonas aeruginosa PA01
gggccagccagagcca

SEQ ID NO: 3491817 - RNA, 13 nt, Pseudomonas aeruginosa PA01
gggccagcccaga

SEQ ID NO: 3491818 - RNA, 14 nt, Pseudomonas aeruginosa PA01
gggccagcccagaa

SEQ ID NO: 3491819 - RNA, 23 nt, Pseudomonas aeruginosa PA01
gggccagcgccguacgcaccgcg

SEQ ID NO: 3491820 - RNA, 12 nt, Pseudomonas aeruginosa PA01
gggccagcgccu

SEQ ID NO: 3491821 - RNA, 12 nt, Pseudomonas aeruginosa PA01
gggccagcggaa

SEQ ID NO: 3491822 - RNA, 22 nt, Pseudomonas aeruginosa PA01
gggccagcuggcgacggcucug

SEQ ID NO: 3491823 - RNA, 16 nt, Pseudomonas aeruginosa PA01
gggccaggaaaucgag

SEQ ID NO: 3491824 - RNA, 21 nt, Pseudomonas aeruginosa PA01
gggccaggaaaucgagcgcca

SEQ ID NO: 3491825 - RNA, 23 nt, Pseudomonas aeruginosa PA01
gggccaggaaaucgagcgccagg

SEQ ID NO: 3491826 - RNA, 22 nt, Pseudomonas aeruginosa PA01
gggccaggagcaucggcgcggc

SEQ ID NO: 3491827 - RNA, 18 nt, Pseudomonas aeruginosa PA01
gggccaggaugaccaggc

SEQ ID NO: 3491828 - RNA, 19 nt, Pseudomonas aeruginosa PA01
gggccaggaugaccaggcu

SEQ ID NO: 3491829 - RNA, 17 nt, Pseudomonas aeruginosa PA01
gggccaggcauccagca

SEQ ID NO: 3491830 - RNA, 15 nt, Pseudomonas aeruginosa PA01
gggccaggccgagca

SEQ ID NO: 3491831 - RNA, 15 nt, Pseudomonas aeruginosa PA01
gggccaggccgagcg

SEQ ID NO: 3491832 - RNA, 17 nt, Pseudomonas aeruginosa PA01
gggccagggaggcgcug

SEQ ID NO: 3491833 - RNA, 20 nt, Pseudomonas aeruginosa PA01
gggccagggaggcgcuggcc

SEQ ID NO: 3491834 - RNA, 12 nt, Pseudomonas aeruginosa PA01
gggccagggccu

SEQ ID NO: 3491835 - RNA, 15 nt, Pseudomonas aeruginosa PA01
gggccagggcgagga

SEQ ID NO: 3491836 - RNA, 13 nt, Pseudomonas aeruginosa PA01
gggccagggcggc

SEQ ID NO: 3491837 - RNA, 19 nt, Pseudomonas aeruginosa PA01
gggccagggcggcggcgau

SEQ ID NO: 3491838 - RNA, 20 nt, Pseudomonas aeruginosa PA01
gggccaucagguccaccagc

SEQ ID NO: 3491839 - RNA, 22 nt, Pseudomonas aeruginosa PA01
gggccaucagguccaccagcca

SEQ ID NO: 3491840 - RNA, 13 nt, Pseudomonas aeruginosa PA01
gggccaucgccgg

SEQ ID NO: 3491841 - RNA, 14 nt, Pseudomonas aeruginosa PA01
gggccaugaccucg

SEQ ID NO: 3491842 - RNA, 20 nt, Pseudomonas aeruginosa PA01
gggccaugaccucggccagc

SEQ ID NO: 3491843 - RNA, 21 nt, Pseudomonas aeruginosa PA01
gggccaugaccucggccagcc

SEQ ID NO: 3491844 - RNA, 16 nt, Pseudomonas aeruginosa PA01
gggccaugagcagggc

SEQ ID NO: 3491845 - RNA, 19 nt, Pseudomonas aeruginosa PA01
gggccaugagcagggcgga

SEQ ID NO: 3491846 - RNA, 23 nt, Pseudomonas aeruginosa PA01
gggccauugcagguaguccagcc

SEQ ID NO: 3491847 - RNA, 21 nt, Pseudomonas aeruginosa PA01
gggccauuguucuuuggccaa

SEQ ID NO: 3491848 - RNA, 18 nt, Pseudomonas aeruginosa PA01
gggcccaagccgagcggc

SEQ ID NO: 3491849 - RNA, 19 nt, Pseudomonas aeruginosa PA01
gggcccaagccgagcggca

SEQ ID NO: 3491850 - RNA, 15 nt, Pseudomonas aeruginosa PA01
gggcccacagugcca

SEQ ID NO: 3491851 - RNA, 19 nt, Pseudomonas aeruginosa PA01
gggcccacagugccaggcu

SEQ ID NO: 3491852 - RNA, 20 nt, Pseudomonas aeruginosa PA01
gggcccacagugccaggcuc

SEQ ID NO: 3491853 - RNA, 20 nt, Pseudomonas aeruginosa PA01
gggcccagagcagcaccagc

SEQ ID NO: 3491854 - RNA, 22 nt, Pseudomonas aeruginosa PA01
gggcccagagcagcaccagcac

SEQ ID NO: 3491855 - RNA, 20 nt, Pseudomonas aeruginosa PA01
gggcccaggcuggcggccag

SEQ ID NO: 3491856 - RNA, 17 nt, Pseudomonas aeruginosa PA01
gggcccaguucgcguag

SEQ ID NO: 3491857 - RNA, 14 nt, Pseudomonas aeruginosa PA01
gggccccggccagg

SEQ ID NO: 3491858 - RNA, 13 nt, Pseudomonas aeruginosa PA01
gggccccggccgg

SEQ ID NO: 3491859 - RNA, 16 nt, Pseudomonas aeruginosa PA01
gggcccggcaggcagu

SEQ ID NO: 3491860 - RNA, 21 nt, Pseudomonas aeruginosa PA01
gggcccggcuccagccgggcu

SEQ ID NO: 3491861 - RNA, 22 nt, Pseudomonas aeruginosa PA01
gggcccgugguagucgagccgg

SEQ ID NO: 3491862 - RNA, 13 nt, Pseudomonas aeruginosa PA01
gggcccuccaggc

SEQ ID NO: 3491863 - RNA, 13 nt, Pseudomonas aeruginosa PA01
gggcccugggccc

SEQ ID NO: 3491864 - RNA, 14 nt, Pseudomonas aeruginosa PA01
gggccgaaggccag

SEQ ID NO: 3491865 - RNA, 16 nt, Pseudomonas aeruginosa PA01
gggccgaaggccaggc

SEQ ID NO: 3491866 - RNA, 19 nt, Pseudomonas aeruginosa PA01
gggccgaaggccaggccgg

SEQ ID NO: 3491867 - RNA, 19 nt, Pseudomonas aeruginosa PA01
gggccgacgaaggccgcgg

SEQ ID NO: 3491868 - RNA, 18 nt, Pseudomonas aeruginosa PA01
gggccgagcgcagcgcca

SEQ ID NO: 3491869 - RNA, 20 nt, Pseudomonas aeruginosa PA01
gggccgaggucgcgggccag

SEQ ID NO: 3491870 - RNA, 21 nt, Pseudomonas aeruginosa PA01
gggccgaggucgcgggccagg

SEQ ID NO: 3491871 - RNA, 23 nt, Pseudomonas aeruginosa PA01
gggccgaggucgcgggccaggcc

SEQ ID NO: 3491872 - RNA, 13 nt, Pseudomonas aeruginosa PA01
gggccgauccgcg

SEQ ID NO: 3491873 - RNA, 14 nt, Pseudomonas aeruginosa PA01
gggccgaugccggg

SEQ ID NO: 3491874 - RNA, 16 nt, Pseudomonas aeruginosa PA01
gggccgaugccgggca

SEQ ID NO: 3491875 - RNA, 19 nt, Pseudomonas aeruginosa PA01
gggccgaugccgggcaacg

SEQ ID NO: 3491876 - RNA, 14 nt, Pseudomonas aeruginosa PA01
gggccgaugcgcga

SEQ ID NO: 3491877 - RNA, 16 nt, Pseudomonas aeruginosa PA01
gggccgcagcgcagcc

SEQ ID NO: 3491878 - RNA, 17 nt, Pseudomonas aeruginosa PA01
gggccgcagcgcagccg

SEQ ID NO: 3491879 - RNA, 19 nt, Pseudomonas aeruginosa PA01
gggccgcagguuggccccg

SEQ ID NO: 3491880 - RNA, 12 nt, Pseudomonas aeruginosa PA01
gggccgccagcc

SEQ ID NO: 3491881 - RNA, 18 nt, Pseudomonas aeruginosa PA01
gggccgccagccgccagg

SEQ ID NO: 3491882 - RNA, 19 nt, Pseudomonas aeruginosa PA01
gggccgccagccgccagga

SEQ ID NO: 3491883 - RNA, 18 nt, Pseudomonas aeruginosa PA01
gggccgccgaugccgacg

SEQ ID NO: 3491884 - RNA, 13 nt, Pseudomonas aeruginosa PA01
gggccgccggcga

SEQ ID NO: 3491885 - RNA, 18 nt, Pseudomonas aeruginosa PA01
gggccgccggcgacgagg

SEQ ID NO: 3491886 - RNA, 19 nt, Pseudomonas aeruginosa PA01
gggccgccguacaggccac

SEQ ID NO: 3491887 - RNA, 20 nt, Pseudomonas aeruginosa PA01
gggccgccuggucggggccg

SEQ ID NO: 3491888 - RNA, 22 nt, Pseudomonas aeruginosa PA01
gggccgcgagagguucaccgac

SEQ ID NO: 3491889 - RNA, 18 nt, Pseudomonas aeruginosa PA01
gggccgcgagguccggcu

SEQ ID NO: 3491890 - RNA, 13 nt, Pseudomonas aeruginosa PA01
gggccgcgccgac

SEQ ID NO: 3491891 - RNA, 15 nt, Pseudomonas aeruginosa PA01
gggccgcgccgagcc

SEQ ID NO: 3491892 - RNA, 17 nt, Pseudomonas aeruginosa PA01
gggccgcgccgagccgg

SEQ ID NO: 3491893 - RNA, 15 nt, Pseudomonas aeruginosa PA01
gggccgcgcugucgg

SEQ ID NO: 3491894 - RNA, 21 nt, Pseudomonas aeruginosa PA01
gggccgcguauggcuuccugu

SEQ ID NO: 3491895 - RNA, 23 nt, Pseudomonas aeruginosa PA01
gggccgcucgagggcgaccgcca

SEQ ID NO: 3491896 - RNA, 16 nt, Pseudomonas aeruginosa PA01
gggccggagcaggcca

SEQ ID NO: 3491897 - RNA, 13 nt, Pseudomonas aeruginosa PA01
gggccggaucggc

SEQ ID NO: 3491898 - RNA, 18 nt, Pseudomonas aeruginosa PA01
gggccggaucggccuugg

SEQ ID NO: 3491899 - RNA, 18 nt, Pseudomonas aeruginosa PA01
gggccggcaugcucagcc

SEQ ID NO: 3491900 - RNA, 20 nt, Pseudomonas aeruginosa PA01
gggccggcaugcucagccgc

SEQ ID NO: 3491901 - RNA, 22 nt, Pseudomonas aeruginosa PA01
gggccggcaugcucagccgcgc

SEQ ID NO: 3491902 - RNA, 12 nt, Pseudomonas aeruginosa PA01
gggccggccugg

SEQ ID NO: 3491903 - RNA, 18 nt, Pseudomonas aeruginosa PA01
gggccggcgauggcccag

SEQ ID NO: 3491904 - RNA, 16 nt, Pseudomonas aeruginosa PA01
gggccggcgccagcag

SEQ ID NO: 3491905 - RNA, 12 nt, Pseudomonas aeruginosa PA01
gggccgggggcg

SEQ ID NO: 3491906 - RNA, 24 nt, Pseudomonas aeruginosa PA01
gggccgguuccgaaucgccuacca

SEQ ID NO: 3491907 - RNA, 15 nt, Pseudomonas aeruginosa PA01
gggccguccgccagg

SEQ ID NO: 3491908 - RNA, 17 nt, Pseudomonas aeruginosa PA01
gggccguccgccagguc

SEQ ID NO: 3491909 - RNA, 17 nt, Pseudomonas aeruginosa PA01
gggccgucgggcauggc

SEQ ID NO: 3491910 - RNA, 21 nt, Pseudomonas aeruginosa PA01
gggccgucguuuuguccggcg

SEQ ID NO: 3491911 - RNA, 19 nt, Pseudomonas aeruginosa PA01
gggccuacugcuggacggc

SEQ ID NO: 3491912 - RNA, 20 nt, Pseudomonas aeruginosa PA01
gggccuacugcuggacggcg

SEQ ID NO: 3491913 - RNA, 15 nt, Pseudomonas aeruginosa PA01
gggccuccuggcggc

SEQ ID NO: 3491914 - RNA, 16 nt, Pseudomonas aeruginosa PA01
gggccuccuggcggcg

SEQ ID NO: 3491915 - RNA, 17 nt, Pseudomonas aeruginosa PA01
gggccucgcugcgcaga

SEQ ID NO: 3491916 - RNA, 22 nt, Pseudomonas aeruginosa PA01
gggccucgcuguaguuguucgg

SEQ ID NO: 3491917 - RNA, 14 nt, Pseudomonas aeruginosa PA01
gggccucggccagc

SEQ ID NO: 3491918 - RNA, 18 nt, Pseudomonas aeruginosa PA01
gggccucggccagcgccg

SEQ ID NO: 3491919 - RNA, 19 nt, Pseudomonas aeruginosa PA01
gggccucggccagcgccgc

SEQ ID NO: 3491920 - RNA, 15 nt, Pseudomonas aeruginosa PA01
gggccucggcgggug

SEQ ID NO: 3491921 - RNA, 14 nt, Pseudomonas aeruginosa PA01
gggccucggggccg

SEQ ID NO: 3491922 - RNA, 15 nt, Pseudomonas aeruginosa PA01
gggccugggcaucgu

SEQ ID NO: 3491923 - RNA, 14 nt, Pseudomonas aeruginosa PA01
gggccuucaggcgc

SEQ ID NO: 3491924 - RNA, 15 nt, Pseudomonas aeruginosa PA01
gggccuucaggcgcu

SEQ ID NO: 3491925 - RNA, 15 nt, Pseudomonas aeruginosa PA01
gggccuucaggcugc

SEQ ID NO: 3491926 - RNA, 14 nt, Pseudomonas aeruginosa PA01
gggccuucgccagc

SEQ ID NO: 3491927 - RNA, 21 nt, Pseudomonas aeruginosa PA01
gggccuucgccagcggccagg

SEQ ID NO: 3491928 - RNA, 21 nt, Pseudomonas aeruginosa PA01
gggccuugaccaccgccaggc

SEQ ID NO: 3491929 - RNA, 14 nt, Pseudomonas aeruginosa PA01
gggccuugagcacg

SEQ ID NO: 3491930 - RNA, 18 nt, Pseudomonas aeruginosa PA01
gggccuugagcaggcguu

SEQ ID NO: 3491931 - RNA, 23 nt, Pseudomonas aeruginosa PA01
gggccuugagcaggcguuccggg

SEQ ID NO: 3491932 - RNA, 20 nt, Pseudomonas aeruginosa PA01
gggccuuguucaggguggcg

SEQ ID NO: 3491933 - RNA, 22 nt, Pseudomonas aeruginosa PA01
gggccuuuuccguuguggcggc

SEQ ID NO: 3491934 - RNA, 23 nt, Pseudomonas aeruginosa PA01
gggccuuuuccguuguggcggcg

SEQ ID NO: 3491935 - RNA, 20 nt, Pseudomonas aeruginosa PA01
gggcgaaacggcaggccagc

SEQ ID NO: 3491936 - RNA, 21 nt, Pseudomonas aeruginosa PA01
gggcgaaacggcaggccagca

SEQ ID NO: 3491937 - RNA, 20 nt, Pseudomonas aeruginosa PA01
gggcgaaagcgguaccgggc

SEQ ID NO: 3491938 - RNA, 14 nt, Pseudomonas aeruginosa PA01
gggcgaacagcacc

SEQ ID NO: 3491939 - RNA, 18 nt, Pseudomonas aeruginosa PA01
gggcgaacagcacccagg

SEQ ID NO: 3491940 - RNA, 16 nt, Pseudomonas aeruginosa PA01
gggcgaacagcgccgc

SEQ ID NO: 3491941 - RNA, 11 nt, Pseudomonas aeruginosa PA01
gggcgaagccg

SEQ ID NO: 3491942 - RNA, 13 nt, Pseudomonas aeruginosa PA01
gggcgaagccggc

SEQ ID NO: 3491943 - RNA, 20 nt, Pseudomonas aeruginosa PA01
gggcgaagccggcggcgcgg

SEQ ID NO: 3491944 - RNA, 13 nt, Pseudomonas aeruginosa PA01
gggcgaaggccac

SEQ ID NO: 3491945 - RNA, 21 nt, Pseudomonas aeruginosa PA01
gggcgaaggccaccaucgcgg

SEQ ID NO: 3491946 - RNA, 16 nt, Pseudomonas aeruginosa PA01
gggcgaaggccucguc

SEQ ID NO: 3491947 - RNA, 17 nt, Pseudomonas aeruginosa PA01
gggcgaaggucugcccc

SEQ ID NO: 3491948 - RNA, 19 nt, Pseudomonas aeruginosa PA01
gggcgaagucggcgcgcca

SEQ ID NO: 3491949 - RNA, 20 nt, Pseudomonas aeruginosa PA01
gggcgaauaacgccaccggc

SEQ ID NO: 3491950 - RNA, 13 nt, Pseudomonas aeruginosa PA01
gggcgaauaccag

SEQ ID NO: 3491951 - RNA, 20 nt, Pseudomonas aeruginosa PA01
gggcgaauaccagugccgcg

SEQ ID NO: 3491952 - RNA, 22 nt, Pseudomonas aeruginosa PA01
gggcgaauaccagugccgcggu

SEQ ID NO: 3491953 - RNA, 22 nt, Pseudomonas aeruginosa PA01
gggcgaauagcgccgcaggcgc

SEQ ID NO: 3491954 - RNA, 17 nt, Pseudomonas aeruginosa PA01
gggcgaauaucgcggcg

SEQ ID NO: 3491955 - RNA, 17 nt, Pseudomonas aeruginosa PA01
gggcgacauagcggcug

SEQ ID NO: 3491956 - RNA, 18 nt, Pseudomonas aeruginosa PA01
gggcgacccaggccgaca

SEQ ID NO: 3491957 - RNA, 14 nt, Pseudomonas aeruginosa PA01
gggcgaccgccagg

SEQ ID NO: 3491958 - RNA, 15 nt, Pseudomonas aeruginosa PA01
gggcgaccgccaggc

SEQ ID NO: 3491959 - RNA, 17 nt, Pseudomonas aeruginosa PA01
gggcgaccgccaggcgg

SEQ ID NO: 3491960 - RNA, 18 nt, Pseudomonas aeruginosa PA01
gggcgaccgccaggcggc

SEQ ID NO: 3491961 - RNA, 20 nt, Pseudomonas aeruginosa PA01
gggcgaccgccaggcggccg

SEQ ID NO: 3491962 - RNA, 14 nt, Pseudomonas aeruginosa PA01
gggcgaccugcucg

SEQ ID NO: 3491963 - RNA, 20 nt, Pseudomonas aeruginosa PA01
gggcgaccuucagcgggucg

SEQ ID NO: 3491964 - RNA, 13 nt, Pseudomonas aeruginosa PA01
gggcgacgcccga

SEQ ID NO: 3491965 - RNA, 16 nt, Pseudomonas aeruginosa PA01
gggcgacgcccgaggc

SEQ ID NO: 3491966 - RNA, 23 nt, Pseudomonas aeruginosa PA01
gggcgacgcccgaggcguuaucc

SEQ ID NO: 3491967 - RNA, 14 nt, Pseudomonas aeruginosa PA01
gggcgacgccgaug

SEQ ID NO: 3491968 - RNA, 15 nt, Pseudomonas aeruginosa PA01
gggcgacgcguccgg

SEQ ID NO: 3491969 - RNA, 15 nt, Pseudomonas aeruginosa PA01
gggcgagaaucgccg

SEQ ID NO: 3491970 - RNA, 18 nt, Pseudomonas aeruginosa PA01
gggcgagaaucgccgagg

SEQ ID NO: 3491971 - RNA, 17 nt, Pseudomonas aeruginosa PA01
gggcgagcagggcacag

SEQ ID NO: 3491972 - RNA, 18 nt, Pseudomonas aeruginosa PA01
gggcgagcagggcgcuga

SEQ ID NO: 3491973 - RNA, 23 nt, Pseudomonas aeruginosa PA01
gggcgagcgcagacgggugcuga

SEQ ID NO: 3491974 - RNA, 13 nt, Pseudomonas aeruginosa PA01
gggcgagcugcac

SEQ ID NO: 3491975 - RNA, 15 nt, Pseudomonas aeruginosa PA01
gggcgagggcgcgca

SEQ ID NO: 3491976 - RNA, 14 nt, Pseudomonas aeruginosa PA01
gggcgagggcggcg

SEQ ID NO: 3491977 - RNA, 16 nt, Pseudomonas aeruginosa PA01
gggcgagggcggcgcg

SEQ ID NO: 3491978 - RNA, 18 nt, Pseudomonas aeruginosa PA01
gggcgagggcggcgcggg

SEQ ID NO: 3491979 - RNA, 17 nt, Pseudomonas aeruginosa PA01
gggcgaggucggccugc

SEQ ID NO: 3491980 - RNA, 19 nt, Pseudomonas aeruginosa PA01
gggcgaggucggccugcgg

SEQ ID NO: 3491981 - RNA, 20 nt, Pseudomonas aeruginosa PA01
gggcgaguucggcgagcagg

SEQ ID NO: 3491982 - RNA, 23 nt, Pseudomonas aeruginosa PA01
gggcgaucacgccgcgcaccagc

SEQ ID NO: 3491983 - RNA, 15 nt, Pseudomonas aeruginosa PA01
gggcgauccagaaga

SEQ ID NO: 3491984 - RNA, 13 nt, Pseudomonas aeruginosa PA01
gggcgauccgccc

SEQ ID NO: 3491985 - RNA, 17 nt, Pseudomonas aeruginosa PA01
gggcgauccgcccgcau

SEQ ID NO: 3491986 - RNA, 22 nt, Pseudomonas aeruginosa PA01
gggcgaucuccucgauccgcug

SEQ ID NO: 3491987 - RNA, 15 nt, Pseudomonas aeruginosa PA01
gggcgaucucgcggg

SEQ ID NO: 3491988 - RNA, 21 nt, Pseudomonas aeruginosa PA01
gggcgaucucgcgggcuacca

SEQ ID NO: 3491989 - RNA, 20 nt, Pseudomonas aeruginosa PA01
gggcgaucuugaucgccagc

SEQ ID NO: 3491990 - RNA, 19 nt, Pseudomonas aeruginosa PA01
gggcgaugcccuuggccag

SEQ ID NO: 3491991 - RNA, 15 nt, Pseudomonas aeruginosa PA01
gggcgaugcgccggu

SEQ ID NO: 3491992 - RNA, 22 nt, Pseudomonas aeruginosa PA01
gggcgaugcgccgguccuuguc

SEQ ID NO: 3491993 - RNA, 15 nt, Pseudomonas aeruginosa PA01
gggcgaugcggcgga

SEQ ID NO: 3491994 - RNA, 23 nt, Pseudomonas aeruginosa PA01
gggcgaugcggucaugcccuugu

SEQ ID NO: 3491995 - RNA, 13 nt, Pseudomonas aeruginosa PA01
gggcgauggccag

SEQ ID NO: 3491996 - RNA, 13 nt, Pseudomonas aeruginosa PA01
gggcgauggcggu

SEQ ID NO: 3491997 - RNA, 19 nt, Pseudomonas aeruginosa PA01
gggcgcaaggccagcggca

SEQ ID NO: 3491998 - RNA, 14 nt, Pseudomonas aeruginosa PA01
gggcgcaccgccuc

SEQ ID NO: 3491999 - RNA, 16 nt, Pseudomonas aeruginosa PA01
gggcgcaccgccucga

SEQ ID NO: 3492000 - RNA, 21 nt, Pseudomonas aeruginosa PA01
gggcgcacuccgggcagacca

SEQ ID NO: 3492001 - RNA, 13 nt, Pseudomonas aeruginosa PA01
gggcgcaggccga

SEQ ID NO: 3492002 - RNA, 18 nt, Pseudomonas aeruginosa PA01
gggcgcaggggcgcgccg

SEQ ID NO: 3492003 - RNA, 20 nt, Pseudomonas aeruginosa PA01
gggcgcauaacgccaacggc

SEQ ID NO: 3492004 - RNA, 14 nt, Pseudomonas aeruginosa PA01
gggcgccagccgcc

SEQ ID NO: 3492005 - RNA, 15 nt, Pseudomonas aeruginosa PA01
gggcgccagccgcca

SEQ ID NO: 3492006 - RNA, 17 nt, Pseudomonas aeruginosa PA01
gggcgccagccgccauc

SEQ ID NO: 3492007 - RNA, 16 nt, Pseudomonas aeruginosa PA01
gggcgccaggugcagg

SEQ ID NO: 3492008 - RNA, 23 nt, Pseudomonas aeruginosa PA01
gggcgccaucgcuuuccuggccg

SEQ ID NO: 3492009 - RNA, 16 nt, Pseudomonas aeruginosa PA01
gggcgcccgccaaggc

SEQ ID NO: 3492010 - RNA, 22 nt, Pseudomonas aeruginosa PA01
gggcgcccgccaaggcccugcu

SEQ ID NO: 3492011 - RNA, 13 nt, Pseudomonas aeruginosa PA01
gggcgcccgcccg

SEQ ID NO: 3492012 - RNA, 23 nt, Pseudomonas aeruginosa PA01
gggcgcccgcccggaaccaccgg

SEQ ID NO: 3492013 - RNA, 19 nt, Pseudomonas aeruginosa PA01
gggcgcccgcccggcacca

SEQ ID NO: 3492014 - RNA, 23 nt, Pseudomonas aeruginosa PA01
gggcgcccgcccggcaccaccgg

SEQ ID NO: 3492015 - RNA, 15 nt, Pseudomonas aeruginosa PA01
gggcgcccucgccaa

SEQ ID NO: 3492016 - RNA, 18 nt, Pseudomonas aeruginosa PA01
gggcgcccuucagcgccu

SEQ ID NO: 3492017 - RNA, 12 nt, Pseudomonas aeruginosa PA01
gggcgccgaugc

SEQ ID NO: 3492018 - RNA, 16 nt, Pseudomonas aeruginosa PA01
gggcgccgccgcuggc

SEQ ID NO: 3492019 - RNA, 13 nt, Pseudomonas aeruginosa PA01
gggcgccgccggu

SEQ ID NO: 3492020 - RNA, 15 nt, Pseudomonas aeruginosa PA01
gggcgccggcgcgca

SEQ ID NO: 3492021 - RNA, 14 nt, Pseudomonas aeruginosa PA01
gggcgccggcucgc

SEQ ID NO: 3492022 - RNA, 17 nt, Pseudomonas aeruginosa PA01
gggcgccgucgggggcg

SEQ ID NO: 3492023 - RNA, 21 nt, Pseudomonas aeruginosa PA01
gggcgccgucgggggcgcgua

SEQ ID NO: 3492024 - RNA, 17 nt, Pseudomonas aeruginosa PA01
gggcgccuccagcgggc

SEQ ID NO: 3492025 - RNA, 19 nt, Pseudomonas aeruginosa PA01
gggcgccuccagcgggccu

SEQ ID NO: 3492026 - RNA, 22 nt, Pseudomonas aeruginosa PA01
gggcgccuccagcgggccuucg

SEQ ID NO: 3492027 - RNA, 13 nt, Pseudomonas aeruginosa PA01
gggcgccucgccg

SEQ ID NO: 3492028 - RNA, 18 nt, Pseudomonas aeruginosa PA01
gggcgccucgccgcggca

SEQ ID NO: 3492029 - RNA, 17 nt, Pseudomonas aeruginosa PA01
gggcgccuguccgggaa

SEQ ID NO: 3492030 - RNA, 21 nt, Pseudomonas aeruginosa PA01
gggcgccuuuuucauggccug

SEQ ID NO: 3492031 - RNA, 18 nt, Pseudomonas aeruginosa PA01
gggcgcgcacuuccucgg

SEQ ID NO: 3492032 - RNA, 14 nt, Pseudomonas aeruginosa PA01
gggcgcgcagcagg

SEQ ID NO: 3492033 - RNA, 17 nt, Pseudomonas aeruginosa PA01
gggcgcgcagcagguag

SEQ ID NO: 3492034 - RNA, 14 nt, Pseudomonas aeruginosa PA01
gggcgcgccccguc

SEQ ID NO: 3492035 - RNA, 20 nt, Pseudomonas aeruginosa PA01
gggcgcgcgccaccgccugg

SEQ ID NO: 3492036 - RNA, 13 nt, Pseudomonas aeruginosa PA01
gggcgcgcgccgg

SEQ ID NO: 3492037 - RNA, 21 nt, Pseudomonas aeruginosa PA01
gggcgcgcgccgggcucagcg

SEQ ID NO: 3492038 - RNA, 14 nt, Pseudomonas aeruginosa PA01
gggcgcgcuggucg

SEQ ID NO: 3492039 - RNA, 12 nt, Pseudomonas aeruginosa PA01
gggcgcggcugg

SEQ ID NO: 3492040 - RNA, 14 nt, Pseudomonas aeruginosa PA01
gggcgcgggcgaag

SEQ ID NO: 3492041 - RNA, 19 nt, Pseudomonas aeruginosa PA01
gggcgcgguagggaucguc

SEQ ID NO: 3492042 - RNA, 20 nt, Pseudomonas aeruginosa PA01
gggcgcguacuugccagggc

SEQ ID NO: 3492043 - RNA, 16 nt, Pseudomonas aeruginosa PA01
gggcgcguugcccagc

SEQ ID NO: 3492044 - RNA, 21 nt, Pseudomonas aeruginosa PA01
gggcgcucaccgaggcgaacg

SEQ ID NO: 3492045 - RNA, 15 nt, Pseudomonas aeruginosa PA01
gggcgcucagggugg

SEQ ID NO: 3492046 - RNA, 12 nt, Pseudomonas aeruginosa PA01
gggcgcucgccc

SEQ ID NO: 3492047 - RNA, 19 nt, Pseudomonas aeruginosa PA01
gggcgcucgcccuugcgcc

SEQ ID NO: 3492048 - RNA, 22 nt, Pseudomonas aeruginosa PA01
gggcgcucgcccuugcgccgcg

SEQ ID NO: 3492049 - RNA, 20 nt, Pseudomonas aeruginosa PA01
gggcgcucguugcgccgcuc

SEQ ID NO: 3492050 - RNA, 18 nt, Pseudomonas aeruginosa PA01
gggcgcucuggccgcgcu

SEQ ID NO: 3492051 - RNA, 12 nt, Pseudomonas aeruginosa PA01
gggcgcugccga

SEQ ID NO: 3492052 - RNA, 11 nt, Pseudomonas aeruginosa PA01
gggcgcugguc

SEQ ID NO: 3492053 - RNA, 14 nt, Pseudomonas aeruginosa PA01
gggcgcuuucgaga

SEQ ID NO: 3492054 - RNA, 16 nt, Pseudomonas aeruginosa PA01
gggcgcuuucgagaaa

SEQ ID NO: 3492055 - RNA, 22 nt, Pseudomonas aeruginosa PA01
gggcggacgcugggcugggucg

SEQ ID NO: 3492056 - RNA, 15 nt, Pseudomonas aeruginosa PA01
gggcggauagcgcgc

SEQ ID NO: 3492057 - RNA, 13 nt, Pseudomonas aeruginosa PA01
gggcggaucagcu

SEQ ID NO: 3492058 - RNA, 20 nt, Pseudomonas aeruginosa PA01
gggcggaucgagcagcggcg

SEQ ID NO: 3492059 - RNA, 14 nt, Pseudomonas aeruginosa PA01
gggcggauucaggc

SEQ ID NO: 3492060 - RNA, 11 nt, Pseudomonas aeruginosa PA01
gggcggcaacu

SEQ ID NO: 3492061 - RNA, 14 nt, Pseudomonas aeruginosa PA01
gggcggcagcacga

SEQ ID NO: 3492062 - RNA, 23 nt, Pseudomonas aeruginosa PA01
gggcggccccuucagcuccagca

SEQ ID NO: 3492063 - RNA, 12 nt, Pseudomonas aeruginosa PA01
gggcggccgccg

SEQ ID NO: 3492064 - RNA, 12 nt, Pseudomonas aeruginosa PA01
gggcggccggcc

SEQ ID NO: 3492065 - RNA, 19 nt, Pseudomonas aeruginosa PA01
gggcggccucguaggcggc

SEQ ID NO: 3492066 - RNA, 20 nt, Pseudomonas aeruginosa PA01
gggcggccucguaggcggcg

SEQ ID NO: 3492067 - RNA, 18 nt, Pseudomonas aeruginosa PA01
gggcggcgaccggccuca

SEQ ID NO: 3492068 - RNA, 15 nt, Pseudomonas aeruginosa PA01
gggcggcgcaucggc

SEQ ID NO: 3492069 - RNA, 17 nt, Pseudomonas aeruginosa PA01
gggcggcgccuggagca

SEQ ID NO: 3492070 - RNA, 22 nt, Pseudomonas aeruginosa PA01
gggcggcgcggcguggcggaag

SEQ ID NO: 3492071 - RNA, 21 nt, Pseudomonas aeruginosa PA01
gggcggcgcgggcgcgcgcca

SEQ ID NO: 3492072 - RNA, 12 nt, Pseudomonas aeruginosa PA01
gggcggcggcga

SEQ ID NO: 3492073 - RNA, 13 nt, Pseudomonas aeruginosa PA01
gggcggcggcgcu

SEQ ID NO: 3492074 - RNA, 14 nt, Pseudomonas aeruginosa PA01
gggcggcggcgcua

SEQ ID NO: 3492075 - RNA, 14 nt, Pseudomonas aeruginosa PA01
gggcggcggcucag

SEQ ID NO: 3492076 - RNA, 20 nt, Pseudomonas aeruginosa PA01
gggcggcggcucaggccgcc

SEQ ID NO: 3492077 - RNA, 14 nt, Pseudomonas aeruginosa PA01
gggcggcgggcgca

SEQ ID NO: 3492078 - RNA, 14 nt, Pseudomonas aeruginosa PA01
gggcggcgucgcgg

SEQ ID NO: 3492079 - RNA, 22 nt, Pseudomonas aeruginosa PA01
gggcggcucggcuccaggaccg

SEQ ID NO: 3492080 - RNA, 13 nt, Pseudomonas aeruginosa PA01
gggcggcuggccg

SEQ ID NO: 3492081 - RNA, 15 nt, Pseudomonas aeruginosa PA01
gggcggcuggccgag

SEQ ID NO: 3492082 - RNA, 15 nt, Pseudomonas aeruginosa PA01
gggcggcuuccaggu

SEQ ID NO: 3492083 - RNA, 13 nt, Pseudomonas aeruginosa PA01
gggcgggcggucg

SEQ ID NO: 3492084 - RNA, 17 nt, Pseudomonas aeruginosa PA01
gggcggguaaagcgccc

SEQ ID NO: 3492085 - RNA, 22 nt, Pseudomonas aeruginosa PA01
gggcgguacaggcgcaccuggc

SEQ ID NO: 3492086 - RNA, 14 nt, Pseudomonas aeruginosa PA01
gggcgguacgccgc

SEQ ID NO: 3492087 - RNA, 18 nt, Pseudomonas aeruginosa PA01
gggcgguagcgggccagc

SEQ ID NO: 3492088 - RNA, 14 nt, Pseudomonas aeruginosa PA01
gggcgguaugccgg

SEQ ID NO: 3492089 - RNA, 22 nt, Pseudomonas aeruginosa PA01
gggcgguaugccggagugccgc

SEQ ID NO: 3492090 - RNA, 13 nt, Pseudomonas aeruginosa PA01
gggcggucgcgga

SEQ ID NO: 3492091 - RNA, 15 nt, Pseudomonas aeruginosa PA01
gggcggucggccagg

SEQ ID NO: 3492092 - RNA, 15 nt, Pseudomonas aeruginosa PA01
gggcggucggcgagg

SEQ ID NO: 3492093 - RNA, 16 nt, Pseudomonas aeruginosa PA01
gggcggucucggcggg

SEQ ID NO: 3492094 - RNA, 15 nt, Pseudomonas aeruginosa PA01
gggcguaaagcaagc

SEQ ID NO: 3492095 - RNA, 19 nt, Pseudomonas aeruginosa PA01
gggcguaacggcucgccgg

SEQ ID NO: 3492096 - RNA, 21 nt, Pseudomonas aeruginosa PA01
gggcguaacggcucgccgggu

SEQ ID NO: 3492097 - RNA, 19 nt, Pseudomonas aeruginosa PA01
gggcguaacggcuugccgg

SEQ ID NO: 3492098 - RNA, 19 nt, Pseudomonas aeruginosa PA01
gggcguacaggccccaggc

SEQ ID NO: 3492099 - RNA, 22 nt, Pseudomonas aeruginosa PA01
gggcguacaggccccaggcgau

SEQ ID NO: 3492100 - RNA, 20 nt, Pseudomonas aeruginosa PA01
gggcguagaccuugcggccg

SEQ ID NO: 3492101 - RNA, 14 nt, Pseudomonas aeruginosa PA01
gggcguagcgcggc

SEQ ID NO: 3492102 - RNA, 17 nt, Pseudomonas aeruginosa PA01
gggcguaguagggacgg

SEQ ID NO: 3492103 - RNA, 23 nt, Pseudomonas aeruginosa PA01
gggcguaguagggacggugcagg

SEQ ID NO: 3492104 - RNA, 17 nt, Pseudomonas aeruginosa PA01
gggcguagugcuccucg

SEQ ID NO: 3492105 - RNA, 19 nt, Pseudomonas aeruginosa PA01
gggcguagugcuccucguc

SEQ ID NO: 3492106 - RNA, 21 nt, Pseudomonas aeruginosa PA01
gggcguccaguagcgccuggu

SEQ ID NO: 3492107 - RNA, 20 nt, Pseudomonas aeruginosa PA01
gggcgucccguuccggcgca

SEQ ID NO: 3492108 - RNA, 15 nt, Pseudomonas aeruginosa PA01
gggcguccggcgagc

SEQ ID NO: 3492109 - RNA, 16 nt, Pseudomonas aeruginosa PA01
gggcguccggcgagca

SEQ ID NO: 3492110 - RNA, 21 nt, Pseudomonas aeruginosa PA01
gggcgucgaacaccggcgccg

SEQ ID NO: 3492111 - RNA, 18 nt, Pseudomonas aeruginosa PA01
gggcgucgaaggcggcgc

SEQ ID NO: 3492112 - RNA, 21 nt, Pseudomonas aeruginosa PA01
gggcgucgaaggcggcgcggc

SEQ ID NO: 3492113 - RNA, 14 nt, Pseudomonas aeruginosa PA01
gggcgucgucgggg

SEQ ID NO: 3492114 - RNA, 18 nt, Pseudomonas aeruginosa PA01
gggcgucuccugccgccg

SEQ ID NO: 3492115 - RNA, 19 nt, Pseudomonas aeruginosa PA01
gggcgucuccugccgccga

SEQ ID NO: 3492116 - RNA, 15 nt, Pseudomonas aeruginosa PA01
gggcgugcaggccgc

SEQ ID NO: 3492117 - RNA, 13 nt, Pseudomonas aeruginosa PA01
gggcgugccagga

SEQ ID NO: 3492118 - RNA, 14 nt, Pseudomonas aeruginosa PA01
gggcgugcuccagc

SEQ ID NO: 3492119 - RNA, 15 nt, Pseudomonas aeruginosa PA01
gggcguggcggccgc

SEQ ID NO: 3492120 - RNA, 18 nt, Pseudomonas aeruginosa PA01
gggcguggucggcggccu

SEQ ID NO: 3492121 - RNA, 17 nt, Pseudomonas aeruginosa PA01
gggcguucuuggccgcg

SEQ ID NO: 3492122 - RNA, 19 nt, Pseudomonas aeruginosa PA01
gggcguucuuggccgcgcc

SEQ ID NO: 3492123 - RNA, 22 nt, Pseudomonas aeruginosa PA01
gggcguucuuggccgcgccgaa

SEQ ID NO: 3492124 - RNA, 23 nt, Pseudomonas aeruginosa PA01
gggcguucuuggccgcgccgaag

SEQ ID NO: 3492125 - RNA, 15 nt, Pseudomonas aeruginosa PA01
gggcguugcgcgccu

SEQ ID NO: 3492126 - RNA, 23 nt, Pseudomonas aeruginosa PA01
gggcguugcgcgccucgccccag

SEQ ID NO: 3492127 - RNA, 13 nt, Pseudomonas aeruginosa PA01
gggcguugcucga

SEQ ID NO: 3492128 - RNA, 13 nt, Pseudomonas aeruginosa PA01
gggcguuggccag

SEQ ID NO: 3492129 - RNA, 14 nt, Pseudomonas aeruginosa PA01
gggcguuggccagc

SEQ ID NO: 3492130 - RNA, 15 nt, Pseudomonas aeruginosa PA01
gggcguuggccagcg

SEQ ID NO: 3492131 - RNA, 19 nt, Pseudomonas aeruginosa PA01
gggcguuggccagcgccac

SEQ ID NO: 3492132 - RNA, 21 nt, Pseudomonas aeruginosa PA01
gggcguuggcuccgggccgag

SEQ ID NO: 3492133 - RNA, 19 nt, Pseudomonas aeruginosa PA01
gggcguuuucguuggcgcg

SEQ ID NO: 3492134 - RNA, 20 nt, Pseudomonas aeruginosa PA01
gggcguuuucguuggcgcga

SEQ ID NO: 3492135 - RNA, 21 nt, Pseudomonas aeruginosa PA01
gggcguuuucguuggcggcca

SEQ ID NO: 3492136 - RNA, 19 nt, Pseudomonas aeruginosa PA01
gggcguuuuucauggcggc

SEQ ID NO: 3492137 - RNA, 22 nt, Pseudomonas aeruginosa PA01
gggcuaccaggaagcucggcag

SEQ ID NO: 3492138 - RNA, 17 nt, Pseudomonas aeruginosa PA01
gggcuacuucgccgggu

SEQ ID NO: 3492139 - RNA, 22 nt, Pseudomonas aeruginosa PA01
gggcuagguuuccccguggcgc

SEQ ID NO: 3492140 - RNA, 13 nt, Pseudomonas aeruginosa PA01
gggcuagucgcgc

SEQ ID NO: 3492141 - RNA, 15 nt, Pseudomonas aeruginosa PA01
gggcuagucgcgcag

SEQ ID NO: 3492142 - RNA, 17 nt, Pseudomonas aeruginosa PA01
gggcuagucgcgcagcg

SEQ ID NO: 3492143 - RNA, 21 nt, Pseudomonas aeruginosa PA01
gggcuagucgcgcagcgccuc

SEQ ID NO: 3492144 - RNA, 18 nt, Pseudomonas aeruginosa PA01
gggcuauucccgccgcuc

SEQ ID NO: 3492145 - RNA, 17 nt, Pseudomonas aeruginosa PA01
gggcucacucccgucca

SEQ ID NO: 3492146 - RNA, 14 nt, Pseudomonas aeruginosa PA01
gggcucagcccagg

SEQ ID NO: 3492147 - RNA, 20 nt, Pseudomonas aeruginosa PA01
gggcucagcccaggcgccgc

SEQ ID NO: 3492148 - RNA, 15 nt, Pseudomonas aeruginosa PA01
gggcucagcgcgcgu

SEQ ID NO: 3492149 - RNA, 24 nt, Pseudomonas aeruginosa PA01
gggcucagcgcgcguagcgugccg

SEQ ID NO: 3492150 - RNA, 20 nt, Pseudomonas aeruginosa PA01
gggcuccgccgcgagcgaaa

SEQ ID NO: 3492151 - RNA, 15 nt, Pseudomonas aeruginosa PA01
gggcucgacgaggaa

SEQ ID NO: 3492152 - RNA, 11 nt, Pseudomonas aeruginosa PA01
gggcucgccca

SEQ ID NO: 3492153 - RNA, 15 nt, Pseudomonas aeruginosa PA01
gggcucgcgcggggc

SEQ ID NO: 3492154 - RNA, 18 nt, Pseudomonas aeruginosa PA01
gggcucgcgcggggcgcg

SEQ ID NO: 3492155 - RNA, 24 nt, Pseudomonas aeruginosa PA01
gggcucgcgcggggcgcgcugcga

SEQ ID NO: 3492156 - RNA, 12 nt, Pseudomonas aeruginosa PA01
gggcucgggcgc

SEQ ID NO: 3492157 - RNA, 14 nt, Pseudomonas aeruginosa PA01
gggcucggucgagc

SEQ ID NO: 3492158 - RNA, 18 nt, Pseudomonas aeruginosa PA01
gggcucugguagccgcag

SEQ ID NO: 3492159 - RNA, 16 nt, Pseudomonas aeruginosa PA01
gggcugaacagcgcca

SEQ ID NO: 3492160 - RNA, 22 nt, Pseudomonas aeruginosa PA01
gggcugaacagcgccaccagca

SEQ ID NO: 3492161 - RNA, 19 nt, Pseudomonas aeruginosa PA01
gggcugaagugggucgccg

SEQ ID NO: 3492162 - RNA, 14 nt, Pseudomonas aeruginosa PA01
gggcugaucucggc

SEQ ID NO: 3492163 - RNA, 20 nt, Pseudomonas aeruginosa PA01
gggcugaucucggccauggu

SEQ ID NO: 3492164 - RNA, 15 nt, Pseudomonas aeruginosa PA01
gggcugccaccgagg

SEQ ID NO: 3492165 - RNA, 12 nt, Pseudomonas aeruginosa PA01
gggcugccagca

SEQ ID NO: 3492166 - RNA, 22 nt, Pseudomonas aeruginosa PA01
gggcugcccaccaccaggacca

SEQ ID NO: 3492167 - RNA, 23 nt, Pseudomonas aeruginosa PA01
gggcugcccaccaccaggaccau

SEQ ID NO: 3492168 - RNA, 17 nt, Pseudomonas aeruginosa PA01
gggcugccgaacaggcg

SEQ ID NO: 3492169 - RNA, 14 nt, Pseudomonas aeruginosa PA01
gggcugccgcccgg

SEQ ID NO: 3492170 - RNA, 16 nt, Pseudomonas aeruginosa PA01
gggcugcgugccagca

SEQ ID NO: 3492171 - RNA, 17 nt, Pseudomonas aeruginosa PA01
gggcugcgugccagcac

SEQ ID NO: 3492172 - RNA, 19 nt, Pseudomonas aeruginosa PA01
gggcugcuguugccaggga

SEQ ID NO: 3492173 - RNA, 17 nt, Pseudomonas aeruginosa PA01
gggcuggcagguugugc

SEQ ID NO: 3492174 - RNA, 16 nt, Pseudomonas aeruginosa PA01
gggcuggccaccagca

SEQ ID NO: 3492175 - RNA, 17 nt, Pseudomonas aeruginosa PA01
gggcuggccaccagcac

SEQ ID NO: 3492176 - RNA, 18 nt, Pseudomonas aeruginosa PA01
gggcuggccaccagcacc

SEQ ID NO: 3492177 - RNA, 17 nt, Pseudomonas aeruginosa PA01
gggcuggccaccgccag

SEQ ID NO: 3492178 - RNA, 20 nt, Pseudomonas aeruginosa PA01
gggcuggccaccgccaggac

SEQ ID NO: 3492179 - RNA, 23 nt, Pseudomonas aeruginosa PA01
gggcuggccaccgccaggaccuc

SEQ ID NO: 3492180 - RNA, 14 nt, Pseudomonas aeruginosa PA01
gggcuggccgucga

SEQ ID NO: 3492181 - RNA, 17 nt, Pseudomonas aeruginosa PA01
gggcugggucggcuggc

SEQ ID NO: 3492182 - RNA, 19 nt, Pseudomonas aeruginosa PA01
gggcuggucguagcagcgg

SEQ ID NO: 3492183 - RNA, 15 nt, Pseudomonas aeruginosa PA01
gggcugguucagcgg

SEQ ID NO: 3492184 - RNA, 21 nt, Pseudomonas aeruginosa PA01
gggcuguagggcgaauaacgc

SEQ ID NO: 3492185 - RNA, 21 nt, Pseudomonas aeruginosa PA01
gggcuguagugcuccggggcg

SEQ ID NO: 3492186 - RNA, 23 nt, Pseudomonas aeruginosa PA01
gggcuguagugcuccggggcgcu

SEQ ID NO: 3492187 - RNA, 21 nt, Pseudomonas aeruginosa PA01
gggcugucguccuggguaugc

SEQ ID NO: 3492188 - RNA, 15 nt, Pseudomonas aeruginosa PA01
gggcuucagcgccgg

SEQ ID NO: 3492189 - RNA, 17 nt, Pseudomonas aeruginosa PA01
gggcuucagcgccgggu

SEQ ID NO: 3492190 - RNA, 15 nt, Pseudomonas aeruginosa PA01
gggcuucgccgccgc

SEQ ID NO: 3492191 - RNA, 15 nt, Pseudomonas aeruginosa PA01
gggcuucgcgcagau

SEQ ID NO: 3492192 - RNA, 20 nt, Pseudomonas aeruginosa PA01
gggcuucgcgguggaugccg

SEQ ID NO: 3492193 - RNA, 17 nt, Pseudomonas aeruginosa PA01
gggcuucguccgccugg

SEQ ID NO: 3492194 - RNA, 23 nt, Pseudomonas aeruginosa PA01
gggcuucuucaccaggccgaacg

SEQ ID NO: 3492195 - RNA, 18 nt, Pseudomonas aeruginosa PA01
gggcuuucuucgccuggc

SEQ ID NO: 3492196 - RNA, 22 nt, Pseudomonas aeruginosa PA01
gggcuuuuucaugggcgcgcgc

SEQ ID NO: 3492197 - RNA, 20 nt, Pseudomonas aeruginosa PA01
gggcuuuuucguauccgcgg

SEQ ID NO: 3492198 - RNA, 19 nt, Pseudomonas aeruginosa PA01
gggcuuuuucguuggccag

SEQ ID NO: 3492199 - RNA, 20 nt, Pseudomonas aeruginosa PA01
gggcuuuuucguuggccagg

SEQ ID NO: 3492200 - RNA, 19 nt, Pseudomonas aeruginosa PA01
gggcuuuuucguuuccggc

SEQ ID NO: 3492201 - RNA, 17 nt, Pseudomonas aeruginosa PA01
gggcuuuuucucgucgc

SEQ ID NO: 3492202 - RNA, 21 nt, Pseudomonas aeruginosa PA01
gggcuuuuucucgucgcgcga

SEQ ID NO: 3492203 - RNA, 19 nt, Pseudomonas aeruginosa PA01
gggcuuuuuuggguuggcg

SEQ ID NO: 3492204 - RNA, 18 nt, Pseudomonas aeruginosa PA01
ggggaaacccucaggucg

SEQ ID NO: 3492205 - RNA, 22 nt, Pseudomonas aeruginosa PA01
ggggaaacccucaggucggcgc

SEQ ID NO: 3492206 - RNA, 20 nt, Pseudomonas aeruginosa PA01
ggggaaaccguggucgccgc

SEQ ID NO: 3492207 - RNA, 22 nt, Pseudomonas aeruginosa PA01
ggggaaaccuucgguggcgacc

SEQ ID NO: 3492208 - RNA, 17 nt, Pseudomonas aeruginosa PA01
ggggaaagcuccucggc

SEQ ID NO: 3492209 - RNA, 16 nt, Pseudomonas aeruginosa PA01
ggggaacacgcgcugg

SEQ ID NO: 3492210 - RNA, 17 nt, Pseudomonas aeruginosa PA01
ggggaacagcgccagcg

SEQ ID NO: 3492211 - RNA, 14 nt, Pseudomonas aeruginosa PA01
ggggaagaucuccg

SEQ ID NO: 3492212 - RNA, 19 nt, Pseudomonas aeruginosa PA01
ggggaagcgauccaugcgc

SEQ ID NO: 3492213 - RNA, 13 nt, Pseudomonas aeruginosa PA01
ggggaaucgccgu

SEQ ID NO: 3492214 - RNA, 16 nt, Pseudomonas aeruginosa PA01
ggggaaucugcgccag

SEQ ID NO: 3492215 - RNA, 22 nt, Pseudomonas aeruginosa PA01
ggggacggaagcauggccggcu

SEQ ID NO: 3492216 - RNA, 12 nt, Pseudomonas aeruginosa PA01
ggggagccgagg

SEQ ID NO: 3492217 - RNA, 14 nt, Pseudomonas aeruginosa PA01
ggggagcgccggcg

SEQ ID NO: 3492218 - RNA, 16 nt, Pseudomonas aeruginosa PA01
ggggaggggagguaag

SEQ ID NO: 3492219 - RNA, 23 nt, Pseudomonas aeruginosa PA01
ggggaguacuacccccucgaccu

SEQ ID NO: 3492220 - RNA, 16 nt, Pseudomonas aeruginosa PA01
ggggaucacucgccgc

SEQ ID NO: 3492221 - RNA, 17 nt, Pseudomonas aeruginosa PA01
ggggaucacucgccgcc

SEQ ID NO: 3492222 - RNA, 12 nt, Pseudomonas aeruginosa PA01
ggggaugcgccg

SEQ ID NO: 3492223 - RNA, 13 nt, Pseudomonas aeruginosa PA01
ggggaugcgcgag

SEQ ID NO: 3492224 - RNA, 14 nt, Pseudomonas aeruginosa PA01
ggggaugcgcgagg

SEQ ID NO: 3492225 - RNA, 18 nt, Pseudomonas aeruginosa PA01
ggggauggccggcgcggc

SEQ ID NO: 3492226 - RNA, 13 nt, Pseudomonas aeruginosa PA01
ggggauggcgggc

SEQ ID NO: 3492227 - RNA, 12 nt, Pseudomonas aeruginosa PA01
ggggcaggcgca

SEQ ID NO: 3492228 - RNA, 13 nt, Pseudomonas aeruginosa PA01
ggggcaggcgcag

SEQ ID NO: 3492229 - RNA, 14 nt, Pseudomonas aeruginosa PA01
ggggcaggcgcagg

SEQ ID NO: 3492230 - RNA, 16 nt, Pseudomonas aeruginosa PA01
ggggcaggcgcaggcg

SEQ ID NO: 3492231 - RNA, 22 nt, Pseudomonas aeruginosa PA01
ggggcaucggccauucggccug

SEQ ID NO: 3492232 - RNA, 16 nt, Pseudomonas aeruginosa PA01
ggggcauguccaccgc

SEQ ID NO: 3492233 - RNA, 17 nt, Pseudomonas aeruginosa PA01
ggggcauguccaccgcc

SEQ ID NO: 3492234 - RNA, 22 nt, Pseudomonas aeruginosa PA01
ggggcauguccaccgccgccag

SEQ ID NO: 3492235 - RNA, 15 nt, Pseudomonas aeruginosa PA01
ggggccccggcaagg

SEQ ID NO: 3492236 - RNA, 21 nt, Pseudomonas aeruginosa PA01
ggggccccggcaagggccugc

SEQ ID NO: 3492237 - RNA, 13 nt, Pseudomonas aeruginosa PA01
ggggcccggcagg

SEQ ID NO: 3492238 - RNA, 19 nt, Pseudomonas aeruginosa PA01
ggggcccggcaggcagugc

SEQ ID NO: 3492239 - RNA, 21 nt, Pseudomonas aeruginosa PA01
ggggcccggcaggcagugccg

SEQ ID NO: 3492240 - RNA, 16 nt, Pseudomonas aeruginosa PA01
ggggcccggcuccagc

SEQ ID NO: 3492241 - RNA, 20 nt, Pseudomonas aeruginosa PA01
ggggccgaggucgaccagcc

SEQ ID NO: 3492242 - RNA, 21 nt, Pseudomonas aeruginosa PA01
ggggccggacgcgacugcugc

SEQ ID NO: 3492243 - RNA, 15 nt, Pseudomonas aeruginosa PA01
ggggccggcacccgg

SEQ ID NO: 3492244 - RNA, 18 nt, Pseudomonas aeruginosa PA01
ggggccggccugggcccc

SEQ ID NO: 3492245 - RNA, 12 nt, Pseudomonas aeruginosa PA01
ggggccggcgau

SEQ ID NO: 3492246 - RNA, 12 nt, Pseudomonas aeruginosa PA01
ggggccguccgc

SEQ ID NO: 3492247 - RNA, 14 nt, Pseudomonas aeruginosa PA01
ggggccucggccag

SEQ ID NO: 3492248 - RNA, 22 nt, Pseudomonas aeruginosa PA01
ggggccuggcucgaucggcagg

SEQ ID NO: 3492249 - RNA, 16 nt, Pseudomonas aeruginosa PA01
ggggccuucaggcgcu

SEQ ID NO: 3492250 - RNA, 19 nt, Pseudomonas aeruginosa PA01
ggggcgacauagcggcugc

SEQ ID NO: 3492251 - RNA, 13 nt, Pseudomonas aeruginosa PA01
ggggcgaccagca

SEQ ID NO: 3492252 - RNA, 12 nt, Pseudomonas aeruginosa PA01
ggggcgaggucg

SEQ ID NO: 3492253 - RNA, 18 nt, Pseudomonas aeruginosa PA01
ggggcgaggucggccugc

SEQ ID NO: 3492254 - RNA, 13 nt, Pseudomonas aeruginosa PA01
ggggcgcaccgcc

SEQ ID NO: 3492255 - RNA, 11 nt, Pseudomonas aeruginosa PA01
ggggcgccggc

SEQ ID NO: 3492256 - RNA, 20 nt, Pseudomonas aeruginosa PA01
ggggcgccggcucgcccagc

SEQ ID NO: 3492257 - RNA, 17 nt, Pseudomonas aeruginosa PA01
ggggcgccuguccggga

SEQ ID NO: 3492258 - RNA, 16 nt, Pseudomonas aeruginosa PA01
ggggcgcgcccgccag

SEQ ID NO: 3492259 - RNA, 19 nt, Pseudomonas aeruginosa PA01
ggggcgcgcccgccagguc

SEQ ID NO: 3492260 - RNA, 13 nt, Pseudomonas aeruginosa PA01
ggggcgcgcugcg

SEQ ID NO: 3492261 - RNA, 14 nt, Pseudomonas aeruginosa PA01
ggggcgcucagggu

SEQ ID NO: 3492262 - RNA, 12 nt, Pseudomonas aeruginosa PA01
ggggcgcucgcc

SEQ ID NO: 3492263 - RNA, 14 nt, Pseudomonas aeruginosa PA01
ggggcgcucguugc

SEQ ID NO: 3492264 - RNA, 14 nt, Pseudomonas aeruginosa PA01
ggggcgcuguuggc

SEQ ID NO: 3492265 - RNA, 17 nt, Pseudomonas aeruginosa PA01
ggggcggauucaggcgc

SEQ ID NO: 3492266 - RNA, 16 nt, Pseudomonas aeruginosa PA01
ggggcggcacggugga

SEQ ID NO: 3492267 - RNA, 13 nt, Pseudomonas aeruginosa PA01
ggggcggccggcg

SEQ ID NO: 3492268 - RNA, 14 nt, Pseudomonas aeruginosa PA01
ggggcggccggcgc

SEQ ID NO: 3492269 - RNA, 18 nt, Pseudomonas aeruginosa PA01
ggggcggccucaggccug

SEQ ID NO: 3492270 - RNA, 13 nt, Pseudomonas aeruginosa PA01
ggggcggcucggc

SEQ ID NO: 3492271 - RNA, 13 nt, Pseudomonas aeruginosa PA01
ggggcgggccgcg

SEQ ID NO: 3492272 - RNA, 15 nt, Pseudomonas aeruginosa PA01
ggggcgugcaggccg

SEQ ID NO: 3492273 - RNA, 18 nt, Pseudomonas aeruginosa PA01
ggggcgugcaggccgccg

SEQ ID NO: 3492274 - RNA, 18 nt, Pseudomonas aeruginosa PA01
ggggcgugucgagggcug

SEQ ID NO: 3492275 - RNA, 19 nt, Pseudomonas aeruginosa PA01
ggggcguuuuuucuuucca

SEQ ID NO: 3492276 - RNA, 20 nt, Pseudomonas aeruginosa PA01
ggggcuagucgcgcagcgcc

SEQ ID NO: 3492277 - RNA, 15 nt, Pseudomonas aeruginosa PA01
ggggcucggcuucca

SEQ ID NO: 3492278 - RNA, 18 nt, Pseudomonas aeruginosa PA01
ggggcucuuucauugcgc

SEQ ID NO: 3492279 - RNA, 22 nt, Pseudomonas aeruginosa PA01
ggggcucuuucguuucagcgcc

SEQ ID NO: 3492280 - RNA, 16 nt, Pseudomonas aeruginosa PA01
ggggcugaacagcgcc

SEQ ID NO: 3492281 - RNA, 13 nt, Pseudomonas aeruginosa PA01
ggggcugagcgca

SEQ ID NO: 3492282 - RNA, 14 nt, Pseudomonas aeruginosa PA01
ggggcugagcgcau

SEQ ID NO: 3492283 - RNA, 21 nt, Pseudomonas aeruginosa PA01
ggggcugaucucggccauggu

SEQ ID NO: 3492284 - RNA, 23 nt, Pseudomonas aeruginosa PA01
ggggcuucuuuuaucgaaucggc

SEQ ID NO: 3492285 - RNA, 20 nt, Pseudomonas aeruginosa PA01
ggggcuuucuucgccuggcg

SEQ ID NO: 3492286 - RNA, 23 nt, Pseudomonas aeruginosa PA01
ggggcuuuuucguuuccggcagg

SEQ ID NO: 3492287 - RNA, 20 nt, Pseudomonas aeruginosa PA01
ggggcuuuuuuaugcgcagc

SEQ ID NO: 3492288 - RNA, 24 nt, Pseudomonas aeruginosa PA01
ggggcuuuuuuaugcgcagcgcgg

SEQ ID NO: 3492289 - RNA, 21 nt, Pseudomonas aeruginosa PA01
ggggcuuuuuucguggccgcg

SEQ ID NO: 3492290 - RNA, 22 nt, Pseudomonas aeruginosa PA01
ggggcuuuuuucguggccgcga

SEQ ID NO: 3492291 - RNA, 19 nt, Pseudomonas aeruginosa PA01
ggggcuuuuuuucgccugc

SEQ ID NO: 3492292 - RNA, 17 nt, Pseudomonas aeruginosa PA01
gggggccucggccagcg

SEQ ID NO: 3492293 - RNA, 19 nt, Pseudomonas aeruginosa PA01
gggggccucggccagcgcc

SEQ ID NO: 3492294 - RNA, 14 nt, Pseudomonas aeruginosa PA01
gggggccuggcucg

SEQ ID NO: 3492295 - RNA, 16 nt, Pseudomonas aeruginosa PA01
gggggcuccaggggag

SEQ ID NO: 3492296 - RNA, 19 nt, Pseudomonas aeruginosa PA01
gggggucucguagcagcca

SEQ ID NO: 3492297 - RNA, 20 nt, Pseudomonas aeruginosa PA01
gggggucuucgaaggucugc

SEQ ID NO: 3492298 - RNA, 19 nt, Pseudomonas aeruginosa PA01
gggggugaagcgcaggcgg

SEQ ID NO: 3492299 - RNA, 17 nt, Pseudomonas aeruginosa PA01
gggggugcccaucaggc

SEQ ID NO: 3492300 - RNA, 20 nt, Pseudomonas aeruginosa PA01
gggguaaggcaugcccaggc

SEQ ID NO: 3492301 - RNA, 22 nt, Pseudomonas aeruginosa PA01
gggguaggaggaaauacagcac

SEQ ID NO: 3492302 - RNA, 16 nt, Pseudomonas aeruginosa PA01
gggguaggggucggcc

SEQ ID NO: 3492303 - RNA, 13 nt, Pseudomonas aeruginosa PA01
ggggucagcgccu

SEQ ID NO: 3492304 - RNA, 17 nt, Pseudomonas aeruginosa PA01
ggggucaggccgaggcg

SEQ ID NO: 3492305 - RNA, 20 nt, Pseudomonas aeruginosa PA01
ggggucaguuccaggucggc

SEQ ID NO: 3492306 - RNA, 21 nt, Pseudomonas aeruginosa PA01
ggggucgacgcagggcggcgc

SEQ ID NO: 3492307 - RNA, 12 nt, Pseudomonas aeruginosa PA01
ggggucggccug

SEQ ID NO: 3492308 - RNA, 17 nt, Pseudomonas aeruginosa PA01
ggggucguagagguugc

SEQ ID NO: 3492309 - RNA, 15 nt, Pseudomonas aeruginosa PA01
ggggucuggccggcg

SEQ ID NO: 3492310 - RNA, 19 nt, Pseudomonas aeruginosa PA01
ggggucuggccggcgauca

SEQ ID NO: 3492311 - RNA, 18 nt, Pseudomonas aeruginosa PA01
ggggucuucguuuucagg

SEQ ID NO: 3492312 - RNA, 12 nt, Pseudomonas aeruginosa PA01
ggggugaagcgc

SEQ ID NO: 3492313 - RNA, 14 nt, Pseudomonas aeruginosa PA01
ggggugaagcgcag

SEQ ID NO: 3492314 - RNA, 19 nt, Pseudomonas aeruginosa PA01
ggggugagaacguuuccau

SEQ ID NO: 3492315 - RNA, 22 nt, Pseudomonas aeruginosa PA01
ggggugaucagucgucguccag

SEQ ID NO: 3492316 - RNA, 12 nt, Pseudomonas aeruginosa PA01
ggggugcagggg

SEQ ID NO: 3492317 - RNA, 19 nt, Pseudomonas aeruginosa PA01
ggggugccgccagucggcc

SEQ ID NO: 3492318 - RNA, 19 nt, Pseudomonas aeruginosa PA01
gggguggaguaccaggcca

SEQ ID NO: 3492319 - RNA, 14 nt, Pseudomonas aeruginosa PA01
ggggugggcauagg

SEQ ID NO: 3492320 - RNA, 18 nt, Pseudomonas aeruginosa PA01
gggguucuugucgaccag

SEQ ID NO: 3492321 - RNA, 22 nt, Pseudomonas aeruginosa PA01
gggguugaguugcaggccggcg

SEQ ID NO: 3492322 - RNA, 18 nt, Pseudomonas aeruginosa PA01
gggguugcaauagaaaag

SEQ ID NO: 3492323 - RNA, 14 nt, Pseudomonas aeruginosa PA01
gggguugcccagca

SEQ ID NO: 3492324 - RNA, 15 nt, Pseudomonas aeruginosa PA01
gggguugcccagcag

SEQ ID NO: 3492325 - RNA, 17 nt, Pseudomonas aeruginosa PA01
gggguugcccagcaggc

SEQ ID NO: 3492326 - RNA, 15 nt, Pseudomonas aeruginosa PA01
gggguuuccucgaag

SEQ ID NO: 3492327 - RNA, 17 nt, Pseudomonas aeruginosa PA01
gggguuucugcuggcca

SEQ ID NO: 3492328 - RNA, 20 nt, Pseudomonas aeruginosa PA01
gggguuucuuuuuauccggc

SEQ ID NO: 3492329 - RNA, 21 nt, Pseudomonas aeruginosa PA01
gggguuuucuuuuugcgccag

SEQ ID NO: 3492330 - RNA, 18 nt, Pseudomonas aeruginosa PA01
ggguaacccagggugcgg

SEQ ID NO: 3492331 - RNA, 19 nt, Pseudomonas aeruginosa PA01
ggguaacgguagcggcagg

SEQ ID NO: 3492332 - RNA, 20 nt, Pseudomonas aeruginosa PA01
ggguaacgguagcggcagga

SEQ ID NO: 3492333 - RNA, 19 nt, Pseudomonas aeruginosa PA01
ggguaaggcaugcccaggc

SEQ ID NO: 3492334 - RNA, 17 nt, Pseudomonas aeruginosa PA01
ggguaauaccccgcccc

SEQ ID NO: 3492335 - RNA, 13 nt, Pseudomonas aeruginosa PA01
ggguacagcgcca

SEQ ID NO: 3492336 - RNA, 22 nt, Pseudomonas aeruginosa PA01
ggguacagcgccacggccagca

SEQ ID NO: 3492337 - RNA, 18 nt, Pseudomonas aeruginosa PA01
ggguaccguugcgcaggc

SEQ ID NO: 3492338 - RNA, 24 nt, Pseudomonas aeruginosa PA01
ggguaccguugcgcaggcguuccu

SEQ ID NO: 3492339 - RNA, 14 nt, Pseudomonas aeruginosa PA01
ggguaccugcucgc

SEQ ID NO: 3492340 - RNA, 20 nt, Pseudomonas aeruginosa PA01
ggguacuucgugccacaggc

SEQ ID NO: 3492341 - RNA, 18 nt, Pseudomonas aeruginosa PA01
ggguagccauggcggauc

SEQ ID NO: 3492342 - RNA, 13 nt, Pseudomonas aeruginosa PA01
ggguagccgccca

SEQ ID NO: 3492343 - RNA, 15 nt, Pseudomonas aeruginosa PA01
ggguagccgcccacc

SEQ ID NO: 3492344 - RNA, 15 nt, Pseudomonas aeruginosa PA01
ggguagccggccgau

SEQ ID NO: 3492345 - RNA, 12 nt, Pseudomonas aeruginosa PA01
ggguagcugcug

SEQ ID NO: 3492346 - RNA, 14 nt, Pseudomonas aeruginosa PA01
ggguaggccaggca

SEQ ID NO: 3492347 - RNA, 16 nt, Pseudomonas aeruginosa PA01
ggguaguagaucagcu

SEQ ID NO: 3492348 - RNA, 16 nt, Pseudomonas aeruginosa PA01
ggguaucguugaucgg

SEQ ID NO: 3492349 - RNA, 15 nt, Pseudomonas aeruginosa PA01
gggucaccagcacca

SEQ ID NO: 3492350 - RNA, 12 nt, Pseudomonas aeruginosa PA01
gggucaccagcg

SEQ ID NO: 3492351 - RNA, 14 nt, Pseudomonas aeruginosa PA01
gggucaccagcgcc

SEQ ID NO: 3492352 - RNA, 18 nt, Pseudomonas aeruginosa PA01
gggucaccagcgccgggu

SEQ ID NO: 3492353 - RNA, 22 nt, Pseudomonas aeruginosa PA01
gggucacgccgaaguucuucag

SEQ ID NO: 3492354 - RNA, 14 nt, Pseudomonas aeruginosa PA01
gggucacgccgcgg

SEQ ID NO: 3492355 - RNA, 15 nt, Pseudomonas aeruginosa PA01
gggucacggucagcu

SEQ ID NO: 3492356 - RNA, 22 nt, Pseudomonas aeruginosa PA01
gggucacggucagcucggcauc

SEQ ID NO: 3492357 - RNA, 18 nt, Pseudomonas aeruginosa PA01
gggucacggugaggaccu

SEQ ID NO: 3492358 - RNA, 16 nt, Pseudomonas aeruginosa PA01
gggucacguggccgcc

SEQ ID NO: 3492359 - RNA, 15 nt, Pseudomonas aeruginosa PA01
gggucagcagcgcca

SEQ ID NO: 3492360 - RNA, 17 nt, Pseudomonas aeruginosa PA01
gggucagcagcgccagu

SEQ ID NO: 3492361 - RNA, 18 nt, Pseudomonas aeruginosa PA01
gggucagcagcgccagua

SEQ ID NO: 3492362 - RNA, 23 nt, Pseudomonas aeruginosa PA01
gggucagcagugcggggcgcucg

SEQ ID NO: 3492363 - RNA, 15 nt, Pseudomonas aeruginosa PA01
gggucagccgcaggc

SEQ ID NO: 3492364 - RNA, 16 nt, Pseudomonas aeruginosa PA01
gggucagccggccgau

SEQ ID NO: 3492365 - RNA, 12 nt, Pseudomonas aeruginosa PA01
gggucagcgcca

SEQ ID NO: 3492366 - RNA, 14 nt, Pseudomonas aeruginosa PA01
gggucagcgccagc

SEQ ID NO: 3492367 - RNA, 15 nt, Pseudomonas aeruginosa PA01
gggucagcgccagca

SEQ ID NO: 3492368 - RNA, 22 nt, Pseudomonas aeruginosa PA01
gggucagcgccagcaacccgcc

SEQ ID NO: 3492369 - RNA, 17 nt, Pseudomonas aeruginosa PA01
gggucagcggguuggcu

SEQ ID NO: 3492370 - RNA, 21 nt, Pseudomonas aeruginosa PA01
gggucagcggguuggcuucca

SEQ ID NO: 3492371 - RNA, 19 nt, Pseudomonas aeruginosa PA01
gggucagcucgacagcguc

SEQ ID NO: 3492372 - RNA, 13 nt, Pseudomonas aeruginosa PA01
gggucaggccgag

SEQ ID NO: 3492373 - RNA, 20 nt, Pseudomonas aeruginosa PA01
gggucaguuccaggucggcg

SEQ ID NO: 3492374 - RNA, 16 nt, Pseudomonas aeruginosa PA01
gggucaucaccggcag

SEQ ID NO: 3492375 - RNA, 17 nt, Pseudomonas aeruginosa PA01
gggucaucaccggcagg

SEQ ID NO: 3492376 - RNA, 15 nt, Pseudomonas aeruginosa PA01
gggucaugagguuca

SEQ ID NO: 3492377 - RNA, 22 nt, Pseudomonas aeruginosa PA01
gggucaugagguucaggccggg

SEQ ID NO: 3492378 - RNA, 13 nt, Pseudomonas aeruginosa PA01
gggucaugccgcc

SEQ ID NO: 3492379 - RNA, 23 nt, Pseudomonas aeruginosa PA01
gggucaugccgccaucgaccagg

SEQ ID NO: 3492380 - RNA, 13 nt, Pseudomonas aeruginosa PA01
gggucaugcucgg

SEQ ID NO: 3492381 - RNA, 13 nt, Pseudomonas aeruginosa PA01
ggguccaggcgcc

SEQ ID NO: 3492382 - RNA, 15 nt, Pseudomonas aeruginosa PA01
ggguccaggcgccag

SEQ ID NO: 3492383 - RNA, 16 nt, Pseudomonas aeruginosa PA01
ggguccaggcgccaga

SEQ ID NO: 3492384 - RNA, 21 nt, Pseudomonas aeruginosa PA01
ggguccaguucagggcgagca

SEQ ID NO: 3492385 - RNA, 11 nt, Pseudomonas aeruginosa PA01
ggguccaugga

SEQ ID NO: 3492386 - RNA, 15 nt, Pseudomonas aeruginosa PA01
ggguccuggugauca

SEQ ID NO: 3492387 - RNA, 12 nt, Pseudomonas aeruginosa PA01
gggucgacugcu

SEQ ID NO: 3492388 - RNA, 16 nt, Pseudomonas aeruginosa PA01
gggucgacuucgcacc

SEQ ID NO: 3492389 - RNA, 23 nt, Pseudomonas aeruginosa PA01
gggucgacuucgcaccagccggc

SEQ ID NO: 3492390 - RNA, 13 nt, Pseudomonas aeruginosa PA01
gggucgagccagg

SEQ ID NO: 3492391 - RNA, 16 nt, Pseudomonas aeruginosa PA01
gggucgagcuugccga

SEQ ID NO: 3492392 - RNA, 18 nt, Pseudomonas aeruginosa PA01
gggucgagcuugccgagg

SEQ ID NO: 3492393 - RNA, 15 nt, Pseudomonas aeruginosa PA01
gggucgaggccgaaa

SEQ ID NO: 3492394 - RNA, 15 nt, Pseudomonas aeruginosa PA01
gggucgaugcccucg

SEQ ID NO: 3492395 - RNA, 22 nt, Pseudomonas aeruginosa PA01
gggucgaugcccucgcggcggc

SEQ ID NO: 3492396 - RNA, 21 nt, Pseudomonas aeruginosa PA01
gggucgauuccugucuccgca

SEQ ID NO: 3492397 - RNA, 23 nt, Pseudomonas aeruginosa PA01
gggucgauugcugggugcggugg

SEQ ID NO: 3492398 - RNA, 13 nt, Pseudomonas aeruginosa PA01
gggucgcagcagg

SEQ ID NO: 3492399 - RNA, 18 nt, Pseudomonas aeruginosa PA01
gggucgcagccgggguug

SEQ ID NO: 3492400 - RNA, 12 nt, Pseudomonas aeruginosa PA01
gggucgccagca

SEQ ID NO: 3492401 - RNA, 12 nt, Pseudomonas aeruginosa PA01
gggucgcgccgg

SEQ ID NO: 3492402 - RNA, 20 nt, Pseudomonas aeruginosa PA01
gggucgcggcugaagaagcu

SEQ ID NO: 3492403 - RNA, 17 nt, Pseudomonas aeruginosa PA01
gggucgcggcuggccgc

SEQ ID NO: 3492404 - RNA, 15 nt, Pseudomonas aeruginosa PA01
gggucgcuuccucgg

SEQ ID NO: 3492405 - RNA, 15 nt, Pseudomonas aeruginosa PA01
gggucggcaccgagc

SEQ ID NO: 3492406 - RNA, 14 nt, Pseudomonas aeruginosa PA01
gggucggcaccugc

SEQ ID NO: 3492407 - RNA, 20 nt, Pseudomonas aeruginosa PA01
gggucggcaccugcagacgg

SEQ ID NO: 3492408 - RNA, 15 nt, Pseudomonas aeruginosa PA01
gggucggcacggcca

SEQ ID NO: 3492409 - RNA, 20 nt, Pseudomonas aeruginosa PA01
gggucggcccggagaccgug

SEQ ID NO: 3492410 - RNA, 21 nt, Pseudomonas aeruginosa PA01
gggucggcggauaaacggcau

SEQ ID NO: 3492411 - RNA, 17 nt, Pseudomonas aeruginosa PA01
gggucggcuggcagggc

SEQ ID NO: 3492412 - RNA, 20 nt, Pseudomonas aeruginosa PA01
gggucggcuggcagggcgcg

SEQ ID NO: 3492413 - RNA, 19 nt, Pseudomonas aeruginosa PA01
gggucgggcucaugggcga

SEQ ID NO: 3492414 - RNA, 18 nt, Pseudomonas aeruginosa PA01
gggucgguucgcggcgca

SEQ ID NO: 3492415 - RNA, 19 nt, Pseudomonas aeruginosa PA01
gggucgguucgcggcgcag

SEQ ID NO: 3492416 - RNA, 22 nt, Pseudomonas aeruginosa PA01
gggucguacaccagauggcugg

SEQ ID NO: 3492417 - RNA, 22 nt, Pseudomonas aeruginosa PA01
gggucguacaccgcgcggcaca

SEQ ID NO: 3492418 - RNA, 23 nt, Pseudomonas aeruginosa PA01
gggucguacaccgcgcggcacag

SEQ ID NO: 3492419 - RNA, 19 nt, Pseudomonas aeruginosa PA01
gggucgucgaagcgcagca

SEQ ID NO: 3492420 - RNA, 21 nt, Pseudomonas aeruginosa PA01
gggucgucgaagcgcagcagg

SEQ ID NO: 3492421 - RNA, 16 nt, Pseudomonas aeruginosa PA01
gggucgucgcccuggc

SEQ ID NO: 3492422 - RNA, 17 nt, Pseudomonas aeruginosa PA01
gggucgucgcuggcgga

SEQ ID NO: 3492423 - RNA, 19 nt, Pseudomonas aeruginosa PA01
gggucgucggucggccagg

SEQ ID NO: 3492424 - RNA, 13 nt, Pseudomonas aeruginosa PA01
gggucuccgcucg

SEQ ID NO: 3492425 - RNA, 18 nt, Pseudomonas aeruginosa PA01
gggucucgaucagcgccg

SEQ ID NO: 3492426 - RNA, 18 nt, Pseudomonas aeruginosa PA01
gggucugcucgcgcuucu

SEQ ID NO: 3492427 - RNA, 18 nt, Pseudomonas aeruginosa PA01
gggucugcucggcgcccu

SEQ ID NO: 3492428 - RNA, 21 nt, Pseudomonas aeruginosa PA01
gggucugcucggcgcccuggg

SEQ ID NO: 3492429 - RNA, 18 nt, Pseudomonas aeruginosa PA01
gggucugcuugcgcuggc

SEQ ID NO: 3492430 - RNA, 23 nt, Pseudomonas aeruginosa PA01
gggucuggcgauucuccugggcg

SEQ ID NO: 3492431 - RNA, 15 nt, Pseudomonas aeruginosa PA01
gggucuucaggccga

SEQ ID NO: 3492432 - RNA, 17 nt, Pseudomonas aeruginosa PA01
gggucuucaggcgccgu

SEQ ID NO: 3492433 - RNA, 21 nt, Pseudomonas aeruginosa PA01
gggugaacucaugcaggccga

SEQ ID NO: 3492434 - RNA, 23 nt, Pseudomonas aeruginosa PA01
gggugaacucaugcaggccgaag

SEQ ID NO: 3492435 - RNA, 13 nt, Pseudomonas aeruginosa PA01
gggugaacuggcc

SEQ ID NO: 3492436 - RNA, 15 nt, Pseudomonas aeruginosa PA01
gggugaagcgcaggc

SEQ ID NO: 3492437 - RNA, 12 nt, Pseudomonas aeruginosa PA01
gggugaagcugc

SEQ ID NO: 3492438 - RNA, 14 nt, Pseudomonas aeruginosa PA01
gggugaagcugcgg

SEQ ID NO: 3492439 - RNA, 14 nt, Pseudomonas aeruginosa PA01
gggugaccgugcgg

SEQ ID NO: 3492440 - RNA, 12 nt, Pseudomonas aeruginosa PA01
gggugaccuggc

SEQ ID NO: 3492441 - RNA, 15 nt, Pseudomonas aeruginosa PA01
gggugaccuggccgc

SEQ ID NO: 3492442 - RNA, 16 nt, Pseudomonas aeruginosa PA01
gggugaucacccagag

SEQ ID NO: 3492443 - RNA, 23 nt, Pseudomonas aeruginosa PA01
gggugaucacccagagcaccagg

SEQ ID NO: 3492444 - RNA, 12 nt, Pseudomonas aeruginosa PA01
gggugaucagcc

SEQ ID NO: 3492445 - RNA, 23 nt, Pseudomonas aeruginosa PA01
gggugaucagcuccgccucgauc

SEQ ID NO: 3492446 - RNA, 23 nt, Pseudomonas aeruginosa PA01
gggugaucagucgucguccagcg

SEQ ID NO: 3492447 - RNA, 21 nt, Pseudomonas aeruginosa PA01
gggugauccagcuggcgcguu

SEQ ID NO: 3492448 - RNA, 18 nt, Pseudomonas aeruginosa PA01
gggugaucuugaucugca

SEQ ID NO: 3492449 - RNA, 20 nt, Pseudomonas aeruginosa PA01
gggugaucuugaucugcaug

SEQ ID NO: 3492450 - RNA, 19 nt, Pseudomonas aeruginosa PA01
gggugaucuuuuccucguc

SEQ ID NO: 3492451 - RNA, 13 nt, Pseudomonas aeruginosa PA01
gggugaugcccgg

SEQ ID NO: 3492452 - RNA, 17 nt, Pseudomonas aeruginosa PA01
gggugauuucuucagcc

SEQ ID NO: 3492453 - RNA, 21 nt, Pseudomonas aeruginosa PA01
gggugcagauggucgccggag

SEQ ID NO: 3492454 - RNA, 14 nt, Pseudomonas aeruginosa PA01
gggugcagcccugg

SEQ ID NO: 3492455 - RNA, 15 nt, Pseudomonas aeruginosa PA01
gggugcagcccuggc

SEQ ID NO: 3492456 - RNA, 14 nt, Pseudomonas aeruginosa PA01
gggugcaggggcgc

SEQ ID NO: 3492457 - RNA, 21 nt, Pseudomonas aeruginosa PA01
gggugcccaucaggcucaggc

SEQ ID NO: 3492458 - RNA, 17 nt, Pseudomonas aeruginosa PA01
gggugccccaggcgagu

SEQ ID NO: 3492459 - RNA, 15 nt, Pseudomonas aeruginosa PA01
gggugcccucguuga

SEQ ID NO: 3492460 - RNA, 19 nt, Pseudomonas aeruginosa PA01
gggugccgccagucggccu

SEQ ID NO: 3492461 - RNA, 21 nt, Pseudomonas aeruginosa PA01
gggugccgcgaauguggugga

SEQ ID NO: 3492462 - RNA, 14 nt, Pseudomonas aeruginosa PA01
gggugccgcgcagg

SEQ ID NO: 3492463 - RNA, 14 nt, Pseudomonas aeruginosa PA01
gggugccggugcgg

SEQ ID NO: 3492464 - RNA, 12 nt, Pseudomonas aeruginosa PA01
gggugccuuccg

SEQ ID NO: 3492465 - RNA, 16 nt, Pseudomonas aeruginosa PA01
gggugccuugccaagg

SEQ ID NO: 3492466 - RNA, 15 nt, Pseudomonas aeruginosa PA01
gggugcgcggcgaag

SEQ ID NO: 3492467 - RNA, 21 nt, Pseudomonas aeruginosa PA01
gggugcucaggacguccuggc

SEQ ID NO: 3492468 - RNA, 20 nt, Pseudomonas aeruginosa PA01
gggugcugaagauaucgccu

SEQ ID NO: 3492469 - RNA, 22 nt, Pseudomonas aeruginosa PA01
gggugcugcccagggcccagag

SEQ ID NO: 3492470 - RNA, 23 nt, Pseudomonas aeruginosa PA01
ggguggaacccgcuucgucgguc

SEQ ID NO: 3492471 - RNA, 16 nt, Pseudomonas aeruginosa PA01
ggguggaacgaggcga

SEQ ID NO: 3492472 - RNA, 11 nt, Pseudomonas aeruginosa PA01
ggguggccagg

SEQ ID NO: 3492473 - RNA, 21 nt, Pseudomonas aeruginosa PA01
ggguggccaggcgcaccagca

SEQ ID NO: 3492474 - RNA, 14 nt, Pseudomonas aeruginosa PA01
ggguggcgacgccg

SEQ ID NO: 3492475 - RNA, 22 nt, Pseudomonas aeruginosa PA01
ggguggcgacgucgccccagcc

SEQ ID NO: 3492476 - RNA, 22 nt, Pseudomonas aeruginosa PA01
ggguggcgccgagcagcggcgc

SEQ ID NO: 3492477 - RNA, 22 nt, Pseudomonas aeruginosa PA01
ggguggcgcgcaccaccuggca

SEQ ID NO: 3492478 - RNA, 13 nt, Pseudomonas aeruginosa PA01
ggguggcgcuggc

SEQ ID NO: 3492479 - RNA, 12 nt, Pseudomonas aeruginosa PA01
ggguggcggcgg

SEQ ID NO: 3492480 - RNA, 17 nt, Pseudomonas aeruginosa PA01
ggguggcggcggcgagu

SEQ ID NO: 3492481 - RNA, 13 nt, Pseudomonas aeruginosa PA01
gggugggcggugc

SEQ ID NO: 3492482 - RNA, 15 nt, Pseudomonas aeruginosa PA01
gggugggcggugcgg

SEQ ID NO: 3492483 - RNA, 14 nt, Pseudomonas aeruginosa PA01
gggugggucauggc

SEQ ID NO: 3492484 - RNA, 20 nt, Pseudomonas aeruginosa PA01
gggugggucauggcguccgg

SEQ ID NO: 3492485 - RNA, 21 nt, Pseudomonas aeruginosa PA01
ggguggucagccagccgagca

SEQ ID NO: 3492486 - RNA, 15 nt, Pseudomonas aeruginosa PA01
ggguggucugcacgg

SEQ ID NO: 3492487 - RNA, 12 nt, Pseudomonas aeruginosa PA01
gggugucggcga

SEQ ID NO: 3492488 - RNA, 13 nt, Pseudomonas aeruginosa PA01
gggugucggcgau

SEQ ID NO: 3492489 - RNA, 14 nt, Pseudomonas aeruginosa PA01
gggugucggcgauc

SEQ ID NO: 3492490 - RNA, 15 nt, Pseudomonas aeruginosa PA01
gggugucggcgauca

SEQ ID NO: 3492491 - RNA, 21 nt, Pseudomonas aeruginosa PA01
gggugucguuguugccgcgca

SEQ ID NO: 3492492 - RNA, 18 nt, Pseudomonas aeruginosa PA01
ggguguucagcggcgcgu

SEQ ID NO: 3492493 - RNA, 16 nt, Pseudomonas aeruginosa PA01
ggguguugucggucag

SEQ ID NO: 3492494 - RNA, 13 nt, Pseudomonas aeruginosa PA01
ggguucagcccgc

SEQ ID NO: 3492495 - RNA, 21 nt, Pseudomonas aeruginosa PA01
ggguucccaguugcugggcga

SEQ ID NO: 3492496 - RNA, 11 nt, Pseudomonas aeruginosa PA01
ggguuccucua

SEQ ID NO: 3492497 - RNA, 13 nt, Pseudomonas aeruginosa PA01
ggguucgacgcgc

SEQ ID NO: 3492498 - RNA, 16 nt, Pseudomonas aeruginosa PA01
ggguucgauuccucua

SEQ ID NO: 3492499 - RNA, 21 nt, Pseudomonas aeruginosa PA01
ggguucggcgagaggucggcg

SEQ ID NO: 3492500 - RNA, 22 nt, Pseudomonas aeruginosa PA01
ggguucggggaacagcgccagc

SEQ ID NO: 3492501 - RNA, 12 nt, Pseudomonas aeruginosa PA01
ggguucuccggg

SEQ ID NO: 3492502 - RNA, 18 nt, Pseudomonas aeruginosa PA01
ggguugacccagagccgc

SEQ ID NO: 3492503 - RNA, 17 nt, Pseudomonas aeruginosa PA01
ggguugaguugcaggcc

SEQ ID NO: 3492504 - RNA, 20 nt, Pseudomonas aeruginosa PA01
ggguugaguugcaggccggc

SEQ ID NO: 3492505 - RNA, 16 nt, Pseudomonas aeruginosa PA01
ggguugcccagcaggc

SEQ ID NO: 3492506 - RNA, 20 nt, Pseudomonas aeruginosa PA01
ggguugcccucgcagccggc

SEQ ID NO: 3492507 - RNA, 21 nt, Pseudomonas aeruginosa PA01
ggguugcccucgcagccggcg

SEQ ID NO: 3492508 - RNA, 15 nt, Pseudomonas aeruginosa PA01
ggguugccgcgccga

SEQ ID NO: 3492509 - RNA, 20 nt, Pseudomonas aeruginosa PA01
ggguugccguagcgaugcgg

SEQ ID NO: 3492510 - RNA, 18 nt, Pseudomonas aeruginosa PA01
ggguugcggcgcccgcca

SEQ ID NO: 3492511 - RNA, 15 nt, Pseudomonas aeruginosa PA01
ggguuggccgcagca

SEQ ID NO: 3492512 - RNA, 20 nt, Pseudomonas aeruginosa PA01
ggguuggcgcaggccgggcg

SEQ ID NO: 3492513 - RNA, 17 nt, Pseudomonas aeruginosa PA01
ggguugggcagcgucgc

SEQ ID NO: 3492514 - RNA, 23 nt, Pseudomonas aeruginosa PA01
ggguugggcagcgucgccgggcg

SEQ ID NO: 3492515 - RNA, 15 nt, Pseudomonas aeruginosa PA01
ggguugguggccgcg

SEQ ID NO: 3492516 - RNA, 13 nt, Pseudomonas aeruginosa PA01
ggguuuccagcag

SEQ ID NO: 3492517 - RNA, 15 nt, Pseudomonas aeruginosa PA01
ggguuuccagcagca

SEQ ID NO: 3492518 - RNA, 17 nt, Pseudomonas aeruginosa PA01
ggguuuccgugcgcugc

SEQ ID NO: 3492519 - RNA, 20 nt, Pseudomonas aeruginosa PA01
ggguuuccgugcgcugcgcg

SEQ ID NO: 3492520 - RNA, 17 nt, Pseudomonas aeruginosa PA01
ggguuuccgugugcagc

SEQ ID NO: 3492521 - RNA, 21 nt, Pseudomonas aeruginosa PA01
ggguuuccgugugcagcaggg

SEQ ID NO: 3492522 - RNA, 13 nt, Pseudomonas aeruginosa PA01
ggguuucgcugcc

SEQ ID NO: 3492523 - RNA, 14 nt, Pseudomonas aeruginosa PA01
gguaaagcgcccgc

SEQ ID NO: 3492524 - RNA, 16 nt, Pseudomonas aeruginosa PA01
gguaaaggccaccaga

SEQ ID NO: 3492525 - RNA, 14 nt, Pseudomonas aeruginosa PA01
gguaacccgcggcg

SEQ ID NO: 3492526 - RNA, 20 nt, Pseudomonas aeruginosa PA01
gcugcaugugccaggccugg

SEQ ID NO: 3492527 - RNA, 17 nt, Pseudomonas aeruginosa PA01
gcugccacccggcucgg

SEQ ID NO: 3492528 - RNA, 17 nt, Pseudomonas aeruginosa PA01
gcugccaccgagggcag

SEQ ID NO: 3492529 - RNA, 22 nt, Pseudomonas aeruginosa PA01
gcugccaccgagggcaggaacc

SEQ ID NO: 3492530 - RNA, 19 nt, Pseudomonas aeruginosa PA01
gcugccagcaggccgagcc

SEQ ID NO: 3492531 - RNA, 13 nt, Pseudomonas aeruginosa PA01
gcugccagcgccg

SEQ ID NO: 3492532 - RNA, 17 nt, Pseudomonas aeruginosa PA01
gcugccagcgccgccgc

SEQ ID NO: 3492533 - RNA, 20 nt, Pseudomonas aeruginosa PA01
gcugccagcgccgccgcgug

SEQ ID NO: 3492534 - RNA, 14 nt, Pseudomonas aeruginosa PA01
gcugccagguuggc

SEQ ID NO: 3492535 - RNA, 15 nt, Pseudomonas aeruginosa PA01
gcugccaguggcggc

SEQ ID NO: 3492536 - RNA, 20 nt, Pseudomonas aeruginosa PA01
gcugccauccgcgccgacca

SEQ ID NO: 3492537 - RNA, 22 nt, Pseudomonas aeruginosa PA01
gcugccauccgcgccgaccagc

SEQ ID NO: 3492538 - RNA, 14 nt, Pseudomonas aeruginosa PA01
gcugccauggcggc

SEQ ID NO: 3492539 - RNA, 16 nt, Pseudomonas aeruginosa PA01
gcugccauggcggcgg

SEQ ID NO: 3492540 - RNA, 16 nt, Pseudomonas aeruginosa PA01
gcugcccaacuggcgg

SEQ ID NO: 3492541 - RNA, 16 nt, Pseudomonas aeruginosa PA01
gcugcccaagggccug

SEQ ID NO: 3492542 - RNA, 18 nt, Pseudomonas aeruginosa PA01
gcugcccaagggccuggg

SEQ ID NO: 3492543 - RNA, 23 nt, Pseudomonas aeruginosa PA01
gcugcccaagggccugggcgccg

SEQ ID NO: 3492544 - RNA, 14 nt, Pseudomonas aeruginosa PA01
gcugcccaccacca

SEQ ID NO: 3492545 - RNA, 16 nt, Pseudomonas aeruginosa PA01
gcugcccagauccccu

SEQ ID NO: 3492546 - RNA, 21 nt, Pseudomonas aeruginosa PA01
gcugcccagauccccugcagg

SEQ ID NO: 3492547 - RNA, 22 nt, Pseudomonas aeruginosa PA01
gcugcccagcccgccuuccagc

SEQ ID NO: 3492548 - RNA, 12 nt, Pseudomonas aeruginosa PA01
gcugcccaggcu

SEQ ID NO: 3492549 - RNA, 20 nt, Pseudomonas aeruginosa PA01
gcugcccagggcccagagca

SEQ ID NO: 3492550 - RNA, 22 nt, Pseudomonas aeruginosa PA01
gcugcccagggcccagagcagc

SEQ ID NO: 3492551 - RNA, 15 nt, Pseudomonas aeruginosa PA01
gcugcccagguagcc

SEQ ID NO: 3492552 - RNA, 20 nt, Pseudomonas aeruginosa PA01
gcugcccagguagccggcga

SEQ ID NO: 3492553 - RNA, 18 nt, Pseudomonas aeruginosa PA01
gcugcccaguugcgcggc

SEQ ID NO: 3492554 - RNA, 20 nt, Pseudomonas aeruginosa PA01
gcugcccaguugcgcggcga

SEQ ID NO: 3492555 - RNA, 14 nt, Pseudomonas aeruginosa PA01
gcugcccaucgccu

SEQ ID NO: 3492556 - RNA, 15 nt, Pseudomonas aeruginosa PA01
gcugcccaucgccuc

SEQ ID NO: 3492557 - RNA, 16 nt, Pseudomonas aeruginosa PA01
gcugcccaucgccucc

SEQ ID NO: 3492558 - RNA, 17 nt, Pseudomonas aeruginosa PA01
gcugcccaucgccucca

SEQ ID NO: 3492559 - RNA, 20 nt, Pseudomonas aeruginosa PA01
gcugcccaucgccuccacgg

SEQ ID NO: 3492560 - RNA, 21 nt, Pseudomonas aeruginosa PA01
gcugcccaucgccuccacggc

SEQ ID NO: 3492561 - RNA, 15 nt, Pseudomonas aeruginosa PA01
gcugccccacaggcc

SEQ ID NO: 3492562 - RNA, 19 nt, Pseudomonas aeruginosa PA01
gcugccccacaggcccugc

SEQ ID NO: 3492563 - RNA, 21 nt, Pseudomonas aeruginosa PA01
gcugccccacaggcccugcag

SEQ ID NO: 3492564 - RNA, 13 nt, Pseudomonas aeruginosa PA01
gcugccccucaca

SEQ ID NO: 3492565 - RNA, 15 nt, Pseudomonas aeruginosa PA01
gcugcccggagcggc

SEQ ID NO: 3492566 - RNA, 17 nt, Pseudomonas aeruginosa PA01
gcugcccggagcggcug

SEQ ID NO: 3492567 - RNA, 18 nt, Pseudomonas aeruginosa PA01
gcugcccggagcggcugc

SEQ ID NO: 3492568 - RNA, 19 nt, Pseudomonas aeruginosa PA01
gcugcccggcauaggcgcc

SEQ ID NO: 3492569 - RNA, 21 nt, Pseudomonas aeruginosa PA01
gcugcccggcauaggcgccag

SEQ ID NO: 3492570 - RNA, 22 nt, Pseudomonas aeruginosa PA01
gcugcccggcauaggcgccagc

SEQ ID NO: 3492571 - RNA, 23 nt, Pseudomonas aeruginosa PA01
gcugcccgggguuggcgcugacc

SEQ ID NO: 3492572 - RNA, 21 nt, Pseudomonas aeruginosa PA01
gcugcccucgaccagguccgg

SEQ ID NO: 3492573 - RNA, 22 nt, Pseudomonas aeruginosa PA01
gcugcccucgaccagguccggc

SEQ ID NO: 3492574 - RNA, 14 nt, Pseudomonas aeruginosa PA01
gcugcccucgacga

SEQ ID NO: 3492575 - RNA, 15 nt, Pseudomonas aeruginosa PA01
gcugcccuggcgcgc

SEQ ID NO: 3492576 - RNA, 16 nt, Pseudomonas aeruginosa PA01
gcugcccuggcgcgcg

SEQ ID NO: 3492577 - RNA, 19 nt, Pseudomonas aeruginosa PA01
gcugcccuggcgcgcgccc

SEQ ID NO: 3492578 - RNA, 22 nt, Pseudomonas aeruginosa PA01
gcugccgaacagacgggacagg

SEQ ID NO: 3492579 - RNA, 15 nt, Pseudomonas aeruginosa PA01
gcugccgaacagcag

SEQ ID NO: 3492580 - RNA, 16 nt, Pseudomonas aeruginosa PA01
gcugccgaacagcagg

SEQ ID NO: 3492581 - RNA, 18 nt, Pseudomonas aeruginosa PA01
gcugccgaacagcaggga

SEQ ID NO: 3492582 - RNA, 23 nt, Pseudomonas aeruginosa PA01
gcugccgaagaucgacaggccgc

SEQ ID NO: 3492583 - RNA, 20 nt, Pseudomonas aeruginosa PA01
gcugccgaagggaaacacca

SEQ ID NO: 3492584 - RNA, 22 nt, Pseudomonas aeruginosa PA01
gcugccgagaaucugcccggcc

SEQ ID NO: 3492585 - RNA, 23 nt, Pseudomonas aeruginosa PA01
gcugccgagcagggucacgccga

SEQ ID NO: 3492586 - RNA, 21 nt, Pseudomonas aeruginosa PA01
gcugccgaggcugaucugccg

SEQ ID NO: 3492587 - RNA, 23 nt, Pseudomonas aeruginosa PA01
gcugccgaggcugaucugccggu

SEQ ID NO: 3492588 - RNA, 23 nt, Pseudomonas aeruginosa PA01
gcugccgcagaucaucgcacggu

SEQ ID NO: 3492589 - RNA, 14 nt, Pseudomonas aeruginosa PA01
gcugccgccgcaga

SEQ ID NO: 3492590 - RNA, 24 nt, Pseudomonas aeruginosa PA01
gcugccgccgcagagccagccgca

SEQ ID NO: 3492591 - RNA, 14 nt, Pseudomonas aeruginosa PA01
gcugccgccgcgca

SEQ ID NO: 3492592 - RNA, 15 nt, Pseudomonas aeruginosa PA01
gcugccgccgcgcag

SEQ ID NO: 3492593 - RNA, 17 nt, Pseudomonas aeruginosa PA01
gcugccgccgcgcaggc

SEQ ID NO: 3492594 - RNA, 15 nt, Pseudomonas aeruginosa PA01
gcugccgccgcgccc

SEQ ID NO: 3492595 - RNA, 18 nt, Pseudomonas aeruginosa PA01
gcugccgccgcgcccggc

SEQ ID NO: 3492596 - RNA, 22 nt, Pseudomonas aeruginosa PA01
gcugccgccgcgcccggcgcca

SEQ ID NO: 3492597 - RNA, 17 nt, Pseudomonas aeruginosa PA01
gcugccgccgcgcugca

SEQ ID NO: 3492598 - RNA, 19 nt, Pseudomonas aeruginosa PA01
gcugccgccgcgcugcagg

SEQ ID NO: 3492599 - RNA, 13 nt, Pseudomonas aeruginosa PA01
gcugccgccgucu

SEQ ID NO: 3492600 - RNA, 23 nt, Pseudomonas aeruginosa PA01
gcugccgccgucuccgccgcuau

SEQ ID NO: 3492601 - RNA, 21 nt, Pseudomonas aeruginosa PA01
gcugccgccuucgcgggccag

SEQ ID NO: 3492602 - RNA, 16 nt, Pseudomonas aeruginosa PA01
gcugccgcgcguggcu

SEQ ID NO: 3492603 - RNA, 21 nt, Pseudomonas aeruginosa PA01
gcugccgcggaagugcgccgg

SEQ ID NO: 3492604 - RNA, 17 nt, Pseudomonas aeruginosa PA01
gcugccgcguuccuugu

SEQ ID NO: 3492605 - RNA, 13 nt, Pseudomonas aeruginosa PA01
gcugccgcucugg

SEQ ID NO: 3492606 - RNA, 17 nt, Pseudomonas aeruginosa PA01
gcugccgcuucggcugc

SEQ ID NO: 3492607 - RNA, 19 nt, Pseudomonas aeruginosa PA01
gcugccggagucucgggaa

SEQ ID NO: 3492608 - RNA, 11 nt, Pseudomonas aeruginosa PA01
gcugccggcau

SEQ ID NO: 3492609 - RNA, 22 nt, Pseudomonas aeruginosa PA01
gcugccggccagggucgccagc

SEQ ID NO: 3492610 - RNA, 14 nt, Pseudomonas aeruginosa PA01
gcugccggccaggu

SEQ ID NO: 3492611 - RNA, 17 nt, Pseudomonas aeruginosa PA01
gcugccggccagguagc

SEQ ID NO: 3492612 - RNA, 15 nt, Pseudomonas aeruginosa PA01
gcugccggcgcgcac

SEQ ID NO: 3492613 - RNA, 20 nt, Pseudomonas aeruginosa PA01
gcugccggcuugcugcaggu

SEQ ID NO: 3492614 - RNA, 15 nt, Pseudomonas aeruginosa PA01
gcugccgggcgagcu

SEQ ID NO: 3492615 - RNA, 18 nt, Pseudomonas aeruginosa PA01
gcugccgggcgagcugca

SEQ ID NO: 3492616 - RNA, 14 nt, Pseudomonas aeruginosa PA01
gcugccgggcucug

SEQ ID NO: 3492617 - RNA, 19 nt, Pseudomonas aeruginosa PA01
gcugccgggcucugguagc

SEQ ID NO: 3492618 - RNA, 15 nt, Pseudomonas aeruginosa PA01
gcugccggucaggcu

SEQ ID NO: 3492619 - RNA, 17 nt, Pseudomonas aeruginosa PA01
gcugccggucaggcugg

SEQ ID NO: 3492620 - RNA, 23 nt, Pseudomonas aeruginosa PA01
gcugccggucaggcuggugccgc

SEQ ID NO: 3492621 - RNA, 19 nt, Pseudomonas aeruginosa PA01
gcugccguacagcccccgc

SEQ ID NO: 3492622 - RNA, 19 nt, Pseudomonas aeruginosa PA01
gcugccguagaggucgccg

SEQ ID NO: 3492623 - RNA, 21 nt, Pseudomonas aeruginosa PA01
gcugccguagaggucgccguc

SEQ ID NO: 3492624 - RNA, 22 nt, Pseudomonas aeruginosa PA01
gcugccguagcgcuucaucagg

SEQ ID NO: 3492625 - RNA, 16 nt, Pseudomonas aeruginosa PA01
gcugccguccaggcgc

SEQ ID NO: 3492626 - RNA, 18 nt, Pseudomonas aeruginosa PA01
gcugccguccaggcgcga

SEQ ID NO: 3492627 - RNA, 15 nt, Pseudomonas aeruginosa PA01
gcugccgucgaaguc

SEQ ID NO: 3492628 - RNA, 15 nt, Pseudomonas aeruginosa PA01
gcugccguucgcccg

SEQ ID NO: 3492629 - RNA, 21 nt, Pseudomonas aeruginosa PA01
gcugccguucgcccgcggcgg

SEQ ID NO: 3492630 - RNA, 18 nt, Pseudomonas aeruginosa PA01
gcugccguugcaggccca

SEQ ID NO: 3492631 - RNA, 20 nt, Pseudomonas aeruginosa PA01
gcugccguugcaggcccagc

SEQ ID NO: 3492632 - RNA, 13 nt, Pseudomonas aeruginosa PA01
gcugccguugcgg

SEQ ID NO: 3492633 - RNA, 17 nt, Pseudomonas aeruginosa PA01
gcugccguugcggcccu

SEQ ID NO: 3492634 - RNA, 20 nt, Pseudomonas aeruginosa PA01
gcugccuaccgucacgcgga

SEQ ID NO: 3492635 - RNA, 22 nt, Pseudomonas aeruginosa PA01
gcugccuaccgucacgcggacc

SEQ ID NO: 3492636 - RNA, 22 nt, Pseudomonas aeruginosa PA01
gcugccucgguuuccggccagg

SEQ ID NO: 3492637 - RNA, 23 nt, Pseudomonas aeruginosa PA01
gcugccucgguuuccggccaggc

SEQ ID NO: 3492638 - RNA, 16 nt, Pseudomonas aeruginosa PA01
gcugccugcaccgggc

SEQ ID NO: 3492639 - RNA, 19 nt, Pseudomonas aeruginosa PA01
gcugccugcaccgggccga

SEQ ID NO: 3492640 - RNA, 16 nt, Pseudomonas aeruginosa PA01
gcugccugucgcagcg

SEQ ID NO: 3492641 - RNA, 16 nt, Pseudomonas aeruginosa PA01
gcugccuuccagcagg

SEQ ID NO: 3492642 - RNA, 15 nt, Pseudomonas aeruginosa PA01
gcugccuuccuuuuc

SEQ ID NO: 3492643 - RNA, 20 nt, Pseudomonas aeruginosa PA01
gcugccuuccuuuucgaaca

SEQ ID NO: 3492644 - RNA, 20 nt, Pseudomonas aeruginosa PA01
gcugcgaaucgucgccggag

SEQ ID NO: 3492645 - RNA, 18 nt, Pseudomonas aeruginosa PA01
gcugcgagaacaggcgga

SEQ ID NO: 3492646 - RNA, 21 nt, Pseudomonas aeruginosa PA01
gcugcgagaacaggcggaucu

SEQ ID NO: 3492647 - RNA, 23 nt, Pseudomonas aeruginosa PA01
gcugcgagggauguuccaggccc

SEQ ID NO: 3492648 - RNA, 17 nt, Pseudomonas aeruginosa PA01
gcugcgauauggccgau

SEQ ID NO: 3492649 - RNA, 19 nt, Pseudomonas aeruginosa PA01
gcugcgauauggccgauca

SEQ ID NO: 3492650 - RNA, 19 nt, Pseudomonas aeruginosa PA01
gcugcgcaacugccggucg

SEQ ID NO: 3492651 - RNA, 22 nt, Pseudomonas aeruginosa PA01
gcugcgcaacugccggucggcc

SEQ ID NO: 3492652 - RNA, 23 nt, Pseudomonas aeruginosa PA01
gcugcgcaacugccggucggccu

SEQ ID NO: 3492653 - RNA, 17 nt, Pseudomonas aeruginosa PA01
gcugcgcaccucggcca

SEQ ID NO: 3492654 - RNA, 19 nt, Pseudomonas aeruginosa PA01
gcugcgcagaugcggggcg

SEQ ID NO: 3492655 - RNA, 13 nt, Pseudomonas aeruginosa PA01
gcugcgcaggccg

SEQ ID NO: 3492656 - RNA, 15 nt, Pseudomonas aeruginosa PA01
gcugcgcagggcgcc

SEQ ID NO: 3492657 - RNA, 17 nt, Pseudomonas aeruginosa PA01
gcugcgcagggcgccgu

SEQ ID NO: 3492658 - RNA, 20 nt, Pseudomonas aeruginosa PA01
gcugcgcaggugcuugucac

SEQ ID NO: 3492659 - RNA, 16 nt, Pseudomonas aeruginosa PA01
gcugcgcagugucgcg

SEQ ID NO: 3492660 - RNA, 15 nt, Pseudomonas aeruginosa PA01
gcugcgcaucgccug

SEQ ID NO: 3492661 - RNA, 16 nt, Pseudomonas aeruginosa PA01
gcugcgcaucgccugg

SEQ ID NO: 3492662 - RNA, 17 nt, Pseudomonas aeruginosa PA01
gcugcgcaucgccuggg

SEQ ID NO: 3492663 - RNA, 18 nt, Pseudomonas aeruginosa PA01
gcugcgcaucgccugggc

SEQ ID NO: 3492664 - RNA, 13 nt, Pseudomonas aeruginosa PA01
gcugcgccaggcc

SEQ ID NO: 3492665 - RNA, 14 nt, Pseudomonas aeruginosa PA01
gcugcgccaggccg

SEQ ID NO: 3492666 - RNA, 13 nt, Pseudomonas aeruginosa PA01
gcugcgccaggcu

SEQ ID NO: 3492667 - RNA, 18 nt, Pseudomonas aeruginosa PA01
gcugcgcccgcucgaccc

SEQ ID NO: 3492668 - RNA, 12 nt, Pseudomonas aeruginosa PA01
gcugcgccgccg

SEQ ID NO: 3492669 - RNA, 13 nt, Pseudomonas aeruginosa PA01
gcugcgccgccgu

SEQ ID NO: 3492670 - RNA, 14 nt, Pseudomonas aeruginosa PA01
gcugcgccgccguc

SEQ ID NO: 3492671 - RNA, 12 nt, Pseudomonas aeruginosa PA01
gcugcgccgccu

SEQ ID NO: 3492672 - RNA, 13 nt, Pseudomonas aeruginosa PA01
gcugcgccgccuu

SEQ ID NO: 3492673 - RNA, 20 nt, Pseudomonas aeruginosa PA01
gcugcgccgcugcggcugca

SEQ ID NO: 3492674 - RNA, 19 nt, Pseudomonas aeruginosa PA01
gcugcgccguuucgacgau

SEQ ID NO: 3492675 - RNA, 23 nt, Pseudomonas aeruginosa PA01
gcugcgccguuucgacgaugcuc

SEQ ID NO: 3492676 - RNA, 15 nt, Pseudomonas aeruginosa PA01
gcugcgccugcagcu

SEQ ID NO: 3492677 - RNA, 13 nt, Pseudomonas aeruginosa PA01
gcugcgccuggcc

SEQ ID NO: 3492678 - RNA, 15 nt, Pseudomonas aeruginosa PA01
gcugcgccuggccgc

SEQ ID NO: 3492679 - RNA, 20 nt, Pseudomonas aeruginosa PA01
gcugcgccuggccgcgcagg

SEQ ID NO: 3492680 - RNA, 15 nt, Pseudomonas aeruginosa PA01
gcugcgcgcaccaua

SEQ ID NO: 3492681 - RNA, 17 nt, Pseudomonas aeruginosa PA01
gcugcgcgcaccauagc

SEQ ID NO: 3492682 - RNA, 14 nt, Pseudomonas aeruginosa PA01
gcugcgcgcggccc

SEQ ID NO: 3492683 - RNA, 18 nt, Pseudomonas aeruginosa PA01
gcugcgcgcggcccacca

SEQ ID NO: 3492684 - RNA, 12 nt, Pseudomonas aeruginosa PA01
gcugcgcggccu

SEQ ID NO: 3492685 - RNA, 22 nt, Pseudomonas aeruginosa PA01
gcugcgcggccugcgccggacc

SEQ ID NO: 3492686 - RNA, 13 nt, Pseudomonas aeruginosa PA01
gcugcgcggcguc

SEQ ID NO: 3492687 - RNA, 15 nt, Pseudomonas aeruginosa PA01
gcugcgcggcgucgg

SEQ ID NO: 3492688 - RNA, 16 nt, Pseudomonas aeruginosa PA01
gcugcgcgggucgucc

SEQ ID NO: 3492689 - RNA, 17 nt, Pseudomonas aeruginosa PA01
gcugcgcgggucguccu

SEQ ID NO: 3492690 - RNA, 13 nt, Pseudomonas aeruginosa PA01
gcugcgcgggucu

SEQ ID NO: 3492691 - RNA, 13 nt, Pseudomonas aeruginosa PA01
gcugcgcuccagg

SEQ ID NO: 3492692 - RNA, 14 nt, Pseudomonas aeruginosa PA01
gcugcgcucggcgc

SEQ ID NO: 3492693 - RNA, 16 nt, Pseudomonas aeruginosa PA01
gcugcgcucggcgcuc

SEQ ID NO: 3492694 - RNA, 17 nt, Pseudomonas aeruginosa PA01
gcugcgcucggcgcucg

SEQ ID NO: 3492695 - RNA, 12 nt, Pseudomonas aeruginosa PA01
gcugcgcugcca

SEQ ID NO: 3492696 - RNA, 14 nt, Pseudomonas aeruginosa PA01
gcugcgcugccagc

SEQ ID NO: 3492697 - RNA, 17 nt, Pseudomonas aeruginosa PA01
gcugcgcugccagcgcc

SEQ ID NO: 3492698 - RNA, 19 nt, Pseudomonas aeruginosa PA01
gcugcgcugccagcgccgc

SEQ ID NO: 3492699 - RNA, 18 nt, Pseudomonas aeruginosa PA01
gcugcgcugggcgccgau

SEQ ID NO: 3492700 - RNA, 14 nt, Pseudomonas aeruginosa PA01
gcugcgcuugcugc

SEQ ID NO: 3492701 - RNA, 20 nt, Pseudomonas aeruginosa PA01
gcugcgcuugcugccauggc

SEQ ID NO: 3492702 - RNA, 13 nt, Pseudomonas aeruginosa PA01
gcugcggaaaccg

SEQ ID NO: 3492703 - RNA, 18 nt, Pseudomonas aeruginosa PA01
gcugcggaugggcgacga

SEQ ID NO: 3492704 - RNA, 20 nt, Pseudomonas aeruginosa PA01
gcugcggaugggcgacgacg

SEQ ID NO: 3492705 - RNA, 14 nt, Pseudomonas aeruginosa PA01
gcugcggcaacgac

SEQ ID NO: 3492706 - RNA, 15 nt, Pseudomonas aeruginosa PA01
gcugcggcagggugg

SEQ ID NO: 3492707 - RNA, 13 nt, Pseudomonas aeruginosa PA01
gcugcggccgagc

SEQ ID NO: 3492708 - RNA, 14 nt, Pseudomonas aeruginosa PA01
gcugcggccgagca

SEQ ID NO: 3492709 - RNA, 15 nt, Pseudomonas aeruginosa PA01
gcugcggccggcgcg

SEQ ID NO: 3492710 - RNA, 18 nt, Pseudomonas aeruginosa PA01
gcugcggcggaaggcggc

SEQ ID NO: 3492711 - RNA, 12 nt, Pseudomonas aeruginosa PA01
gcugcggcggca

SEQ ID NO: 3492712 - RNA, 14 nt, Pseudomonas aeruginosa PA01
gcugcggcggcacc

SEQ ID NO: 3492713 - RNA, 15 nt, Pseudomonas aeruginosa PA01
gcugcggcggcacca

SEQ ID NO: 3492714 - RNA, 15 nt, Pseudomonas aeruginosa PA01
gcugcggcgguccca

SEQ ID NO: 3492715 - RNA, 22 nt, Pseudomonas aeruginosa PA01
gcugcggcggucccagaccagc

SEQ ID NO: 3492716 - RNA, 14 nt, Pseudomonas aeruginosa PA01
gcugcggcucgccg

SEQ ID NO: 3492717 - RNA, 15 nt, Pseudomonas aeruginosa PA01
gcugcggcucgccga

SEQ ID NO: 3492718 - RNA, 17 nt, Pseudomonas aeruginosa PA01
gcugcggcugcagggcc

SEQ ID NO: 3492719 - RNA, 15 nt, Pseudomonas aeruginosa PA01
gcugcggcuucgcgu

SEQ ID NO: 3492720 - RNA, 18 nt, Pseudomonas aeruginosa PA01
gcugcggcuucgcgugcc

SEQ ID NO: 3492721 - RNA, 13 nt, Pseudomonas aeruginosa PA01
gcugcgggcgccg

SEQ ID NO: 3492722 - RNA, 15 nt, Pseudomonas aeruginosa PA01
gcugcgggcgccgcc

SEQ ID NO: 3492723 - RNA, 16 nt, Pseudomonas aeruginosa PA01
gcugcgggcgccgccg

SEQ ID NO: 3492724 - RNA, 14 nt, Pseudomonas aeruginosa PA01
gcugcgggcgcugc

SEQ ID NO: 3492725 - RNA, 15 nt, Pseudomonas aeruginosa PA01
gcugcgggcgcugca

SEQ ID NO: 3492726 - RNA, 15 nt, Pseudomonas aeruginosa PA01
gcugcgggcguagcg

SEQ ID NO: 3492727 - RNA, 20 nt, Pseudomonas aeruginosa PA01
gcugcgggcguagcgcggca

SEQ ID NO: 3492728 - RNA, 13 nt, Pseudomonas aeruginosa PA01
gcugcggggccgg

SEQ ID NO: 3492729 - RNA, 18 nt, Pseudomonas aeruginosa PA01
gcugcggggccggacgcg

SEQ ID NO: 3492730 - RNA, 20 nt, Pseudomonas aeruginosa PA01
gcugcggggccggacgcgac

SEQ ID NO: 3492731 - RNA, 14 nt, Pseudomonas aeruginosa PA01
gcugcggggccugc

SEQ ID NO: 3492732 - RNA, 15 nt, Pseudomonas aeruginosa PA01
gcugcggggccugcu

SEQ ID NO: 3492733 - RNA, 17 nt, Pseudomonas aeruginosa PA01
gcugcggggugagcagu

SEQ ID NO: 3492734 - RNA, 18 nt, Pseudomonas aeruginosa PA01
gcgccagcgccccaccag

SEQ ID NO: 3492735 - RNA, 12 nt, Pseudomonas aeruginosa PA01
gcgccagcgccg

SEQ ID NO: 3492736 - RNA, 15 nt, Pseudomonas aeruginosa PA01
gcgccagcgccgcca

SEQ ID NO: 3492737 - RNA, 16 nt, Pseudomonas aeruginosa PA01
gcgccagcgccgccag

SEQ ID NO: 3492738 - RNA, 13 nt, Pseudomonas aeruginosa PA01
gcgccagcggcag

SEQ ID NO: 3492739 - RNA, 12 nt, Pseudomonas aeruginosa PA01
gcgccagcggcc

SEQ ID NO: 3492740 - RNA, 13 nt, Pseudomonas aeruginosa PA01
gcgccagcggccc

SEQ ID NO: 3492741 - RNA, 20 nt, Pseudomonas aeruginosa PA01
gcgccagcggcccggcaggc

SEQ ID NO: 3492742 - RNA, 23 nt, Pseudomonas aeruginosa PA01
gcgccagcggcccggcaggcgca

SEQ ID NO: 3492743 - RNA, 20 nt, Pseudomonas aeruginosa PA01
gcgccagcgguucaggucga

SEQ ID NO: 3492744 - RNA, 21 nt, Pseudomonas aeruginosa PA01
gcgccagcgguucaggucgag

SEQ ID NO: 3492745 - RNA, 17 nt, Pseudomonas aeruginosa PA01
gcgccagcuccagcgcc

SEQ ID NO: 3492746 - RNA, 22 nt, Pseudomonas aeruginosa PA01
gcgccagcuccagcgcccaggu

SEQ ID NO: 3492747 - RNA, 23 nt, Pseudomonas aeruginosa PA01
gcgccagcucggacaagggccag

SEQ ID NO: 3492748 - RNA, 18 nt, Pseudomonas aeruginosa PA01
gcgccaggaacgccucug

SEQ ID NO: 3492749 - RNA, 17 nt, Pseudomonas aeruginosa PA01
gcgccaggaagccgcgc

SEQ ID NO: 3492750 - RNA, 18 nt, Pseudomonas aeruginosa PA01
gcgccaggaagccgcgcc

SEQ ID NO: 3492751 - RNA, 21 nt, Pseudomonas aeruginosa PA01
gcgccaggaagccgcgcccca

SEQ ID NO: 3492752 - RNA, 24 nt, Pseudomonas aeruginosa PA01
gcgccaggaccauuugcgccucgu

SEQ ID NO: 3492753 - RNA, 17 nt, Pseudomonas aeruginosa PA01
gcgccaggacucgccau

SEQ ID NO: 3492754 - RNA, 22 nt, Pseudomonas aeruginosa PA01
gcgccaggacucgccaucggcc

SEQ ID NO: 3492755 - RNA, 23 nt, Pseudomonas aeruginosa PA01
gcgccaggacucgccaucggccu

SEQ ID NO: 3492756 - RNA, 16 nt, Pseudomonas aeruginosa PA01
gcgccaggagcagggc

SEQ ID NO: 3492757 - RNA, 18 nt, Pseudomonas aeruginosa PA01
gcgccaggagcagggcgc

SEQ ID NO: 3492758 - RNA, 17 nt, Pseudomonas aeruginosa PA01
gcgccaggcccacgccc

SEQ ID NO: 3492759 - RNA, 21 nt, Pseudomonas aeruginosa PA01
gcgccaggcccacgcccaucg

SEQ ID NO: 3492760 - RNA, 17 nt, Pseudomonas aeruginosa PA01
gcgccaggcccggcgcu

SEQ ID NO: 3492761 - RNA, 20 nt, Pseudomonas aeruginosa PA01
gcgccaggcccucggcgacc

SEQ ID NO: 3492762 - RNA, 21 nt, Pseudomonas aeruginosa PA01
gcgccaggcccucggcgacca

SEQ ID NO: 3492763 - RNA, 12 nt, Pseudomonas aeruginosa PA01
gcgccaggccga

SEQ ID NO: 3492764 - RNA, 22 nt, Pseudomonas aeruginosa PA01
gcgccaggccgaucagcgccuc

SEQ ID NO: 3492765 - RNA, 23 nt, Pseudomonas aeruginosa PA01
gcgccaggccgaucagcgccucg

SEQ ID NO: 3492766 - RNA, 13 nt, Pseudomonas aeruginosa PA01
gcgccaggccgcc

SEQ ID NO: 3492767 - RNA, 15 nt, Pseudomonas aeruginosa PA01
gcgccaggccgccga

SEQ ID NO: 3492768 - RNA, 22 nt, Pseudomonas aeruginosa PA01
gcgccaggccgccgaagaacuc

SEQ ID NO: 3492769 - RNA, 12 nt, Pseudomonas aeruginosa PA01
gcgccaggccgg

SEQ ID NO: 3492770 - RNA, 20 nt, Pseudomonas aeruginosa PA01
gcgccaggccggagccgcgu

SEQ ID NO: 3492771 - RNA, 13 nt, Pseudomonas aeruginosa PA01
gcgccaggccggc

SEQ ID NO: 3492772 - RNA, 12 nt, Pseudomonas aeruginosa PA01
gcgccaggccgu

SEQ ID NO: 3492773 - RNA, 12 nt, Pseudomonas aeruginosa PA01
gcgccaggcgca

SEQ ID NO: 3492774 - RNA, 14 nt, Pseudomonas aeruginosa PA01
gcgccaggcgcaag

SEQ ID NO: 3492775 - RNA, 13 nt, Pseudomonas aeruginosa PA01
gcgccaggcgcag

SEQ ID NO: 3492776 - RNA, 13 nt, Pseudomonas aeruginosa PA01
gcgccaggcgcgg

SEQ ID NO: 3492777 - RNA, 19 nt, Pseudomonas aeruginosa PA01
gcgccaggcggaacggcuc

SEQ ID NO: 3492778 - RNA, 19 nt, Pseudomonas aeruginosa PA01
gcgccaggcgugcagaccg

SEQ ID NO: 3492779 - RNA, 14 nt, Pseudomonas aeruginosa PA01
gcgccaggcguucc

SEQ ID NO: 3492780 - RNA, 22 nt, Pseudomonas aeruginosa PA01
gcgccaggcguuccagcucggc

SEQ ID NO: 3492781 - RNA, 10 nt, Pseudomonas aeruginosa PA01
gcgccaggcu

SEQ ID NO: 3492782 - RNA, 22 nt, Pseudomonas aeruginosa PA01
gcgccaggcuuuccgccgagcg

SEQ ID NO: 3492783 - RNA, 12 nt, Pseudomonas aeruginosa PA01
gcgccagggacg

SEQ ID NO: 3492784 - RNA, 14 nt, Pseudomonas aeruginosa PA01
gcgccagggacgcg

SEQ ID NO: 3492785 - RNA, 16 nt, Pseudomonas aeruginosa PA01
gcgccagggacgcgca

SEQ ID NO: 3492786 - RNA, 12 nt, Pseudomonas aeruginosa PA01
gcgccagggcau

SEQ ID NO: 3492787 - RNA, 17 nt, Pseudomonas aeruginosa PA01
gcgccagggccagggaa

SEQ ID NO: 3492788 - RNA, 21 nt, Pseudomonas aeruginosa PA01
gcgccagggccagggaaauca

SEQ ID NO: 3492789 - RNA, 16 nt, Pseudomonas aeruginosa PA01
gcgccagggccggguc

SEQ ID NO: 3492790 - RNA, 20 nt, Pseudomonas aeruginosa PA01
gcgccagggccgggucauca

SEQ ID NO: 3492791 - RNA, 23 nt, Pseudomonas aeruginosa PA01
gcgccagggccgggucaucaccg

SEQ ID NO: 3492792 - RNA, 18 nt, Pseudomonas aeruginosa PA01
gcgccagggguaggagga

SEQ ID NO: 3492793 - RNA, 20 nt, Pseudomonas aeruginosa PA01
gcgccagguaguccagcggu

SEQ ID NO: 3492794 - RNA, 22 nt, Pseudomonas aeruginosa PA01
gcgccagguaguccagcgguac

SEQ ID NO: 3492795 - RNA, 20 nt, Pseudomonas aeruginosa PA01
gcgccagguagugccgcccu

SEQ ID NO: 3492796 - RNA, 22 nt, Pseudomonas aeruginosa PA01
gcgccagguagugccgcccuug

SEQ ID NO: 3492797 - RNA, 22 nt, Pseudomonas aeruginosa PA01
gcgccaggugcaggaagcgccg

SEQ ID NO: 3492798 - RNA, 12 nt, Pseudomonas aeruginosa PA01
gcgccaggugcg

SEQ ID NO: 3492799 - RNA, 18 nt, Pseudomonas aeruginosa PA01
gcgccagguuggccuggc

SEQ ID NO: 3492800 - RNA, 20 nt, Pseudomonas aeruginosa PA01
gcgccagguuggccuggccc

SEQ ID NO: 3492801 - RNA, 21 nt, Pseudomonas aeruginosa PA01
gcgccagguuggccuggcccg

SEQ ID NO: 3492802 - RNA, 23 nt, Pseudomonas aeruginosa PA01
gcgccagguuggccuggcccggc

SEQ ID NO: 3492803 - RNA, 17 nt, Pseudomonas aeruginosa PA01
gcgccaguacuccgagg

SEQ ID NO: 3492804 - RNA, 21 nt, Pseudomonas aeruginosa PA01
gcgccaguacuccgagggccg

SEQ ID NO: 3492805 - RNA, 13 nt, Pseudomonas aeruginosa PA01
gcgccaguccacg

SEQ ID NO: 3492806 - RNA, 19 nt, Pseudomonas aeruginosa PA01
gcgccaguccacgacgaac

SEQ ID NO: 3492807 - RNA, 12 nt, Pseudomonas aeruginosa PA01
gcgccagucccg

SEQ ID NO: 3492808 - RNA, 23 nt, Pseudomonas aeruginosa PA01
gcgccagucccgcaaagcccgcu

SEQ ID NO: 3492809 - RNA, 15 nt, Pseudomonas aeruginosa PA01
gcgccagugccugca

SEQ ID NO: 3492810 - RNA, 17 nt, Pseudomonas aeruginosa PA01
gcgccagugccugcacc

SEQ ID NO: 3492811 - RNA, 20 nt, Pseudomonas aeruginosa PA01
gcgccaguuccuucgccgaa

SEQ ID NO: 3492812 - RNA, 21 nt, Pseudomonas aeruginosa PA01
gcgccaguucgccggugacgc

SEQ ID NO: 3492813 - RNA, 15 nt, Pseudomonas aeruginosa PA01
gcgccaguuggacgc

SEQ ID NO: 3492814 - RNA, 16 nt, Pseudomonas aeruginosa PA01
gcgccaguuggacgcg

SEQ ID NO: 3492815 - RNA, 18 nt, Pseudomonas aeruginosa PA01
gcgccaguuggacgcggc

SEQ ID NO: 3492816 - RNA, 22 nt, Pseudomonas aeruginosa PA01
gcgccaguuggacgcggccugg

SEQ ID NO: 3492817 - RNA, 23 nt, Pseudomonas aeruginosa PA01
gcgccaguuggacgcggccuggg

SEQ ID NO: 3492818 - RNA, 21 nt, Pseudomonas aeruginosa PA01
gcgccauaccggcaaggcggc

SEQ ID NO: 3492819 - RNA, 24 nt, Pseudomonas aeruginosa PA01
gcgccauaccggcaaggcggccuc

SEQ ID NO: 3492820 - RNA, 19 nt, Pseudomonas aeruginosa PA01
gcgccauaggccagcaccu

SEQ ID NO: 3492821 - RNA, 14 nt, Pseudomonas aeruginosa PA01
gcgccauagggcac

SEQ ID NO: 3492822 - RNA, 13 nt, Pseudomonas aeruginosa PA01
gcgccaucagcga

SEQ ID NO: 3492823 - RNA, 15 nt, Pseudomonas aeruginosa PA01
gcgccaucagcgacc

SEQ ID NO: 3492824 - RNA, 14 nt, Pseudomonas aeruginosa PA01
gcgccaucaggccc

SEQ ID NO: 3492825 - RNA, 17 nt, Pseudomonas aeruginosa PA01
gcgccaucaggcccuug

SEQ ID NO: 3492826 - RNA, 15 nt, Pseudomonas aeruginosa PA01
gcgccauccuccagc

SEQ ID NO: 3492827 - RNA, 17 nt, Pseudomonas aeruginosa PA01
gcgccauccuccagcgc

SEQ ID NO: 3492828 - RNA, 18 nt, Pseudomonas aeruginosa PA01
gcgccauccuccagcgcc

SEQ ID NO: 3492829 - RNA, 23 nt, Pseudomonas aeruginosa PA01
gcgccauccuccagcgccgcauu

SEQ ID NO: 3492830 - RNA, 21 nt, Pseudomonas aeruginosa PA01
gcgccaucgcuuuccuggccg

SEQ ID NO: 3492831 - RNA, 22 nt, Pseudomonas aeruginosa PA01
gcgccaucgcuuuccuggccga

SEQ ID NO: 3492832 - RNA, 15 nt, Pseudomonas aeruginosa PA01
gcgccaucuccucgc

SEQ ID NO: 3492833 - RNA, 17 nt, Pseudomonas aeruginosa PA01
gcgccaucuccucgcug

SEQ ID NO: 3492834 - RNA, 19 nt, Pseudomonas aeruginosa PA01
gcgccaucuccucgcugau

SEQ ID NO: 3492835 - RNA, 20 nt, Pseudomonas aeruginosa PA01
gcgccaugcaagaacgccga

SEQ ID NO: 3492836 - RNA, 22 nt, Pseudomonas aeruginosa PA01
gcgccaugcaagaacgccgacc

SEQ ID NO: 3492837 - RNA, 23 nt, Pseudomonas aeruginosa PA01
gcgccaugcaagaacgccgaccc

SEQ ID NO: 3492838 - RNA, 16 nt, Pseudomonas aeruginosa PA01
gcgccaugccggcgcc

SEQ ID NO: 3492839 - RNA, 17 nt, Pseudomonas aeruginosa PA01
gcgccaugccggcgccg

SEQ ID NO: 3492840 - RNA, 18 nt, Pseudomonas aeruginosa PA01
gcgccaugccggcgccga

SEQ ID NO: 3492841 - RNA, 19 nt, Pseudomonas aeruginosa PA01
gcgccaugccggcgccgau

SEQ ID NO: 3492842 - RNA, 15 nt, Pseudomonas aeruginosa PA01
gcgccaugccguuca

SEQ ID NO: 3492843 - RNA, 20 nt, Pseudomonas aeruginosa PA01
gcgccaugccguucaggccg

SEQ ID NO: 3492844 - RNA, 21 nt, Pseudomonas aeruginosa PA01
gcgccaugccguucaggccgg

SEQ ID NO: 3492845 - RNA, 23 nt, Pseudomonas aeruginosa PA01
gcgccaugccguucaggccggcg

SEQ ID NO: 3492846 - RNA, 16 nt, Pseudomonas aeruginosa PA01
gcgccaugcgcccgcu

SEQ ID NO: 3492847 - RNA, 20 nt, Pseudomonas aeruginosa PA01
gcgccaugcuguugccgugg

SEQ ID NO: 3492848 - RNA, 12 nt, Pseudomonas aeruginosa PA01
gcgccauggccg

SEQ ID NO: 3492849 - RNA, 19 nt, Pseudomonas aeruginosa PA01
gcgccauggcgguuccucc

SEQ ID NO: 3492850 - RNA, 18 nt, Pseudomonas aeruginosa PA01
gcgccauggggaucaccg

SEQ ID NO: 3492851 - RNA, 16 nt, Pseudomonas aeruginosa PA01
gcgccauugccgccag

SEQ ID NO: 3492852 - RNA, 20 nt, Pseudomonas aeruginosa PA01
gcgccauugugcgcgcgcag

SEQ ID NO: 3492853 - RNA, 18 nt, Pseudomonas aeruginosa PA01
gcgcccaacgucuucagg

SEQ ID NO: 3492854 - RNA, 22 nt, Pseudomonas aeruginosa PA01
gcgcccaacgucuucaggcgcu

SEQ ID NO: 3492855 - RNA, 18 nt, Pseudomonas aeruginosa PA01
gcgcccaaugcaucggcc

SEQ ID NO: 3492856 - RNA, 19 nt, Pseudomonas aeruginosa PA01
gcgcccaaugcaucggccg

SEQ ID NO: 3492857 - RNA, 20 nt, Pseudomonas aeruginosa PA01
gcgcccaaugcaucggccgg

SEQ ID NO: 3492858 - RNA, 20 nt, Pseudomonas aeruginosa PA01
gcgcccacaaccugccgauc

SEQ ID NO: 3492859 - RNA, 14 nt, Pseudomonas aeruginosa PA01
gcgcccagaaaaaa

SEQ ID NO: 3492860 - RNA, 17 nt, Pseudomonas aeruginosa PA01
gcgcccagacacgccuc

SEQ ID NO: 3492861 - RNA, 18 nt, Pseudomonas aeruginosa PA01
gcgcccagcaccacagca

SEQ ID NO: 3492862 - RNA, 13 nt, Pseudomonas aeruginosa PA01
gcgcccagcagca

SEQ ID NO: 3492863 - RNA, 16 nt, Pseudomonas aeruginosa PA01
gcgcccagcagcaggc

SEQ ID NO: 3492864 - RNA, 20 nt, Pseudomonas aeruginosa PA01
gcgcccagcagcaggccggc

SEQ ID NO: 3492865 - RNA, 12 nt, Pseudomonas aeruginosa PA01
gcgcccaggcag

SEQ ID NO: 3492866 - RNA, 14 nt, Pseudomonas aeruginosa PA01
gcgcccaggcagca

SEQ ID NO: 3492867 - RNA, 21 nt, Pseudomonas aeruginosa PA01
gcgcccaggcagcagagcgcc

SEQ ID NO: 3492868 - RNA, 15 nt, Pseudomonas aeruginosa PA01
gcgcccaggcaggcg

SEQ ID NO: 3492869 - RNA, 16 nt, Pseudomonas aeruginosa PA01
gcgcccaggcaggcga

SEQ ID NO: 3492870 - RNA, 12 nt, Pseudomonas aeruginosa PA01
gcgcccaggccc

SEQ ID NO: 3492871 - RNA, 20 nt, Pseudomonas aeruginosa PA01
gcgcccaggcccagcgcggc

SEQ ID NO: 3492872 - RNA, 22 nt, Pseudomonas aeruginosa PA01
gcgcccaggccgggucgcagcc

SEQ ID NO: 3492873 - RNA, 13 nt, Pseudomonas aeruginosa PA01
gcgcccaggcgca

SEQ ID NO: 3492874 - RNA, 17 nt, Pseudomonas aeruginosa PA01
gcgcccaggcgcaccuc

SEQ ID NO: 3492875 - RNA, 15 nt, Pseudomonas aeruginosa PA01
gcgcccaggcugccg

SEQ ID NO: 3492876 - RNA, 17 nt, Pseudomonas aeruginosa PA01
gcgcccaggcugccggc

SEQ ID NO: 3492877 - RNA, 22 nt, Pseudomonas aeruginosa PA01
gcgcccaggcugccggccaggu

SEQ ID NO: 3492878 - RNA, 16 nt, Pseudomonas aeruginosa PA01
gcgcccagggacgcgc

SEQ ID NO: 3492879 - RNA, 21 nt, Pseudomonas aeruginosa PA01
gcgcccagggacgcgccggcg

SEQ ID NO: 3492880 - RNA, 14 nt, Pseudomonas aeruginosa PA01
gcgcccagguccgg

SEQ ID NO: 3492881 - RNA, 18 nt, Pseudomonas aeruginosa PA01
gcgcccagugcccggcag

SEQ ID NO: 3492882 - RNA, 15 nt, Pseudomonas aeruginosa PA01
gcgcccaugccgccc

SEQ ID NO: 3492883 - RNA, 18 nt, Pseudomonas aeruginosa PA01
gcgcccaugccgcccggc

SEQ ID NO: 3492884 - RNA, 14 nt, Pseudomonas aeruginosa PA01
gcgccccaccaggc

SEQ ID NO: 3492885 - RNA, 16 nt, Pseudomonas aeruginosa PA01
gcgccccaccaggcuc

SEQ ID NO: 3492886 - RNA, 15 nt, Pseudomonas aeruginosa PA01
gcgccccacggcgcg

SEQ ID NO: 3492887 - RNA, 16 nt, Pseudomonas aeruginosa PA01
gcgccccagaucgcca

SEQ ID NO: 3492888 - RNA, 21 nt, Pseudomonas aeruginosa PA01
gcgccccagaucgccagcgcc

SEQ ID NO: 3492889 - RNA, 22 nt, Pseudomonas aeruginosa PA01
gcgccccagaucgccagcgcca

SEQ ID NO: 3492890 - RNA, 23 nt, Pseudomonas aeruginosa PA01
gcgccccagaucgccagcgccag

SEQ ID NO: 3492891 - RNA, 12 nt, Pseudomonas aeruginosa PA01
gcgccccagcac

SEQ ID NO: 3492892 - RNA, 13 nt, Pseudomonas aeruginosa PA01
gcgccccagcggc

SEQ ID NO: 3492893 - RNA, 19 nt, Pseudomonas aeruginosa PA01
gcgccccagcggcaggcac

SEQ ID NO: 3492894 - RNA, 15 nt, Pseudomonas aeruginosa PA01
gcgccccaggcgccc

SEQ ID NO: 3492895 - RNA, 18 nt, Pseudomonas aeruginosa PA01
gcgccccaggcgcccagg

SEQ ID NO: 3492896 - RNA, 19 nt, Pseudomonas aeruginosa PA01
gcgccccaggcgcccaggc

SEQ ID NO: 3492897 - RNA, 21 nt, Pseudomonas aeruginosa PA01
gcgccccaggcgcccaggcag

SEQ ID NO: 3492898 - RNA, 15 nt, Pseudomonas aeruginosa PA01
gcgccccaggcgggc

SEQ ID NO: 3492899 - RNA, 19 nt, Pseudomonas aeruginosa PA01
gcgccccaggcgggcacgu

SEQ ID NO: 3492900 - RNA, 14 nt, Pseudomonas aeruginosa PA01
gcgccccaggugca

SEQ ID NO: 3492901 - RNA, 17 nt, Pseudomonas aeruginosa PA01
gcgccccaggugcagcg

SEQ ID NO: 3492902 - RNA, 13 nt, Pseudomonas aeruginosa PA01
gcgcccccagcgc

SEQ ID NO: 3492903 - RNA, 14 nt, Pseudomonas aeruginosa PA01
gcgcccccagcgcc

SEQ ID NO: 3492904 - RNA, 18 nt, Pseudomonas aeruginosa PA01
gcgcccccagcgcccgca

SEQ ID NO: 3492905 - RNA, 21 nt, Pseudomonas aeruginosa PA01
gcgcccccagcgcccgcacca

SEQ ID NO: 3492906 - RNA, 18 nt, Pseudomonas aeruginosa PA01
gcgcccccaucugcacgu

SEQ ID NO: 3492907 - RNA, 14 nt, Pseudomonas aeruginosa PA01
gcgcccccuggccg

SEQ ID NO: 3492908 - RNA, 15 nt, Pseudomonas aeruginosa PA01
gcgcccccuggccgu

SEQ ID NO: 3492909 - RNA, 14 nt, Pseudomonas aeruginosa PA01
gcgccccgccuacc

SEQ ID NO: 3492910 - RNA, 20 nt, Pseudomonas aeruginosa PA01
gcgccccgccuaccggggcg

SEQ ID NO: 3492911 - RNA, 22 nt, Pseudomonas aeruginosa PA01
gcgccccgccuaccggggcgcg

SEQ ID NO: 3492912 - RNA, 12 nt, Pseudomonas aeruginosa PA01
gcgccccggccc

SEQ ID NO: 3492913 - RNA, 14 nt, Pseudomonas aeruginosa PA01
gcgccccggcccag

SEQ ID NO: 3492914 - RNA, 15 nt, Pseudomonas aeruginosa PA01
gcgccccggcccagc

SEQ ID NO: 3492915 - RNA, 17 nt, Pseudomonas aeruginosa PA01
gcgccccggcccagccg

SEQ ID NO: 3492916 - RNA, 13 nt, Pseudomonas aeruginosa PA01
gcgccccggccgc

SEQ ID NO: 3492917 - RNA, 14 nt, Pseudomonas aeruginosa PA01
gcgccccggccgcg

SEQ ID NO: 3492918 - RNA, 14 nt, Pseudomonas aeruginosa PA01
gcgccccgggucgg

SEQ ID NO: 3492919 - RNA, 18 nt, Pseudomonas aeruginosa PA01
gcgccccggucucgcgca

SEQ ID NO: 3492920 - RNA, 22 nt, Pseudomonas aeruginosa PA01
gcgccccgucccuaccagcgca

SEQ ID NO: 3492921 - RNA, 14 nt, Pseudomonas aeruginosa PA01
gcgccccugcgccc

SEQ ID NO: 3492922 - RNA, 18 nt, Pseudomonas aeruginosa PA01
gcgccccugcgcccaggg

SEQ ID NO: 3492923 - RNA, 17 nt, Pseudomonas aeruginosa PA01
gcgccccugcggcgccg

SEQ ID NO: 3492924 - RNA, 18 nt, Pseudomonas aeruginosa PA01
gcgccccuuggccagcac

SEQ ID NO: 3492925 - RNA, 12 nt, Pseudomonas aeruginosa PA01
gcgcccgacggc

SEQ ID NO: 3492926 - RNA, 20 nt, Pseudomonas aeruginosa PA01
gcgcccgauaggcgccggcg

SEQ ID NO: 3492927 - RNA, 22 nt, Pseudomonas aeruginosa PA01
gcgcccgauaggcgccggcgcg

SEQ ID NO: 3492928 - RNA, 18 nt, Pseudomonas aeruginosa PA01
gcgcccgauugggcgcgu

SEQ ID NO: 3492929 - RNA, 19 nt, Pseudomonas aeruginosa PA01
gcgcccgccaaggcccugc

SEQ ID NO: 3492930 - RNA, 21 nt, Pseudomonas aeruginosa PA01
gcgcccgccaaggcccugcug

SEQ ID NO: 3492931 - RNA, 19 nt, Pseudomonas aeruginosa PA01
gcgcccgccaagggcgccg

SEQ ID NO: 3492932 - RNA, 13 nt, Pseudomonas aeruginosa PA01
gcgcccgccaggu

SEQ ID NO: 3492933 - RNA, 20 nt, Pseudomonas aeruginosa PA01
gcgcccgcccggcaccaccg

SEQ ID NO: 3492934 - RNA, 18 nt, Pseudomonas aeruginosa PA01
gcgcccgccgcgagcgcc

SEQ ID NO: 3492935 - RNA, 20 nt, Pseudomonas aeruginosa PA01
gcgcccgccgcgagcgccgc

SEQ ID NO: 3492936 - RNA, 12 nt, Pseudomonas aeruginosa PA01
gcgcccgccggc

SEQ ID NO: 3492937 - RNA, 22 nt, Pseudomonas aeruginosa PA01
gcgcccgccgucauggcgggcg

SEQ ID NO: 3492938 - RNA, 16 nt, Pseudomonas aeruginosa PA01
gcgcccgccuggaagg

SEQ ID NO: 3492939 - RNA, 22 nt, Pseudomonas aeruginosa PA01
gcgcccgccuuguucgccagca

SEQ ID NO: 3492940 - RNA, 18 nt, Pseudomonas aeruginosa PA01
gcgcccgcucgacccggu

SEQ ID NO: 3492941 - RNA, 20 nt, Pseudomonas aeruginosa PA01
gcgcccggaaaaaaaagccc

SEQ ID NO: 3492942 - RNA, 23 nt, Pseudomonas aeruginosa PA01
gcgcccggagcuuugcagggcga

SEQ ID NO: 3492943 - RNA, 21 nt, Pseudomonas aeruginosa PA01
gcgcccggcaaucaggcgcga

SEQ ID NO: 3492944 - RNA, 12 nt, Pseudomonas aeruginosa PA01
gcgcccggccag

SEQ ID NO: 3492945 - RNA, 15 nt, Pseudomonas aeruginosa PA01
gcgcccggccaggcc

SEQ ID NO: 3492946 - RNA, 18 nt, Pseudomonas aeruginosa PA01
gcgcccggccaggccgcc

SEQ ID NO: 3492947 - RNA, 19 nt, Pseudomonas aeruginosa PA01
gcgcccggccaggccgccc

SEQ ID NO: 3492948 - RNA, 22 nt, Pseudomonas aeruginosa PA01
gcgcccggccaggccgcccagg

SEQ ID NO: 3492949 - RNA, 14 nt, Pseudomonas aeruginosa PA01
gcgcccggccuccc

SEQ ID NO: 3492950 - RNA, 12 nt, Pseudomonas aeruginosa PA01
gcgcccggccuu

SEQ ID NO: 3492951 - RNA, 23 nt, Pseudomonas aeruginosa PA01
gcgcccggccuucaccgcgccgc

SEQ ID NO: 3492952 - RNA, 20 nt, Pseudomonas aeruginosa PA01
gcgcccggcgaacagcgcuu

SEQ ID NO: 3492953 - RNA, 13 nt, Pseudomonas aeruginosa PA01
gcgcccggcgcag

SEQ ID NO: 3492954 - RNA, 15 nt, Pseudomonas aeruginosa PA01
gcgcccggcgccacc

SEQ ID NO: 3492955 - RNA, 16 nt, Pseudomonas aeruginosa PA01
gcgcccggcgccaccc

SEQ ID NO: 3492956 - RNA, 14 nt, Pseudomonas aeruginosa PA01
gcgcccggcgccag

SEQ ID NO: 3492957 - RNA, 16 nt, Pseudomonas aeruginosa PA01
gcgcccggcgccaggc

SEQ ID NO: 3492958 - RNA, 17 nt, Pseudomonas aeruginosa PA01
gcgcccggcgccaggcu

SEQ ID NO: 3492959 - RNA, 13 nt, Pseudomonas aeruginosa PA01
gcgcccggcgccc

SEQ ID NO: 3492960 - RNA, 14 nt, Pseudomonas aeruginosa PA01
gcgcccggcgcccu

SEQ ID NO: 3492961 - RNA, 13 nt, Pseudomonas aeruginosa PA01
gcgcccggcgcga

SEQ ID NO: 3492962 - RNA, 12 nt, Pseudomonas aeruginosa PA01
gcgcccggcugg

SEQ ID NO: 3492963 - RNA, 13 nt, Pseudomonas aeruginosa PA01
gcgcccggcuggc

SEQ ID NO: 3492964 - RNA, 15 nt, Pseudomonas aeruginosa PA01
gcgcccggcuggcca

SEQ ID NO: 3492965 - RNA, 18 nt, Pseudomonas aeruginosa PA01
gcgcccggcuucggcggc

SEQ ID NO: 3492966 - RNA, 12 nt, Pseudomonas aeruginosa PA01
gcgcccggucag

SEQ ID NO: 3492967 - RNA, 16 nt, Pseudomonas aeruginosa PA01
gcgcccguagcacaug

SEQ ID NO: 3492968 - RNA, 13 nt, Pseudomonas aeruginosa PA01
gcgcccguccucc

SEQ ID NO: 3492969 - RNA, 18 nt, Pseudomonas aeruginosa PA01
gcgcccgucgucguggcg

SEQ ID NO: 3492970 - RNA, 21 nt, Pseudomonas aeruginosa PA01
gcgcccgugggguauuccagg

SEQ ID NO: 3492971 - RNA, 16 nt, Pseudomonas aeruginosa PA01
gcgcccguucgaucaa

SEQ ID NO: 3492972 - RNA, 19 nt, Pseudomonas aeruginosa PA01
gcgcccuagucgaggggaa

SEQ ID NO: 3492973 - RNA, 21 nt, Pseudomonas aeruginosa PA01
gcgcccuagucgaggggaacc

SEQ ID NO: 3492974 - RNA, 22 nt, Pseudomonas aeruginosa PA01
gcgcccuagucgaggggaaccg

SEQ ID NO: 3492975 - RNA, 20 nt, Pseudomonas aeruginosa PA01
gcgcccucaagucuccagcg

SEQ ID NO: 3492976 - RNA, 14 nt, Pseudomonas aeruginosa PA01
gcgcccucgcugag

SEQ ID NO: 3492977 - RNA, 21 nt, Pseudomonas aeruginosa PA01
gcgcccucggugauaccgccg

SEQ ID NO: 3492978 - RNA, 14 nt, Pseudomonas aeruginosa PA01
gcgcccucugccgg

SEQ ID NO: 3492979 - RNA, 18 nt, Pseudomonas aeruginosa PA01
gcgcccugcaggccgaau

SEQ ID NO: 3492980 - RNA, 15 nt, Pseudomonas aeruginosa PA01
gcgcccuggccgucg

SEQ ID NO: 3492981 - RNA, 18 nt, Pseudomonas aeruginosa PA01
gcgcccuggccgucggcc

SEQ ID NO: 3492982 - RNA, 21 nt, Pseudomonas aeruginosa PA01
gcgcccuggccgucggccugc

SEQ ID NO: 3492983 - RNA, 10 nt, Pseudomonas aeruginosa PA01
gcgcccuggg

SEQ ID NO: 3492984 - RNA, 14 nt, Pseudomonas aeruginosa PA01
gcgcccugggcgcg

SEQ ID NO: 3492985 - RNA, 19 nt, Pseudomonas aeruginosa PA01
gcgcccuucagcgccucga

SEQ ID NO: 3492986 - RNA, 21 nt, Pseudomonas aeruginosa PA01
gcgcccuucgguuucgcgcca

SEQ ID NO: 3492987 - RNA, 24 nt, Pseudomonas aeruginosa PA01
gcgcccuucgguuucgcgccaugg

SEQ ID NO: 3492988 - RNA, 20 nt, Pseudomonas aeruginosa PA01
gcgcccuuguacucgauggu

SEQ ID NO: 3492989 - RNA, 21 nt, Pseudomonas aeruginosa PA01
gcgccgaaaaaaaggggcccg

SEQ ID NO: 3492990 - RNA, 12 nt, Pseudomonas aeruginosa PA01
gcgccgaaggcc

SEQ ID NO: 3492991 - RNA, 14 nt, Pseudomonas aeruginosa PA01
gcgccgaaggccag

SEQ ID NO: 3492992 - RNA, 22 nt, Pseudomonas aeruginosa PA01
gcgccgaaggcgauauggccga

SEQ ID NO: 3492993 - RNA, 22 nt, Pseudomonas aeruginosa PA01
gcgccgaaggcgucaguuccgc

SEQ ID NO: 3492994 - RNA, 18 nt, Pseudomonas aeruginosa PA01
gcgccgaauccaggccga

SEQ ID NO: 3492995 - RNA, 19 nt, Pseudomonas aeruginosa PA01
gcgccgacagcacgauggc

SEQ ID NO: 3492996 - RNA, 23 nt, Pseudomonas aeruginosa PA01
gcgccgacagcacgauggcgagg

SEQ ID NO: 3492997 - RNA, 22 nt, Pseudomonas aeruginosa PA01
gcgccgacaggcaucgcucgca

SEQ ID NO: 3492998 - RNA, 13 nt, Pseudomonas aeruginosa PA01
gcgccgaccacga

SEQ ID NO: 3492999 - RNA, 15 nt, Pseudomonas aeruginosa PA01
gcgccgaccagccgc

SEQ ID NO: 3493000 - RNA, 19 nt, Pseudomonas aeruginosa PA01
gcgccgaccagccgcaggc

SEQ ID NO: 3493001 - RNA, 20 nt, Pseudomonas aeruginosa PA01
gcgccgaccagccgcaggcu

SEQ ID NO: 3493002 - RNA, 21 nt, Pseudomonas aeruginosa PA01
gcgccgaccagccgcaggcug

SEQ ID NO: 3493003 - RNA, 19 nt, Pseudomonas aeruginosa PA01
gcgccgacccagagcgcgc

SEQ ID NO: 3493004 - RNA, 21 nt, Pseudomonas aeruginosa PA01
gcgccgacccagagcgcgccc

SEQ ID NO: 3493005 - RNA, 22 nt, Pseudomonas aeruginosa PA01
gcgccgacccagagcgcgcccu

SEQ ID NO: 3493006 - RNA, 19 nt, Pseudomonas aeruginosa PA01
gcgccgaccgcaccgccag

SEQ ID NO: 3493007 - RNA, 20 nt, Pseudomonas aeruginosa PA01
gcgccgaccgcaccgccagc

SEQ ID NO: 3493008 - RNA, 20 nt, Pseudomonas aeruginosa PA01
gcgccgaccgcgcgccugca

SEQ ID NO: 3493009 - RNA, 15 nt, Pseudomonas aeruginosa PA01
gcgccgacgccacca

SEQ ID NO: 3493010 - RNA, 18 nt, Pseudomonas aeruginosa PA01
gcgccgacgccaccagcc

SEQ ID NO: 3493011 - RNA, 19 nt, Pseudomonas aeruginosa PA01
gcgccgacgccaccagcca

SEQ ID NO: 3493012 - RNA, 22 nt, Pseudomonas aeruginosa PA01
gcgccgacgccaccagccaggc

SEQ ID NO: 3493013 - RNA, 18 nt, Pseudomonas aeruginosa PA01
gcgccgagacgaucagca

SEQ ID NO: 3493014 - RNA, 14 nt, Pseudomonas aeruginosa PA01
gcgccgagauagcg

SEQ ID NO: 3493015 - RNA, 22 nt, Pseudomonas aeruginosa PA01
gcgccgagcccccggcgcccag

SEQ ID NO: 3493016 - RNA, 15 nt, Pseudomonas aeruginosa PA01
gcgccgagccggcug

SEQ ID NO: 3493017 - RNA, 16 nt, Pseudomonas aeruginosa PA01
gcgccgagccggcugc

SEQ ID NO: 3493018 - RNA, 22 nt, Pseudomonas aeruginosa PA01
gcgccgagccggcugccgaaga

SEQ ID NO: 3493019 - RNA, 13 nt, Pseudomonas aeruginosa PA01
gcgccgagcgcuc

SEQ ID NO: 3493020 - RNA, 16 nt, Pseudomonas aeruginosa PA01
gcgccgagcuggcgcg

SEQ ID NO: 3493021 - RNA, 17 nt, Pseudomonas aeruginosa PA01
gcgccgagcuggcgcgc

SEQ ID NO: 3493022 - RNA, 20 nt, Pseudomonas aeruginosa PA01
gcgccgagggguacagggca

SEQ ID NO: 3493023 - RNA, 11 nt, Pseudomonas aeruginosa PA01
gcgccgaggua

SEQ ID NO: 3493024 - RNA, 19 nt, Pseudomonas aeruginosa PA01
gcgccgaggucuuggccag

SEQ ID NO: 3493025 - RNA, 20 nt, Pseudomonas aeruginosa PA01
gcgccgaggucuuggccagc

SEQ ID NO: 3493026 - RNA, 22 nt, Pseudomonas aeruginosa PA01
gcgccgaggucuuggccagccg

SEQ ID NO: 3493027 - RNA, 23 nt, Pseudomonas aeruginosa PA01
gcgccgaggucuuggccagccgc

SEQ ID NO: 3493028 - RNA, 17 nt, Pseudomonas aeruginosa PA01
gcgccgaguucgccgcg

SEQ ID NO: 3493029 - RNA, 18 nt, Pseudomonas aeruginosa PA01
gcgccgaguucgccgcga

SEQ ID NO: 3493030 - RNA, 22 nt, Pseudomonas aeruginosa PA01
gcgccgaucaaugcguuccugu

SEQ ID NO: 3493031 - RNA, 22 nt, Pseudomonas aeruginosa PA01
gcgccgauccaggcguggggcg

SEQ ID NO: 3493032 - RNA, 17 nt, Pseudomonas aeruginosa PA01
gcgccgaugcccaggcc

SEQ ID NO: 3493033 - RNA, 14 nt, Pseudomonas aeruginosa PA01
gcgccgaugccggc

SEQ ID NO: 3493034 - RNA, 19 nt, Pseudomonas aeruginosa PA01
gcgccgaugccggccggca

SEQ ID NO: 3493035 - RNA, 14 nt, Pseudomonas aeruginosa PA01
gcgccgaugcugua

SEQ ID NO: 3493036 - RNA, 18 nt, Pseudomonas aeruginosa PA01
gcgccgauguacggcacc

SEQ ID NO: 3493037 - RNA, 17 nt, Pseudomonas aeruginosa PA01
gcgccgauuccugggcg

SEQ ID NO: 3493038 - RNA, 22 nt, Pseudomonas aeruginosa PA01
gcgccgcaacgaaaaagggcgg

SEQ ID NO: 3493039 - RNA, 23 nt, Pseudomonas aeruginosa PA01
gcgccgcaacgaaaaagggcggc

SEQ ID NO: 3493040 - RNA, 17 nt, Pseudomonas aeruginosa PA01
gcgccgcaaguggcggc

SEQ ID NO: 3493041 - RNA, 18 nt, Pseudomonas aeruginosa PA01
gcgccgcaaguggcggcu

SEQ ID NO: 3493042 - RNA, 19 nt, Pseudomonas aeruginosa PA01
gcgccgcaaguggcggcug

SEQ ID NO: 3493043 - RNA, 22 nt, Pseudomonas aeruginosa PA01
gcgccgcaccacguagccggcg

SEQ ID NO: 3493044 - RNA, 20 nt, Pseudomonas aeruginosa PA01
gcuccagcgugcccgcugca

SEQ ID NO: 3493045 - RNA, 16 nt, Pseudomonas aeruginosa PA01
gcuccagcuccuccag

SEQ ID NO: 3493046 - RNA, 20 nt, Pseudomonas aeruginosa PA01
gcuccagcuccuccagcagg

SEQ ID NO: 3493047 - RNA, 16 nt, Pseudomonas aeruginosa PA01
gcuccagcuugucguc

SEQ ID NO: 3493048 - RNA, 19 nt, Pseudomonas aeruginosa PA01
gcuccagcuugucgucggc

SEQ ID NO: 3493049 - RNA, 20 nt, Pseudomonas aeruginosa PA01
gcuccagcuugucgucggcc

SEQ ID NO: 3493050 - RNA, 16 nt, Pseudomonas aeruginosa PA01
gcuccaggaccggcag

SEQ ID NO: 3493051 - RNA, 12 nt, Pseudomonas aeruginosa PA01
gcuccaggccgc

SEQ ID NO: 3493052 - RNA, 13 nt, Pseudomonas aeruginosa PA01
gcuccaggccgcg

SEQ ID NO: 3493053 - RNA, 12 nt, Pseudomonas aeruginosa PA01
gcuccaggcugu

SEQ ID NO: 3493054 - RNA, 16 nt, Pseudomonas aeruginosa PA01
gcuccagggagcgcuc

SEQ ID NO: 3493055 - RNA, 17 nt, Pseudomonas aeruginosa PA01
gcuccagggagcgcucg

SEQ ID NO: 3493056 - RNA, 13 nt, Pseudomonas aeruginosa PA01
gcuccagggcgaa

SEQ ID NO: 3493057 - RNA, 15 nt, Pseudomonas aeruginosa PA01
gcuccagggcgcuga

SEQ ID NO: 3493058 - RNA, 13 nt, Pseudomonas aeruginosa PA01
gcuccagggcggc

SEQ ID NO: 3493059 - RNA, 15 nt, Pseudomonas aeruginosa PA01
gcuccagggcggccc

SEQ ID NO: 3493060 - RNA, 20 nt, Pseudomonas aeruginosa PA01
gcuccagggcugccaccgag

SEQ ID NO: 3493061 - RNA, 13 nt, Pseudomonas aeruginosa PA01
gcuccaggggagc

SEQ ID NO: 3493062 - RNA, 17 nt, Pseudomonas aeruginosa PA01
gcuccaggggagccccg

SEQ ID NO: 3493063 - RNA, 22 nt, Pseudomonas aeruginosa PA01
gcuccaggugcacggccaggcc

SEQ ID NO: 3493064 - RNA, 16 nt, Pseudomonas aeruginosa PA01
gcuccagucggggcag

SEQ ID NO: 3493065 - RNA, 22 nt, Pseudomonas aeruginosa PA01
gcuccagucggggcaggcgcag

SEQ ID NO: 3493066 - RNA, 16 nt, Pseudomonas aeruginosa PA01
gcuccaguugcagcac

SEQ ID NO: 3493067 - RNA, 18 nt, Pseudomonas aeruginosa PA01
gcuccaguugcagcaccc

SEQ ID NO: 3493068 - RNA, 20 nt, Pseudomonas aeruginosa PA01
gcuccaguugcagcaccccc

SEQ ID NO: 3493069 - RNA, 18 nt, Pseudomonas aeruginosa PA01
gcuccaucaguugcgcgc

SEQ ID NO: 3493070 - RNA, 20 nt, Pseudomonas aeruginosa PA01
gcucccaacagucgucgcgc

SEQ ID NO: 3493071 - RNA, 13 nt, Pseudomonas aeruginosa PA01
gcucccagccgac

SEQ ID NO: 3493072 - RNA, 18 nt, Pseudomonas aeruginosa PA01
gcucccaggcgucgccga

SEQ ID NO: 3493073 - RNA, 20 nt, Pseudomonas aeruginosa PA01
gcucccaggcgucgccgacu

SEQ ID NO: 3493074 - RNA, 15 nt, Pseudomonas aeruginosa PA01
gcucccccgcgccgc

SEQ ID NO: 3493075 - RNA, 16 nt, Pseudomonas aeruginosa PA01
gcucccccgcgccgcc

SEQ ID NO: 3493076 - RNA, 15 nt, Pseudomonas aeruginosa PA01
gcuccccgcaccugc

SEQ ID NO: 3493077 - RNA, 14 nt, Pseudomonas aeruginosa PA01
gcuccccgccgcca

SEQ ID NO: 3493078 - RNA, 14 nt, Pseudomonas aeruginosa PA01
gcuccccuggagcc

SEQ ID NO: 3493079 - RNA, 18 nt, Pseudomonas aeruginosa PA01
gcuccccuggagcccccg

SEQ ID NO: 3493080 - RNA, 19 nt, Pseudomonas aeruginosa PA01
gcuccccuggagcccccgu

SEQ ID NO: 3493081 - RNA, 12 nt, Pseudomonas aeruginosa PA01
gcucccgcggcc

SEQ ID NO: 3493082 - RNA, 18 nt, Pseudomonas aeruginosa PA01
gcucccgcggcccaaggg

SEQ ID NO: 3493083 - RNA, 13 nt, Pseudomonas aeruginosa PA01
gcucccggcuugc

SEQ ID NO: 3493084 - RNA, 16 nt, Pseudomonas aeruginosa PA01
gcucccugauccgcgu

SEQ ID NO: 3493085 - RNA, 20 nt, Pseudomonas aeruginosa PA01
gcucccugcaauggggcggc

SEQ ID NO: 3493086 - RNA, 22 nt, Pseudomonas aeruginosa PA01
gcucccugcaauggggcggccg

SEQ ID NO: 3493087 - RNA, 14 nt, Pseudomonas aeruginosa PA01
gcucccugccgccc

SEQ ID NO: 3493088 - RNA, 17 nt, Pseudomonas aeruginosa PA01
gcucccugccgcccuuc

SEQ ID NO: 3493089 - RNA, 13 nt, Pseudomonas aeruginosa PA01
gcucccuggcgga

SEQ ID NO: 3493090 - RNA, 16 nt, Pseudomonas aeruginosa PA01
gcucccuugccgccgg

SEQ ID NO: 3493091 - RNA, 22 nt, Pseudomonas aeruginosa PA01
gcuccgaagggaacccgcggcg

SEQ ID NO: 3493092 - RNA, 17 nt, Pseudomonas aeruginosa PA01
gcuccgacuccugcaac

SEQ ID NO: 3493093 - RNA, 14 nt, Pseudomonas aeruginosa PA01
gcuccgagcaggcc

SEQ ID NO: 3493094 - RNA, 15 nt, Pseudomonas aeruginosa PA01
gcuccgagcaggccu

SEQ ID NO: 3493095 - RNA, 19 nt, Pseudomonas aeruginosa PA01
gcuccgaugaagcaggcgg

SEQ ID NO: 3493096 - RNA, 17 nt, Pseudomonas aeruginosa PA01
gcuccgauggcgcugga

SEQ ID NO: 3493097 - RNA, 20 nt, Pseudomonas aeruginosa PA01
gcuccgccgaacgccaccag

SEQ ID NO: 3493098 - RNA, 21 nt, Pseudomonas aeruginosa PA01
gcuccgccgaacgccaccagg

SEQ ID NO: 3493099 - RNA, 17 nt, Pseudomonas aeruginosa PA01
gcuccgccugaccgcug

SEQ ID NO: 3493100 - RNA, 17 nt, Pseudomonas aeruginosa PA01
gcuccgccuggcggaua

SEQ ID NO: 3493101 - RNA, 23 nt, Pseudomonas aeruginosa PA01
gcuccgcgauguccccggccagc

SEQ ID NO: 3493102 - RNA, 14 nt, Pseudomonas aeruginosa PA01
gcuccgcgcacgga

SEQ ID NO: 3493103 - RNA, 17 nt, Pseudomonas aeruginosa PA01
gcuccgcgcguucagcc

SEQ ID NO: 3493104 - RNA, 19 nt, Pseudomonas aeruginosa PA01
gcuccgcgcguucagccac

SEQ ID NO: 3493105 - RNA, 15 nt, Pseudomonas aeruginosa PA01
gcuccgcggccggcu

SEQ ID NO: 3493106 - RNA, 16 nt, Pseudomonas aeruginosa PA01
gcuccgcggccggcuu

SEQ ID NO: 3493107 - RNA, 19 nt, Pseudomonas aeruginosa PA01
gcuccgcuaagcgucacuc

SEQ ID NO: 3493108 - RNA, 23 nt, Pseudomonas aeruginosa PA01
gcuccgcucagucgaccgucgcc

SEQ ID NO: 3493109 - RNA, 18 nt, Pseudomonas aeruginosa PA01
gcuccggaacgccugcau

SEQ ID NO: 3493110 - RNA, 15 nt, Pseudomonas aeruginosa PA01
gcuccggauggcuga

SEQ ID NO: 3493111 - RNA, 18 nt, Pseudomonas aeruginosa PA01
gcuccggauggcugaccc

SEQ ID NO: 3493112 - RNA, 14 nt, Pseudomonas aeruginosa PA01
gcuccggcagcgcg

SEQ ID NO: 3493113 - RNA, 15 nt, Pseudomonas aeruginosa PA01
gcuccggcagcgcgu

SEQ ID NO: 3493114 - RNA, 15 nt, Pseudomonas aeruginosa PA01
gcuccggcgccaggc

SEQ ID NO: 3493115 - RNA, 16 nt, Pseudomonas aeruginosa PA01
gcuccggcgccaggcc

SEQ ID NO: 3493116 - RNA, 12 nt, Pseudomonas aeruginosa PA01
gcuccggcgccg

SEQ ID NO: 3493117 - RNA, 14 nt, Pseudomonas aeruginosa PA01
gcuccggcgcgcca

SEQ ID NO: 3493118 - RNA, 13 nt, Pseudomonas aeruginosa PA01
gcuccggcgggcg

SEQ ID NO: 3493119 - RNA, 20 nt, Pseudomonas aeruginosa PA01
gcuccggcguaccguuggcg

SEQ ID NO: 3493120 - RNA, 16 nt, Pseudomonas aeruginosa PA01
gcuccggcuccgcgca

SEQ ID NO: 3493121 - RNA, 15 nt, Pseudomonas aeruginosa PA01
gcuccggcugcgcgg

SEQ ID NO: 3493122 - RNA, 16 nt, Pseudomonas aeruginosa PA01
gcuccgggcccgugcg

SEQ ID NO: 3493123 - RNA, 13 nt, Pseudomonas aeruginosa PA01
gcuccgggcggcu

SEQ ID NO: 3493124 - RNA, 18 nt, Pseudomonas aeruginosa PA01
gcuccgggcuggccacca

SEQ ID NO: 3493125 - RNA, 19 nt, Pseudomonas aeruginosa PA01
gcuccgggcuggccaccag

SEQ ID NO: 3493126 - RNA, 15 nt, Pseudomonas aeruginosa PA01
gcuccggggcgcugu

SEQ ID NO: 3493127 - RNA, 23 nt, Pseudomonas aeruginosa PA01
gcuccggguacuggcgcugcgcg

SEQ ID NO: 3493128 - RNA, 14 nt, Pseudomonas aeruginosa PA01
gcuccggugccagg

SEQ ID NO: 3493129 - RNA, 16 nt, Pseudomonas aeruginosa PA01
gcuccggugccagggc

SEQ ID NO: 3493130 - RNA, 23 nt, Pseudomonas aeruginosa PA01
gcuccgguucggcaaggcgcagc

SEQ ID NO: 3493131 - RNA, 17 nt, Pseudomonas aeruginosa PA01
gcuccguagggcgacgc

SEQ ID NO: 3493132 - RNA, 21 nt, Pseudomonas aeruginosa PA01
gcuccguagggcgacgcccga

SEQ ID NO: 3493133 - RNA, 22 nt, Pseudomonas aeruginosa PA01
gcuccguagggcgacgcccgag

SEQ ID NO: 3493134 - RNA, 23 nt, Pseudomonas aeruginosa PA01
gcuccguagggcgacgcccgagg

SEQ ID NO: 3493135 - RNA, 17 nt, Pseudomonas aeruginosa PA01
gcuccgucgcuucgccc

SEQ ID NO: 3493136 - RNA, 18 nt, Pseudomonas aeruginosa PA01
gcuccgucgcuucgcccg

SEQ ID NO: 3493137 - RNA, 22 nt, Pseudomonas aeruginosa PA01
gcuccgucgcuucgcccgccgc

SEQ ID NO: 3493138 - RNA, 14 nt, Pseudomonas aeruginosa PA01
gcuccgugucggcg

SEQ ID NO: 3493139 - RNA, 17 nt, Pseudomonas aeruginosa PA01
gcuccgugucggcggcg

SEQ ID NO: 3493140 - RNA, 18 nt, Pseudomonas aeruginosa PA01
gcuccgugucggcggcgc

SEQ ID NO: 3493141 - RNA, 21 nt, Pseudomonas aeruginosa PA01
gcuccguugaacucggcgccc

SEQ ID NO: 3493142 - RNA, 24 nt, Pseudomonas aeruginosa PA01
gcuccguugaacucggcgcccagg

SEQ ID NO: 3493143 - RNA, 13 nt, Pseudomonas aeruginosa PA01
gcuccucagaggc

SEQ ID NO: 3493144 - RNA, 13 nt, Pseudomonas aeruginosa PA01
gcuccuccagcag

SEQ ID NO: 3493145 - RNA, 15 nt, Pseudomonas aeruginosa PA01
gcuccuccagcagga

SEQ ID NO: 3493146 - RNA, 18 nt, Pseudomonas aeruginosa PA01
gcuccuccagcaggaccu

SEQ ID NO: 3493147 - RNA, 15 nt, Pseudomonas aeruginosa PA01
gcuccuccagcgccg

SEQ ID NO: 3493148 - RNA, 16 nt, Pseudomonas aeruginosa PA01
gcuccuccagcgccgc

SEQ ID NO: 3493149 - RNA, 22 nt, Pseudomonas aeruginosa PA01
gcuccuccagcgccgccaggcg

SEQ ID NO: 3493150 - RNA, 13 nt, Pseudomonas aeruginosa PA01
gcuccuccaggcu

SEQ ID NO: 3493151 - RNA, 19 nt, Pseudomonas aeruginosa PA01
gcuccuccaggcucuucag

SEQ ID NO: 3493152 - RNA, 14 nt, Pseudomonas aeruginosa PA01
gcuccuccgggaag

SEQ ID NO: 3493153 - RNA, 13 nt, Pseudomonas aeruginosa PA01
gcuccuccgggcg

SEQ ID NO: 3493154 - RNA, 17 nt, Pseudomonas aeruginosa PA01
gcuccuccgggcgugcc

SEQ ID NO: 3493155 - RNA, 22 nt, Pseudomonas aeruginosa PA01
gcuccuccgggcgugccaggag

SEQ ID NO: 3493156 - RNA, 23 nt, Pseudomonas aeruginosa PA01
gcuccuccgggcgugccaggagc

SEQ ID NO: 3493157 - RNA, 12 nt, Pseudomonas aeruginosa PA01
gcuccuccucgc

SEQ ID NO: 3493158 - RNA, 22 nt, Pseudomonas aeruginosa PA01
gcuccuccucgcucugcgccgc

SEQ ID NO: 3493159 - RNA, 20 nt, Pseudomonas aeruginosa PA01
gcuccucgauaaacggcgcu

SEQ ID NO: 3493160 - RNA, 17 nt, Pseudomonas aeruginosa PA01
gcuccucgauccgcucc

SEQ ID NO: 3493161 - RNA, 20 nt, Pseudomonas aeruginosa PA01
gcuccucgauccgcuccagc

SEQ ID NO: 3493162 - RNA, 21 nt, Pseudomonas aeruginosa PA01
gcuccucgauccgcuccagca

SEQ ID NO: 3493163 - RNA, 14 nt, Pseudomonas aeruginosa PA01
gcuccucgcgcugc

SEQ ID NO: 3493164 - RNA, 15 nt, Pseudomonas aeruginosa PA01
gcuccucgcgcugcc

SEQ ID NO: 3493165 - RNA, 17 nt, Pseudomonas aeruginosa PA01
gcuccucgcgcugcccg

SEQ ID NO: 3493166 - RNA, 18 nt, Pseudomonas aeruginosa PA01
gcuccucgcgcugcccgg

SEQ ID NO: 3493167 - RNA, 19 nt, Pseudomonas aeruginosa PA01
gcuccucgcgcugcccggc

SEQ ID NO: 3493168 - RNA, 20 nt, Pseudomonas aeruginosa PA01
gcuccucgcgcugcccggcg

SEQ ID NO: 3493169 - RNA, 23 nt, Pseudomonas aeruginosa PA01
gcuccucgcgcugcccggcgcga

SEQ ID NO: 3493170 - RNA, 20 nt, Pseudomonas aeruginosa PA01
gcuccucggcagcgcuggcg

SEQ ID NO: 3493171 - RNA, 15 nt, Pseudomonas aeruginosa PA01
gcuccucggccuggg

SEQ ID NO: 3493172 - RNA, 17 nt, Pseudomonas aeruginosa PA01
gcuccucggccugggcg

SEQ ID NO: 3493173 - RNA, 23 nt, Pseudomonas aeruginosa PA01
gcuccucggccugggcgcaggcc

SEQ ID NO: 3493174 - RNA, 24 nt, Pseudomonas aeruginosa PA01
gcuccucggccugggcgcaggccg

SEQ ID NO: 3493175 - RNA, 15 nt, Pseudomonas aeruginosa PA01
gcuccucggccuugc

SEQ ID NO: 3493176 - RNA, 21 nt, Pseudomonas aeruginosa PA01
gcuccucggccuugcuggcga

SEQ ID NO: 3493177 - RNA, 16 nt, Pseudomonas aeruginosa PA01
gcuccucugccugcgc

SEQ ID NO: 3493178 - RNA, 19 nt, Pseudomonas aeruginosa PA01
gcuccugaaggaccagcuu

SEQ ID NO: 3493179 - RNA, 18 nt, Pseudomonas aeruginosa PA01
gcuccugcaggcccugcc

SEQ ID NO: 3493180 - RNA, 17 nt, Pseudomonas aeruginosa PA01
gcuccugcggcuggcga

SEQ ID NO: 3493181 - RNA, 20 nt, Pseudomonas aeruginosa PA01
gcuccuggaagaacaggcgc

SEQ ID NO: 3493182 - RNA, 21 nt, Pseudomonas aeruginosa PA01
gcuccuggaagaacaggcgcu

SEQ ID NO: 3493183 - RNA, 20 nt, Pseudomonas aeruginosa PA01
gcuccuggaugcuccgcgcc

SEQ ID NO: 3493184 - RNA, 21 nt, Pseudomonas aeruginosa PA01
gcuccuggaugcuccgcgccu

SEQ ID NO: 3493185 - RNA, 21 nt, Pseudomonas aeruginosa PA01
gcuccuggugcggcaccagcc

SEQ ID NO: 3493186 - RNA, 23 nt, Pseudomonas aeruginosa PA01
gcuccuggugcggcaccagccag

SEQ ID NO: 3493187 - RNA, 19 nt, Pseudomonas aeruginosa PA01
gcuccuguugcuggccggu

SEQ ID NO: 3493188 - RNA, 19 nt, Pseudomonas aeruginosa PA01
gcuccuucgguaccugguc

SEQ ID NO: 3493189 - RNA, 21 nt, Pseudomonas aeruginosa PA01
gcuccuugacccucugguugg

SEQ ID NO: 3493190 - RNA, 16 nt, Pseudomonas aeruginosa PA01
gcuccuugcgccaggc

SEQ ID NO: 3493191 - RNA, 20 nt, Pseudomonas aeruginosa PA01
gcuccuugcgcuccuuggcu

SEQ ID NO: 3493192 - RNA, 21 nt, Pseudomonas aeruginosa PA01
gcuccuugcucucgcgcacgc

SEQ ID NO: 3493193 - RNA, 14 nt, Pseudomonas aeruginosa PA01
gcuccuuggcuggc

SEQ ID NO: 3493194 - RNA, 20 nt, Pseudomonas aeruginosa PA01
gcuccuuggcuggccagccc

SEQ ID NO: 3493195 - RNA, 21 nt, Pseudomonas aeruginosa PA01
gcuccuuucggaacagcgccu

SEQ ID NO: 3493196 - RNA, 19 nt, Pseudomonas aeruginosa PA01
gcucgaaacgaagcuucau

SEQ ID NO: 3493197 - RNA, 19 nt, Pseudomonas aeruginosa PA01
gcucgaaagccuccagcag

SEQ ID NO: 3493198 - RNA, 22 nt, Pseudomonas aeruginosa PA01
gcucgaacagcaccgagcaggc

SEQ ID NO: 3493199 - RNA, 21 nt, Pseudomonas aeruginosa PA01
gcucgaacaucagcagcgcca

SEQ ID NO: 3493200 - RNA, 16 nt, Pseudomonas aeruginosa PA01
gcucgaacgccgcccg

SEQ ID NO: 3493201 - RNA, 21 nt, Pseudomonas aeruginosa PA01
gcucgaacgccgcccgucgcg

SEQ ID NO: 3493202 - RNA, 17 nt, Pseudomonas aeruginosa PA01
gcucgaacggcggaucg

SEQ ID NO: 3493203 - RNA, 12 nt, Pseudomonas aeruginosa PA01
gcucgaacgggc

SEQ ID NO: 3493204 - RNA, 13 nt, Pseudomonas aeruginosa PA01
gcucgaacgggca

SEQ ID NO: 3493205 - RNA, 14 nt, Pseudomonas aeruginosa PA01
gcucgaagccgccg

SEQ ID NO: 3493206 - RNA, 15 nt, Pseudomonas aeruginosa PA01
gcucgaagccgccgu

SEQ ID NO: 3493207 - RNA, 23 nt, Pseudomonas aeruginosa PA01
gcucgaauaaaaaaccggccaau

SEQ ID NO: 3493208 - RNA, 23 nt, Pseudomonas aeruginosa PA01
gcucgaaugcuguuccucgucga

SEQ ID NO: 3493209 - RNA, 15 nt, Pseudomonas aeruginosa PA01
gcucgacagcgucgu

SEQ ID NO: 3493210 - RNA, 17 nt, Pseudomonas aeruginosa PA01
gcucgacaggucggcga

SEQ ID NO: 3493211 - RNA, 18 nt, Pseudomonas aeruginosa PA01
gcucgacauacuccgccg

SEQ ID NO: 3493212 - RNA, 19 nt, Pseudomonas aeruginosa PA01
gcucgacauacuccgccgc

SEQ ID NO: 3493213 - RNA, 21 nt, Pseudomonas aeruginosa PA01
gcucgacauacuccgccgcuu

SEQ ID NO: 3493214 - RNA, 13 nt, Pseudomonas aeruginosa PA01
gcucgaccaccuc

SEQ ID NO: 3493215 - RNA, 14 nt, Pseudomonas aeruginosa PA01
gcucgaccaccucg

SEQ ID NO: 3493216 - RNA, 14 nt, Pseudomonas aeruginosa PA01
gcucgacccgcccg

SEQ ID NO: 3493217 - RNA, 16 nt, Pseudomonas aeruginosa PA01
gcucgacccgcccgcc

SEQ ID NO: 3493218 - RNA, 21 nt, Pseudomonas aeruginosa PA01
gcucgacccgcccgccguccu

SEQ ID NO: 3493219 - RNA, 21 nt, Pseudomonas aeruginosa PA01
gcucgaccgccugcucgcggc

SEQ ID NO: 3493220 - RNA, 22 nt, Pseudomonas aeruginosa PA01
gcucgaccgccugcucgcggcu

SEQ ID NO: 3493221 - RNA, 17 nt, Pseudomonas aeruginosa PA01
gcucgaccuugcccuug

SEQ ID NO: 3493222 - RNA, 21 nt, Pseudomonas aeruginosa PA01
gcucgaccuugccgagcgcga

SEQ ID NO: 3493223 - RNA, 23 nt, Pseudomonas aeruginosa PA01
gcucgaccuugccgagcgcgauc

SEQ ID NO: 3493224 - RNA, 14 nt, Pseudomonas aeruginosa PA01
gcucgacgagccgc

SEQ ID NO: 3493225 - RNA, 21 nt, Pseudomonas aeruginosa PA01
gcucgacgagccgcgacgcga

SEQ ID NO: 3493226 - RNA, 14 nt, Pseudomonas aeruginosa PA01
gcucgacgaucagg

SEQ ID NO: 3493227 - RNA, 14 nt, Pseudomonas aeruginosa PA01
gcucgacggcacca

SEQ ID NO: 3493228 - RNA, 21 nt, Pseudomonas aeruginosa PA01
gcucgacggcaccagcgcguc

SEQ ID NO: 3493229 - RNA, 23 nt, Pseudomonas aeruginosa PA01
gcucgacggcaccagcgcgucga

SEQ ID NO: 3493230 - RNA, 19 nt, Pseudomonas aeruginosa PA01
gcucgacggucagcggaca

SEQ ID NO: 3493231 - RNA, 22 nt, Pseudomonas aeruginosa PA01
gcucgacuuccugggaugccgg

SEQ ID NO: 3493232 - RNA, 23 nt, Pseudomonas aeruginosa PA01
gcucgacuuccugggaugccggg

SEQ ID NO: 3493233 - RNA, 18 nt, Pseudomonas aeruginosa PA01
gcucgaggaagcgcccga

SEQ ID NO: 3493234 - RNA, 14 nt, Pseudomonas aeruginosa PA01
gcucgaggccagga

SEQ ID NO: 3493235 - RNA, 15 nt, Pseudomonas aeruginosa PA01
gcucgaggccaggau

SEQ ID NO: 3493236 - RNA, 16 nt, Pseudomonas aeruginosa PA01
gcucgaggccaggauc

SEQ ID NO: 3493237 - RNA, 11 nt, Pseudomonas aeruginosa PA01
gcucgaggccg

SEQ ID NO: 3493238 - RNA, 18 nt, Pseudomonas aeruginosa PA01
gcucgaggccgagccggc

SEQ ID NO: 3493239 - RNA, 20 nt, Pseudomonas aeruginosa PA01
gcucgaggccgagccggcau

SEQ ID NO: 3493240 - RNA, 16 nt, Pseudomonas aeruginosa PA01
gcucgagggcgaccgc

SEQ ID NO: 3493241 - RNA, 18 nt, Pseudomonas aeruginosa PA01
gcucgagggcgaccgcca

SEQ ID NO: 3493242 - RNA, 18 nt, Pseudomonas aeruginosa PA01
gcucgaucaaccccugga

SEQ ID NO: 3493243 - RNA, 12 nt, Pseudomonas aeruginosa PA01
gcucgaucacca

SEQ ID NO: 3493244 - RNA, 13 nt, Pseudomonas aeruginosa PA01
gcucgaucagccc

SEQ ID NO: 3493245 - RNA, 15 nt, Pseudomonas aeruginosa PA01
gcucgaucagccggc

SEQ ID NO: 3493246 - RNA, 17 nt, Pseudomonas aeruginosa PA01
gcucgaucagccggcgc

SEQ ID NO: 3493247 - RNA, 14 nt, Pseudomonas aeruginosa PA01
gcucgauccagccg

SEQ ID NO: 3493248 - RNA, 17 nt, Pseudomonas aeruginosa PA01
gcucgauccagccggca

SEQ ID NO: 3493249 - RNA, 23 nt, Pseudomonas aeruginosa PA01
gcucgauccagccggcauccagc

SEQ ID NO: 3493250 - RNA, 18 nt, Pseudomonas aeruginosa PA01
gcucgaucccggcgcgga

SEQ ID NO: 3493251 - RNA, 18 nt, Pseudomonas aeruginosa PA01
gcucgaucggcagggcgc

SEQ ID NO: 3493252 - RNA, 20 nt, Pseudomonas aeruginosa PA01
gcucgaucggcagggcgccg

SEQ ID NO: 3493253 - RNA, 18 nt, Pseudomonas aeruginosa PA01
gcucgaucucauggucgg

SEQ ID NO: 3493254 - RNA, 18 nt, Pseudomonas aeruginosa PA01
gcucgaugaucaccagac

SEQ ID NO: 3493255 - RNA, 13 nt, Pseudomonas aeruginosa PA01
gcucgaugaucga

SEQ ID NO: 3493256 - RNA, 22 nt, Pseudomonas aeruginosa PA01
gcucgaugccaucgaggccagg

SEQ ID NO: 3493257 - RNA, 15 nt, Pseudomonas aeruginosa PA01
gcucgaugcccgcca

SEQ ID NO: 3493258 - RNA, 19 nt, Pseudomonas aeruginosa PA01
gcucgaugcccgccagcag

SEQ ID NO: 3493259 - RNA, 20 nt, Pseudomonas aeruginosa PA01
gcucgaugcccgccagcagg

SEQ ID NO: 3493260 - RNA, 21 nt, Pseudomonas aeruginosa PA01
gcucgaugcccgccagcaggc

SEQ ID NO: 3493261 - RNA, 14 nt, Pseudomonas aeruginosa PA01
gcucgauggcggcc

SEQ ID NO: 3493262 - RNA, 18 nt, Pseudomonas aeruginosa PA01
gcucgauggcggccuggu

SEQ ID NO: 3493263 - RNA, 19 nt, Pseudomonas aeruginosa PA01
gcucgauugcugaggggug

SEQ ID NO: 3493264 - RNA, 17 nt, Pseudomonas aeruginosa PA01
gcucgcaaucagcgcga

SEQ ID NO: 3493265 - RNA, 18 nt, Pseudomonas aeruginosa PA01
gcucgcaaucagcgcgau

SEQ ID NO: 3493266 - RNA, 14 nt, Pseudomonas aeruginosa PA01
gcucgcaccaggcc

SEQ ID NO: 3493267 - RNA, 16 nt, Pseudomonas aeruginosa PA01
gcucgcaccaggccag

SEQ ID NO: 3493268 - RNA, 13 nt, Pseudomonas aeruginosa PA01
gcucgcagagggc

SEQ ID NO: 3493269 - RNA, 15 nt, Pseudomonas aeruginosa PA01
gcucgcagagggcga

SEQ ID NO: 3493270 - RNA, 13 nt, Pseudomonas aeruginosa PA01
gcucgcagccggu

SEQ ID NO: 3493271 - RNA, 13 nt, Pseudomonas aeruginosa PA01
gcucgccagauga

SEQ ID NO: 3493272 - RNA, 16 nt, Pseudomonas aeruginosa PA01
gcucgccagaugacga

SEQ ID NO: 3493273 - RNA, 12 nt, Pseudomonas aeruginosa PA01
gcucgcccaucu

SEQ ID NO: 3493274 - RNA, 21 nt, Pseudomonas aeruginosa PA01
gcucgcccaugcgcggcgaga

SEQ ID NO: 3493275 - RNA, 11 nt, Pseudomonas aeruginosa PA01
gcucgccccgg

SEQ ID NO: 3493276 - RNA, 17 nt, Pseudomonas aeruginosa PA01
gcucgcccuugcgccgc

SEQ ID NO: 3493277 - RNA, 17 nt, Pseudomonas aeruginosa PA01
gcucgccgaacaggauc

SEQ ID NO: 3493278 - RNA, 21 nt, Pseudomonas aeruginosa PA01
gcucgccgaacaggaucuccu

SEQ ID NO: 3493279 - RNA, 14 nt, Pseudomonas aeruginosa PA01
gcucgccgacggcu

SEQ ID NO: 3493280 - RNA, 21 nt, Pseudomonas aeruginosa PA01
gcucgccgacggcuucgacca

SEQ ID NO: 3493281 - RNA, 16 nt, Pseudomonas aeruginosa PA01
gcucgccgacuuccag

SEQ ID NO: 3493282 - RNA, 18 nt, Pseudomonas aeruginosa PA01
gcucgccgacuuccaggc

SEQ ID NO: 3493283 - RNA, 21 nt, Pseudomonas aeruginosa PA01
gcucgccgacuuccaggcgca

SEQ ID NO: 3493284 - RNA, 19 nt, Pseudomonas aeruginosa PA01
gcucgccgagguugcugcg

SEQ ID NO: 3493285 - RNA, 21 nt, Pseudomonas aeruginosa PA01
gcucgccgagguugcugcggc

SEQ ID NO: 3493286 - RNA, 14 nt, Pseudomonas aeruginosa PA01
gcucgccgauugca

SEQ ID NO: 3493287 - RNA, 13 nt, Pseudomonas aeruginosa PA01
gcucgccgccagc

SEQ ID NO: 3493288 - RNA, 15 nt, Pseudomonas aeruginosa PA01
gcucgccgccagcag

SEQ ID NO: 3493289 - RNA, 17 nt, Pseudomonas aeruginosa PA01
gcucgccgccagcagga

SEQ ID NO: 3493290 - RNA, 19 nt, Pseudomonas aeruginosa PA01
gcucgccgccagcaggauc

SEQ ID NO: 3493291 - RNA, 20 nt, Pseudomonas aeruginosa PA01
gcucgccgccagcaggaucg

SEQ ID NO: 3493292 - RNA, 15 nt, Pseudomonas aeruginosa PA01
gcucgccgccggcga

SEQ ID NO: 3493293 - RNA, 17 nt, Pseudomonas aeruginosa PA01
gcucgccgccggcgagg

SEQ ID NO: 3493294 - RNA, 15 nt, Pseudomonas aeruginosa PA01
gcucgccgccgggcg

SEQ ID NO: 3493295 - RNA, 15 nt, Pseudomonas aeruginosa PA01
gcucgccgcgcugca

SEQ ID NO: 3493296 - RNA, 21 nt, Pseudomonas aeruginosa PA01
gcucgccgcugaaguccuggc

SEQ ID NO: 3493297 - RNA, 22 nt, Pseudomonas aeruginosa PA01
gcucgccgcugaaguccuggcc

SEQ ID NO: 3493298 - RNA, 17 nt, Pseudomonas aeruginosa PA01
gcucgccggcgcgggcg

SEQ ID NO: 3493299 - RNA, 20 nt, Pseudomonas aeruginosa PA01
gcucgccggcgcgggcggcc

SEQ ID NO: 3493300 - RNA, 14 nt, Pseudomonas aeruginosa PA01
gcucgccggcgucc

SEQ ID NO: 3493301 - RNA, 19 nt, Pseudomonas aeruginosa PA01
gcucgccgggaaucgccag

SEQ ID NO: 3493302 - RNA, 20 nt, Pseudomonas aeruginosa PA01
gcucgccgggaaucgccagc

SEQ ID NO: 3493303 - RNA, 22 nt, Pseudomonas aeruginosa PA01
gcucgccgggaaucgccagcag

SEQ ID NO: 3493304 - RNA, 16 nt, Pseudomonas aeruginosa PA01
gcucgccggguagggc

SEQ ID NO: 3493305 - RNA, 17 nt, Pseudomonas aeruginosa PA01
gcucgccgggucgccgc

SEQ ID NO: 3493306 - RNA, 23 nt, Pseudomonas aeruginosa PA01
gcucgccggguuguccaggcgau

SEQ ID NO: 3493307 - RNA, 17 nt, Pseudomonas aeruginosa PA01
gcucgccucgggccaug

SEQ ID NO: 3493308 - RNA, 21 nt, Pseudomonas aeruginosa PA01
gcucgccucgggccaugagca

SEQ ID NO: 3493309 - RNA, 18 nt, Pseudomonas aeruginosa PA01
gcucgccugguaggcggc

SEQ ID NO: 3493310 - RNA, 19 nt, Pseudomonas aeruginosa PA01
gcucgcgaugcugugcagg

SEQ ID NO: 3493311 - RNA, 19 nt, Pseudomonas aeruginosa PA01
gcucgcgcaaccagccgga

SEQ ID NO: 3493312 - RNA, 18 nt, Pseudomonas aeruginosa PA01
gcucgcgcaagcgcccgg

SEQ ID NO: 3493313 - RNA, 21 nt, Pseudomonas aeruginosa PA01
gcucgcgcaagcgcccggcga

SEQ ID NO: 3493314 - RNA, 19 nt, Pseudomonas aeruginosa PA01
gcucgcgcaccgcggccag

SEQ ID NO: 3493315 - RNA, 15 nt, Pseudomonas aeruginosa PA01
gcucgcgcacggcga

SEQ ID NO: 3493316 - RNA, 16 nt, Pseudomonas aeruginosa PA01
gcucgcgcacggcgaa

SEQ ID NO: 3493317 - RNA, 19 nt, Pseudomonas aeruginosa PA01
gcucgcgcagccacuggcg

SEQ ID NO: 3493318 - RNA, 20 nt, Pseudomonas aeruginosa PA01
gcucgcgcagccacuggcgg

SEQ ID NO: 3493319 - RNA, 14 nt, Pseudomonas aeruginosa PA01
gcucgcgcagccag

SEQ ID NO: 3493320 - RNA, 17 nt, Pseudomonas aeruginosa PA01
gcucgcgcagccaggcg

SEQ ID NO: 3493321 - RNA, 19 nt, Pseudomonas aeruginosa PA01
gcucgcgcagccaggcgag

SEQ ID NO: 3493322 - RNA, 16 nt, Pseudomonas aeruginosa PA01
gcucgcgcagcgacuc

SEQ ID NO: 3493323 - RNA, 18 nt, Pseudomonas aeruginosa PA01
gcucgcgcagcgacucga

SEQ ID NO: 3493324 - RNA, 17 nt, Pseudomonas aeruginosa PA01
gcucgcgcagcggcgcg

SEQ ID NO: 3493325 - RNA, 18 nt, Pseudomonas aeruginosa PA01
gcucgcgcagcggcgcgu

SEQ ID NO: 3493326 - RNA, 15 nt, Pseudomonas aeruginosa PA01
gcucgcgcagggucg

SEQ ID NO: 3493327 - RNA, 18 nt, Pseudomonas aeruginosa PA01
gcucgcgcagggucgagg

SEQ ID NO: 3493328 - RNA, 17 nt, Pseudomonas aeruginosa PA01
gcucgcgcaugaccuuc

SEQ ID NO: 3493329 - RNA, 23 nt, Pseudomonas aeruginosa PA01
gcucgcgcaugaccuucagcacc

SEQ ID NO: 3493330 - RNA, 20 nt, Pseudomonas aeruginosa PA01
gcucgcgcaugaucgccucg

SEQ ID NO: 3493331 - RNA, 12 nt, Pseudomonas aeruginosa PA01
gcucgcgccagc

SEQ ID NO: 3493332 - RNA, 14 nt, Pseudomonas aeruginosa PA01
gcucgcgccagccc

SEQ ID NO: 3493333 - RNA, 18 nt, Pseudomonas aeruginosa PA01
gcucgcgccagccccagg

SEQ ID NO: 3493334 - RNA, 22 nt, Pseudomonas aeruginosa PA01
gcucgcgccagccccaggcgcg

SEQ ID NO: 3493335 - RNA, 12 nt, Pseudomonas aeruginosa PA01
gcucgcgccggc

SEQ ID NO: 3493336 - RNA, 13 nt, Pseudomonas aeruginosa PA01
gcucgcgccggcg

SEQ ID NO: 3493337 - RNA, 14 nt, Pseudomonas aeruginosa PA01
gcucgcgccggcgc

SEQ ID NO: 3493338 - RNA, 13 nt, Pseudomonas aeruginosa PA01
gcucgcgcggcac

SEQ ID NO: 3493339 - RNA, 16 nt, Pseudomonas aeruginosa PA01
gcucgcgcggggcgcg

SEQ ID NO: 3493340 - RNA, 19 nt, Pseudomonas aeruginosa PA01
gcucgcgcggggcgcgcug

SEQ ID NO: 3493341 - RNA, 21 nt, Pseudomonas aeruginosa PA01
gcucgcgcggggcgcgcugcg

SEQ ID NO: 3493342 - RNA, 15 nt, Pseudomonas aeruginosa PA01
gcucgcgcuuccggc

SEQ ID NO: 3493343 - RNA, 18 nt, Pseudomonas aeruginosa PA01
gcucgcgcuucucgacgu

SEQ ID NO: 3493344 - RNA, 14 nt, Pseudomonas aeruginosa PA01
gcucgcggaccagc

SEQ ID NO: 3493345 - RNA, 17 nt, Pseudomonas aeruginosa PA01
gcucgcggaccagcucc

SEQ ID NO: 3493346 - RNA, 17 nt, Pseudomonas aeruginosa PA01
gcucgcggaccucugcg

SEQ ID NO: 3493347 - RNA, 16 nt, Pseudomonas aeruginosa PA01
gcucgcggcaucccgc

SEQ ID NO: 3493348 - RNA, 19 nt, Pseudomonas aeruginosa PA01
gcucgcggcaucccgcccg

SEQ ID NO: 3493349 - RNA, 15 nt, Pseudomonas aeruginosa PA01
gcucgcggcgcucgu

SEQ ID NO: 3493350 - RNA, 20 nt, Pseudomonas aeruginosa PA01
gcucgcggcguaggccucgg

SEQ ID NO: 3493351 - RNA, 14 nt, Pseudomonas aeruginosa PA01
gcucgcggcuggcc

SEQ ID NO: 3493352 - RNA, 15 nt, Pseudomonas aeruginosa PA01
gcucgcggcuggccg

SEQ ID NO: 3493353 - RNA, 19 nt, Pseudomonas aeruginosa PA01
gcucgcggcuggccgccuc

SEQ ID NO: 3493354 - RNA, 21 nt, Pseudomonas aeruginosa PA01
gcucgcggcuggccgccucgc

SEQ ID NO: 3493355 - RNA, 23 nt, Pseudomonas aeruginosa PA01
gcucgcggcuggccgccucgcgc

SEQ ID NO: 3493356 - RNA, 13 nt, Pseudomonas aeruginosa PA01
gcucgcgggccgc

SEQ ID NO: 3493357 - RNA, 16 nt, Pseudomonas aeruginosa PA01
gcucgcgggccgccug

SEQ ID NO: 3493358 - RNA, 19 nt, Pseudomonas aeruginosa PA01
gcucgcgggccgccugguc

SEQ ID NO: 3493359 - RNA, 21 nt, Pseudomonas aeruginosa PA01
gcucgcgggucaccaccggga

SEQ ID NO: 3493360 - RNA, 18 nt, Pseudomonas aeruginosa PA01
gcucgcgguaggccagcu

SEQ ID NO: 3493361 - RNA, 20 nt, Pseudomonas aeruginosa PA01
gcucgcgguaggccagcucc

SEQ ID NO: 3493362 - RNA, 17 nt, Pseudomonas aeruginosa PA01
gcucgcgguuauccgcc

SEQ ID NO: 3493363 - RNA, 20 nt, Pseudomonas aeruginosa PA01
gcucgcgguuauccgccgcc

SEQ ID NO: 3493364 - RNA, 21 nt, Pseudomonas aeruginosa PA01
gcucgcgguuauccgccgccu

SEQ ID NO: 3493365 - RNA, 22 nt, Pseudomonas aeruginosa PA01
gcucgcgguuauccgccgccua

SEQ ID NO: 3493366 - RNA, 19 nt, Pseudomonas aeruginosa PA01
gcucgcgguuauccgccgg

SEQ ID NO: 3493367 - RNA, 16 nt, Pseudomonas aeruginosa PA01
gcucgcgguucgagga

SEQ ID NO: 3493368 - RNA, 18 nt, Pseudomonas aeruginosa PA01
gcucgcgguucgaggacu

SEQ ID NO: 3493369 - RNA, 14 nt, Pseudomonas aeruginosa PA01
gcucgcguccgcag

SEQ ID NO: 3493370 - RNA, 17 nt, Pseudomonas aeruginosa PA01
gcucgcuacagccggga

SEQ ID NO: 3493371 - RNA, 20 nt, Pseudomonas aeruginosa PA01
gcucgcuacagccgggaucu

SEQ ID NO: 3493372 - RNA, 13 nt, Pseudomonas aeruginosa PA01
gcucgcuccgagc

SEQ ID NO: 3493373 - RNA, 14 nt, Pseudomonas aeruginosa PA01
gcucgcuccgagca

SEQ ID NO: 3493374 - RNA, 18 nt, Pseudomonas aeruginosa PA01
gcucgcuccgagcaggcc

SEQ ID NO: 3493375 - RNA, 19 nt, Pseudomonas aeruginosa PA01
gcucgcuccgagcaggccu

SEQ ID NO: 3493376 - RNA, 19 nt, Pseudomonas aeruginosa PA01
gcucgcucucgaacaccgg

SEQ ID NO: 3493377 - RNA, 15 nt, Pseudomonas aeruginosa PA01
gcucgcucuuuccau

SEQ ID NO: 3493378 - RNA, 20 nt, Pseudomonas aeruginosa PA01
gcucgcugaaauccaccagc

SEQ ID NO: 3493379 - RNA, 22 nt, Pseudomonas aeruginosa PA01
gcucgcugaaauccaccagcac

SEQ ID NO: 3493380 - RNA, 23 nt, Pseudomonas aeruginosa PA01
gcucgcugaaauccaccagcacg

SEQ ID NO: 3493381 - RNA, 22 nt, Pseudomonas aeruginosa PA01
gcucgcugucgcucagcgggcc

SEQ ID NO: 3493382 - RNA, 15 nt, Pseudomonas aeruginosa PA01
gcucgcuucagcgag

SEQ ID NO: 3493383 - RNA, 17 nt, Pseudomonas aeruginosa PA01
gcucgcuucagcgagcg

SEQ ID NO: 3493384 - RNA, 18 nt, Pseudomonas aeruginosa PA01
gcucgcuucagcgagcgg

SEQ ID NO: 3493385 - RNA, 22 nt, Pseudomonas aeruginosa PA01
gcucgcuucagcgagcggucgg

SEQ ID NO: 3493386 - RNA, 15 nt, Pseudomonas aeruginosa PA01
gcucggacagcuucu

SEQ ID NO: 3493387 - RNA, 16 nt, Pseudomonas aeruginosa PA01
gcucggacagcuucug

SEQ ID NO: 3493388 - RNA, 20 nt, Pseudomonas aeruginosa PA01
gcucggacgacaucucgucc

SEQ ID NO: 3493389 - RNA, 15 nt, Pseudomonas aeruginosa PA01
gcucggaucaggcgg

SEQ ID NO: 3493390 - RNA, 22 nt, Pseudomonas aeruginosa PA01
gcucggaucaggcgggcuccgc

SEQ ID NO: 3493391 - RNA, 16 nt, Pseudomonas aeruginosa PA01
gcucggauuccagcgc

SEQ ID NO: 3493392 - RNA, 20 nt, Pseudomonas aeruginosa PA01
gcucggauuccagcgcggug

SEQ ID NO: 3493393 - RNA, 17 nt, Pseudomonas aeruginosa PA01
gcucggcaagcgaaccg

SEQ ID NO: 3493394 - RNA, 17 nt, Pseudomonas aeruginosa PA01
gcucggcacgcagcagc

SEQ ID NO: 3493395 - RNA, 18 nt, Pseudomonas aeruginosa PA01
gcucggcacgcagcagcu

SEQ ID NO: 3493396 - RNA, 19 nt, Pseudomonas aeruginosa PA01
gcucggcauucgacccgcc

SEQ ID NO: 3493397 - RNA, 13 nt, Pseudomonas aeruginosa PA01
gcucggccacauu

SEQ ID NO: 3493398 - RNA, 20 nt, Pseudomonas aeruginosa PA01
gcucggccagcgccacggcg

SEQ ID NO: 3493399 - RNA, 13 nt, Pseudomonas aeruginosa PA01
gcucggccagcgu

SEQ ID NO: 3493400 - RNA, 13 nt, Pseudomonas aeruginosa PA01
gcucggccagcuc

SEQ ID NO: 3493401 - RNA, 14 nt, Pseudomonas aeruginosa PA01
gcucggccagcucg

SEQ ID NO: 3493402 - RNA, 18 nt, Pseudomonas aeruginosa PA01
gcucggccagcucgccga

SEQ ID NO: 3493403 - RNA, 19 nt, Pseudomonas aeruginosa PA01
gcucggccagcucgccgaa

SEQ ID NO: 3493404 - RNA, 14 nt, Pseudomonas aeruginosa PA01
gcucggccaggcac

SEQ ID NO: 3493405 - RNA, 14 nt, Pseudomonas aeruginosa PA01
gcucggccagggcc

SEQ ID NO: 3493406 - RNA, 16 nt, Pseudomonas aeruginosa PA01
gcucggccagggccgc

SEQ ID NO: 3493407 - RNA, 18 nt, Pseudomonas aeruginosa PA01
gcucggccagggccgcuc

SEQ ID NO: 3493408 - RNA, 19 nt, Pseudomonas aeruginosa PA01
gcucggccagggccgcucg

SEQ ID NO: 3493409 - RNA, 17 nt, Pseudomonas aeruginosa PA01
gcucggccaggucgcga

SEQ ID NO: 3493410 - RNA, 15 nt, Pseudomonas aeruginosa PA01
gcucggccaguucgc

SEQ ID NO: 3493411 - RNA, 19 nt, Pseudomonas aeruginosa PA01
gcucggccaguucgcggcg

SEQ ID NO: 3493412 - RNA, 21 nt, Pseudomonas aeruginosa PA01
gcucggccaguucgcggcgca

SEQ ID NO: 3493413 - RNA, 20 nt, Pseudomonas aeruginosa PA01
gcucggccaguucgucgagc

SEQ ID NO: 3493414 - RNA, 21 nt, Pseudomonas aeruginosa PA01
gcucggccaguucgucgagca

SEQ ID NO: 3493415 - RNA, 18 nt, Pseudomonas aeruginosa PA01
gcucggccaucagcgcca

SEQ ID NO: 3493416 - RNA, 18 nt, Pseudomonas aeruginosa PA01
gcucggccgagggcagcc

SEQ ID NO: 3493417 - RNA, 19 nt, Pseudomonas aeruginosa PA01
gcucggccgagggcagccu

SEQ ID NO: 3493418 - RNA, 14 nt, Pseudomonas aeruginosa PA01
gcucggccgccagc

SEQ ID NO: 3493419 - RNA, 15 nt, Pseudomonas aeruginosa PA01
gcucggccgccagca

SEQ ID NO: 3493420 - RNA, 15 nt, Pseudomonas aeruginosa PA01
gcucggccgccuggc

SEQ ID NO: 3493421 - RNA, 16 nt, Pseudomonas aeruginosa PA01
gcucggccgccuggcg

SEQ ID NO: 3493422 - RNA, 20 nt, Pseudomonas aeruginosa PA01
gcucggccgccuggcgugcc

SEQ ID NO: 3493423 - RNA, 12 nt, Pseudomonas aeruginosa PA01
gcucggccggca

SEQ ID NO: 3493424 - RNA, 21 nt, Pseudomonas aeruginosa PA01
gcucggccugaucaucugggc

SEQ ID NO: 3493425 - RNA, 23 nt, Pseudomonas aeruginosa PA01
gcucggccugaucaucugggcca

SEQ ID NO: 3493426 - RNA, 17 nt, Pseudomonas aeruginosa PA01
gcucggccuggaucgcc

SEQ ID NO: 3493427 - RNA, 15 nt, Pseudomonas aeruginosa PA01
gcucggccugguccg

SEQ ID NO: 3493428 - RNA, 19 nt, Pseudomonas aeruginosa PA01
gcucggccugguccggcac

SEQ ID NO: 3493429 - RNA, 22 nt, Pseudomonas aeruginosa PA01
gcucggccuguaccgcuuccug

SEQ ID NO: 3493430 - RNA, 20 nt, Pseudomonas aeruginosa PA01
gcucggccuguuuccagaag

SEQ ID NO: 3493431 - RNA, 17 nt, Pseudomonas aeruginosa PA01
gcucggccuugagcgcc

SEQ ID NO: 3493432 - RNA, 20 nt, Pseudomonas aeruginosa PA01
gcucggcgacauagccggcg

SEQ ID NO: 3493433 - RNA, 21 nt, Pseudomonas aeruginosa PA01
gcucggcgacauagccggcga

SEQ ID NO: 3493434 - RNA, 14 nt, Pseudomonas aeruginosa PA01
gcucggcgagccgc

SEQ ID NO: 3493435 - RNA, 22 nt, Pseudomonas aeruginosa PA01
gcucggcgaggaacagcaccag

SEQ ID NO: 3493436 - RNA, 23 nt, Pseudomonas aeruginosa PA01
gcucggcgaggaacagcaccagc

SEQ ID NO: 3493437 - RNA, 17 nt, Pseudomonas aeruginosa PA01
gcucggcgaggccggcg

SEQ ID NO: 3493438 - RNA, 19 nt, Pseudomonas aeruginosa PA01
gcucggcgaguaaccaccg

SEQ ID NO: 3493439 - RNA, 16 nt, Pseudomonas aeruginosa PA01
gcucggcgauccgcgc

SEQ ID NO: 3493440 - RNA, 18 nt, Pseudomonas aeruginosa PA01
gcucggcgauggcgcgcg

SEQ ID NO: 3493441 - RNA, 21 nt, Pseudomonas aeruginosa PA01
gcucggcgauggcgcgcgggc

SEQ ID NO: 3493442 - RNA, 13 nt, Pseudomonas aeruginosa PA01
gcucggcgcccug

SEQ ID NO: 3493443 - RNA, 16 nt, Pseudomonas aeruginosa PA01
gcucggcgcccuggcc

SEQ ID NO: 3493444 - RNA, 18 nt, Pseudomonas aeruginosa PA01
gcucggcgcccuggccgc

SEQ ID NO: 3493445 - RNA, 19 nt, Pseudomonas aeruginosa PA01
gcucggcgcccuggguggu

SEQ ID NO: 3493446 - RNA, 23 nt, Pseudomonas aeruginosa PA01
gcucggcgcccuggguggucugc

SEQ ID NO: 3493447 - RNA, 22 nt, Pseudomonas aeruginosa PA01
gcucggcgcgaugaugccgccg

SEQ ID NO: 3493448 - RNA, 23 nt, Pseudomonas aeruginosa PA01
gcucggcgcgaugaugccgccgu

SEQ ID NO: 3493449 - RNA, 13 nt, Pseudomonas aeruginosa PA01
gcucggcgcucgg

SEQ ID NO: 3493450 - RNA, 14 nt, Pseudomonas aeruginosa PA01
gcucggcgcucggc

SEQ ID NO: 3493451 - RNA, 14 nt, Pseudomonas aeruginosa PA01
gcucggcggcaggc

SEQ ID NO: 3493452 - RNA, 18 nt, Pseudomonas aeruginosa PA01
gcucggcggcaggcugcg

SEQ ID NO: 3493453 - RNA, 22 nt, Pseudomonas aeruginosa PA01
gcucggcggcaggcugcgccgc

SEQ ID NO: 3493454 - RNA, 23 nt, Pseudomonas aeruginosa PA01
gcucggcggccauugccgcgggc

SEQ ID NO: 3493455 - RNA, 13 nt, Pseudomonas aeruginosa PA01
gcucggcggccuc

SEQ ID NO: 3493456 - RNA, 15 nt, Pseudomonas aeruginosa PA01
gcucggcggccucgc

SEQ ID NO: 3493457 - RNA, 15 nt, Pseudomonas aeruginosa PA01
gcucggcggcgcgca

SEQ ID NO: 3493458 - RNA, 13 nt, Pseudomonas aeruginosa PA01
gcucggcgggcug

SEQ ID NO: 3493459 - RNA, 22 nt, Pseudomonas aeruginosa PA01
gcucggcggguauccgccgggc

SEQ ID NO: 3493460 - RNA, 16 nt, Pseudomonas aeruginosa PA01
gcucggcggugaccgg

SEQ ID NO: 3493461 - RNA, 12 nt, Pseudomonas aeruginosa PA01
gcucggcgucca

SEQ ID NO: 3493462 - RNA, 13 nt, Pseudomonas aeruginosa PA01
gcucggcgucguc

SEQ ID NO: 3493463 - RNA, 16 nt, Pseudomonas aeruginosa PA01
gcucggcuccagccag

SEQ ID NO: 3493464 - RNA, 18 nt, Pseudomonas aeruginosa PA01
gcucggcuccagccaggc

SEQ ID NO: 3493465 - RNA, 19 nt, Pseudomonas aeruginosa PA01
gcucggcuccagccaggcc

SEQ ID NO: 3493466 - RNA, 18 nt, Pseudomonas aeruginosa PA01
gcucggcuccaggaccgg

SEQ ID NO: 3493467 - RNA, 14 nt, Pseudomonas aeruginosa PA01
gcucggcucgcggu

SEQ ID NO: 3493468 - RNA, 17 nt, Pseudomonas aeruginosa PA01
gcucggcucgcgguucg

SEQ ID NO: 3493469 - RNA, 12 nt, Pseudomonas aeruginosa PA01
gcucggcuucca

SEQ ID NO: 3493470 - RNA, 16 nt, Pseudomonas aeruginosa PA01
gcucggcuuccaucac

SEQ ID NO: 3493471 - RNA, 14 nt, Pseudomonas aeruginosa PA01
gcucggcuucgcgu

SEQ ID NO: 3493472 - RNA, 18 nt, Pseudomonas aeruginosa PA01
gcucggcuugacuggcag

SEQ ID NO: 3493473 - RNA, 12 nt, Pseudomonas aeruginosa PA01
gcucgggcgcgg

SEQ ID NO: 3493474 - RNA, 13 nt, Pseudomonas aeruginosa PA01
gcucgggcgucuc

SEQ ID NO: 3493475 - RNA, 18 nt, Pseudomonas aeruginosa PA01
gcucgggcgucuccugcc

SEQ ID NO: 3493476 - RNA, 15 nt, Pseudomonas aeruginosa PA01
gcucgggcugccgca

SEQ ID NO: 3493477 - RNA, 16 nt, Pseudomonas aeruginosa PA01
gcucgggcugccgcag

SEQ ID NO: 3493478 - RNA, 17 nt, Pseudomonas aeruginosa PA01
gcucgggcugccgcaga

SEQ ID NO: 3493479 - RNA, 22 nt, Pseudomonas aeruginosa PA01
gcucgggcugccgcagaucauc

SEQ ID NO: 3493480 - RNA, 18 nt, Pseudomonas aeruginosa PA01
gcucggggaacacgcgcu

SEQ ID NO: 3493481 - RNA, 21 nt, Pseudomonas aeruginosa PA01
gcucggggaacacgcgcugga

SEQ ID NO: 3493482 - RNA, 22 nt, Pseudomonas aeruginosa PA01
gcucggggaacacgcgcuggag

SEQ ID NO: 3493483 - RNA, 21 nt, Pseudomonas aeruginosa PA01
gcucggggauguagcggaagu

SEQ ID NO: 3493484 - RNA, 18 nt, Pseudomonas aeruginosa PA01
gcucggggauguccgccg

SEQ ID NO: 3493485 - RNA, 20 nt, Pseudomonas aeruginosa PA01
gcucggggauguccgccgcc

SEQ ID NO: 3493486 - RNA, 22 nt, Pseudomonas aeruginosa PA01
gcucggggauguccgccgccca

SEQ ID NO: 3493487 - RNA, 17 nt, Pseudomonas aeruginosa PA01
gcucggggcaucggcca

SEQ ID NO: 3493488 - RNA, 16 nt, Pseudomonas aeruginosa PA01
gcucggggugcgcggc

SEQ ID NO: 3493489 - RNA, 16 nt, Pseudomonas aeruginosa PA01
gcucgggguuuccucg

SEQ ID NO: 3493490 - RNA, 13 nt, Pseudomonas aeruginosa PA01
gcucggucagcgg

SEQ ID NO: 3493491 - RNA, 17 nt, Pseudomonas aeruginosa PA01
gcucggucagcggcgca

SEQ ID NO: 3493492 - RNA, 15 nt, Pseudomonas aeruginosa PA01
gcucggucagcuccc

SEQ ID NO: 3493493 - RNA, 13 nt, Pseudomonas aeruginosa PA01
gcucggucgagcc

SEQ ID NO: 3493494 - RNA, 15 nt, Pseudomonas aeruginosa PA01
gcucggucgagcccc

SEQ ID NO: 3493495 - RNA, 21 nt, Pseudomonas aeruginosa PA01
gcucggucgagccccacgucg

SEQ ID NO: 3493496 - RNA, 17 nt, Pseudomonas aeruginosa PA01
gcucggucucgaucggc

SEQ ID NO: 3493497 - RNA, 15 nt, Pseudomonas aeruginosa PA01
gcucggugagcaggc

SEQ ID NO: 3493498 - RNA, 20 nt, Pseudomonas aeruginosa PA01
gcucggugagcaggcgccgg

SEQ ID NO: 3493499 - RNA, 12 nt, Pseudomonas aeruginosa PA01
gcucgguggcau

SEQ ID NO: 3493500 - RNA, 18 nt, Pseudomonas aeruginosa PA01
gcucgguucugcgcacca

SEQ ID NO: 3493501 - RNA, 15 nt, Pseudomonas aeruginosa PA01
gcucgguugccaggc

SEQ ID NO: 3493502 - RNA, 19 nt, Pseudomonas aeruginosa PA01
gcucgguugccaggccggc

SEQ ID NO: 3493503 - RNA, 18 nt, Pseudomonas aeruginosa PA01
gcucguagccggcgcggc

SEQ ID NO: 3493504 - RNA, 18 nt, Pseudomonas aeruginosa PA01
gcucgucacccgcgccug

SEQ ID NO: 3493505 - RNA, 14 nt, Pseudomonas aeruginosa PA01
gcucgucaggcgcu

SEQ ID NO: 3493506 - RNA, 18 nt, Pseudomonas aeruginosa PA01
gcucgucauggcgcacgc

SEQ ID NO: 3493507 - RNA, 16 nt, Pseudomonas aeruginosa PA01
gcucgucgagcugcuc

SEQ ID NO: 3493508 - RNA, 21 nt, Pseudomonas aeruginosa PA01
gcucgucgagcugcucggcgg

SEQ ID NO: 3493509 - RNA, 19 nt, Pseudomonas aeruginosa PA01
gcucgucggcguugcugau

SEQ ID NO: 3493510 - RNA, 23 nt, Pseudomonas aeruginosa PA01
gcucgucuuucaggugggccacu

SEQ ID NO: 3493511 - RNA, 15 nt, Pseudomonas aeruginosa PA01
gcucgugcagguagc

SEQ ID NO: 3493512 - RNA, 19 nt, Pseudomonas aeruginosa PA01
gcucgugccaucaggccgc

SEQ ID NO: 3493513 - RNA, 20 nt, Pseudomonas aeruginosa PA01
gcucguggcuggcgccgcgg

SEQ ID NO: 3493514 - RNA, 18 nt, Pseudomonas aeruginosa PA01
gcucguucaugucggcuc

SEQ ID NO: 3493515 - RNA, 13 nt, Pseudomonas aeruginosa PA01
gcucguucgccca

SEQ ID NO: 3493516 - RNA, 14 nt, Pseudomonas aeruginosa PA01
gcucguucgcccag

SEQ ID NO: 3493517 - RNA, 13 nt, Pseudomonas aeruginosa PA01
gcucguugcacag

SEQ ID NO: 3493518 - RNA, 14 nt, Pseudomonas aeruginosa PA01
gcucguugcacagc

SEQ ID NO: 3493519 - RNA, 17 nt, Pseudomonas aeruginosa PA01
gcucguugcacagcgcc

SEQ ID NO: 3493520 - RNA, 18 nt, Pseudomonas aeruginosa PA01
gcucguugcacagcgccc

SEQ ID NO: 3493521 - RNA, 23 nt, Pseudomonas aeruginosa PA01
gcucguugcacagcgcccagaca

SEQ ID NO: 3493522 - RNA, 14 nt, Pseudomonas aeruginosa PA01
gcucguugcccggc

SEQ ID NO: 3493523 - RNA, 15 nt, Pseudomonas aeruginosa PA01
gcucguugcgccgcu

SEQ ID NO: 3493524 - RNA, 22 nt, Pseudomonas aeruginosa PA01
gcucguugcgccgcuccuggca

SEQ ID NO: 3493525 - RNA, 16 nt, Pseudomonas aeruginosa PA01
gcucguuggcggccag

SEQ ID NO: 3493526 - RNA, 23 nt, Pseudomonas aeruginosa PA01
gcucuaucgacgguuucaggccu

SEQ ID NO: 3493527 - RNA, 20 nt, Pseudomonas aeruginosa PA01
gcucuccacuaccgccgagg

SEQ ID NO: 3493528 - RNA, 23 nt, Pseudomonas aeruginosa PA01
gcucuccacuaccgccgagggcg

SEQ ID NO: 3493529 - RNA, 17 nt, Pseudomonas aeruginosa PA01
gcucucccgaggcgauc

SEQ ID NO: 3493530 - RNA, 19 nt, Pseudomonas aeruginosa PA01
gcucucgaacaccaggcgc

SEQ ID NO: 3493531 - RNA, 23 nt, Pseudomonas aeruginosa PA01
gcucucgaacaccaggcgccagg

SEQ ID NO: 3493532 - RNA, 20 nt, Pseudomonas aeruginosa PA01
gcucucgaacaccggcgagc

SEQ ID NO: 3493533 - RNA, 21 nt, Pseudomonas aeruginosa PA01
gcucucgaacaccggcgagca

SEQ ID NO: 3493534 - RNA, 15 nt, Pseudomonas aeruginosa PA01
gcucucgaacagcag

SEQ ID NO: 3493535 - RNA, 16 nt, Pseudomonas aeruginosa PA01
gcucucgaacagcagc

SEQ ID NO: 3493536 - RNA, 22 nt, Pseudomonas aeruginosa PA01
gcucucgaacagcagcaagccg

SEQ ID NO: 3493537 - RNA, 14 nt, Pseudomonas aeruginosa PA01
gcucucgagcaugc

SEQ ID NO: 3493538 - RNA, 13 nt, Pseudomonas aeruginosa PA01
gcucucgccgcgc

SEQ ID NO: 3493539 - RNA, 15 nt, Pseudomonas aeruginosa PA01
gcucucgccggccug

SEQ ID NO: 3493540 - RNA, 15 nt, Pseudomonas aeruginosa PA01
gcucucgcgcacgcu

SEQ ID NO: 3493541 - RNA, 16 nt, Pseudomonas aeruginosa PA01
gcucucgcgcagcagg

SEQ ID NO: 3493542 - RNA, 20 nt, Pseudomonas aeruginosa PA01
gcucucgcgcagcaggaucc

SEQ ID NO: 3493543 - RNA, 12 nt, Pseudomonas aeruginosa PA01
gcucugcagugc

SEQ ID NO: 3493544 - RNA, 18 nt, Pseudomonas aeruginosa PA01
gcucugccagaaggccug

SEQ ID NO: 3493545 - RNA, 19 nt, Pseudomonas aeruginosa PA01
gcucugccagaaggccugc

SEQ ID NO: 3493546 - RNA, 22 nt, Pseudomonas aeruginosa PA01
gcucugccagaaggccugcgcu

SEQ ID NO: 3493547 - RNA, 21 nt, Pseudomonas aeruginosa PA01
gcucugcccgaccggguugau

SEQ ID NO: 3493548 - RNA, 21 nt, Pseudomonas aeruginosa PA01
gcucugcgacuggaugcagcc

SEQ ID NO: 3493549 - RNA, 17 nt, Pseudomonas aeruginosa PA01
gcucugcgaucagggcc

SEQ ID NO: 3493550 - RNA, 13 nt, Pseudomonas aeruginosa PA01
gcucugcgccagg

SEQ ID NO: 3493551 - RNA, 15 nt, Pseudomonas aeruginosa PA01
gcucugcgccaggcg

SEQ ID NO: 3493552 - RNA, 13 nt, Pseudomonas aeruginosa PA01
gcucugcgccgcg

SEQ ID NO: 3493553 - RNA, 13 nt, Pseudomonas aeruginosa PA01
gcucugcuccagc

SEQ ID NO: 3493554 - RNA, 16 nt, Pseudomonas aeruginosa PA01
gcucugcuccagcaau

SEQ ID NO: 3493555 - RNA, 20 nt, Pseudomonas aeruginosa PA01
gcucugcucggccagcgcca

SEQ ID NO: 3493556 - RNA, 13 nt, Pseudomonas aeruginosa PA01
gcucugcuggcca

SEQ ID NO: 3493557 - RNA, 14 nt, Pseudomonas aeruginosa PA01
gcucugcuggccac

SEQ ID NO: 3493558 - RNA, 16 nt, Pseudomonas aeruginosa PA01
gcucugcuggccgccc

SEQ ID NO: 3493559 - RNA, 22 nt, Pseudomonas aeruginosa PA01
gcucugcuggccgcccuugcgg

SEQ ID NO: 3493560 - RNA, 14 nt, Pseudomonas aeruginosa PA01
gcucugcuggcugu

SEQ ID NO: 3493561 - RNA, 17 nt, Pseudomonas aeruginosa PA01
gcucugcuucugucccu

SEQ ID NO: 3493562 - RNA, 18 nt, Pseudomonas aeruginosa PA01
gcucuggaugcggcgcug

SEQ ID NO: 3493563 - RNA, 13 nt, Pseudomonas aeruginosa PA01
gcucuggcccagc

SEQ ID NO: 3493564 - RNA, 14 nt, Pseudomonas aeruginosa PA01
gcucuggccgcgcu

SEQ ID NO: 3493565 - RNA, 17 nt, Pseudomonas aeruginosa PA01
gcucuggccgcgcucca

SEQ ID NO: 3493566 - RNA, 19 nt, Pseudomonas aeruginosa PA01
gcucuggccgcgcuccaac

SEQ ID NO: 3493567 - RNA, 16 nt, Pseudomonas aeruginosa PA01
gcucuggccguccugc

SEQ ID NO: 3493568 - RNA, 19 nt, Pseudomonas aeruginosa PA01
gcucuggccguucuccagg

SEQ ID NO: 3493569 - RNA, 20 nt, Pseudomonas aeruginosa PA01
gcucuggccguucuccaggu

SEQ ID NO: 3493570 - RNA, 23 nt, Pseudomonas aeruginosa PA01
gcucuggccguucuccaggucga

SEQ ID NO: 3493571 - RNA, 17 nt, Pseudomonas aeruginosa PA01
gcucuggcgcagggaga

SEQ ID NO: 3493572 - RNA, 21 nt, Pseudomonas aeruginosa PA01
gcucuggcgcauagcggccau

SEQ ID NO: 3493573 - RNA, 17 nt, Pseudomonas aeruginosa PA01
gcucuggcugcuggcga

SEQ ID NO: 3493574 - RNA, 18 nt, Pseudomonas aeruginosa PA01
gcucugggcauggcuggc

SEQ ID NO: 3493575 - RNA, 15 nt, Pseudomonas aeruginosa PA01
gcucuggguacagug

SEQ ID NO: 3493576 - RNA, 23 nt, Pseudomonas aeruginosa PA01
gcucugguucggcgucuucggcg

SEQ ID NO: 3493577 - RNA, 17 nt, Pseudomonas aeruginosa PA01
gcucuguuucgggucgc

SEQ ID NO: 3493578 - RNA, 22 nt, Pseudomonas aeruginosa PA01
gcucuucacauggugggcgccg

SEQ ID NO: 3493579 - RNA, 21 nt, Pseudomonas aeruginosa PA01
gcucuucacuuccagcugcca

SEQ ID NO: 3493580 - RNA, 16 nt, Pseudomonas aeruginosa PA01
gcucuucagcacgccc

SEQ ID NO: 3493581 - RNA, 14 nt, Pseudomonas aeruginosa PA01
gcucuucagcgguc

SEQ ID NO: 3493582 - RNA, 21 nt, Pseudomonas aeruginosa PA01
gcucuuccaggugauccaugu

SEQ ID NO: 3493583 - RNA, 12 nt, Pseudomonas aeruginosa PA01
gcucuuccuugu

SEQ ID NO: 3493584 - RNA, 21 nt, Pseudomonas aeruginosa PA01
gcucuucgccaguuccuugag

SEQ ID NO: 3493585 - RNA, 15 nt, Pseudomonas aeruginosa PA01
gcucuucgccgcggc

SEQ ID NO: 3493586 - RNA, 16 nt, Pseudomonas aeruginosa PA01
gcucuucggcggccag

SEQ ID NO: 3493587 - RNA, 19 nt, Pseudomonas aeruginosa PA01
gcucuucggcggccagcgg

SEQ ID NO: 3493588 - RNA, 21 nt, Pseudomonas aeruginosa PA01
gcucuucggcggccagcggau

SEQ ID NO: 3493589 - RNA, 21 nt, Pseudomonas aeruginosa PA01
gcucuucugguaggccagcag

SEQ ID NO: 3493590 - RNA, 20 nt, Pseudomonas aeruginosa PA01
gcucuugauacccaccggcu

SEQ ID NO: 3493591 - RNA, 20 nt, Pseudomonas aeruginosa PA01
gcucuugaucgucucggugc

SEQ ID NO: 3493592 - RNA, 23 nt, Pseudomonas aeruginosa PA01
gcucuugccgacaagccuccagc

SEQ ID NO: 3493593 - RNA, 22 nt, Pseudomonas aeruginosa PA01
gcucuugccgcgagcuuggccc

SEQ ID NO: 3493594 - RNA, 21 nt, Pseudomonas aeruginosa PA01
gcucuugggcucugccuucag

SEQ ID NO: 3493595 - RNA, 18 nt, Pseudomonas aeruginosa PA01
gcucuuggucgcggucug

SEQ ID NO: 3493596 - RNA, 20 nt, Pseudomonas aeruginosa PA01
gcucuuucauugcgcacggu

SEQ ID NO: 3493597 - RNA, 20 nt, Pseudomonas aeruginosa PA01
gcucuuucguuucagcgcca

SEQ ID NO: 3493598 - RNA, 18 nt, Pseudomonas aeruginosa PA01
gcugaaaaacgccugggc

SEQ ID NO: 3493599 - RNA, 15 nt, Pseudomonas aeruginosa PA01
gcugaaacgcgcguc

SEQ ID NO: 3493600 - RNA, 22 nt, Pseudomonas aeruginosa PA01
gcugaaagcgauagccggggcc

SEQ ID NO: 3493601 - RNA, 18 nt, Pseudomonas aeruginosa PA01
gcugaaauccaccagcac

SEQ ID NO: 3493602 - RNA, 16 nt, Pseudomonas aeruginosa PA01
gcugaacaagcccugg

SEQ ID NO: 3493603 - RNA, 14 nt, Pseudomonas aeruginosa PA01
gcugaacagcgcca

SEQ ID NO: 3493604 - RNA, 23 nt, Pseudomonas aeruginosa PA01
gcugaagacccugcacaucaccu

SEQ ID NO: 3493605 - RNA, 17 nt, Pseudomonas aeruginosa PA01
gcugaagauaucgccuu

SEQ ID NO: 3493606 - RNA, 15 nt, Pseudomonas aeruginosa PA01
gcugaagaucgccac

SEQ ID NO: 3493607 - RNA, 14 nt, Pseudomonas aeruginosa PA01
gcugaagcccaggc

SEQ ID NO: 3493608 - RNA, 21 nt, Pseudomonas aeruginosa PA01
gcugaagcccaggcgucgcgc

SEQ ID NO: 3493609 - RNA, 24 nt, Pseudomonas aeruginosa PA01
gcugaagcccaggcgucgcgccag

SEQ ID NO: 3493610 - RNA, 20 nt, Pseudomonas aeruginosa PA01
gcugaagccccagcccaggg

SEQ ID NO: 3493611 - RNA, 14 nt, Pseudomonas aeruginosa PA01
gcugaagcgccgcg

SEQ ID NO: 3493612 - RNA, 15 nt, Pseudomonas aeruginosa PA01
gcugaagcgccgcgg

SEQ ID NO: 3493613 - RNA, 17 nt, Pseudomonas aeruginosa PA01
gcugaagcgccgcggcc

SEQ ID NO: 3493614 - RNA, 14 nt, Pseudomonas aeruginosa PA01
gcugaagcggccga

SEQ ID NO: 3493615 - RNA, 16 nt, Pseudomonas aeruginosa PA01
gcugaagcggccgaga

SEQ ID NO: 3493616 - RNA, 16 nt, Pseudomonas aeruginosa PA01
gcugaagcggccgccg

SEQ ID NO: 3493617 - RNA, 17 nt, Pseudomonas aeruginosa PA01
gcugaaggacugugccu

SEQ ID NO: 3493618 - RNA, 13 nt, Pseudomonas aeruginosa PA01
gcugaaggcggug

SEQ ID NO: 3493619 - RNA, 17 nt, Pseudomonas aeruginosa PA01
gcugaaggucgccgcgc

SEQ ID NO: 3493620 - RNA, 18 nt, Pseudomonas aeruginosa PA01
gcugaaggucgccgcgcu

SEQ ID NO: 3493621 - RNA, 15 nt, Pseudomonas aeruginosa PA01
gcugaaguccuggcc

SEQ ID NO: 3493622 - RNA, 17 nt, Pseudomonas aeruginosa PA01
gcugaaguccuggccga

SEQ ID NO: 3493623 - RNA, 20 nt, Pseudomonas aeruginosa PA01
gcugaaguccuggccgagca

SEQ ID NO: 3493624 - RNA, 17 nt, Pseudomonas aeruginosa PA01
gcugaagugggucgccg

SEQ ID NO: 3493625 - RNA, 23 nt, Pseudomonas aeruginosa PA01
gcugaauaccacguggccggcgc

SEQ ID NO: 3493626 - RNA, 15 nt, Pseudomonas aeruginosa PA01
gcugacauccaccag

SEQ ID NO: 3493627 - RNA, 18 nt, Pseudomonas aeruginosa PA01
gcugaccaccagggcgau

SEQ ID NO: 3493628 - RNA, 17 nt, Pseudomonas aeruginosa PA01
gcugaccacccggugca

SEQ ID NO: 3493629 - RNA, 17 nt, Pseudomonas aeruginosa PA01
gcugaccagcccggcgg

SEQ ID NO: 3493630 - RNA, 18 nt, Pseudomonas aeruginosa PA01
gcugaccagcccggcggc

SEQ ID NO: 3493631 - RNA, 20 nt, Pseudomonas aeruginosa PA01
gcugaccagcccggcggcgg

SEQ ID NO: 3493632 - RNA, 22 nt, Pseudomonas aeruginosa PA01
gcugaccagcccggcggcggca

SEQ ID NO: 3493633 - RNA, 14 nt, Pseudomonas aeruginosa PA01
gcugaccaggucgu

SEQ ID NO: 3493634 - RNA, 14 nt, Pseudomonas aeruginosa PA01
gcugacccagcgca

SEQ ID NO: 3493635 - RNA, 22 nt, Pseudomonas aeruginosa PA01
gcugacccaggcuucggcgcgc

SEQ ID NO: 3493636 - RNA, 15 nt, Pseudomonas aeruginosa PA01
gcugacccgcugcug

SEQ ID NO: 3493637 - RNA, 19 nt, Pseudomonas aeruginosa PA01
gcugacccgcuguccgccg

SEQ ID NO: 3493638 - RNA, 21 nt, Pseudomonas aeruginosa PA01
gcugaccgcgugggccggcau

SEQ ID NO: 3493639 - RNA, 19 nt, Pseudomonas aeruginosa PA01
gcugaccgcucccaggcaa

SEQ ID NO: 3493640 - RNA, 16 nt, Pseudomonas aeruginosa PA01
gcugaccggcaucgac

SEQ ID NO: 3493641 - RNA, 14 nt, Pseudomonas aeruginosa PA01
gcugaccucgagcu

SEQ ID NO: 3493642 - RNA, 13 nt, Pseudomonas aeruginosa PA01
gcugaccuggucg

SEQ ID NO: 3493643 - RNA, 20 nt, Pseudomonas aeruginosa PA01
gcugaccuucacuucgcgcg

SEQ ID NO: 3493644 - RNA, 15 nt, Pseudomonas aeruginosa PA01
gcugacgaacaucgc

SEQ ID NO: 3493645 - RNA, 16 nt, Pseudomonas aeruginosa PA01
gcugacgaacaucgcc

SEQ ID NO: 3493646 - RNA, 17 nt, Pseudomonas aeruginosa PA01
gcugacgaacaucgcca

SEQ ID NO: 3493647 - RNA, 19 nt, Pseudomonas aeruginosa PA01
gcugacgaacaucgccagc

SEQ ID NO: 3493648 - RNA, 22 nt, Pseudomonas aeruginosa PA01
gcugacgaacaucgccagcgcc

SEQ ID NO: 3493649 - RNA, 17 nt, Pseudomonas aeruginosa PA01
gcugacgaaguccuugu

SEQ ID NO: 3493650 - RNA, 16 nt, Pseudomonas aeruginosa PA01
gcugacgaggacgccg

SEQ ID NO: 3493651 - RNA, 17 nt, Pseudomonas aeruginosa PA01
gcugacgaggacgccgc

SEQ ID NO: 3493652 - RNA, 20 nt, Pseudomonas aeruginosa PA01
gcugacgaggacgccgccgg

SEQ ID NO: 3493653 - RNA, 22 nt, Pseudomonas aeruginosa PA01
gcugacgccauucaggcggauc

SEQ ID NO: 3493654 - RNA, 13 nt, Pseudomonas aeruginosa PA01
gcugacgccggca

SEQ ID NO: 3493655 - RNA, 22 nt, Pseudomonas aeruginosa PA01
gcugacgcuggcgaaggcgcuc

SEQ ID NO: 3493656 - RNA, 21 nt, Pseudomonas aeruginosa PA01
gcugacggcaaggaccugcug

SEQ ID NO: 3493657 - RNA, 11 nt, Pseudomonas aeruginosa PA01
gcugacggcgu

SEQ ID NO: 3493658 - RNA, 17 nt, Pseudomonas aeruginosa PA01
gcugacggcguggcgga

SEQ ID NO: 3493659 - RNA, 19 nt, Pseudomonas aeruginosa PA01
gcugacggcguggcggaua

SEQ ID NO: 3493660 - RNA, 18 nt, Pseudomonas aeruginosa PA01
gcugacggucugccagcu

SEQ ID NO: 3493661 - RNA, 19 nt, Pseudomonas aeruginosa PA01
gcugacgucgacgcagcgc

SEQ ID NO: 3493662 - RNA, 20 nt, Pseudomonas aeruginosa PA01
gcugagaccgauccagcagu

SEQ ID NO: 3493663 - RNA, 16 nt, Pseudomonas aeruginosa PA01
gcugagaccuuccugc

SEQ ID NO: 3493664 - RNA, 15 nt, Pseudomonas aeruginosa PA01
gcugagcaccgggac

SEQ ID NO: 3493665 - RNA, 16 nt, Pseudomonas aeruginosa PA01
gcugagcagcaggugg

SEQ ID NO: 3493666 - RNA, 23 nt, Pseudomonas aeruginosa PA01
gcugagcagcagguggcaagccu

SEQ ID NO: 3493667 - RNA, 16 nt, Pseudomonas aeruginosa PA01
gcugagcaggccgacg

SEQ ID NO: 3493668 - RNA, 23 nt, Pseudomonas aeruginosa PA01
gcugagcaggccgacggcgcgcu

SEQ ID NO: 3493669 - RNA, 15 nt, Pseudomonas aeruginosa PA01
gcugagcagucgccu

SEQ ID NO: 3493670 - RNA, 16 nt, Pseudomonas aeruginosa PA01
gcugagcagucgccug

SEQ ID NO: 3493671 - RNA, 17 nt, Pseudomonas aeruginosa PA01
gcugagcagucgccugg

SEQ ID NO: 3493672 - RNA, 18 nt, Pseudomonas aeruginosa PA01
gcugagcaguugcgggcg

SEQ ID NO: 3493673 - RNA, 20 nt, Pseudomonas aeruginosa PA01
gcugagcaguugcgggcgca

SEQ ID NO: 3493674 - RNA, 13 nt, Pseudomonas aeruginosa PA01
gcugagcgccagg

SEQ ID NO: 3493675 - RNA, 19 nt, Pseudomonas aeruginosa PA01
gcugagcgccaggcgcaag

SEQ ID NO: 3493676 - RNA, 13 nt, Pseudomonas aeruginosa PA01
gcugagcggcugg

SEQ ID NO: 3493677 - RNA, 15 nt, Pseudomonas aeruginosa PA01
gcugaggaagagcag

SEQ ID NO: 3493678 - RNA, 18 nt, Pseudomonas aeruginosa PA01
gcugaggaagagcagcgc

SEQ ID NO: 3493679 - RNA, 16 nt, Pseudomonas aeruginosa PA01
gcugaggacugccagg

SEQ ID NO: 3493680 - RNA, 22 nt, Pseudomonas aeruginosa PA01
gcugaggacugccaggguaccg

SEQ ID NO: 3493681 - RNA, 20 nt, Pseudomonas aeruginosa PA01
gcugaggaucacgauggccg

SEQ ID NO: 3493682 - RNA, 22 nt, Pseudomonas aeruginosa PA01
gcugaggaucacgauggccggc

SEQ ID NO: 3493683 - RNA, 15 nt, Pseudomonas aeruginosa PA01
gcugaggaucagcca

SEQ ID NO: 3493684 - RNA, 15 nt, Pseudomonas aeruginosa PA01
gcugaggccgacgaa

SEQ ID NO: 3493685 - RNA, 19 nt, Pseudomonas aeruginosa PA01
gcugaggccgacgaacagc

SEQ ID NO: 3493686 - RNA, 13 nt, Pseudomonas aeruginosa PA01
gcugaggccgccc

SEQ ID NO: 3493687 - RNA, 14 nt, Pseudomonas aeruginosa PA01
gcugaggccgcccu

SEQ ID NO: 3493688 - RNA, 17 nt, Pseudomonas aeruginosa PA01
gcugaggcucagcgcgc

SEQ ID NO: 3493689 - RNA, 15 nt, Pseudomonas aeruginosa PA01
gcugaggcucgccgg

SEQ ID NO: 3493690 - RNA, 15 nt, Pseudomonas aeruginosa PA01
gcugaggggugagaa

SEQ ID NO: 3493691 - RNA, 21 nt, Pseudomonas aeruginosa PA01
gcugaggguggaacccauggc

SEQ ID NO: 3493692 - RNA, 17 nt, Pseudomonas aeruginosa PA01
gcugaggucgcgggcga

SEQ ID NO: 3493693 - RNA, 21 nt, Pseudomonas aeruginosa PA01
gcugagucgcuucacucaucc

SEQ ID NO: 3493694 - RNA, 18 nt, Pseudomonas aeruginosa PA01
gcugaguucgucgagcau

SEQ ID NO: 3493695 - RNA, 16 nt, Pseudomonas aeruginosa PA01
gcugaguuugcccagc

SEQ ID NO: 3493696 - RNA, 21 nt, Pseudomonas aeruginosa PA01
gcugaguuugcccagcgccgc

SEQ ID NO: 3493697 - RNA, 23 nt, Pseudomonas aeruginosa PA01
gcugaguuugcccagcgccgccu

SEQ ID NO: 3493698 - RNA, 14 nt, Pseudomonas aeruginosa PA01
gcugaucagcaccc

SEQ ID NO: 3493699 - RNA, 16 nt, Pseudomonas aeruginosa PA01
gcugaucagcccgcug

SEQ ID NO: 3493700 - RNA, 19 nt, Pseudomonas aeruginosa PA01
gcugaucagcccgcugagg

SEQ ID NO: 3493701 - RNA, 22 nt, Pseudomonas aeruginosa PA01
gcugaucaggaggaucgccagg

SEQ ID NO: 3493702 - RNA, 14 nt, Pseudomonas aeruginosa PA01
gcugaucaggccga

SEQ ID NO: 3493703 - RNA, 15 nt, Pseudomonas aeruginosa PA01
gcugaucaguaccgg

SEQ ID NO: 3493704 - RNA, 23 nt, Pseudomonas aeruginosa PA01
gcugaucaguaccggcagcgccg

SEQ ID NO: 3493705 - RNA, 17 nt, Pseudomonas aeruginosa PA01
gcugaucaucagcaggg

SEQ ID NO: 3493706 - RNA, 20 nt, Pseudomonas aeruginosa PA01
gcugaucaucagcaggguca

SEQ ID NO: 3493707 - RNA, 22 nt, Pseudomonas aeruginosa PA01
gcugaucaucagcagggucagg

SEQ ID NO: 3493708 - RNA, 19 nt, Pseudomonas aeruginosa PA01
gcugaucaucgagaacagg

SEQ ID NO: 3493709 - RNA, 20 nt, Pseudomonas aeruginosa PA01
gcugaucgcgcagaucgccg

SEQ ID NO: 3493710 - RNA, 21 nt, Pseudomonas aeruginosa PA01
gcugaucgcgcagaucgccgc

SEQ ID NO: 3493711 - RNA, 15 nt, Pseudomonas aeruginosa PA01
gcugaucggccgcca

SEQ ID NO: 3493712 - RNA, 16 nt, Pseudomonas aeruginosa PA01
gcugaucggccgccag

SEQ ID NO: 3493713 - RNA, 19 nt, Pseudomonas aeruginosa PA01
gcugaucggccgccagugc

SEQ ID NO: 3493714 - RNA, 17 nt, Pseudomonas aeruginosa PA01
gcugaucggcgcgccgg

SEQ ID NO: 3493715 - RNA, 18 nt, Pseudomonas aeruginosa PA01
gcugaucggcgcgccggc

SEQ ID NO: 3493716 - RNA, 15 nt, Pseudomonas aeruginosa PA01
gcugaucucggcgac

SEQ ID NO: 3493717 - RNA, 14 nt, Pseudomonas aeruginosa PA01
gcugaucugccggu

SEQ ID NO: 3493718 - RNA, 15 nt, Pseudomonas aeruginosa PA01
gcugaucuucugucc

SEQ ID NO: 3493719 - RNA, 13 nt, Pseudomonas aeruginosa PA01
gcugaugcccggg

SEQ ID NO: 3493720 - RNA, 20 nt, Pseudomonas aeruginosa PA01
gcugauugcgggccuuggcg

SEQ ID NO: 3493721 - RNA, 18 nt, Pseudomonas aeruginosa PA01
gcugcaaaaaagcgcgcc

SEQ ID NO: 3493722 - RNA, 15 nt, Pseudomonas aeruginosa PA01
gcugcaacauggcgu

SEQ ID NO: 3493723 - RNA, 16 nt, Pseudomonas aeruginosa PA01
gcugcaacauggcguc

SEQ ID NO: 3493724 - RNA, 15 nt, Pseudomonas aeruginosa PA01
gcugcaacgccgcgg

SEQ ID NO: 3493725 - RNA, 16 nt, Pseudomonas aeruginosa PA01
gcugcaacgccggccc

SEQ ID NO: 3493726 - RNA, 18 nt, Pseudomonas aeruginosa PA01
gcugcaacuccgccuguc

SEQ ID NO: 3493727 - RNA, 19 nt, Pseudomonas aeruginosa PA01
gcugcaaggcuucggcggu

SEQ ID NO: 3493728 - RNA, 21 nt, Pseudomonas aeruginosa PA01
gcugcaaggcuucggcgguca

SEQ ID NO: 3493729 - RNA, 17 nt, Pseudomonas aeruginosa PA01
gcugcaaucgcugccgg

SEQ ID NO: 3493730 - RNA, 19 nt, Pseudomonas aeruginosa PA01
gcugcaaucgcugccgguc

SEQ ID NO: 3493731 - RNA, 22 nt, Pseudomonas aeruginosa PA01
gcugcaaucgcugccggucagg

SEQ ID NO: 3493732 - RNA, 15 nt, Pseudomonas aeruginosa PA01
gcugcaauucgucgg

SEQ ID NO: 3493733 - RNA, 19 nt, Pseudomonas aeruginosa PA01
gcugcaauucgucggccug

SEQ ID NO: 3493734 - RNA, 15 nt, Pseudomonas aeruginosa PA01
gcugcaccagcaggu

SEQ ID NO: 3493735 - RNA, 16 nt, Pseudomonas aeruginosa PA01
gcugcaccagcuucuu

SEQ ID NO: 3493736 - RNA, 16 nt, Pseudomonas aeruginosa PA01
gcugcaccgcgcggau

SEQ ID NO: 3493737 - RNA, 17 nt, Pseudomonas aeruginosa PA01
gcugcacgcacgcgccu

SEQ ID NO: 3493738 - RNA, 19 nt, Pseudomonas aeruginosa PA01
gcugcacgcacgcgccugc

SEQ ID NO: 3493739 - RNA, 20 nt, Pseudomonas aeruginosa PA01
gcugcacgcacgcgccugcu

SEQ ID NO: 3493740 - RNA, 18 nt, Pseudomonas aeruginosa PA01
gcugcacguuguugccca

SEQ ID NO: 3493741 - RNA, 20 nt, Pseudomonas aeruginosa PA01
gcugcacguuguugcccacc

SEQ ID NO: 3493742 - RNA, 22 nt, Pseudomonas aeruginosa PA01
gcugcacguuguugcccaccuc

SEQ ID NO: 3493743 - RNA, 13 nt, Pseudomonas aeruginosa PA01
gcugcagcaucag

SEQ ID NO: 3493744 - RNA, 14 nt, Pseudomonas aeruginosa PA01
gcugcagcgcccca

SEQ ID NO: 3493745 - RNA, 12 nt, Pseudomonas aeruginosa PA01
gcugcaggccac

SEQ ID NO: 3493746 - RNA, 12 nt, Pseudomonas aeruginosa PA01
gcugcaggccga

SEQ ID NO: 3493747 - RNA, 20 nt, Pseudomonas aeruginosa PA01
gcugcaggccgagaccgcag

SEQ ID NO: 3493748 - RNA, 13 nt, Pseudomonas aeruginosa PA01
gcugcagggccag

SEQ ID NO: 3493749 - RNA, 16 nt, Pseudomonas aeruginosa PA01
gcugcagggccaggga

SEQ ID NO: 3493750 - RNA, 15 nt, Pseudomonas aeruginosa PA01
gcugcagggccucgc

SEQ ID NO: 3493751 - RNA, 15 nt, Pseudomonas aeruginosa PA01
gcugcagggcggcgc

SEQ ID NO: 3493752 - RNA, 16 nt, Pseudomonas aeruginosa PA01
gcugcagggcggcgcu

SEQ ID NO: 3493753 - RNA, 19 nt, Pseudomonas aeruginosa PA01
gcugcagguaggcgguggc

SEQ ID NO: 3493754 - RNA, 20 nt, Pseudomonas aeruginosa PA01
gcugcagguaggcgguggcg

SEQ ID NO: 3493755 - RNA, 13 nt, Pseudomonas aeruginosa PA01
gcugcagguggcg

SEQ ID NO: 3493756 - RNA, 15 nt, Pseudomonas aeruginosa PA01
gcugcaucggcgcgc

SEQ ID NO: 3493757 - RNA, 16 nt, Pseudomonas aeruginosa PA01
gcugcaucggcgcgcc

SEQ ID NO: 3493758 - RNA, 18 nt, Pseudomonas aeruginosa PA01
gcugcaucggcgcgccga

SEQ ID NO: 3493759 - RNA, 22 nt, Pseudomonas aeruginosa PA01
gcugcaucggcgcgccgaaggc

SEQ ID NO: 3493760 - RNA, 23 nt, Pseudomonas aeruginosa PA01
gcugcaugaaaaagcccggccgc

SEQ ID NO: 3493761 - RNA, 16 nt, Pseudomonas aeruginosa PA01
gcugcaugccgggguc

SEQ ID NO: 3493762 - RNA, 23 nt, Pseudomonas aeruginosa PA01
gcugcaugcggaacaccgccugg

SEQ ID NO: 3493763 - RNA, 20 nt, Pseudomonas aeruginosa PA01
gcugcaugggcucgcgcggg

SEQ ID NO: 3493764 - RNA, 22 nt, Pseudomonas aeruginosa PA01
gcugcaugggcucgcgcggggc

SEQ ID NO: 3493765 - RNA, 21 nt, Pseudomonas aeruginosa PA01
gcugcauguccgcaggcaggu

SEQ ID NO: 3493766 - RNA, 16 nt, Pseudomonas aeruginosa PA01
gcugcauguccgccag

SEQ ID NO: 3493767 - RNA, 18 nt, Pseudomonas aeruginosa PA01
gcugcaugugccaggccu

SEQ ID NO: 3493768 - RNA, 23 nt, Pseudomonas aeruginosa PA01
gcggcgagcaucucggccaggcc

SEQ ID NO: 3493769 - RNA, 14 nt, Pseudomonas aeruginosa PA01
gcggcgagcggguc

SEQ ID NO: 3493770 - RNA, 14 nt, Pseudomonas aeruginosa PA01
gcggcgagggcgcc

SEQ ID NO: 3493771 - RNA, 15 nt, Pseudomonas aeruginosa PA01
gcggcgagggcgccg

SEQ ID NO: 3493772 - RNA, 16 nt, Pseudomonas aeruginosa PA01
gcggcgagggcgccgg

SEQ ID NO: 3493773 - RNA, 14 nt, Pseudomonas aeruginosa PA01
gcggcgagguugcc

SEQ ID NO: 3493774 - RNA, 20 nt, Pseudomonas aeruginosa PA01
gcggcgagguugcccacggc

SEQ ID NO: 3493775 - RNA, 21 nt, Pseudomonas aeruginosa PA01
gcggcgagguugcccacggcc

SEQ ID NO: 3493776 - RNA, 23 nt, Pseudomonas aeruginosa PA01
gcggcgagguugcccacggccag

SEQ ID NO: 3493777 - RNA, 16 nt, Pseudomonas aeruginosa PA01
gcggcgaguugcgcga

SEQ ID NO: 3493778 - RNA, 18 nt, Pseudomonas aeruginosa PA01
gcggcgaguugcgcgagg

SEQ ID NO: 3493779 - RNA, 21 nt, Pseudomonas aeruginosa PA01
gcggcgaguuuguugcgcgag

SEQ ID NO: 3493780 - RNA, 17 nt, Pseudomonas aeruginosa PA01
gcggcgauaggcgcgca

SEQ ID NO: 3493781 - RNA, 14 nt, Pseudomonas aeruginosa PA01
gcggcgaucgccug

SEQ ID NO: 3493782 - RNA, 16 nt, Pseudomonas aeruginosa PA01
gcggcgaucgccuggu

SEQ ID NO: 3493783 - RNA, 18 nt, Pseudomonas aeruginosa PA01
gcggcgaucgccuggucg

SEQ ID NO: 3493784 - RNA, 15 nt, Pseudomonas aeruginosa PA01
gcggcgaucuucucc

SEQ ID NO: 3493785 - RNA, 18 nt, Pseudomonas aeruginosa PA01
gcggcgaucuucuccgcc

SEQ ID NO: 3493786 - RNA, 21 nt, Pseudomonas aeruginosa PA01
gcggcgaugaccaggguggcg

SEQ ID NO: 3493787 - RNA, 17 nt, Pseudomonas aeruginosa PA01
gcggcgaugaucggcag

SEQ ID NO: 3493788 - RNA, 16 nt, Pseudomonas aeruginosa PA01
gcggcgaugcgcaugc

SEQ ID NO: 3493789 - RNA, 20 nt, Pseudomonas aeruginosa PA01
gcggcgaugcgcaugcgcag

SEQ ID NO: 3493790 - RNA, 21 nt, Pseudomonas aeruginosa PA01
gcggcgaugcgcaugcgcagc

SEQ ID NO: 3493791 - RNA, 13 nt, Pseudomonas aeruginosa PA01
gcggcgauggacu

SEQ ID NO: 3493792 - RNA, 18 nt, Pseudomonas aeruginosa PA01
gcggcgauggacucgauc

SEQ ID NO: 3493793 - RNA, 15 nt, Pseudomonas aeruginosa PA01
gcggcgauggccgcc

SEQ ID NO: 3493794 - RNA, 18 nt, Pseudomonas aeruginosa PA01
gcggcgauggccgccagc

SEQ ID NO: 3493795 - RNA, 20 nt, Pseudomonas aeruginosa PA01
gcggcgauggccgccagcag

SEQ ID NO: 3493796 - RNA, 16 nt, Pseudomonas aeruginosa PA01
gcggcgauggcgucca

SEQ ID NO: 3493797 - RNA, 20 nt, Pseudomonas aeruginosa PA01
gcggcgauggcguccaccgc

SEQ ID NO: 3493798 - RNA, 15 nt, Pseudomonas aeruginosa PA01
gcggcgaugucggcc

SEQ ID NO: 3493799 - RNA, 18 nt, Pseudomonas aeruginosa PA01
gcggcgaugucggccugc

SEQ ID NO: 3493800 - RNA, 23 nt, Pseudomonas aeruginosa PA01
gcggcgcaaucagggcugggcgc

SEQ ID NO: 3493801 - RNA, 18 nt, Pseudomonas aeruginosa PA01
gcggcgcaccgacgccgc

SEQ ID NO: 3493802 - RNA, 16 nt, Pseudomonas aeruginosa PA01
gcggcgcagccagagc

SEQ ID NO: 3493803 - RNA, 22 nt, Pseudomonas aeruginosa PA01
gcggcgcagccagagcuccagg

SEQ ID NO: 3493804 - RNA, 17 nt, Pseudomonas aeruginosa PA01
gcggcgcaggcugucgg

SEQ ID NO: 3493805 - RNA, 20 nt, Pseudomonas aeruginosa PA01
gcggcgcaggcugucggcca

SEQ ID NO: 3493806 - RNA, 21 nt, Pseudomonas aeruginosa PA01
gcggcgcaggcugucggccag

SEQ ID NO: 3493807 - RNA, 22 nt, Pseudomonas aeruginosa PA01
gcggcgcaggcugucggccagc

SEQ ID NO: 3493808 - RNA, 13 nt, Pseudomonas aeruginosa PA01
gcggcgcaguucg

SEQ ID NO: 3493809 - RNA, 15 nt, Pseudomonas aeruginosa PA01
gcggcgcaucggcgg

SEQ ID NO: 3493810 - RNA, 18 nt, Pseudomonas aeruginosa PA01
gcggcgccaacucggccu

SEQ ID NO: 3493811 - RNA, 19 nt, Pseudomonas aeruginosa PA01
gcggcgccaacucggccug

SEQ ID NO: 3493812 - RNA, 20 nt, Pseudomonas aeruginosa PA01
gcggcgccaacucggccugg

SEQ ID NO: 3493813 - RNA, 15 nt, Pseudomonas aeruginosa PA01
gcggcgccaccgcga

SEQ ID NO: 3493814 - RNA, 19 nt, Pseudomonas aeruginosa PA01
gcggcgccaccgcgacgcg

SEQ ID NO: 3493815 - RNA, 14 nt, Pseudomonas aeruginosa PA01
gcggcgccagcgcc

SEQ ID NO: 3493816 - RNA, 23 nt, Pseudomonas aeruginosa PA01
gcggcgccagcgccccaccaggc

SEQ ID NO: 3493817 - RNA, 12 nt, Pseudomonas aeruginosa PA01
gcggcgccagcu

SEQ ID NO: 3493818 - RNA, 20 nt, Pseudomonas aeruginosa PA01
gcggcgccagcuccagcgcc

SEQ ID NO: 3493819 - RNA, 15 nt, Pseudomonas aeruginosa PA01
gcggcgccaggccgg

SEQ ID NO: 3493820 - RNA, 18 nt, Pseudomonas aeruginosa PA01
gcggcgccaggccggcga

SEQ ID NO: 3493821 - RNA, 19 nt, Pseudomonas aeruginosa PA01
gcggcgccauagggcaccc

SEQ ID NO: 3493822 - RNA, 13 nt, Pseudomonas aeruginosa PA01
gcggcgccccagg

SEQ ID NO: 3493823 - RNA, 14 nt, Pseudomonas aeruginosa PA01
gcggcgccccaggc

SEQ ID NO: 3493824 - RNA, 17 nt, Pseudomonas aeruginosa PA01
gcggcgccccaggcgcc

SEQ ID NO: 3493825 - RNA, 19 nt, Pseudomonas aeruginosa PA01
gcggcgccccaggcgccca

SEQ ID NO: 3493826 - RNA, 20 nt, Pseudomonas aeruginosa PA01
gcggcgccccaggcgcccag

SEQ ID NO: 3493827 - RNA, 12 nt, Pseudomonas aeruginosa PA01
gcggcgcccgcc

SEQ ID NO: 3493828 - RNA, 22 nt, Pseudomonas aeruginosa PA01
gcggcgcccgccaagggcgccg

SEQ ID NO: 3493829 - RNA, 14 nt, Pseudomonas aeruginosa PA01
gcggcgcccucugc

SEQ ID NO: 3493830 - RNA, 17 nt, Pseudomonas aeruginosa PA01
gcggcgcccucugccgg

SEQ ID NO: 3493831 - RNA, 20 nt, Pseudomonas aeruginosa PA01
gcggcgcccucugccggucg

SEQ ID NO: 3493832 - RNA, 23 nt, Pseudomonas aeruginosa PA01
gcggcgcccucugccggucggaa

SEQ ID NO: 3493833 - RNA, 15 nt, Pseudomonas aeruginosa PA01
gcggcgcccuggcuc

SEQ ID NO: 3493834 - RNA, 21 nt, Pseudomonas aeruginosa PA01
gcggcgccgaacagggcgagc

SEQ ID NO: 3493835 - RNA, 23 nt, Pseudomonas aeruginosa PA01
gcggcgccgaacagggcgagcag

SEQ ID NO: 3493836 - RNA, 16 nt, Pseudomonas aeruginosa PA01
gcggcgccgaggcccu

SEQ ID NO: 3493837 - RNA, 14 nt, Pseudomonas aeruginosa PA01
gcggcgccggugag

SEQ ID NO: 3493838 - RNA, 20 nt, Pseudomonas aeruginosa PA01
gcggcgccggugaggcgcag

SEQ ID NO: 3493839 - RNA, 12 nt, Pseudomonas aeruginosa PA01
gcggcgccgguu

SEQ ID NO: 3493840 - RNA, 21 nt, Pseudomonas aeruginosa PA01
gcggcgccuagacccugggcc

SEQ ID NO: 3493841 - RNA, 22 nt, Pseudomonas aeruginosa PA01
gcggcgccuagacccugggcca

SEQ ID NO: 3493842 - RNA, 15 nt, Pseudomonas aeruginosa PA01
gcggcgccugcugcg

SEQ ID NO: 3493843 - RNA, 15 nt, Pseudomonas aeruginosa PA01
gcggcgccuggagca

SEQ ID NO: 3493844 - RNA, 12 nt, Pseudomonas aeruginosa PA01
gcggcgccuggc

SEQ ID NO: 3493845 - RNA, 21 nt, Pseudomonas aeruginosa PA01
gcggcgccuucagcgccgcca

SEQ ID NO: 3493846 - RNA, 22 nt, Pseudomonas aeruginosa PA01
gcggcgccuucagcgccgccag

SEQ ID NO: 3493847 - RNA, 12 nt, Pseudomonas aeruginosa PA01
gcggcgccuucg

SEQ ID NO: 3493848 - RNA, 17 nt, Pseudomonas aeruginosa PA01
gcggcgccuucgccgga

SEQ ID NO: 3493849 - RNA, 13 nt, Pseudomonas aeruginosa PA01
gcggcgccuugcg

SEQ ID NO: 3493850 - RNA, 17 nt, Pseudomonas aeruginosa PA01
gcggcgcgaaccagcag

SEQ ID NO: 3493851 - RNA, 19 nt, Pseudomonas aeruginosa PA01
gcggcgcgaaccagcagca

SEQ ID NO: 3493852 - RNA, 17 nt, Pseudomonas aeruginosa PA01
gcggcgcgagaugaagc

SEQ ID NO: 3493853 - RNA, 22 nt, Pseudomonas aeruginosa PA01
gcggcgcgagaugaagcgccgc

SEQ ID NO: 3493854 - RNA, 21 nt, Pseudomonas aeruginosa PA01
gcggcgcgauauccgccaggg

SEQ ID NO: 3493855 - RNA, 18 nt, Pseudomonas aeruginosa PA01
gcggcgcgcagcgaacgg

SEQ ID NO: 3493856 - RNA, 19 nt, Pseudomonas aeruginosa PA01
gcggcgcgccuucagcgcc

SEQ ID NO: 3493857 - RNA, 18 nt, Pseudomonas aeruginosa PA01
gcggcgcgcgucguccag

SEQ ID NO: 3493858 - RNA, 18 nt, Pseudomonas aeruginosa PA01
gcggcgcgcugcggguca

SEQ ID NO: 3493859 - RNA, 16 nt, Pseudomonas aeruginosa PA01
gcggcgcggagauccc

SEQ ID NO: 3493860 - RNA, 19 nt, Pseudomonas aeruginosa PA01
gcggcgcggagauccccuc

SEQ ID NO: 3493861 - RNA, 23 nt, Pseudomonas aeruginosa PA01
gcggcgcggauguucgccacgcu

SEQ ID NO: 3493862 - RNA, 13 nt, Pseudomonas aeruginosa PA01
gcggcgcggcgca

SEQ ID NO: 3493863 - RNA, 12 nt, Pseudomonas aeruginosa PA01
gcggcgcggcgg

SEQ ID NO: 3493864 - RNA, 13 nt, Pseudomonas aeruginosa PA01
gcggcgcggcgua

SEQ ID NO: 3493865 - RNA, 21 nt, Pseudomonas aeruginosa PA01
gcggcgcgggcgcgcgccacc

SEQ ID NO: 3493866 - RNA, 16 nt, Pseudomonas aeruginosa PA01
gcggcgcguaggcgaa

SEQ ID NO: 3493867 - RNA, 18 nt, Pseudomonas aeruginosa PA01
gcggcgcguaggcgaaca

SEQ ID NO: 3493868 - RNA, 21 nt, Pseudomonas aeruginosa PA01
gcggcgcguccaccuggcggc

SEQ ID NO: 3493869 - RNA, 15 nt, Pseudomonas aeruginosa PA01
gcggcgcgucggugc

SEQ ID NO: 3493870 - RNA, 18 nt, Pseudomonas aeruginosa PA01
gcggcgcgucggugccgc

SEQ ID NO: 3493871 - RNA, 16 nt, Pseudomonas aeruginosa PA01
gcggcgcguuccgggu

SEQ ID NO: 3493872 - RNA, 22 nt, Pseudomonas aeruginosa PA01
gcggcgcuacgaaggcgugccg

SEQ ID NO: 3493873 - RNA, 16 nt, Pseudomonas aeruginosa PA01
gcggcgcuauccgccg

SEQ ID NO: 3493874 - RNA, 20 nt, Pseudomonas aeruginosa PA01
gcggcgcucacccacauggc

SEQ ID NO: 3493875 - RNA, 18 nt, Pseudomonas aeruginosa PA01
gcggcgcucagucgagca

SEQ ID NO: 3493876 - RNA, 15 nt, Pseudomonas aeruginosa PA01
gcggcgcuccaggcg

SEQ ID NO: 3493877 - RNA, 14 nt, Pseudomonas aeruginosa PA01
gcggcgcucgggau

SEQ ID NO: 3493878 - RNA, 21 nt, Pseudomonas aeruginosa PA01
gcggcgcugaggaucagccag

SEQ ID NO: 3493879 - RNA, 16 nt, Pseudomonas aeruginosa PA01
gcggcgcuugcgggcg

SEQ ID NO: 3493880 - RNA, 18 nt, Pseudomonas aeruginosa PA01
gcggcgcuugcgggcgcg

SEQ ID NO: 3493881 - RNA, 17 nt, Pseudomonas aeruginosa PA01
gcggcgcuuguagccca

SEQ ID NO: 3493882 - RNA, 19 nt, Pseudomonas aeruginosa PA01
gcggcgcuuguagcccagg

SEQ ID NO: 3493883 - RNA, 22 nt, Pseudomonas aeruginosa PA01
gcggcgcuuguagcccaggggc

SEQ ID NO: 3493884 - RNA, 21 nt, Pseudomonas aeruginosa PA01
gcggcggaacuugucgccgcu

SEQ ID NO: 3493885 - RNA, 21 nt, Pseudomonas aeruginosa PA01
gcggcggaagaauaccgccag

SEQ ID NO: 3493886 - RNA, 22 nt, Pseudomonas aeruginosa PA01
gcggcggaagaauaccgccagc

SEQ ID NO: 3493887 - RNA, 14 nt, Pseudomonas aeruginosa PA01
gcggcggaaggcgg

SEQ ID NO: 3493888 - RNA, 15 nt, Pseudomonas aeruginosa PA01
gcggcggaaggcggc

SEQ ID NO: 3493889 - RNA, 22 nt, Pseudomonas aeruginosa PA01
gcggcggacaggcagccggcca

SEQ ID NO: 3493890 - RNA, 15 nt, Pseudomonas aeruginosa PA01
gcggcggaccuccgc

SEQ ID NO: 3493891 - RNA, 16 nt, Pseudomonas aeruginosa PA01
gcggcggaccuccgcc

SEQ ID NO: 3493892 - RNA, 17 nt, Pseudomonas aeruginosa PA01
gcggcggaccuccgcca

SEQ ID NO: 3493893 - RNA, 18 nt, Pseudomonas aeruginosa PA01
gcggcggaccuccgccag

SEQ ID NO: 3493894 - RNA, 15 nt, Pseudomonas aeruginosa PA01
gcggcggacgacgaa

SEQ ID NO: 3493895 - RNA, 16 nt, Pseudomonas aeruginosa PA01
gcggcggacgacgaag

SEQ ID NO: 3493896 - RNA, 17 nt, Pseudomonas aeruginosa PA01
gcggcggagucguagcg

SEQ ID NO: 3493897 - RNA, 16 nt, Pseudomonas aeruginosa PA01
gcggcggauaaccgcg

SEQ ID NO: 3493898 - RNA, 20 nt, Pseudomonas aeruginosa PA01
gcggcggauaaccgcgagcg

SEQ ID NO: 3493899 - RNA, 14 nt, Pseudomonas aeruginosa PA01
gcggcggauaacgc

SEQ ID NO: 3493900 - RNA, 18 nt, Pseudomonas aeruginosa PA01
gcggcggauaacgccugu

SEQ ID NO: 3493901 - RNA, 20 nt, Pseudomonas aeruginosa PA01
gcggcggauacaggcgcagc

SEQ ID NO: 3493902 - RNA, 22 nt, Pseudomonas aeruginosa PA01
gcggcggauacaggcgcagcag

SEQ ID NO: 3493903 - RNA, 15 nt, Pseudomonas aeruginosa PA01
gcggcggcaccgacg

SEQ ID NO: 3493904 - RNA, 21 nt, Pseudomonas aeruginosa PA01
gcggcggcaccgacgccgaag

SEQ ID NO: 3493905 - RNA, 14 nt, Pseudomonas aeruginosa PA01
gcggcggcacgacc

SEQ ID NO: 3493906 - RNA, 14 nt, Pseudomonas aeruginosa PA01
gcggcggcaggcca

SEQ ID NO: 3493907 - RNA, 16 nt, Pseudomonas aeruginosa PA01
gcggcggcaggccagc

SEQ ID NO: 3493908 - RNA, 20 nt, Pseudomonas aeruginosa PA01
gcggcggcaggccagcuucc

SEQ ID NO: 3493909 - RNA, 12 nt, Pseudomonas aeruginosa PA01
gcggcggccagc

SEQ ID NO: 3493910 - RNA, 13 nt, Pseudomonas aeruginosa PA01
gcggcggccagca

SEQ ID NO: 3493911 - RNA, 14 nt, Pseudomonas aeruginosa PA01
gcggcggccagcag

SEQ ID NO: 3493912 - RNA, 15 nt, Pseudomonas aeruginosa PA01
gcggcggccagcagc

SEQ ID NO: 3493913 - RNA, 18 nt, Pseudomonas aeruginosa PA01
gcggcggccgcaugccgg

SEQ ID NO: 3493914 - RNA, 14 nt, Pseudomonas aeruginosa PA01
gcggcggccgccuc

SEQ ID NO: 3493915 - RNA, 16 nt, Pseudomonas aeruginosa PA01
gcggcggccgccucgg

SEQ ID NO: 3493916 - RNA, 19 nt, Pseudomonas aeruginosa PA01
gcggcggccugcucgcgca

SEQ ID NO: 3493917 - RNA, 13 nt, Pseudomonas aeruginosa PA01
gcggcggcgccgg

SEQ ID NO: 3493918 - RNA, 14 nt, Pseudomonas aeruginosa PA01
gcggcggcgccggc

SEQ ID NO: 3493919 - RNA, 13 nt, Pseudomonas aeruginosa PA01
gcggcggcgcgga

SEQ ID NO: 3493920 - RNA, 14 nt, Pseudomonas aeruginosa PA01
gcggcggcgcggag

SEQ ID NO: 3493921 - RNA, 15 nt, Pseudomonas aeruginosa PA01
gcggcggcgcggguc

SEQ ID NO: 3493922 - RNA, 12 nt, Pseudomonas aeruginosa PA01
gcggcggcgcgu

SEQ ID NO: 3493923 - RNA, 15 nt, Pseudomonas aeruginosa PA01
gcggcggcgcgucgg

SEQ ID NO: 3493924 - RNA, 15 nt, Pseudomonas aeruginosa PA01
gcggcggcggacagc

SEQ ID NO: 3493925 - RNA, 14 nt, Pseudomonas aeruginosa PA01
gcggcggcggccag

SEQ ID NO: 3493926 - RNA, 15 nt, Pseudomonas aeruginosa PA01
gcggcggcggccagc

SEQ ID NO: 3493927 - RNA, 19 nt, Pseudomonas aeruginosa PA01
gcggcggcguauucgccga

SEQ ID NO: 3493928 - RNA, 14 nt, Pseudomonas aeruginosa PA01
gcggcggcucaggc

SEQ ID NO: 3493929 - RNA, 15 nt, Pseudomonas aeruginosa PA01
gcggcggcucaggcc

SEQ ID NO: 3493930 - RNA, 19 nt, Pseudomonas aeruginosa PA01
gcggcggcucaggccgccg

SEQ ID NO: 3493931 - RNA, 16 nt, Pseudomonas aeruginosa PA01
gcggcggcuccggcgc

SEQ ID NO: 3493932 - RNA, 17 nt, Pseudomonas aeruginosa PA01
gcggcggcuccggcgcc

SEQ ID NO: 3493933 - RNA, 20 nt, Pseudomonas aeruginosa PA01
gcggcggcuccggcgccagg

SEQ ID NO: 3493934 - RNA, 23 nt, Pseudomonas aeruginosa PA01
gcggcggcuccggcgccaggccg

SEQ ID NO: 3493935 - RNA, 20 nt, Pseudomonas aeruginosa PA01
gcggcggcuucagccagacc

SEQ ID NO: 3493936 - RNA, 12 nt, Pseudomonas aeruginosa PA01
gcggcgggccgg

SEQ ID NO: 3493937 - RNA, 14 nt, Pseudomonas aeruginosa PA01
gcggcgggccggcg

SEQ ID NO: 3493938 - RNA, 13 nt, Pseudomonas aeruginosa PA01
gcggcgggcgccc

SEQ ID NO: 3493939 - RNA, 15 nt, Pseudomonas aeruginosa PA01
gcggcgggcgcccgc

SEQ ID NO: 3493940 - RNA, 19 nt, Pseudomonas aeruginosa PA01
gcggcgggcgcccgccaag

SEQ ID NO: 3493941 - RNA, 21 nt, Pseudomonas aeruginosa PA01
gcggcgggcgcccgccaaggc

SEQ ID NO: 3493942 - RNA, 19 nt, Pseudomonas aeruginosa PA01
gcggcggggaaggcgucgg

SEQ ID NO: 3493943 - RNA, 12 nt, Pseudomonas aeruginosa PA01
gcggcggggcca

SEQ ID NO: 3493944 - RNA, 16 nt, Pseudomonas aeruginosa PA01
gcggcggggccaucag

SEQ ID NO: 3493945 - RNA, 18 nt, Pseudomonas aeruginosa PA01
gcggcgguacauggccuu

SEQ ID NO: 3493946 - RNA, 15 nt, Pseudomonas aeruginosa PA01
gcggcgguagccgag

SEQ ID NO: 3493947 - RNA, 22 nt, Pseudomonas aeruginosa PA01
gcggcgguagccgaggcggccg

SEQ ID NO: 3493948 - RNA, 23 nt, Pseudomonas aeruginosa PA01
gcggcgguagccgaggcggccga

SEQ ID NO: 3493949 - RNA, 21 nt, Pseudomonas aeruginosa PA01
gcggcgguagcuccaggccga

SEQ ID NO: 3493950 - RNA, 19 nt, Pseudomonas aeruginosa PA01
gcggcggucaucgcgccgc

SEQ ID NO: 3493951 - RNA, 20 nt, Pseudomonas aeruginosa PA01
gcggcggucaucgcgccgcc

SEQ ID NO: 3493952 - RNA, 21 nt, Pseudomonas aeruginosa PA01
gcggcggucaucgcgccgccg

SEQ ID NO: 3493953 - RNA, 17 nt, Pseudomonas aeruginosa PA01
gcggcggucccagacca

SEQ ID NO: 3493954 - RNA, 19 nt, Pseudomonas aeruginosa PA01
gcggcggucccagaccagc

SEQ ID NO: 3493955 - RNA, 22 nt, Pseudomonas aeruginosa PA01
gcggcggucccagaccagcagc

SEQ ID NO: 3493956 - RNA, 22 nt, Pseudomonas aeruginosa PA01
gcggcggucccaucagcagucc

SEQ ID NO: 3493957 - RNA, 22 nt, Pseudomonas aeruginosa PA01
gcggcggucccuucgugggccu

SEQ ID NO: 3493958 - RNA, 18 nt, Pseudomonas aeruginosa PA01
gcggcggucgcgaucugc

SEQ ID NO: 3493959 - RNA, 19 nt, Pseudomonas aeruginosa PA01
gcggcggucgcgaucugcu

SEQ ID NO: 3493960 - RNA, 17 nt, Pseudomonas aeruginosa PA01
gcggcggugcagaacgc

SEQ ID NO: 3493961 - RNA, 15 nt, Pseudomonas aeruginosa PA01
gcggcggugcgccgg

SEQ ID NO: 3493962 - RNA, 17 nt, Pseudomonas aeruginosa PA01
gcggcggugcgccggcg

SEQ ID NO: 3493963 - RNA, 15 nt, Pseudomonas aeruginosa PA01
gcggcgguggccgcg

SEQ ID NO: 3493964 - RNA, 18 nt, Pseudomonas aeruginosa PA01
gcggcgguucgccgagcg

SEQ ID NO: 3493965 - RNA, 20 nt, Pseudomonas aeruginosa PA01
gcggcgguucgccgagcgcc

SEQ ID NO: 3493966 - RNA, 22 nt, Pseudomonas aeruginosa PA01
gcggcgguucgccgagcgccgc

SEQ ID NO: 3493967 - RNA, 17 nt, Pseudomonas aeruginosa PA01
gcggcgguuggagcgag

SEQ ID NO: 3493968 - RNA, 19 nt, Pseudomonas aeruginosa PA01
gcggcgguuggagcgagcg

SEQ ID NO: 3493969 - RNA, 18 nt, Pseudomonas aeruginosa PA01
gcggcguaaucgcgccag

SEQ ID NO: 3493970 - RNA, 16 nt, Pseudomonas aeruginosa PA01
gcggcguaccagccgc

SEQ ID NO: 3493971 - RNA, 19 nt, Pseudomonas aeruginosa PA01
gcggcguaccuucgagcag

SEQ ID NO: 3493972 - RNA, 12 nt, Pseudomonas aeruginosa PA01
gcggcguaggcc

SEQ ID NO: 3493973 - RNA, 13 nt, Pseudomonas aeruginosa PA01
gcggcguaggccu

SEQ ID NO: 3493974 - RNA, 14 nt, Pseudomonas aeruginosa PA01
gcggcguaggccuc

SEQ ID NO: 3493975 - RNA, 17 nt, Pseudomonas aeruginosa PA01
gcggcguaggcgcgcca

SEQ ID NO: 3493976 - RNA, 19 nt, Pseudomonas aeruginosa PA01
gcggcguaggcgcgccaag

SEQ ID NO: 3493977 - RNA, 19 nt, Pseudomonas aeruginosa PA01
gcggcguauccucggccau

SEQ ID NO: 3493978 - RNA, 15 nt, Pseudomonas aeruginosa PA01
gcggcguaugcgccu

SEQ ID NO: 3493979 - RNA, 17 nt, Pseudomonas aeruginosa PA01
gcggcguaugcgccucc

SEQ ID NO: 3493980 - RNA, 18 nt, Pseudomonas aeruginosa PA01
gcggcguaugcgccucca

SEQ ID NO: 3493981 - RNA, 15 nt, Pseudomonas aeruginosa PA01
gcggcguauucgccg

SEQ ID NO: 3493982 - RNA, 16 nt, Pseudomonas aeruginosa PA01
gcggcguauucgccga

SEQ ID NO: 3493983 - RNA, 17 nt, Pseudomonas aeruginosa PA01
gcggcguauucgccgaa

SEQ ID NO: 3493984 - RNA, 18 nt, Pseudomonas aeruginosa PA01
gcggcguauucgccgaag

SEQ ID NO: 3493985 - RNA, 23 nt, Pseudomonas aeruginosa PA01
gcggcguauucgccgaagauccg

SEQ ID NO: 3493986 - RNA, 20 nt, Pseudomonas aeruginosa PA01
gcggcgucccggcgccgccc

SEQ ID NO: 3493987 - RNA, 21 nt, Pseudomonas aeruginosa PA01
gcggcgucccggcgccgcccu

SEQ ID NO: 3493988 - RNA, 14 nt, Pseudomonas aeruginosa PA01
gcggcguccgcguc

SEQ ID NO: 3493989 - RNA, 18 nt, Pseudomonas aeruginosa PA01
gcggcgucgaccacggcc

SEQ ID NO: 3493990 - RNA, 19 nt, Pseudomonas aeruginosa PA01
gcggcgucgaccacggccu

SEQ ID NO: 3493991 - RNA, 22 nt, Pseudomonas aeruginosa PA01
gcggcgucgaccacggccuucg

SEQ ID NO: 3493992 - RNA, 15 nt, Pseudomonas aeruginosa PA01
gcggcgucgcggaga

SEQ ID NO: 3493993 - RNA, 13 nt, Pseudomonas aeruginosa PA01
gcggcgucggcga

SEQ ID NO: 3493994 - RNA, 16 nt, Pseudomonas aeruginosa PA01
gcggcgucggcgaagc

SEQ ID NO: 3493995 - RNA, 14 nt, Pseudomonas aeruginosa PA01
gcggcgucgucgcu

SEQ ID NO: 3493996 - RNA, 17 nt, Pseudomonas aeruginosa PA01
gcggcgucgucgcugcg

SEQ ID NO: 3493997 - RNA, 20 nt, Pseudomonas aeruginosa PA01
gcggcgucgucgcugcgcgg

SEQ ID NO: 3493998 - RNA, 18 nt, Pseudomonas aeruginosa PA01
gcggcgugaagccgccgc

SEQ ID NO: 3493999 - RNA, 21 nt, Pseudomonas aeruginosa PA01
gcggcgugaagccgccgccca

SEQ ID NO: 3494000 - RNA, 23 nt, Pseudomonas aeruginosa PA01
gcggcgugaagccgccgcccagc

SEQ ID NO: 3494001 - RNA, 16 nt, Pseudomonas aeruginosa PA01
gcggcgugcaggccga

SEQ ID NO: 3494002 - RNA, 17 nt, Pseudomonas aeruginosa PA01
gcggcgugcaggccgau

SEQ ID NO: 3494003 - RNA, 14 nt, Pseudomonas aeruginosa PA01
gcggcgugcagggu

SEQ ID NO: 3494004 - RNA, 15 nt, Pseudomonas aeruginosa PA01
gcggcguggcaccgc

SEQ ID NO: 3494005 - RNA, 15 nt, Pseudomonas aeruginosa PA01
gcggcguggcgauca

SEQ ID NO: 3494006 - RNA, 17 nt, Pseudomonas aeruginosa PA01
gcggcguggcgaucagg

SEQ ID NO: 3494007 - RNA, 23 nt, Pseudomonas aeruginosa PA01
gcggcguggcucgaucagccggc

SEQ ID NO: 3494008 - RNA, 15 nt, Pseudomonas aeruginosa PA01
gcggcguuauccgcc

SEQ ID NO: 3494009 - RNA, 16 nt, Pseudomonas aeruginosa PA01
gcggcguuauccgccc

SEQ ID NO: 3494010 - RNA, 15 nt, Pseudomonas aeruginosa PA01
gcggcguucgcccug

SEQ ID NO: 3494011 - RNA, 17 nt, Pseudomonas aeruginosa PA01
gcggcguucgcccugcg

SEQ ID NO: 3494012 - RNA, 19 nt, Pseudomonas aeruginosa PA01
gcggcguucgcccugcgga

SEQ ID NO: 3494013 - RNA, 20 nt, Pseudomonas aeruginosa PA01
gcggcguucgcccugcggau

SEQ ID NO: 3494014 - RNA, 17 nt, Pseudomonas aeruginosa PA01
gcggcguucgccgagca

SEQ ID NO: 3494015 - RNA, 14 nt, Pseudomonas aeruginosa PA01
gcggcguucgccgc

SEQ ID NO: 3494016 - RNA, 15 nt, Pseudomonas aeruginosa PA01
gcggcguucggaccu

SEQ ID NO: 3494017 - RNA, 17 nt, Pseudomonas aeruginosa PA01
gcggcguuggccgagga

SEQ ID NO: 3494018 - RNA, 22 nt, Pseudomonas aeruginosa PA01
gcggcguuggccgaggaggcca

SEQ ID NO: 3494019 - RNA, 16 nt, Pseudomonas aeruginosa PA01
gcggcguugucggcca

SEQ ID NO: 3494020 - RNA, 18 nt, Pseudomonas aeruginosa PA01
gcggcguugucggccagc

SEQ ID NO: 3494021 - RNA, 19 nt, Pseudomonas aeruginosa PA01
gcggcguugucggccagca

SEQ ID NO: 3494022 - RNA, 20 nt, Pseudomonas aeruginosa PA01
gcggcguugucggccagcag

SEQ ID NO: 3494023 - RNA, 21 nt, Pseudomonas aeruginosa PA01
gcggcguugucggccagcagc

SEQ ID NO: 3494024 - RNA, 22 nt, Pseudomonas aeruginosa PA01
gcggcguuuuucauugggcagc

SEQ ID NO: 3494025 - RNA, 15 nt, Pseudomonas aeruginosa PA01
gcggcuacccucucc

SEQ ID NO: 3494026 - RNA, 14 nt, Pseudomonas aeruginosa PA01
gcggcuacucgccc

SEQ ID NO: 3494027 - RNA, 16 nt, Pseudomonas aeruginosa PA01
gcggcuacucgcccga

SEQ ID NO: 3494028 - RNA, 18 nt, Pseudomonas aeruginosa PA01
gcggcuacucgcccgacc

SEQ ID NO: 3494029 - RNA, 16 nt, Pseudomonas aeruginosa PA01
gcggcuaucgaugauc

SEQ ID NO: 3494030 - RNA, 23 nt, Pseudomonas aeruginosa PA01
gcggcucaccgagaaccaguacu

SEQ ID NO: 3494031 - RNA, 13 nt, Pseudomonas aeruginosa PA01
gcggcucacgccc

SEQ ID NO: 3494032 - RNA, 20 nt, Pseudomonas aeruginosa PA01
gcggcucacgccccagcgca

SEQ ID NO: 3494033 - RNA, 19 nt, Pseudomonas aeruginosa PA01
gcggcucaggccgccgcgu

SEQ ID NO: 3494034 - RNA, 20 nt, Pseudomonas aeruginosa PA01
gcggcuccagccgcugcagg

SEQ ID NO: 3494035 - RNA, 23 nt, Pseudomonas aeruginosa PA01
gcggcuccagccgcugcagggcg

SEQ ID NO: 3494036 - RNA, 23 nt, Pseudomonas aeruginosa PA01
gcggcucccuuuuuucaugggca

SEQ ID NO: 3494037 - RNA, 16 nt, Pseudomonas aeruginosa PA01
gcggcuccggcgccag

SEQ ID NO: 3494038 - RNA, 17 nt, Pseudomonas aeruginosa PA01
gcggcuccggcgccagg

SEQ ID NO: 3494039 - RNA, 18 nt, Pseudomonas aeruginosa PA01
gcggcuccggcgccaggc

SEQ ID NO: 3494040 - RNA, 16 nt, Pseudomonas aeruginosa PA01
gcggcuccucggccug

SEQ ID NO: 3494041 - RNA, 23 nt, Pseudomonas aeruginosa PA01
gcggcuccucggccugggcgcag

SEQ ID NO: 3494042 - RNA, 20 nt, Pseudomonas aeruginosa PA01
gcggcuccuggaugcuccgc

SEQ ID NO: 3494043 - RNA, 20 nt, Pseudomonas aeruginosa PA01
gcggcucgccgaaaggccgu

SEQ ID NO: 3494044 - RNA, 13 nt, Pseudomonas aeruginosa PA01
gcggcucgccgau

SEQ ID NO: 3494045 - RNA, 14 nt, Pseudomonas aeruginosa PA01
gcggcucggccagg

SEQ ID NO: 3494046 - RNA, 15 nt, Pseudomonas aeruginosa PA01
gcggcucggccaggg

SEQ ID NO: 3494047 - RNA, 14 nt, Pseudomonas aeruginosa PA01
gcggcucggcgggc

SEQ ID NO: 3494048 - RNA, 15 nt, Pseudomonas aeruginosa PA01
gcggcucggcgggcu

SEQ ID NO: 3494049 - RNA, 19 nt, Pseudomonas aeruginosa PA01
gcggcucggcgggcugccg

SEQ ID NO: 3494050 - RNA, 23 nt, Pseudomonas aeruginosa PA01
gcggcucggcgggcugccgcgga

SEQ ID NO: 3494051 - RNA, 16 nt, Pseudomonas aeruginosa PA01
gcggcucggcuccagg

SEQ ID NO: 3494052 - RNA, 18 nt, Pseudomonas aeruginosa PA01
gcggcucgggcggcaagg

SEQ ID NO: 3494053 - RNA, 18 nt, Pseudomonas aeruginosa PA01
gcggcucgucaucgucca

SEQ ID NO: 3494054 - RNA, 19 nt, Pseudomonas aeruginosa PA01
gcggcucgucaucguccag

SEQ ID NO: 3494055 - RNA, 15 nt, Pseudomonas aeruginosa PA01
gcggcucuggcgcag

SEQ ID NO: 3494056 - RNA, 16 nt, Pseudomonas aeruginosa PA01
gcggcucuuuccgggu

SEQ ID NO: 3494057 - RNA, 18 nt, Pseudomonas aeruginosa PA01
gcggcucuuuccggguca

SEQ ID NO: 3494058 - RNA, 22 nt, Pseudomonas aeruginosa PA01
gcggcucuuuccgggucauugg

SEQ ID NO: 3494059 - RNA, 23 nt, Pseudomonas aeruginosa PA01
gcggcugaagaagcugccccaca

SEQ ID NO: 3494060 - RNA, 15 nt, Pseudomonas aeruginosa PA01
gcggcugaaggccga

SEQ ID NO: 3494061 - RNA, 16 nt, Pseudomonas aeruginosa PA01
gcggcugaaggccgaa

SEQ ID NO: 3494062 - RNA, 18 nt, Pseudomonas aeruginosa PA01
gcggcugaaggccgaacg

SEQ ID NO: 3494063 - RNA, 20 nt, Pseudomonas aeruginosa PA01
gcggcugaaggugagauggu

SEQ ID NO: 3494064 - RNA, 21 nt, Pseudomonas aeruginosa PA01
gcggcugaaggugagaugguc

SEQ ID NO: 3494065 - RNA, 18 nt, Pseudomonas aeruginosa PA01
gcggcugaucggccgcca

SEQ ID NO: 3494066 - RNA, 22 nt, Pseudomonas aeruginosa PA01
gcggcugaucggccgccagugc

SEQ ID NO: 3494067 - RNA, 14 nt, Pseudomonas aeruginosa PA01
gcggcugaugccgc

SEQ ID NO: 3494068 - RNA, 20 nt, Pseudomonas aeruginosa PA01
gcggcugcagggccagggag

SEQ ID NO: 3494069 - RNA, 19 nt, Pseudomonas aeruginosa PA01
gcggcugcccgggguuggc

SEQ ID NO: 3494070 - RNA, 13 nt, Pseudomonas aeruginosa PA01
gcggcugccggug

SEQ ID NO: 3494071 - RNA, 15 nt, Pseudomonas aeruginosa PA01
gcggcugccggugcc

SEQ ID NO: 3494072 - RNA, 13 nt, Pseudomonas aeruginosa PA01
gcggcugcgcgcc

SEQ ID NO: 3494073 - RNA, 18 nt, Pseudomonas aeruginosa PA01
gcggcugcgcgccggguc

SEQ ID NO: 3494074 - RNA, 19 nt, Pseudomonas aeruginosa PA01
gcggcugcgguaggugaug

SEQ ID NO: 3494075 - RNA, 17 nt, Pseudomonas aeruginosa PA01
gcggcugcugcgccugg

SEQ ID NO: 3494076 - RNA, 16 nt, Pseudomonas aeruginosa PA01
gcggcugcuugccgcu

SEQ ID NO: 3494077 - RNA, 12 nt, Pseudomonas aeruginosa PA01
gcggcuggcagg

SEQ ID NO: 3494078 - RNA, 16 nt, Pseudomonas aeruginosa PA01
gcggcuggcaggugcc

SEQ ID NO: 3494079 - RNA, 19 nt, Pseudomonas aeruginosa PA01
gcggcuggcaggugccgcu

SEQ ID NO: 3494080 - RNA, 13 nt, Pseudomonas aeruginosa PA01
gcggcuggccgcc

SEQ ID NO: 3494081 - RNA, 21 nt, Pseudomonas aeruginosa PA01
gcggcuggccgccuggccggc

SEQ ID NO: 3494082 - RNA, 15 nt, Pseudomonas aeruginosa PA01
gcggcuggccgucga

SEQ ID NO: 3494083 - RNA, 17 nt, Pseudomonas aeruginosa PA01
gcggcuggcgaaccagu

SEQ ID NO: 3494084 - RNA, 22 nt, Pseudomonas aeruginosa PA01
gcggcuggcgcgaucggggcag

SEQ ID NO: 3494085 - RNA, 13 nt, Pseudomonas aeruginosa PA01
gcggcuggcgcgc

SEQ ID NO: 3494086 - RNA, 15 nt, Pseudomonas aeruginosa PA01
gcggcuggcgcgcgc

SEQ ID NO: 3494087 - RNA, 14 nt, Pseudomonas aeruginosa PA01
gcggcuggcugaag

SEQ ID NO: 3494088 - RNA, 17 nt, Pseudomonas aeruginosa PA01
gcggcuggcugaagccg

SEQ ID NO: 3494089 - RNA, 21 nt, Pseudomonas aeruginosa PA01
gcggcuggcugaagccgggca

SEQ ID NO: 3494090 - RNA, 13 nt, Pseudomonas aeruginosa PA01
gcggcuggcugcc

SEQ ID NO: 3494091 - RNA, 24 nt, Pseudomonas aeruginosa PA01
gcggcugggucgauuccugucucc

SEQ ID NO: 3494092 - RNA, 13 nt, Pseudomonas aeruginosa PA01
gcggcuggguguc

SEQ ID NO: 3494093 - RNA, 22 nt, Pseudomonas aeruginosa PA01
gcggcugguucugguccaccag

SEQ ID NO: 3494094 - RNA, 17 nt, Pseudomonas aeruginosa PA01
gcggcuguagccacggc

SEQ ID NO: 3494095 - RNA, 21 nt, Pseudomonas aeruginosa PA01
gcggcuguagcggaucaggcc

SEQ ID NO: 3494096 - RNA, 16 nt, Pseudomonas aeruginosa PA01
gcggcuguugccguuc

SEQ ID NO: 3494097 - RNA, 16 nt, Pseudomonas aeruginosa PA01
gcggcuucagagcugg

SEQ ID NO: 3494098 - RNA, 21 nt, Pseudomonas aeruginosa PA01
gcggcuucgcgcuccaggccc

SEQ ID NO: 3494099 - RNA, 21 nt, Pseudomonas aeruginosa PA01
gcggcuugcagucgaaaaccg

SEQ ID NO: 3494100 - RNA, 14 nt, Pseudomonas aeruginosa PA01
gcggcuugcccugc

SEQ ID NO: 3494101 - RNA, 21 nt, Pseudomonas aeruginosa PA01
gcggcuugcccugcucgucgc

SEQ ID NO: 3494102 - RNA, 14 nt, Pseudomonas aeruginosa PA01
gcggcuugccggcg

SEQ ID NO: 3494103 - RNA, 14 nt, Pseudomonas aeruginosa PA01
gcggcuugcguucg

SEQ ID NO: 3494104 - RNA, 18 nt, Pseudomonas aeruginosa PA01
gcggcuuguccuggcgca

SEQ ID NO: 3494105 - RNA, 18 nt, Pseudomonas aeruginosa PA01
gcggcuuuuuucauggcg

SEQ ID NO: 3494106 - RNA, 20 nt, Pseudomonas aeruginosa PA01
gcggcuuuuuucauggcggu

SEQ ID NO: 3494107 - RNA, 21 nt, Pseudomonas aeruginosa PA01
gcggcuuuuuucauggcgguc

SEQ ID NO: 3494108 - RNA, 23 nt, Pseudomonas aeruginosa PA01
gcggcuuuuuucauggcggucag

SEQ ID NO: 3494109 - RNA, 16 nt, Pseudomonas aeruginosa PA01
gcgggaaacgcagcga

SEQ ID NO: 3494110 - RNA, 18 nt, Pseudomonas aeruginosa PA01
gcgggaaacgcagcgaca

SEQ ID NO: 3494111 - RNA, 15 nt, Pseudomonas aeruginosa PA01
gcgggaacgaugccg

SEQ ID NO: 3494112 - RNA, 18 nt, Pseudomonas aeruginosa PA01
gcgggaacgaugccgcag

SEQ ID NO: 3494113 - RNA, 19 nt, Pseudomonas aeruginosa PA01
gcgggaacgccgggcaacg

SEQ ID NO: 3494114 - RNA, 21 nt, Pseudomonas aeruginosa PA01
gcgggaagcguuccuggaagc

SEQ ID NO: 3494115 - RNA, 13 nt, Pseudomonas aeruginosa PA01
gcgggaaggucgg

SEQ ID NO: 3494116 - RNA, 14 nt, Pseudomonas aeruginosa PA01
gcgggaaggucggc

SEQ ID NO: 3494117 - RNA, 16 nt, Pseudomonas aeruginosa PA01
gcgggaaggucggcag

SEQ ID NO: 3494118 - RNA, 20 nt, Pseudomonas aeruginosa PA01
gcgggacagcuugccgucca

SEQ ID NO: 3494119 - RNA, 22 nt, Pseudomonas aeruginosa PA01
gcgggacagcuugccguccagc

SEQ ID NO: 3494120 - RNA, 15 nt, Pseudomonas aeruginosa PA01
gcgggacgaugccga

SEQ ID NO: 3494121 - RNA, 15 nt, Pseudomonas aeruginosa PA01
gcgggacgccgcagg

SEQ ID NO: 3494122 - RNA, 17 nt, Pseudomonas aeruginosa PA01
gcgggacgccgcaggaa

SEQ ID NO: 3494123 - RNA, 18 nt, Pseudomonas aeruginosa PA01
gcgggacgcguucccccg

SEQ ID NO: 3494124 - RNA, 14 nt, Pseudomonas aeruginosa PA01
gcgggacggcgcau

SEQ ID NO: 3494125 - RNA, 20 nt, Pseudomonas aeruginosa PA01
gcgggacuuguacucgccgg

SEQ ID NO: 3494126 - RNA, 21 nt, Pseudomonas aeruginosa PA01
gcgggacuuguacucgccggu

SEQ ID NO: 3494127 - RNA, 22 nt, Pseudomonas aeruginosa PA01
gcgggacuuguacucgccggug

SEQ ID NO: 3494128 - RNA, 12 nt, Pseudomonas aeruginosa PA01
gcgggagcggcc

SEQ ID NO: 3494129 - RNA, 13 nt, Pseudomonas aeruginosa PA01
gcgggagcggccu

SEQ ID NO: 3494130 - RNA, 14 nt, Pseudomonas aeruginosa PA01
gcgggagcggccug

SEQ ID NO: 3494131 - RNA, 13 nt, Pseudomonas aeruginosa PA01
gcgggaggccgcc

SEQ ID NO: 3494132 - RNA, 14 nt, Pseudomonas aeruginosa PA01
gcgggaggccgccu

SEQ ID NO: 3494133 - RNA, 19 nt, Pseudomonas aeruginosa PA01
gcgggaggcuacagccuga

SEQ ID NO: 3494134 - RNA, 21 nt, Pseudomonas aeruginosa PA01
gcgggaucaggucgccagcgc

SEQ ID NO: 3494135 - RNA, 22 nt, Pseudomonas aeruginosa PA01
gcgggaucaggucgccagcgcc

SEQ ID NO: 3494136 - RNA, 17 nt, Pseudomonas aeruginosa PA01
gcgggaucgacgccgcu

SEQ ID NO: 3494137 - RNA, 21 nt, Pseudomonas aeruginosa PA01
gcgggaucgacgccgcuggcg

SEQ ID NO: 3494138 - RNA, 22 nt, Pseudomonas aeruginosa PA01
gcgggaucgacgccgcuggcgg

SEQ ID NO: 3494139 - RNA, 21 nt, Pseudomonas aeruginosa PA01
gcgggaucgaguaagugccga

SEQ ID NO: 3494140 - RNA, 21 nt, Pseudomonas aeruginosa PA01
gcgggaucuucuaccuggcgc

SEQ ID NO: 3494141 - RNA, 22 nt, Pseudomonas aeruginosa PA01
gcgggaucuucuaccuggcgcu

SEQ ID NO: 3494142 - RNA, 16 nt, Pseudomonas aeruginosa PA01
gcgggauguacgccag

SEQ ID NO: 3494143 - RNA, 18 nt, Pseudomonas aeruginosa PA01
gcgggauguacgccaggg

SEQ ID NO: 3494144 - RNA, 17 nt, Pseudomonas aeruginosa PA01
gcgggaugugcaccagc

SEQ ID NO: 3494145 - RNA, 20 nt, Pseudomonas aeruginosa PA01
gcgggaugugcaccagcaac

SEQ ID NO: 3494146 - RNA, 15 nt, Pseudomonas aeruginosa PA01
gcgggauugucgccg

SEQ ID NO: 3494147 - RNA, 17 nt, Pseudomonas aeruginosa PA01
gcgggauugucgccgcc

SEQ ID NO: 3494148 - RNA, 19 nt, Pseudomonas aeruginosa PA01
gcgggauugucgccgccga

SEQ ID NO: 3494149 - RNA, 18 nt, Pseudomonas aeruginosa PA01
gcgggcaaccgcggcggc

SEQ ID NO: 3494150 - RNA, 22 nt, Pseudomonas aeruginosa PA01
gcgggcaaccgcggcggccuca

SEQ ID NO: 3494151 - RNA, 15 nt, Pseudomonas aeruginosa PA01
gcgggcaccgccagc

SEQ ID NO: 3494152 - RNA, 18 nt, Pseudomonas aeruginosa PA01
gcgggcaccgccagcccg

SEQ ID NO: 3494153 - RNA, 17 nt, Pseudomonas aeruginosa PA01
gcgggcacgucgcggau

SEQ ID NO: 3494154 - RNA, 13 nt, Pseudomonas aeruginosa PA01
gcgggcagcaguc

SEQ ID NO: 3494155 - RNA, 16 nt, Pseudomonas aeruginosa PA01
gcgggcagcagucgca

SEQ ID NO: 3494156 - RNA, 18 nt, Pseudomonas aeruginosa PA01
gcgggcauccagcggacg

SEQ ID NO: 3494157 - RNA, 15 nt, Pseudomonas aeruginosa PA01
gcgggcaugcaccua

SEQ ID NO: 3494158 - RNA, 13 nt, Pseudomonas aeruginosa PA01
gcgggccagcagc

SEQ ID NO: 3494159 - RNA, 18 nt, Pseudomonas aeruginosa PA01
gcgggccagcagcuccgg

SEQ ID NO: 3494160 - RNA, 23 nt, Pseudomonas aeruginosa PA01
gcgggccagcagcuccgggcugg

SEQ ID NO: 3494161 - RNA, 14 nt, Pseudomonas aeruginosa PA01
gcgggccagcaggc

SEQ ID NO: 3494162 - RNA, 16 nt, Pseudomonas aeruginosa PA01
gcgggccagcaggcgc

SEQ ID NO: 3494163 - RNA, 17 nt, Pseudomonas aeruginosa PA01
gcgggccagcaggcgcu

SEQ ID NO: 3494164 - RNA, 22 nt, Pseudomonas aeruginosa PA01
gcgggccagcaggcgcucggcg

SEQ ID NO: 3494165 - RNA, 21 nt, Pseudomonas aeruginosa PA01
gcgggccagcaggguggccag

SEQ ID NO: 3494166 - RNA, 22 nt, Pseudomonas aeruginosa PA01
gcgggccagcaggguggccagg

SEQ ID NO: 3494167 - RNA, 14 nt, Pseudomonas aeruginosa PA01
gcgggccagccguu

SEQ ID NO: 3494168 - RNA, 14 nt, Pseudomonas aeruginosa PA01
gcgggccagcuggc

SEQ ID NO: 3494169 - RNA, 20 nt, Pseudomonas aeruginosa PA01
gcgggccaggcccuugguca

SEQ ID NO: 3494170 - RNA, 16 nt, Pseudomonas aeruginosa PA01
gcgggccaggccgagc

SEQ ID NO: 3494171 - RNA, 17 nt, Pseudomonas aeruginosa PA01
gcgggccaggccgagcg

SEQ ID NO: 3494172 - RNA, 21 nt, Pseudomonas aeruginosa PA01
gcgggccaggccgagcgugcg

SEQ ID NO: 3494173 - RNA, 15 nt, Pseudomonas aeruginosa PA01
gcgggccaggcggua

SEQ ID NO: 3494174 - RNA, 20 nt, Pseudomonas aeruginosa PA01
gcgggccaugcgcucggggu

SEQ ID NO: 3494175 - RNA, 14 nt, Pseudomonas aeruginosa PA01
gcgggcccagcggu

SEQ ID NO: 3494176 - RNA, 14 nt, Pseudomonas aeruginosa PA01
gcgggcccauggcg

SEQ ID NO: 3494177 - RNA, 17 nt, Pseudomonas aeruginosa PA01
gcgggcccguggcaggu

SEQ ID NO: 3494178 - RNA, 16 nt, Pseudomonas aeruginosa PA01
gcgggccgaggucgcg

SEQ ID NO: 3494179 - RNA, 20 nt, Pseudomonas aeruginosa PA01
gcgggccgaggucgcgggcc

SEQ ID NO: 3494180 - RNA, 14 nt, Pseudomonas aeruginosa PA01
gcgggccgauccgc

SEQ ID NO: 3494181 - RNA, 16 nt, Pseudomonas aeruginosa PA01
gcgggccgccuggucg

SEQ ID NO: 3494182 - RNA, 18 nt, Pseudomonas aeruginosa PA01
gcgggccgccuggucggg

SEQ ID NO: 3494183 - RNA, 19 nt, Pseudomonas aeruginosa PA01
gcgggccgccuggucgggg

SEQ ID NO: 3494184 - RNA, 12 nt, Pseudomonas aeruginosa PA01
gcgggccgcgcc

SEQ ID NO: 3494185 - RNA, 12 nt, Pseudomonas aeruginosa PA01
gcgggccgcggc

SEQ ID NO: 3494186 - RNA, 13 nt, Pseudomonas aeruginosa PA01
gcgggccgcggcg

SEQ ID NO: 3494187 - RNA, 17 nt, Pseudomonas aeruginosa PA01
gcgggccgcggcgacca

SEQ ID NO: 3494188 - RNA, 15 nt, Pseudomonas aeruginosa PA01
gcgggccgcucgcgc

SEQ ID NO: 3494189 - RNA, 15 nt, Pseudomonas aeruginosa PA01
gcgggccggcgaugg

SEQ ID NO: 3494190 - RNA, 16 nt, Pseudomonas aeruginosa PA01
gcgggccggcguccag

SEQ ID NO: 3494191 - RNA, 14 nt, Pseudomonas aeruginosa PA01
gcgggccucggcgg

SEQ ID NO: 3494192 - RNA, 20 nt, Pseudomonas aeruginosa PA01
gcgggccucggcgggugugg

SEQ ID NO: 3494193 - RNA, 13 nt, Pseudomonas aeruginosa PA01
gcgggccugggca

SEQ ID NO: 3494194 - RNA, 16 nt, Pseudomonas aeruginosa PA01
gcgggccugggcaucg

SEQ ID NO: 3494195 - RNA, 18 nt, Pseudomonas aeruginosa PA01
gcgggccuggugagcgga

SEQ ID NO: 3494196 - RNA, 13 nt, Pseudomonas aeruginosa PA01
gcgggccuucagg

SEQ ID NO: 3494197 - RNA, 17 nt, Pseudomonas aeruginosa PA01
gcgggccuucaggcugc

SEQ ID NO: 3494198 - RNA, 17 nt, Pseudomonas aeruginosa PA01
gcgggccuucgccagcg

SEQ ID NO: 3494199 - RNA, 19 nt, Pseudomonas aeruginosa PA01
gcgggccuucgccagcggc

SEQ ID NO: 3494200 - RNA, 18 nt, Pseudomonas aeruginosa PA01
gcgggccuugaccaccgc

SEQ ID NO: 3494201 - RNA, 21 nt, Pseudomonas aeruginosa PA01
gcgggccuugaccaccgccag

SEQ ID NO: 3494202 - RNA, 22 nt, Pseudomonas aeruginosa PA01
gcgggccuugaccaccgccagg

SEQ ID NO: 3494203 - RNA, 23 nt, Pseudomonas aeruginosa PA01
gcgggccuugaccaccgccaggc

SEQ ID NO: 3494204 - RNA, 13 nt, Pseudomonas aeruginosa PA01
gcgggccuuggcg

SEQ ID NO: 3494205 - RNA, 19 nt, Pseudomonas aeruginosa PA01
gcgggccuuuucuuuggcg

SEQ ID NO: 3494206 - RNA, 18 nt, Pseudomonas aeruginosa PA01
gcgggcgaacggcagcgu

SEQ ID NO: 3494207 - RNA, 14 nt, Pseudomonas aeruginosa PA01
gcgggcgaagcgca

SEQ ID NO: 3494208 - RNA, 17 nt, Pseudomonas aeruginosa PA01
gcgggcgacgugggccu

SEQ ID NO: 3494209 - RNA, 15 nt, Pseudomonas aeruginosa PA01
gcgggcgagggcggc

SEQ ID NO: 3494210 - RNA, 17 nt, Pseudomonas aeruginosa PA01
gcgggcgagggcggcgc

SEQ ID NO: 3494211 - RNA, 21 nt, Pseudomonas aeruginosa PA01
gcgggcgagggcggcgcgggc

SEQ ID NO: 3494212 - RNA, 15 nt, Pseudomonas aeruginosa PA01
gcgggcgaucucgcg

SEQ ID NO: 3494213 - RNA, 15 nt, Pseudomonas aeruginosa PA01
gcgggcgaugaggcu

SEQ ID NO: 3494214 - RNA, 14 nt, Pseudomonas aeruginosa PA01
gcgggcgauggccc

SEQ ID NO: 3494215 - RNA, 15 nt, Pseudomonas aeruginosa PA01
gcgggcgcaagccca

SEQ ID NO: 3494216 - RNA, 19 nt, Pseudomonas aeruginosa PA01
gcgggcgcaagcccaaggg

SEQ ID NO: 3494217 - RNA, 11 nt, Pseudomonas aeruginosa PA01
gcgggcgcagg

SEQ ID NO: 3494218 - RNA, 13 nt, Pseudomonas aeruginosa PA01
gcgggcgcagguu

SEQ ID NO: 3494219 - RNA, 20 nt, Pseudomonas aeruginosa PA01
gcgggcgcccgccaaggccc

SEQ ID NO: 3494220 - RNA, 22 nt, Pseudomonas aeruginosa PA01
gcgggcgcccgccaaggcccug

SEQ ID NO: 3494221 - RNA, 13 nt, Pseudomonas aeruginosa PA01
gcgggcgccgaug

SEQ ID NO: 3494222 - RNA, 14 nt, Pseudomonas aeruginosa PA01
gcgggcgccgaugc

SEQ ID NO: 3494223 - RNA, 16 nt, Pseudomonas aeruginosa PA01
gcgggcgccgaugccg

SEQ ID NO: 3494224 - RNA, 17 nt, Pseudomonas aeruginosa PA01
gcgggcgccgaugccgg

SEQ ID NO: 3494225 - RNA, 19 nt, Pseudomonas aeruginosa PA01
gcgggcgccgaugccggcc

SEQ ID NO: 3494226 - RNA, 13 nt, Pseudomonas aeruginosa PA01
gcgggcgccgccg

SEQ ID NO: 3494227 - RNA, 16 nt, Pseudomonas aeruginosa PA01
gcgggcgcgaggcgcc

SEQ ID NO: 3494228 - RNA, 17 nt, Pseudomonas aeruginosa PA01
gcgggcgcgaggcgccc

SEQ ID NO: 3494229 - RNA, 22 nt, Pseudomonas aeruginosa PA01
gcgggcgcgaggcgcccgccgg

SEQ ID NO: 3494230 - RNA, 24 nt, Pseudomonas aeruginosa PA01
gcgggcgcgaggcgcccgccggcc

SEQ ID NO: 3494231 - RNA, 20 nt, Pseudomonas aeruginosa PA01
gcgggcgcgccugagcuggc

SEQ ID NO: 3494232 - RNA, 14 nt, Pseudomonas aeruginosa PA01
gcgggcgcgcgcca

SEQ ID NO: 3494233 - RNA, 15 nt, Pseudomonas aeruginosa PA01
gcgggcgcgcgccac

SEQ ID NO: 3494234 - RNA, 18 nt, Pseudomonas aeruginosa PA01
gcgggcgcgcgccaccgc

SEQ ID NO: 3494235 - RNA, 19 nt, Pseudomonas aeruginosa PA01
gcgggcgcgcgccaccgcc

SEQ ID NO: 3494236 - RNA, 14 nt, Pseudomonas aeruginosa PA01
gcgggcgcggaucg

SEQ ID NO: 3494237 - RNA, 20 nt, Pseudomonas aeruginosa PA01
gcgggcgcgggcguugucca

SEQ ID NO: 3494238 - RNA, 21 nt, Pseudomonas aeruginosa PA01
gcgggcgcgguaggugaugcg

SEQ ID NO: 3494239 - RNA, 14 nt, Pseudomonas aeruginosa PA01
gcgggcgcugcaug

SEQ ID NO: 3494240 - RNA, 13 nt, Pseudomonas aeruginosa PA01
gcgggcgcuugaa

SEQ ID NO: 3494241 - RNA, 12 nt, Pseudomonas aeruginosa PA01
gcgggcggauca

SEQ ID NO: 3494242 - RNA, 20 nt, Pseudomonas aeruginosa PA01
gcgggcggaucagcucgauc

SEQ ID NO: 3494243 - RNA, 13 nt, Pseudomonas aeruginosa PA01
gcgggcggccccu

SEQ ID NO: 3494244 - RNA, 14 nt, Pseudomonas aeruginosa PA01
gcgggcggccucga

SEQ ID NO: 3494245 - RNA, 16 nt, Pseudomonas aeruginosa PA01
gcgggcggccucgaug

SEQ ID NO: 3494246 - RNA, 14 nt, Pseudomonas aeruginosa PA01
gcgggcggcgucga

SEQ ID NO: 3494247 - RNA, 16 nt, Pseudomonas aeruginosa PA01
gcgggcggcgucgaaa

SEQ ID NO: 3494248 - RNA, 17 nt, Pseudomonas aeruginosa PA01
gcgggcgguagaucucc

SEQ ID NO: 3494249 - RNA, 17 nt, Pseudomonas aeruginosa PA01
gcgggcggucgcggacc

SEQ ID NO: 3494250 - RNA, 23 nt, Pseudomonas aeruginosa PA01
gcgggcggucgcggaccuccagc

SEQ ID NO: 3494251 - RNA, 24 nt, Pseudomonas aeruginosa PA01
gcgggcggucgcggaccuccagcc

SEQ ID NO: 3494252 - RNA, 17 nt, Pseudomonas aeruginosa PA01
gcgggcguagcgcggca

SEQ ID NO: 3494253 - RNA, 15 nt, Pseudomonas aeruginosa PA01
gcgggcgucgucggg

SEQ ID NO: 3494254 - RNA, 22 nt, Pseudomonas aeruginosa PA01
gcgggcgucgucggggugccgc

SEQ ID NO: 3494255 - RNA, 20 nt, Pseudomonas aeruginosa PA01
gcgggcgugcuccagcaccg

SEQ ID NO: 3494256 - RNA, 17 nt, Pseudomonas aeruginosa PA01
gcgggcguuggccugga

SEQ ID NO: 3494257 - RNA, 19 nt, Pseudomonas aeruginosa PA01
gcgggcguuguccacggaa

SEQ ID NO: 3494258 - RNA, 18 nt, Pseudomonas aeruginosa PA01
gcgggcuauucccgccgc

SEQ ID NO: 3494259 - RNA, 20 nt, Pseudomonas aeruginosa PA01
gcgggcuauucccgccgcuc

SEQ ID NO: 3494260 - RNA, 17 nt, Pseudomonas aeruginosa PA01
gcgggcuccgccgccgu

SEQ ID NO: 3494261 - RNA, 18 nt, Pseudomonas aeruginosa PA01
gcgggcuccgccgccgug

SEQ ID NO: 3494262 - RNA, 20 nt, Pseudomonas aeruginosa PA01
gcgggcucuaugcgcggggu

SEQ ID NO: 3494263 - RNA, 20 nt, Pseudomonas aeruginosa PA01
gcgggcugaagugggucgcc

SEQ ID NO: 3494264 - RNA, 15 nt, Pseudomonas aeruginosa PA01
gcgggcugccgcgga

SEQ ID NO: 3494265 - RNA, 17 nt, Pseudomonas aeruginosa PA01
gcgggcugcgugccagc

SEQ ID NO: 3494266 - RNA, 12 nt, Pseudomonas aeruginosa PA01
gcgggcuggaaa

SEQ ID NO: 3494267 - RNA, 23 nt, Pseudomonas aeruginosa PA01
gcgggcuggccaccgggaucagc

SEQ ID NO: 3494268 - RNA, 14 nt, Pseudomonas aeruginosa PA01
gcgggcugucgucc

SEQ ID NO: 3494269 - RNA, 20 nt, Pseudomonas aeruginosa PA01
gcgggcuucggacuuuucgc

SEQ ID NO: 3494270 - RNA, 23 nt, Pseudomonas aeruginosa PA01
gcgggcuuuuuucauucauggcg

SEQ ID NO: 3494271 - RNA, 18 nt, Pseudomonas aeruginosa PA01
gcggggaaaccuucggug

SEQ ID NO: 3494272 - RNA, 17 nt, Pseudomonas aeruginosa PA01
gcggggauggcgggcuc

SEQ ID NO: 3494273 - RNA, 13 nt, Pseudomonas aeruginosa PA01
gcggggccccggc

SEQ ID NO: 3494274 - RNA, 21 nt, Pseudomonas aeruginosa PA01
gcggggcccggcuccagccgg

SEQ ID NO: 3494275 - RNA, 18 nt, Pseudomonas aeruginosa PA01
gcggggcgaggucggccu

SEQ ID NO: 3494276 - RNA, 14 nt, Pseudomonas aeruginosa PA01
gcggggcgcaccgc

SEQ ID NO: 3494277 - RNA, 15 nt, Pseudomonas aeruginosa PA01
gcggggcgcagcagg

SEQ ID NO: 3494278 - RNA, 13 nt, Pseudomonas aeruginosa PA01
gcggggcgcgcug

SEQ ID NO: 3494279 - RNA, 15 nt, Pseudomonas aeruginosa PA01
gcggggcgcucgccc

SEQ ID NO: 3494280 - RNA, 13 nt, Pseudomonas aeruginosa PA01
gcggggcggauga

SEQ ID NO: 3494281 - RNA, 21 nt, Pseudomonas aeruginosa PA01
gcggggcggcgucccggcgcc

SEQ ID NO: 3494282 - RNA, 18 nt, Pseudomonas aeruginosa PA01
gcggggcguucuuuuucg

SEQ ID NO: 3494283 - RNA, 16 nt, Pseudomonas aeruginosa PA01
gcggggcuugcgcccc

SEQ ID NO: 3494284 - RNA, 17 nt, Pseudomonas aeruginosa PA01
gcggggcuuuccgucuc

SEQ ID NO: 3494285 - RNA, 23 nt, Pseudomonas aeruginosa PA01
gcggggcuuuuuccaacgcgcga

SEQ ID NO: 3494286 - RNA, 22 nt, Pseudomonas aeruginosa PA01
gcggggcuuuuuuaugcgcagc

SEQ ID NO: 3494287 - RNA, 23 nt, Pseudomonas aeruginosa PA01
gcggggcuuuuuuaugcgcagcg

SEQ ID NO: 3494288 - RNA, 20 nt, Pseudomonas aeruginosa PA01
gcggggcuuuuuuucgccug

SEQ ID NO: 3494289 - RNA, 19 nt, Pseudomonas aeruginosa PA01
gcgggguagggguggccag

SEQ ID NO: 3494290 - RNA, 20 nt, Pseudomonas aeruginosa PA01
gcgggguagggguggccagg

SEQ ID NO: 3494291 - RNA, 21 nt, Pseudomonas aeruginosa PA01
gcgggguagggguggccaggc

SEQ ID NO: 3494292 - RNA, 22 nt, Pseudomonas aeruginosa PA01
gcgggguagggguggccaggcg

SEQ ID NO: 3494293 - RNA, 24 nt, Pseudomonas aeruginosa PA01
gcgggguagggguggccaggcgca

SEQ ID NO: 3494294 - RNA, 18 nt, Pseudomonas aeruginosa PA01
gcgggguauuaccccgcc

SEQ ID NO: 3494295 - RNA, 17 nt, Pseudomonas aeruginosa PA01
gcggggucgcgccggug

SEQ ID NO: 3494296 - RNA, 18 nt, Pseudomonas aeruginosa PA01
gcggggucgcgccggugg

SEQ ID NO: 3494297 - RNA, 19 nt, Pseudomonas aeruginosa PA01
gcggggugaucacccagag

SEQ ID NO: 3494298 - RNA, 21 nt, Pseudomonas aeruginosa PA01
gcggggugaucagucgucguc

SEQ ID NO: 3494299 - RNA, 16 nt, Pseudomonas aeruginosa PA01
gcgggguucgacgcgc

SEQ ID NO: 3494300 - RNA, 21 nt, Pseudomonas aeruginosa PA01
gcgggguucgacgcgccacgc

SEQ ID NO: 3494301 - RNA, 21 nt, Pseudomonas aeruginosa PA01
gcggguagagucgcucgcgca

SEQ ID NO: 3494302 - RNA, 20 nt, Pseudomonas aeruginosa PA01
gcggguagaugccacugacg

SEQ ID NO: 3494303 - RNA, 16 nt, Pseudomonas aeruginosa PA01
gcggguagcgccggua

SEQ ID NO: 3494304 - RNA, 17 nt, Pseudomonas aeruginosa PA01
gcggguaguagaucagc

SEQ ID NO: 3494305 - RNA, 17 nt, Pseudomonas aeruginosa PA01
gcggguauccgccgggc

SEQ ID NO: 3494306 - RNA, 18 nt, Pseudomonas aeruginosa PA01
gcggguauccgccgggcc

SEQ ID NO: 3494307 - RNA, 20 nt, Pseudomonas aeruginosa PA01
gcggguaucgaucucgaucg

SEQ ID NO: 3494308 - RNA, 19 nt, Pseudomonas aeruginosa PA01
gcgggucaccaccgggaug

SEQ ID NO: 3494309 - RNA, 17 nt, Pseudomonas aeruginosa PA01
gcgggucaccagcgccg

SEQ ID NO: 3494310 - RNA, 14 nt, Pseudomonas aeruginosa PA01
gcgggucacgccga

SEQ ID NO: 3494311 - RNA, 16 nt, Pseudomonas aeruginosa PA01
gcgggucacgccgaag

SEQ ID NO: 3494312 - RNA, 21 nt, Pseudomonas aeruginosa PA01
gcgggucacgccgagggcgcg

SEQ ID NO: 3494313 - RNA, 16 nt, Pseudomonas aeruginosa PA01
gcgggucagaccacga

SEQ ID NO: 3494314 - RNA, 22 nt, Pseudomonas aeruginosa PA01
gcgggucagcagcaccgcgagc

SEQ ID NO: 3494315 - RNA, 15 nt, Pseudomonas aeruginosa PA01
gcgggucagcagugc

SEQ ID NO: 3494316 - RNA, 16 nt, Pseudomonas aeruginosa PA01
gcgggucauagucggu

SEQ ID NO: 3494317 - RNA, 17 nt, Pseudomonas aeruginosa PA01
gcgggucauagucggug

SEQ ID NO: 3494318 - RNA, 19 nt, Pseudomonas aeruginosa PA01
gcgggucaucggcccgacg

SEQ ID NO: 3494319 - RNA, 21 nt, Pseudomonas aeruginosa PA01
gcgggucaucggcccgacgcc

SEQ ID NO: 3494320 - RNA, 14 nt, Pseudomonas aeruginosa PA01
gcgggucaugaggu

SEQ ID NO: 3494321 - RNA, 13 nt, Pseudomonas aeruginosa PA01
gcggguccgcguc

SEQ ID NO: 3494322 - RNA, 19 nt, Pseudomonas aeruginosa PA01
gcgggucgagccaggcgua

SEQ ID NO: 3494323 - RNA, 17 nt, Pseudomonas aeruginosa PA01
gcgggucgaggccgaaa

SEQ ID NO: 3494324 - RNA, 17 nt, Pseudomonas aeruginosa PA01
gcgggucgaucaggcgc

SEQ ID NO: 3494325 - RNA, 18 nt, Pseudomonas aeruginosa PA01
gcgggucgaucaggcgca

SEQ ID NO: 3494326 - RNA, 20 nt, Pseudomonas aeruginosa PA01
gcgggucgaucaggcgcaug

SEQ ID NO: 3494327 - RNA, 13 nt, Pseudomonas aeruginosa PA01
gcgggucggcgga

SEQ ID NO: 3494328 - RNA, 19 nt, Pseudomonas aeruginosa PA01
gcgggucguacaccgcgcg

SEQ ID NO: 3494329 - RNA, 21 nt, Pseudomonas aeruginosa PA01
gcgggucgucgaagcgcagca

SEQ ID NO: 3494330 - RNA, 17 nt, Pseudomonas aeruginosa PA01
gcgggucucgaucagcg

SEQ ID NO: 3494331 - RNA, 21 nt, Pseudomonas aeruginosa PA01
gcgggucucgaucagcgccgg

SEQ ID NO: 3494332 - RNA, 22 nt, Pseudomonas aeruginosa PA01
gcgggucucgaucagcgccggg

SEQ ID NO: 3494333 - RNA, 17 nt, Pseudomonas aeruginosa PA01
gcgggucugcgccucgc

SEQ ID NO: 3494334 - RNA, 14 nt, Pseudomonas aeruginosa PA01
gcgggucugcucgg

SEQ ID NO: 3494335 - RNA, 17 nt, Pseudomonas aeruginosa PA01
gcgggucugcucggcgc

SEQ ID NO: 3494336 - RNA, 18 nt, Pseudomonas aeruginosa PA01
gcgggucugcucggcgcc

SEQ ID NO: 3494337 - RNA, 23 nt, Pseudomonas aeruginosa PA01
gcgggucugcucggcgcccuggg

SEQ ID NO: 3494338 - RNA, 16 nt, Pseudomonas aeruginosa PA01
gcgggucuucaggccg

SEQ ID NO: 3494339 - RNA, 20 nt, Pseudomonas aeruginosa PA01
gcgggucuugccggucugcu

SEQ ID NO: 3494340 - RNA, 15 nt, Pseudomonas aeruginosa PA01
gcgggucuugcgcag

SEQ ID NO: 3494341 - RNA, 17 nt, Pseudomonas aeruginosa PA01
gcgggucuugcgcaggg

SEQ ID NO: 3494342 - RNA, 23 nt, Pseudomonas aeruginosa PA01
gcgggucuugcgcagggcggcga

SEQ ID NO: 3494343 - RNA, 14 nt, Pseudomonas aeruginosa PA01
gcgggugaccuggc

SEQ ID NO: 3494344 - RNA, 22 nt, Pseudomonas aeruginosa PA01
gcgggugauacggcucuugaaa

SEQ ID NO: 3494345 - RNA, 13 nt, Pseudomonas aeruginosa PA01
gcgggugccgaag

SEQ ID NO: 3494346 - RNA, 16 nt, Pseudomonas aeruginosa PA01
gcgggugccgaagacc

SEQ ID NO: 3494347 - RNA, 14 nt, Pseudomonas aeruginosa PA01
gcgggugcgcaggc

SEQ ID NO: 3494348 - RNA, 15 nt, Pseudomonas aeruginosa PA01
gcgggugcgcaggcu

SEQ ID NO: 3494349 - RNA, 16 nt, Pseudomonas aeruginosa PA01
gcgggugcgcaggcug

SEQ ID NO: 3494350 - RNA, 17 nt, Pseudomonas aeruginosa PA01
gcgggugcgcaggcugc

SEQ ID NO: 3494351 - RNA, 18 nt, Pseudomonas aeruginosa PA01
gcgggugcgcaggcugcc

SEQ ID NO: 3494352 - RNA, 23 nt, Pseudomonas aeruginosa PA01
gcgggugcguggugcauccgccg

SEQ ID NO: 3494353 - RNA, 22 nt, Pseudomonas aeruginosa PA01
gcggguggcaacugccgcccgc

SEQ ID NO: 3494354 - RNA, 15 nt, Pseudomonas aeruginosa PA01
gcggguggucgccgc

SEQ ID NO: 3494355 - RNA, 16 nt, Pseudomonas aeruginosa PA01
gcggguggucgccgcc

SEQ ID NO: 3494356 - RNA, 23 nt, Pseudomonas aeruginosa PA01
gcggguggucuugcgcaggcggu

SEQ ID NO: 3494357 - RNA, 16 nt, Pseudomonas aeruginosa PA01
gcgggugucgcgacgg

SEQ ID NO: 3494358 - RNA, 18 nt, Pseudomonas aeruginosa PA01
gcgggugucgcgacggug

SEQ ID NO: 3494359 - RNA, 17 nt, Pseudomonas aeruginosa PA01
gcggguucagcccgccg

SEQ ID NO: 3494360 - RNA, 18 nt, Pseudomonas aeruginosa PA01
gcggguucagcccgccgu

SEQ ID NO: 3494361 - RNA, 19 nt, Pseudomonas aeruginosa PA01
gcggguucagcccgccgug

SEQ ID NO: 3494362 - RNA, 15 nt, Pseudomonas aeruginosa PA01
gcggguucagucggc

SEQ ID NO: 3494363 - RNA, 18 nt, Pseudomonas aeruginosa PA01
gcggguucagucggccag

SEQ ID NO: 3494364 - RNA, 18 nt, Pseudomonas aeruginosa PA01
gcggguucccugcgccuc

SEQ ID NO: 3494365 - RNA, 20 nt, Pseudomonas aeruginosa PA01
gcggguucccugcgccucga

SEQ ID NO: 3494366 - RNA, 19 nt, Pseudomonas aeruginosa PA01
gcggguuccucacggcgca

SEQ ID NO: 3494367 - RNA, 21 nt, Pseudomonas aeruginosa PA01
gcggguuccucacggcgcagc

SEQ ID NO: 3494368 - RNA, 23 nt, Pseudomonas aeruginosa PA01
gcggguuccucacggcgcagccg

SEQ ID NO: 3494369 - RNA, 19 nt, Pseudomonas aeruginosa PA01
gcggguucgagucccgucc

SEQ ID NO: 3494370 - RNA, 21 nt, Pseudomonas aeruginosa PA01
gcggguucgagucccguccgc

SEQ ID NO: 3494371 - RNA, 23 nt, Pseudomonas aeruginosa PA01
gcggguucgagucccguccgcug

SEQ ID NO: 3494372 - RNA, 21 nt, Pseudomonas aeruginosa PA01
gcggguucggcgagaggucgg

SEQ ID NO: 3494373 - RNA, 13 nt, Pseudomonas aeruginosa PA01
gcggguucggcgu

SEQ ID NO: 3494374 - RNA, 19 nt, Pseudomonas aeruginosa PA01
gcggguucgugccaggcgg

SEQ ID NO: 3494375 - RNA, 16 nt, Pseudomonas aeruginosa PA01
gcggguucuugccgcu

SEQ ID NO: 3494376 - RNA, 20 nt, Pseudomonas aeruginosa PA01
gcggguucuugccgcuguug

SEQ ID NO: 3494377 - RNA, 19 nt, Pseudomonas aeruginosa PA01
gcggguugaugucgucgaa

SEQ ID NO: 3494378 - RNA, 14 nt, Pseudomonas aeruginosa PA01
gcggguugcccggc

SEQ ID NO: 3494379 - RNA, 15 nt, Pseudomonas aeruginosa PA01
gcggguugcccggcu

SEQ ID NO: 3494380 - RNA, 18 nt, Pseudomonas aeruginosa PA01
gcggguugcccggcucca

SEQ ID NO: 3494381 - RNA, 18 nt, Pseudomonas aeruginosa PA01
gcggguuggcuuccagcc

SEQ ID NO: 3494382 - RNA, 20 nt, Pseudomonas aeruginosa PA01
gcggguuggcuuccagccag

SEQ ID NO: 3494383 - RNA, 14 nt, Pseudomonas aeruginosa PA01
gcggguuggucggc

SEQ ID NO: 3494384 - RNA, 20 nt, Pseudomonas aeruginosa PA01
gcggguuggucggcaccagg

SEQ ID NO: 3494385 - RNA, 20 nt, Pseudomonas aeruginosa PA01
gcggguuuccgugcgcugcg

SEQ ID NO: 3494386 - RNA, 21 nt, Pseudomonas aeruginosa PA01
gcggguuuccgugcgcugcgc

SEQ ID NO: 3494387 - RNA, 22 nt, Pseudomonas aeruginosa PA01
gcggguuuuuuuaugccucggc

SEQ ID NO: 3494388 - RNA, 23 nt, Pseudomonas aeruginosa PA01
gcggguuuuuuuaugccucggcg

SEQ ID NO: 3494389 - RNA, 17 nt, Pseudomonas aeruginosa PA01
gcgguacaccgccaggg

SEQ ID NO: 3494390 - RNA, 20 nt, Pseudomonas aeruginosa PA01
gcgguacagcccccaggcac

SEQ ID NO: 3494391 - RNA, 14 nt, Pseudomonas aeruginosa PA01
gcgguaccagcagc

SEQ ID NO: 3494392 - RNA, 16 nt, Pseudomonas aeruginosa PA01
gcgguaccagcagcgc

SEQ ID NO: 3494393 - RNA, 17 nt, Pseudomonas aeruginosa PA01
gcgguaccagcagcgcc

SEQ ID NO: 3494394 - RNA, 18 nt, Pseudomonas aeruginosa PA01
gcgguaccagcagcgccg

SEQ ID NO: 3494395 - RNA, 20 nt, Pseudomonas aeruginosa PA01
gcgguaccagcagcgccgaa

SEQ ID NO: 3494396 - RNA, 13 nt, Pseudomonas aeruginosa PA01
gcgguaccagcgc

SEQ ID NO: 3494397 - RNA, 15 nt, Pseudomonas aeruginosa PA01
gcgguaccagcgcac

SEQ ID NO: 3494398 - RNA, 22 nt, Pseudomonas aeruginosa PA01
gcgguacccagcuugcuggcgu

SEQ ID NO: 3494399 - RNA, 13 nt, Pseudomonas aeruginosa PA01
gcgguacccgccg

SEQ ID NO: 3494400 - RNA, 17 nt, Pseudomonas aeruginosa PA01
gcgguacccgccggcca

SEQ ID NO: 3494401 - RNA, 13 nt, Pseudomonas aeruginosa PA01
gcgguaccgggcc

SEQ ID NO: 3494402 - RNA, 16 nt, Pseudomonas aeruginosa PA01
gcgguaccgggccagg

SEQ ID NO: 3494403 - RNA, 19 nt, Pseudomonas aeruginosa PA01
gcgguacgcccuccagcac

SEQ ID NO: 3494404 - RNA, 23 nt, Pseudomonas aeruginosa PA01
gcgguacgcccuccagcacccag

SEQ ID NO: 3494405 - RNA, 14 nt, Pseudomonas aeruginosa PA01
gcgguacgccgcgc

SEQ ID NO: 3494406 - RNA, 15 nt, Pseudomonas aeruginosa PA01
gcgguacgccgcgcu

SEQ ID NO: 3494407 - RNA, 22 nt, Pseudomonas aeruginosa PA01
gcgguacgccgcgcugcgccag

SEQ ID NO: 3494408 - RNA, 23 nt, Pseudomonas aeruginosa PA01
gcgguacuccggguugaccgcca

SEQ ID NO: 3494409 - RNA, 13 nt, Pseudomonas aeruginosa PA01
gcgguagaacagg

SEQ ID NO: 3494410 - RNA, 14 nt, Pseudomonas aeruginosa PA01
gcgguagaacaggc

SEQ ID NO: 3494411 - RNA, 17 nt, Pseudomonas aeruginosa PA01
gcgguagaucuccaccc

SEQ ID NO: 3494412 - RNA, 16 nt, Pseudomonas aeruginosa PA01
gcgguagcccggcagc

SEQ ID NO: 3494413 - RNA, 12 nt, Pseudomonas aeruginosa PA01
gcgguagccgag

SEQ ID NO: 3494414 - RNA, 14 nt, Pseudomonas aeruginosa PA01
gcgguagccgaggc

SEQ ID NO: 3494415 - RNA, 17 nt, Pseudomonas aeruginosa PA01
gcgguagccgaggcggc

SEQ ID NO: 3494416 - RNA, 15 nt, Pseudomonas aeruginosa PA01
gcgguagcgccgcgc

SEQ ID NO: 3494417 - RNA, 18 nt, Pseudomonas aeruginosa PA01
gcgguagcgccgcgccaa

SEQ ID NO: 3494418 - RNA, 14 nt, Pseudomonas aeruginosa PA01
gcgguagcgcgaag

SEQ ID NO: 3494419 - RNA, 19 nt, Pseudomonas aeruginosa PA01
gcgguagcgcgaaggcgcc

SEQ ID NO: 3494420 - RNA, 16 nt, Pseudomonas aeruginosa PA01
gcgguagcgggccagc

SEQ ID NO: 3494421 - RNA, 17 nt, Pseudomonas aeruginosa PA01
gcgguagcgggccagca

SEQ ID NO: 3494422 - RNA, 19 nt, Pseudomonas aeruginosa PA01
gcgguagcgggccagcagc

SEQ ID NO: 3494423 - RNA, 15 nt, Pseudomonas aeruginosa PA01
gcgguagcuccaggc

SEQ ID NO: 3494424 - RNA, 16 nt, Pseudomonas aeruginosa PA01
gcgguagcuccaggcc

SEQ ID NO: 3494425 - RNA, 18 nt, Pseudomonas aeruginosa PA01
gcgguagcuccaggccga

SEQ ID NO: 3494426 - RNA, 16 nt, Pseudomonas aeruginosa PA01
gcgguagcugcgcagg

SEQ ID NO: 3494427 - RNA, 17 nt, Pseudomonas aeruginosa PA01
gcgguagcugcgcaggg

SEQ ID NO: 3494428 - RNA, 13 nt, Pseudomonas aeruginosa PA01
gcgguaggcgcgu

SEQ ID NO: 3494429 - RNA, 16 nt, Pseudomonas aeruginosa PA01
gcgguaggcgcguggg

SEQ ID NO: 3494430 - RNA, 13 nt, Pseudomonas aeruginosa PA01
gcgguagggaucg

SEQ ID NO: 3494431 - RNA, 17 nt, Pseudomonas aeruginosa PA01
gcgguagggaucgucgc

SEQ ID NO: 3494432 - RNA, 19 nt, Pseudomonas aeruginosa PA01
gcgguagggaucgucgcca

SEQ ID NO: 3494433 - RNA, 21 nt, Pseudomonas aeruginosa PA01
gcgguagggaucgucgccaag

SEQ ID NO: 3494434 - RNA, 13 nt, Pseudomonas aeruginosa PA01
gcgguaggugaug

SEQ ID NO: 3494435 - RNA, 21 nt, Pseudomonas aeruginosa PA01
gcgguaguaggguucgccgac

SEQ ID NO: 3494436 - RNA, 22 nt, Pseudomonas aeruginosa PA01
gcgguaguaggguucgccgacg

SEQ ID NO: 3494437 - RNA, 16 nt, Pseudomonas aeruginosa PA01
gcgguaguccacggag

SEQ ID NO: 3494438 - RNA, 17 nt, Pseudomonas aeruginosa PA01
gcgguagucgcugcugg

SEQ ID NO: 3494439 - RNA, 21 nt, Pseudomonas aeruginosa PA01
gcgguagucgcugcuggcgcc

SEQ ID NO: 3494440 - RNA, 15 nt, Pseudomonas aeruginosa PA01
gcgguagugggcgag

SEQ ID NO: 3494441 - RNA, 21 nt, Pseudomonas aeruginosa PA01
gcgguauagcucauggccagg

SEQ ID NO: 3494442 - RNA, 22 nt, Pseudomonas aeruginosa PA01
gcgguauagcucauggccaggu

SEQ ID NO: 3494443 - RNA, 13 nt, Pseudomonas aeruginosa PA01
gcgguaugccgga

SEQ ID NO: 3494444 - RNA, 17 nt, Pseudomonas aeruginosa PA01
gcgguauucuccagcag

SEQ ID NO: 3494445 - RNA, 20 nt, Pseudomonas aeruginosa PA01
gcgguauucuccagcaggcu

SEQ ID NO: 3494446 - RNA, 21 nt, Pseudomonas aeruginosa PA01
gcgguauugucgaugggcagg

SEQ ID NO: 3494447 - RNA, 20 nt, Pseudomonas aeruginosa PA01
gcggucacccauucgaugcc

SEQ ID NO: 3494448 - RNA, 22 nt, Pseudomonas aeruginosa PA01
gcggucacccauucgaugccgc

SEQ ID NO: 3494449 - RNA, 23 nt, Pseudomonas aeruginosa PA01
gcggucagcuugcccucagggaa

SEQ ID NO: 3494450 - RNA, 16 nt, Pseudomonas aeruginosa PA01
gcggucaggccaagcu

SEQ ID NO: 3494451 - RNA, 14 nt, Pseudomonas aeruginosa PA01
gcggucauccgccg

SEQ ID NO: 3494452 - RNA, 14 nt, Pseudomonas aeruginosa PA01
gcggucaucgccgg

SEQ ID NO: 3494453 - RNA, 16 nt, Pseudomonas aeruginosa PA01
gcggucaucgccggcg

SEQ ID NO: 3494454 - RNA, 17 nt, Pseudomonas aeruginosa PA01
gcggucaucgccggcgc

SEQ ID NO: 3494455 - RNA, 15 nt, Pseudomonas aeruginosa PA01
gcggucaucgcgccg

SEQ ID NO: 3494456 - RNA, 16 nt, Pseudomonas aeruginosa PA01
gcggucaucgcgccgc

SEQ ID NO: 3494457 - RNA, 20 nt, Pseudomonas aeruginosa PA01
gcggucaucgcgccgccgaa

SEQ ID NO: 3494458 - RNA, 20 nt, Pseudomonas aeruginosa PA01
gcggucaugcccuugucgcc

SEQ ID NO: 3494459 - RNA, 22 nt, Pseudomonas aeruginosa PA01
gcggucaugcccuugucgcccu

SEQ ID NO: 3494460 - RNA, 20 nt, Pseudomonas aeruginosa PA01
gcgguccagcgagcgggcga

SEQ ID NO: 3494461 - RNA, 20 nt, Pseudomonas aeruginosa PA01
gcgguccaggggccgaugcc

SEQ ID NO: 3494462 - RNA, 22 nt, Pseudomonas aeruginosa PA01
gcgguccaggucaugcccuggc

SEQ ID NO: 3494463 - RNA, 16 nt, Pseudomonas aeruginosa PA01
gcgguccaucccuucg

SEQ ID NO: 3494464 - RNA, 23 nt, Pseudomonas aeruginosa PA01
gcgguccaucccuucgugcuggc

SEQ ID NO: 3494465 - RNA, 20 nt, Pseudomonas aeruginosa PA01
gcggucccgggaaaccacca

SEQ ID NO: 3494466 - RNA, 14 nt, Pseudomonas aeruginosa PA01
gcggucccuggauc

SEQ ID NO: 3494467 - RNA, 17 nt, Pseudomonas aeruginosa PA01
gcggucccuucgugggc

SEQ ID NO: 3494468 - RNA, 20 nt, Pseudomonas aeruginosa PA01
gcggucccuucgugggccug

SEQ ID NO: 3494469 - RNA, 24 nt, Pseudomonas aeruginosa PA01
gcggucccuucgugggccugcucg

SEQ ID NO: 3494470 - RNA, 14 nt, Pseudomonas aeruginosa PA01
gcgguccgccgcgg

SEQ ID NO: 3494471 - RNA, 12 nt, Pseudomonas aeruginosa PA01
gcgguccggcga

SEQ ID NO: 3494472 - RNA, 14 nt, Pseudomonas aeruginosa PA01
gcgguccggcgaag

SEQ ID NO: 3494473 - RNA, 20 nt, Pseudomonas aeruginosa PA01
gcgguccucgggcaccagca

SEQ ID NO: 3494474 - RNA, 22 nt, Pseudomonas aeruginosa PA01
gcgguccucgggcaccagcacg

SEQ ID NO: 3494475 - RNA, 15 nt, Pseudomonas aeruginosa PA01
gcggucgagcagcgc

SEQ ID NO: 3494476 - RNA, 17 nt, Pseudomonas aeruginosa PA01
gcggucgagcagcgccg

SEQ ID NO: 3494477 - RNA, 17 nt, Pseudomonas aeruginosa PA01
gcggucgagcucggcca

SEQ ID NO: 3494478 - RNA, 18 nt, Pseudomonas aeruginosa PA01
gcggucgagcucggccag

SEQ ID NO: 3494479 - RNA, 20 nt, Pseudomonas aeruginosa PA01
gcggucgagcucggccaggc

SEQ ID NO: 3494480 - RNA, 23 nt, Pseudomonas aeruginosa PA01
gcggucgagcucggccaggcaca

SEQ ID NO: 3494481 - RNA, 23 nt, Pseudomonas aeruginosa PA01
gcggucgaggcccucggcggcga

SEQ ID NO: 3494482 - RNA, 22 nt, Pseudomonas aeruginosa PA01
gcggucgauccgaccuggggcg

SEQ ID NO: 3494483 - RNA, 15 nt, Pseudomonas aeruginosa PA01
gcggucgauguccug

SEQ ID NO: 3494484 - RNA, 20 nt, Pseudomonas aeruginosa PA01
gcggucgauguccugggcca

SEQ ID NO: 3494485 - RNA, 21 nt, Pseudomonas aeruginosa PA01
gcggucgauguccugggccac

SEQ ID NO: 3494486 - RNA, 15 nt, Pseudomonas aeruginosa PA01
gcggucgaugucgcg

SEQ ID NO: 3494487 - RNA, 17 nt, Pseudomonas aeruginosa PA01
gcggucgaugucgcggc

SEQ ID NO: 3494488 - RNA, 19 nt, Pseudomonas aeruginosa PA01
gcggucgaugucgcggccc

SEQ ID NO: 3494489 - RNA, 13 nt, Pseudomonas aeruginosa PA01
gcggucgccgaac

SEQ ID NO: 3494490 - RNA, 17 nt, Pseudomonas aeruginosa PA01
gcggucgccgaacagcc

SEQ ID NO: 3494491 - RNA, 23 nt, Pseudomonas aeruginosa PA01
gcggucgccgaacagccgcccca

SEQ ID NO: 3494492 - RNA, 16 nt, Pseudomonas aeruginosa PA01
gcggucgccgccggcg

SEQ ID NO: 3494493 - RNA, 18 nt, Pseudomonas aeruginosa PA01
gcggucgccgccggcgaa

SEQ ID NO: 3494494 - RNA, 22 nt, Pseudomonas aeruginosa PA01
gcggucgccgccggcgaacagc

SEQ ID NO: 3494495 - RNA, 14 nt, Pseudomonas aeruginosa PA01
gcggucgccggucg

SEQ ID NO: 3494496 - RNA, 14 nt, Pseudomonas aeruginosa PA01
gcggucgcgcccgc

SEQ ID NO: 3494497 - RNA, 20 nt, Pseudomonas aeruginosa PA01
gcggucgcgcccgcugugcg

SEQ ID NO: 3494498 - RNA, 17 nt, Pseudomonas aeruginosa PA01
gcggucgcggaccucca

SEQ ID NO: 3494499 - RNA, 23 nt, Pseudomonas aeruginosa PA01
gcggucgcggaccuccagccggc

SEQ ID NO: 3494500 - RNA, 19 nt, Pseudomonas aeruginosa PA01
gcggucggaaagcagggcg

SEQ ID NO: 3494501 - RNA, 14 nt, Pseudomonas aeruginosa PA01
gcggucggaucgga

SEQ ID NO: 3494502 - RNA, 14 nt, Pseudomonas aeruginosa PA01
gcggucggccaggc

SEQ ID NO: 3494503 - RNA, 15 nt, Pseudomonas aeruginosa PA01
gcggucggccaggcg

SEQ ID NO: 3494504 - RNA, 17 nt, Pseudomonas aeruginosa PA01
gcggucggccaggcggc

SEQ ID NO: 3494505 - RNA, 20 nt, Pseudomonas aeruginosa PA01
gcggucggccaggcggccga

SEQ ID NO: 3494506 - RNA, 22 nt, Pseudomonas aeruginosa PA01
gcggucggcgagggcaccacgu

SEQ ID NO: 3494507 - RNA, 17 nt, Pseudomonas aeruginosa PA01
gcggucggcucagccga

SEQ ID NO: 3494508 - RNA, 22 nt, Pseudomonas aeruginosa PA01
gcggucgggcagauguccaggc

SEQ ID NO: 3494509 - RNA, 16 nt, Pseudomonas aeruginosa PA01
gcggucguagcccaug

SEQ ID NO: 3494510 - RNA, 18 nt, Pseudomonas aeruginosa PA01
gcggucguagcccauggu

SEQ ID NO: 3494511 - RNA, 20 nt, Pseudomonas aeruginosa PA01
gcggucguagcccaugguca

SEQ ID NO: 3494512 - RNA, 18 nt, Pseudomonas aeruginosa PA01
gcggucguaggaacgugc

SEQ ID NO: 3494513 - RNA, 19 nt, Pseudomonas aeruginosa PA01
gcggucgugcagcagcgcc

SEQ ID NO: 3494514 - RNA, 20 nt, Pseudomonas aeruginosa PA01
gcggucgugcagcagcgccu

SEQ ID NO: 3494515 - RNA, 15 nt, Pseudomonas aeruginosa PA01
gcggucucgaacgcc

SEQ ID NO: 3494516 - RNA, 19 nt, Pseudomonas aeruginosa PA01
gcggucucgaacgccaggc

SEQ ID NO: 3494517 - RNA, 17 nt, Pseudomonas aeruginosa PA01
gcggucucuucgucggu

SEQ ID NO: 3494518 - RNA, 17 nt, Pseudomonas aeruginosa PA01
gcggucuucaucaccuu

SEQ ID NO: 3494519 - RNA, 22 nt, Pseudomonas aeruginosa PA01
gcggucuucaucaccuugcccg

SEQ ID NO: 3494520 - RNA, 21 nt, Pseudomonas aeruginosa PA01
gcggucuucccguaaggccag

SEQ ID NO: 3494521 - RNA, 22 nt, Pseudomonas aeruginosa PA01
gcggucuucccguaaggccagg

SEQ ID NO: 3494522 - RNA, 23 nt, Pseudomonas aeruginosa PA01
gcggucuucccguaaggccaggc

SEQ ID NO: 3494523 - RNA, 20 nt, Pseudomonas aeruginosa PA01
gcggucuucgcguuggcggu

SEQ ID NO: 3494524 - RNA, 22 nt, Pseudomonas aeruginosa PA01
gcggucuucgcguuggcggugc

SEQ ID NO: 3494525 - RNA, 24 nt, Pseudomonas aeruginosa PA01
gcggugaaaccggcaagcuccgcg

SEQ ID NO: 3494526 - RNA, 17 nt, Pseudomonas aeruginosa PA01
gcggugaccagcggcac

SEQ ID NO: 3494527 - RNA, 22 nt, Pseudomonas aeruginosa PA01
gcggugaccguuucgccgccgg

SEQ ID NO: 3494528 - RNA, 18 nt, Pseudomonas aeruginosa PA01
gcggugagcagggugacg

SEQ ID NO: 3494529 - RNA, 13 nt, Pseudomonas aeruginosa PA01
gcggugagggcga

SEQ ID NO: 3494530 - RNA, 17 nt, Pseudomonas aeruginosa PA01
gcggugagggcgacggc

SEQ ID NO: 3494531 - RNA, 19 nt, Pseudomonas aeruginosa PA01
gcggugagguugccgccga

SEQ ID NO: 3494532 - RNA, 20 nt, Pseudomonas aeruginosa PA01
gcggugagguugccgccgau

SEQ ID NO: 3494533 - RNA, 22 nt, Pseudomonas aeruginosa PA01
gcggugaucgaaaaaaggcgcc

SEQ ID NO: 3494534 - RNA, 21 nt, Pseudomonas aeruginosa PA01
gcggugccauucggugcgcuc

SEQ ID NO: 3494535 - RNA, 23 nt, Pseudomonas aeruginosa PA01
gcggugccgcagacaucgccgag

SEQ ID NO: 3494536 - RNA, 11 nt, Pseudomonas aeruginosa PA01
gcggugccgcg

SEQ ID NO: 3494537 - RNA, 13 nt, Pseudomonas aeruginosa PA01
gcggugccgcgca

SEQ ID NO: 3494538 - RNA, 14 nt, Pseudomonas aeruginosa PA01
gcggugccgcgcag

SEQ ID NO: 3494539 - RNA, 22 nt, Pseudomonas aeruginosa PA01
gcggugcgcaugucguccaggc

SEQ ID NO: 3494540 - RNA, 13 nt, Pseudomonas aeruginosa PA01
gcggugcgccggc

SEQ ID NO: 3494541 - RNA, 13 nt, Pseudomonas aeruginosa PA01
gcggugcgcgcca

SEQ ID NO: 3494542 - RNA, 15 nt, Pseudomonas aeruginosa PA01
gcggugcgcgccauc

SEQ ID NO: 3494543 - RNA, 17 nt, Pseudomonas aeruginosa PA01
gcggugcgcgccaucaa

SEQ ID NO: 3494544 - RNA, 13 nt, Pseudomonas aeruginosa PA01
gcggugcggaugg

SEQ ID NO: 3494545 - RNA, 13 nt, Pseudomonas aeruginosa PA01
gcggugcggucgg

SEQ ID NO: 3494546 - RNA, 16 nt, Pseudomonas aeruginosa PA01
gcggugcggucggcgc

SEQ ID NO: 3494547 - RNA, 17 nt, Pseudomonas aeruginosa PA01
gcggugcggucggcgcc

SEQ ID NO: 3494548 - RNA, 20 nt, Pseudomonas aeruginosa PA01
gcggugcguucgcgggcgcc

SEQ ID NO: 3494549 - RNA, 17 nt, Pseudomonas aeruginosa PA01
gcgguggaugccggugg

SEQ ID NO: 3494550 - RNA, 19 nt, Pseudomonas aeruginosa PA01
gcgguggccacgucgcccc

SEQ ID NO: 3494551 - RNA, 20 nt, Pseudomonas aeruginosa PA01
gcgguggccacgucgcccca

SEQ ID NO: 3494552 - RNA, 13 nt, Pseudomonas aeruginosa PA01
gcgguggcgauca

SEQ ID NO: 3494553 - RNA, 17 nt, Pseudomonas aeruginosa PA01
gcggugggcgagggcgc

SEQ ID NO: 3494554 - RNA, 15 nt, Pseudomonas aeruginosa PA01
gcgguggggccgccg

SEQ ID NO: 3494555 - RNA, 17 nt, Pseudomonas aeruginosa PA01
gcgguggggccgccgau

SEQ ID NO: 3494556 - RNA, 18 nt, Pseudomonas aeruginosa PA01
gcgguggggccgccgaug

SEQ ID NO: 3494557 - RNA, 18 nt, Pseudomonas aeruginosa PA01
gcgguguagaccaccagc

SEQ ID NO: 3494558 - RNA, 19 nt, Pseudomonas aeruginosa PA01
gcgguguagaccaccagca

SEQ ID NO: 3494559 - RNA, 21 nt, Pseudomonas aeruginosa PA01
gcggugucgcgguugcgcugc

SEQ ID NO: 3494560 - RNA, 14 nt, Pseudomonas aeruginosa PA01
gcggugugcucagg

SEQ ID NO: 3494561 - RNA, 19 nt, Pseudomonas aeruginosa PA01
gcgguguuuccgucguggc

SEQ ID NO: 3494562 - RNA, 20 nt, Pseudomonas aeruginosa PA01
gcgguguuuccgucguggcg

SEQ ID NO: 3494563 - RNA, 13 nt, Pseudomonas aeruginosa PA01
gcgguuagccggc

SEQ ID NO: 3494564 - RNA, 14 nt, Pseudomonas aeruginosa PA01
gcgguuauccgccg

SEQ ID NO: 3494565 - RNA, 18 nt, Pseudomonas aeruginosa PA01
gcgguuauccgccgccgg

SEQ ID NO: 3494566 - RNA, 17 nt, Pseudomonas aeruginosa PA01
gcgguuauccgccggcu

SEQ ID NO: 3494567 - RNA, 17 nt, Pseudomonas aeruginosa PA01
gcgguuauccgccggug

SEQ ID NO: 3494568 - RNA, 20 nt, Pseudomonas aeruginosa PA01
gcgguuauucgcccuaccgc

SEQ ID NO: 3494569 - RNA, 21 nt, Pseudomonas aeruginosa PA01
gcgguuauucgcccuaccgcc

SEQ ID NO: 3494570 - RNA, 14 nt, Pseudomonas aeruginosa PA01
gcgguucaggucga

SEQ ID NO: 3494571 - RNA, 22 nt, Pseudomonas aeruginosa PA01
gcgguuccacucccaugccagg

SEQ ID NO: 3494572 - RNA, 14 nt, Pseudomonas aeruginosa PA01
gcgguucgaggacu

SEQ ID NO: 3494573 - RNA, 16 nt, Pseudomonas aeruginosa PA01
gcgguucgaucccguc

SEQ ID NO: 3494574 - RNA, 18 nt, Pseudomonas aeruginosa PA01
gcgguucgccgagcgccg

SEQ ID NO: 3494575 - RNA, 15 nt, Pseudomonas aeruginosa PA01
gcgguucgccuuccc

SEQ ID NO: 3494576 - RNA, 21 nt, Pseudomonas aeruginosa PA01
gcgguucucgucgaugucgcg

SEQ ID NO: 3494577 - RNA, 14 nt, Pseudomonas aeruginosa PA01
gcgguugaaacugc

SEQ ID NO: 3494578 - RNA, 18 nt, Pseudomonas aeruginosa PA01
gcgguugaaacugcgcag

SEQ ID NO: 3494579 - RNA, 23 nt, Pseudomonas aeruginosa PA01
gcgguugaaacugcgcaggcugg

SEQ ID NO: 3494580 - RNA, 15 nt, Pseudomonas aeruginosa PA01
gcgguugagcagggc

SEQ ID NO: 3494581 - RNA, 17 nt, Pseudomonas aeruginosa PA01
gcgguugaugccgacgu

SEQ ID NO: 3494582 - RNA, 15 nt, Pseudomonas aeruginosa PA01
gcgguugccgaagcg

SEQ ID NO: 3494583 - RNA, 23 nt, Pseudomonas aeruginosa PA01
gcgguugccgaagcgcucgguca

SEQ ID NO: 3494584 - RNA, 12 nt, Pseudomonas aeruginosa PA01
gcgguugccgcu

SEQ ID NO: 3494585 - RNA, 19 nt, Pseudomonas aeruginosa PA01
gcgguugccgcugcggcgg

SEQ ID NO: 3494586 - RNA, 21 nt, Pseudomonas aeruginosa PA01
gcgguugccggagacgauggc

SEQ ID NO: 3494587 - RNA, 13 nt, Pseudomonas aeruginosa PA01
gcgguugcgcugc

SEQ ID NO: 3494588 - RNA, 14 nt, Pseudomonas aeruginosa PA01
gcgguugcgcugcu

SEQ ID NO: 3494589 - RNA, 14 nt, Pseudomonas aeruginosa PA01
gcgguugcggaacu

SEQ ID NO: 3494590 - RNA, 16 nt, Pseudomonas aeruginosa PA01
gcgguugcgggucagc

SEQ ID NO: 3494591 - RNA, 16 nt, Pseudomonas aeruginosa PA01
gcgguuggagcgagcg

SEQ ID NO: 3494592 - RNA, 14 nt, Pseudomonas aeruginosa PA01
gcgguuggcccgcg

SEQ ID NO: 3494593 - RNA, 17 nt, Pseudomonas aeruginosa PA01
gcgguuggcccgcgccg

SEQ ID NO: 3494594 - RNA, 22 nt, Pseudomonas aeruginosa PA01
gcgguuggcgccucgcaaaggu

SEQ ID NO: 3494595 - RNA, 23 nt, Pseudomonas aeruginosa PA01
gcgguuuccaguucaucgagcag

SEQ ID NO: 3494596 - RNA, 13 nt, Pseudomonas aeruginosa PA01
gcgguuucgcagc

SEQ ID NO: 3494597 - RNA, 15 nt, Pseudomonas aeruginosa PA01
gcgguuucgccaccu

SEQ ID NO: 3494598 - RNA, 15 nt, Pseudomonas aeruginosa PA01
gcgguuucgccgagg

SEQ ID NO: 3494599 - RNA, 15 nt, Pseudomonas aeruginosa PA01
gcgguuucgucgaag

SEQ ID NO: 3494600 - RNA, 20 nt, Pseudomonas aeruginosa PA01
gcgguuucuucgccuugccc

SEQ ID NO: 3494601 - RNA, 22 nt, Pseudomonas aeruginosa PA01
gcguaacggcuugccgguaggg

SEQ ID NO: 3494602 - RNA, 20 nt, Pseudomonas aeruginosa PA01
gcguaacguuacgcagauag

SEQ ID NO: 3494603 - RNA, 21 nt, Pseudomonas aeruginosa PA01
gcguaacuguaccgcucugca

SEQ ID NO: 3494604 - RNA, 12 nt, Pseudomonas aeruginosa PA01
gcguaagcggcc

SEQ ID NO: 3494605 - RNA, 18 nt, Pseudomonas aeruginosa PA01
gcguaauaggcgaagcgg

SEQ ID NO: 3494606 - RNA, 23 nt, Pseudomonas aeruginosa PA01
gcguaauaggcgaagcggcucgg

SEQ ID NO: 3494607 - RNA, 18 nt, Pseudomonas aeruginosa PA01
gcguaaucgcgccaggcc

SEQ ID NO: 3494608 - RNA, 16 nt, Pseudomonas aeruginosa PA01
gcguacaggccccagg

SEQ ID NO: 3494609 - RNA, 16 nt, Pseudomonas aeruginosa PA01
gcguaccagccgcggu

SEQ ID NO: 3494610 - RNA, 18 nt, Pseudomonas aeruginosa PA01
gcguaccagcuugucgcc

SEQ ID NO: 3494611 - RNA, 17 nt, Pseudomonas aeruginosa PA01
gcguaccucgccaggcu

SEQ ID NO: 3494612 - RNA, 19 nt, Pseudomonas aeruginosa PA01
gcguaccucgccaggcugg

SEQ ID NO: 3494613 - RNA, 19 nt, Pseudomonas aeruginosa PA01
gcguacgacuucggcgaca

SEQ ID NO: 3494614 - RNA, 12 nt, Pseudomonas aeruginosa PA01
gcguacgcccag

SEQ ID NO: 3494615 - RNA, 20 nt, Pseudomonas aeruginosa PA01
gcguacgcccagcagcggca

SEQ ID NO: 3494616 - RNA, 22 nt, Pseudomonas aeruginosa PA01
gcguacgcccagcagcggcagg

SEQ ID NO: 3494617 - RNA, 23 nt, Pseudomonas aeruginosa PA01
gcguacgucgauauugccgcggg

SEQ ID NO: 3494618 - RNA, 13 nt, Pseudomonas aeruginosa PA01
gcguacuuggccc

SEQ ID NO: 3494619 - RNA, 17 nt, Pseudomonas aeruginosa PA01
gcguagaaacgcgccuc

SEQ ID NO: 3494620 - RNA, 21 nt, Pseudomonas aeruginosa PA01
gcguagaagucguccucgccc

SEQ ID NO: 3494621 - RNA, 17 nt, Pseudomonas aeruginosa PA01
gcguagaccaccucgac

SEQ ID NO: 3494622 - RNA, 18 nt, Pseudomonas aeruginosa PA01
gcguagaccaucgccggc

SEQ ID NO: 3494623 - RNA, 19 nt, Pseudomonas aeruginosa PA01
gcguagaccaucgccggcg

SEQ ID NO: 3494624 - RNA, 22 nt, Pseudomonas aeruginosa PA01
gcguagaccaucgccggcgagc

SEQ ID NO: 3494625 - RNA, 17 nt, Pseudomonas aeruginosa PA01
gcguagaccuucucguc

SEQ ID NO: 3494626 - RNA, 18 nt, Pseudomonas aeruginosa PA01
gcguagaccuucucgucc

SEQ ID NO: 3494627 - RNA, 17 nt, Pseudomonas aeruginosa PA01
gcguagaguucgcugcg

SEQ ID NO: 3494628 - RNA, 21 nt, Pseudomonas aeruginosa PA01
gcguagaguucgcugcgcgcc

SEQ ID NO: 3494629 - RNA, 17 nt, Pseudomonas aeruginosa PA01
gcguagccccucgcgca

SEQ ID NO: 3494630 - RNA, 15 nt, Pseudomonas aeruginosa PA01
gcguagccggccagg

SEQ ID NO: 3494631 - RNA, 14 nt, Pseudomonas aeruginosa PA01
gcguagcgccaggc

SEQ ID NO: 3494632 - RNA, 15 nt, Pseudomonas aeruginosa PA01
gcguagcgccaggcc

SEQ ID NO: 3494633 - RNA, 19 nt, Pseudomonas aeruginosa PA01
gcguagcgccccuuggcca

SEQ ID NO: 3494634 - RNA, 23 nt, Pseudomonas aeruginosa PA01
gcguagcgccccuuggccagcac

SEQ ID NO: 3494635 - RNA, 19 nt, Pseudomonas aeruginosa PA01
gcguagcgcggcagcgcca

SEQ ID NO: 3494636 - RNA, 20 nt, Pseudomonas aeruginosa PA01
gcguagcgcggcagcgccau

SEQ ID NO: 3494637 - RNA, 17 nt, Pseudomonas aeruginosa PA01
gcguagcgcuucccgcg

SEQ ID NO: 3494638 - RNA, 21 nt, Pseudomonas aeruginosa PA01
gcguagcgcuucccgcggcuc

SEQ ID NO: 3494639 - RNA, 13 nt, Pseudomonas aeruginosa PA01
gcguagcgugccg

SEQ ID NO: 3494640 - RNA, 14 nt, Pseudomonas aeruginosa PA01
gcguagcgugccgc

SEQ ID NO: 3494641 - RNA, 16 nt, Pseudomonas aeruginosa PA01
gcguaggccgucgcug

SEQ ID NO: 3494642 - RNA, 19 nt, Pseudomonas aeruginosa PA01
gcguaggccgucgcugccg

SEQ ID NO: 3494643 - RNA, 13 nt, Pseudomonas aeruginosa PA01
gcguaggccucgg

SEQ ID NO: 3494644 - RNA, 13 nt, Pseudomonas aeruginosa PA01
gcguaggcgcgcc

SEQ ID NO: 3494645 - RNA, 15 nt, Pseudomonas aeruginosa PA01
gcguaggcgcgccaa

SEQ ID NO: 3494646 - RNA, 22 nt, Pseudomonas aeruginosa PA01
gcguaggcgcgccaaggccgcc

SEQ ID NO: 3494647 - RNA, 14 nt, Pseudomonas aeruginosa PA01
gcguaggcggugcg

SEQ ID NO: 3494648 - RNA, 18 nt, Pseudomonas aeruginosa PA01
gcguaggcgucgcgaacc

SEQ ID NO: 3494649 - RNA, 21 nt, Pseudomonas aeruginosa PA01
gcguaggcuuggucgggcgcc

SEQ ID NO: 3494650 - RNA, 17 nt, Pseudomonas aeruginosa PA01
gcguagguggcgccgcc

SEQ ID NO: 3494651 - RNA, 19 nt, Pseudomonas aeruginosa PA01
gcguagguggcgccgccgg

SEQ ID NO: 3494652 - RNA, 22 nt, Pseudomonas aeruginosa PA01
gcguagguggcgccgccggcga

SEQ ID NO: 3494653 - RNA, 15 nt, Pseudomonas aeruginosa PA01
gcguagugcaucagc

SEQ ID NO: 3494654 - RNA, 17 nt, Pseudomonas aeruginosa PA01
gcguagugcaucagccu

SEQ ID NO: 3494655 - RNA, 18 nt, Pseudomonas aeruginosa PA01
gcguagugcaucagccug

SEQ ID NO: 3494656 - RNA, 14 nt, Pseudomonas aeruginosa PA01
gcguaguggugcca

SEQ ID NO: 3494657 - RNA, 16 nt, Pseudomonas aeruginosa PA01
gcguaguugagcccca

SEQ ID NO: 3494658 - RNA, 18 nt, Pseudomonas aeruginosa PA01
gcguaguugagccccagg

SEQ ID NO: 3494659 - RNA, 14 nt, Pseudomonas aeruginosa PA01
gcguauaaccgcuc

SEQ ID NO: 3494660 - RNA, 15 nt, Pseudomonas aeruginosa PA01
gcguauccucggcca

SEQ ID NO: 3494661 - RNA, 14 nt, Pseudomonas aeruginosa PA01
gcguaucgaugcgc

SEQ ID NO: 3494662 - RNA, 18 nt, Pseudomonas aeruginosa PA01
gcguaucgaugcgcgcgg

SEQ ID NO: 3494663 - RNA, 16 nt, Pseudomonas aeruginosa PA01
gcguaugcgccuccag

SEQ ID NO: 3494664 - RNA, 16 nt, Pseudomonas aeruginosa PA01
gcguauucgccgaaga

SEQ ID NO: 3494665 - RNA, 17 nt, Pseudomonas aeruginosa PA01
gcgucaacgaagucgcg

SEQ ID NO: 3494666 - RNA, 18 nt, Pseudomonas aeruginosa PA01
gcgucaacgaagucgcga

SEQ ID NO: 3494667 - RNA, 16 nt, Pseudomonas aeruginosa PA01
gcgucaccgcgccgaa

SEQ ID NO: 3494668 - RNA, 20 nt, Pseudomonas aeruginosa PA01
gcgucacgccgaucccggcg

SEQ ID NO: 3494669 - RNA, 21 nt, Pseudomonas aeruginosa PA01
gcgucacgccgaucccggcgg

SEQ ID NO: 3494670 - RNA, 18 nt, Pseudomonas aeruginosa PA01
gcgucacggacccgcucg

SEQ ID NO: 3494671 - RNA, 19 nt, Pseudomonas aeruginosa PA01
gcgucacggacccgcucgg

SEQ ID NO: 3494672 - RNA, 16 nt, Pseudomonas aeruginosa PA01
gcgucacucgacaggc

SEQ ID NO: 3494673 - RNA, 13 nt, Pseudomonas aeruginosa PA01
gcgucagccgcgg

SEQ ID NO: 3494674 - RNA, 14 nt, Pseudomonas aeruginosa PA01
gcgucagccgcggc

SEQ ID NO: 3494675 - RNA, 17 nt, Pseudomonas aeruginosa PA01
gcgucagccgcggccgg

SEQ ID NO: 3494676 - RNA, 21 nt, Pseudomonas aeruginosa PA01
gcgucagcgaggcgggcgcgg

SEQ ID NO: 3494677 - RNA, 22 nt, Pseudomonas aeruginosa PA01
gcgucagcgaggcgggcgcgga

SEQ ID NO: 3494678 - RNA, 18 nt, Pseudomonas aeruginosa PA01
gcgucagcgcgccagcac

SEQ ID NO: 3494679 - RNA, 22 nt, Pseudomonas aeruginosa PA01
gcgucaguuccgcaucggccac

SEQ ID NO: 3494680 - RNA, 12 nt, Pseudomonas aeruginosa PA01
gcgucauccgcc

SEQ ID NO: 3494681 - RNA, 13 nt, Pseudomonas aeruginosa PA01
gcgucauccgcca

SEQ ID NO: 3494682 - RNA, 17 nt, Pseudomonas aeruginosa PA01
gcgucauccgccaaccg

SEQ ID NO: 3494683 - RNA, 15 nt, Pseudomonas aeruginosa PA01
gcgucaugccgccgu

SEQ ID NO: 3494684 - RNA, 20 nt, Pseudomonas aeruginosa PA01
gcgucaugccgccgucgcgg

SEQ ID NO: 3494685 - RNA, 16 nt, Pseudomonas aeruginosa PA01
gcguccaccagcgccc

SEQ ID NO: 3494686 - RNA, 22 nt, Pseudomonas aeruginosa PA01
gcguccaccagcgcccguagca

SEQ ID NO: 3494687 - RNA, 16 nt, Pseudomonas aeruginosa PA01
gcguccaccggcgccc

SEQ ID NO: 3494688 - RNA, 16 nt, Pseudomonas aeruginosa PA01
gcguccaccuggcggc

SEQ ID NO: 3494689 - RNA, 21 nt, Pseudomonas aeruginosa PA01
gcguccaccuggcggcugagc

SEQ ID NO: 3494690 - RNA, 15 nt, Pseudomonas aeruginosa PA01
gcguccacuccggca

SEQ ID NO: 3494691 - RNA, 18 nt, Pseudomonas aeruginosa PA01
gcguccacuccggcagca

SEQ ID NO: 3494692 - RNA, 21 nt, Pseudomonas aeruginosa PA01
gcguccacuccggcagcaccc

SEQ ID NO: 3494693 - RNA, 13 nt, Pseudomonas aeruginosa PA01
gcguccagcaggu

SEQ ID NO: 3494694 - RNA, 13 nt, Pseudomonas aeruginosa PA01
gcguccagccggu

SEQ ID NO: 3494695 - RNA, 17 nt, Pseudomonas aeruginosa PA01
gcguccagcuccaccag

SEQ ID NO: 3494696 - RNA, 19 nt, Pseudomonas aeruginosa PA01
gcguccagcuccaccaggc

SEQ ID NO: 3494697 - RNA, 20 nt, Pseudomonas aeruginosa PA01
gcguccagcuccaccaggcc

SEQ ID NO: 3494698 - RNA, 19 nt, Pseudomonas aeruginosa PA01
gcguccagcucgucgugga

SEQ ID NO: 3494699 - RNA, 16 nt, Pseudomonas aeruginosa PA01
gcguccagggcuucga

SEQ ID NO: 3494700 - RNA, 13 nt, Pseudomonas aeruginosa PA01
gcguccaggugcg

SEQ ID NO: 3494701 - RNA, 17 nt, Pseudomonas aeruginosa PA01
gcguccaggugcggcug

SEQ ID NO: 3494702 - RNA, 19 nt, Pseudomonas aeruginosa PA01
gcguccaggugcggcuggg

SEQ ID NO: 3494703 - RNA, 17 nt, Pseudomonas aeruginosa PA01
gcguccaguagcgccug

SEQ ID NO: 3494704 - RNA, 14 nt, Pseudomonas aeruginosa PA01
gcguccauccaggc

SEQ ID NO: 3494705 - RNA, 15 nt, Pseudomonas aeruginosa PA01
gcguccauccaggcu

SEQ ID NO: 3494706 - RNA, 13 nt, Pseudomonas aeruginosa PA01
gcguccauccccg

SEQ ID NO: 3494707 - RNA, 17 nt, Pseudomonas aeruginosa PA01
gcguccauccccgccuc

SEQ ID NO: 3494708 - RNA, 17 nt, Pseudomonas aeruginosa PA01
gcgucccauggcgccac

SEQ ID NO: 3494709 - RNA, 19 nt, Pseudomonas aeruginosa PA01
gcgucccauggcgccacgc

SEQ ID NO: 3494710 - RNA, 22 nt, Pseudomonas aeruginosa PA01
gcguccccaugcccggccuggc

SEQ ID NO: 3494711 - RNA, 16 nt, Pseudomonas aeruginosa PA01
gcgucccgcuccagcc

SEQ ID NO: 3494712 - RNA, 14 nt, Pseudomonas aeruginosa PA01
gcgucccggcgccg

SEQ ID NO: 3494713 - RNA, 18 nt, Pseudomonas aeruginosa PA01
gcgucccggcgccgcccu

SEQ ID NO: 3494714 - RNA, 18 nt, Pseudomonas aeruginosa PA01
gcgucccguuccggcgca

SEQ ID NO: 3494715 - RNA, 20 nt, Pseudomonas aeruginosa PA01
gcgucccguuccggcgcagc

SEQ ID NO: 3494716 - RNA, 13 nt, Pseudomonas aeruginosa PA01
gcgucccugcaca

SEQ ID NO: 3494717 - RNA, 14 nt, Pseudomonas aeruginosa PA01
gcgucccuggagca

SEQ ID NO: 3494718 - RNA, 20 nt, Pseudomonas aeruginosa PA01
gcgucccuggagcagggcga

SEQ ID NO: 3494719 - RNA, 17 nt, Pseudomonas aeruginosa PA01
gcgucccugggcgcagg

SEQ ID NO: 3494720 - RNA, 13 nt, Pseudomonas aeruginosa PA01
gcgucccuuggcg

SEQ ID NO: 3494721 - RNA, 16 nt, Pseudomonas aeruginosa PA01
gcgucccuuggcgucg

SEQ ID NO: 3494722 - RNA, 20 nt, Pseudomonas aeruginosa PA01
gcgucccuuggcgucgcggc

SEQ ID NO: 3494723 - RNA, 22 nt, Pseudomonas aeruginosa PA01
gcgucccuuguuuuccuggccc

SEQ ID NO: 3494724 - RNA, 23 nt, Pseudomonas aeruginosa PA01
gcgucccuuguuuuccuggcccu

SEQ ID NO: 3494725 - RNA, 14 nt, Pseudomonas aeruginosa PA01
gcguccgaacgcgc

SEQ ID NO: 3494726 - RNA, 16 nt, Pseudomonas aeruginosa PA01
gcguccgaacgcgcug

SEQ ID NO: 3494727 - RNA, 17 nt, Pseudomonas aeruginosa PA01
gcguccgaacgcgcuga

SEQ ID NO: 3494728 - RNA, 20 nt, Pseudomonas aeruginosa PA01
gcguccgagagcagggccug

SEQ ID NO: 3494729 - RNA, 22 nt, Pseudomonas aeruginosa PA01
gcguccgagagcagggccuggc

SEQ ID NO: 3494730 - RNA, 21 nt, Pseudomonas aeruginosa PA01
gcguccgaugucguugcgcag

SEQ ID NO: 3494731 - RNA, 20 nt, Pseudomonas aeruginosa PA01
gcguccgcaguucgccccgc

SEQ ID NO: 3494732 - RNA, 21 nt, Pseudomonas aeruginosa PA01
gcguccgcaguucgccccgcc

SEQ ID NO: 3494733 - RNA, 13 nt, Pseudomonas aeruginosa PA01
gcguccgccgccg

SEQ ID NO: 3494734 - RNA, 14 nt, Pseudomonas aeruginosa PA01
gcguccgccgccgu

SEQ ID NO: 3494735 - RNA, 14 nt, Pseudomonas aeruginosa PA01
gcguccgccucgcu

SEQ ID NO: 3494736 - RNA, 13 nt, Pseudomonas aeruginosa PA01
gcguccgcgcagg

SEQ ID NO: 3494737 - RNA, 17 nt, Pseudomonas aeruginosa PA01
gcguccgcgcaggcggu

SEQ ID NO: 3494738 - RNA, 13 nt, Pseudomonas aeruginosa PA01
gcguccgcggccu

SEQ ID NO: 3494739 - RNA, 21 nt, Pseudomonas aeruginosa PA01
gcguccggagugaugccgaug

SEQ ID NO: 3494740 - RNA, 14 nt, Pseudomonas aeruginosa PA01
gcguccggccagcc

SEQ ID NO: 3494741 - RNA, 15 nt, Pseudomonas aeruginosa PA01
gcguccggccagccu

SEQ ID NO: 3494742 - RNA, 16 nt, Pseudomonas aeruginosa PA01
gcguccggccagccug

SEQ ID NO: 3494743 - RNA, 18 nt, Pseudomonas aeruginosa PA01
gcguccggccagccuggc

SEQ ID NO: 3494744 - RNA, 20 nt, Pseudomonas aeruginosa PA01
gcguccgggugccccaggcg

SEQ ID NO: 3494745 - RNA, 21 nt, Pseudomonas aeruginosa PA01
gcguccgggugccccaggcga

SEQ ID NO: 3494746 - RNA, 24 nt, Pseudomonas aeruginosa PA01
gcguccgggugccccaggcgaguc

SEQ ID NO: 3494747 - RNA, 23 nt, Pseudomonas aeruginosa PA01
gcguccgguaggagcgagagcgc

SEQ ID NO: 3494748 - RNA, 14 nt, Pseudomonas aeruginosa PA01
gcguccgguugcug

SEQ ID NO: 3494749 - RNA, 22 nt, Pseudomonas aeruginosa PA01
gcguccguaaugcaacccgccg

SEQ ID NO: 3494750 - RNA, 19 nt, Pseudomonas aeruginosa PA01
gcguccuccuggaggacgc

SEQ ID NO: 3494751 - RNA, 20 nt, Pseudomonas aeruginosa PA01
gcguccugcucccuggcgga

SEQ ID NO: 3494752 - RNA, 18 nt, Pseudomonas aeruginosa PA01
gcguccuggcgaguggcg

SEQ ID NO: 3494753 - RNA, 17 nt, Pseudomonas aeruginosa PA01
gcguccuucggcgcucu

SEQ ID NO: 3494754 - RNA, 21 nt, Pseudomonas aeruginosa PA01
gcguccuugaguucccagacc

SEQ ID NO: 3494755 - RNA, 23 nt, Pseudomonas aeruginosa PA01
gcguccuugaguucccagaccug

SEQ ID NO: 3494756 - RNA, 19 nt, Pseudomonas aeruginosa PA01
gcguccuugcccggcgcca

SEQ ID NO: 3494757 - RNA, 21 nt, Pseudomonas aeruginosa PA01
gcguccuugcccggcgccagu

SEQ ID NO: 3494758 - RNA, 17 nt, Pseudomonas aeruginosa PA01
gcguccuugggaucguc

SEQ ID NO: 3494759 - RNA, 20 nt, Pseudomonas aeruginosa PA01
gcguccuugggaucgucgaa

SEQ ID NO: 3494760 - RNA, 19 nt, Pseudomonas aeruginosa PA01
gcgucgaaacgggcgcucu

SEQ ID NO: 3494761 - RNA, 16 nt, Pseudomonas aeruginosa PA01
gcgucgaaaugcucgu

SEQ ID NO: 3494762 - RNA, 15 nt, Pseudomonas aeruginosa PA01
gcgucgaacaccggc

SEQ ID NO: 3494763 - RNA, 20 nt, Pseudomonas aeruginosa PA01
gcgucgaacaccggcgccgc

SEQ ID NO: 3494764 - RNA, 22 nt, Pseudomonas aeruginosa PA01
gcgucgaacaccggcgccgccu

SEQ ID NO: 3494765 - RNA, 15 nt, Pseudomonas aeruginosa PA01
gcgucgaacagcgag

SEQ ID NO: 3494766 - RNA, 23 nt, Pseudomonas aeruginosa PA01
gcgucgaacagcgagucgucgga

SEQ ID NO: 3494767 - RNA, 15 nt, Pseudomonas aeruginosa PA01
gcgucgaagccggau

SEQ ID NO: 3494768 - RNA, 16 nt, Pseudomonas aeruginosa PA01
gcgucgaagccggauu

SEQ ID NO: 3494769 - RNA, 16 nt, Pseudomonas aeruginosa PA01
gcgucgaaggccucgu

SEQ ID NO: 3494770 - RNA, 17 nt, Pseudomonas aeruginosa PA01
gcgucgaaggccucguc

SEQ ID NO: 3494771 - RNA, 14 nt, Pseudomonas aeruginosa PA01
gcgucgaaggcggc

SEQ ID NO: 3494772 - RNA, 15 nt, Pseudomonas aeruginosa PA01
gcgucgaaggcggcg

SEQ ID NO: 3494773 - RNA, 18 nt, Pseudomonas aeruginosa PA01
gcgucgaaggcggcgcgg

SEQ ID NO: 3494774 - RNA, 21 nt, Pseudomonas aeruginosa PA01
gcgucgaaggcggcgcggcgg

SEQ ID NO: 3494775 - RNA, 22 nt, Pseudomonas aeruginosa PA01
gcgucgaaggcggcgcggcggg

SEQ ID NO: 3494776 - RNA, 18 nt, Pseudomonas aeruginosa PA01
gcgucgaccgccugccag

SEQ ID NO: 3494777 - RNA, 22 nt, Pseudomonas aeruginosa PA01
gcgucgagcguuucgcggaagg

SEQ ID NO: 3494778 - RNA, 16 nt, Pseudomonas aeruginosa PA01
gcgucgagcuggcgca

SEQ ID NO: 3494779 - RNA, 18 nt, Pseudomonas aeruginosa PA01
gcgucgagcuggcgcagg

SEQ ID NO: 3494780 - RNA, 19 nt, Pseudomonas aeruginosa PA01
gcgucgagcuggcgcaggc

SEQ ID NO: 3494781 - RNA, 18 nt, Pseudomonas aeruginosa PA01
gcgucgaggugcggcugc

SEQ ID NO: 3494782 - RNA, 19 nt, Pseudomonas aeruginosa PA01
gcgucgaguaccgcugcgg

SEQ ID NO: 3494783 - RNA, 16 nt, Pseudomonas aeruginosa PA01
gcgucgagucgcgcag

SEQ ID NO: 3494784 - RNA, 17 nt, Pseudomonas aeruginosa PA01
gcgucgagucgcgcagc

SEQ ID NO: 3494785 - RNA, 17 nt, Pseudomonas aeruginosa PA01
gcgucgaucaggcgggc

SEQ ID NO: 3494786 - RNA, 18 nt, Pseudomonas aeruginosa PA01
gcgucgaucaggcgggcg

SEQ ID NO: 3494787 - RNA, 21 nt, Pseudomonas aeruginosa PA01
gcgucgaucaucugcugcagc

SEQ ID NO: 3494788 - RNA, 22 nt, Pseudomonas aeruginosa PA01
gcgucgaucaucugcugcagca

SEQ ID NO: 3494789 - RNA, 13 nt, Pseudomonas aeruginosa PA01
gcgucgaucccgg

SEQ ID NO: 3494790 - RNA, 21 nt, Pseudomonas aeruginosa PA01
gcgucgaucccggauucgccg

SEQ ID NO: 3494791 - RNA, 22 nt, Pseudomonas aeruginosa PA01
gcgucgaugcgccucagcggcc

SEQ ID NO: 3494792 - RNA, 23 nt, Pseudomonas aeruginosa PA01
gcgucgaugucgaacaacccgcc

SEQ ID NO: 3494793 - RNA, 17 nt, Pseudomonas aeruginosa PA01
gcgucgcaccaggugcu

SEQ ID NO: 3494794 - RNA, 14 nt, Pseudomonas aeruginosa PA01
gcgucgcacccggc

SEQ ID NO: 3494795 - RNA, 21 nt, Pseudomonas aeruginosa PA01
gcgucgcagagacgcagcgcu

SEQ ID NO: 3494796 - RNA, 14 nt, Pseudomonas aeruginosa PA01
gcgucgcaggcgau

SEQ ID NO: 3494797 - RNA, 14 nt, Pseudomonas aeruginosa PA01
gcgucgcauccacc

SEQ ID NO: 3494798 - RNA, 17 nt, Pseudomonas aeruginosa PA01
gcgucgcauccaccagc

SEQ ID NO: 3494799 - RNA, 17 nt, Pseudomonas aeruginosa PA01
gcgucgccaacgcgccg

SEQ ID NO: 3494800 - RNA, 18 nt, Pseudomonas aeruginosa PA01
gcgucgccaacgcgccgu

SEQ ID NO: 3494801 - RNA, 12 nt, Pseudomonas aeruginosa PA01
gcgucgccaggc

SEQ ID NO: 3494802 - RNA, 13 nt, Pseudomonas aeruginosa PA01
gcgucgccaggcc

SEQ ID NO: 3494803 - RNA, 14 nt, Pseudomonas aeruginosa PA01
gcgucgccaggccg

SEQ ID NO: 3494804 - RNA, 15 nt, Pseudomonas aeruginosa PA01
gcgucgccaggccgu

SEQ ID NO: 3494805 - RNA, 13 nt, Pseudomonas aeruginosa PA01
gcgucgcccaggc

SEQ ID NO: 3494806 - RNA, 15 nt, Pseudomonas aeruginosa PA01
gcgucgcccaggccg

SEQ ID NO: 3494807 - RNA, 20 nt, Pseudomonas aeruginosa PA01
gcgucgcccaggccgcuggc

SEQ ID NO: 3494808 - RNA, 21 nt, Pseudomonas aeruginosa PA01
gcgucgcccaggccgcuggcg

SEQ ID NO: 3494809 - RNA, 15 nt, Pseudomonas aeruginosa PA01
gcgucgccgaacggc

SEQ ID NO: 3494810 - RNA, 16 nt, Pseudomonas aeruginosa PA01
gcgucgccgaacggca

SEQ ID NO: 3494811 - RNA, 19 nt, Pseudomonas aeruginosa PA01
gcgucgccgaacuccgagc

SEQ ID NO: 3494812 - RNA, 20 nt, Pseudomonas aeruginosa PA01
gcgucgccgacuucggcaag

SEQ ID NO: 3494813 - RNA, 20 nt, Pseudomonas aeruginosa PA01
gcgucgccgccagcgccggc

SEQ ID NO: 3494814 - RNA, 19 nt, Pseudomonas aeruginosa PA01
gcgucgccgccgcgggcga

SEQ ID NO: 3494815 - RNA, 16 nt, Pseudomonas aeruginosa PA01
gcgucgccggccgcug

SEQ ID NO: 3494816 - RNA, 13 nt, Pseudomonas aeruginosa PA01
gcgucgccgggcg

SEQ ID NO: 3494817 - RNA, 14 nt, Pseudomonas aeruginosa PA01
gcgucgccgggcgu

SEQ ID NO: 3494818 - RNA, 14 nt, Pseudomonas aeruginosa PA01
gcgucgccugccag

SEQ ID NO: 3494819 - RNA, 19 nt, Pseudomonas aeruginosa PA01
gcgucgccuuccaccacca

SEQ ID NO: 3494820 - RNA, 20 nt, Pseudomonas aeruginosa PA01
gcgucgccuuccaccaccag

SEQ ID NO: 3494821 - RNA, 21 nt, Pseudomonas aeruginosa PA01
gcgucgccuuccaccaccagg

SEQ ID NO: 3494822 - RNA, 15 nt, Pseudomonas aeruginosa PA01
gcgucgcgcacgagg

SEQ ID NO: 3494823 - RNA, 12 nt, Pseudomonas aeruginosa PA01
gcgucgcgcagg

SEQ ID NO: 3494824 - RNA, 13 nt, Pseudomonas aeruginosa PA01
gcgucgcgcaggc

SEQ ID NO: 3494825 - RNA, 16 nt, Pseudomonas aeruginosa PA01
gcgucgcgccagcacc

SEQ ID NO: 3494826 - RNA, 17 nt, Pseudomonas aeruginosa PA01
gcgucgcgccagcaccg

SEQ ID NO: 3494827 - RNA, 22 nt, Pseudomonas aeruginosa PA01
gcgucgcgccagcaccgugguc

SEQ ID NO: 3494828 - RNA, 22 nt, Pseudomonas aeruginosa PA01
gcgucgcgccgcccggcucgcc

SEQ ID NO: 3494829 - RNA, 15 nt, Pseudomonas aeruginosa PA01
gcgucgcgcgcggca

SEQ ID NO: 3494830 - RNA, 14 nt, Pseudomonas aeruginosa PA01
gcgucgcgcggcca

SEQ ID NO: 3494831 - RNA, 18 nt, Pseudomonas aeruginosa PA01
gcgucgcgcggccagcgu

SEQ ID NO: 3494832 - RNA, 14 nt, Pseudomonas aeruginosa PA01
gcgucgcgcgucca

SEQ ID NO: 3494833 - RNA, 18 nt, Pseudomonas aeruginosa PA01
gcgucgcgcguccagccg

SEQ ID NO: 3494834 - RNA, 20 nt, Pseudomonas aeruginosa PA01
gcgucgcggccucuucgucg

SEQ ID NO: 3494835 - RNA, 23 nt, Pseudomonas aeruginosa PA01
gcgucgcggccucuucgucggcg

SEQ ID NO: 3494836 - RNA, 20 nt, Pseudomonas aeruginosa PA01
gcgucgcggucuuccgccga

SEQ ID NO: 3494837 - RNA, 15 nt, Pseudomonas aeruginosa PA01
gcgucgcgucggccu

SEQ ID NO: 3494838 - RNA, 14 nt, Pseudomonas aeruginosa PA01
gcgucgcugccgcc

SEQ ID NO: 3494839 - RNA, 15 nt, Pseudomonas aeruginosa PA01
gcgucgcugccgccg

SEQ ID NO: 3494840 - RNA, 20 nt, Pseudomonas aeruginosa PA01
gcgucgcugccgccgcgccc

SEQ ID NO: 3494841 - RNA, 23 nt, Pseudomonas aeruginosa PA01
gcgucgcugccgccgcgcccggc

SEQ ID NO: 3494842 - RNA, 14 nt, Pseudomonas aeruginosa PA01
gcgucgcugccgcu

SEQ ID NO: 3494843 - RNA, 15 nt, Pseudomonas aeruginosa PA01
gcgucgcugccgcug

SEQ ID NO: 3494844 - RNA, 13 nt, Pseudomonas aeruginosa PA01
gcgucgcugcgca

SEQ ID NO: 3494845 - RNA, 16 nt, Pseudomonas aeruginosa PA01
gcgucgcugcgcaacu

SEQ ID NO: 3494846 - RNA, 18 nt, Pseudomonas aeruginosa PA01
gcgucgcuguagcggcuc

SEQ ID NO: 3494847 - RNA, 23 nt, Pseudomonas aeruginosa PA01
gcgucgcuguagcggcucgccga

SEQ ID NO: 3494848 - RNA, 20 nt, Pseudomonas aeruginosa PA01
gcgucggagagauagucgcc

SEQ ID NO: 3494849 - RNA, 13 nt, Pseudomonas aeruginosa PA01
gcgucggcauggc

SEQ ID NO: 3494850 - RNA, 16 nt, Pseudomonas aeruginosa PA01
gcgucggcauggcugu

SEQ ID NO: 3494851 - RNA, 14 nt, Pseudomonas aeruginosa PA01
gcgucggccgcucg

SEQ ID NO: 3494852 - RNA, 16 nt, Pseudomonas aeruginosa PA01
gcgucggccgcucggc

SEQ ID NO: 3494853 - RNA, 14 nt, Pseudomonas aeruginosa PA01
gcgucggccuggcg

SEQ ID NO: 3494854 - RNA, 15 nt, Pseudomonas aeruginosa PA01
gcgucggccuggcgc

SEQ ID NO: 3494855 - RNA, 17 nt, Pseudomonas aeruginosa PA01
gcgucggccuggcgcag

SEQ ID NO: 3494856 - RNA, 20 nt, Pseudomonas aeruginosa PA01
gcgucggcgaacccggcgcg

SEQ ID NO: 3494857 - RNA, 22 nt, Pseudomonas aeruginosa PA01
gcgucggcgaacccggcgcggc

SEQ ID NO: 3494858 - RNA, 12 nt, Pseudomonas aeruginosa PA01
gcgucggcgauc

SEQ ID NO: 3494859 - RNA, 14 nt, Pseudomonas aeruginosa PA01
gcgucggcgaucac

SEQ ID NO: 3494860 - RNA, 13 nt, Pseudomonas aeruginosa PA01
gcgucggcgccuu

SEQ ID NO: 3494861 - RNA, 15 nt, Pseudomonas aeruginosa PA01
gcgucggcgcgggcg

SEQ ID NO: 3494862 - RNA, 19 nt, Pseudomonas aeruginosa PA01
gcgucggcgcgggcgccga

SEQ ID NO: 3494863 - RNA, 11 nt, Pseudomonas aeruginosa PA01
gcgucggcggg

SEQ ID NO: 3494864 - RNA, 19 nt, Pseudomonas aeruginosa PA01
gcgucggcuucgcccaugg

SEQ ID NO: 3494865 - RNA, 20 nt, Pseudomonas aeruginosa PA01
gcgucggcuucgcccauggc

SEQ ID NO: 3494866 - RNA, 22 nt, Pseudomonas aeruginosa PA01
gcgucggcuucgcccauggcac

SEQ ID NO: 3494867 - RNA, 23 nt, Pseudomonas aeruginosa PA01
gcgucgggaaaggccgccacggc

SEQ ID NO: 3494868 - RNA, 21 nt, Pseudomonas aeruginosa PA01
gcgucgggcgaaacggcaggc

SEQ ID NO: 3494869 - RNA, 19 nt, Pseudomonas aeruginosa PA01
gcgucgggcgggaucaggu

SEQ ID NO: 3494870 - RNA, 22 nt, Pseudomonas aeruginosa PA01
gcgucgguccagcuccuugcgc

SEQ ID NO: 3494871 - RNA, 12 nt, Pseudomonas aeruginosa PA01
gcgucggugccg

SEQ ID NO: 3494872 - RNA, 16 nt, Pseudomonas aeruginosa PA01
gcgucggugccgacgg

SEQ ID NO: 3494873 - RNA, 16 nt, Pseudomonas aeruginosa PA01
gcgucggugccgcccg

SEQ ID NO: 3494874 - RNA, 19 nt, Pseudomonas aeruginosa PA01
gcgucggugccgcccggcg

SEQ ID NO: 3494875 - RNA, 17 nt, Pseudomonas aeruginosa PA01
gcgucgguggcaggaaa

SEQ ID NO: 3494876 - RNA, 14 nt, Pseudomonas aeruginosa PA01
gcgucguaacggau

SEQ ID NO: 3494877 - RNA, 17 nt, Pseudomonas aeruginosa PA01
gcgucguagagcgugcg

SEQ ID NO: 3494878 - RNA, 22 nt, Pseudomonas aeruginosa PA01
gcgucguagagcgugcggccga

SEQ ID NO: 3494879 - RNA, 20 nt, Pseudomonas aeruginosa PA01
gcgucguaguggcgcaacac

SEQ ID NO: 3494880 - RNA, 20 nt, Pseudomonas aeruginosa PA01
gcgucguaguugccucucga

SEQ ID NO: 3494881 - RNA, 16 nt, Pseudomonas aeruginosa PA01
gcgucguauaggcgcu

SEQ ID NO: 3494882 - RNA, 20 nt, Pseudomonas aeruginosa PA01
gcgucguauaggcgcuggug

SEQ ID NO: 3494883 - RNA, 14 nt, Pseudomonas aeruginosa PA01
gcgucguccagggc

SEQ ID NO: 3494884 - RNA, 20 nt, Pseudomonas aeruginosa PA01
gcgucgucgcugcgcggguc

SEQ ID NO: 3494885 - RNA, 21 nt, Pseudomonas aeruginosa PA01
gcgucgucggggugccgccag

SEQ ID NO: 3494886 - RNA, 17 nt, Pseudomonas aeruginosa PA01
gcgucgugcgccggccu

SEQ ID NO: 3494887 - RNA, 15 nt, Pseudomonas aeruginosa PA01
gcgucguugccgauc

SEQ ID NO: 3494888 - RNA, 16 nt, Pseudomonas aeruginosa PA01
gcgucguuggccggcu

SEQ ID NO: 3494889 - RNA, 19 nt, Pseudomonas aeruginosa PA01
gcgucguuguugcgggcga

SEQ ID NO: 3494890 - RNA, 13 nt, Pseudomonas aeruginosa PA01
gcgucucagcccu

SEQ ID NO: 3494891 - RNA, 15 nt, Pseudomonas aeruginosa PA01
gcgucucagcccucg

SEQ ID NO: 3494892 - RNA, 12 nt, Pseudomonas aeruginosa PA01
gcgucuccagcu

SEQ ID NO: 3494893 - RNA, 21 nt, Pseudomonas aeruginosa PA01
gcgucuccagcucggcgaucc

SEQ ID NO: 3494894 - RNA, 23 nt, Pseudomonas aeruginosa PA01
gcgucuccaugcgggagagcgcc

SEQ ID NO: 3494895 - RNA, 23 nt, Pseudomonas aeruginosa PA01
gcgucucggagugaggccgagcc

SEQ ID NO: 3494896 - RNA, 15 nt, Pseudomonas aeruginosa PA01
gcgucucggcugccg

SEQ ID NO: 3494897 - RNA, 19 nt, Pseudomonas aeruginosa PA01
gcgucucggcugccgccag

SEQ ID NO: 3494898 - RNA, 20 nt, Pseudomonas aeruginosa PA01
gcgucucggcugccgccagc

SEQ ID NO: 3494899 - RNA, 21 nt, Pseudomonas aeruginosa PA01
gcgucugcagcuugcgcgcca

SEQ ID NO: 3494900 - RNA, 17 nt, Pseudomonas aeruginosa PA01
gcgucugccgcucguug

SEQ ID NO: 3494901 - RNA, 22 nt, Pseudomonas aeruginosa PA01
gcgucugccgcucguuggcggc

SEQ ID NO: 3494902 - RNA, 13 nt, Pseudomonas aeruginosa PA01
gcgucugccgcug

SEQ ID NO: 3494903 - RNA, 18 nt, Pseudomonas aeruginosa PA01
gcgucugccgcuggcggc

SEQ ID NO: 3494904 - RNA, 13 nt, Pseudomonas aeruginosa PA01
gcgucugggacgg

SEQ ID NO: 3494905 - RNA, 15 nt, Pseudomonas aeruginosa PA01
gcgucugggacggca

SEQ ID NO: 3494906 - RNA, 21 nt, Pseudomonas aeruginosa PA01
gcgucugggacggcagccugg

SEQ ID NO: 3494907 - RNA, 22 nt, Pseudomonas aeruginosa PA01
gcgucuggggugaggccgagcc

SEQ ID NO: 3494908 - RNA, 17 nt, Pseudomonas aeruginosa PA01
gcgucugggugaccagc

SEQ ID NO: 3494909 - RNA, 20 nt, Pseudomonas aeruginosa PA01
gcgucugggugaccagcagg

SEQ ID NO: 3494910 - RNA, 21 nt, Pseudomonas aeruginosa PA01
gcgucuuccggcucgccgcgc

SEQ ID NO: 3494911 - RNA, 12 nt, Pseudomonas aeruginosa PA01
gcgucuucgccg

SEQ ID NO: 3494912 - RNA, 20 nt, Pseudomonas aeruginosa PA01
gcgucuucgccgaugcgccg

SEQ ID NO: 3494913 - RNA, 18 nt, Pseudomonas aeruginosa PA01
gcgucuucggcggcgccg

SEQ ID NO: 3494914 - RNA, 18 nt, Pseudomonas aeruginosa PA01
gcgugaagaccuggucca

SEQ ID NO: 3494915 - RNA, 18 nt, Pseudomonas aeruginosa PA01
gcgugaagccgccgccca

SEQ ID NO: 3494916 - RNA, 13 nt, Pseudomonas aeruginosa PA01
gcgugaagcugga

SEQ ID NO: 3494917 - RNA, 14 nt, Pseudomonas aeruginosa PA01
gcgugaagcuggag

SEQ ID NO: 3494918 - RNA, 13 nt, Pseudomonas aeruginosa PA01
gcgugacccgcgc

SEQ ID NO: 3494919 - RNA, 21 nt, Pseudomonas aeruginosa PA01
gcgugaggaucacgcaagugc

SEQ ID NO: 3494920 - RNA, 18 nt, Pseudomonas aeruginosa PA01
gcgugagggucgcgccga

SEQ ID NO: 3494921 - RNA, 23 nt, Pseudomonas aeruginosa PA01
gcgugagggucgcgccgacgacc

SEQ ID NO: 3494922 - RNA, 24 nt, Pseudomonas aeruginosa PA01
gcgugauacagcucgcugucgccg

SEQ ID NO: 3494923 - RNA, 23 nt, Pseudomonas aeruginosa PA01
gcgugcagaccaggguacgacug

SEQ ID NO: 3494924 - RNA, 12 nt, Pseudomonas aeruginosa PA01
gcgugcaggccg

SEQ ID NO: 3494925 - RNA, 16 nt, Pseudomonas aeruginosa PA01
gcgugcaggccgccga

SEQ ID NO: 3494926 - RNA, 11 nt, Pseudomonas aeruginosa PA01
gcgugcagggu

SEQ ID NO: 3494927 - RNA, 18 nt, Pseudomonas aeruginosa PA01
gcgugcagguagcagccg

SEQ ID NO: 3494928 - RNA, 19 nt, Pseudomonas aeruginosa PA01
gcgugcaguacuuggccag

SEQ ID NO: 3494929 - RNA, 22 nt, Pseudomonas aeruginosa PA01
gcgugcaguacuuggccagcag

SEQ ID NO: 3494930 - RNA, 14 nt, Pseudomonas aeruginosa PA01
gcgugcauggccgg

SEQ ID NO: 3494931 - RNA, 23 nt, Pseudomonas aeruginosa PA01
gcgugccaggagcuugccgaaga

SEQ ID NO: 3494932 - RNA, 21 nt, Pseudomonas aeruginosa PA01
gcgugccagggcuucccaggc

SEQ ID NO: 3494933 - RNA, 24 nt, Pseudomonas aeruginosa PA01
gcgugccagggcuucccaggccag

SEQ ID NO: 3494934 - RNA, 13 nt, Pseudomonas aeruginosa PA01
gcgugcccauccg

SEQ ID NO: 3494935 - RNA, 17 nt, Pseudomonas aeruginosa PA01
gcgugccccguggcggg

SEQ ID NO: 3494936 - RNA, 13 nt, Pseudomonas aeruginosa PA01
gcgugcccgcugc

SEQ ID NO: 3494937 - RNA, 21 nt, Pseudomonas aeruginosa PA01
gcgugcccgcugcaugugcca

SEQ ID NO: 3494938 - RNA, 23 nt, Pseudomonas aeruginosa PA01
gcgugcccgcugcaugugccagg

SEQ ID NO: 3494939 - RNA, 18 nt, Pseudomonas aeruginosa PA01
gcgugcccuuuuccucca

SEQ ID NO: 3494940 - RNA, 13 nt, Pseudomonas aeruginosa PA01
gcgugccgcaggc

SEQ ID NO: 3494941 - RNA, 14 nt, Pseudomonas aeruginosa PA01
gcgugccgcaggcc

SEQ ID NO: 3494942 - RNA, 17 nt, Pseudomonas aeruginosa PA01
gcgugccgcaggccgcg

SEQ ID NO: 3494943 - RNA, 15 nt, Pseudomonas aeruginosa PA01
gcgugccgccaggcc

SEQ ID NO: 3494944 - RNA, 16 nt, Pseudomonas aeruginosa PA01
gcgugccgccaggccu

SEQ ID NO: 3494945 - RNA, 21 nt, Pseudomonas aeruginosa PA01
gcgugccgccaucgccucgcc

SEQ ID NO: 3494946 - RNA, 15 nt, Pseudomonas aeruginosa PA01
gcgugccgccggacc

SEQ ID NO: 3494947 - RNA, 12 nt, Pseudomonas aeruginosa PA01
gcgugccgcugg

SEQ ID NO: 3494948 - RNA, 15 nt, Pseudomonas aeruginosa PA01
gcgugccgcuggccg

SEQ ID NO: 3494949 - RNA, 13 nt, Pseudomonas aeruginosa PA01
gcgugccgggcag

SEQ ID NO: 3494950 - RNA, 20 nt, Pseudomonas aeruginosa PA01
gcgugccgggccggccaggg

SEQ ID NO: 3494951 - RNA, 19 nt, Pseudomonas aeruginosa PA01
gcgugccuguuccuccgcc

SEQ ID NO: 3494952 - RNA, 12 nt, Pseudomonas aeruginosa PA01
gcgugcgagggc

SEQ ID NO: 3494953 - RNA, 15 nt, Pseudomonas aeruginosa PA01
gcgugcgagggcggc

SEQ ID NO: 3494954 - RNA, 22 nt, Pseudomonas aeruginosa PA01
gcgugcgagggcggcggcucag

SEQ ID NO: 3494955 - RNA, 16 nt, Pseudomonas aeruginosa PA01
gcgugcgcaugcccgc

SEQ ID NO: 3494956 - RNA, 14 nt, Pseudomonas aeruginosa PA01
gcgugcgccgcucg

SEQ ID NO: 3494957 - RNA, 21 nt, Pseudomonas aeruginosa PA01
gcgugcgccgcucgcgcacgg

SEQ ID NO: 3494958 - RNA, 15 nt, Pseudomonas aeruginosa PA01
gcgugcgccguagca

SEQ ID NO: 3494959 - RNA, 16 nt, Pseudomonas aeruginosa PA01
gcgugcgcgccgccgg

SEQ ID NO: 3494960 - RNA, 19 nt, Pseudomonas aeruginosa PA01
gcgugcgcgccgccgggcg

SEQ ID NO: 3494961 - RNA, 13 nt, Pseudomonas aeruginosa PA01
gcgugcggccgau

SEQ ID NO: 3494962 - RNA, 14 nt, Pseudomonas aeruginosa PA01
gcgugcuccagcac

SEQ ID NO: 3494963 - RNA, 15 nt, Pseudomonas aeruginosa PA01
gcgugcuccagcacc

SEQ ID NO: 3494964 - RNA, 17 nt, Pseudomonas aeruginosa PA01
gcgugcuccgugucggc

SEQ ID NO: 3494965 - RNA, 22 nt, Pseudomonas aeruginosa PA01
gcgugcuccgugucggcggcgc

SEQ ID NO: 3494966 - RNA, 23 nt, Pseudomonas aeruginosa PA01
gcgugcucgcgcaugaucgccuc

SEQ ID NO: 3494967 - RNA, 11 nt, Pseudomonas aeruginosa PA01
gcgugcucggc

SEQ ID NO: 3494968 - RNA, 16 nt, Pseudomonas aeruginosa PA01
gcgugcugcacggagu

SEQ ID NO: 3494969 - RNA, 19 nt, Pseudomonas aeruginosa PA01
gcgugcugggucuccuccu

SEQ ID NO: 3494970 - RNA, 18 nt, Pseudomonas aeruginosa PA01
gcgugcuggugccgauca

SEQ ID NO: 3494971 - RNA, 23 nt, Pseudomonas aeruginosa PA01
gcgugcuuggcgaggcgcgccug

SEQ ID NO: 3494972 - RNA, 16 nt, Pseudomonas aeruginosa PA01
gcguggaaccgcggcg

SEQ ID NO: 3494973 - RNA, 20 nt, Pseudomonas aeruginosa PA01
gcguggaaccgcggcgcccu

SEQ ID NO: 3494974 - RNA, 21 nt, Pseudomonas aeruginosa PA01
gcguggaaccgcggcgcccuc

SEQ ID NO: 3494975 - RNA, 15 nt, Pseudomonas aeruginosa PA01
gcguggaaggccacu

SEQ ID NO: 3494976 - RNA, 16 nt, Pseudomonas aeruginosa PA01
gcguggacccacgcau

SEQ ID NO: 3494977 - RNA, 20 nt, Pseudomonas aeruginosa PA01
gcguggcaaaaaugcccuug

SEQ ID NO: 3494978 - RNA, 14 nt, Pseudomonas aeruginosa PA01
gcguggccagcgcc

SEQ ID NO: 3494979 - RNA, 15 nt, Pseudomonas aeruginosa PA01
gcguggccagcgccc

SEQ ID NO: 3494980 - RNA, 19 nt, Pseudomonas aeruginosa PA01
gcguggccagcgcccaggc

SEQ ID NO: 3494981 - RNA, 12 nt, Pseudomonas aeruginosa PA01
gcguggcccggc

SEQ ID NO: 3494982 - RNA, 15 nt, Pseudomonas aeruginosa PA01
gcguggcccggcgcg

SEQ ID NO: 3494983 - RNA, 15 nt, Pseudomonas aeruginosa PA01
gcguggccggcgacc

SEQ ID NO: 3494984 - RNA, 20 nt, Pseudomonas aeruginosa PA01
gcguggccggcgaccagcuc

SEQ ID NO: 3494985 - RNA, 15 nt, Pseudomonas aeruginosa PA01
gcguggcgaacgccc

SEQ ID NO: 3494986 - RNA, 20 nt, Pseudomonas aeruginosa PA01
gcguggcgaacgcccggcuu

SEQ ID NO: 3494987 - RNA, 13 nt, Pseudomonas aeruginosa PA01
gcguggcgaugcc

SEQ ID NO: 3494988 - RNA, 22 nt, Pseudomonas aeruginosa PA01
gcguggcggacaacccggcgcu

SEQ ID NO: 3494989 - RNA, 12 nt, Pseudomonas aeruginosa PA01
gcguggcggccg

SEQ ID NO: 3494990 - RNA, 15 nt, Pseudomonas aeruginosa PA01
gcguggcggccgccg

SEQ ID NO: 3494991 - RNA, 18 nt, Pseudomonas aeruginosa PA01
gcguggcggccgccggcg

SEQ ID NO: 3494992 - RNA, 19 nt, Pseudomonas aeruginosa PA01
gcguggcggccgccggcgc

SEQ ID NO: 3494993 - RNA, 20 nt, Pseudomonas aeruginosa PA01
gcguggcggccgccggcgcc

SEQ ID NO: 3494994 - RNA, 12 nt, Pseudomonas aeruginosa PA01
gcguggcgucgg

SEQ ID NO: 3494995 - RNA, 14 nt, Pseudomonas aeruginosa PA01
gcguggcgucggcg

SEQ ID NO: 3494996 - RNA, 15 nt, Pseudomonas aeruginosa PA01
gcguggcgucggcgc

SEQ ID NO: 3494997 - RNA, 16 nt, Pseudomonas aeruginosa PA01
gcguggcgucggcgcu

SEQ ID NO: 3494998 - RNA, 12 nt, Pseudomonas aeruginosa PA01
gcguggcgugcu

SEQ ID NO: 3494999 - RNA, 15 nt, Pseudomonas aeruginosa PA01
gcguggcgugcucgg

SEQ ID NO: 3495000 - RNA, 18 nt, Pseudomonas aeruginosa PA01
gcguggcgugcucggcga

SEQ ID NO: 3495001 - RNA, 20 nt, Pseudomonas aeruginosa PA01
gcguggcuucguccagcgag

SEQ ID NO: 3495002 - RNA, 14 nt, Pseudomonas aeruginosa PA01
gcguggcuuggccc

SEQ ID NO: 3495003 - RNA, 23 nt, Pseudomonas aeruginosa PA01
gcguggcuuggcccugcgcgcgc

SEQ ID NO: 3495004 - RNA, 18 nt, Pseudomonas aeruginosa PA01
gcgugggcaacaggccga

SEQ ID NO: 3495005 - RNA, 15 nt, Pseudomonas aeruginosa PA01
gcgugggccaccauc

SEQ ID NO: 3495006 - RNA, 16 nt, Pseudomonas aeruginosa PA01
gcgugggccggcaugc

SEQ ID NO: 3495007 - RNA, 16 nt, Pseudomonas aeruginosa PA01
gcgugggcgccggcgc

SEQ ID NO: 3495008 - RNA, 17 nt, Pseudomonas aeruginosa PA01
gcgugggcgccggcgcg

SEQ ID NO: 3495009 - RNA, 16 nt, Pseudomonas aeruginosa PA01
gcgugggcggccggcc

SEQ ID NO: 3495010 - RNA, 20 nt, Pseudomonas aeruginosa PA01
gcgugggcggccggccaggu

SEQ ID NO: 3495011 - RNA, 14 nt, Pseudomonas aeruginosa PA01
gcgugggcggucgg

SEQ ID NO: 3495012 - RNA, 14 nt, Pseudomonas aeruginosa PA01
gcgugggcugacau

SEQ ID NO: 3495013 - RNA, 18 nt, Pseudomonas aeruginosa PA01
gcgugggcuucgccgccg

SEQ ID NO: 3495014 - RNA, 13 nt, Pseudomonas aeruginosa PA01
gcguggguagccg

SEQ ID NO: 3495015 - RNA, 17 nt, Pseudomonas aeruginosa PA01
gcguggguagccgccca

SEQ ID NO: 3495016 - RNA, 18 nt, Pseudomonas aeruginosa PA01
gcguggguagccgcccac

SEQ ID NO: 3495017 - RNA, 21 nt, Pseudomonas aeruginosa PA01
gcguggguagccgcccaccgc

SEQ ID NO: 3495018 - RNA, 19 nt, Pseudomonas aeruginosa PA01
gcguggguccacgccgggc

SEQ ID NO: 3495019 - RNA, 17 nt, Pseudomonas aeruginosa PA01
gcgugguaccgcugcgu

SEQ ID NO: 3495020 - RNA, 16 nt, Pseudomonas aeruginosa PA01
gcgugguaucggcgcu

SEQ ID NO: 3495021 - RNA, 19 nt, Pseudomonas aeruginosa PA01
gcgugguaucggcgcucac

SEQ ID NO: 3495022 - RNA, 16 nt, Pseudomonas aeruginosa PA01
gcguggucggcggccu

SEQ ID NO: 3495023 - RNA, 22 nt, Pseudomonas aeruginosa PA01
gcguggucuccgugcuggccgg

SEQ ID NO: 3495024 - RNA, 18 nt, Pseudomonas aeruginosa PA01
gcguggucuuccucggug

SEQ ID NO: 3495025 - RNA, 20 nt, Pseudomonas aeruginosa PA01
gcguggugagcacgaacagg

SEQ ID NO: 3495026 - RNA, 12 nt, Pseudomonas aeruginosa PA01
gcguggugaugu

SEQ ID NO: 3495027 - RNA, 19 nt, Pseudomonas aeruginosa PA01
gcguggugcauccgccgca

SEQ ID NO: 3495028 - RNA, 21 nt, Pseudomonas aeruginosa PA01
gcguggugcauccgccgcaga

SEQ ID NO: 3495029 - RNA, 21 nt, Pseudomonas aeruginosa PA01
gcgugguggcggggaacagca

SEQ ID NO: 3495030 - RNA, 21 nt, Pseudomonas aeruginosa PA01
gcguguggcgaaacuccagca

SEQ ID NO: 3495031 - RNA, 21 nt, Pseudomonas aeruginosa PA01
gcguguuacaucagaucgcgu

SEQ ID NO: 3495032 - RNA, 13 nt, Pseudomonas aeruginosa PA01
gcguguucccugu

SEQ ID NO: 3495033 - RNA, 17 nt, Pseudomonas aeruginosa PA01
gcguguucgcggcucug

SEQ ID NO: 3495034 - RNA, 14 nt, Pseudomonas aeruginosa PA01
gcguguucggcggc

SEQ ID NO: 3495035 - RNA, 18 nt, Pseudomonas aeruginosa PA01
gcguguucggcggcucug

SEQ ID NO: 3495036 - RNA, 19 nt, Pseudomonas aeruginosa PA01
gcguuaccggcagguggcc

SEQ ID NO: 3495037 - RNA, 19 nt, Pseudomonas aeruginosa PA01
gcguuaccguccgcgccgc

SEQ ID NO: 3495038 - RNA, 21 nt, Pseudomonas aeruginosa PA01
gcguuauccgcccugcgcagc

SEQ ID NO: 3495039 - RNA, 13 nt, Pseudomonas aeruginosa PA01
gcguuauccgccg

SEQ ID NO: 3495040 - RNA, 16 nt, Pseudomonas aeruginosa PA01
gcguuauccgccgccg

SEQ ID NO: 3495041 - RNA, 23 nt, Pseudomonas aeruginosa PA01
gcguuaugcgcccuaccuguccc

SEQ ID NO: 3495042 - RNA, 22 nt, Pseudomonas aeruginosa PA01
gcguuauucgcccuacgccagu

SEQ ID NO: 3495043 - RNA, 13 nt, Pseudomonas aeruginosa PA01
gcguucaccgcgc

SEQ ID NO: 3495044 - RNA, 22 nt, Pseudomonas aeruginosa PA01
gcguucacuccacgaggauguc

SEQ ID NO: 3495045 - RNA, 21 nt, Pseudomonas aeruginosa PA01
gcguucagccacggacgcgca

SEQ ID NO: 3495046 - RNA, 15 nt, Pseudomonas aeruginosa PA01
gcguucagucccgcg

SEQ ID NO: 3495047 - RNA, 20 nt, Pseudomonas aeruginosa PA01
gcguucaucgucggcagcca

SEQ ID NO: 3495048 - RNA, 15 nt, Pseudomonas aeruginosa PA01
gcguucaugaaagcc

SEQ ID NO: 3495049 - RNA, 19 nt, Pseudomonas aeruginosa PA01
gcguucaugaaagccagca

SEQ ID NO: 3495050 - RNA, 20 nt, Pseudomonas aeruginosa PA01
gcguucaugaaagccagcaa

SEQ ID NO: 3495051 - RNA, 14 nt, Pseudomonas aeruginosa PA01
gcguuccaacuggc

SEQ ID NO: 3495052 - RNA, 23 nt, Pseudomonas aeruginosa PA01
gcguuccacgaaaaagcccggca

SEQ ID NO: 3495053 - RNA, 15 nt, Pseudomonas aeruginosa PA01
gcguuccagcaccuc

SEQ ID NO: 3495054 - RNA, 14 nt, Pseudomonas aeruginosa PA01
gcguuccagcuccg

SEQ ID NO: 3495055 - RNA, 15 nt, Pseudomonas aeruginosa PA01
gcguuccagcuccgu

SEQ ID NO: 3495056 - RNA, 19 nt, Pseudomonas aeruginosa PA01
gcguuccagcucggcgagg

SEQ ID NO: 3495057 - RNA, 16 nt, Pseudomonas aeruginosa PA01
gcguuccaggcggcgg

SEQ ID NO: 3495058 - RNA, 12 nt, Pseudomonas aeruginosa PA01
gcguuccagggc

SEQ ID NO: 3495059 - RNA, 15 nt, Pseudomonas aeruginosa PA01
gcguuccagggcgaa

SEQ ID NO: 3495060 - RNA, 17 nt, Pseudomonas aeruginosa PA01
gcguuccaggucgcugc

SEQ ID NO: 3495061 - RNA, 12 nt, Pseudomonas aeruginosa PA01
gcguuccaggug

SEQ ID NO: 3495062 - RNA, 22 nt, Pseudomonas aeruginosa PA01
gcguuccaguacacccagggca

SEQ ID NO: 3495063 - RNA, 17 nt, Pseudomonas aeruginosa PA01
gcguucccacucgcgac

SEQ ID NO: 3495064 - RNA, 17 nt, Pseudomonas aeruginosa PA01
gcguuccgggucgcugc

SEQ ID NO: 3495065 - RNA, 18 nt, Pseudomonas aeruginosa PA01
gcguuccgggucgcugcc

SEQ ID NO: 3495066 - RNA, 15 nt, Pseudomonas aeruginosa PA01
gcguuccuccucguc

SEQ ID NO: 3495067 - RNA, 19 nt, Pseudomonas aeruginosa PA01
gcguuccuggcgcgcggcc

SEQ ID NO: 3495068 - RNA, 21 nt, Pseudomonas aeruginosa PA01
gcguuccuggcgcgcggccgc

SEQ ID NO: 3495069 - RNA, 19 nt, Pseudomonas aeruginosa PA01
gcguuccuguucgcugccu

SEQ ID NO: 3495070 - RNA, 22 nt, Pseudomonas aeruginosa PA01
gcguuccuguucgcugccuucc

SEQ ID NO: 3495071 - RNA, 16 nt, Pseudomonas aeruginosa PA01
gcguucgaucuccucg

SEQ ID NO: 3495072 - RNA, 17 nt, Pseudomonas aeruginosa PA01
gcguucgaucuccucgc

SEQ ID NO: 3495073 - RNA, 13 nt, Pseudomonas aeruginosa PA01
gcguucgcccugc

SEQ ID NO: 3495074 - RNA, 13 nt, Pseudomonas aeruginosa PA01
gcguucgccgaaa

SEQ ID NO: 3495075 - RNA, 12 nt, Pseudomonas aeruginosa PA01
gcguucgccgag

SEQ ID NO: 3495076 - RNA, 15 nt, Pseudomonas aeruginosa PA01
gcguucgccgaggcg

SEQ ID NO: 3495077 - RNA, 19 nt, Pseudomonas aeruginosa PA01
gcguucgccgaggcggcgc

SEQ ID NO: 3495078 - RNA, 15 nt, Pseudomonas aeruginosa PA01
gcguucgccgagggc

SEQ ID NO: 3495079 - RNA, 19 nt, Pseudomonas aeruginosa PA01
gcguucgccuugcggggcg

SEQ ID NO: 3495080 - RNA, 15 nt, Pseudomonas aeruginosa PA01
gcguucgcgcgaggc

SEQ ID NO: 3495081 - RNA, 16 nt, Pseudomonas aeruginosa PA01
gcguucgcgcgaggcg

SEQ ID NO: 3495082 - RNA, 19 nt, Pseudomonas aeruginosa PA01
gcguucgcgcgaggcgcuc

SEQ ID NO: 3495083 - RNA, 18 nt, Pseudomonas aeruginosa PA01
gcguucgcgggcgccgug

SEQ ID NO: 3495084 - RNA, 16 nt, Pseudomonas aeruginosa PA01
gcguucgcggucggug

SEQ ID NO: 3495085 - RNA, 16 nt, Pseudomonas aeruginosa PA01
gcguucgcuccagucg

SEQ ID NO: 3495086 - RNA, 15 nt, Pseudomonas aeruginosa PA01
gcguucgcuccgggc

SEQ ID NO: 3495087 - RNA, 19 nt, Pseudomonas aeruginosa PA01
gcguucgcuccgggcccgu

SEQ ID NO: 3495088 - RNA, 21 nt, Pseudomonas aeruginosa PA01
gcguucgcuccgggcccgugc

SEQ ID NO: 3495089 - RNA, 13 nt, Pseudomonas aeruginosa PA01
gcguucggcgacc

SEQ ID NO: 3495090 - RNA, 15 nt, Pseudomonas aeruginosa PA01
gcguucggcgaugcc

SEQ ID NO: 3495091 - RNA, 15 nt, Pseudomonas aeruginosa PA01
gcguucggcgauguc

SEQ ID NO: 3495092 - RNA, 20 nt, Pseudomonas aeruginosa PA01
gcguucggggcccuccaggc

SEQ ID NO: 3495093 - RNA, 15 nt, Pseudomonas aeruginosa PA01
gcguucggucaggcu

SEQ ID NO: 3495094 - RNA, 11 nt, Pseudomonas aeruginosa PA01
gcguucgucgg

SEQ ID NO: 3495095 - RNA, 12 nt, Pseudomonas aeruginosa PA01
gcguucgucggc

SEQ ID NO: 3495096 - RNA, 14 nt, Pseudomonas aeruginosa PA01
gcguucgucggcca

SEQ ID NO: 3495097 - RNA, 22 nt, Pseudomonas aeruginosa PA01
gcguucguguaggguucgcugc

SEQ ID NO: 3495098 - RNA, 15 nt, Pseudomonas aeruginosa PA01
gcguucucccugagc

SEQ ID NO: 3495099 - RNA, 17 nt, Pseudomonas aeruginosa PA01
gcguucucccugagccu

SEQ ID NO: 3495100 - RNA, 23 nt, Pseudomonas aeruginosa PA01
gcguucucgaucaucgccagcgg

SEQ ID NO: 3495101 - RNA, 13 nt, Pseudomonas aeruginosa PA01
gcguucucugucg

SEQ ID NO: 3495102 - RNA, 22 nt, Pseudomonas aeruginosa PA01
gcguucugcgacaucuccaggc

SEQ ID NO: 3495103 - RNA, 22 nt, Pseudomonas aeruginosa PA01
gcguucugcugcuugcgccgug

SEQ ID NO: 3495104 - RNA, 21 nt, Pseudomonas aeruginosa PA01
gcguucugcuucucggcuacc

SEQ ID NO: 3495105 - RNA, 24 nt, Pseudomonas aeruginosa PA01
gcguucuucacccgcagcggcagc

SEQ ID NO: 3495106 - RNA, 13 nt, Pseudomonas aeruginosa PA01
gcguucuuggccg

SEQ ID NO: 3495107 - RNA, 14 nt, Pseudomonas aeruginosa PA01
gcguugaacugccc

SEQ ID NO: 3495108 - RNA, 19 nt, Pseudomonas aeruginosa PA01
gcguugacgcaguuccgcg

SEQ ID NO: 3495109 - RNA, 15 nt, Pseudomonas aeruginosa PA01
gcguugacugccugc

SEQ ID NO: 3495110 - RNA, 19 nt, Pseudomonas aeruginosa PA01
gcguugacugccugcaggu

SEQ ID NO: 3495111 - RNA, 23 nt, Pseudomonas aeruginosa PA01
gcguugacugccugcagguagcg

SEQ ID NO: 3495112 - RNA, 16 nt, Pseudomonas aeruginosa PA01
gcguugauccgguuga

SEQ ID NO: 3495113 - RNA, 15 nt, Pseudomonas aeruginosa PA01
gcguugcagcgccug

SEQ ID NO: 3495114 - RNA, 17 nt, Pseudomonas aeruginosa PA01
gcguugcagugcgccgc

SEQ ID NO: 3495115 - RNA, 21 nt, Pseudomonas aeruginosa PA01
gcguugcauguccucggcgcc

SEQ ID NO: 3495116 - RNA, 19 nt, Pseudomonas aeruginosa PA01
gcguugccggacuuccuug

SEQ ID NO: 3495117 - RNA, 23 nt, Pseudomonas aeruginosa PA01
gcguugcgcgccucgccccagac

SEQ ID NO: 3495118 - RNA, 16 nt, Pseudomonas aeruginosa PA01
gcguugcgcggcaggu

SEQ ID NO: 3495119 - RNA, 17 nt, Pseudomonas aeruginosa PA01
gcguugcucgcaccagg

SEQ ID NO: 3495120 - RNA, 18 nt, Pseudomonas aeruginosa PA01
gcguugcucgcaccaggc

SEQ ID NO: 3495121 - RNA, 23 nt, Pseudomonas aeruginosa PA01
gcguugcucgcaccaggccaggu

SEQ ID NO: 3495122 - RNA, 16 nt, Pseudomonas aeruginosa PA01
gcguugcugaucacgu

SEQ ID NO: 3495123 - RNA, 17 nt, Pseudomonas aeruginosa PA01
gcguugcuuccaggcac

SEQ ID NO: 3495124 - RNA, 16 nt, Pseudomonas aeruginosa PA01
gcguuggaucaccggg

SEQ ID NO: 3495125 - RNA, 13 nt, Pseudomonas aeruginosa PA01
gcguuggccagcg

SEQ ID NO: 3495126 - RNA, 23 nt, Pseudomonas aeruginosa PA01
gcguuggccuggagaaacucgcg

SEQ ID NO: 3495127 - RNA, 14 nt, Pseudomonas aeruginosa PA01
gcguuggcggugcc

SEQ ID NO: 3495128 - RNA, 15 nt, Pseudomonas aeruginosa PA01
gcguuggcggugccg

SEQ ID NO: 3495129 - RNA, 19 nt, Pseudomonas aeruginosa PA01
gcguuggcggugccgcaga

SEQ ID NO: 3495130 - RNA, 14 nt, Pseudomonas aeruginosa PA01
gcguugggccucgc

SEQ ID NO: 3495131 - RNA, 19 nt, Pseudomonas aeruginosa PA01
gcguugggccucgcugcgc

SEQ ID NO: 3495132 - RNA, 20 nt, Pseudomonas aeruginosa PA01
gcguugggccucgcugcgca

SEQ ID NO: 3495133 - RNA, 20 nt, Pseudomonas aeruginosa PA01
gcguuguaggaauagaucgc

SEQ ID NO: 3495134 - RNA, 15 nt, Pseudomonas aeruginosa PA01
gcguugucccugucc

SEQ ID NO: 3495135 - RNA, 21 nt, Pseudomonas aeruginosa PA01
gcguugucccugucccgccgc

SEQ ID NO: 3495136 - RNA, 18 nt, Pseudomonas aeruginosa PA01
gcguuguccucggcggcu

SEQ ID NO: 3495137 - RNA, 18 nt, Pseudomonas aeruginosa PA01
gcguugucggccagcagc

SEQ ID NO: 3495138 - RNA, 19 nt, Pseudomonas aeruginosa PA01
gcguugucggccagcagca

SEQ ID NO: 3495139 - RNA, 17 nt, Pseudomonas aeruginosa PA01
gcguuucgaagccgccg

SEQ ID NO: 3495140 - RNA, 15 nt, Pseudomonas aeruginosa PA01
gcguuucgccgggcc

SEQ ID NO: 3495141 - RNA, 13 nt, Pseudomonas aeruginosa PA01
gcguuucguugcg

SEQ ID NO: 3495142 - RNA, 17 nt, Pseudomonas aeruginosa PA01
gcguuucucagcgccgu

SEQ ID NO: 3495143 - RNA, 18 nt, Pseudomonas aeruginosa PA01
gcguuuuucauggcggca

SEQ ID NO: 3495144 - RNA, 20 nt, Pseudomonas aeruginosa PA01
gcguuuuucauuuccgccgg

SEQ ID NO: 3495145 - RNA, 21 nt, Pseudomonas aeruginosa PA01
gcguuuuuucuuuccagcgcc

SEQ ID NO: 3495146 - RNA, 22 nt, Pseudomonas aeruginosa PA01
gcguuuuuucuuuccagcgccg

SEQ ID NO: 3495147 - RNA, 16 nt, Pseudomonas aeruginosa PA01
gcuaaccgccuucgcg

SEQ ID NO: 3495148 - RNA, 14 nt, Pseudomonas aeruginosa PA01
gcuaaccgcgaagc

SEQ ID NO: 3495149 - RNA, 22 nt, Pseudomonas aeruginosa PA01
gcuaaccggucgcaauggcgga

SEQ ID NO: 3495150 - RNA, 14 nt, Pseudomonas aeruginosa PA01
gcuaacgccgagga

SEQ ID NO: 3495151 - RNA, 15 nt, Pseudomonas aeruginosa PA01
gcuacagcaauuaca

SEQ ID NO: 3495152 - RNA, 20 nt, Pseudomonas aeruginosa PA01
gcuaccagcgcuucggcggc

SEQ ID NO: 3495153 - RNA, 21 nt, Pseudomonas aeruginosa PA01
gcuaccaggaagcucggcagc

SEQ ID NO: 3495154 - RNA, 15 nt, Pseudomonas aeruginosa PA01
gcuacccaggugguc

SEQ ID NO: 3495155 - RNA, 16 nt, Pseudomonas aeruginosa PA01
gcuacccagguggucg

SEQ ID NO: 3495156 - RNA, 16 nt, Pseudomonas aeruginosa PA01
gcuacccucaggggug

SEQ ID NO: 3495157 - RNA, 21 nt, Pseudomonas aeruginosa PA01
gcuacccucaggggugcagcc

SEQ ID NO: 3495158 - RNA, 15 nt, Pseudomonas aeruginosa PA01
gcuaccgacaggacc

SEQ ID NO: 3495159 - RNA, 17 nt, Pseudomonas aeruginosa PA01
gcuaccgcaucgccacc

SEQ ID NO: 3495160 - RNA, 22 nt, Pseudomonas aeruginosa PA01
gcuaccgcaucgccaccgcgga

SEQ ID NO: 3495161 - RNA, 18 nt, Pseudomonas aeruginosa PA01
gcuaccgcgcauggcggc

SEQ ID NO: 3495162 - RNA, 19 nt, Pseudomonas aeruginosa PA01
gcuaccgcgcauggcggcg

SEQ ID NO: 3495163 - RNA, 22 nt, Pseudomonas aeruginosa PA01
gcuaccgcgcauggcggcgacc

SEQ ID NO: 3495164 - RNA, 13 nt, Pseudomonas aeruginosa PA01
gcuaccggcaggg

SEQ ID NO: 3495165 - RNA, 20 nt, Pseudomonas aeruginosa PA01
gcuaccggcagggucacgcc

SEQ ID NO: 3495166 - RNA, 19 nt, Pseudomonas aeruginosa PA01
gcuacgaaggcgugccgcu

SEQ ID NO: 3495167 - RNA, 22 nt, Pseudomonas aeruginosa PA01
gcuacgaaggcgugccgcuggc

SEQ ID NO: 3495168 - RNA, 13 nt, Pseudomonas aeruginosa PA01
gcuacgcaggccc

SEQ ID NO: 3495169 - RNA, 12 nt, Pseudomonas aeruginosa PA01
gcuacgcggcgg

SEQ ID NO: 3495170 - RNA, 14 nt, Pseudomonas aeruginosa PA01
gcuacgcggcggga

SEQ ID NO: 3495171 - RNA, 22 nt, Pseudomonas aeruginosa PA01
gcuacgcuccguagggcgacgc

SEQ ID NO: 3495172 - RNA, 17 nt, Pseudomonas aeruginosa PA01
gcuacgcucgccgacgg

SEQ ID NO: 3495173 - RNA, 14 nt, Pseudomonas aeruginosa PA01
gcuacgcucggggu

SEQ ID NO: 3495174 - RNA, 23 nt, Pseudomonas aeruginosa PA01
gcuacgcucggggugcgcggcga

SEQ ID NO: 3495175 - RNA, 16 nt, Pseudomonas aeruginosa PA01
gcuacggaaggucgcc

SEQ ID NO: 3495176 - RNA, 21 nt, Pseudomonas aeruginosa PA01
gcuacggaaggucgccgggcu

SEQ ID NO: 3495177 - RNA, 20 nt, Pseudomonas aeruginosa PA01
gcuacggaugcugucccaac

SEQ ID NO: 3495178 - RNA, 15 nt, Pseudomonas aeruginosa PA01
gcuacguuccagggc

SEQ ID NO: 3495179 - RNA, 16 nt, Pseudomonas aeruginosa PA01
gcuacguuccagggcc

SEQ ID NO: 3495180 - RNA, 18 nt, Pseudomonas aeruginosa PA01
gcuacguuccagggccug

SEQ ID NO: 3495181 - RNA, 21 nt, Pseudomonas aeruginosa PA01
gcuacguuccagggccuggua

SEQ ID NO: 3495182 - RNA, 12 nt, Pseudomonas aeruginosa PA01
gcuacucgcccg

SEQ ID NO: 3495183 - RNA, 15 nt, Pseudomonas aeruginosa PA01
gcuacugcgcgggca

SEQ ID NO: 3495184 - RNA, 14 nt, Pseudomonas aeruginosa PA01
gcuacuucgccggg

SEQ ID NO: 3495185 - RNA, 17 nt, Pseudomonas aeruginosa PA01
gcuagcccgucggcgac

SEQ ID NO: 3495186 - RNA, 21 nt, Pseudomonas aeruginosa PA01
gcuagcccgucggcgacggga

SEQ ID NO: 3495187 - RNA, 13 nt, Pseudomonas aeruginosa PA01
gcuagucuuccug

SEQ ID NO: 3495188 - RNA, 14 nt, Pseudomonas aeruginosa PA01
gcuagucuuccugc

SEQ ID NO: 3495189 - RNA, 15 nt, Pseudomonas aeruginosa PA01
gcuagucuuccugca

SEQ ID NO: 3495190 - RNA, 19 nt, Pseudomonas aeruginosa PA01
gcuagucuuccugcacgcu

SEQ ID NO: 3495191 - RNA, 22 nt, Pseudomonas aeruginosa PA01
gcuagucuuccugcacgcugcg

SEQ ID NO: 3495192 - RNA, 12 nt, Pseudomonas aeruginosa PA01
gcuaucagguga

SEQ ID NO: 3495193 - RNA, 12 nt, Pseudomonas aeruginosa PA01
gcuauccaccgu

SEQ ID NO: 3495194 - RNA, 17 nt, Pseudomonas aeruginosa PA01
gcuauccaccgucgcgg

SEQ ID NO: 3495195 - RNA, 20 nt, Pseudomonas aeruginosa PA01
gcuauccaccgucgcgguca

SEQ ID NO: 3495196 - RNA, 16 nt, Pseudomonas aeruginosa PA01
gcuaucccccggccga

SEQ ID NO: 3495197 - RNA, 20 nt, Pseudomonas aeruginosa PA01
gcuaucccccggccgaugga

SEQ ID NO: 3495198 - RNA, 21 nt, Pseudomonas aeruginosa PA01
gcuauccgccgcuacugcgcg

SEQ ID NO: 3495199 - RNA, 15 nt, Pseudomonas aeruginosa PA01
gcuauccuccaggcc

SEQ ID NO: 3495200 - RNA, 20 nt, Pseudomonas aeruginosa PA01
gcuauccuccaggccgccgg

SEQ ID NO: 3495201 - RNA, 23 nt, Pseudomonas aeruginosa PA01
gcuauccuccaggccgccggcga

SEQ ID NO: 3495202 - RNA, 20 nt, Pseudomonas aeruginosa PA01
gcuaucgaucacugccuggc

SEQ ID NO: 3495203 - RNA, 14 nt, Pseudomonas aeruginosa PA01
gcuaucgccgccgc

SEQ ID NO: 3495204 - RNA, 17 nt, Pseudomonas aeruginosa PA01
gcuaucgccgccgcagc

SEQ ID NO: 3495205 - RNA, 13 nt, Pseudomonas aeruginosa PA01
gcuaucgcuggcg

SEQ ID NO: 3495206 - RNA, 15 nt, Pseudomonas aeruginosa PA01
gcuaucgcuggcgca

SEQ ID NO: 3495207 - RNA, 23 nt, Pseudomonas aeruginosa PA01
gcuaucgcuggcgcagccgcugc

SEQ ID NO: 3495208 - RNA, 17 nt, Pseudomonas aeruginosa PA01
gcuaugcagcagguagu

SEQ ID NO: 3495209 - RNA, 13 nt, Pseudomonas aeruginosa PA01
gcuauggcggggc

SEQ ID NO: 3495210 - RNA, 19 nt, Pseudomonas aeruginosa PA01
gcuaugggcaccgcgccgg

SEQ ID NO: 3495211 - RNA, 21 nt, Pseudomonas aeruginosa PA01
gcuaugggcaccgcgccggcg

SEQ ID NO: 3495212 - RNA, 18 nt, Pseudomonas aeruginosa PA01
gcuauguauucggcgguc

SEQ ID NO: 3495213 - RNA, 12 nt, Pseudomonas aeruginosa PA01
gcuauucccgcc

SEQ ID NO: 3495214 - RNA, 13 nt, Pseudomonas aeruginosa PA01
gcuauucccgccg

SEQ ID NO: 3495215 - RNA, 14 nt, Pseudomonas aeruginosa PA01
gcuauucccgccgc

SEQ ID NO: 3495216 - RNA, 18 nt, Pseudomonas aeruginosa PA01
gcuauucccgccgcuccg

SEQ ID NO: 3495217 - RNA, 20 nt, Pseudomonas aeruginosa PA01
gcucaaaccuguucggcagg

SEQ ID NO: 3495218 - RNA, 15 nt, Pseudomonas aeruginosa PA01
gcucaacgccucgcg

SEQ ID NO: 3495219 - RNA, 17 nt, Pseudomonas aeruginosa PA01
gcucaacgccucgcggc

SEQ ID NO: 3495220 - RNA, 15 nt, Pseudomonas aeruginosa PA01
gcucaacugguccug

SEQ ID NO: 3495221 - RNA, 23 nt, Pseudomonas aeruginosa PA01
gcucaacugguuggccgccuggc

SEQ ID NO: 3495222 - RNA, 13 nt, Pseudomonas aeruginosa PA01
gcucaagacggcc

SEQ ID NO: 3495223 - RNA, 19 nt, Pseudomonas aeruginosa PA01
gcucaagacggcccgcaga

SEQ ID NO: 3495224 - RNA, 23 nt, Pseudomonas aeruginosa PA01
gcucacauuaauugcgagcgagc

SEQ ID NO: 3495225 - RNA, 13 nt, Pseudomonas aeruginosa PA01
gcucaccaaugcc

SEQ ID NO: 3495226 - RNA, 19 nt, Pseudomonas aeruginosa PA01
gcucaccaaugccagugcc

SEQ ID NO: 3495227 - RNA, 20 nt, Pseudomonas aeruginosa PA01
gcucaccaaugccagugccu

SEQ ID NO: 3495228 - RNA, 19 nt, Pseudomonas aeruginosa PA01
gcucaccaccaccgcgccg

SEQ ID NO: 3495229 - RNA, 20 nt, Pseudomonas aeruginosa PA01
gcucaccaccaccgcgccga

SEQ ID NO: 3495230 - RNA, 12 nt, Pseudomonas aeruginosa PA01
gcucaccaggcc

SEQ ID NO: 3495231 - RNA, 17 nt, Pseudomonas aeruginosa PA01
gcucaccaggcccgccg

SEQ ID NO: 3495232 - RNA, 16 nt, Pseudomonas aeruginosa PA01
gcucacccacauggcg

SEQ ID NO: 3495233 - RNA, 23 nt, Pseudomonas aeruginosa PA01
gcucacccacauggcgguccagg

SEQ ID NO: 3495234 - RNA, 12 nt, Pseudomonas aeruginosa PA01
gcucacccuguc

SEQ ID NO: 3495235 - RNA, 14 nt, Pseudomonas aeruginosa PA01
gcucacccuguccc

SEQ ID NO: 3495236 - RNA, 19 nt, Pseudomonas aeruginosa PA01
gcucaccgcauagucgcga

SEQ ID NO: 3495237 - RNA, 17 nt, Pseudomonas aeruginosa PA01
gcucaccgccaccccgc

SEQ ID NO: 3495238 - RNA, 20 nt, Pseudomonas aeruginosa PA01
gcucaccgccaccccgccgg

SEQ ID NO: 3495239 - RNA, 22 nt, Pseudomonas aeruginosa PA01
gcucaccgccaccccgccggcg

SEQ ID NO: 3495240 - RNA, 23 nt, Pseudomonas aeruginosa PA01
gcucaccgccaccccgccggcgu

SEQ ID NO: 3495241 - RNA, 23 nt, Pseudomonas aeruginosa PA01
gcucaccggaccguggugacggu

SEQ ID NO: 3495242 - RNA, 19 nt, Pseudomonas aeruginosa PA01
gcucaccgguagaggggga

SEQ ID NO: 3495243 - RNA, 14 nt, Pseudomonas aeruginosa PA01
gcucaccucgaagg

SEQ ID NO: 3495244 - RNA, 18 nt, Pseudomonas aeruginosa PA01
gcucacgcaccucgucga

SEQ ID NO: 3495245 - RNA, 16 nt, Pseudomonas aeruginosa PA01
gcucacgccccagcgc

SEQ ID NO: 3495246 - RNA, 24 nt, Pseudomonas aeruginosa PA01
gcucacgccccagcgcaucgcgca

SEQ ID NO: 3495247 - RNA, 13 nt, Pseudomonas aeruginosa PA01
gcucacggccgaa

SEQ ID NO: 3495248 - RNA, 23 nt, Pseudomonas aeruginosa PA01
gcucacggccgaacagacgcagg

SEQ ID NO: 3495249 - RNA, 13 nt, Pseudomonas aeruginosa PA01
gcucacguagccc

SEQ ID NO: 3495250 - RNA, 23 nt, Pseudomonas aeruginosa PA01
gcucacgugaccguccagcgcgc

SEQ ID NO: 3495251 - RNA, 18 nt, Pseudomonas aeruginosa PA01
gcucacucccguccagcg

SEQ ID NO: 3495252 - RNA, 14 nt, Pseudomonas aeruginosa PA01
gcucacugcgagca

SEQ ID NO: 3495253 - RNA, 17 nt, Pseudomonas aeruginosa PA01
gcucacugcgagcacca

SEQ ID NO: 3495254 - RNA, 20 nt, Pseudomonas aeruginosa PA01
gcucagaagucccagcgagu

SEQ ID NO: 3495255 - RNA, 20 nt, Pseudomonas aeruginosa PA01
gcucagauuaucugcgacug

SEQ ID NO: 3495256 - RNA, 14 nt, Pseudomonas aeruginosa PA01
gcucagcacccugg

SEQ ID NO: 3495257 - RNA, 16 nt, Pseudomonas aeruginosa PA01
gcucagcacccuggcc

SEQ ID NO: 3495258 - RNA, 18 nt, Pseudomonas aeruginosa PA01
gcucagcacccuggccac

SEQ ID NO: 3495259 - RNA, 16 nt, Pseudomonas aeruginosa PA01
gcucagcacggcgacg

SEQ ID NO: 3495260 - RNA, 15 nt, Pseudomonas aeruginosa PA01
gcucagcaggucgcg

SEQ ID NO: 3495261 - RNA, 15 nt, Pseudomonas aeruginosa PA01
gcucagcaucagcga

SEQ ID NO: 3495262 - RNA, 16 nt, Pseudomonas aeruginosa PA01
gcucagcccaggcgcc

SEQ ID NO: 3495263 - RNA, 18 nt, Pseudomonas aeruginosa PA01
gcucagcccaggcgccgc

SEQ ID NO: 3495264 - RNA, 19 nt, Pseudomonas aeruginosa PA01
gcucagccccgaucgccuc

SEQ ID NO: 3495265 - RNA, 17 nt, Pseudomonas aeruginosa PA01
gcucagccgaggucgcc

SEQ ID NO: 3495266 - RNA, 18 nt, Pseudomonas aeruginosa PA01
gcucagccgaggucgccg

SEQ ID NO: 3495267 - RNA, 19 nt, Pseudomonas aeruginosa PA01
gcucagccgaggucgccgc

SEQ ID NO: 3495268 - RNA, 12 nt, Pseudomonas aeruginosa PA01
gcucagccgcgc

SEQ ID NO: 3495269 - RNA, 14 nt, Pseudomonas aeruginosa PA01
gcucagccgcgccg

SEQ ID NO: 3495270 - RNA, 17 nt, Pseudomonas aeruginosa PA01
gcucagccgcgccgggg

SEQ ID NO: 3495271 - RNA, 15 nt, Pseudomonas aeruginosa PA01
gcucagccgcuggcg

SEQ ID NO: 3495272 - RNA, 22 nt, Pseudomonas aeruginosa PA01
gcucagccguggcacccaggcc

SEQ ID NO: 3495273 - RNA, 21 nt, Pseudomonas aeruginosa PA01
gcucagcgccgcuucuucccg

SEQ ID NO: 3495274 - RNA, 16 nt, Pseudomonas aeruginosa PA01
gcucagcgccggccag

SEQ ID NO: 3495275 - RNA, 20 nt, Pseudomonas aeruginosa PA01
gcucagcgccggccaggggc

SEQ ID NO: 3495276 - RNA, 12 nt, Pseudomonas aeruginosa PA01
gcucagcgcgcg

SEQ ID NO: 3495277 - RNA, 13 nt, Pseudomonas aeruginosa PA01
gcucagcgcgcgu

SEQ ID NO: 3495278 - RNA, 15 nt, Pseudomonas aeruginosa PA01
gcucagcgcgcucgg

SEQ ID NO: 3495279 - RNA, 16 nt, Pseudomonas aeruginosa PA01
gcucagcgcgcucggc

SEQ ID NO: 3495280 - RNA, 17 nt, Pseudomonas aeruginosa PA01
gcucagcgcgcucggcc

SEQ ID NO: 3495281 - RNA, 19 nt, Pseudomonas aeruginosa PA01
gcucagcgcgcucggccug

SEQ ID NO: 3495282 - RNA, 17 nt, Pseudomonas aeruginosa PA01
gcucagcgcggcggcgg

SEQ ID NO: 3495283 - RNA, 19 nt, Pseudomonas aeruginosa PA01
gcucagcgcggcggcggcc

SEQ ID NO: 3495284 - RNA, 21 nt, Pseudomonas aeruginosa PA01
gcucagcgcggcggcggccgc

SEQ ID NO: 3495285 - RNA, 16 nt, Pseudomonas aeruginosa PA01
gcucagcgcuucggcu

SEQ ID NO: 3495286 - RNA, 23 nt, Pseudomonas aeruginosa PA01
gcucagcgcuucggcuccagcac

SEQ ID NO: 3495287 - RNA, 21 nt, Pseudomonas aeruginosa PA01
gcucagcggaacauuuccuug

SEQ ID NO: 3495288 - RNA, 18 nt, Pseudomonas aeruginosa PA01
gcucagcggcccagcgcc

SEQ ID NO: 3495289 - RNA, 23 nt, Pseudomonas aeruginosa PA01
gcucagcgggccgauccgcgaau

SEQ ID NO: 3495290 - RNA, 13 nt, Pseudomonas aeruginosa PA01
gcucagcguccuc

SEQ ID NO: 3495291 - RNA, 13 nt, Pseudomonas aeruginosa PA01
gcucagcuccagg

SEQ ID NO: 3495292 - RNA, 15 nt, Pseudomonas aeruginosa PA01
gcucagcuccaggcc

SEQ ID NO: 3495293 - RNA, 23 nt, Pseudomonas aeruginosa PA01
gcucagcuccaggccgcgggucu

SEQ ID NO: 3495294 - RNA, 16 nt, Pseudomonas aeruginosa PA01
gcucagcucggcgaug

SEQ ID NO: 3495295 - RNA, 19 nt, Pseudomonas aeruginosa PA01
gcucagcucggcgaugccg

SEQ ID NO: 3495296 - RNA, 22 nt, Pseudomonas aeruginosa PA01
gcucagcucggcgaugccgccg

SEQ ID NO: 3495297 - RNA, 23 nt, Pseudomonas aeruginosa PA01
gcucagcucggcgaugccgccgg

SEQ ID NO: 3495298 - RNA, 20 nt, Pseudomonas aeruginosa PA01
gcucagcucucccgaggcga

SEQ ID NO: 3495299 - RNA, 19 nt, Pseudomonas aeruginosa PA01
gcucagcuggauagaguac

SEQ ID NO: 3495300 - RNA, 18 nt, Pseudomonas aeruginosa PA01
gcucaggacguccuggcc

SEQ ID NO: 3495301 - RNA, 22 nt, Pseudomonas aeruginosa PA01
gcucaggacguccuggccgagc

SEQ ID NO: 3495302 - RNA, 23 nt, Pseudomonas aeruginosa PA01
gcucaggacguccuggccgagcc

SEQ ID NO: 3495303 - RNA, 14 nt, Pseudomonas aeruginosa PA01
gcucaggcacucga

SEQ ID NO: 3495304 - RNA, 23 nt, Pseudomonas aeruginosa PA01
gcucaggcacucgaugaacagcg

SEQ ID NO: 3495305 - RNA, 14 nt, Pseudomonas aeruginosa PA01
gcucaggccgccgc

SEQ ID NO: 3495306 - RNA, 16 nt, Pseudomonas aeruginosa PA01
gcucaggccgccgcgu

SEQ ID NO: 3495307 - RNA, 19 nt, Pseudomonas aeruginosa PA01
gcucaggccgccgcgucga

SEQ ID NO: 3495308 - RNA, 13 nt, Pseudomonas aeruginosa PA01
gcucaggccucga

SEQ ID NO: 3495309 - RNA, 15 nt, Pseudomonas aeruginosa PA01
gcucaggccucgagg

SEQ ID NO: 3495310 - RNA, 11 nt, Pseudomonas aeruginosa PA01
gcucaggcgaa

SEQ ID NO: 3495311 - RNA, 18 nt, Pseudomonas aeruginosa PA01
gcucaggcgaaccuggag

SEQ ID NO: 3495312 - RNA, 19 nt, Pseudomonas aeruginosa PA01
gcucaggcgcagcguccug

SEQ ID NO: 3495313 - RNA, 19 nt, Pseudomonas aeruginosa PA01
gcucaggcgcaguaacgcc

SEQ ID NO: 3495314 - RNA, 14 nt, Pseudomonas aeruginosa PA01
gcucaggcgcugcu

SEQ ID NO: 3495315 - RNA, 19 nt, Pseudomonas aeruginosa PA01
gcucaggcgcugcuggugg

SEQ ID NO: 3495316 - RNA, 23 nt, Pseudomonas aeruginosa PA01
gcucaggcggccgaacuggauga

SEQ ID NO: 3495317 - RNA, 17 nt, Pseudomonas aeruginosa PA01
gcucaggcgucccgcuc

SEQ ID NO: 3495318 - RNA, 21 nt, Pseudomonas aeruginosa PA01
gcucaggcgucccgcuccagc

SEQ ID NO: 3495319 - RNA, 22 nt, Pseudomonas aeruginosa PA01
gcucaggcgucccgcuccagcc

SEQ ID NO: 3495320 - RNA, 21 nt, Pseudomonas aeruginosa PA01
gcucaggcguucgucguggcc

SEQ ID NO: 3495321 - RNA, 24 nt, Pseudomonas aeruginosa PA01
gcucaggcugugcaggaaggcgac

SEQ ID NO: 3495322 - RNA, 23 nt, Pseudomonas aeruginosa PA01
gcucagggaauggaugcgcggca

SEQ ID NO: 3495323 - RNA, 18 nt, Pseudomonas aeruginosa PA01
gcucagggacaccccguc

SEQ ID NO: 3495324 - RNA, 17 nt, Pseudomonas aeruginosa PA01
gcucagggccgcgccga

SEQ ID NO: 3495325 - RNA, 15 nt, Pseudomonas aeruginosa PA01
gcucagggucucgcg

SEQ ID NO: 3495326 - RNA, 17 nt, Pseudomonas aeruginosa PA01
gcucagggucucgcggg

SEQ ID NO: 3495327 - RNA, 18 nt, Pseudomonas aeruginosa PA01
gcucagggucucgcgggc

SEQ ID NO: 3495328 - RNA, 19 nt, Pseudomonas aeruginosa PA01
gcucagggucucgcgggcg

SEQ ID NO: 3495329 - RNA, 11 nt, Pseudomonas aeruginosa PA01
gcucaggucga

SEQ ID NO: 3495330 - RNA, 16 nt, Pseudomonas aeruginosa PA01
gcucaggucgaacugc

SEQ ID NO: 3495331 - RNA, 11 nt, Pseudomonas aeruginosa PA01
gcucaggucgu

SEQ ID NO: 3495332 - RNA, 20 nt, Pseudomonas aeruginosa PA01
gcucaggucguagggcguca

SEQ ID NO: 3495333 - RNA, 15 nt, Pseudomonas aeruginosa PA01
gcucagucgaccguc

SEQ ID NO: 3495334 - RNA, 21 nt, Pseudomonas aeruginosa PA01
gcucagucgagcaugucgcug

SEQ ID NO: 3495335 - RNA, 18 nt, Pseudomonas aeruginosa PA01
gcucagucgguagagcag

SEQ ID NO: 3495336 - RNA, 20 nt, Pseudomonas aeruginosa PA01
gcucaguucggccagcggca

SEQ ID NO: 3495337 - RNA, 15 nt, Pseudomonas aeruginosa PA01
gcucaguugcaccug

SEQ ID NO: 3495338 - RNA, 21 nt, Pseudomonas aeruginosa PA01
gcucauaccgguaauccggca

SEQ ID NO: 3495339 - RNA, 15 nt, Pseudomonas aeruginosa PA01
gcucauccugcccgu

SEQ ID NO: 3495340 - RNA, 16 nt, Pseudomonas aeruginosa PA01
gcucauccugcccgua

SEQ ID NO: 3495341 - RNA, 12 nt, Pseudomonas aeruginosa PA01
gcucaucgcccg

SEQ ID NO: 3495342 - RNA, 19 nt, Pseudomonas aeruginosa PA01
gcucaucgcguagguggcg

SEQ ID NO: 3495343 - RNA, 14 nt, Pseudomonas aeruginosa PA01
gcucaucggcgaca

SEQ ID NO: 3495344 - RNA, 15 nt, Pseudomonas aeruginosa PA01
gcucaucugcaccac

SEQ ID NO: 3495345 - RNA, 21 nt, Pseudomonas aeruginosa PA01
gcucaucuucucguucagcgc

SEQ ID NO: 3495346 - RNA, 18 nt, Pseudomonas aeruginosa PA01
gcucaugagauccgccag

SEQ ID NO: 3495347 - RNA, 19 nt, Pseudomonas aeruginosa PA01
gcucaugagauccgccagc

SEQ ID NO: 3495348 - RNA, 20 nt, Pseudomonas aeruginosa PA01
gcucaugagauccgccagca

SEQ ID NO: 3495349 - RNA, 22 nt, Pseudomonas aeruginosa PA01
gcucaugagauccgccagcaga

SEQ ID NO: 3495350 - RNA, 17 nt, Pseudomonas aeruginosa PA01
gcucauggagcaacagc

SEQ ID NO: 3495351 - RNA, 13 nt, Pseudomonas aeruginosa PA01
gcucauggccagg

SEQ ID NO: 3495352 - RNA, 21 nt, Pseudomonas aeruginosa PA01
gcucauggccaggucagccac

SEQ ID NO: 3495353 - RNA, 14 nt, Pseudomonas aeruginosa PA01
gcucauggccgggg

SEQ ID NO: 3495354 - RNA, 15 nt, Pseudomonas aeruginosa PA01
gcucauggccggggu

SEQ ID NO: 3495355 - RNA, 11 nt, Pseudomonas aeruginosa PA01
gcucauggcgc

SEQ ID NO: 3495356 - RNA, 14 nt, Pseudomonas aeruginosa PA01
gcucauggcgccgc

SEQ ID NO: 3495357 - RNA, 16 nt, Pseudomonas aeruginosa PA01
gcucauggcgccgcca

SEQ ID NO: 3495358 - RNA, 17 nt, Pseudomonas aeruginosa PA01
gcucaugggcgaugcgc

SEQ ID NO: 3495359 - RNA, 14 nt, Pseudomonas aeruginosa PA01
gcucaugucgugga

SEQ ID NO: 3495360 - RNA, 17 nt, Pseudomonas aeruginosa PA01
gcucaugugggcuaccg

SEQ ID NO: 3495361 - RNA, 21 nt, Pseudomonas aeruginosa PA01
gcucauguucaguucggcgga

SEQ ID NO: 3495362 - RNA, 19 nt, Pseudomonas aeruginosa PA01
gcucauguugcgggcuucg

SEQ ID NO: 3495363 - RNA, 19 nt, Pseudomonas aeruginosa PA01
gcuccaacaggcauugccg

SEQ ID NO: 3495364 - RNA, 21 nt, Pseudomonas aeruginosa PA01
gcuccaacaggcauugccguc

SEQ ID NO: 3495365 - RNA, 14 nt, Pseudomonas aeruginosa PA01
gcuccaacgcaggc

SEQ ID NO: 3495366 - RNA, 16 nt, Pseudomonas aeruginosa PA01
gcuccaacgcaggcgc

SEQ ID NO: 3495367 - RNA, 17 nt, Pseudomonas aeruginosa PA01
gcuccaacgcaggcgca

SEQ ID NO: 3495368 - RNA, 23 nt, Pseudomonas aeruginosa PA01
gcuccaauccgauuccgcgcagg

SEQ ID NO: 3495369 - RNA, 15 nt, Pseudomonas aeruginosa PA01
gcuccaaugcaccug

SEQ ID NO: 3495370 - RNA, 16 nt, Pseudomonas aeruginosa PA01
gcuccaaugcaccugc

SEQ ID NO: 3495371 - RNA, 17 nt, Pseudomonas aeruginosa PA01
gcuccaaugcaccugcg

SEQ ID NO: 3495372 - RNA, 18 nt, Pseudomonas aeruginosa PA01
gcuccaaugcaccugcgc

SEQ ID NO: 3495373 - RNA, 15 nt, Pseudomonas aeruginosa PA01
gcuccacacccgguc

SEQ ID NO: 3495374 - RNA, 21 nt, Pseudomonas aeruginosa PA01
gcuccacacccggucgcgcug

SEQ ID NO: 3495375 - RNA, 22 nt, Pseudomonas aeruginosa PA01
gcuccacacccggucgcgcugg

SEQ ID NO: 3495376 - RNA, 15 nt, Pseudomonas aeruginosa PA01
gcuccacagcugcca

SEQ ID NO: 3495377 - RNA, 19 nt, Pseudomonas aeruginosa PA01
gcuccacagcugccagccc

SEQ ID NO: 3495378 - RNA, 13 nt, Pseudomonas aeruginosa PA01
gcuccaccaggcc

SEQ ID NO: 3495379 - RNA, 22 nt, Pseudomonas aeruginosa PA01
gcuccaccaggccauagcgcgc

SEQ ID NO: 3495380 - RNA, 15 nt, Pseudomonas aeruginosa PA01
gcuccaccagggccu

SEQ ID NO: 3495381 - RNA, 16 nt, Pseudomonas aeruginosa PA01
gcuccacccaggcgcc

SEQ ID NO: 3495382 - RNA, 18 nt, Pseudomonas aeruginosa PA01
gcuccacccaggcgccga

SEQ ID NO: 3495383 - RNA, 20 nt, Pseudomonas aeruginosa PA01
gcuccacccaggcgccgauc

SEQ ID NO: 3495384 - RNA, 12 nt, Pseudomonas aeruginosa PA01
gcuccacccgca

SEQ ID NO: 3495385 - RNA, 17 nt, Pseudomonas aeruginosa PA01
gcuccacccgcagccgc

SEQ ID NO: 3495386 - RNA, 18 nt, Pseudomonas aeruginosa PA01
gcuccaccgauggcgcgc

SEQ ID NO: 3495387 - RNA, 21 nt, Pseudomonas aeruginosa PA01
gcuccaccgcccccggcgcca

SEQ ID NO: 3495388 - RNA, 14 nt, Pseudomonas aeruginosa PA01
gcuccaccgcgcuc

SEQ ID NO: 3495389 - RNA, 21 nt, Pseudomonas aeruginosa PA01
gcuccaccucggaccagaggc

SEQ ID NO: 3495390 - RNA, 15 nt, Pseudomonas aeruginosa PA01
gcuccacgucggccc

SEQ ID NO: 3495391 - RNA, 17 nt, Pseudomonas aeruginosa PA01
gcuccacugcuuggcca

SEQ ID NO: 3495392 - RNA, 21 nt, Pseudomonas aeruginosa PA01
gcuccacugcuuggccaggcg

SEQ ID NO: 3495393 - RNA, 22 nt, Pseudomonas aeruginosa PA01
gcuccacugcuuggccaggcgc

SEQ ID NO: 3495394 - RNA, 21 nt, Pseudomonas aeruginosa PA01
gcuccagaucgccguucucga

SEQ ID NO: 3495395 - RNA, 17 nt, Pseudomonas aeruginosa PA01
gcuccagaugcuggagc

SEQ ID NO: 3495396 - RNA, 19 nt, Pseudomonas aeruginosa PA01
gcuccagcaaugccagcgc

SEQ ID NO: 3495397 - RNA, 20 nt, Pseudomonas aeruginosa PA01
gcuccagcaaugccagcgcc

SEQ ID NO: 3495398 - RNA, 21 nt, Pseudomonas aeruginosa PA01
gcuccagcaaugccagcgcca

SEQ ID NO: 3495399 - RNA, 17 nt, Pseudomonas aeruginosa PA01
gcuccagcaccggcggc

SEQ ID NO: 3495400 - RNA, 20 nt, Pseudomonas aeruginosa PA01
gcuccagcaccggcggcgcc

SEQ ID NO: 3495401 - RNA, 17 nt, Pseudomonas aeruginosa PA01
gcuccagcaccguggcg

SEQ ID NO: 3495402 - RNA, 20 nt, Pseudomonas aeruginosa PA01
gcuccagcaccguggcgcca

SEQ ID NO: 3495403 - RNA, 14 nt, Pseudomonas aeruginosa PA01
gcuccagcagggcc

SEQ ID NO: 3495404 - RNA, 16 nt, Pseudomonas aeruginosa PA01
gcuccagcagggccag

SEQ ID NO: 3495405 - RNA, 17 nt, Pseudomonas aeruginosa PA01
gcuccagcagggccagc

SEQ ID NO: 3495406 - RNA, 21 nt, Pseudomonas aeruginosa PA01
gcuccagcagggccagcgccu

SEQ ID NO: 3495407 - RNA, 22 nt, Pseudomonas aeruginosa PA01
gcuccagcagggccagcgccug

SEQ ID NO: 3495408 - RNA, 23 nt, Pseudomonas aeruginosa PA01
gcuccagcagggccagcgccugg

SEQ ID NO: 3495409 - RNA, 19 nt, Pseudomonas aeruginosa PA01
gcuccagcagucgcacagc

SEQ ID NO: 3495410 - RNA, 18 nt, Pseudomonas aeruginosa PA01
gcuccagcaguucgucgc

SEQ ID NO: 3495411 - RNA, 14 nt, Pseudomonas aeruginosa PA01
gcuccagccaggcc

SEQ ID NO: 3495412 - RNA, 16 nt, Pseudomonas aeruginosa PA01
gcuccagccaggcccg

SEQ ID NO: 3495413 - RNA, 14 nt, Pseudomonas aeruginosa PA01
gcuccagccgcugc

SEQ ID NO: 3495414 - RNA, 15 nt, Pseudomonas aeruginosa PA01
gcuccagccgcugca

SEQ ID NO: 3495415 - RNA, 21 nt, Pseudomonas aeruginosa PA01
gcuccagccgggcuccgccgc

SEQ ID NO: 3495416 - RNA, 23 nt, Pseudomonas aeruginosa PA01
gcuccagcgaauggacaggcgcc

SEQ ID NO: 3495417 - RNA, 15 nt, Pseudomonas aeruginosa PA01
gcuccagcgcccagg

SEQ ID NO: 3495418 - RNA, 16 nt, Pseudomonas aeruginosa PA01
gcuccagcgcccaggu

SEQ ID NO: 3495419 - RNA, 17 nt, Pseudomonas aeruginosa PA01
gcuccagcgccucgacc

SEQ ID NO: 3495420 - RNA, 14 nt, Pseudomonas aeruginosa PA01
gcuccagcggcagc

SEQ ID NO: 3495421 - RNA, 20 nt, Pseudomonas aeruginosa PA01
gcuccagcggcagcucggcg

SEQ ID NO: 3495422 - RNA, 21 nt, Pseudomonas aeruginosa PA01
ggcacggucauggccagcucg

SEQ ID NO: 3495423 - RNA, 15 nt, Pseudomonas aeruginosa PA01
ggcacguacguccag

SEQ ID NO: 3495424 - RNA, 19 nt, Pseudomonas aeruginosa PA01
ggcacguacguccagggca

SEQ ID NO: 3495425 - RNA, 20 nt, Pseudomonas aeruginosa PA01
ggcacguacguccagggcac

SEQ ID NO: 3495426 - RNA, 16 nt, Pseudomonas aeruginosa PA01
ggcacgugcagcggca

SEQ ID NO: 3495427 - RNA, 14 nt, Pseudomonas aeruginosa PA01
ggcacucagccagc

SEQ ID NO: 3495428 - RNA, 16 nt, Pseudomonas aeruginosa PA01
ggcacucagccagcgg

SEQ ID NO: 3495429 - RNA, 20 nt, Pseudomonas aeruginosa PA01
ggcacucagccagcggcgcu

SEQ ID NO: 3495430 - RNA, 13 nt, Pseudomonas aeruginosa PA01
ggcacuccggcau

SEQ ID NO: 3495431 - RNA, 19 nt, Pseudomonas aeruginosa PA01
ggcacuccguugaccuggu

SEQ ID NO: 3495432 - RNA, 22 nt, Pseudomonas aeruginosa PA01
ggcacuccguugaccugguugc

SEQ ID NO: 3495433 - RNA, 18 nt, Pseudomonas aeruginosa PA01
ggcacucgaugaacagcg

SEQ ID NO: 3495434 - RNA, 15 nt, Pseudomonas aeruginosa PA01
ggcacucgccgggcg

SEQ ID NO: 3495435 - RNA, 15 nt, Pseudomonas aeruginosa PA01
ggcacucggcgacca

SEQ ID NO: 3495436 - RNA, 19 nt, Pseudomonas aeruginosa PA01
ggcacuucguccaggccgc

SEQ ID NO: 3495437 - RNA, 20 nt, Pseudomonas aeruginosa PA01
ggcacuucguccaggccgcc

SEQ ID NO: 3495438 - RNA, 22 nt, Pseudomonas aeruginosa PA01
ggcacuucguccaggccgccua

SEQ ID NO: 3495439 - RNA, 20 nt, Pseudomonas aeruginosa PA01
ggcacuucucgaacagcucc

SEQ ID NO: 3495440 - RNA, 19 nt, Pseudomonas aeruginosa PA01
ggcagaacacccggguuuc

SEQ ID NO: 3495441 - RNA, 12 nt, Pseudomonas aeruginosa PA01
ggcagaacaucg

SEQ ID NO: 3495442 - RNA, 16 nt, Pseudomonas aeruginosa PA01
ggcagacaccaccagg

SEQ ID NO: 3495443 - RNA, 15 nt, Pseudomonas aeruginosa PA01
ggcagaccagcagcg

SEQ ID NO: 3495444 - RNA, 18 nt, Pseudomonas aeruginosa PA01
ggcagaccagcagcgcac

SEQ ID NO: 3495445 - RNA, 23 nt, Pseudomonas aeruginosa PA01
ggcagaccagcagcgcaccaucc

SEQ ID NO: 3495446 - RNA, 14 nt, Pseudomonas aeruginosa PA01
ggcagaccagcgca

SEQ ID NO: 3495447 - RNA, 21 nt, Pseudomonas aeruginosa PA01
ggcagaccagcgcaagcggcg

SEQ ID NO: 3495448 - RNA, 23 nt, Pseudomonas aeruginosa PA01
ggcagaccagcgcaagcggcggc

SEQ ID NO: 3495449 - RNA, 18 nt, Pseudomonas aeruginosa PA01
ggcagaccaggccgagca

SEQ ID NO: 3495450 - RNA, 17 nt, Pseudomonas aeruginosa PA01
ggcagaccugcagcagg

SEQ ID NO: 3495451 - RNA, 18 nt, Pseudomonas aeruginosa PA01
ggcagaccugcagcagga

SEQ ID NO: 3495452 - RNA, 21 nt, Pseudomonas aeruginosa PA01
ggcagaccugcagcaggauca

SEQ ID NO: 3495453 - RNA, 23 nt, Pseudomonas aeruginosa PA01
ggcagaccugcagcaggaucagc

SEQ ID NO: 3495454 - RNA, 21 nt, Pseudomonas aeruginosa PA01
ggcagaccuggugggcggcgg

SEQ ID NO: 3495455 - RNA, 23 nt, Pseudomonas aeruginosa PA01
ggcagaccuggugggcggcggcu

SEQ ID NO: 3495456 - RNA, 15 nt, Pseudomonas aeruginosa PA01
ggcagacgcugcucg

SEQ ID NO: 3495457 - RNA, 18 nt, Pseudomonas aeruginosa PA01
ggcagacgcugcucgacg

SEQ ID NO: 3495458 - RNA, 13 nt, Pseudomonas aeruginosa PA01
ggcagacgugcug

SEQ ID NO: 3495459 - RNA, 16 nt, Pseudomonas aeruginosa PA01
ggcagacuucgccgug

SEQ ID NO: 3495460 - RNA, 22 nt, Pseudomonas aeruginosa PA01
ggcagagcuggaagucguccag

SEQ ID NO: 3495461 - RNA, 16 nt, Pseudomonas aeruginosa PA01
ggcagaguggcgcggc

SEQ ID NO: 3495462 - RNA, 20 nt, Pseudomonas aeruginosa PA01
ggcagaguggcgcggcugau

SEQ ID NO: 3495463 - RNA, 23 nt, Pseudomonas aeruginosa PA01
ggcagauccgccgugaggcgcgc

SEQ ID NO: 3495464 - RNA, 17 nt, Pseudomonas aeruginosa PA01
ggcagaucgcgccgagc

SEQ ID NO: 3495465 - RNA, 18 nt, Pseudomonas aeruginosa PA01
ggcagaucgcgccgagcu

SEQ ID NO: 3495466 - RNA, 15 nt, Pseudomonas aeruginosa PA01
ggcagaugccgggcg

SEQ ID NO: 3495467 - RNA, 15 nt, Pseudomonas aeruginosa PA01
ggcagauguccaggc

SEQ ID NO: 3495468 - RNA, 17 nt, Pseudomonas aeruginosa PA01
ggcagauguccaggcag

SEQ ID NO: 3495469 - RNA, 18 nt, Pseudomonas aeruginosa PA01
ggcagauguccaggcagg

SEQ ID NO: 3495470 - RNA, 20 nt, Pseudomonas aeruginosa PA01
ggcagauuccuggaccccgc

SEQ ID NO: 3495471 - RNA, 18 nt, Pseudomonas aeruginosa PA01
ggcagcacaugccacgca

SEQ ID NO: 3495472 - RNA, 12 nt, Pseudomonas aeruginosa PA01
ggcagcaccagg

SEQ ID NO: 3495473 - RNA, 18 nt, Pseudomonas aeruginosa PA01
ggcagcaccaggccaucg

SEQ ID NO: 3495474 - RNA, 13 nt, Pseudomonas aeruginosa PA01
ggcagcacccgca

SEQ ID NO: 3495475 - RNA, 16 nt, Pseudomonas aeruginosa PA01
ggcagcacccgcacca

SEQ ID NO: 3495476 - RNA, 19 nt, Pseudomonas aeruginosa PA01
ggcagcacccgcaccagcc

SEQ ID NO: 3495477 - RNA, 22 nt, Pseudomonas aeruginosa PA01
ggcagcacccgcaccagccggc

SEQ ID NO: 3495478 - RNA, 18 nt, Pseudomonas aeruginosa PA01
ggcagcacgcuggcgucg

SEQ ID NO: 3495479 - RNA, 21 nt, Pseudomonas aeruginosa PA01
ggcagcacgcuggcgucgggc

SEQ ID NO: 3495480 - RNA, 22 nt, Pseudomonas aeruginosa PA01
ggcagcacggcgauacccaggc

SEQ ID NO: 3495481 - RNA, 22 nt, Pseudomonas aeruginosa PA01
ggcagcacgucuugcaggcuca

SEQ ID NO: 3495482 - RNA, 15 nt, Pseudomonas aeruginosa PA01
ggcagcagagcgcca

SEQ ID NO: 3495483 - RNA, 19 nt, Pseudomonas aeruginosa PA01
ggcagcagccaaccgucgc

SEQ ID NO: 3495484 - RNA, 15 nt, Pseudomonas aeruginosa PA01
ggcagcagcgaacgc

SEQ ID NO: 3495485 - RNA, 17 nt, Pseudomonas aeruginosa PA01
ggcagcagcgaacgccg

SEQ ID NO: 3495486 - RNA, 13 nt, Pseudomonas aeruginosa PA01
ggcagcagcgcca

SEQ ID NO: 3495487 - RNA, 14 nt, Pseudomonas aeruginosa PA01
ggcagcagcgccag

SEQ ID NO: 3495488 - RNA, 15 nt, Pseudomonas aeruginosa PA01
ggcagcagcgccagg

SEQ ID NO: 3495489 - RNA, 22 nt, Pseudomonas aeruginosa PA01
ggcagcagcgccaggaagccgc

SEQ ID NO: 3495490 - RNA, 21 nt, Pseudomonas aeruginosa PA01
ggcagcagcggauauucgacg

SEQ ID NO: 3495491 - RNA, 14 nt, Pseudomonas aeruginosa PA01
ggcagcagcggauc

SEQ ID NO: 3495492 - RNA, 17 nt, Pseudomonas aeruginosa PA01
ggcagcagcggaucggc

SEQ ID NO: 3495493 - RNA, 18 nt, Pseudomonas aeruginosa PA01
ggcagcagcuugccggca

SEQ ID NO: 3495494 - RNA, 13 nt, Pseudomonas aeruginosa PA01
ggcagcaggccgc

SEQ ID NO: 3495495 - RNA, 14 nt, Pseudomonas aeruginosa PA01
ggcagcaggcgggc

SEQ ID NO: 3495496 - RNA, 15 nt, Pseudomonas aeruginosa PA01
ggcagcaggcgggcg

SEQ ID NO: 3495497 - RNA, 19 nt, Pseudomonas aeruginosa PA01
ggcagcaggcgggcgaagu

SEQ ID NO: 3495498 - RNA, 13 nt, Pseudomonas aeruginosa PA01
ggcagcaggcugu

SEQ ID NO: 3495499 - RNA, 21 nt, Pseudomonas aeruginosa PA01
ggcagcaggcuguacagcagg

SEQ ID NO: 3495500 - RNA, 13 nt, Pseudomonas aeruginosa PA01
ggcagcagggcgu

SEQ ID NO: 3495501 - RNA, 19 nt, Pseudomonas aeruginosa PA01
ggcagcagggucagcagcg

SEQ ID NO: 3495502 - RNA, 20 nt, Pseudomonas aeruginosa PA01
ggcagcagggucagcagcgc

SEQ ID NO: 3495503 - RNA, 22 nt, Pseudomonas aeruginosa PA01
ggcagcagggucagcagcgcca

SEQ ID NO: 3495504 - RNA, 18 nt, Pseudomonas aeruginosa PA01
ggcagcagucgcagcucg

SEQ ID NO: 3495505 - RNA, 13 nt, Pseudomonas aeruginosa PA01
ggcagcaucagcc

SEQ ID NO: 3495506 - RNA, 16 nt, Pseudomonas aeruginosa PA01
ggcagcaucagccgcg

SEQ ID NO: 3495507 - RNA, 21 nt, Pseudomonas aeruginosa PA01
ggcagcaucagccgcgacgac

SEQ ID NO: 3495508 - RNA, 17 nt, Pseudomonas aeruginosa PA01
ggcagcauccguaccag

SEQ ID NO: 3495509 - RNA, 20 nt, Pseudomonas aeruginosa PA01
ggcagcaucucggugcgccc

SEQ ID NO: 3495510 - RNA, 21 nt, Pseudomonas aeruginosa PA01
ggcagcaucucggugcgcccc

SEQ ID NO: 3495511 - RNA, 18 nt, Pseudomonas aeruginosa PA01
ggcagccacucggccagg

SEQ ID NO: 3495512 - RNA, 22 nt, Pseudomonas aeruginosa PA01
ggcagccacucggccaggcgcc

SEQ ID NO: 3495513 - RNA, 24 nt, Pseudomonas aeruginosa PA01
ggcagccacucggccaggcgccag

SEQ ID NO: 3495514 - RNA, 15 nt, Pseudomonas aeruginosa PA01
ggcagccagccgccg

SEQ ID NO: 3495515 - RNA, 22 nt, Pseudomonas aeruginosa PA01
ggcagccaucgcauagccggcg

SEQ ID NO: 3495516 - RNA, 23 nt, Pseudomonas aeruginosa PA01
ggcagccaucgcauagccggcgc

SEQ ID NO: 3495517 - RNA, 20 nt, Pseudomonas aeruginosa PA01
ggcagccauuuuagaaaaau

SEQ ID NO: 3495518 - RNA, 19 nt, Pseudomonas aeruginosa PA01
ggcagccccuugagcgcgu

SEQ ID NO: 3495519 - RNA, 16 nt, Pseudomonas aeruginosa PA01
ggcagccccuugcgcu

SEQ ID NO: 3495520 - RNA, 22 nt, Pseudomonas aeruginosa PA01
ggcagccccuugcgcucuggcg

SEQ ID NO: 3495521 - RNA, 21 nt, Pseudomonas aeruginosa PA01
ggcagccgccgcggcaccggc

SEQ ID NO: 3495522 - RNA, 16 nt, Pseudomonas aeruginosa PA01
ggcagccggccaugcu

SEQ ID NO: 3495523 - RNA, 14 nt, Pseudomonas aeruginosa PA01
ggcagccguccgcc

SEQ ID NO: 3495524 - RNA, 17 nt, Pseudomonas aeruginosa PA01
ggcagccugggggucua

SEQ ID NO: 3495525 - RNA, 13 nt, Pseudomonas aeruginosa PA01
ggcagcgaccacc

SEQ ID NO: 3495526 - RNA, 15 nt, Pseudomonas aeruginosa PA01
ggcagcgaccaccac

SEQ ID NO: 3495527 - RNA, 17 nt, Pseudomonas aeruginosa PA01
ggcagcgaccaccacca

SEQ ID NO: 3495528 - RNA, 23 nt, Pseudomonas aeruginosa PA01
ggcagcgaccaccaccaggucgg

SEQ ID NO: 3495529 - RNA, 18 nt, Pseudomonas aeruginosa PA01
ggcagcgagcgggucagc

SEQ ID NO: 3495530 - RNA, 22 nt, Pseudomonas aeruginosa PA01
ggcagcgagcgggucagcagca

SEQ ID NO: 3495531 - RNA, 14 nt, Pseudomonas aeruginosa PA01
ggcagcgaucgccg

SEQ ID NO: 3495532 - RNA, 16 nt, Pseudomonas aeruginosa PA01
ggcagcgaucgccgcc

SEQ ID NO: 3495533 - RNA, 18 nt, Pseudomonas aeruginosa PA01
ggcagcgaugccuccggc

SEQ ID NO: 3495534 - RNA, 13 nt, Pseudomonas aeruginosa PA01
ggcagcgccaggu

SEQ ID NO: 3495535 - RNA, 16 nt, Pseudomonas aeruginosa PA01
ggcagcgccaucaggc

SEQ ID NO: 3495536 - RNA, 12 nt, Pseudomonas aeruginosa PA01
ggcagcgccgag

SEQ ID NO: 3495537 - RNA, 13 nt, Pseudomonas aeruginosa PA01
ggcagcgccgagg

SEQ ID NO: 3495538 - RNA, 18 nt, Pseudomonas aeruginosa PA01
ggcagcgccgaggucuug

SEQ ID NO: 3495539 - RNA, 15 nt, Pseudomonas aeruginosa PA01
ggcagcgccgccagc

SEQ ID NO: 3495540 - RNA, 18 nt, Pseudomonas aeruginosa PA01
ggcagcgccgccagcagg

SEQ ID NO: 3495541 - RNA, 19 nt, Pseudomonas aeruginosa PA01
ggcagcgccgccagcagga

SEQ ID NO: 3495542 - RNA, 14 nt, Pseudomonas aeruginosa PA01
ggcagcgccgccca

SEQ ID NO: 3495543 - RNA, 15 nt, Pseudomonas aeruginosa PA01
ggcagcgccgcccac

SEQ ID NO: 3495544 - RNA, 19 nt, Pseudomonas aeruginosa PA01
ggcagcgccgccgggcgua

SEQ ID NO: 3495545 - RNA, 14 nt, Pseudomonas aeruginosa PA01
ggcagcgccgggca

SEQ ID NO: 3495546 - RNA, 15 nt, Pseudomonas aeruginosa PA01
ggcagcgccgggcau

SEQ ID NO: 3495547 - RNA, 24 nt, Pseudomonas aeruginosa PA01
ggcagcgcgauaucgcaggccagg

SEQ ID NO: 3495548 - RNA, 14 nt, Pseudomonas aeruginosa PA01
ggcagcgcgcggcc

SEQ ID NO: 3495549 - RNA, 17 nt, Pseudomonas aeruginosa PA01
ggcagcgcgcggccagu

SEQ ID NO: 3495550 - RNA, 16 nt, Pseudomonas aeruginosa PA01
ggcagcgcguagacca

SEQ ID NO: 3495551 - RNA, 12 nt, Pseudomonas aeruginosa PA01
ggcagcgcuggc

SEQ ID NO: 3495552 - RNA, 15 nt, Pseudomonas aeruginosa PA01
ggcagcgcuggcgau

SEQ ID NO: 3495553 - RNA, 20 nt, Pseudomonas aeruginosa PA01
ggcagcgcuggcgaucacca

SEQ ID NO: 3495554 - RNA, 22 nt, Pseudomonas aeruginosa PA01
ggcagcgcuucguugcuccugc

SEQ ID NO: 3495555 - RNA, 12 nt, Pseudomonas aeruginosa PA01
ggcagcggcgca

SEQ ID NO: 3495556 - RNA, 21 nt, Pseudomonas aeruginosa PA01
ggcagcggcgugaagccgccg

SEQ ID NO: 3495557 - RNA, 14 nt, Pseudomonas aeruginosa PA01
ggcagcggcucguc

SEQ ID NO: 3495558 - RNA, 23 nt, Pseudomonas aeruginosa PA01
ggcagcggcucgucaucguccag

SEQ ID NO: 3495559 - RNA, 12 nt, Pseudomonas aeruginosa PA01
ggcagcggcugg

SEQ ID NO: 3495560 - RNA, 14 nt, Pseudomonas aeruginosa PA01
ggcagcggcuggcc

SEQ ID NO: 3495561 - RNA, 15 nt, Pseudomonas aeruginosa PA01
ggcagcggcuggccg

SEQ ID NO: 3495562 - RNA, 16 nt, Pseudomonas aeruginosa PA01
ggcagcggcuggccgu

SEQ ID NO: 3495563 - RNA, 18 nt, Pseudomonas aeruginosa PA01
ggcagcggcuggccgucg

SEQ ID NO: 3495564 - RNA, 18 nt, Pseudomonas aeruginosa PA01
ggcagcgggccaggcggu

SEQ ID NO: 3495565 - RNA, 13 nt, Pseudomonas aeruginosa PA01
ggcagcggucgcc

SEQ ID NO: 3495566 - RNA, 17 nt, Pseudomonas aeruginosa PA01
ggcagcgguucgcccgc

SEQ ID NO: 3495567 - RNA, 19 nt, Pseudomonas aeruginosa PA01
ggcagcgguucgcccgcgg

SEQ ID NO: 3495568 - RNA, 22 nt, Pseudomonas aeruginosa PA01
ggcagcgucgagcuggcgcagg

SEQ ID NO: 3495569 - RNA, 23 nt, Pseudomonas aeruginosa PA01
ggcagcgucgagcuggcgcaggc

SEQ ID NO: 3495570 - RNA, 18 nt, Pseudomonas aeruginosa PA01
ggcagcgucgccgggcgu

SEQ ID NO: 3495571 - RNA, 21 nt, Pseudomonas aeruginosa PA01
ggcagcgucggaaaacccugu

SEQ ID NO: 3495572 - RNA, 18 nt, Pseudomonas aeruginosa PA01
ggcagcgucucggcugcc

SEQ ID NO: 3495573 - RNA, 21 nt, Pseudomonas aeruginosa PA01
ggcagcgucucggcugccgcc

SEQ ID NO: 3495574 - RNA, 22 nt, Pseudomonas aeruginosa PA01
ggcagcgucucggcugccgcca

SEQ ID NO: 3495575 - RNA, 19 nt, Pseudomonas aeruginosa PA01
ggcagcgugcaccagcagg

SEQ ID NO: 3495576 - RNA, 20 nt, Pseudomonas aeruginosa PA01
ggcagcgugcaccagcaggc

SEQ ID NO: 3495577 - RNA, 21 nt, Pseudomonas aeruginosa PA01
ggcagcgugcaccagcaggcg

SEQ ID NO: 3495578 - RNA, 18 nt, Pseudomonas aeruginosa PA01
ggcagcgugcucacggca

SEQ ID NO: 3495579 - RNA, 19 nt, Pseudomonas aeruginosa PA01
ggcagcucauaggucaggu

SEQ ID NO: 3495580 - RNA, 20 nt, Pseudomonas aeruginosa PA01
ggcagcucccuugccgccgg

SEQ ID NO: 3495581 - RNA, 21 nt, Pseudomonas aeruginosa PA01
ggcagcucgcuaugcagcagg

SEQ ID NO: 3495582 - RNA, 16 nt, Pseudomonas aeruginosa PA01
ggcagcucggccgagg

SEQ ID NO: 3495583 - RNA, 18 nt, Pseudomonas aeruginosa PA01
ggcagcucggccgagggc

SEQ ID NO: 3495584 - RNA, 19 nt, Pseudomonas aeruginosa PA01
ggcagcucggccgagggca

SEQ ID NO: 3495585 - RNA, 15 nt, Pseudomonas aeruginosa PA01
ggcagcucggcgaca

SEQ ID NO: 3495586 - RNA, 21 nt, Pseudomonas aeruginosa PA01
ggcagcucguugcacagcgcc

SEQ ID NO: 3495587 - RNA, 22 nt, Pseudomonas aeruginosa PA01
ggcagcucugcgacuggaugca

SEQ ID NO: 3495588 - RNA, 22 nt, Pseudomonas aeruginosa PA01
ggcagcuggauccgugccaggc

SEQ ID NO: 3495589 - RNA, 23 nt, Pseudomonas aeruginosa PA01
ggcagcuuggcggucagcgacug

SEQ ID NO: 3495590 - RNA, 21 nt, Pseudomonas aeruginosa PA01
ggcaggaaccagacguugcgc

SEQ ID NO: 3495591 - RNA, 15 nt, Pseudomonas aeruginosa PA01
ggcaggaacgcccgc

SEQ ID NO: 3495592 - RNA, 23 nt, Pseudomonas aeruginosa PA01
ggcaggaacgcccgcggcagcag

SEQ ID NO: 3495593 - RNA, 13 nt, Pseudomonas aeruginosa PA01
ggcaggacccaga

SEQ ID NO: 3495594 - RNA, 17 nt, Pseudomonas aeruginosa PA01
ggcaggaccucgggcga

SEQ ID NO: 3495595 - RNA, 16 nt, Pseudomonas aeruginosa PA01
ggcaggacgaugauca

SEQ ID NO: 3495596 - RNA, 18 nt, Pseudomonas aeruginosa PA01
ggcaggaggaucgcggcc

SEQ ID NO: 3495597 - RNA, 21 nt, Pseudomonas aeruginosa PA01
ggcaggaggaucgcggccuuc

SEQ ID NO: 3495598 - RNA, 15 nt, Pseudomonas aeruginosa PA01
ggcaggauaucgccc

SEQ ID NO: 3495599 - RNA, 17 nt, Pseudomonas aeruginosa PA01
ggcaggauaucgcccag

SEQ ID NO: 3495600 - RNA, 18 nt, Pseudomonas aeruginosa PA01
ggcaggauaucgcccagg

SEQ ID NO: 3495601 - RNA, 14 nt, Pseudomonas aeruginosa PA01
ggcaggaucaggcu

SEQ ID NO: 3495602 - RNA, 15 nt, Pseudomonas aeruginosa PA01
ggcaggaucggcgcg

SEQ ID NO: 3495603 - RNA, 20 nt, Pseudomonas aeruginosa PA01
ggcaggaucggcgcggucgg

SEQ ID NO: 3495604 - RNA, 21 nt, Pseudomonas aeruginosa PA01
ggcaggcacgcugccagcagg

SEQ ID NO: 3495605 - RNA, 15 nt, Pseudomonas aeruginosa PA01
ggcaggcaggccugg

SEQ ID NO: 3495606 - RNA, 14 nt, Pseudomonas aeruginosa PA01
ggcaggcagugccg

SEQ ID NO: 3495607 - RNA, 16 nt, Pseudomonas aeruginosa PA01
ggcaggcaugcggccc

SEQ ID NO: 3495608 - RNA, 23 nt, Pseudomonas aeruginosa PA01
ggcaggcaugguggaucgacugc

SEQ ID NO: 3495609 - RNA, 17 nt, Pseudomonas aeruginosa PA01
ggcaggccacggccgcu

SEQ ID NO: 3495610 - RNA, 12 nt, Pseudomonas aeruginosa PA01
ggcaggccagca

SEQ ID NO: 3495611 - RNA, 14 nt, Pseudomonas aeruginosa PA01
ggcaggccagcagg

SEQ ID NO: 3495612 - RNA, 15 nt, Pseudomonas aeruginosa PA01
ggcaggccagcaggu

SEQ ID NO: 3495613 - RNA, 17 nt, Pseudomonas aeruginosa PA01
ggcaggccagcagguag

SEQ ID NO: 3495614 - RNA, 12 nt, Pseudomonas aeruginosa PA01
ggcaggccagcu

SEQ ID NO: 3495615 - RNA, 22 nt, Pseudomonas aeruginosa PA01
ggcaggccagcuuccaggcgcg

SEQ ID NO: 3495616 - RNA, 12 nt, Pseudomonas aeruginosa PA01
ggcaggccgagg

SEQ ID NO: 3495617 - RNA, 14 nt, Pseudomonas aeruginosa PA01
ggcaggccgaggcc

SEQ ID NO: 3495618 - RNA, 15 nt, Pseudomonas aeruginosa PA01
ggcaggccgauggcc

SEQ ID NO: 3495619 - RNA, 16 nt, Pseudomonas aeruginosa PA01
ggcaggccgauggccc

SEQ ID NO: 3495620 - RNA, 15 nt, Pseudomonas aeruginosa PA01
ggcaggccgccgauc

SEQ ID NO: 3495621 - RNA, 19 nt, Pseudomonas aeruginosa PA01
ggcaggccgggcuggccac

SEQ ID NO: 3495622 - RNA, 18 nt, Pseudomonas aeruginosa PA01
ggcaggccuucggcgccg

SEQ ID NO: 3495623 - RNA, 20 nt, Pseudomonas aeruginosa PA01
ggcaggccuucggcgccgga

SEQ ID NO: 3495624 - RNA, 21 nt, Pseudomonas aeruginosa PA01
ggcaggccuucggcgccggag

SEQ ID NO: 3495625 - RNA, 18 nt, Pseudomonas aeruginosa PA01
ggcaggcgaugaccgccc

SEQ ID NO: 3495626 - RNA, 17 nt, Pseudomonas aeruginosa PA01
ggcaggcgcacgcgcag

SEQ ID NO: 3495627 - RNA, 13 nt, Pseudomonas aeruginosa PA01
ggcaggcgcaggc

SEQ ID NO: 3495628 - RNA, 18 nt, Pseudomonas aeruginosa PA01
ggcaggcgcaucaggcca

SEQ ID NO: 3495629 - RNA, 22 nt, Pseudomonas aeruginosa PA01
ggcaggcgccaaccgggcagca

SEQ ID NO: 3495630 - RNA, 14 nt, Pseudomonas aeruginosa PA01
ggcaggcgcccggu

SEQ ID NO: 3495631 - RNA, 22 nt, Pseudomonas aeruginosa PA01
ggcaggcgcccggucagguugg

SEQ ID NO: 3495632 - RNA, 16 nt, Pseudomonas aeruginosa PA01
ggcaggcgccggccgg

SEQ ID NO: 3495633 - RNA, 13 nt, Pseudomonas aeruginosa PA01
ggcaggcgcggca

SEQ ID NO: 3495634 - RNA, 14 nt, Pseudomonas aeruginosa PA01
ggcaggcgcggcau

SEQ ID NO: 3495635 - RNA, 12 nt, Pseudomonas aeruginosa PA01
ggcaggcgcggg

SEQ ID NO: 3495636 - RNA, 19 nt, Pseudomonas aeruginosa PA01
ggcaggcgcgggucaucgg

SEQ ID NO: 3495637 - RNA, 23 nt, Pseudomonas aeruginosa PA01
ggcaggcgcuccuggugcggcac

SEQ ID NO: 3495638 - RNA, 14 nt, Pseudomonas aeruginosa PA01
ggcaggcggcggcg

SEQ ID NO: 3495639 - RNA, 17 nt, Pseudomonas aeruginosa PA01
ggcaggcggcggcguug

SEQ ID NO: 3495640 - RNA, 14 nt, Pseudomonas aeruginosa PA01
ggcaggcggucagc

SEQ ID NO: 3495641 - RNA, 15 nt, Pseudomonas aeruginosa PA01
ggcaggcggucagcg

SEQ ID NO: 3495642 - RNA, 13 nt, Pseudomonas aeruginosa PA01
ggcaggcucaccg

SEQ ID NO: 3495643 - RNA, 15 nt, Pseudomonas aeruginosa PA01
ggcaggcucaccgcg

SEQ ID NO: 3495644 - RNA, 17 nt, Pseudomonas aeruginosa PA01
ggcaggcucagcgcaug

SEQ ID NO: 3495645 - RNA, 15 nt, Pseudomonas aeruginosa PA01
ggcaggcugcgccgc

SEQ ID NO: 3495646 - RNA, 19 nt, Pseudomonas aeruginosa PA01
ggcaggcugugccauuccu

SEQ ID NO: 3495647 - RNA, 15 nt, Pseudomonas aeruginosa PA01
ggcagggaguccgcc

SEQ ID NO: 3495648 - RNA, 18 nt, Pseudomonas aeruginosa PA01
ggcagggaguccgccagc

SEQ ID NO: 3495649 - RNA, 19 nt, Pseudomonas aeruginosa PA01
ggcagggaguccgccagcc

SEQ ID NO: 3495650 - RNA, 22 nt, Pseudomonas aeruginosa PA01
ggcagggaguccgccagccggc

SEQ ID NO: 3495651 - RNA, 21 nt, Pseudomonas aeruginosa PA01
ggcagggcagccgccgcggca

SEQ ID NO: 3495652 - RNA, 19 nt, Pseudomonas aeruginosa PA01
ggcagggccucgggcggga

SEQ ID NO: 3495653 - RNA, 14 nt, Pseudomonas aeruginosa PA01
ggcagggcgcccgc

SEQ ID NO: 3495654 - RNA, 17 nt, Pseudomonas aeruginosa PA01
ggcagggcgcccgcccg

SEQ ID NO: 3495655 - RNA, 15 nt, Pseudomonas aeruginosa PA01
ggcagggcgccgacc

SEQ ID NO: 3495656 - RNA, 22 nt, Pseudomonas aeruginosa PA01
ggcagggcgccgaccagcuuca

SEQ ID NO: 3495657 - RNA, 12 nt, Pseudomonas aeruginosa PA01
ggcagggcgcgu

SEQ ID NO: 3495658 - RNA, 14 nt, Pseudomonas aeruginosa PA01
ggcagggcgcgucc

SEQ ID NO: 3495659 - RNA, 16 nt, Pseudomonas aeruginosa PA01
ggcaggguagccacgc

SEQ ID NO: 3495660 - RNA, 19 nt, Pseudomonas aeruginosa PA01
ggcaggguagccacgccgg

SEQ ID NO: 3495661 - RNA, 19 nt, Pseudomonas aeruginosa PA01
ggcagguagaccucgaugu

SEQ ID NO: 3495662 - RNA, 16 nt, Pseudomonas aeruginosa PA01
ggcagguagccgccuu

SEQ ID NO: 3495663 - RNA, 16 nt, Pseudomonas aeruginosa PA01
ggcagguaguggcccu

SEQ ID NO: 3495664 - RNA, 18 nt, Pseudomonas aeruginosa PA01
ggcagguaguggcccucg

SEQ ID NO: 3495665 - RNA, 16 nt, Pseudomonas aeruginosa PA01
ggcagguaucgcuggg

SEQ ID NO: 3495666 - RNA, 21 nt, Pseudomonas aeruginosa PA01
ggcaggucguugacgaucugc

SEQ ID NO: 3495667 - RNA, 15 nt, Pseudomonas aeruginosa PA01
ggcagguggacggca

SEQ ID NO: 3495668 - RNA, 16 nt, Pseudomonas aeruginosa PA01
ggcagguggacggcau

SEQ ID NO: 3495669 - RNA, 13 nt, Pseudomonas aeruginosa PA01
ggcagguggccgg

SEQ ID NO: 3495670 - RNA, 12 nt, Pseudomonas aeruginosa PA01
ggcagguggcgg

SEQ ID NO: 3495671 - RNA, 16 nt, Pseudomonas aeruginosa PA01
ggcagguggcgggucg

SEQ ID NO: 3495672 - RNA, 14 nt, Pseudomonas aeruginosa PA01
ggcagguggcuggc

SEQ ID NO: 3495673 - RNA, 15 nt, Pseudomonas aeruginosa PA01
ggcagguggcuggcc

SEQ ID NO: 3495674 - RNA, 16 nt, Pseudomonas aeruginosa PA01
ggcagguggguaccga

SEQ ID NO: 3495675 - RNA, 19 nt, Pseudomonas aeruginosa PA01
ggcagguucagcaggucgc

SEQ ID NO: 3495676 - RNA, 22 nt, Pseudomonas aeruginosa PA01
ggcagguugaugugcaguucga

SEQ ID NO: 3495677 - RNA, 17 nt, Pseudomonas aeruginosa PA01
ggcagguugcacggccg

SEQ ID NO: 3495678 - RNA, 20 nt, Pseudomonas aeruginosa PA01
ggcagguugcacggccggua

SEQ ID NO: 3495679 - RNA, 15 nt, Pseudomonas aeruginosa PA01
ggcagguugugguug

SEQ ID NO: 3495680 - RNA, 21 nt, Pseudomonas aeruginosa PA01
ggcagguugugguugggcagg

SEQ ID NO: 3495681 - RNA, 14 nt, Pseudomonas aeruginosa PA01
ggcagguuucgcga

SEQ ID NO: 3495682 - RNA, 15 nt, Pseudomonas aeruginosa PA01
ggcaguacguggcgc

SEQ ID NO: 3495683 - RNA, 23 nt, Pseudomonas aeruginosa PA01
ggcaguacucaugaccgccgcuc

SEQ ID NO: 3495684 - RNA, 20 nt, Pseudomonas aeruginosa PA01
ggcagucccagaaggccagg

SEQ ID NO: 3495685 - RNA, 22 nt, Pseudomonas aeruginosa PA01
ggcagucccagaaggccagggc

SEQ ID NO: 3495686 - RNA, 19 nt, Pseudomonas aeruginosa PA01
ggcagucccugccaggggc

SEQ ID NO: 3495687 - RNA, 20 nt, Pseudomonas aeruginosa PA01
ggcagucccugccaggggcu

SEQ ID NO: 3495688 - RNA, 23 nt, Pseudomonas aeruginosa PA01
ggcagucccugccaggggcuagu

SEQ ID NO: 3495689 - RNA, 22 nt, Pseudomonas aeruginosa PA01
ggcaguccuggcgguagcccgg

SEQ ID NO: 3495690 - RNA, 18 nt, Pseudomonas aeruginosa PA01
ggcaguccuugagcgcca

SEQ ID NO: 3495691 - RNA, 21 nt, Pseudomonas aeruginosa PA01
ggcaguccuugagcgccagca

SEQ ID NO: 3495692 - RNA, 16 nt, Pseudomonas aeruginosa PA01
ggcagucgccgcaccg

SEQ ID NO: 3495693 - RNA, 20 nt, Pseudomonas aeruginosa PA01
ggcagucgccgcaccggcga

SEQ ID NO: 3495694 - RNA, 14 nt, Pseudomonas aeruginosa PA01
ggcagucgccgcca

SEQ ID NO: 3495695 - RNA, 20 nt, Pseudomonas aeruginosa PA01
ggcagucgguagaaauccuc

SEQ ID NO: 3495696 - RNA, 18 nt, Pseudomonas aeruginosa PA01
ggcagucgucgcagccga

SEQ ID NO: 3495697 - RNA, 14 nt, Pseudomonas aeruginosa PA01
ggcagugccgggcg

SEQ ID NO: 3495698 - RNA, 14 nt, Pseudomonas aeruginosa PA01
ggcagugcgcccuc

SEQ ID NO: 3495699 - RNA, 21 nt, Pseudomonas aeruginosa PA01
ggcagugcgcccucgaacggc

SEQ ID NO: 3495700 - RNA, 16 nt, Pseudomonas aeruginosa PA01
ggcagugcucgaucag

SEQ ID NO: 3495701 - RNA, 24 nt, Pseudomonas aeruginosa PA01
ggcagugcucgaucaggcugugca

SEQ ID NO: 3495702 - RNA, 15 nt, Pseudomonas aeruginosa PA01
ggcaguggcgccagc

SEQ ID NO: 3495703 - RNA, 17 nt, Pseudomonas aeruginosa PA01
ggcagugugcaccgagu

SEQ ID NO: 3495704 - RNA, 23 nt, Pseudomonas aeruginosa PA01
ggcaguugcaguaccugcucacg

SEQ ID NO: 3495705 - RNA, 21 nt, Pseudomonas aeruginosa PA01
ggcauaaccggaagcgaucuc

SEQ ID NO: 3495706 - RNA, 17 nt, Pseudomonas aeruginosa PA01
ggcauacacaugcaggc

SEQ ID NO: 3495707 - RNA, 19 nt, Pseudomonas aeruginosa PA01
ggcauagaugccgcccugc

SEQ ID NO: 3495708 - RNA, 16 nt, Pseudomonas aeruginosa PA01
ggcauagaugccggcc

SEQ ID NO: 3495709 - RNA, 18 nt, Pseudomonas aeruginosa PA01
ggcauagaugccggccuc

SEQ ID NO: 3495710 - RNA, 23 nt, Pseudomonas aeruginosa PA01
ggcauagaugccggccucgacgc

SEQ ID NO: 3495711 - RNA, 16 nt, Pseudomonas aeruginosa PA01
ggcauagcgcagccgc

SEQ ID NO: 3495712 - RNA, 20 nt, Pseudomonas aeruginosa PA01
ggcauaggaauacggcgcga

SEQ ID NO: 3495713 - RNA, 15 nt, Pseudomonas aeruginosa PA01
ggcaucaaucgcugg

SEQ ID NO: 3495714 - RNA, 15 nt, Pseudomonas aeruginosa PA01
ggcaucagccccucg

SEQ ID NO: 3495715 - RNA, 19 nt, Pseudomonas aeruginosa PA01
ggcaucagccccucggcca

SEQ ID NO: 3495716 - RNA, 18 nt, Pseudomonas aeruginosa PA01
ggcaucaguagcgggcau

SEQ ID NO: 3495717 - RNA, 16 nt, Pseudomonas aeruginosa PA01
ggcaucaugccgagca

SEQ ID NO: 3495718 - RNA, 17 nt, Pseudomonas aeruginosa PA01
ggcaucaugccgagcau

SEQ ID NO: 3495719 - RNA, 19 nt, Pseudomonas aeruginosa PA01
ggcaucaugccgagcauca

SEQ ID NO: 3495720 - RNA, 22 nt, Pseudomonas aeruginosa PA01
ggcaucaugccgagcaucagcg

SEQ ID NO: 3495721 - RNA, 14 nt, Pseudomonas aeruginosa PA01
ggcauccagcaccg

SEQ ID NO: 3495722 - RNA, 23 nt, Pseudomonas aeruginosa PA01
ggcauccagcauccgugcgaaca

SEQ ID NO: 3495723 - RNA, 15 nt, Pseudomonas aeruginosa PA01
ggcauccagcggacg

SEQ ID NO: 3495724 - RNA, 20 nt, Pseudomonas aeruginosa PA01
ggcauccaguuccugcacca

SEQ ID NO: 3495725 - RNA, 14 nt, Pseudomonas aeruginosa PA01
ggcauccaguucgu

SEQ ID NO: 3495726 - RNA, 15 nt, Pseudomonas aeruginosa PA01
ggcauccccggacca

SEQ ID NO: 3495727 - RNA, 21 nt, Pseudomonas aeruginosa PA01
ggcauccccuuuuuucagccu

SEQ ID NO: 3495728 - RNA, 22 nt, Pseudomonas aeruginosa PA01
ggcauccccuuuuuucagccug

SEQ ID NO: 3495729 - RNA, 12 nt, Pseudomonas aeruginosa PA01
ggcaucccgccc

SEQ ID NO: 3495730 - RNA, 14 nt, Pseudomonas aeruginosa PA01
ggcauccgccgcug

SEQ ID NO: 3495731 - RNA, 15 nt, Pseudomonas aeruginosa PA01
ggcauccggcaggcg

SEQ ID NO: 3495732 - RNA, 18 nt, Pseudomonas aeruginosa PA01
ggcauccucgccccgccg

SEQ ID NO: 3495733 - RNA, 18 nt, Pseudomonas aeruginosa PA01
ggacuccggaggcgcaca

SEQ ID NO: 3495734 - RNA, 22 nt, Pseudomonas aeruginosa PA01
ggacucgcuaucaggcaucccc

SEQ ID NO: 3495735 - RNA, 16 nt, Pseudomonas aeruginosa PA01
ggacugcccagcgccg

SEQ ID NO: 3495736 - RNA, 20 nt, Pseudomonas aeruginosa PA01
ggacugcccagcgccgccag

SEQ ID NO: 3495737 - RNA, 21 nt, Pseudomonas aeruginosa PA01
ggacugcccagcgccgccagc

SEQ ID NO: 3495738 - RNA, 18 nt, Pseudomonas aeruginosa PA01
ggacugcccgcgucccau

SEQ ID NO: 3495739 - RNA, 18 nt, Pseudomonas aeruginosa PA01
ggacugcgaggcggugca

SEQ ID NO: 3495740 - RNA, 22 nt, Pseudomonas aeruginosa PA01
ggacugcucgccgccggcgagg

SEQ ID NO: 3495741 - RNA, 18 nt, Pseudomonas aeruginosa PA01
ggacugguaggacagggc

SEQ ID NO: 3495742 - RNA, 21 nt, Pseudomonas aeruginosa PA01
ggacugguaggacagggccag

SEQ ID NO: 3495743 - RNA, 20 nt, Pseudomonas aeruginosa PA01
ggacuuggagaagaucgccg

SEQ ID NO: 3495744 - RNA, 15 nt, Pseudomonas aeruginosa PA01
ggacuuucgaugguu

SEQ ID NO: 3495745 - RNA, 15 nt, Pseudomonas aeruginosa PA01
ggagaaacucgcggg

SEQ ID NO: 3495746 - RNA, 19 nt, Pseudomonas aeruginosa PA01
ggagaaacucgcgggcgcg

SEQ ID NO: 3495747 - RNA, 14 nt, Pseudomonas aeruginosa PA01
ggagaacagcagcg

SEQ ID NO: 3495748 - RNA, 22 nt, Pseudomonas aeruginosa PA01
ggagaacagcagcggcaccagc

SEQ ID NO: 3495749 - RNA, 17 nt, Pseudomonas aeruginosa PA01
ggagaacagcaggguca

SEQ ID NO: 3495750 - RNA, 21 nt, Pseudomonas aeruginosa PA01
ggagaacagcagggucagggu

SEQ ID NO: 3495751 - RNA, 15 nt, Pseudomonas aeruginosa PA01
ggagaaccaggcggu

SEQ ID NO: 3495752 - RNA, 17 nt, Pseudomonas aeruginosa PA01
ggagaaccaggcggugu

SEQ ID NO: 3495753 - RNA, 14 nt, Pseudomonas aeruginosa PA01
ggagaacgccgcca

SEQ ID NO: 3495754 - RNA, 16 nt, Pseudomonas aeruginosa PA01
ggagaacuuuucccag

SEQ ID NO: 3495755 - RNA, 17 nt, Pseudomonas aeruginosa PA01
ggagaacuuuucccagc

SEQ ID NO: 3495756 - RNA, 21 nt, Pseudomonas aeruginosa PA01
ggagaacuuuucccagcggcu

SEQ ID NO: 3495757 - RNA, 21 nt, Pseudomonas aeruginosa PA01
ggagaagcgccucgccuucgu

SEQ ID NO: 3495758 - RNA, 13 nt, Pseudomonas aeruginosa PA01
ggagaagggcgcg

SEQ ID NO: 3495759 - RNA, 23 nt, Pseudomonas aeruginosa PA01
ggagaaguagucauugcgcugug

SEQ ID NO: 3495760 - RNA, 22 nt, Pseudomonas aeruginosa PA01
ggagacaggaaucgacccagcc

SEQ ID NO: 3495761 - RNA, 15 nt, Pseudomonas aeruginosa PA01
ggagaccgugccgcc

SEQ ID NO: 3495762 - RNA, 16 nt, Pseudomonas aeruginosa PA01
ggagacucagcgcgac

SEQ ID NO: 3495763 - RNA, 19 nt, Pseudomonas aeruginosa PA01
ggagacucagcgcgacagg

SEQ ID NO: 3495764 - RNA, 16 nt, Pseudomonas aeruginosa PA01
ggagagacccgccagc

SEQ ID NO: 3495765 - RNA, 17 nt, Pseudomonas aeruginosa PA01
ggagagacccgccagcg

SEQ ID NO: 3495766 - RNA, 23 nt, Pseudomonas aeruginosa PA01
ggagagauagagcuucucgucgc

SEQ ID NO: 3495767 - RNA, 16 nt, Pseudomonas aeruginosa PA01
ggagagauagucgccg

SEQ ID NO: 3495768 - RNA, 15 nt, Pseudomonas aeruginosa PA01
ggagagcagcacggc

SEQ ID NO: 3495769 - RNA, 14 nt, Pseudomonas aeruginosa PA01
ggagagcccgggcg

SEQ ID NO: 3495770 - RNA, 16 nt, Pseudomonas aeruginosa PA01
ggagagcccgggcgca

SEQ ID NO: 3495771 - RNA, 21 nt, Pseudomonas aeruginosa PA01
ggagagcgaauacaccgagcg

SEQ ID NO: 3495772 - RNA, 12 nt, Pseudomonas aeruginosa PA01
ggagagcgccgu

SEQ ID NO: 3495773 - RNA, 15 nt, Pseudomonas aeruginosa PA01
ggagaggaucagcga

SEQ ID NO: 3495774 - RNA, 17 nt, Pseudomonas aeruginosa PA01
ggagagggcggcgaccg

SEQ ID NO: 3495775 - RNA, 21 nt, Pseudomonas aeruginosa PA01
ggagaggggcuacuucgccgg

SEQ ID NO: 3495776 - RNA, 16 nt, Pseudomonas aeruginosa PA01
ggagauagccuccucc

SEQ ID NO: 3495777 - RNA, 14 nt, Pseudomonas aeruginosa PA01
ggagaucagcggac

SEQ ID NO: 3495778 - RNA, 16 nt, Pseudomonas aeruginosa PA01
ggagaucagcggaccg

SEQ ID NO: 3495779 - RNA, 16 nt, Pseudomonas aeruginosa PA01
ggagaucgccgcgccg

SEQ ID NO: 3495780 - RNA, 16 nt, Pseudomonas aeruginosa PA01
ggagaugcagcgucgc

SEQ ID NO: 3495781 - RNA, 13 nt, Pseudomonas aeruginosa PA01
ggagaugcucagg

SEQ ID NO: 3495782 - RNA, 18 nt, Pseudomonas aeruginosa PA01
ggagaugcucaggcgcug

SEQ ID NO: 3495783 - RNA, 20 nt, Pseudomonas aeruginosa PA01
ggagaugcucaggcgcugcu

SEQ ID NO: 3495784 - RNA, 16 nt, Pseudomonas aeruginosa PA01
ggagauguccaucagc

SEQ ID NO: 3495785 - RNA, 14 nt, Pseudomonas aeruginosa PA01
ggagcaacagcguc

SEQ ID NO: 3495786 - RNA, 18 nt, Pseudomonas aeruginosa PA01
ggagcaccgcgccuucca

SEQ ID NO: 3495787 - RNA, 15 nt, Pseudomonas aeruginosa PA01
ggagcacgccgugca

SEQ ID NO: 3495788 - RNA, 17 nt, Pseudomonas aeruginosa PA01
ggagcacgccgugcagg

SEQ ID NO: 3495789 - RNA, 23 nt, Pseudomonas aeruginosa PA01
ggagcacgccgugcagggucagg

SEQ ID NO: 3495790 - RNA, 16 nt, Pseudomonas aeruginosa PA01
ggagcagaaccgccag

SEQ ID NO: 3495791 - RNA, 15 nt, Pseudomonas aeruginosa PA01
ggagcagcagcgccg

SEQ ID NO: 3495792 - RNA, 14 nt, Pseudomonas aeruginosa PA01
ggagcaggccaugg

SEQ ID NO: 3495793 - RNA, 16 nt, Pseudomonas aeruginosa PA01
ggagcaggccaugggu

SEQ ID NO: 3495794 - RNA, 14 nt, Pseudomonas aeruginosa PA01
ggagcagggcgccg

SEQ ID NO: 3495795 - RNA, 15 nt, Pseudomonas aeruginosa PA01
ggagcaucggcgcgg

SEQ ID NO: 3495796 - RNA, 20 nt, Pseudomonas aeruginosa PA01
ggagcaucggcgcggccuuc

SEQ ID NO: 3495797 - RNA, 14 nt, Pseudomonas aeruginosa PA01
ggagcaugucuucg

SEQ ID NO: 3495798 - RNA, 14 nt, Pseudomonas aeruginosa PA01
ggagccaacgcccg

SEQ ID NO: 3495799 - RNA, 18 nt, Pseudomonas aeruginosa PA01
ggagccaacgcccgggcc

SEQ ID NO: 3495800 - RNA, 16 nt, Pseudomonas aeruginosa PA01
ggagccaggcggcucc

SEQ ID NO: 3495801 - RNA, 16 nt, Pseudomonas aeruginosa PA01
ggagccaucgcuccag

SEQ ID NO: 3495802 - RNA, 12 nt, Pseudomonas aeruginosa PA01
ggagccgccgga

SEQ ID NO: 3495803 - RNA, 19 nt, Pseudomonas aeruginosa PA01
ggagccggauagaucaggc

SEQ ID NO: 3495804 - RNA, 13 nt, Pseudomonas aeruginosa PA01
ggagccggccagg

SEQ ID NO: 3495805 - RNA, 19 nt, Pseudomonas aeruginosa PA01
ggagccggugccggcggcg

SEQ ID NO: 3495806 - RNA, 14 nt, Pseudomonas aeruginosa PA01
ggagccgucgccgg

SEQ ID NO: 3495807 - RNA, 15 nt, Pseudomonas aeruginosa PA01
ggagccgucggcucc

SEQ ID NO: 3495808 - RNA, 20 nt, Pseudomonas aeruginosa PA01
ggagcgaaacgccccgucga

SEQ ID NO: 3495809 - RNA, 12 nt, Pseudomonas aeruginosa PA01
ggagcgccagca

SEQ ID NO: 3495810 - RNA, 14 nt, Pseudomonas aeruginosa PA01
ggagcgccaucagc

SEQ ID NO: 3495811 - RNA, 16 nt, Pseudomonas aeruginosa PA01
ggagcgccaucagcga

SEQ ID NO: 3495812 - RNA, 18 nt, Pseudomonas aeruginosa PA01
ggagcgccaucagcgacc

SEQ ID NO: 3495813 - RNA, 21 nt, Pseudomonas aeruginosa PA01
ggagcgccgcgcagcgcggcg

SEQ ID NO: 3495814 - RNA, 12 nt, Pseudomonas aeruginosa PA01
ggagcgccggcg

SEQ ID NO: 3495815 - RNA, 13 nt, Pseudomonas aeruginosa PA01
ggagcgccggcgc

SEQ ID NO: 3495816 - RNA, 24 nt, Pseudomonas aeruginosa PA01
ggagcgccucgaaggccucgguca

SEQ ID NO: 3495817 - RNA, 13 nt, Pseudomonas aeruginosa PA01
ggagcgccuggcg

SEQ ID NO: 3495818 - RNA, 16 nt, Pseudomonas aeruginosa PA01
ggagcgcgaaagcgcc

SEQ ID NO: 3495819 - RNA, 17 nt, Pseudomonas aeruginosa PA01
ggagcgcgaaagcgccc

SEQ ID NO: 3495820 - RNA, 22 nt, Pseudomonas aeruginosa PA01
ggagcgcgacuuggacagcguc

SEQ ID NO: 3495821 - RNA, 12 nt, Pseudomonas aeruginosa PA01
ggagcgcgagcg

SEQ ID NO: 3495822 - RNA, 15 nt, Pseudomonas aeruginosa PA01
ggagcgcgaggcgca

SEQ ID NO: 3495823 - RNA, 14 nt, Pseudomonas aeruginosa PA01
ggagcggccgugca

SEQ ID NO: 3495824 - RNA, 15 nt, Pseudomonas aeruginosa PA01
ggagcggccgugcau

SEQ ID NO: 3495825 - RNA, 15 nt, Pseudomonas aeruginosa PA01
ggagcguccaccagc

SEQ ID NO: 3495826 - RNA, 18 nt, Pseudomonas aeruginosa PA01
ggagcguccaccagcgcc

SEQ ID NO: 3495827 - RNA, 16 nt, Pseudomonas aeruginosa PA01
ggagcguugcgggcag

SEQ ID NO: 3495828 - RNA, 23 nt, Pseudomonas aeruginosa PA01
ggagcuggaaauggcggucgccg

SEQ ID NO: 3495829 - RNA, 14 nt, Pseudomonas aeruginosa PA01
ggagcuugccggcg

SEQ ID NO: 3495830 - RNA, 13 nt, Pseudomonas aeruginosa PA01
ggagcuuugcagg

SEQ ID NO: 3495831 - RNA, 13 nt, Pseudomonas aeruginosa PA01
ggaggacgaugga

SEQ ID NO: 3495832 - RNA, 22 nt, Pseudomonas aeruginosa PA01
ggaggaucgagccuugcggcgc

SEQ ID NO: 3495833 - RNA, 19 nt, Pseudomonas aeruginosa PA01
ggaggaucgccaggacgcu

SEQ ID NO: 3495834 - RNA, 17 nt, Pseudomonas aeruginosa PA01
ggaggaucuccaacugg

SEQ ID NO: 3495835 - RNA, 16 nt, Pseudomonas aeruginosa PA01
ggaggaugccgaucac

SEQ ID NO: 3495836 - RNA, 14 nt, Pseudomonas aeruginosa PA01
ggaggauucgccag

SEQ ID NO: 3495837 - RNA, 13 nt, Pseudomonas aeruginosa PA01
ggaccuccgccag

SEQ ID NO: 3495838 - RNA, 14 nt, Pseudomonas aeruginosa PA01
ggaccuccgccagg

SEQ ID NO: 3495839 - RNA, 15 nt, Pseudomonas aeruginosa PA01
ggaccuccgccagga

SEQ ID NO: 3495840 - RNA, 18 nt, Pseudomonas aeruginosa PA01
ggaccuccgccaggaccu

SEQ ID NO: 3495841 - RNA, 12 nt, Pseudomonas aeruginosa PA01
ggaccuccugca

SEQ ID NO: 3495842 - RNA, 23 nt, Pseudomonas aeruginosa PA01
ggaccuccuggcgcgucggccgc

SEQ ID NO: 3495843 - RNA, 18 nt, Pseudomonas aeruginosa PA01
ggaccucgaagcuggcca

SEQ ID NO: 3495844 - RNA, 13 nt, Pseudomonas aeruginosa PA01
ggaccucgggcga

SEQ ID NO: 3495845 - RNA, 20 nt, Pseudomonas aeruginosa PA01
ggaccucggguuuggcgccc

SEQ ID NO: 3495846 - RNA, 22 nt, Pseudomonas aeruginosa PA01
ggaccucggguuuggcgcccgc

SEQ ID NO: 3495847 - RNA, 17 nt, Pseudomonas aeruginosa PA01
ggaccucucucgcugcg

SEQ ID NO: 3495848 - RNA, 19 nt, Pseudomonas aeruginosa PA01
ggaccugagaucagcgccc

SEQ ID NO: 3495849 - RNA, 16 nt, Pseudomonas aeruginosa PA01
ggaccugcugcccggc

SEQ ID NO: 3495850 - RNA, 17 nt, Pseudomonas aeruginosa PA01
ggaccugcugcccggca

SEQ ID NO: 3495851 - RNA, 18 nt, Pseudomonas aeruginosa PA01
ggaccugcugcccggcau

SEQ ID NO: 3495852 - RNA, 15 nt, Pseudomonas aeruginosa PA01
ggaccuggccggcga

SEQ ID NO: 3495853 - RNA, 20 nt, Pseudomonas aeruginosa PA01
ggaccuggcugaggcguucc

SEQ ID NO: 3495854 - RNA, 22 nt, Pseudomonas aeruginosa PA01
ggaccuggcugaggcguuccag

SEQ ID NO: 3495855 - RNA, 20 nt, Pseudomonas aeruginosa PA01
ggaccugucggcucgcgccg

SEQ ID NO: 3495856 - RNA, 23 nt, Pseudomonas aeruginosa PA01
ggaccugucggcucgcgccggcg

SEQ ID NO: 3495857 - RNA, 16 nt, Pseudomonas aeruginosa PA01
ggaccuuccgccagca

SEQ ID NO: 3495858 - RNA, 19 nt, Pseudomonas aeruginosa PA01
ggaccuuccgccagcaggc

SEQ ID NO: 3495859 - RNA, 19 nt, Pseudomonas aeruginosa PA01
ggaccuugccccaggugcu

SEQ ID NO: 3495860 - RNA, 23 nt, Pseudomonas aeruginosa PA01
ggacgacaucucguccucgggga

SEQ ID NO: 3495861 - RNA, 17 nt, Pseudomonas aeruginosa PA01
ggacgacgaaagaagcc

SEQ ID NO: 3495862 - RNA, 19 nt, Pseudomonas aeruginosa PA01
ggacgacgaagugaccgcg

SEQ ID NO: 3495863 - RNA, 20 nt, Pseudomonas aeruginosa PA01
ggacgacgaagugaccgcgc

SEQ ID NO: 3495864 - RNA, 15 nt, Pseudomonas aeruginosa PA01
ggacgacgcuggccu

SEQ ID NO: 3495865 - RNA, 17 nt, Pseudomonas aeruginosa PA01
ggacgacgcuggccugc

SEQ ID NO: 3495866 - RNA, 20 nt, Pseudomonas aeruginosa PA01
ggacgacgcuggccugccga

SEQ ID NO: 3495867 - RNA, 17 nt, Pseudomonas aeruginosa PA01
ggacgagcguccgccgc

SEQ ID NO: 3495868 - RNA, 17 nt, Pseudomonas aeruginosa PA01
ggacgagcuuuccugcu

SEQ ID NO: 3495869 - RNA, 14 nt, Pseudomonas aeruginosa PA01
ggacgaggaaggcg

SEQ ID NO: 3495870 - RNA, 15 nt, Pseudomonas aeruginosa PA01
ggacgaggaaggcgc

SEQ ID NO: 3495871 - RNA, 18 nt, Pseudomonas aeruginosa PA01
ggacgaggaaggcgcgca

SEQ ID NO: 3495872 - RNA, 16 nt, Pseudomonas aeruginosa PA01
ggacgaggauggucag

SEQ ID NO: 3495873 - RNA, 18 nt, Pseudomonas aeruginosa PA01
ggacgaggauggucaggc

SEQ ID NO: 3495874 - RNA, 23 nt, Pseudomonas aeruginosa PA01
ggacgaggauggucaggccggcg

SEQ ID NO: 3495875 - RNA, 23 nt, Pseudomonas aeruginosa PA01
ggacgauauugguguagcugcag

SEQ ID NO: 3495876 - RNA, 21 nt, Pseudomonas aeruginosa PA01
ggacgaucacucccugcucgc

SEQ ID NO: 3495877 - RNA, 19 nt, Pseudomonas aeruginosa PA01
ggacgaugaucaccaggac

SEQ ID NO: 3495878 - RNA, 23 nt, Pseudomonas aeruginosa PA01
ggacgaugaucaccaggacccag

SEQ ID NO: 3495879 - RNA, 14 nt, Pseudomonas aeruginosa PA01
ggacgaugccgauc

SEQ ID NO: 3495880 - RNA, 15 nt, Pseudomonas aeruginosa PA01
ggacgaugccgaucu

SEQ ID NO: 3495881 - RNA, 14 nt, Pseudomonas aeruginosa PA01
ggacgauggaacgc

SEQ ID NO: 3495882 - RNA, 14 nt, Pseudomonas aeruginosa PA01
ggacgcaccagcag

SEQ ID NO: 3495883 - RNA, 17 nt, Pseudomonas aeruginosa PA01
ggacgcaccagcaggcc

SEQ ID NO: 3495884 - RNA, 18 nt, Pseudomonas aeruginosa PA01
ggacgcaccagcaggccg

SEQ ID NO: 3495885 - RNA, 15 nt, Pseudomonas aeruginosa PA01
ggacgcaggccgacc

SEQ ID NO: 3495886 - RNA, 15 nt, Pseudomonas aeruginosa PA01
ggacgccaccaggcc

SEQ ID NO: 3495887 - RNA, 16 nt, Pseudomonas aeruginosa PA01
ggacgccaccaggccg

SEQ ID NO: 3495888 - RNA, 18 nt, Pseudomonas aeruginosa PA01
ggacgccaccaggccgcu

SEQ ID NO: 3495889 - RNA, 19 nt, Pseudomonas aeruginosa PA01
ggacgccaccaggccgcug

SEQ ID NO: 3495890 - RNA, 22 nt, Pseudomonas aeruginosa PA01
ggacgccaccaggccgcugccg

SEQ ID NO: 3495891 - RNA, 13 nt, Pseudomonas aeruginosa PA01
ggacgccaggcgu

SEQ ID NO: 3495892 - RNA, 13 nt, Pseudomonas aeruginosa PA01
ggacgccgaacgc

SEQ ID NO: 3495893 - RNA, 14 nt, Pseudomonas aeruginosa PA01
ggacgccgaacgcc

SEQ ID NO: 3495894 - RNA, 17 nt, Pseudomonas aeruginosa PA01
ggacgccgaagcgggcu

SEQ ID NO: 3495895 - RNA, 14 nt, Pseudomonas aeruginosa PA01
ggacgccgggcugg

SEQ ID NO: 3495896 - RNA, 16 nt, Pseudomonas aeruginosa PA01
ggacgccguagcggcc

SEQ ID NO: 3495897 - RNA, 14 nt, Pseudomonas aeruginosa PA01
ggacgccucgucgg

SEQ ID NO: 3495898 - RNA, 16 nt, Pseudomonas aeruginosa PA01
ggacgcgcagcggcgc

SEQ ID NO: 3495899 - RNA, 18 nt, Pseudomonas aeruginosa PA01
ggacgcgcagggucaggc

SEQ ID NO: 3495900 - RNA, 21 nt, Pseudomonas aeruginosa PA01
ggacgcgcagggucaggcccu

SEQ ID NO: 3495901 - RNA, 18 nt, Pseudomonas aeruginosa PA01
ggacgcgcaugcagggcg

SEQ ID NO: 3495902 - RNA, 11 nt, Pseudomonas aeruginosa PA01
ggacgcgccgg

SEQ ID NO: 3495903 - RNA, 16 nt, Pseudomonas aeruginosa PA01
ggacgcggccugggcc

SEQ ID NO: 3495904 - RNA, 13 nt, Pseudomonas aeruginosa PA01
ggacgcggcgugg

SEQ ID NO: 3495905 - RNA, 15 nt, Pseudomonas aeruginosa PA01
ggacgcuccugcgcc

SEQ ID NO: 3495906 - RNA, 16 nt, Pseudomonas aeruginosa PA01
ggacgcuccugcgccg

SEQ ID NO: 3495907 - RNA, 19 nt, Pseudomonas aeruginosa PA01
ggacgcuccugcgccggcu

SEQ ID NO: 3495908 - RNA, 13 nt, Pseudomonas aeruginosa PA01
ggacgcuggcgau

SEQ ID NO: 3495909 - RNA, 22 nt, Pseudomonas aeruginosa PA01
ggacgcuggcgauaucgaaggc

SEQ ID NO: 3495910 - RNA, 14 nt, Pseudomonas aeruginosa PA01
ggacgcuggcgauc

SEQ ID NO: 3495911 - RNA, 16 nt, Pseudomonas aeruginosa PA01
ggacgcuggcgaucau

SEQ ID NO: 3495912 - RNA, 12 nt, Pseudomonas aeruginosa PA01
ggacgcuguccc

SEQ ID NO: 3495913 - RNA, 22 nt, Pseudomonas aeruginosa PA01
ggacgcuuguccuucggccagu

SEQ ID NO: 3495914 - RNA, 19 nt, Pseudomonas aeruginosa PA01
ggacggaagcauggccggc

SEQ ID NO: 3495915 - RNA, 20 nt, Pseudomonas aeruginosa PA01
ggacggaagcauggccggcu

SEQ ID NO: 3495916 - RNA, 16 nt, Pseudomonas aeruginosa PA01
ggacggauaacggcag

SEQ ID NO: 3495917 - RNA, 20 nt, Pseudomonas aeruginosa PA01
ggacggauaacggcagccgc

SEQ ID NO: 3495918 - RNA, 17 nt, Pseudomonas aeruginosa PA01
ggacggcagggucagcc

SEQ ID NO: 3495919 - RNA, 23 nt, Pseudomonas aeruginosa PA01
ggacggcagggucagccgaugcu

SEQ ID NO: 3495920 - RNA, 17 nt, Pseudomonas aeruginosa PA01
ggacggccggcucggug

SEQ ID NO: 3495921 - RNA, 13 nt, Pseudomonas aeruginosa PA01
ggacggcggcugg

SEQ ID NO: 3495922 - RNA, 19 nt, Pseudomonas aeruginosa PA01
ggacggcucgcgcagcggc

SEQ ID NO: 3495923 - RNA, 12 nt, Pseudomonas aeruginosa PA01
ggacggguacug

SEQ ID NO: 3495924 - RNA, 16 nt, Pseudomonas aeruginosa PA01
ggacgggugcgcgcca

SEQ ID NO: 3495925 - RNA, 19 nt, Pseudomonas aeruginosa PA01
ggacgggugcgcgccaccu

SEQ ID NO: 3495926 - RNA, 22 nt, Pseudomonas aeruginosa PA01
ggacgggugcgcgccaccuggu

SEQ ID NO: 3495927 - RNA, 14 nt, Pseudomonas aeruginosa PA01
ggacggucucgccg

SEQ ID NO: 3495928 - RNA, 13 nt, Pseudomonas aeruginosa PA01
ggacggugcaggc

SEQ ID NO: 3495929 - RNA, 15 nt, Pseudomonas aeruginosa PA01
ggacggugcaggccg

SEQ ID NO: 3495930 - RNA, 17 nt, Pseudomonas aeruginosa PA01
ggacggugcaggccgac

SEQ ID NO: 3495931 - RNA, 17 nt, Pseudomonas aeruginosa PA01
ggacguccuggccgagc

SEQ ID NO: 3495932 - RNA, 13 nt, Pseudomonas aeruginosa PA01
ggacgucgacgag

SEQ ID NO: 3495933 - RNA, 15 nt, Pseudomonas aeruginosa PA01
ggacgugcaggauca

SEQ ID NO: 3495934 - RNA, 19 nt, Pseudomonas aeruginosa PA01
ggacguguaccuggguugc

SEQ ID NO: 3495935 - RNA, 16 nt, Pseudomonas aeruginosa PA01
ggacguuccaccuggc

SEQ ID NO: 3495936 - RNA, 17 nt, Pseudomonas aeruginosa PA01
ggacguuuccagcggcu

SEQ ID NO: 3495937 - RNA, 23 nt, Pseudomonas aeruginosa PA01
ggacuaccuucgaucacccgguc

SEQ ID NO: 3495938 - RNA, 13 nt, Pseudomonas aeruginosa PA01
ggacucccgcaga

SEQ ID NO: 3495939 - RNA, 15 nt, Pseudomonas aeruginosa PA01
ggacuccgacgcguc

SEQ ID NO: 3495940 - RNA, 14 nt, Pseudomonas aeruginosa PA01
ggacuccgcccagu

SEQ ID NO: 3495941 - RNA, 17 nt, Pseudomonas aeruginosa PA01
ggaggauucgccagccu

SEQ ID NO: 3495942 - RNA, 23 nt, Pseudomonas aeruginosa PA01
ggaggcacgaaccguccgcagcg

SEQ ID NO: 3495943 - RNA, 12 nt, Pseudomonas aeruginosa PA01
ggaggcccagau

SEQ ID NO: 3495944 - RNA, 14 nt, Pseudomonas aeruginosa PA01
ggaggccgccucga

SEQ ID NO: 3495945 - RNA, 13 nt, Pseudomonas aeruginosa PA01
ggaggccguggug

SEQ ID NO: 3495946 - RNA, 12 nt, Pseudomonas aeruginosa PA01
ggaggccuucgc

SEQ ID NO: 3495947 - RNA, 22 nt, Pseudomonas aeruginosa PA01
ggaggcgcaaaauguauaggag

SEQ ID NO: 3495948 - RNA, 16 nt, Pseudomonas aeruginosa PA01
ggaggcgccgcgccag

SEQ ID NO: 3495949 - RNA, 17 nt, Pseudomonas aeruginosa PA01
ggaggcgccgcgccagg

SEQ ID NO: 3495950 - RNA, 13 nt, Pseudomonas aeruginosa PA01
ggaggcgccgggu

SEQ ID NO: 3495951 - RNA, 13 nt, Pseudomonas aeruginosa PA01
ggaggcgcuggcc

SEQ ID NO: 3495952 - RNA, 16 nt, Pseudomonas aeruginosa PA01
ggaggcgcuggccagc

SEQ ID NO: 3495953 - RNA, 13 nt, Pseudomonas aeruginosa PA01
ggaggcggcgagc

SEQ ID NO: 3495954 - RNA, 22 nt, Pseudomonas aeruginosa PA01
ggagggaucgcgcggcuggcug

SEQ ID NO: 3495955 - RNA, 12 nt, Pseudomonas aeruginosa PA01
ggaggggcggcc

SEQ ID NO: 3495956 - RNA, 18 nt, Pseudomonas aeruginosa PA01
ggagggucaggccgaggg

SEQ ID NO: 3495957 - RNA, 16 nt, Pseudomonas aeruginosa PA01
ggagguagcugcgccg

SEQ ID NO: 3495958 - RNA, 17 nt, Pseudomonas aeruginosa PA01
ggagguagcugcgccgc

SEQ ID NO: 3495959 - RNA, 13 nt, Pseudomonas aeruginosa PA01
ggaggucgcacgc

SEQ ID NO: 3495960 - RNA, 15 nt, Pseudomonas aeruginosa PA01
ggaggugcggcggug

SEQ ID NO: 3495961 - RNA, 14 nt, Pseudomonas aeruginosa PA01
ggagguucggcagg

SEQ ID NO: 3495962 - RNA, 17 nt, Pseudomonas aeruginosa PA01
ggagguuggucugcucg

SEQ ID NO: 3495963 - RNA, 13 nt, Pseudomonas aeruginosa PA01
ggaguaccaggcc

SEQ ID NO: 3495964 - RNA, 15 nt, Pseudomonas aeruginosa PA01
ggaguaccaggccac

SEQ ID NO: 3495965 - RNA, 16 nt, Pseudomonas aeruginosa PA01
ggaguacuacccccuc

SEQ ID NO: 3495966 - RNA, 14 nt, Pseudomonas aeruginosa PA01
ggaguagccggcgg

SEQ ID NO: 3495967 - RNA, 18 nt, Pseudomonas aeruginosa PA01
ggagucaggcgccggccu

SEQ ID NO: 3495968 - RNA, 21 nt, Pseudomonas aeruginosa PA01
ggaguccaggcgggccagcug

SEQ ID NO: 3495969 - RNA, 13 nt, Pseudomonas aeruginosa PA01
ggaguccgccagc

SEQ ID NO: 3495970 - RNA, 22 nt, Pseudomonas aeruginosa PA01
ggagucguagcgcgcggcgagc

SEQ ID NO: 3495971 - RNA, 14 nt, Pseudomonas aeruginosa PA01
ggagucucgggaag

SEQ ID NO: 3495972 - RNA, 16 nt, Pseudomonas aeruginosa PA01
ggagugaggccgagcc

SEQ ID NO: 3495973 - RNA, 14 nt, Pseudomonas aeruginosa PA01
ggagugaugccgau

SEQ ID NO: 3495974 - RNA, 22 nt, Pseudomonas aeruginosa PA01
ggagugcucgaucagguaggcg

SEQ ID NO: 3495975 - RNA, 14 nt, Pseudomonas aeruginosa PA01
ggagugggccgcgu

SEQ ID NO: 3495976 - RNA, 21 nt, Pseudomonas aeruginosa PA01
ggaguucgaaucucucuaccc

SEQ ID NO: 3495977 - RNA, 18 nt, Pseudomonas aeruginosa PA01
ggaguucgacccaugccg

SEQ ID NO: 3495978 - RNA, 23 nt, Pseudomonas aeruginosa PA01
ggaguuucaucucggcgcaggca

SEQ ID NO: 3495979 - RNA, 13 nt, Pseudomonas aeruginosa PA01
ggauaaaauccac

SEQ ID NO: 3495980 - RNA, 12 nt, Pseudomonas aeruginosa PA01
ggauaacgccug

SEQ ID NO: 3495981 - RNA, 21 nt, Pseudomonas aeruginosa PA01
ggauaacgcuacccucagggg

SEQ ID NO: 3495982 - RNA, 17 nt, Pseudomonas aeruginosa PA01
ggauaacggcagccgcg

SEQ ID NO: 3495983 - RNA, 15 nt, Pseudomonas aeruginosa PA01
ggauacaccagguug

SEQ ID NO: 3495984 - RNA, 21 nt, Pseudomonas aeruginosa PA01
ggauacaccagguuggccagu

SEQ ID NO: 3495985 - RNA, 16 nt, Pseudomonas aeruginosa PA01
ggauacaggcgcagca

SEQ ID NO: 3495986 - RNA, 18 nt, Pseudomonas aeruginosa PA01
ggauacaggcgcagcagc

SEQ ID NO: 3495987 - RNA, 20 nt, Pseudomonas aeruginosa PA01
ggauaccacccgcagccccg

SEQ ID NO: 3495988 - RNA, 21 nt, Pseudomonas aeruginosa PA01
ggauaccacccgcagccccgc

SEQ ID NO: 3495989 - RNA, 21 nt, Pseudomonas aeruginosa PA01
ggauaccagaucaccaccacc

SEQ ID NO: 3495990 - RNA, 19 nt, Pseudomonas aeruginosa PA01
ggauaccgcacggccguca

SEQ ID NO: 3495991 - RNA, 20 nt, Pseudomonas aeruginosa PA01
ggauaccggccaucagcacc

SEQ ID NO: 3495992 - RNA, 14 nt, Pseudomonas aeruginosa PA01
ggauacggcagggu

SEQ ID NO: 3495993 - RNA, 21 nt, Pseudomonas aeruginosa PA01
ggauacggcaggguagccacg

SEQ ID NO: 3495994 - RNA, 16 nt, Pseudomonas aeruginosa PA01
ggauacucaugcaggc

SEQ ID NO: 3495995 - RNA, 19 nt, Pseudomonas aeruginosa PA01
ggauacucaugcaggcguc

SEQ ID NO: 3495996 - RNA, 19 nt, Pseudomonas aeruginosa PA01
ggauagaaaagcaaggagc

SEQ ID NO: 3495997 - RNA, 18 nt, Pseudomonas aeruginosa PA01
ggauagaucaggccggcg

SEQ ID NO: 3495998 - RNA, 11 nt, Pseudomonas aeruginosa PA01
ggauagcaccg

SEQ ID NO: 3495999 - RNA, 17 nt, Pseudomonas aeruginosa PA01
ggauauccagguucgcg

SEQ ID NO: 3496000 - RNA, 17 nt, Pseudomonas aeruginosa PA01
ggauaucgcccagggcc

SEQ ID NO: 3496001 - RNA, 22 nt, Pseudomonas aeruginosa PA01
ggauaucgcccagggccagcgg

SEQ ID NO: 3496002 - RNA, 14 nt, Pseudomonas aeruginosa PA01
ggauaucgcgccgc

SEQ ID NO: 3496003 - RNA, 15 nt, Pseudomonas aeruginosa PA01
ggauaucugggccau

SEQ ID NO: 3496004 - RNA, 13 nt, Pseudomonas aeruginosa PA01
ggauaugcgccgc

SEQ ID NO: 3496005 - RNA, 15 nt, Pseudomonas aeruginosa PA01
ggauaugcgccgcca

SEQ ID NO: 3496006 - RNA, 23 nt, Pseudomonas aeruginosa PA01
ggauaugcgccgccacgugcacg

SEQ ID NO: 3496007 - RNA, 21 nt, Pseudomonas aeruginosa PA01
ggaucaacuccgccaggcgcu

SEQ ID NO: 3496008 - RNA, 22 nt, Pseudomonas aeruginosa PA01
ggaucaacuccgccaggcgcuc

SEQ ID NO: 3496009 - RNA, 17 nt, Pseudomonas aeruginosa PA01
ggaucacaggcucuucu

SEQ ID NO: 3496010 - RNA, 21 nt, Pseudomonas aeruginosa PA01
ggaucaccagggucggcaccu

SEQ ID NO: 3496011 - RNA, 22 nt, Pseudomonas aeruginosa PA01
ggaucaccagggucggcaccug

SEQ ID NO: 3496012 - RNA, 19 nt, Pseudomonas aeruginosa PA01
ggaucaccggaaccggggu

SEQ ID NO: 3496013 - RNA, 13 nt, Pseudomonas aeruginosa PA01
ggaucaccggcug

SEQ ID NO: 3496014 - RNA, 20 nt, Pseudomonas aeruginosa PA01
ggaucaccggcuggcccucc

SEQ ID NO: 3496015 - RNA, 13 nt, Pseudomonas aeruginosa PA01
ggaucaccggggu

SEQ ID NO: 3496016 - RNA, 17 nt, Pseudomonas aeruginosa PA01
ggaucacgauggccggc

SEQ ID NO: 3496017 - RNA, 18 nt, Pseudomonas aeruginosa PA01
ggaucacgcagcaggcga

SEQ ID NO: 3496018 - RNA, 20 nt, Pseudomonas aeruginosa PA01
ggaucacgcagcaggcgacg

SEQ ID NO: 3496019 - RNA, 16 nt, Pseudomonas aeruginosa PA01
ggaucacucgccgccg

SEQ ID NO: 3496020 - RNA, 23 nt, Pseudomonas aeruginosa PA01
ggaucagccacgggcgccagcgg

SEQ ID NO: 3496021 - RNA, 24 nt, Pseudomonas aeruginosa PA01
ggaucagccacgggcgccagcggu

SEQ ID NO: 3496022 - RNA, 18 nt, Pseudomonas aeruginosa PA01
ggaucagccagccggcga

SEQ ID NO: 3496023 - RNA, 13 nt, Pseudomonas aeruginosa PA01
ggaucagcgccuc

SEQ ID NO: 3496024 - RNA, 17 nt, Pseudomonas aeruginosa PA01
ggaucagcggcggggcc

SEQ ID NO: 3496025 - RNA, 20 nt, Pseudomonas aeruginosa PA01
ggaucaggaagguccaggcc

SEQ ID NO: 3496026 - RNA, 20 nt, Pseudomonas aeruginosa PA01
ggaucaggcgggcuccgccg

SEQ ID NO: 3496027 - RNA, 22 nt, Pseudomonas aeruginosa PA01
ggaucaggcgggcuccgccgcc

SEQ ID NO: 3496028 - RNA, 23 nt, Pseudomonas aeruginosa PA01
ggaucaggcugggguugcggcgc

SEQ ID NO: 3496029 - RNA, 16 nt, Pseudomonas aeruginosa PA01
ggaucaggucgccagc

SEQ ID NO: 3496030 - RNA, 19 nt, Pseudomonas aeruginosa PA01
ggaucaggucgccagcgcc

SEQ ID NO: 3496031 - RNA, 22 nt, Pseudomonas aeruginosa PA01
ggaucaggucgccgcugaauac

SEQ ID NO: 3496032 - RNA, 19 nt, Pseudomonas aeruginosa PA01
ggaucagguugaagagcag

SEQ ID NO: 3496033 - RNA, 18 nt, Pseudomonas aeruginosa PA01
ggaucagucaggaucggc

SEQ ID NO: 3496034 - RNA, 19 nt, Pseudomonas aeruginosa PA01
ggaucagucccuugaucag

SEQ ID NO: 3496035 - RNA, 22 nt, Pseudomonas aeruginosa PA01
ggaucaguucgugccaggcgac

SEQ ID NO: 3496036 - RNA, 15 nt, Pseudomonas aeruginosa PA01
ggaucaucugaccuu

SEQ ID NO: 3496037 - RNA, 11 nt, Pseudomonas aeruginosa PA01
ggauccaggug

SEQ ID NO: 3496038 - RNA, 18 nt, Pseudomonas aeruginosa PA01
ggauccaggugcgcggca

SEQ ID NO: 3496039 - RNA, 19 nt, Pseudomonas aeruginosa PA01
ggaucccguguaccacgcc

SEQ ID NO: 3496040 - RNA, 12 nt, Pseudomonas aeruginosa PA01
ggauccggacug

SEQ ID NO: 3496041 - RNA, 15 nt, Pseudomonas aeruginosa PA01
ggauccgugccaggc

SEQ ID NO: 3496042 - RNA, 18 nt, Pseudomonas aeruginosa PA01
ggauccgugccaggcgcu

SEQ ID NO: 3496043 - RNA, 20 nt, Pseudomonas aeruginosa PA01
ggauccugcucagcggccca

SEQ ID NO: 3496044 - RNA, 22 nt, Pseudomonas aeruginosa PA01
ggauccugcucagcggcccagc

SEQ ID NO: 3496045 - RNA, 23 nt, Pseudomonas aeruginosa PA01
ggauccuggaagaauggcguggc

SEQ ID NO: 3496046 - RNA, 17 nt, Pseudomonas aeruginosa PA01
ggaucgaacuggccagc

SEQ ID NO: 3496047 - RNA, 14 nt, Pseudomonas aeruginosa PA01
ggaucgacagcagc

SEQ ID NO: 3496048 - RNA, 17 nt, Pseudomonas aeruginosa PA01
ggaucgacagcagcgcc

SEQ ID NO: 3496049 - RNA, 18 nt, Pseudomonas aeruginosa PA01
ggaucgacagcagcgcca

SEQ ID NO: 3496050 - RNA, 19 nt, Pseudomonas aeruginosa PA01
ggaucgacagcagcgccag

SEQ ID NO: 3496051 - RNA, 22 nt, Pseudomonas aeruginosa PA01
ggaucgacagcagcgccagggc

SEQ ID NO: 3496052 - RNA, 21 nt, Pseudomonas aeruginosa PA01
ggaucgacgccgcuggcggcg

SEQ ID NO: 3496053 - RNA, 19 nt, Pseudomonas aeruginosa PA01
ggaucgagcagcggcgcca

SEQ ID NO: 3496054 - RNA, 17 nt, Pseudomonas aeruginosa PA01
ggaucgagcccuggucg

SEQ ID NO: 3496055 - RNA, 19 nt, Pseudomonas aeruginosa PA01
ggaucgaguaagugccgac

SEQ ID NO: 3496056 - RNA, 16 nt, Pseudomonas aeruginosa PA01
ggaucgaucagcagca

SEQ ID NO: 3496057 - RNA, 23 nt, Pseudomonas aeruginosa PA01
ggaucgaucagcgagcuucgccg

SEQ ID NO: 3496058 - RNA, 19 nt, Pseudomonas aeruginosa PA01
ggaucgaucucgucggcgg

SEQ ID NO: 3496059 - RNA, 17 nt, Pseudomonas aeruginosa PA01
ggaucgccacgccggcg

SEQ ID NO: 3496060 - RNA, 19 nt, Pseudomonas aeruginosa PA01
ggaucgccacgccggcgcu

SEQ ID NO: 3496061 - RNA, 15 nt, Pseudomonas aeruginosa PA01
ggaucgccagcaauu

SEQ ID NO: 3496062 - RNA, 23 nt, Pseudomonas aeruginosa PA01
ggaucgccagcaauugccgcugc

SEQ ID NO: 3496063 - RNA, 16 nt, Pseudomonas aeruginosa PA01
ggaucgccaggacgcu

SEQ ID NO: 3496064 - RNA, 23 nt, Pseudomonas aeruginosa PA01
ggaucgccauaggaugccgaggu

SEQ ID NO: 3496065 - RNA, 15 nt, Pseudomonas aeruginosa PA01
ggaucgcccggcgcu

SEQ ID NO: 3496066 - RNA, 18 nt, Pseudomonas aeruginosa PA01
ggaucgcccuggcgccag

SEQ ID NO: 3496067 - RNA, 20 nt, Pseudomonas aeruginosa PA01
ggaucgccuccaccagcgcc

SEQ ID NO: 3496068 - RNA, 15 nt, Pseudomonas aeruginosa PA01
ggaucgcgcaaugcc

SEQ ID NO: 3496069 - RNA, 22 nt, Pseudomonas aeruginosa PA01
ggaucgcgcaaugccgcgucga

SEQ ID NO: 3496070 - RNA, 15 nt, Pseudomonas aeruginosa PA01
ggaucgcgcggcugg

SEQ ID NO: 3496071 - RNA, 16 nt, Pseudomonas aeruginosa PA01
ggaucgcgcggcuggc

SEQ ID NO: 3496072 - RNA, 20 nt, Pseudomonas aeruginosa PA01
ggaucgcgcggcuggcugcc

SEQ ID NO: 3496073 - RNA, 15 nt, Pseudomonas aeruginosa PA01
ggaucgcgcuggcca

SEQ ID NO: 3496074 - RNA, 17 nt, Pseudomonas aeruginosa PA01
ggaucgcgcugggcgca

SEQ ID NO: 3496075 - RNA, 19 nt, Pseudomonas aeruginosa PA01
ggaucgcgcugggcgcagc

SEQ ID NO: 3496076 - RNA, 12 nt, Pseudomonas aeruginosa PA01
ggaucgcggccu

SEQ ID NO: 3496077 - RNA, 20 nt, Pseudomonas aeruginosa PA01
ggaucgcggccuucucgucg

SEQ ID NO: 3496078 - RNA, 21 nt, Pseudomonas aeruginosa PA01
ggaucgcggccuucucgucgc

SEQ ID NO: 3496079 - RNA, 21 nt, Pseudomonas aeruginosa PA01
ggaucgcggcguaggcgcgcc

SEQ ID NO: 3496080 - RNA, 23 nt, Pseudomonas aeruginosa PA01
ggaucgcggcguaggcgcgccaa

SEQ ID NO: 3496081 - RNA, 19 nt, Pseudomonas aeruginosa PA01
ggaucgcgucgcaggcgau

SEQ ID NO: 3496082 - RNA, 13 nt, Pseudomonas aeruginosa PA01
ggaucgcugagca

SEQ ID NO: 3496083 - RNA, 19 nt, Pseudomonas aeruginosa PA01
ggaucgcugagcaucuggg

SEQ ID NO: 3496084 - RNA, 13 nt, Pseudomonas aeruginosa PA01
ggaucggauagcc

SEQ ID NO: 3496085 - RNA, 14 nt, Pseudomonas aeruginosa PA01
ggaucggcaggcug

SEQ ID NO: 3496086 - RNA, 16 nt, Pseudomonas aeruginosa PA01
ggaucggcauggccac

SEQ ID NO: 3496087 - RNA, 14 nt, Pseudomonas aeruginosa PA01
ggaucggcccuucg

SEQ ID NO: 3496088 - RNA, 13 nt, Pseudomonas aeruginosa PA01
ggaucggcgauca

SEQ ID NO: 3496089 - RNA, 12 nt, Pseudomonas aeruginosa PA01
ggaucggcgccc

SEQ ID NO: 3496090 - RNA, 14 nt, Pseudomonas aeruginosa PA01
ggaucggcgcccag

SEQ ID NO: 3496091 - RNA, 18 nt, Pseudomonas aeruginosa PA01
ggaucggcgcccagcacc

SEQ ID NO: 3496092 - RNA, 13 nt, Pseudomonas aeruginosa PA01
ggaucggcgcggu

SEQ ID NO: 3496093 - RNA, 16 nt, Pseudomonas aeruginosa PA01
ggaucggcgcggucgg

SEQ ID NO: 3496094 - RNA, 19 nt, Pseudomonas aeruginosa PA01
ggaucggcggugccaugga

SEQ ID NO: 3496095 - RNA, 23 nt, Pseudomonas aeruginosa PA01
ggaucggggaagggacgucgcca

SEQ ID NO: 3496096 - RNA, 22 nt, Pseudomonas aeruginosa PA01
ggaucgucgaaagccucgacga

SEQ ID NO: 3496097 - RNA, 20 nt, Pseudomonas aeruginosa PA01
ggaucgucgaagcucggcgc

SEQ ID NO: 3496098 - RNA, 16 nt, Pseudomonas aeruginosa PA01
ggaucgucgccaagcc

SEQ ID NO: 3496099 - RNA, 19 nt, Pseudomonas aeruginosa PA01
ggaucgucgccaagcccgg

SEQ ID NO: 3496100 - RNA, 21 nt, Pseudomonas aeruginosa PA01
ggaucgucgccaagcccggcg

SEQ ID NO: 3496101 - RNA, 22 nt, Pseudomonas aeruginosa PA01
ggaucgucgccaagcccggcga

SEQ ID NO: 3496102 - RNA, 22 nt, Pseudomonas aeruginosa PA01
ggaucgucgcggcgcgagauga

SEQ ID NO: 3496103 - RNA, 18 nt, Pseudomonas aeruginosa PA01
ggaucuaaggggcggcuc

SEQ ID NO: 3496104 - RNA, 21 nt, Pseudomonas aeruginosa PA01
ggaucuccgaguccugcugcg

SEQ ID NO: 3496105 - RNA, 14 nt, Pseudomonas aeruginosa PA01
ggaucuccgcgcca

SEQ ID NO: 3496106 - RNA, 14 nt, Pseudomonas aeruginosa PA01
ggaucuccucggcc

SEQ ID NO: 3496107 - RNA, 18 nt, Pseudomonas aeruginosa PA01
ggaucuccucggccaacg

SEQ ID NO: 3496108 - RNA, 17 nt, Pseudomonas aeruginosa PA01
ggaucuccuggcgcguc

SEQ ID NO: 3496109 - RNA, 15 nt, Pseudomonas aeruginosa PA01
ggaucuccugggucg

SEQ ID NO: 3496110 - RNA, 16 nt, Pseudomonas aeruginosa PA01
ggaucuccugggucga

SEQ ID NO: 3496111 - RNA, 14 nt, Pseudomonas aeruginosa PA01
ggaucucgccacug

SEQ ID NO: 3496112 - RNA, 22 nt, Pseudomonas aeruginosa PA01
ggaucucggcggccaggcggcu

SEQ ID NO: 3496113 - RNA, 14 nt, Pseudomonas aeruginosa PA01
ggaucucgucgccg

SEQ ID NO: 3496114 - RNA, 14 nt, Pseudomonas aeruginosa PA01
ggaucugcucgacg

SEQ ID NO: 3496115 - RNA, 19 nt, Pseudomonas aeruginosa PA01
ggaucugcugcaacauggc

SEQ ID NO: 3496116 - RNA, 22 nt, Pseudomonas aeruginosa PA01
ggaucugcugcaacauggcguc

SEQ ID NO: 3496117 - RNA, 16 nt, Pseudomonas aeruginosa PA01
ggaucuucuaccuggc

SEQ ID NO: 3496118 - RNA, 17 nt, Pseudomonas aeruginosa PA01
ggaucuucuaccuggcg

SEQ ID NO: 3496119 - RNA, 21 nt, Pseudomonas aeruginosa PA01
ggaucuucuaccuggcgcuga

SEQ ID NO: 3496120 - RNA, 17 nt, Pseudomonas aeruginosa PA01
ggaucuugcgcccggcg

SEQ ID NO: 3496121 - RNA, 21 nt, Pseudomonas aeruginosa PA01
ggaucuugcgcccggcgcgac

SEQ ID NO: 3496122 - RNA, 22 nt, Pseudomonas aeruginosa PA01
ggaucuugcgcccggcgcgacc

SEQ ID NO: 3496123 - RNA, 18 nt, Pseudomonas aeruginosa PA01
ggaugaacgacuccagcu

SEQ ID NO: 3496124 - RNA, 17 nt, Pseudomonas aeruginosa PA01
ggaugaacugcagcuug

SEQ ID NO: 3496125 - RNA, 16 nt, Pseudomonas aeruginosa PA01
ggaugaccaggcugau

SEQ ID NO: 3496126 - RNA, 15 nt, Pseudomonas aeruginosa PA01
ggaugacccgcaccu

SEQ ID NO: 3496127 - RNA, 20 nt, Pseudomonas aeruginosa PA01
ggaugagccgcugguccagc

SEQ ID NO: 3496128 - RNA, 19 nt, Pseudomonas aeruginosa PA01
ggaugaucagggcaccgcc

SEQ ID NO: 3496129 - RNA, 20 nt, Pseudomonas aeruginosa PA01
ggaugaucagggcaccgccg

SEQ ID NO: 3496130 - RNA, 21 nt, Pseudomonas aeruginosa PA01
ggaugaucagggcaccgccga

SEQ ID NO: 3496131 - RNA, 18 nt, Pseudomonas aeruginosa PA01
ggaugaucgcgugggcca

SEQ ID NO: 3496132 - RNA, 20 nt, Pseudomonas aeruginosa PA01
ggaugaucggcuccagcuug

SEQ ID NO: 3496133 - RNA, 23 nt, Pseudomonas aeruginosa PA01
ggaugaugacgagggacugaaga

SEQ ID NO: 3496134 - RNA, 13 nt, Pseudomonas aeruginosa PA01
ggaugcaaccgcc

SEQ ID NO: 3496135 - RNA, 18 nt, Pseudomonas aeruginosa PA01
ggaugcaaccgcccuggu

SEQ ID NO: 3496136 - RNA, 19 nt, Pseudomonas aeruginosa PA01
ggaugcacgugcagcucgg

SEQ ID NO: 3496137 - RNA, 18 nt, Pseudomonas aeruginosa PA01
ggaugcagauccagcggc

SEQ ID NO: 3496138 - RNA, 19 nt, Pseudomonas aeruginosa PA01
ggaugcagauccagcggca

SEQ ID NO: 3496139 - RNA, 20 nt, Pseudomonas aeruginosa PA01
ggaugcagauccagcggcag

SEQ ID NO: 3496140 - RNA, 13 nt, Pseudomonas aeruginosa PA01
ggaugcagccgau

SEQ ID NO: 3496141 - RNA, 12 nt, Pseudomonas aeruginosa PA01
ggaugcagccgg

SEQ ID NO: 3496142 - RNA, 15 nt, Pseudomonas aeruginosa PA01
ggaugcagucggcac

SEQ ID NO: 3496143 - RNA, 13 nt, Pseudomonas aeruginosa PA01
ggaugcaguucgu

SEQ ID NO: 3496144 - RNA, 23 nt, Pseudomonas aeruginosa PA01
ggaugccgaccacguaguaggcg

SEQ ID NO: 3496145 - RNA, 12 nt, Pseudomonas aeruginosa PA01
ggaugccgcaca

SEQ ID NO: 3496146 - RNA, 18 nt, Pseudomonas aeruginosa PA01
ggaugccgcacaggcugg

SEQ ID NO: 3496147 - RNA, 23 nt, Pseudomonas aeruginosa PA01
ggaugccgcacaggcuggccaga

SEQ ID NO: 3496148 - RNA, 12 nt, Pseudomonas aeruginosa PA01
ggaugccgccgg

SEQ ID NO: 3496149 - RNA, 14 nt, Pseudomonas aeruginosa PA01
ggaugccgccggca

SEQ ID NO: 3496150 - RNA, 15 nt, Pseudomonas aeruginosa PA01
ggaugccgccggcau

SEQ ID NO: 3496151 - RNA, 16 nt, Pseudomonas aeruginosa PA01
ggaugccgccggcauc

SEQ ID NO: 3496152 - RNA, 14 nt, Pseudomonas aeruginosa PA01
ggaugccggccucg

SEQ ID NO: 3496153 - RNA, 13 nt, Pseudomonas aeruginosa PA01
ggaugccggcgcu

SEQ ID NO: 3496154 - RNA, 13 nt, Pseudomonas aeruginosa PA01
ggaugccggcggc

SEQ ID NO: 3496155 - RNA, 14 nt, Pseudomonas aeruginosa PA01
ggaugccggcggca

SEQ ID NO: 3496156 - RNA, 21 nt, Pseudomonas aeruginosa PA01
ggaugccgggcgagucgauca

SEQ ID NO: 3496157 - RNA, 12 nt, Pseudomonas aeruginosa PA01
ggaugccggugc

SEQ ID NO: 3496158 - RNA, 18 nt, Pseudomonas aeruginosa PA01
ggaugccgguggcgccca

SEQ ID NO: 3496159 - RNA, 12 nt, Pseudomonas aeruginosa PA01
ggaugcgccagc

SEQ ID NO: 3496160 - RNA, 13 nt, Pseudomonas aeruginosa PA01
ggaugcgccagcg

SEQ ID NO: 3496161 - RNA, 14 nt, Pseudomonas aeruginosa PA01
ggaugcgccagcgg

SEQ ID NO: 3496162 - RNA, 15 nt, Pseudomonas aeruginosa PA01
ggaugcgccagcggc

SEQ ID NO: 3496163 - RNA, 13 nt, Pseudomonas aeruginosa PA01
ggaugcggcgcug

SEQ ID NO: 3496164 - RNA, 15 nt, Pseudomonas aeruginosa PA01
ggaugcguugcucgc

SEQ ID NO: 3496165 - RNA, 16 nt, Pseudomonas aeruginosa PA01
ggaugcucaccgcgcu

SEQ ID NO: 3496166 - RNA, 13 nt, Pseudomonas aeruginosa PA01
ggaugcuccgcgc

SEQ ID NO: 3496167 - RNA, 18 nt, Pseudomonas aeruginosa PA01
ggaugcucgccugguagg

SEQ ID NO: 3496168 - RNA, 15 nt, Pseudomonas aeruginosa PA01
ggaugcugaucagca

SEQ ID NO: 3496169 - RNA, 15 nt, Pseudomonas aeruginosa PA01
ggauggacagcuugg

SEQ ID NO: 3496170 - RNA, 13 nt, Pseudomonas aeruginosa PA01
ggauggagcacag

SEQ ID NO: 3496171 - RNA, 15 nt, Pseudomonas aeruginosa PA01
ggauggccggcgcgg

SEQ ID NO: 3496172 - RNA, 17 nt, Pseudomonas aeruginosa PA01
ggauggccggcgcggcg

SEQ ID NO: 3496173 - RNA, 15 nt, Pseudomonas aeruginosa PA01
ggauggcgaagccga

SEQ ID NO: 3496174 - RNA, 12 nt, Pseudomonas aeruginosa PA01
ggauggcgcggg

SEQ ID NO: 3496175 - RNA, 13 nt, Pseudomonas aeruginosa PA01
ggauggcgcgguc

SEQ ID NO: 3496176 - RNA, 17 nt, Pseudomonas aeruginosa PA01
ggauggcgcgguccgcg

SEQ ID NO: 3496177 - RNA, 17 nt, Pseudomonas aeruginosa PA01
ggauggcugacccgcug

SEQ ID NO: 3496178 - RNA, 13 nt, Pseudomonas aeruginosa PA01
ggaugggcgagcu

SEQ ID NO: 3496179 - RNA, 22 nt, Pseudomonas aeruginosa PA01
ggauggucggugacccgcacgg

SEQ ID NO: 3496180 - RNA, 21 nt, Pseudomonas aeruginosa PA01
ggauguccuuguucggcugga

SEQ ID NO: 3496181 - RNA, 17 nt, Pseudomonas aeruginosa PA01
ggaugucgcuggccagc

SEQ ID NO: 3496182 - RNA, 12 nt, Pseudomonas aeruginosa PA01
ggaugucggcga

SEQ ID NO: 3496183 - RNA, 15 nt, Pseudomonas aeruginosa PA01
ggaugucggcgaacu

SEQ ID NO: 3496184 - RNA, 15 nt, Pseudomonas aeruginosa PA01
ggaugugcaccagca

SEQ ID NO: 3496185 - RNA, 15 nt, Pseudomonas aeruginosa PA01
ggaugugcucagcga

SEQ ID NO: 3496186 - RNA, 16 nt, Pseudomonas aeruginosa PA01
ggaugugcucagcgau

SEQ ID NO: 3496187 - RNA, 13 nt, Pseudomonas aeruginosa PA01
ggauguucuucac

SEQ ID NO: 3496188 - RNA, 15 nt, Pseudomonas aeruginosa PA01
ggauguucuucaccu

SEQ ID NO: 3496189 - RNA, 12 nt, Pseudomonas aeruginosa PA01
ggauuagcucag

SEQ ID NO: 3496190 - RNA, 23 nt, Pseudomonas aeruginosa PA01
ggauucagugggucgaugcccuc

SEQ ID NO: 3496191 - RNA, 12 nt, Pseudomonas aeruginosa PA01
ggauucgccagc

SEQ ID NO: 3496192 - RNA, 15 nt, Pseudomonas aeruginosa PA01
ggauucggccugccg

SEQ ID NO: 3496193 - RNA, 18 nt, Pseudomonas aeruginosa PA01
ggauucguugaggcccau

SEQ ID NO: 3496194 - RNA, 20 nt, Pseudomonas aeruginosa PA01
ggauugacgauggccagccc

SEQ ID NO: 3496195 - RNA, 14 nt, Pseudomonas aeruginosa PA01
ggauuggccgggcc

SEQ ID NO: 3496196 - RNA, 16 nt, Pseudomonas aeruginosa PA01
ggauuguaucggcucc

SEQ ID NO: 3496197 - RNA, 21 nt, Pseudomonas aeruginosa PA01
ggauuuccgcgcccggcuggc

SEQ ID NO: 3496198 - RNA, 18 nt, Pseudomonas aeruginosa PA01
ggauuuccgcggccggca

SEQ ID NO: 3496199 - RNA, 17 nt, Pseudomonas aeruginosa PA01
ggauuuccugcggcacg

SEQ ID NO: 3496200 - RNA, 17 nt, Pseudomonas aeruginosa PA01
ggauuuccuucggcacc

SEQ ID NO: 3496201 - RNA, 17 nt, Pseudomonas aeruginosa PA01
ggauuuugggcagcgug

SEQ ID NO: 3496202 - RNA, 19 nt, Pseudomonas aeruginosa PA01
ggcaaaaaugcccuuggcu

SEQ ID NO: 3496203 - RNA, 14 nt, Pseudomonas aeruginosa PA01
ggcaaacgccgcca

SEQ ID NO: 3496204 - RNA, 16 nt, Pseudomonas aeruginosa PA01
ggcaaagaccgaccag

SEQ ID NO: 3496205 - RNA, 16 nt, Pseudomonas aeruginosa PA01
ggcaaagcgcgggcug

SEQ ID NO: 3496206 - RNA, 18 nt, Pseudomonas aeruginosa PA01
ggcaaaggcccggcgcgg

SEQ ID NO: 3496207 - RNA, 17 nt, Pseudomonas aeruginosa PA01
ggcaaaggcgcgcaggg

SEQ ID NO: 3496208 - RNA, 21 nt, Pseudomonas aeruginosa PA01
ggcaaaggcgcgcagggccgc

SEQ ID NO: 3496209 - RNA, 22 nt, Pseudomonas aeruginosa PA01
ggcaaaguauucggugcgccgu

SEQ ID NO: 3496210 - RNA, 22 nt, Pseudomonas aeruginosa PA01
ggcaacaccaucggccccaccg

SEQ ID NO: 3496211 - RNA, 13 nt, Pseudomonas aeruginosa PA01
ggcaacagcccgc

SEQ ID NO: 3496212 - RNA, 17 nt, Pseudomonas aeruginosa PA01
ggcaacagcccgcgccg

SEQ ID NO: 3496213 - RNA, 13 nt, Pseudomonas aeruginosa PA01
ggcaacaggucga

SEQ ID NO: 3496214 - RNA, 18 nt, Pseudomonas aeruginosa PA01
ggcaacccagggcgcugc

SEQ ID NO: 3496215 - RNA, 19 nt, Pseudomonas aeruginosa PA01
ggcaacccagggcgcugcc

SEQ ID NO: 3496216 - RNA, 13 nt, Pseudomonas aeruginosa PA01
ggcaaccgcggcg

SEQ ID NO: 3496217 - RNA, 15 nt, Pseudomonas aeruginosa PA01
ggcaaccgcggcggc

SEQ ID NO: 3496218 - RNA, 18 nt, Pseudomonas aeruginosa PA01
ggcaaccgcggcggccuc

SEQ ID NO: 3496219 - RNA, 20 nt, Pseudomonas aeruginosa PA01
ggcaaccggguaccugcucg

SEQ ID NO: 3496220 - RNA, 18 nt, Pseudomonas aeruginosa PA01
ggcaaccgucgaacaggu

SEQ ID NO: 3496221 - RNA, 20 nt, Pseudomonas aeruginosa PA01
ggcaaccgucgaacaggugg

SEQ ID NO: 3496222 - RNA, 22 nt, Pseudomonas aeruginosa PA01
ggcaaccgucgaacagguggcu

SEQ ID NO: 3496223 - RNA, 23 nt, Pseudomonas aeruginosa PA01
ggcaaccuugcacauccagcccu

SEQ ID NO: 3496224 - RNA, 20 nt, Pseudomonas aeruginosa PA01
ggcaacgacgaggccuggau

SEQ ID NO: 3496225 - RNA, 14 nt, Pseudomonas aeruginosa PA01
ggcaacgacggcaa

SEQ ID NO: 3496226 - RNA, 16 nt, Pseudomonas aeruginosa PA01
ggcaacgagcaggacu

SEQ ID NO: 3496227 - RNA, 18 nt, Pseudomonas aeruginosa PA01
ggcaacgagcaggacugc

SEQ ID NO: 3496228 - RNA, 16 nt, Pseudomonas aeruginosa PA01
ggcaacgauaccgccg

SEQ ID NO: 3496229 - RNA, 17 nt, Pseudomonas aeruginosa PA01
ggcaacgauaccgccgc

SEQ ID NO: 3496230 - RNA, 23 nt, Pseudomonas aeruginosa PA01
ggcaacgauaccgccgccggccu

SEQ ID NO: 3496231 - RNA, 20 nt, Pseudomonas aeruginosa PA01
ggcaacgauucgacgcagcg

SEQ ID NO: 3496232 - RNA, 15 nt, Pseudomonas aeruginosa PA01
ggcaacgccaggccg

SEQ ID NO: 3496233 - RNA, 16 nt, Pseudomonas aeruginosa PA01
ggcaacgccaggccgc

SEQ ID NO: 3496234 - RNA, 14 nt, Pseudomonas aeruginosa PA01
ggcaacgccaggcu

SEQ ID NO: 3496235 - RNA, 17 nt, Pseudomonas aeruginosa PA01
ggcaacgcgcagaggcg

SEQ ID NO: 3496236 - RNA, 19 nt, Pseudomonas aeruginosa PA01
ggcaacgcgcagaggcgcu

SEQ ID NO: 3496237 - RNA, 13 nt, Pseudomonas aeruginosa PA01
ggcaacggcgggc

SEQ ID NO: 3496238 - RNA, 19 nt, Pseudomonas aeruginosa PA01
ggcaacggcugggucacgu

SEQ ID NO: 3496239 - RNA, 16 nt, Pseudomonas aeruginosa PA01
ggcaacgucaggcugu

SEQ ID NO: 3496240 - RNA, 14 nt, Pseudomonas aeruginosa PA01
ggcaacugccgccc

SEQ ID NO: 3496241 - RNA, 21 nt, Pseudomonas aeruginosa PA01
ggcaagcaccuugagggccuu

SEQ ID NO: 3496242 - RNA, 23 nt, Pseudomonas aeruginosa PA01
ggcaagccucgcguucgcggucg

SEQ ID NO: 3496243 - RNA, 12 nt, Pseudomonas aeruginosa PA01
ggcaagcgaacc

SEQ ID NO: 3496244 - RNA, 22 nt, Pseudomonas aeruginosa PA01
ggcaagcgcaugaggcuggcca

SEQ ID NO: 3496245 - RNA, 21 nt, Pseudomonas aeruginosa PA01
ggcaagcuccgcgaugucccc

SEQ ID NO: 3496246 - RNA, 15 nt, Pseudomonas aeruginosa PA01
ggcaagcucgacgag

SEQ ID NO: 3496247 - RNA, 19 nt, Pseudomonas aeruginosa PA01
ggcaagcucgacgagccgc

SEQ ID NO: 3496248 - RNA, 17 nt, Pseudomonas aeruginosa PA01
ggcaagcugaagcgccg

SEQ ID NO: 3496249 - RNA, 15 nt, Pseudomonas aeruginosa PA01
ggcaagcugcacggc

SEQ ID NO: 3496250 - RNA, 16 nt, Pseudomonas aeruginosa PA01
ggcaagcugcacggcg

SEQ ID NO: 3496251 - RNA, 22 nt, Pseudomonas aeruginosa PA01
ggcaagcugcacggcgacccgc

SEQ ID NO: 3496252 - RNA, 15 nt, Pseudomonas aeruginosa PA01
ggcaaggaccugcug

SEQ ID NO: 3496253 - RNA, 22 nt, Pseudomonas aeruginosa PA01
ggcaaggaccugcugcccggca

SEQ ID NO: 3496254 - RNA, 23 nt, Pseudomonas aeruginosa PA01
ggcaaggccaagucggccgccca

SEQ ID NO: 3496255 - RNA, 15 nt, Pseudomonas aeruginosa PA01
ggcaaggcgaucccg

SEQ ID NO: 3496256 - RNA, 18 nt, Pseudomonas aeruginosa PA01
ggcaaggcgaucccggcg

SEQ ID NO: 3496257 - RNA, 15 nt, Pseudomonas aeruginosa PA01
ggcaaggcggccuca

SEQ ID NO: 3496258 - RNA, 22 nt, Pseudomonas aeruginosa PA01
ggcaagggcacgugcagcggca

SEQ ID NO: 3496259 - RNA, 17 nt, Pseudomonas aeruginosa PA01
ggcaagggccugcucag

SEQ ID NO: 3496260 - RNA, 21 nt, Pseudomonas aeruginosa PA01
ggcaagguaguccaucaccgc

SEQ ID NO: 3496261 - RNA, 19 nt, Pseudomonas aeruginosa PA01
ggcaaguaaugccgaaggc

SEQ ID NO: 3496262 - RNA, 15 nt, Pseudomonas aeruginosa PA01
ggcaagugggucacg

SEQ ID NO: 3496263 - RNA, 12 nt, Pseudomonas aeruginosa PA01
ggcaaucgcggg

SEQ ID NO: 3496264 - RNA, 23 nt, Pseudomonas aeruginosa PA01
ggcaaugccgcccuccaucagcg

SEQ ID NO: 3496265 - RNA, 16 nt, Pseudomonas aeruginosa PA01
ggcaaugcggcgaugg

SEQ ID NO: 3496266 - RNA, 16 nt, Pseudomonas aeruginosa PA01
ggcaauggccggcggg

SEQ ID NO: 3496267 - RNA, 20 nt, Pseudomonas aeruginosa PA01
ggcaauggccggcgggcgcg

SEQ ID NO: 3496268 - RNA, 17 nt, Pseudomonas aeruginosa PA01
ggcacaaaaaaggcgga

SEQ ID NO: 3496269 - RNA, 18 nt, Pseudomonas aeruginosa PA01
ggcacaaaaaaggcggau

SEQ ID NO: 3496270 - RNA, 22 nt, Pseudomonas aeruginosa PA01
ggcacacgucggcaucgaacuc

SEQ ID NO: 3496271 - RNA, 18 nt, Pseudomonas aeruginosa PA01
ggcacagccauagugcug

SEQ ID NO: 3496272 - RNA, 23 nt, Pseudomonas aeruginosa PA01
ggcacagccauagugcugggcga

SEQ ID NO: 3496273 - RNA, 20 nt, Pseudomonas aeruginosa PA01
ggcacagcguggccagcgcc

SEQ ID NO: 3496274 - RNA, 21 nt, Pseudomonas aeruginosa PA01
ggcacagcguggccagcgccc

SEQ ID NO: 3496275 - RNA, 21 nt, Pseudomonas aeruginosa PA01
ggcacaggacccuuccagcgu

SEQ ID NO: 3496276 - RNA, 23 nt, Pseudomonas aeruginosa PA01
ggcacaggacccuuccagcgugu

SEQ ID NO: 3496277 - RNA, 13 nt, Pseudomonas aeruginosa PA01
ggcacagggcgac

SEQ ID NO: 3496278 - RNA, 17 nt, Pseudomonas aeruginosa PA01
ggcacaguuccuguacc

SEQ ID NO: 3496279 - RNA, 14 nt, Pseudomonas aeruginosa PA01
ggcaccaccagcgc

SEQ ID NO: 3496280 - RNA, 12 nt, Pseudomonas aeruginosa PA01
ggcaccaccgcc

SEQ ID NO: 3496281 - RNA, 14 nt, Pseudomonas aeruginosa PA01
ggcaccaccgccgc

SEQ ID NO: 3496282 - RNA, 18 nt, Pseudomonas aeruginosa PA01
ggcaccaccgccgccagc

SEQ ID NO: 3496283 - RNA, 21 nt, Pseudomonas aeruginosa PA01
ggcaccaccgccgccagcaac

SEQ ID NO: 3496284 - RNA, 11 nt, Pseudomonas aeruginosa PA01
ggcaccaccgg

SEQ ID NO: 3496285 - RNA, 23 nt, Pseudomonas aeruginosa PA01
ggcaccagcacguugccauccag

SEQ ID NO: 3496286 - RNA, 17 nt, Pseudomonas aeruginosa PA01
ggcaccaguggcgccgc

SEQ ID NO: 3496287 - RNA, 18 nt, Pseudomonas aeruginosa PA01
ggcaccaguggcgccgcc

SEQ ID NO: 3496288 - RNA, 23 nt, Pseudomonas aeruginosa PA01
ggcaccccgagcggcgcgaaguc

SEQ ID NO: 3496289 - RNA, 21 nt, Pseudomonas aeruginosa PA01
ggcaccccuucgagcaacaca

SEQ ID NO: 3496290 - RNA, 13 nt, Pseudomonas aeruginosa PA01
ggcacccggcugg

SEQ ID NO: 3496291 - RNA, 15 nt, Pseudomonas aeruginosa PA01
ggcacccggcugggu

SEQ ID NO: 3496292 - RNA, 20 nt, Pseudomonas aeruginosa PA01
ggcacccggcuggguucggc

SEQ ID NO: 3496293 - RNA, 19 nt, Pseudomonas aeruginosa PA01
ggcacccgguugaccccgc

SEQ ID NO: 3496294 - RNA, 22 nt, Pseudomonas aeruginosa PA01
ggcacccgguugaccccgcggg

SEQ ID NO: 3496295 - RNA, 20 nt, Pseudomonas aeruginosa PA01
ggcacccucuuccgcgcuga

SEQ ID NO: 3496296 - RNA, 22 nt, Pseudomonas aeruginosa PA01
ggcacccugaccgcgagcgccg

SEQ ID NO: 3496297 - RNA, 23 nt, Pseudomonas aeruginosa PA01
ggcaccgaagcugaggccggugu

SEQ ID NO: 3496298 - RNA, 20 nt, Pseudomonas aeruginosa PA01
ggcaccgagagcugcaaggc

SEQ ID NO: 3496299 - RNA, 13 nt, Pseudomonas aeruginosa PA01
ggcaccgaucgcc

SEQ ID NO: 3496300 - RNA, 20 nt, Pseudomonas aeruginosa PA01
ggcaccgaucgcccgcgccu

SEQ ID NO: 3496301 - RNA, 13 nt, Pseudomonas aeruginosa PA01
ggcaccgccagcc

SEQ ID NO: 3496302 - RNA, 12 nt, Pseudomonas aeruginosa PA01
ggcaccgccgag

SEQ ID NO: 3496303 - RNA, 13 nt, Pseudomonas aeruginosa PA01
ggcaccgcgcagc

SEQ ID NO: 3496304 - RNA, 17 nt, Pseudomonas aeruginosa PA01
ggcaccgcgcagcguca

SEQ ID NO: 3496305 - RNA, 13 nt, Pseudomonas aeruginosa PA01
ggcaccgcuuucg

SEQ ID NO: 3496306 - RNA, 19 nt, Pseudomonas aeruginosa PA01
ggcaccgcuuucguagggc

SEQ ID NO: 3496307 - RNA, 19 nt, Pseudomonas aeruginosa PA01
ggcaccggccaggcgcugg

SEQ ID NO: 3496308 - RNA, 21 nt, Pseudomonas aeruginosa PA01
ggcaccggccaggcgcugguc

SEQ ID NO: 3496309 - RNA, 22 nt, Pseudomonas aeruginosa PA01
ggcaccggccaggcgcuggucc

SEQ ID NO: 3496310 - RNA, 15 nt, Pseudomonas aeruginosa PA01
ggcaccguaggccag

SEQ ID NO: 3496311 - RNA, 18 nt, Pseudomonas aeruginosa PA01
ggcaccguaggccaggca

SEQ ID NO: 3496312 - RNA, 18 nt, Pseudomonas aeruginosa PA01
ggcaccgucaagggccag

SEQ ID NO: 3496313 - RNA, 19 nt, Pseudomonas aeruginosa PA01
ggcaccgucaagggccagg

SEQ ID NO: 3496314 - RNA, 20 nt, Pseudomonas aeruginosa PA01
ggcaccgucgagcaccaggc

SEQ ID NO: 3496315 - RNA, 23 nt, Pseudomonas aeruginosa PA01
ggcaccgucgagcaccaggcggu

SEQ ID NO: 3496316 - RNA, 17 nt, Pseudomonas aeruginosa PA01
ggcaccguggugcccgg

SEQ ID NO: 3496317 - RNA, 18 nt, Pseudomonas aeruginosa PA01
ggcaccucgauggcggcg

SEQ ID NO: 3496318 - RNA, 13 nt, Pseudomonas aeruginosa PA01
ggcaccugcagac

SEQ ID NO: 3496319 - RNA, 19 nt, Pseudomonas aeruginosa PA01
ggcaccuugcgaaaagccc

SEQ ID NO: 3496320 - RNA, 21 nt, Pseudomonas aeruginosa PA01
ggcaccuugcgaaaagcccgc

SEQ ID NO: 3496321 - RNA, 22 nt, Pseudomonas aeruginosa PA01
ggcaccuugcgaaaagcccgcc

SEQ ID NO: 3496322 - RNA, 20 nt, Pseudomonas aeruginosa PA01
ggcacgaaccauugcggccc

SEQ ID NO: 3496323 - RNA, 22 nt, Pseudomonas aeruginosa PA01
ggcacgaaccauugcggcccgc

SEQ ID NO: 3496324 - RNA, 19 nt, Pseudomonas aeruginosa PA01
ggcacgaccacaucggcca

SEQ ID NO: 3496325 - RNA, 22 nt, Pseudomonas aeruginosa PA01
ggcacgaccuucuccgaccagg

SEQ ID NO: 3496326 - RNA, 17 nt, Pseudomonas aeruginosa PA01
ggcacgagucgaggcga

SEQ ID NO: 3496327 - RNA, 17 nt, Pseudomonas aeruginosa PA01
ggcacgaucugcgccgc

SEQ ID NO: 3496328 - RNA, 18 nt, Pseudomonas aeruginosa PA01
ggcacgaucugcgccgca

SEQ ID NO: 3496329 - RNA, 15 nt, Pseudomonas aeruginosa PA01
ggcacgaugcugaac

SEQ ID NO: 3496330 - RNA, 14 nt, Pseudomonas aeruginosa PA01
ggcacgcagcagcu

SEQ ID NO: 3496331 - RNA, 20 nt, Pseudomonas aeruginosa PA01
ggcacgcagcagcuucggcg

SEQ ID NO: 3496332 - RNA, 22 nt, Pseudomonas aeruginosa PA01
ggcacgcagcagcuucggcgcg

SEQ ID NO: 3496333 - RNA, 13 nt, Pseudomonas aeruginosa PA01
ggcacgcagggcu

SEQ ID NO: 3496334 - RNA, 16 nt, Pseudomonas aeruginosa PA01
ggcacgccauccuccg

SEQ ID NO: 3496335 - RNA, 22 nt, Pseudomonas aeruginosa PA01
ggcacgccccauccgggcggcg

SEQ ID NO: 3496336 - RNA, 23 nt, Pseudomonas aeruginosa PA01
ggcacgccccauccgggcggcgg

SEQ ID NO: 3496337 - RNA, 18 nt, Pseudomonas aeruginosa PA01
ggcacgccgaaguccugc

SEQ ID NO: 3496338 - RNA, 16 nt, Pseudomonas aeruginosa PA01
ggcacgcucaggcgca

SEQ ID NO: 3496339 - RNA, 19 nt, Pseudomonas aeruginosa PA01
ggcacgcuccagaucgccg

SEQ ID NO: 3496340 - RNA, 22 nt, Pseudomonas aeruginosa PA01
ggcacgcuccagaucgccguuc

SEQ ID NO: 3496341 - RNA, 19 nt, Pseudomonas aeruginosa PA01
ggcacgcuccagggcggcc

SEQ ID NO: 3496342 - RNA, 22 nt, Pseudomonas aeruginosa PA01
ggcacgcucuggccguucucca

SEQ ID NO: 3496343 - RNA, 20 nt, Pseudomonas aeruginosa PA01
ggcacgcugccagcaggccg

SEQ ID NO: 3496344 - RNA, 21 nt, Pseudomonas aeruginosa PA01
ggcacgcugccagcaggccga

SEQ ID NO: 3496345 - RNA, 17 nt, Pseudomonas aeruginosa PA01
ggcacgcugcuugcgca

SEQ ID NO: 3496346 - RNA, 20 nt, Pseudomonas aeruginosa PA01
ggcacgcugcuugcgcaccu

SEQ ID NO: 3496347 - RNA, 22 nt, Pseudomonas aeruginosa PA01
ggcacgcugcuugcgcaccucc

SEQ ID NO: 3496348 - RNA, 17 nt, Pseudomonas aeruginosa PA01
ggcacggaagcgcugcu

SEQ ID NO: 3496349 - RNA, 23 nt, Pseudomonas aeruginosa PA01
ggcacggccagucgcguuggccg

SEQ ID NO: 3496350 - RNA, 17 nt, Pseudomonas aeruginosa PA01
ggcacggggcgccuguc

SEQ ID NO: 3496351 - RNA, 19 nt, Pseudomonas aeruginosa PA01
ggcacggggcgccuguccg

SEQ ID NO: 3496352 - RNA, 22 nt, Pseudomonas aeruginosa PA01
ggcacggggcgccuguccggga

SEQ ID NO: 3496353 - RNA, 12 nt, Pseudomonas aeruginosa PA01
ggcacgguagcc

SEQ ID NO: 3496354 - RNA, 19 nt, Pseudomonas aeruginosa PA01
ggcacggucauggccagcu

SEQ ID NO: 3496355 - RNA, 16 nt, Pseudomonas aeruginosa PA01
gcuuucuucgccuggc

SEQ ID NO: 3496356 - RNA, 19 nt, Pseudomonas aeruginosa PA01
gcuuucuucgccuggcgcg

SEQ ID NO: 3496357 - RNA, 14 nt, Pseudomonas aeruginosa PA01
gcuuugcagggcga

SEQ ID NO: 3496358 - RNA, 14 nt, Pseudomonas aeruginosa PA01
gcuuugcauggccu

SEQ ID NO: 3496359 - RNA, 20 nt, Pseudomonas aeruginosa PA01
gcuuugcauggccuguacca

SEQ ID NO: 3496360 - RNA, 21 nt, Pseudomonas aeruginosa PA01
gcuuugcccgucuagcgcagg

SEQ ID NO: 3496361 - RNA, 12 nt, Pseudomonas aeruginosa PA01
gcuuugcgcagc

SEQ ID NO: 3496362 - RNA, 15 nt, Pseudomonas aeruginosa PA01
gcuuugcgccucgcg

SEQ ID NO: 3496363 - RNA, 13 nt, Pseudomonas aeruginosa PA01
gcuuugcgcgcag

SEQ ID NO: 3496364 - RNA, 17 nt, Pseudomonas aeruginosa PA01
gcuuuucauuaccggcg

SEQ ID NO: 3496365 - RNA, 21 nt, Pseudomonas aeruginosa PA01
gcuuuuccggcgccggcagga

SEQ ID NO: 3496366 - RNA, 21 nt, Pseudomonas aeruginosa PA01
gcuuuuccucgacccacuggc

SEQ ID NO: 3496367 - RNA, 20 nt, Pseudomonas aeruginosa PA01
gcuuuucucgccucccggcu

SEQ ID NO: 3496368 - RNA, 17 nt, Pseudomonas aeruginosa PA01
gcuuuugaacaccagcg

SEQ ID NO: 3496369 - RNA, 18 nt, Pseudomonas aeruginosa PA01
gcuuuuucauuuccuccg

SEQ ID NO: 3496370 - RNA, 12 nt, Pseudomonas aeruginosa PA01
gcuuuuuccgcu

SEQ ID NO: 3496371 - RNA, 21 nt, Pseudomonas aeruginosa PA01
gcuuuuuucguugcgccugcu

SEQ ID NO: 3496372 - RNA, 23 nt, Pseudomonas aeruginosa PA01
ggaaaaaaaagcccgcacgaggc

SEQ ID NO: 3496373 - RNA, 18 nt, Pseudomonas aeruginosa PA01
ggaaaaaacgccggucau

SEQ ID NO: 3496374 - RNA, 19 nt, Pseudomonas aeruginosa PA01
ggaaaaacccggcccaggc

SEQ ID NO: 3496375 - RNA, 9 nt, Pseudomonas aeruginosa PA01
ggaaaaaga

SEQ ID NO: 3496376 - RNA, 23 nt, Pseudomonas aeruginosa PA01
ggaaaacgccgcgaagcccagcg

SEQ ID NO: 3496377 - RNA, 15 nt, Pseudomonas aeruginosa PA01
ggaaaagaagccgcg

SEQ ID NO: 3496378 - RNA, 16 nt, Pseudomonas aeruginosa PA01
ggaaaagcccgcuccg

SEQ ID NO: 3496379 - RNA, 17 nt, Pseudomonas aeruginosa PA01
ggaaacacagcacgagc

SEQ ID NO: 3496380 - RNA, 21 nt, Pseudomonas aeruginosa PA01
ggaaacccgugguccgccagc

SEQ ID NO: 3496381 - RNA, 22 nt, Pseudomonas aeruginosa PA01
ggaaacccgugguccgccagca

SEQ ID NO: 3496382 - RNA, 14 nt, Pseudomonas aeruginosa PA01
ggaaaccgcggccg

SEQ ID NO: 3496383 - RNA, 16 nt, Pseudomonas aeruginosa PA01
ggaaaccggccagcgc

SEQ ID NO: 3496384 - RNA, 17 nt, Pseudomonas aeruginosa PA01
ggaaaccggccagcgca

SEQ ID NO: 3496385 - RNA, 16 nt, Pseudomonas aeruginosa PA01
ggaaaccucgccgguc

SEQ ID NO: 3496386 - RNA, 20 nt, Pseudomonas aeruginosa PA01
ggaaaccucgccggucaggu

SEQ ID NO: 3496387 - RNA, 21 nt, Pseudomonas aeruginosa PA01
ggaaaccugugcugcgcgccg

SEQ ID NO: 3496388 - RNA, 15 nt, Pseudomonas aeruginosa PA01
ggaaacgacaggcug

SEQ ID NO: 3496389 - RNA, 13 nt, Pseudomonas aeruginosa PA01
ggaaacgccgaga

SEQ ID NO: 3496390 - RNA, 20 nt, Pseudomonas aeruginosa PA01
ggaaacgccgagaacgcggc

SEQ ID NO: 3496391 - RNA, 21 nt, Pseudomonas aeruginosa PA01
ggaaacgccgagaacgcggcg

SEQ ID NO: 3496392 - RNA, 23 nt, Pseudomonas aeruginosa PA01
ggaaacgcgcgcucucgccggcc

SEQ ID NO: 3496393 - RNA, 14 nt, Pseudomonas aeruginosa PA01
ggaaacucacccug

SEQ ID NO: 3496394 - RNA, 18 nt, Pseudomonas aeruginosa PA01
ggaaagaccggcgccccu

SEQ ID NO: 3496395 - RNA, 16 nt, Pseudomonas aeruginosa PA01
ggaaagccuggccggc

SEQ ID NO: 3496396 - RNA, 17 nt, Pseudomonas aeruginosa PA01
ggaaagccuggccggcg

SEQ ID NO: 3496397 - RNA, 19 nt, Pseudomonas aeruginosa PA01
ggaaagcuccucggccuug

SEQ ID NO: 3496398 - RNA, 22 nt, Pseudomonas aeruginosa PA01
ggaaaggcgucguugccgauca

SEQ ID NO: 3496399 - RNA, 23 nt, Pseudomonas aeruginosa PA01
ggaaauccuuucgaucuggcugc

SEQ ID NO: 3496400 - RNA, 20 nt, Pseudomonas aeruginosa PA01
ggaaaucggccacuccagcc

SEQ ID NO: 3496401 - RNA, 23 nt, Pseudomonas aeruginosa PA01
ggaaaucggccacuccagccccg

SEQ ID NO: 3496402 - RNA, 20 nt, Pseudomonas aeruginosa PA01
ggaaaucgguugccgcgcca

SEQ ID NO: 3496403 - RNA, 13 nt, Pseudomonas aeruginosa PA01
ggaaaugccuggc

SEQ ID NO: 3496404 - RNA, 15 nt, Pseudomonas aeruginosa PA01
ggaaauucagcgcuu

SEQ ID NO: 3496405 - RNA, 14 nt, Pseudomonas aeruginosa PA01
ggaacaagccgccu

SEQ ID NO: 3496406 - RNA, 17 nt, Pseudomonas aeruginosa PA01
ggaacaagccgccuucg

SEQ ID NO: 3496407 - RNA, 16 nt, Pseudomonas aeruginosa PA01
ggaacaccaggccgca

SEQ ID NO: 3496408 - RNA, 21 nt, Pseudomonas aeruginosa PA01
ggaacacccagaagccgaccu

SEQ ID NO: 3496409 - RNA, 16 nt, Pseudomonas aeruginosa PA01
ggaacagcagccaggc

SEQ ID NO: 3496410 - RNA, 17 nt, Pseudomonas aeruginosa PA01
ggaacagcagccaggcg

SEQ ID NO: 3496411 - RNA, 15 nt, Pseudomonas aeruginosa PA01
ggaacagccgcagcg

SEQ ID NO: 3496412 - RNA, 12 nt, Pseudomonas aeruginosa PA01
ggaacagcgcca

SEQ ID NO: 3496413 - RNA, 21 nt, Pseudomonas aeruginosa PA01
ggaacagcgccagcggcagcg

SEQ ID NO: 3496414 - RNA, 12 nt, Pseudomonas aeruginosa PA01
ggaacagcuccu

SEQ ID NO: 3496415 - RNA, 21 nt, Pseudomonas aeruginosa PA01
ggaacaggagccaucgcucca

SEQ ID NO: 3496416 - RNA, 20 nt, Pseudomonas aeruginosa PA01
ggaacaggucgacgccaugg

SEQ ID NO: 3496417 - RNA, 18 nt, Pseudomonas aeruginosa PA01
ggaacagguucggcaggc

SEQ ID NO: 3496418 - RNA, 19 nt, Pseudomonas aeruginosa PA01
ggaacagguucggcaggcc

SEQ ID NO: 3496419 - RNA, 20 nt, Pseudomonas aeruginosa PA01
ggaacagguucggcaggccu

SEQ ID NO: 3496420 - RNA, 17 nt, Pseudomonas aeruginosa PA01
ggaacaguucggcgagu

SEQ ID NO: 3496421 - RNA, 16 nt, Pseudomonas aeruginosa PA01
ggaacaguugcggaga

SEQ ID NO: 3496422 - RNA, 21 nt, Pseudomonas aeruginosa PA01
ggaacauugccaccaccaugc

SEQ ID NO: 3496423 - RNA, 21 nt, Pseudomonas aeruginosa PA01
ggaaccacgacgaagcgccgg

SEQ ID NO: 3496424 - RNA, 21 nt, Pseudomonas aeruginosa PA01
ggaaccaggggucgacgcagg

SEQ ID NO: 3496425 - RNA, 22 nt, Pseudomonas aeruginosa PA01
ggaaccaggggucgacgcaggg

SEQ ID NO: 3496426 - RNA, 21 nt, Pseudomonas aeruginosa PA01
ggaacccagguucuggucgcc

SEQ ID NO: 3496427 - RNA, 16 nt, Pseudomonas aeruginosa PA01
ggaacccuugcgcagg

SEQ ID NO: 3496428 - RNA, 23 nt, Pseudomonas aeruginosa PA01
ggaaccgaguuucccggcgcggc

SEQ ID NO: 3496429 - RNA, 18 nt, Pseudomonas aeruginosa PA01
ggaaccgauggccagggg

SEQ ID NO: 3496430 - RNA, 15 nt, Pseudomonas aeruginosa PA01
ggaaccgcggcgccc

SEQ ID NO: 3496431 - RNA, 24 nt, Pseudomonas aeruginosa PA01
ggaaccggccauuacgccgagcau

SEQ ID NO: 3496432 - RNA, 14 nt, Pseudomonas aeruginosa PA01
ggaaccggccggca

SEQ ID NO: 3496433 - RNA, 20 nt, Pseudomonas aeruginosa PA01
ggaaccggguagaggguauu

SEQ ID NO: 3496434 - RNA, 20 nt, Pseudomonas aeruginosa PA01
ggaaccuguccgaacagggc

SEQ ID NO: 3496435 - RNA, 21 nt, Pseudomonas aeruginosa PA01
ggaaccuguccgaacagggcg

SEQ ID NO: 3496436 - RNA, 17 nt, Pseudomonas aeruginosa PA01
ggaacgaacaugagcga

SEQ ID NO: 3496437 - RNA, 18 nt, Pseudomonas aeruginosa PA01
ggaacgaugccgcaggca

SEQ ID NO: 3496438 - RNA, 19 nt, Pseudomonas aeruginosa PA01
ggaacgaugccgcaggcau

SEQ ID NO: 3496439 - RNA, 14 nt, Pseudomonas aeruginosa PA01
ggaacgcaggggca

SEQ ID NO: 3496440 - RNA, 20 nt, Pseudomonas aeruginosa PA01
ggaacgcccgcggcagcagc

SEQ ID NO: 3496441 - RNA, 15 nt, Pseudomonas aeruginosa PA01
ggaacgccgacaggc

SEQ ID NO: 3496442 - RNA, 22 nt, Pseudomonas aeruginosa PA01
ggaacgccucgcagagcgccag

SEQ ID NO: 3496443 - RNA, 23 nt, Pseudomonas aeruginosa PA01
ggaacgccucgcagagcgccagc

SEQ ID NO: 3496444 - RNA, 21 nt, Pseudomonas aeruginosa PA01
ggaacgcggcuucggucaggu

SEQ ID NO: 3496445 - RNA, 19 nt, Pseudomonas aeruginosa PA01
ggaacgcggguugcccggc

SEQ ID NO: 3496446 - RNA, 14 nt, Pseudomonas aeruginosa PA01
ggaacggcucgcga

SEQ ID NO: 3496447 - RNA, 13 nt, Pseudomonas aeruginosa PA01
ggaacggcuugcu

SEQ ID NO: 3496448 - RNA, 17 nt, Pseudomonas aeruginosa PA01
ggaacgggacgccuggc

SEQ ID NO: 3496449 - RNA, 18 nt, Pseudomonas aeruginosa PA01
ggaacgggacgccuggcg

SEQ ID NO: 3496450 - RNA, 16 nt, Pseudomonas aeruginosa PA01
ggaacgugcggccugc

SEQ ID NO: 3496451 - RNA, 17 nt, Pseudomonas aeruginosa PA01
ggaacgugcggccugca

SEQ ID NO: 3496452 - RNA, 20 nt, Pseudomonas aeruginosa PA01
ggaacuagcccucgaccugg

SEQ ID NO: 3496453 - RNA, 13 nt, Pseudomonas aeruginosa PA01
ggaacucgaucag

SEQ ID NO: 3496454 - RNA, 21 nt, Pseudomonas aeruginosa PA01
ggaacucgaucagcgcggcca

SEQ ID NO: 3496455 - RNA, 11 nt, Pseudomonas aeruginosa PA01
ggaacugggcg

SEQ ID NO: 3496456 - RNA, 18 nt, Pseudomonas aeruginosa PA01
ggaacuggucgauccgcg

SEQ ID NO: 3496457 - RNA, 14 nt, Pseudomonas aeruginosa PA01
ggaacuuggcgcgc

SEQ ID NO: 3496458 - RNA, 16 nt, Pseudomonas aeruginosa PA01
ggaagaaaagaaggcg

SEQ ID NO: 3496459 - RNA, 19 nt, Pseudomonas aeruginosa PA01
ggaagaaacugcgguugaa

SEQ ID NO: 3496460 - RNA, 12 nt, Pseudomonas aeruginosa PA01
ggaagaacaucg

SEQ ID NO: 3496461 - RNA, 15 nt, Pseudomonas aeruginosa PA01
ggaagaagccgauca

SEQ ID NO: 3496462 - RNA, 19 nt, Pseudomonas aeruginosa PA01
ggaagaauaccgccagcuc

SEQ ID NO: 3496463 - RNA, 20 nt, Pseudomonas aeruginosa PA01
ggaagaauaccgccagcucg

SEQ ID NO: 3496464 - RNA, 23 nt, Pseudomonas aeruginosa PA01
ggaagaauaccgccagcucgcug

SEQ ID NO: 3496465 - RNA, 19 nt, Pseudomonas aeruginosa PA01
ggaagagcagcgcggcggc

SEQ ID NO: 3496466 - RNA, 13 nt, Pseudomonas aeruginosa PA01
ggaagagcaggcg

SEQ ID NO: 3496467 - RNA, 22 nt, Pseudomonas aeruginosa PA01
ggaagaucuccggguccaucug

SEQ ID NO: 3496468 - RNA, 18 nt, Pseudomonas aeruginosa PA01
ggaagaugcacaccagcu

SEQ ID NO: 3496469 - RNA, 21 nt, Pseudomonas aeruginosa PA01
ggaagaugcacaccagcuccc

SEQ ID NO: 3496470 - RNA, 22 nt, Pseudomonas aeruginosa PA01
ggaagaugcacaccagcucccc

SEQ ID NO: 3496471 - RNA, 16 nt, Pseudomonas aeruginosa PA01
ggaagauguucgccgc

SEQ ID NO: 3496472 - RNA, 17 nt, Pseudomonas aeruginosa PA01
ggaagauguucgccgcc

SEQ ID NO: 3496473 - RNA, 21 nt, Pseudomonas aeruginosa PA01
ggaagcacggcucggcgagga

SEQ ID NO: 3496474 - RNA, 17 nt, Pseudomonas aeruginosa PA01
ggaagcaggucucgacg

SEQ ID NO: 3496475 - RNA, 23 nt, Pseudomonas aeruginosa PA01
ggaagcccugcuggcgcagccag

SEQ ID NO: 3496476 - RNA, 19 nt, Pseudomonas aeruginosa PA01
ggaagccgaccacucgcga

SEQ ID NO: 3496477 - RNA, 15 nt, Pseudomonas aeruginosa PA01
ggaagccgaccggcg

SEQ ID NO: 3496478 - RNA, 17 nt, Pseudomonas aeruginosa PA01
ggaagccgaccggcgcc

SEQ ID NO: 3496479 - RNA, 15 nt, Pseudomonas aeruginosa PA01
ggaagccgaucggca

SEQ ID NO: 3496480 - RNA, 17 nt, Pseudomonas aeruginosa PA01
ggaagccgaucggcaug

SEQ ID NO: 3496481 - RNA, 12 nt, Pseudomonas aeruginosa PA01
ggaagccgcgcc

SEQ ID NO: 3496482 - RNA, 14 nt, Pseudomonas aeruginosa PA01
ggaagccgcgcccc

SEQ ID NO: 3496483 - RNA, 17 nt, Pseudomonas aeruginosa PA01
ggaagccgcgccccagc

SEQ ID NO: 3496484 - RNA, 12 nt, Pseudomonas aeruginosa PA01
ggaagccgcgcu

SEQ ID NO: 3496485 - RNA, 20 nt, Pseudomonas aeruginosa PA01
ggaagccgggaagccgcucg

SEQ ID NO: 3496486 - RNA, 20 nt, Pseudomonas aeruginosa PA01
ggaagccgucggcgaucgcc

SEQ ID NO: 3496487 - RNA, 14 nt, Pseudomonas aeruginosa PA01
ggaagccguggcgg

SEQ ID NO: 3496488 - RNA, 16 nt, Pseudomonas aeruginosa PA01
ggaagccguggcgggc

SEQ ID NO: 3496489 - RNA, 16 nt, Pseudomonas aeruginosa PA01
ggaagccugccagacc

SEQ ID NO: 3496490 - RNA, 16 nt, Pseudomonas aeruginosa PA01
ggaagccuucgcccgg

SEQ ID NO: 3496491 - RNA, 15 nt, Pseudomonas aeruginosa PA01
ggaagcgaaccaggc

SEQ ID NO: 3496492 - RNA, 22 nt, Pseudomonas aeruginosa PA01
ggaagcgaucuccugccgcggc

SEQ ID NO: 3496493 - RNA, 21 nt, Pseudomonas aeruginosa PA01
ggaagcgcccgaugaucgagc

SEQ ID NO: 3496494 - RNA, 18 nt, Pseudomonas aeruginosa PA01
ggaagcgcggcucgggga

SEQ ID NO: 3496495 - RNA, 20 nt, Pseudomonas aeruginosa PA01
ggaagcggcgguacauggcc

SEQ ID NO: 3496496 - RNA, 21 nt, Pseudomonas aeruginosa PA01
ggaagcggcgguacauggccu

SEQ ID NO: 3496497 - RNA, 15 nt, Pseudomonas aeruginosa PA01
ggaagcgggccucgg

SEQ ID NO: 3496498 - RNA, 19 nt, Pseudomonas aeruginosa PA01
ggaagcgggccucggcggg

SEQ ID NO: 3496499 - RNA, 20 nt, Pseudomonas aeruginosa PA01
ggaagcgguagugggcgagg

SEQ ID NO: 3496500 - RNA, 14 nt, Pseudomonas aeruginosa PA01
ggaagcgucagccg

SEQ ID NO: 3496501 - RNA, 16 nt, Pseudomonas aeruginosa PA01
ggaagcgucagccgcg

SEQ ID NO: 3496502 - RNA, 17 nt, Pseudomonas aeruginosa PA01
ggaagcgucagccgcgg

SEQ ID NO: 3496503 - RNA, 18 nt, Pseudomonas aeruginosa PA01
ggaagcgucagccgcggc

SEQ ID NO: 3496504 - RNA, 20 nt, Pseudomonas aeruginosa PA01
ggaagcgucagccgcggccg

SEQ ID NO: 3496505 - RNA, 18 nt, Pseudomonas aeruginosa PA01
ggaagcguuccuggaagc

SEQ ID NO: 3496506 - RNA, 15 nt, Pseudomonas aeruginosa PA01
ggaagcucggcagca

SEQ ID NO: 3496507 - RNA, 16 nt, Pseudomonas aeruginosa PA01
ggaagcucggcagcac

SEQ ID NO: 3496508 - RNA, 14 nt, Pseudomonas aeruginosa PA01
ggaagcugacgaac

SEQ ID NO: 3496509 - RNA, 15 nt, Pseudomonas aeruginosa PA01
ggaagcugacgaaca

SEQ ID NO: 3496510 - RNA, 15 nt, Pseudomonas aeruginosa PA01
ggaagcugccuucca

SEQ ID NO: 3496511 - RNA, 19 nt, Pseudomonas aeruginosa PA01
ggaagcugccuuccagcag

SEQ ID NO: 3496512 - RNA, 20 nt, Pseudomonas aeruginosa PA01
ggaagcugccuuccagcagg

SEQ ID NO: 3496513 - RNA, 14 nt, Pseudomonas aeruginosa PA01
ggaagcuucaggcu

SEQ ID NO: 3496514 - RNA, 18 nt, Pseudomonas aeruginosa PA01
ggaagcuucaggcucggc

SEQ ID NO: 3496515 - RNA, 15 nt, Pseudomonas aeruginosa PA01
ggaagcuuccagcuu

SEQ ID NO: 3496516 - RNA, 23 nt, Pseudomonas aeruginosa PA01
ggaagcuuccagcuuggcacggc

SEQ ID NO: 3496517 - RNA, 17 nt, Pseudomonas aeruginosa PA01
ggaaggauuccacccgc

SEQ ID NO: 3496518 - RNA, 19 nt, Pseudomonas aeruginosa PA01
ggaaggauuccacccgcuc

SEQ ID NO: 3496519 - RNA, 17 nt, Pseudomonas aeruginosa PA01
ggaaggccacgccgccg

SEQ ID NO: 3496520 - RNA, 14 nt, Pseudomonas aeruginosa PA01
ggaaggccagcagg

SEQ ID NO: 3496521 - RNA, 15 nt, Pseudomonas aeruginosa PA01
ggaaggcccgcgagc

SEQ ID NO: 3496522 - RNA, 13 nt, Pseudomonas aeruginosa PA01
ggaaggccgcgcc

SEQ ID NO: 3496523 - RNA, 14 nt, Pseudomonas aeruginosa PA01
ggaaggccgggccc

SEQ ID NO: 3496524 - RNA, 15 nt, Pseudomonas aeruginosa PA01
ggaaggcgcgcacca

SEQ ID NO: 3496525 - RNA, 13 nt, Pseudomonas aeruginosa PA01
ggaaggcgcuggg

SEQ ID NO: 3496526 - RNA, 13 nt, Pseudomonas aeruginosa PA01
ggaaggcggcguc

SEQ ID NO: 3496527 - RNA, 14 nt, Pseudomonas aeruginosa PA01
ggaaggcggcgucg

SEQ ID NO: 3496528 - RNA, 14 nt, Pseudomonas aeruginosa PA01
ggaaggcgucgccg

SEQ ID NO: 3496529 - RNA, 23 nt, Pseudomonas aeruginosa PA01
ggaaggcucguucguagaucccu

SEQ ID NO: 3496530 - RNA, 16 nt, Pseudomonas aeruginosa PA01
ggaagggacgucgcca

SEQ ID NO: 3496531 - RNA, 17 nt, Pseudomonas aeruginosa PA01
ggaagggacgucgccag

SEQ ID NO: 3496532 - RNA, 13 nt, Pseudomonas aeruginosa PA01
ggaagggaucgac

SEQ ID NO: 3496533 - RNA, 23 nt, Pseudomonas aeruginosa PA01
ggaaggucaccgaaaggcucuug

SEQ ID NO: 3496534 - RNA, 22 nt, Pseudomonas aeruginosa PA01
ggaaggucagguagguggaggc

SEQ ID NO: 3496535 - RNA, 19 nt, Pseudomonas aeruginosa PA01
ggaagguccuugggccagg

SEQ ID NO: 3496536 - RNA, 17 nt, Pseudomonas aeruginosa PA01
ggaaggucggcagcagc

SEQ ID NO: 3496537 - RNA, 14 nt, Pseudomonas aeruginosa PA01
ggaaggucucgccg

SEQ ID NO: 3496538 - RNA, 16 nt, Pseudomonas aeruginosa PA01
ggaaggucucgccgcc

SEQ ID NO: 3496539 - RNA, 16 nt, Pseudomonas aeruginosa PA01
ggaaguacggcgcggu

SEQ ID NO: 3496540 - RNA, 16 nt, Pseudomonas aeruginosa PA01
ggaaguagugcagcug

SEQ ID NO: 3496541 - RNA, 19 nt, Pseudomonas aeruginosa PA01
ggaaguauugcuccacccg

SEQ ID NO: 3496542 - RNA, 22 nt, Pseudomonas aeruginosa PA01
ggaaguauugcuccacccgcag

SEQ ID NO: 3496543 - RNA, 15 nt, Pseudomonas aeruginosa PA01
ggaaguccgggcgcg

SEQ ID NO: 3496544 - RNA, 19 nt, Pseudomonas aeruginosa PA01
ggaagucgaugaacgcgcg

SEQ ID NO: 3496545 - RNA, 16 nt, Pseudomonas aeruginosa PA01
ggaagucgcccugccc

SEQ ID NO: 3496546 - RNA, 19 nt, Pseudomonas aeruginosa PA01
ggaagucgcccugcccggu

SEQ ID NO: 3496547 - RNA, 14 nt, Pseudomonas aeruginosa PA01
ggaagucggcggcc

SEQ ID NO: 3496548 - RNA, 16 nt, Pseudomonas aeruginosa PA01
ggaagucggcggccgc

SEQ ID NO: 3496549 - RNA, 15 nt, Pseudomonas aeruginosa PA01
ggaaguggcagcgcc

SEQ ID NO: 3496550 - RNA, 16 nt, Pseudomonas aeruginosa PA01
ggaagugucgguugaa

SEQ ID NO: 3496551 - RNA, 14 nt, Pseudomonas aeruginosa PA01
ggaaguuaucgggg

SEQ ID NO: 3496552 - RNA, 20 nt, Pseudomonas aeruginosa PA01
ggaaguuaucggggccaggu

SEQ ID NO: 3496553 - RNA, 20 nt, Pseudomonas aeruginosa PA01
ggaaucaccacucgccagcg

SEQ ID NO: 3496554 - RNA, 14 nt, Pseudomonas aeruginosa PA01
ggaauccagggccg

SEQ ID NO: 3496555 - RNA, 21 nt, Pseudomonas aeruginosa PA01
ggaauccccaguagcgcuucg

SEQ ID NO: 3496556 - RNA, 14 nt, Pseudomonas aeruginosa PA01
ggaauccuccgcca

SEQ ID NO: 3496557 - RNA, 16 nt, Pseudomonas aeruginosa PA01
ggaauccuccgccagc

SEQ ID NO: 3496558 - RNA, 18 nt, Pseudomonas aeruginosa PA01
ggaauccuccgccagcgu

SEQ ID NO: 3496559 - RNA, 19 nt, Pseudomonas aeruginosa PA01
ggaauccuucgcggcggcg

SEQ ID NO: 3496560 - RNA, 20 nt, Pseudomonas aeruginosa PA01
ggaaucgacccagccgcacg

SEQ ID NO: 3496561 - RNA, 13 nt, Pseudomonas aeruginosa PA01
ggaaucgccagca

SEQ ID NO: 3496562 - RNA, 13 nt, Pseudomonas aeruginosa PA01
ggaaucgcgcccu

SEQ ID NO: 3496563 - RNA, 19 nt, Pseudomonas aeruginosa PA01
ggaaucgucacggcgugcc

SEQ ID NO: 3496564 - RNA, 13 nt, Pseudomonas aeruginosa PA01
ggaaucugcgcca

SEQ ID NO: 3496565 - RNA, 16 nt, Pseudomonas aeruginosa PA01
ggaaucugcgccaggu

SEQ ID NO: 3496566 - RNA, 22 nt, Pseudomonas aeruginosa PA01
ggaaugacuaucgggccgaucg

SEQ ID NO: 3496567 - RNA, 19 nt, Pseudomonas aeruginosa PA01
ggaaugauguacucgcggc

SEQ ID NO: 3496568 - RNA, 21 nt, Pseudomonas aeruginosa PA01
ggaaugcaaaaagcccacucg

SEQ ID NO: 3496569 - RNA, 13 nt, Pseudomonas aeruginosa PA01
ggaaugccggccg

SEQ ID NO: 3496570 - RNA, 16 nt, Pseudomonas aeruginosa PA01
ggaaugcucagcacgg

SEQ ID NO: 3496571 - RNA, 18 nt, Pseudomonas aeruginosa PA01
ggaauggagaugccgaac

SEQ ID NO: 3496572 - RNA, 18 nt, Pseudomonas aeruginosa PA01
ggaauggcgaugccgagg

SEQ ID NO: 3496573 - RNA, 12 nt, Pseudomonas aeruginosa PA01
ggaauggcgcgc

SEQ ID NO: 3496574 - RNA, 22 nt, Pseudomonas aeruginosa PA01
ggaauggcgcgcaaaaaaaggg

SEQ ID NO: 3496575 - RNA, 23 nt, Pseudomonas aeruginosa PA01
ggaauggcgcgcaaaaaaagggg

SEQ ID NO: 3496576 - RNA, 14 nt, Pseudomonas aeruginosa PA01
ggaauuccugcucg

SEQ ID NO: 3496577 - RNA, 12 nt, Pseudomonas aeruginosa PA01
ggaauucuuccg

SEQ ID NO: 3496578 - RNA, 13 nt, Pseudomonas aeruginosa PA01
ggacaacaggccg

SEQ ID NO: 3496579 - RNA, 16 nt, Pseudomonas aeruginosa PA01
ggacaacaggccgggc

SEQ ID NO: 3496580 - RNA, 17 nt, Pseudomonas aeruginosa PA01
ggacaacaggccgggcg

SEQ ID NO: 3496581 - RNA, 22 nt, Pseudomonas aeruginosa PA01
ggacaacaggccgggcggcggc

SEQ ID NO: 3496582 - RNA, 17 nt, Pseudomonas aeruginosa PA01
ggacaacccggcgcugg

SEQ ID NO: 3496583 - RNA, 20 nt, Pseudomonas aeruginosa PA01
ggacaacccggcgcuggccg

SEQ ID NO: 3496584 - RNA, 14 nt, Pseudomonas aeruginosa PA01
ggacaacgacagcc

SEQ ID NO: 3496585 - RNA, 17 nt, Pseudomonas aeruginosa PA01
ggacaacgacagccccg

SEQ ID NO: 3496586 - RNA, 22 nt, Pseudomonas aeruginosa PA01
ggacaacgacagccccggcccg

SEQ ID NO: 3496587 - RNA, 14 nt, Pseudomonas aeruginosa PA01
ggacaagcccagcu

SEQ ID NO: 3496588 - RNA, 18 nt, Pseudomonas aeruginosa PA01
ggacaagcgucgccggcc

SEQ ID NO: 3496589 - RNA, 16 nt, Pseudomonas aeruginosa PA01
ggacaagggccagagc

SEQ ID NO: 3496590 - RNA, 23 nt, Pseudomonas aeruginosa PA01
ggacaccccgaaacgguccacca

SEQ ID NO: 3496591 - RNA, 17 nt, Pseudomonas aeruginosa PA01
ggacacccugcugcugc

SEQ ID NO: 3496592 - RNA, 23 nt, Pseudomonas aeruginosa PA01
ggacaccgcggugucggugcccu

SEQ ID NO: 3496593 - RNA, 22 nt, Pseudomonas aeruginosa PA01
ggacaccucccgggccagcucc

SEQ ID NO: 3496594 - RNA, 17 nt, Pseudomonas aeruginosa PA01
ggacagcacgcucaggc

SEQ ID NO: 3496595 - RNA, 13 nt, Pseudomonas aeruginosa PA01
ggacagcaggcug

SEQ ID NO: 3496596 - RNA, 22 nt, Pseudomonas aeruginosa PA01
ggacagcgucugggugaccagc

SEQ ID NO: 3496597 - RNA, 19 nt, Pseudomonas aeruginosa PA01
ggacagcgugcggcccuug

SEQ ID NO: 3496598 - RNA, 20 nt, Pseudomonas aeruginosa PA01
ggacagcucgcgggacagcu

SEQ ID NO: 3496599 - RNA, 16 nt, Pseudomonas aeruginosa PA01
ggacagcuucugguug

SEQ ID NO: 3496600 - RNA, 20 nt, Pseudomonas aeruginosa PA01
ggacagcuugacccguugcg

SEQ ID NO: 3496601 - RNA, 23 nt, Pseudomonas aeruginosa PA01
ggacagcuugacccguugcgccu

SEQ ID NO: 3496602 - RNA, 14 nt, Pseudomonas aeruginosa PA01
ggacaggcagccgg

SEQ ID NO: 3496603 - RNA, 18 nt, Pseudomonas aeruginosa PA01
ggacaggcauuccgggca

SEQ ID NO: 3496604 - RNA, 16 nt, Pseudomonas aeruginosa PA01
ggacaggccacccgcc

SEQ ID NO: 3496605 - RNA, 12 nt, Pseudomonas aeruginosa PA01
ggacaggccgac

SEQ ID NO: 3496606 - RNA, 16 nt, Pseudomonas aeruginosa PA01
ggacagggccaggccg

SEQ ID NO: 3496607 - RNA, 22 nt, Pseudomonas aeruginosa PA01
ggacagguccuggaacaggaag

SEQ ID NO: 3496608 - RNA, 16 nt, Pseudomonas aeruginosa PA01
ggacaggucgacggcc

SEQ ID NO: 3496609 - RNA, 21 nt, Pseudomonas aeruginosa PA01
ggacaggucgcggaagugcgg

SEQ ID NO: 3496610 - RNA, 18 nt, Pseudomonas aeruginosa PA01
ggacagguuggcgccggg

SEQ ID NO: 3496611 - RNA, 20 nt, Pseudomonas aeruginosa PA01
ggacagguuggcgccgggcg

SEQ ID NO: 3496612 - RNA, 17 nt, Pseudomonas aeruginosa PA01
ggacagguugucgacca

SEQ ID NO: 3496613 - RNA, 15 nt, Pseudomonas aeruginosa PA01
ggacauacaggcgcg

SEQ ID NO: 3496614 - RNA, 14 nt, Pseudomonas aeruginosa PA01
ggacaucccggggu

SEQ ID NO: 3496615 - RNA, 22 nt, Pseudomonas aeruginosa PA01
ggacauggagaccuggcugaau

SEQ ID NO: 3496616 - RNA, 20 nt, Pseudomonas aeruginosa PA01
ggacauggcgcucgagcuug

SEQ ID NO: 3496617 - RNA, 16 nt, Pseudomonas aeruginosa PA01
ggacaugucgagggcc

SEQ ID NO: 3496618 - RNA, 19 nt, Pseudomonas aeruginosa PA01
ggaccaccguggcgccggc

SEQ ID NO: 3496619 - RNA, 18 nt, Pseudomonas aeruginosa PA01
ggaccacgcucaggucgg

SEQ ID NO: 3496620 - RNA, 19 nt, Pseudomonas aeruginosa PA01
ggaccagaggcugacccgc

SEQ ID NO: 3496621 - RNA, 12 nt, Pseudomonas aeruginosa PA01
ggaccagcccgu

SEQ ID NO: 3496622 - RNA, 15 nt, Pseudomonas aeruginosa PA01
ggaccagccgguccc

SEQ ID NO: 3496623 - RNA, 22 nt, Pseudomonas aeruginosa PA01
ggaccagccggucccgggcucc

SEQ ID NO: 3496624 - RNA, 21 nt, Pseudomonas aeruginosa PA01
ggaccagccguccgcgggcga

SEQ ID NO: 3496625 - RNA, 13 nt, Pseudomonas aeruginosa PA01
ggaccagcgccgc

SEQ ID NO: 3496626 - RNA, 14 nt, Pseudomonas aeruginosa PA01
ggaccagcgccugc

SEQ ID NO: 3496627 - RNA, 17 nt, Pseudomonas aeruginosa PA01
ggaccagcgccugcugc

SEQ ID NO: 3496628 - RNA, 12 nt, Pseudomonas aeruginosa PA01
ggaccagcuccg

SEQ ID NO: 3496629 - RNA, 17 nt, Pseudomonas aeruginosa PA01
ggaccaggcggccggug

SEQ ID NO: 3496630 - RNA, 17 nt, Pseudomonas aeruginosa PA01
ggaccaguucagcgcgc

SEQ ID NO: 3496631 - RNA, 21 nt, Pseudomonas aeruginosa PA01
ggaccaguucagcgcgcucgc

SEQ ID NO: 3496632 - RNA, 16 nt, Pseudomonas aeruginosa PA01
ggaccaguucgccgcc

SEQ ID NO: 3496633 - RNA, 21 nt, Pseudomonas aeruginosa PA01
ggaccaguucgccgccgcgcu

SEQ ID NO: 3496634 - RNA, 15 nt, Pseudomonas aeruginosa PA01
ggaccaucaccaccu

SEQ ID NO: 3496635 - RNA, 12 nt, Pseudomonas aeruginosa PA01
ggaccauggccg

SEQ ID NO: 3496636 - RNA, 14 nt, Pseudomonas aeruginosa PA01
ggaccauggccggc

SEQ ID NO: 3496637 - RNA, 15 nt, Pseudomonas aeruginosa PA01
ggaccauggccggcg

SEQ ID NO: 3496638 - RNA, 16 nt, Pseudomonas aeruginosa PA01
ggaccauggccggcgu

SEQ ID NO: 3496639 - RNA, 21 nt, Pseudomonas aeruginosa PA01
ggaccaugucgcacuggucgg

SEQ ID NO: 3496640 - RNA, 22 nt, Pseudomonas aeruginosa PA01
ggacccagaaaccgaucagcac

SEQ ID NO: 3496641 - RNA, 14 nt, Pseudomonas aeruginosa PA01
ggacccaguugggc

SEQ ID NO: 3496642 - RNA, 19 nt, Pseudomonas aeruginosa PA01
ggacccaguugggccagga

SEQ ID NO: 3496643 - RNA, 17 nt, Pseudomonas aeruginosa PA01
ggacccaucgaugcuca

SEQ ID NO: 3496644 - RNA, 15 nt, Pseudomonas aeruginosa PA01
ggacccgcaccugga

SEQ ID NO: 3496645 - RNA, 21 nt, Pseudomonas aeruginosa PA01
ggacccgcgccggcagcucgg

SEQ ID NO: 3496646 - RNA, 19 nt, Pseudomonas aeruginosa PA01
ggacccgcucggccuuagc

SEQ ID NO: 3496647 - RNA, 14 nt, Pseudomonas aeruginosa PA01
ggacccgggccucc

SEQ ID NO: 3496648 - RNA, 20 nt, Pseudomonas aeruginosa PA01
ggacccguugccgaccgagc

SEQ ID NO: 3496649 - RNA, 22 nt, Pseudomonas aeruginosa PA01
ggacccguugccgaccgagcag

SEQ ID NO: 3496650 - RNA, 20 nt, Pseudomonas aeruginosa PA01
ggacccugccguucgucacc

SEQ ID NO: 3496651 - RNA, 20 nt, Pseudomonas aeruginosa PA01
ggacccugguaguccagcag

SEQ ID NO: 3496652 - RNA, 18 nt, Pseudomonas aeruginosa PA01
ggaccgaaggcaacagcc

SEQ ID NO: 3496653 - RNA, 21 nt, Pseudomonas aeruginosa PA01
ggaccgaaggcaacagcccgc

SEQ ID NO: 3496654 - RNA, 20 nt, Pseudomonas aeruginosa PA01
ggaccgacggcaacugagcg

SEQ ID NO: 3496655 - RNA, 14 nt, Pseudomonas aeruginosa PA01
ggaccgcaaccggu

SEQ ID NO: 3496656 - RNA, 17 nt, Pseudomonas aeruginosa PA01
ggaccgcaccuggugga

SEQ ID NO: 3496657 - RNA, 14 nt, Pseudomonas aeruginosa PA01
ggaccgccauggcg

SEQ ID NO: 3496658 - RNA, 14 nt, Pseudomonas aeruginosa PA01
ggaccggcucgucg

SEQ ID NO: 3496659 - RNA, 22 nt, Pseudomonas aeruginosa PA01
ggaccggcucucuucggccgau

SEQ ID NO: 3496660 - RNA, 14 nt, Pseudomonas aeruginosa PA01
ggaccgggcggcag

SEQ ID NO: 3496661 - RNA, 16 nt, Pseudomonas aeruginosa PA01
ggaccgggcggcaggc

SEQ ID NO: 3496662 - RNA, 17 nt, Pseudomonas aeruginosa PA01
ggaccgggcggcaggcg

SEQ ID NO: 3496663 - RNA, 12 nt, Pseudomonas aeruginosa PA01
ggaccgugguga

SEQ ID NO: 3496664 - RNA, 12 nt, Pseudomonas aeruginosa PA01
ggaccuccagcc

SEQ ID NO: 3496665 - RNA, 18 nt, Pseudomonas aeruginosa PA01
ggaccuccagccggccau

SEQ ID NO: 3496666 - RNA, 22 nt, Pseudomonas aeruginosa PA01
gcugugugccucugaccgcgcc

SEQ ID NO: 3496667 - RNA, 13 nt, Pseudomonas aeruginosa PA01
gcuguucuucagu

SEQ ID NO: 3496668 - RNA, 19 nt, Pseudomonas aeruginosa PA01
gcuguucuugauccgcucc

SEQ ID NO: 3496669 - RNA, 14 nt, Pseudomonas aeruginosa PA01
gcuguugcccuggg

SEQ ID NO: 3496670 - RNA, 20 nt, Pseudomonas aeruginosa PA01
gcuguugccgcugcaggcca

SEQ ID NO: 3496671 - RNA, 17 nt, Pseudomonas aeruginosa PA01
gcuguuggccugggcga

SEQ ID NO: 3496672 - RNA, 14 nt, Pseudomonas aeruginosa PA01
gcuguugguguuga

SEQ ID NO: 3496673 - RNA, 21 nt, Pseudomonas aeruginosa PA01
gcuguuucagcccacgcgccu

SEQ ID NO: 3496674 - RNA, 15 nt, Pseudomonas aeruginosa PA01
gcuguuucaggccgg

SEQ ID NO: 3496675 - RNA, 17 nt, Pseudomonas aeruginosa PA01
gcuguuucaggccggcg

SEQ ID NO: 3496676 - RNA, 21 nt, Pseudomonas aeruginosa PA01
gcuguuucuccaguucggcga

SEQ ID NO: 3496677 - RNA, 23 nt, Pseudomonas aeruginosa PA01
gcuguuugcggcgcaggcggauc

SEQ ID NO: 3496678 - RNA, 22 nt, Pseudomonas aeruginosa PA01
gcuuaaagcaacgcggagcagg

SEQ ID NO: 3496679 - RNA, 19 nt, Pseudomonas aeruginosa PA01
gcuuaauacggcgcaggcu

SEQ ID NO: 3496680 - RNA, 17 nt, Pseudomonas aeruginosa PA01
gcuuaccuugccggugc

SEQ ID NO: 3496681 - RNA, 14 nt, Pseudomonas aeruginosa PA01
gcuuacgcggccuu

SEQ ID NO: 3496682 - RNA, 21 nt, Pseudomonas aeruginosa PA01
gcuucaaccguggcucgauga

SEQ ID NO: 3496683 - RNA, 13 nt, Pseudomonas aeruginosa PA01
gcuucaagcggcc

SEQ ID NO: 3496684 - RNA, 13 nt, Pseudomonas aeruginosa PA01
gcuucaccagagc

SEQ ID NO: 3496685 - RNA, 14 nt, Pseudomonas aeruginosa PA01
gcuucaccggugcc

SEQ ID NO: 3496686 - RNA, 14 nt, Pseudomonas aeruginosa PA01
gcuucacucauccu

SEQ ID NO: 3496687 - RNA, 13 nt, Pseudomonas aeruginosa PA01
gcuucagcccggc

SEQ ID NO: 3496688 - RNA, 23 nt, Pseudomonas aeruginosa PA01
gcuucagccgaccguccgccugc

SEQ ID NO: 3496689 - RNA, 16 nt, Pseudomonas aeruginosa PA01
gcuucagcgagcgguc

SEQ ID NO: 3496690 - RNA, 15 nt, Pseudomonas aeruginosa PA01
gcuucagcgccaggc

SEQ ID NO: 3496691 - RNA, 16 nt, Pseudomonas aeruginosa PA01
gcuucagcgccaggcc

SEQ ID NO: 3496692 - RNA, 18 nt, Pseudomonas aeruginosa PA01
gcuucagcgccaggccga

SEQ ID NO: 3496693 - RNA, 15 nt, Pseudomonas aeruginosa PA01
gcuucagcgccgggu

SEQ ID NO: 3496694 - RNA, 23 nt, Pseudomonas aeruginosa PA01
gcuucagcgccgggucgaccuug

SEQ ID NO: 3496695 - RNA, 19 nt, Pseudomonas aeruginosa PA01
gcuucagcgccucgaccug

SEQ ID NO: 3496696 - RNA, 17 nt, Pseudomonas aeruginosa PA01
gcuucagcgcgccgagc

SEQ ID NO: 3496697 - RNA, 15 nt, Pseudomonas aeruginosa PA01
gcuucagcuccgagc

SEQ ID NO: 3496698 - RNA, 18 nt, Pseudomonas aeruginosa PA01
gcuucagcuccgagccac

SEQ ID NO: 3496699 - RNA, 17 nt, Pseudomonas aeruginosa PA01
gcuucagcucgaggcca

SEQ ID NO: 3496700 - RNA, 21 nt, Pseudomonas aeruginosa PA01
gcuucagcucgaggccaggau

SEQ ID NO: 3496701 - RNA, 13 nt, Pseudomonas aeruginosa PA01
gcuucaggcaguc

SEQ ID NO: 3496702 - RNA, 20 nt, Pseudomonas aeruginosa PA01
gcuucaggcaguccuugagc

SEQ ID NO: 3496703 - RNA, 12 nt, Pseudomonas aeruginosa PA01
gcuucaggcgca

SEQ ID NO: 3496704 - RNA, 18 nt, Pseudomonas aeruginosa PA01
gcuucaggcgcgcggcca

SEQ ID NO: 3496705 - RNA, 16 nt, Pseudomonas aeruginosa PA01
gcuucaggcucggccu

SEQ ID NO: 3496706 - RNA, 17 nt, Pseudomonas aeruginosa PA01
gcuucaggcucggccug

SEQ ID NO: 3496707 - RNA, 18 nt, Pseudomonas aeruginosa PA01
gcuucaggcucggccugu

SEQ ID NO: 3496708 - RNA, 19 nt, Pseudomonas aeruginosa PA01
gcuucaggguggcgcugcc

SEQ ID NO: 3496709 - RNA, 22 nt, Pseudomonas aeruginosa PA01
gcuucaggguggcgcugccuuc

SEQ ID NO: 3496710 - RNA, 19 nt, Pseudomonas aeruginosa PA01
gcuucaggucgucgggcag

SEQ ID NO: 3496711 - RNA, 16 nt, Pseudomonas aeruginosa PA01
gcuucaucaggcugcu

SEQ ID NO: 3496712 - RNA, 17 nt, Pseudomonas aeruginosa PA01
gcuucauccugcgcgcc

SEQ ID NO: 3496713 - RNA, 19 nt, Pseudomonas aeruginosa PA01
gcuucauccugcgcgccuc

SEQ ID NO: 3496714 - RNA, 19 nt, Pseudomonas aeruginosa PA01
gcuucaucgaggugcuuga

SEQ ID NO: 3496715 - RNA, 23 nt, Pseudomonas aeruginosa PA01
gcuucaucgcgccaaugccgucg

SEQ ID NO: 3496716 - RNA, 18 nt, Pseudomonas aeruginosa PA01
gcuucaugaagucagcca

SEQ ID NO: 3496717 - RNA, 17 nt, Pseudomonas aeruginosa PA01
gcuuccaccagacgcag

SEQ ID NO: 3496718 - RNA, 22 nt, Pseudomonas aeruginosa PA01
gcuuccaccagacgcagcaugu

SEQ ID NO: 3496719 - RNA, 18 nt, Pseudomonas aeruginosa PA01
gcuuccaccgccugcccc

SEQ ID NO: 3496720 - RNA, 19 nt, Pseudomonas aeruginosa PA01
gcuuccaccgccugcccca

SEQ ID NO: 3496721 - RNA, 21 nt, Pseudomonas aeruginosa PA01
gcuuccacgcugaggcucagc

SEQ ID NO: 3496722 - RNA, 19 nt, Pseudomonas aeruginosa PA01
gcuuccagaccucgagcag

SEQ ID NO: 3496723 - RNA, 20 nt, Pseudomonas aeruginosa PA01
gcuuccagaccucgagcagg

SEQ ID NO: 3496724 - RNA, 23 nt, Pseudomonas aeruginosa PA01
gcuuccagaggcauucaucacca

SEQ ID NO: 3496725 - RNA, 14 nt, Pseudomonas aeruginosa PA01
gcuuccagccagcc

SEQ ID NO: 3496726 - RNA, 17 nt, Pseudomonas aeruginosa PA01
gcuuccagccagcccuc

SEQ ID NO: 3496727 - RNA, 17 nt, Pseudomonas aeruginosa PA01
gcuuccagcuuggcacg

SEQ ID NO: 3496728 - RNA, 23 nt, Pseudomonas aeruginosa PA01
gcuuccagcuuggcacggccggc

SEQ ID NO: 3496729 - RNA, 13 nt, Pseudomonas aeruginosa PA01
gcuuccaggcgcg

SEQ ID NO: 3496730 - RNA, 20 nt, Pseudomonas aeruginosa PA01
gcuuccagggucgagggcau

SEQ ID NO: 3496731 - RNA, 15 nt, Pseudomonas aeruginosa PA01
gcuucccaggccagc

SEQ ID NO: 3496732 - RNA, 19 nt, Pseudomonas aeruginosa PA01
gcuucccaggccagcgggc

SEQ ID NO: 3496733 - RNA, 15 nt, Pseudomonas aeruginosa PA01
gcuucccgcauggca

SEQ ID NO: 3496734 - RNA, 15 nt, Pseudomonas aeruginosa PA01
gcuucccgcggcucc

SEQ ID NO: 3496735 - RNA, 18 nt, Pseudomonas aeruginosa PA01
gcuucccgcggcuccagc

SEQ ID NO: 3496736 - RNA, 19 nt, Pseudomonas aeruginosa PA01
gcuuccgagcaguugcaga

SEQ ID NO: 3496737 - RNA, 16 nt, Pseudomonas aeruginosa PA01
gcuuccgccaggcgca

SEQ ID NO: 3496738 - RNA, 18 nt, Pseudomonas aeruginosa PA01
gcuuccgccaggcgcagc

SEQ ID NO: 3496739 - RNA, 15 nt, Pseudomonas aeruginosa PA01
gcuuccgccgccagg

SEQ ID NO: 3496740 - RNA, 16 nt, Pseudomonas aeruginosa PA01
gcuuccgccgccaggu

SEQ ID NO: 3496741 - RNA, 23 nt, Pseudomonas aeruginosa PA01
gcuuccgcgcggcgcccugccgg

SEQ ID NO: 3496742 - RNA, 14 nt, Pseudomonas aeruginosa PA01
gcuuccggcagcca

SEQ ID NO: 3496743 - RNA, 16 nt, Pseudomonas aeruginosa PA01
gcuuccggcagccagc

SEQ ID NO: 3496744 - RNA, 19 nt, Pseudomonas aeruginosa PA01
gcuuccggcagccagccgc

SEQ ID NO: 3496745 - RNA, 15 nt, Pseudomonas aeruginosa PA01
gcuuccggcccggcc

SEQ ID NO: 3496746 - RNA, 12 nt, Pseudomonas aeruginosa PA01
gcuuccggcgcc

SEQ ID NO: 3496747 - RNA, 14 nt, Pseudomonas aeruginosa PA01
gcuuccggcgcucc

SEQ ID NO: 3496748 - RNA, 16 nt, Pseudomonas aeruginosa PA01
gcuuccggcgcuccac

SEQ ID NO: 3496749 - RNA, 15 nt, Pseudomonas aeruginosa PA01
gcuuccggcuccagu

SEQ ID NO: 3496750 - RNA, 12 nt, Pseudomonas aeruginosa PA01
gcuuccguaggu

SEQ ID NO: 3496751 - RNA, 16 nt, Pseudomonas aeruginosa PA01
gcuuccuccaucgccu

SEQ ID NO: 3496752 - RNA, 15 nt, Pseudomonas aeruginosa PA01
gcuuccucgcccuca

SEQ ID NO: 3496753 - RNA, 13 nt, Pseudomonas aeruginosa PA01
gcuuccucgcucg

SEQ ID NO: 3496754 - RNA, 13 nt, Pseudomonas aeruginosa PA01
gcuuccucggcac

SEQ ID NO: 3496755 - RNA, 22 nt, Pseudomonas aeruginosa PA01
gcuuccucggcacucagccagc

SEQ ID NO: 3496756 - RNA, 23 nt, Pseudomonas aeruginosa PA01
gcuuccugcuugucgauggucag

SEQ ID NO: 3496757 - RNA, 22 nt, Pseudomonas aeruginosa PA01
gcuuccugggaauugcgcacgc

SEQ ID NO: 3496758 - RNA, 19 nt, Pseudomonas aeruginosa PA01
gcuuccugggcuucguccg

SEQ ID NO: 3496759 - RNA, 12 nt, Pseudomonas aeruginosa PA01
gcuuccuugccc

SEQ ID NO: 3496760 - RNA, 18 nt, Pseudomonas aeruginosa PA01
gcuucgaacgugcgcgca

SEQ ID NO: 3496761 - RNA, 14 nt, Pseudomonas aeruginosa PA01
gcuucgaagcucuc

SEQ ID NO: 3496762 - RNA, 17 nt, Pseudomonas aeruginosa PA01
gcuucgaccagggcauc

SEQ ID NO: 3496763 - RNA, 18 nt, Pseudomonas aeruginosa PA01
gcuucgagcaccccgagc

SEQ ID NO: 3496764 - RNA, 23 nt, Pseudomonas aeruginosa PA01
gcuucgagcaccccgagcccggc

SEQ ID NO: 3496765 - RNA, 17 nt, Pseudomonas aeruginosa PA01
gcuucgagcacuuccca

SEQ ID NO: 3496766 - RNA, 18 nt, Pseudomonas aeruginosa PA01
gcuucgagcacuucccag

SEQ ID NO: 3496767 - RNA, 16 nt, Pseudomonas aeruginosa PA01
gcuucgaggcgggcgu

SEQ ID NO: 3496768 - RNA, 17 nt, Pseudomonas aeruginosa PA01
gcuucgcagaugucggu

SEQ ID NO: 3496769 - RNA, 20 nt, Pseudomonas aeruginosa PA01
gcuucgccaucgauggucac

SEQ ID NO: 3496770 - RNA, 22 nt, Pseudomonas aeruginosa PA01
gcuucgcccuacgcggcaccgc

SEQ ID NO: 3496771 - RNA, 16 nt, Pseudomonas aeruginosa PA01
gcuucgccgcccugga

SEQ ID NO: 3496772 - RNA, 12 nt, Pseudomonas aeruginosa PA01
gcuucgccgccg

SEQ ID NO: 3496773 - RNA, 18 nt, Pseudomonas aeruginosa PA01
gcuucgccgccgcgcgcg

SEQ ID NO: 3496774 - RNA, 14 nt, Pseudomonas aeruginosa PA01
gcuucgccgcgcaa

SEQ ID NO: 3496775 - RNA, 19 nt, Pseudomonas aeruginosa PA01
gcuucgccgcgcaagcucg

SEQ ID NO: 3496776 - RNA, 19 nt, Pseudomonas aeruginosa PA01
gcuucgcgaucggcguccg

SEQ ID NO: 3496777 - RNA, 16 nt, Pseudomonas aeruginosa PA01
gcuucgcgcuccaggc

SEQ ID NO: 3496778 - RNA, 17 nt, Pseudomonas aeruginosa PA01
gcuucgcgcuccaggcc

SEQ ID NO: 3496779 - RNA, 22 nt, Pseudomonas aeruginosa PA01
gcuucgcgggugaccuggccgc

SEQ ID NO: 3496780 - RNA, 20 nt, Pseudomonas aeruginosa PA01
gcuucgcguugcaggcgacg

SEQ ID NO: 3496781 - RNA, 17 nt, Pseudomonas aeruginosa PA01
gcuucgcugaugccggc

SEQ ID NO: 3496782 - RNA, 17 nt, Pseudomonas aeruginosa PA01
gcuucggcgcgcugguu

SEQ ID NO: 3496783 - RNA, 14 nt, Pseudomonas aeruginosa PA01
gcuucggcggcuuc

SEQ ID NO: 3496784 - RNA, 12 nt, Pseudomonas aeruginosa PA01
gcuucggcgggg

SEQ ID NO: 3496785 - RNA, 14 nt, Pseudomonas aeruginosa PA01
gcuucggcuccagc

SEQ ID NO: 3496786 - RNA, 19 nt, Pseudomonas aeruginosa PA01
gcuucggcuccagcaccag

SEQ ID NO: 3496787 - RNA, 20 nt, Pseudomonas aeruginosa PA01
gcuucggcuccagcaccagc

SEQ ID NO: 3496788 - RNA, 16 nt, Pseudomonas aeruginosa PA01
gcuucggucagguggg

SEQ ID NO: 3496789 - RNA, 15 nt, Pseudomonas aeruginosa PA01
gcuucgguguaucgg

SEQ ID NO: 3496790 - RNA, 19 nt, Pseudomonas aeruginosa PA01
gcuucgguguaucggcgga

SEQ ID NO: 3496791 - RNA, 13 nt, Pseudomonas aeruginosa PA01
gcuucguccagcg

SEQ ID NO: 3496792 - RNA, 14 nt, Pseudomonas aeruginosa PA01
gcuucguccagcga

SEQ ID NO: 3496793 - RNA, 16 nt, Pseudomonas aeruginosa PA01
gcuucguccugcugcu

SEQ ID NO: 3496794 - RNA, 16 nt, Pseudomonas aeruginosa PA01
gcuucguugccauagc

SEQ ID NO: 3496795 - RNA, 16 nt, Pseudomonas aeruginosa PA01
gcuucguugcuccugc

SEQ ID NO: 3496796 - RNA, 21 nt, Pseudomonas aeruginosa PA01
gcuucuacgccuugcggcgcc

SEQ ID NO: 3496797 - RNA, 23 nt, Pseudomonas aeruginosa PA01
gcuucucaccgaggaucggcacg

SEQ ID NO: 3496798 - RNA, 15 nt, Pseudomonas aeruginosa PA01
gcuucuccaccggau

SEQ ID NO: 3496799 - RNA, 22 nt, Pseudomonas aeruginosa PA01
gcuucuccaccggaucgcccug

SEQ ID NO: 3496800 - RNA, 13 nt, Pseudomonas aeruginosa PA01
gcuucuccucggc

SEQ ID NO: 3496801 - RNA, 14 nt, Pseudomonas aeruginosa PA01
gcuucucggcuacc

SEQ ID NO: 3496802 - RNA, 20 nt, Pseudomonas aeruginosa PA01
gcuucucggcuaccccacgc

SEQ ID NO: 3496803 - RNA, 20 nt, Pseudomonas aeruginosa PA01
gcuucucgguagggccgagg

SEQ ID NO: 3496804 - RNA, 14 nt, Pseudomonas aeruginosa PA01
gcuucucgucgccg

SEQ ID NO: 3496805 - RNA, 18 nt, Pseudomonas aeruginosa PA01
gcuucucgucgccgccgu

SEQ ID NO: 3496806 - RNA, 17 nt, Pseudomonas aeruginosa PA01
gcuucugcgccuccucg

SEQ ID NO: 3496807 - RNA, 15 nt, Pseudomonas aeruginosa PA01
gcuucugcucggccu

SEQ ID NO: 3496808 - RNA, 16 nt, Pseudomonas aeruginosa PA01
gcuucugcucggccug

SEQ ID NO: 3496809 - RNA, 23 nt, Pseudomonas aeruginosa PA01
gcuucugcucggccuggaucgcc

SEQ ID NO: 3496810 - RNA, 13 nt, Pseudomonas aeruginosa PA01
gcuucugcuggcc

SEQ ID NO: 3496811 - RNA, 14 nt, Pseudomonas aeruginosa PA01
gcuucugcuggccg

SEQ ID NO: 3496812 - RNA, 17 nt, Pseudomonas aeruginosa PA01
gcuucuggaaggcgguc

SEQ ID NO: 3496813 - RNA, 12 nt, Pseudomonas aeruginosa PA01
gcuucugguugu

SEQ ID NO: 3496814 - RNA, 21 nt, Pseudomonas aeruginosa PA01
gcuucugguuguaagcgucgg

SEQ ID NO: 3496815 - RNA, 19 nt, Pseudomonas aeruginosa PA01
gcuucugucccugggccau

SEQ ID NO: 3496816 - RNA, 15 nt, Pseudomonas aeruginosa PA01
gcuucugugggcagc

SEQ ID NO: 3496817 - RNA, 15 nt, Pseudomonas aeruginosa PA01
gcuucuuccuggccg

SEQ ID NO: 3496818 - RNA, 17 nt, Pseudomonas aeruginosa PA01
gcuucuuccuggccggg

SEQ ID NO: 3496819 - RNA, 15 nt, Pseudomonas aeruginosa PA01
gcuucuucugcagcu

SEQ ID NO: 3496820 - RNA, 16 nt, Pseudomonas aeruginosa PA01
gcuucuugccuuccac

SEQ ID NO: 3496821 - RNA, 20 nt, Pseudomonas aeruginosa PA01
gcuugaaccgcgagaccccg

SEQ ID NO: 3496822 - RNA, 17 nt, Pseudomonas aeruginosa PA01
gcuugaacgcgcgccug

SEQ ID NO: 3496823 - RNA, 15 nt, Pseudomonas aeruginosa PA01
gcuugaagccggcgu

SEQ ID NO: 3496824 - RNA, 23 nt, Pseudomonas aeruginosa PA01
gcuugaccaccaugugcuggcgg

SEQ ID NO: 3496825 - RNA, 14 nt, Pseudomonas aeruginosa PA01
gcuugaccgccgcc

SEQ ID NO: 3496826 - RNA, 16 nt, Pseudomonas aeruginosa PA01
gcuugaccgccgccgc

SEQ ID NO: 3496827 - RNA, 17 nt, Pseudomonas aeruginosa PA01
gcuugaccuugccgccg

SEQ ID NO: 3496828 - RNA, 18 nt, Pseudomonas aeruginosa PA01
gcuugaccuugccgccgg

SEQ ID NO: 3496829 - RNA, 16 nt, Pseudomonas aeruginosa PA01
gcuugacgaaggcggc

SEQ ID NO: 3496830 - RNA, 16 nt, Pseudomonas aeruginosa PA01
gcuugacgaucuucug

SEQ ID NO: 3496831 - RNA, 17 nt, Pseudomonas aeruginosa PA01
gcuugagccauucggcu

SEQ ID NO: 3496832 - RNA, 16 nt, Pseudomonas aeruginosa PA01
gcuugagccccggcag

SEQ ID NO: 3496833 - RNA, 22 nt, Pseudomonas aeruginosa PA01
gcuugagguaggccagccccag

SEQ ID NO: 3496834 - RNA, 22 nt, Pseudomonas aeruginosa PA01
gcuugaggucggccucgagcau

SEQ ID NO: 3496835 - RNA, 21 nt, Pseudomonas aeruginosa PA01
gcuugaggucgugcagcacau

SEQ ID NO: 3496836 - RNA, 23 nt, Pseudomonas aeruginosa PA01
gcuugaucgagcccuugcgcggc

SEQ ID NO: 3496837 - RNA, 20 nt, Pseudomonas aeruginosa PA01
gcuugaucgagucgccggcg

SEQ ID NO: 3496838 - RNA, 21 nt, Pseudomonas aeruginosa PA01
gcuugauguaggacaggccga

SEQ ID NO: 3496839 - RNA, 15 nt, Pseudomonas aeruginosa PA01
gcuugcaauccgugc

SEQ ID NO: 3496840 - RNA, 15 nt, Pseudomonas aeruginosa PA01
gcuugcacaccuggu

SEQ ID NO: 3496841 - RNA, 13 nt, Pseudomonas aeruginosa PA01
gcuugcagguagc

SEQ ID NO: 3496842 - RNA, 15 nt, Pseudomonas aeruginosa PA01
gcuugcagucgaaaa

SEQ ID NO: 3496843 - RNA, 16 nt, Pseudomonas aeruginosa PA01
gcuugcaguucagcca

SEQ ID NO: 3496844 - RNA, 20 nt, Pseudomonas aeruginosa PA01
gcuugcaguucagccacugc

SEQ ID NO: 3496845 - RNA, 18 nt, Pseudomonas aeruginosa PA01
gcuugccacugcgcgcca

SEQ ID NO: 3496846 - RNA, 19 nt, Pseudomonas aeruginosa PA01
gcuugccacugcgcgccag

SEQ ID NO: 3496847 - RNA, 15 nt, Pseudomonas aeruginosa PA01
gcuugcccagguagu

SEQ ID NO: 3496848 - RNA, 16 nt, Pseudomonas aeruginosa PA01
gcuugccgagcugggc

SEQ ID NO: 3496849 - RNA, 19 nt, Pseudomonas aeruginosa PA01
gcuugccgagguucuucca

SEQ ID NO: 3496850 - RNA, 21 nt, Pseudomonas aeruginosa PA01
gcuugccgaugucgccggcau

SEQ ID NO: 3496851 - RNA, 18 nt, Pseudomonas aeruginosa PA01
gcuugccgcgcccggcca

SEQ ID NO: 3496852 - RNA, 13 nt, Pseudomonas aeruginosa PA01
gcuugccggcagc

SEQ ID NO: 3496853 - RNA, 13 nt, Pseudomonas aeruginosa PA01
gcuugccggcgac

SEQ ID NO: 3496854 - RNA, 12 nt, Pseudomonas aeruginosa PA01
gcuugccggcgc

SEQ ID NO: 3496855 - RNA, 14 nt, Pseudomonas aeruginosa PA01
gcuugccggcgcgc

SEQ ID NO: 3496856 - RNA, 15 nt, Pseudomonas aeruginosa PA01
gcuugccggcgcgcg

SEQ ID NO: 3496857 - RNA, 13 nt, Pseudomonas aeruginosa PA01
gcuugccggcggc

SEQ ID NO: 3496858 - RNA, 15 nt, Pseudomonas aeruginosa PA01
gcuugccggcggcgc

SEQ ID NO: 3496859 - RNA, 13 nt, Pseudomonas aeruginosa PA01
gcuugccgggguc

SEQ ID NO: 3496860 - RNA, 17 nt, Pseudomonas aeruginosa PA01
gcuugccggggucgagg

SEQ ID NO: 3496861 - RNA, 15 nt, Pseudomonas aeruginosa PA01
gcuugccgguagggc

SEQ ID NO: 3496862 - RNA, 14 nt, Pseudomonas aeruginosa PA01
gcuugccguccagc

SEQ ID NO: 3496863 - RNA, 18 nt, Pseudomonas aeruginosa PA01
gcuugccguccagcgaga

SEQ ID NO: 3496864 - RNA, 19 nt, Pseudomonas aeruginosa PA01
gcuugccguccagcgagaa

SEQ ID NO: 3496865 - RNA, 14 nt, Pseudomonas aeruginosa PA01
gcuugccgucggug

SEQ ID NO: 3496866 - RNA, 20 nt, Pseudomonas aeruginosa PA01
gcuugccguuggcgucgcgc

SEQ ID NO: 3496867 - RNA, 16 nt, Pseudomonas aeruginosa PA01
gcuugccuuccaggcu

SEQ ID NO: 3496868 - RNA, 14 nt, Pseudomonas aeruginosa PA01
gcuugccuuccugg

SEQ ID NO: 3496869 - RNA, 15 nt, Pseudomonas aeruginosa PA01
gcuugcgcaccuccu

SEQ ID NO: 3496870 - RNA, 15 nt, Pseudomonas aeruginosa PA01
gcuugcgcagcaucu

SEQ ID NO: 3496871 - RNA, 19 nt, Pseudomonas aeruginosa PA01
gcuugcgcagcaucuucuc

SEQ ID NO: 3496872 - RNA, 18 nt, Pseudomonas aeruginosa PA01
gcuugcgcccccaacgga

SEQ ID NO: 3496873 - RNA, 14 nt, Pseudomonas aeruginosa PA01
gcuugcgccgccuc

SEQ ID NO: 3496874 - RNA, 17 nt, Pseudomonas aeruginosa PA01
gcuugcgccgccucgcg

SEQ ID NO: 3496875 - RNA, 15 nt, Pseudomonas aeruginosa PA01
gcuugcgccguggca

SEQ ID NO: 3496876 - RNA, 16 nt, Pseudomonas aeruginosa PA01
gcuugcgcgccgccgc

SEQ ID NO: 3496877 - RNA, 21 nt, Pseudomonas aeruginosa PA01
gcuugcgcgccgccgccgcgg

SEQ ID NO: 3496878 - RNA, 17 nt, Pseudomonas aeruginosa PA01
gcuugcgcucagggaca

SEQ ID NO: 3496879 - RNA, 15 nt, Pseudomonas aeruginosa PA01
gcuugcgggcgcgcc

SEQ ID NO: 3496880 - RNA, 17 nt, Pseudomonas aeruginosa PA01
gcuugcgggcgcgccug

SEQ ID NO: 3496881 - RNA, 19 nt, Pseudomonas aeruginosa PA01
gcuugcgguaguccacgga

SEQ ID NO: 3496882 - RNA, 17 nt, Pseudomonas aeruginosa PA01
gcuugcggucauccgcc

SEQ ID NO: 3496883 - RNA, 17 nt, Pseudomonas aeruginosa PA01
gcuugcgguuauccgcc

SEQ ID NO: 3496884 - RNA, 22 nt, Pseudomonas aeruginosa PA01
gcuugcgguuauccgccgccgg

SEQ ID NO: 3496885 - RNA, 17 nt, Pseudomonas aeruginosa PA01
gcuugcgucccuuggcg

SEQ ID NO: 3496886 - RNA, 18 nt, Pseudomonas aeruginosa PA01
gcuugcguucgcuccagu

SEQ ID NO: 3496887 - RNA, 20 nt, Pseudomonas aeruginosa PA01
gcuugcucauguugcgggcu

SEQ ID NO: 3496888 - RNA, 15 nt, Pseudomonas aeruginosa PA01
gcuugcucuccacua

SEQ ID NO: 3496889 - RNA, 19 nt, Pseudomonas aeruginosa PA01
gcuugcugaagccccaguc

SEQ ID NO: 3496890 - RNA, 20 nt, Pseudomonas aeruginosa PA01
gcuugcugccauggcggcgg

SEQ ID NO: 3496891 - RNA, 19 nt, Pseudomonas aeruginosa PA01
gcuugcuggcgcgauccgc

SEQ ID NO: 3496892 - RNA, 18 nt, Pseudomonas aeruginosa PA01
gcuuggagcgggcgccgg

SEQ ID NO: 3496893 - RNA, 15 nt, Pseudomonas aeruginosa PA01
gcuuggcaccgcgca

SEQ ID NO: 3496894 - RNA, 21 nt, Pseudomonas aeruginosa PA01
gcuuggcaccgcgcagcguca

SEQ ID NO: 3496895 - RNA, 20 nt, Pseudomonas aeruginosa PA01
gcuuggccacuccgggcugg

SEQ ID NO: 3496896 - RNA, 15 nt, Pseudomonas aeruginosa PA01
gcuuggccagcaggc

SEQ ID NO: 3496897 - RNA, 20 nt, Pseudomonas aeruginosa PA01
gcuuggccagcaggccgagc

SEQ ID NO: 3496898 - RNA, 15 nt, Pseudomonas aeruginosa PA01
gcuuggccagcgcgg

SEQ ID NO: 3496899 - RNA, 16 nt, Pseudomonas aeruginosa PA01
gcuuggccagcgcggu

SEQ ID NO: 3496900 - RNA, 13 nt, Pseudomonas aeruginosa PA01
gcuuggccaggcg

SEQ ID NO: 3496901 - RNA, 14 nt, Pseudomonas aeruginosa PA01
gcuuggccaggcgc

SEQ ID NO: 3496902 - RNA, 15 nt, Pseudomonas aeruginosa PA01
gcuuggccaggucgc

SEQ ID NO: 3496903 - RNA, 19 nt, Pseudomonas aeruginosa PA01
gcuuggccaggucgcgcag

SEQ ID NO: 3496904 - RNA, 20 nt, Pseudomonas aeruginosa PA01
gcuuggccaggucgucgcgc

SEQ ID NO: 3496905 - RNA, 16 nt, Pseudomonas aeruginosa PA01
gcuuggccauggcgcu

SEQ ID NO: 3496906 - RNA, 20 nt, Pseudomonas aeruginosa PA01
gcuuggccauggcgcuugcg

SEQ ID NO: 3496907 - RNA, 18 nt, Pseudomonas aeruginosa PA01
gcuuggcccugcgcgcgc

SEQ ID NO: 3496908 - RNA, 15 nt, Pseudomonas aeruginosa PA01
gcuuggcccuggccu

SEQ ID NO: 3496909 - RNA, 16 nt, Pseudomonas aeruginosa PA01
gcuuggcccuggccuu

SEQ ID NO: 3496910 - RNA, 9 nt, Pseudomonas aeruginosa PA01
gcuuggccu

SEQ ID NO: 3496911 - RNA, 17 nt, Pseudomonas aeruginosa PA01
gcuuggccuugauggug

SEQ ID NO: 3496912 - RNA, 12 nt, Pseudomonas aeruginosa PA01
gcuuggccuugc

SEQ ID NO: 3496913 - RNA, 14 nt, Pseudomonas aeruginosa PA01
gcuuggccuugccg

SEQ ID NO: 3496914 - RNA, 20 nt, Pseudomonas aeruginosa PA01
gcuuggcgaauagccggcgc

SEQ ID NO: 3496915 - RNA, 17 nt, Pseudomonas aeruginosa PA01
gcuuggcgcgcuggcag

SEQ ID NO: 3496916 - RNA, 20 nt, Pseudomonas aeruginosa PA01
gcuuggcggucagcgacugg

SEQ ID NO: 3496917 - RNA, 13 nt, Pseudomonas aeruginosa PA01
gcuugggcgccuc

SEQ ID NO: 3496918 - RNA, 20 nt, Pseudomonas aeruginosa PA01
gcuugggcgccucgccgcgg

SEQ ID NO: 3496919 - RNA, 21 nt, Pseudomonas aeruginosa PA01
gcuugguauccaccucgcccu

SEQ ID NO: 3496920 - RNA, 22 nt, Pseudomonas aeruginosa PA01
gcuuggucacgccguucagggu

SEQ ID NO: 3496921 - RNA, 23 nt, Pseudomonas aeruginosa PA01
gcuuggucacgccguucaggguc

SEQ ID NO: 3496922 - RNA, 21 nt, Pseudomonas aeruginosa PA01
gcuuggucgggauggcgaagc

SEQ ID NO: 3496923 - RNA, 18 nt, Pseudomonas aeruginosa PA01
gcuuggucgggcgccgcg

SEQ ID NO: 3496924 - RNA, 15 nt, Pseudomonas aeruginosa PA01
gcuugguguagagau

SEQ ID NO: 3496925 - RNA, 18 nt, Pseudomonas aeruginosa PA01
gcuugguguagagauucu

SEQ ID NO: 3496926 - RNA, 20 nt, Pseudomonas aeruginosa PA01
gcuuggugucggccgccagg

SEQ ID NO: 3496927 - RNA, 17 nt, Pseudomonas aeruginosa PA01
gcuugguucgcgcgcug

SEQ ID NO: 3496928 - RNA, 14 nt, Pseudomonas aeruginosa PA01
gcuuguagcccagg

SEQ ID NO: 3496929 - RNA, 15 nt, Pseudomonas aeruginosa PA01
gcuuguagcccaggg

SEQ ID NO: 3496930 - RNA, 21 nt, Pseudomonas aeruginosa PA01
gcuuguagcccaggggcacgu

SEQ ID NO: 3496931 - RNA, 17 nt, Pseudomonas aeruginosa PA01
gcuuguaguagcgcccg

SEQ ID NO: 3496932 - RNA, 20 nt, Pseudomonas aeruginosa PA01
gcuuguaguagcgcccgacg

SEQ ID NO: 3496933 - RNA, 22 nt, Pseudomonas aeruginosa PA01
gcuuguccacgccauaggcggc

SEQ ID NO: 3496934 - RNA, 16 nt, Pseudomonas aeruginosa PA01
gcuuguccgagaccgg

SEQ ID NO: 3496935 - RNA, 15 nt, Pseudomonas aeruginosa PA01
gcuuguccuccagcu

SEQ ID NO: 3496936 - RNA, 21 nt, Pseudomonas aeruginosa PA01
gcuuguccuccagcugcgccu

SEQ ID NO: 3496937 - RNA, 19 nt, Pseudomonas aeruginosa PA01
gcuuguccuuccagcucuc

SEQ ID NO: 3496938 - RNA, 14 nt, Pseudomonas aeruginosa PA01
gcuuguccuuggcc

SEQ ID NO: 3496939 - RNA, 18 nt, Pseudomonas aeruginosa PA01
gcuugucgauggucagga

SEQ ID NO: 3496940 - RNA, 12 nt, Pseudomonas aeruginosa PA01
gcuugucgccuu

SEQ ID NO: 3496941 - RNA, 17 nt, Pseudomonas aeruginosa PA01
gcuugucgccuucccgg

SEQ ID NO: 3496942 - RNA, 16 nt, Pseudomonas aeruginosa PA01
gcuugucgccuuccuc

SEQ ID NO: 3496943 - RNA, 15 nt, Pseudomonas aeruginosa PA01
gcuugucggccuugg

SEQ ID NO: 3496944 - RNA, 18 nt, Pseudomonas aeruginosa PA01
gcuugucgucggccuuga

SEQ ID NO: 3496945 - RNA, 15 nt, Pseudomonas aeruginosa PA01
gcuugugggcaugcu

SEQ ID NO: 3496946 - RNA, 22 nt, Pseudomonas aeruginosa PA01
gcuugugguagugguaaugagc

SEQ ID NO: 3496947 - RNA, 22 nt, Pseudomonas aeruginosa PA01
gcuuguugcgcuccacccaggc

SEQ ID NO: 3496948 - RNA, 16 nt, Pseudomonas aeruginosa PA01
gcuuguuggccagcag

SEQ ID NO: 3496949 - RNA, 22 nt, Pseudomonas aeruginosa PA01
gcuuguuggccagcagccaggc

SEQ ID NO: 3496950 - RNA, 24 nt, Pseudomonas aeruginosa PA01
gcuuguuggccagcagccaggccu

SEQ ID NO: 3496951 - RNA, 14 nt, Pseudomonas aeruginosa PA01
gcuuucagcgccgc

SEQ ID NO: 3496952 - RNA, 21 nt, Pseudomonas aeruginosa PA01
gcuuucagcgccgcucggcga

SEQ ID NO: 3496953 - RNA, 16 nt, Pseudomonas aeruginosa PA01
gcuuucaggcgcucgu

SEQ ID NO: 3496954 - RNA, 14 nt, Pseudomonas aeruginosa PA01
gcuuucaucaggcg

SEQ ID NO: 3496955 - RNA, 16 nt, Pseudomonas aeruginosa PA01
gcuuuccaccgccagc

SEQ ID NO: 3496956 - RNA, 18 nt, Pseudomonas aeruginosa PA01
gcuuuccaccgccagcac

SEQ ID NO: 3496957 - RNA, 19 nt, Pseudomonas aeruginosa PA01
gcuuuccaccgccagcacc

SEQ ID NO: 3496958 - RNA, 19 nt, Pseudomonas aeruginosa PA01
gcuuuccagcaggcgcucg

SEQ ID NO: 3496959 - RNA, 20 nt, Pseudomonas aeruginosa PA01
gcuuuccagcaggcgcucgc

SEQ ID NO: 3496960 - RNA, 21 nt, Pseudomonas aeruginosa PA01
gcuuuccagcaggcgcucgcu

SEQ ID NO: 3496961 - RNA, 20 nt, Pseudomonas aeruginosa PA01
gcuuuccagcccggcguggg

SEQ ID NO: 3496962 - RNA, 14 nt, Pseudomonas aeruginosa PA01
gcuuuccaggcgcc

SEQ ID NO: 3496963 - RNA, 20 nt, Pseudomonas aeruginosa PA01
gcuuucccgcuucggcccgc

SEQ ID NO: 3496964 - RNA, 16 nt, Pseudomonas aeruginosa PA01
gcuuuccgccgagcgu

SEQ ID NO: 3496965 - RNA, 14 nt, Pseudomonas aeruginosa PA01
gcuuuccgcggcgu

SEQ ID NO: 3496966 - RNA, 17 nt, Pseudomonas aeruginosa PA01
gcuuuccggcgcggccu

SEQ ID NO: 3496967 - RNA, 20 nt, Pseudomonas aeruginosa PA01
gcuuuccggcgcggccugca

SEQ ID NO: 3496968 - RNA, 21 nt, Pseudomonas aeruginosa PA01
gcuuuccgucucaggcgccag

SEQ ID NO: 3496969 - RNA, 22 nt, Pseudomonas aeruginosa PA01
gcuuuccgucucaggcgccagg

SEQ ID NO: 3496970 - RNA, 15 nt, Pseudomonas aeruginosa PA01
gcuuuccucggccau

SEQ ID NO: 3496971 - RNA, 14 nt, Pseudomonas aeruginosa PA01
gcuuuccugcgccu

SEQ ID NO: 3496972 - RNA, 17 nt, Pseudomonas aeruginosa PA01
gcuuuccugcuccagca

SEQ ID NO: 3496973 - RNA, 15 nt, Pseudomonas aeruginosa PA01
gcuuuccuggccgac

SEQ ID NO: 3496974 - RNA, 20 nt, Pseudomonas aeruginosa PA01
gcuuuccuggccgacccgca

SEQ ID NO: 3496975 - RNA, 17 nt, Pseudomonas aeruginosa PA01
gcuuucgguuugcgccg

SEQ ID NO: 3496976 - RNA, 20 nt, Pseudomonas aeruginosa PA01
gcuuucguaggcaggcgcgg

SEQ ID NO: 3496977 - RNA, 16 nt, Pseudomonas aeruginosa PA01
gcuuucguagggcgaa

SEQ ID NO: 3496978 - RNA, 17 nt, Pseudomonas aeruginosa PA01
gcugcgguaccagcgca

SEQ ID NO: 3496979 - RNA, 21 nt, Pseudomonas aeruginosa PA01
gcugcgguaccagcgcaccag

SEQ ID NO: 3496980 - RNA, 17 nt, Pseudomonas aeruginosa PA01
gcugcguaguugagccc

SEQ ID NO: 3496981 - RNA, 21 nt, Pseudomonas aeruginosa PA01
gcugcguaguugagccccagg

SEQ ID NO: 3496982 - RNA, 19 nt, Pseudomonas aeruginosa PA01
gcugcgucgucgcggcgcc

SEQ ID NO: 3496983 - RNA, 20 nt, Pseudomonas aeruginosa PA01
gcugcgucgucgcggcgccu

SEQ ID NO: 3496984 - RNA, 21 nt, Pseudomonas aeruginosa PA01
gcugcgucguuggccggcugc

SEQ ID NO: 3496985 - RNA, 15 nt, Pseudomonas aeruginosa PA01
gcugcgugccagcac

SEQ ID NO: 3496986 - RNA, 16 nt, Pseudomonas aeruginosa PA01
gcugcgugccagcacc

SEQ ID NO: 3496987 - RNA, 13 nt, Pseudomonas aeruginosa PA01
gcugcgugccagg

SEQ ID NO: 3496988 - RNA, 16 nt, Pseudomonas aeruginosa PA01
gcugcgugcguugcgc

SEQ ID NO: 3496989 - RNA, 19 nt, Pseudomonas aeruginosa PA01
gcugcguggguagccgccc

SEQ ID NO: 3496990 - RNA, 20 nt, Pseudomonas aeruginosa PA01
gcugcguggguagccgccca

SEQ ID NO: 3496991 - RNA, 17 nt, Pseudomonas aeruginosa PA01
gcugcguucuuccccug

SEQ ID NO: 3496992 - RNA, 18 nt, Pseudomonas aeruginosa PA01
gcugcguucuuccccugc

SEQ ID NO: 3496993 - RNA, 17 nt, Pseudomonas aeruginosa PA01
gcugcucaccaggugau

SEQ ID NO: 3496994 - RNA, 14 nt, Pseudomonas aeruginosa PA01
gcugcucagcgcgc

SEQ ID NO: 3496995 - RNA, 21 nt, Pseudomonas aeruginosa PA01
gcugcucagcgcgcucggccu

SEQ ID NO: 3496996 - RNA, 20 nt, Pseudomonas aeruginosa PA01
gcugcucagggccgcgccga

SEQ ID NO: 3496997 - RNA, 14 nt, Pseudomonas aeruginosa PA01
gcugcucagggcuc

SEQ ID NO: 3496998 - RNA, 23 nt, Pseudomonas aeruginosa PA01
gcugcuccaucaguugcgcgcgg

SEQ ID NO: 3496999 - RNA, 17 nt, Pseudomonas aeruginosa PA01
gcugcuccggaucgcgc

SEQ ID NO: 3497000 - RNA, 22 nt, Pseudomonas aeruginosa PA01
gcugcuccuccccguccuggcg

SEQ ID NO: 3497001 - RNA, 16 nt, Pseudomonas aeruginosa PA01
gcugcucgaccaccuc

SEQ ID NO: 3497002 - RNA, 21 nt, Pseudomonas aeruginosa PA01
gcugcucgaccaccucggcgu

SEQ ID NO: 3497003 - RNA, 17 nt, Pseudomonas aeruginosa PA01
gcugcucgacggcacca

SEQ ID NO: 3497004 - RNA, 13 nt, Pseudomonas aeruginosa PA01
gcugcucgauggc

SEQ ID NO: 3497005 - RNA, 14 nt, Pseudomonas aeruginosa PA01
gcugcucgauggcc

SEQ ID NO: 3497006 - RNA, 19 nt, Pseudomonas aeruginosa PA01
gcugcucgauggcggccug

SEQ ID NO: 3497007 - RNA, 20 nt, Pseudomonas aeruginosa PA01
gcugcucgauggcggccugg

SEQ ID NO: 3497008 - RNA, 21 nt, Pseudomonas aeruginosa PA01
gcugcucgauggcggccuggu

SEQ ID NO: 3497009 - RNA, 22 nt, Pseudomonas aeruginosa PA01
gcugcucgcagagggcgaugcc

SEQ ID NO: 3497010 - RNA, 15 nt, Pseudomonas aeruginosa PA01
gcugcucgcagccgg

SEQ ID NO: 3497011 - RNA, 16 nt, Pseudomonas aeruginosa PA01
gcugcucgccaugggc

SEQ ID NO: 3497012 - RNA, 12 nt, Pseudomonas aeruginosa PA01
gcugcucgccuc

SEQ ID NO: 3497013 - RNA, 22 nt, Pseudomonas aeruginosa PA01
gcugcugaucaggaggaucgcc

SEQ ID NO: 3497014 - RNA, 14 nt, Pseudomonas aeruginosa PA01
gcugcugcaaccga

SEQ ID NO: 3497015 - RNA, 21 nt, Pseudomonas aeruginosa PA01
gcugcugccauccgcgccgac

SEQ ID NO: 3497016 - RNA, 13 nt, Pseudomonas aeruginosa PA01
gcugcugccggcc

SEQ ID NO: 3497017 - RNA, 13 nt, Pseudomonas aeruginosa PA01
gcugcugcgccug

SEQ ID NO: 3497018 - RNA, 16 nt, Pseudomonas aeruginosa PA01
gcugcugcgccuggcc

SEQ ID NO: 3497019 - RNA, 18 nt, Pseudomonas aeruginosa PA01
gcugcugcgccuggccgc

SEQ ID NO: 3497020 - RNA, 14 nt, Pseudomonas aeruginosa PA01
gcugcugcggcuuc

SEQ ID NO: 3497021 - RNA, 14 nt, Pseudomonas aeruginosa PA01
gcugcugcggggcc

SEQ ID NO: 3497022 - RNA, 21 nt, Pseudomonas aeruginosa PA01
gcugcugcggggccggacgcg

SEQ ID NO: 3497023 - RNA, 17 nt, Pseudomonas aeruginosa PA01
gcugcugcggggccugc

SEQ ID NO: 3497024 - RNA, 15 nt, Pseudomonas aeruginosa PA01
gcugcugcucagcgc

SEQ ID NO: 3497025 - RNA, 19 nt, Pseudomonas aeruginosa PA01
gcugcugcucagcgcgcuc

SEQ ID NO: 3497026 - RNA, 16 nt, Pseudomonas aeruginosa PA01
gcugcugcugcggcuu

SEQ ID NO: 3497027 - RNA, 13 nt, Pseudomonas aeruginosa PA01
gcugcuggauggg

SEQ ID NO: 3497028 - RNA, 12 nt, Pseudomonas aeruginosa PA01
gcugcuggcgcc

SEQ ID NO: 3497029 - RNA, 14 nt, Pseudomonas aeruginosa PA01
gcugcuggcgccgc

SEQ ID NO: 3497030 - RNA, 15 nt, Pseudomonas aeruginosa PA01
gcugcuggcgccgcu

SEQ ID NO: 3497031 - RNA, 17 nt, Pseudomonas aeruginosa PA01
gcugcuggcgccgcugg

SEQ ID NO: 3497032 - RNA, 15 nt, Pseudomonas aeruginosa PA01
gcugcugggcggcga

SEQ ID NO: 3497033 - RNA, 20 nt, Pseudomonas aeruginosa PA01
gcugcuggggaacugggcga

SEQ ID NO: 3497034 - RNA, 23 nt, Pseudomonas aeruginosa PA01
gcugcuggggaacugggcgagca

SEQ ID NO: 3497035 - RNA, 14 nt, Pseudomonas aeruginosa PA01
gcugcugggugaug

SEQ ID NO: 3497036 - RNA, 19 nt, Pseudomonas aeruginosa PA01
gcugcugguagugcuggcg

SEQ ID NO: 3497037 - RNA, 22 nt, Pseudomonas aeruginosa PA01
gcugcuguacagcucaccccag

SEQ ID NO: 3497038 - RNA, 12 nt, Pseudomonas aeruginosa PA01
gcugcuguccag

SEQ ID NO: 3497039 - RNA, 14 nt, Pseudomonas aeruginosa PA01
gcugcuguccagcg

SEQ ID NO: 3497040 - RNA, 21 nt, Pseudomonas aeruginosa PA01
gcugcugucgagggucugcuc

SEQ ID NO: 3497041 - RNA, 23 nt, Pseudomonas aeruginosa PA01
gcugcuguugccagggauacuca

SEQ ID NO: 3497042 - RNA, 13 nt, Pseudomonas aeruginosa PA01
gcugcuucggcag

SEQ ID NO: 3497043 - RNA, 16 nt, Pseudomonas aeruginosa PA01
gcugcuucggcagccu

SEQ ID NO: 3497044 - RNA, 16 nt, Pseudomonas aeruginosa PA01
gcugcuugaacaccuc

SEQ ID NO: 3497045 - RNA, 15 nt, Pseudomonas aeruginosa PA01
gcugcuugccgcuca

SEQ ID NO: 3497046 - RNA, 15 nt, Pseudomonas aeruginosa PA01
gcugcuugccggugc

SEQ ID NO: 3497047 - RNA, 16 nt, Pseudomonas aeruginosa PA01
gcugcuugccggugcc

SEQ ID NO: 3497048 - RNA, 13 nt, Pseudomonas aeruginosa PA01
gcugcuugcgccg

SEQ ID NO: 3497049 - RNA, 15 nt, Pseudomonas aeruginosa PA01
gcugcuugcgcgcgg

SEQ ID NO: 3497050 - RNA, 12 nt, Pseudomonas aeruginosa PA01
gcugcuuggcca

SEQ ID NO: 3497051 - RNA, 17 nt, Pseudomonas aeruginosa PA01
gcugcuuucgcgucugg

SEQ ID NO: 3497052 - RNA, 15 nt, Pseudomonas aeruginosa PA01
gcuggaaaacgccac

SEQ ID NO: 3497053 - RNA, 15 nt, Pseudomonas aeruginosa PA01
gcuggaaauggcggu

SEQ ID NO: 3497054 - RNA, 21 nt, Pseudomonas aeruginosa PA01
gcuggaaauggcggucgccga

SEQ ID NO: 3497055 - RNA, 22 nt, Pseudomonas aeruginosa PA01
gcuggaaauggcggucgccgac

SEQ ID NO: 3497056 - RNA, 22 nt, Pseudomonas aeruginosa PA01
gcuggaacggccaggucuucug

SEQ ID NO: 3497057 - RNA, 16 nt, Pseudomonas aeruginosa PA01
gcuggaagccgcgcuc

SEQ ID NO: 3497058 - RNA, 13 nt, Pseudomonas aeruginosa PA01
gcuggaagucgcc

SEQ ID NO: 3497059 - RNA, 15 nt, Pseudomonas aeruginosa PA01
gcuggaagucgcccu

SEQ ID NO: 3497060 - RNA, 21 nt, Pseudomonas aeruginosa PA01
gcuggaaguuguacagcgagg

SEQ ID NO: 3497061 - RNA, 13 nt, Pseudomonas aeruginosa PA01
gcuggacaggcgc

SEQ ID NO: 3497062 - RNA, 14 nt, Pseudomonas aeruginosa PA01
gcuggacaggcgca

SEQ ID NO: 3497063 - RNA, 16 nt, Pseudomonas aeruginosa PA01
gcuggacaggcgcagg

SEQ ID NO: 3497064 - RNA, 14 nt, Pseudomonas aeruginosa PA01
gcuggaccaggcgg

SEQ ID NO: 3497065 - RNA, 17 nt, Pseudomonas aeruginosa PA01
gcuggaccaggcggccg

SEQ ID NO: 3497066 - RNA, 19 nt, Pseudomonas aeruginosa PA01
gcuggaccaguucagcgcg

SEQ ID NO: 3497067 - RNA, 20 nt, Pseudomonas aeruginosa PA01
gcuggaccaguucagcgcgc

SEQ ID NO: 3497068 - RNA, 21 nt, Pseudomonas aeruginosa PA01
gcuggaccaguucagcgcgcu

SEQ ID NO: 3497069 - RNA, 17 nt, Pseudomonas aeruginosa PA01
gcuggaccauggccggc

SEQ ID NO: 3497070 - RNA, 15 nt, Pseudomonas aeruginosa PA01
gcuggacccgcaccu

SEQ ID NO: 3497071 - RNA, 20 nt, Pseudomonas aeruginosa PA01
gcuggacccgcaccuggacc

SEQ ID NO: 3497072 - RNA, 21 nt, Pseudomonas aeruginosa PA01
gcuggacccgcaccuggaccg

SEQ ID NO: 3497073 - RNA, 16 nt, Pseudomonas aeruginosa PA01
gcuggaccuggccggc

SEQ ID NO: 3497074 - RNA, 18 nt, Pseudomonas aeruginosa PA01
gcuggaccuggccggcga

SEQ ID NO: 3497075 - RNA, 14 nt, Pseudomonas aeruginosa PA01
gcuggacgaaccag

SEQ ID NO: 3497076 - RNA, 17 nt, Pseudomonas aeruginosa PA01
gcuggacgacgcuggcc

SEQ ID NO: 3497077 - RNA, 19 nt, Pseudomonas aeruginosa PA01
gcuggacgacgcuggccug

SEQ ID NO: 3497078 - RNA, 20 nt, Pseudomonas aeruginosa PA01
gcuggacgacgcuggccugc

SEQ ID NO: 3497079 - RNA, 18 nt, Pseudomonas aeruginosa PA01
gcuggacgugcaggauca

SEQ ID NO: 3497080 - RNA, 16 nt, Pseudomonas aeruginosa PA01
gcuggacucgcgccag

SEQ ID NO: 3497081 - RNA, 17 nt, Pseudomonas aeruginosa PA01
gcuggacuucccggcgu

SEQ ID NO: 3497082 - RNA, 14 nt, Pseudomonas aeruginosa PA01
gcuggagaccuugu

SEQ ID NO: 3497083 - RNA, 16 nt, Pseudomonas aeruginosa PA01
gcuggagcagcagcgc

SEQ ID NO: 3497084 - RNA, 18 nt, Pseudomonas aeruginosa PA01
gcuggagcagcagcgccg

SEQ ID NO: 3497085 - RNA, 21 nt, Pseudomonas aeruginosa PA01
gcuggagcagcagcgccgcga

SEQ ID NO: 3497086 - RNA, 14 nt, Pseudomonas aeruginosa PA01
gcuggagcgcugcg

SEQ ID NO: 3497087 - RNA, 20 nt, Pseudomonas aeruginosa PA01
gcuggaguaucgcccuggcc

SEQ ID NO: 3497088 - RNA, 19 nt, Pseudomonas aeruginosa PA01
gcuggauagaguacucggc

SEQ ID NO: 3497089 - RNA, 21 nt, Pseudomonas aeruginosa PA01
gcuggauagaguacucggcua

SEQ ID NO: 3497090 - RNA, 17 nt, Pseudomonas aeruginosa PA01
gcuggauccgugccagg

SEQ ID NO: 3497091 - RNA, 14 nt, Pseudomonas aeruginosa PA01
gcuggauccucgcc

SEQ ID NO: 3497092 - RNA, 16 nt, Pseudomonas aeruginosa PA01
gcuggauccucgccuc

SEQ ID NO: 3497093 - RNA, 19 nt, Pseudomonas aeruginosa PA01
gcuggaucggcaggcuggc

SEQ ID NO: 3497094 - RNA, 20 nt, Pseudomonas aeruginosa PA01
gcuggaucugguggaacagc

SEQ ID NO: 3497095 - RNA, 22 nt, Pseudomonas aeruginosa PA01
gcuggaucugguggaacagcau

SEQ ID NO: 3497096 - RNA, 15 nt, Pseudomonas aeruginosa PA01
gcuggaucugguuga

SEQ ID NO: 3497097 - RNA, 20 nt, Pseudomonas aeruginosa PA01
gcuggaugcccuccugggcc

SEQ ID NO: 3497098 - RNA, 15 nt, Pseudomonas aeruginosa PA01
gcuggaugucggcga

SEQ ID NO: 3497099 - RNA, 16 nt, Pseudomonas aeruginosa PA01
gcuggauuucgccgag

SEQ ID NO: 3497100 - RNA, 23 nt, Pseudomonas aeruginosa PA01
gcuggauuucgccgaguggccgc

SEQ ID NO: 3497101 - RNA, 16 nt, Pseudomonas aeruginosa PA01
gcuggcaacggcgggc

SEQ ID NO: 3497102 - RNA, 19 nt, Pseudomonas aeruginosa PA01
gcuggcaacggcgggccgc

SEQ ID NO: 3497103 - RNA, 21 nt, Pseudomonas aeruginosa PA01
gcuggcaacggcgggccgcuc

SEQ ID NO: 3497104 - RNA, 17 nt, Pseudomonas aeruginosa PA01
gcuggcacagguccagc

SEQ ID NO: 3497105 - RNA, 20 nt, Pseudomonas aeruginosa PA01
gcuggcacagguccagcaag

SEQ ID NO: 3497106 - RNA, 14 nt, Pseudomonas aeruginosa PA01
gcuggcaccggcca

SEQ ID NO: 3497107 - RNA, 18 nt, Pseudomonas aeruginosa PA01
gcuggcaccggccaggcg

SEQ ID NO: 3497108 - RNA, 14 nt, Pseudomonas aeruginosa PA01
gcuggcagaacgcg

SEQ ID NO: 3497109 - RNA, 19 nt, Pseudomonas aeruginosa PA01
gcuggcagaacgcgucgac

SEQ ID NO: 3497110 - RNA, 13 nt, Pseudomonas aeruginosa PA01
gcuggcagggcgc

SEQ ID NO: 3497111 - RNA, 18 nt, Pseudomonas aeruginosa PA01
gcuggcagggcgcgucca

SEQ ID NO: 3497112 - RNA, 15 nt, Pseudomonas aeruginosa PA01
gcuggcaggugccgc

SEQ ID NO: 3497113 - RNA, 17 nt, Pseudomonas aeruginosa PA01
gcuggcaggugccgcuc

SEQ ID NO: 3497114 - RNA, 18 nt, Pseudomonas aeruginosa PA01
gcuggcagguugcacggc

SEQ ID NO: 3497115 - RNA, 18 nt, Pseudomonas aeruginosa PA01
gcuggcagguugugcggg

SEQ ID NO: 3497116 - RNA, 21 nt, Pseudomonas aeruginosa PA01
gcuggcauacacaugcaggcu

SEQ ID NO: 3497117 - RNA, 23 nt, Pseudomonas aeruginosa PA01
gcuggcauacacaugcaggcucg

SEQ ID NO: 3497118 - RNA, 13 nt, Pseudomonas aeruginosa PA01
gcuggcaucggug

SEQ ID NO: 3497119 - RNA, 13 nt, Pseudomonas aeruginosa PA01
gcuggccaccagc

SEQ ID NO: 3497120 - RNA, 14 nt, Pseudomonas aeruginosa PA01
gcuggccaccagca

SEQ ID NO: 3497121 - RNA, 15 nt, Pseudomonas aeruginosa PA01
gcuggccaccagcac

SEQ ID NO: 3497122 - RNA, 16 nt, Pseudomonas aeruginosa PA01
gcuggccaccagcacc

SEQ ID NO: 3497123 - RNA, 13 nt, Pseudomonas aeruginosa PA01
gcuggccacccuu

SEQ ID NO: 3497124 - RNA, 14 nt, Pseudomonas aeruginosa PA01
gcuggccacccuug

SEQ ID NO: 3497125 - RNA, 13 nt, Pseudomonas aeruginosa PA01
gcuggccaccgcc

SEQ ID NO: 3497126 - RNA, 14 nt, Pseudomonas aeruginosa PA01
gcuggccaccgcca

SEQ ID NO: 3497127 - RNA, 18 nt, Pseudomonas aeruginosa PA01
gcuggccaccgccaggac

SEQ ID NO: 3497128 - RNA, 22 nt, Pseudomonas aeruginosa PA01
gcuggccaccgccaggaccucg

SEQ ID NO: 3497129 - RNA, 23 nt, Pseudomonas aeruginosa PA01
gcuggccaccgccaggaccucga

SEQ ID NO: 3497130 - RNA, 19 nt, Pseudomonas aeruginosa PA01
gcuggccagaauuccagca

SEQ ID NO: 3497131 - RNA, 22 nt, Pseudomonas aeruginosa PA01
gcuggccagaauuccagcaggu

SEQ ID NO: 3497132 - RNA, 18 nt, Pseudomonas aeruginosa PA01
gcuggccagcaauacccg

SEQ ID NO: 3497133 - RNA, 22 nt, Pseudomonas aeruginosa PA01
gcuggccagcaauacccgccgc

SEQ ID NO: 3497134 - RNA, 12 nt, Pseudomonas aeruginosa PA01
gcuggccagcag

SEQ ID NO: 3497135 - RNA, 14 nt, Pseudomonas aeruginosa PA01
gcuggccagcaggc

SEQ ID NO: 3497136 - RNA, 15 nt, Pseudomonas aeruginosa PA01
gcuggccagcaggcu

SEQ ID NO: 3497137 - RNA, 21 nt, Pseudomonas aeruginosa PA01
gcuggccagcaggcuggcggc

SEQ ID NO: 3497138 - RNA, 22 nt, Pseudomonas aeruginosa PA01
gcuggccagcaggcuggcggca

SEQ ID NO: 3497139 - RNA, 13 nt, Pseudomonas aeruginosa PA01
gcuggccagcccu

SEQ ID NO: 3497140 - RNA, 13 nt, Pseudomonas aeruginosa PA01
gcuggccagcgcu

SEQ ID NO: 3497141 - RNA, 22 nt, Pseudomonas aeruginosa PA01
gcuggccaguuccaugucgcug

SEQ ID NO: 3497142 - RNA, 23 nt, Pseudomonas aeruginosa PA01
gcuggccaguuccaugucgcugg

SEQ ID NO: 3497143 - RNA, 19 nt, Pseudomonas aeruginosa PA01
gcuggccaguugcgcuccg

SEQ ID NO: 3497144 - RNA, 20 nt, Pseudomonas aeruginosa PA01
gcuggccaguugcgcuccgg

SEQ ID NO: 3497145 - RNA, 21 nt, Pseudomonas aeruginosa PA01
gcuggccaguugcgcuccggu

SEQ ID NO: 3497146 - RNA, 13 nt, Pseudomonas aeruginosa PA01
gcuggccauccgc

SEQ ID NO: 3497147 - RNA, 14 nt, Pseudomonas aeruginosa PA01
gcuggccauccgcc

SEQ ID NO: 3497148 - RNA, 15 nt, Pseudomonas aeruginosa PA01
gcuggccauccgccc

SEQ ID NO: 3497149 - RNA, 21 nt, Pseudomonas aeruginosa PA01
gcuggcccaguugcccggccu

SEQ ID NO: 3497150 - RNA, 18 nt, Pseudomonas aeruginosa PA01
gcuggcccuccauccagu

SEQ ID NO: 3497151 - RNA, 15 nt, Pseudomonas aeruginosa PA01
gcuggcccucggcgu

SEQ ID NO: 3497152 - RNA, 20 nt, Pseudomonas aeruginosa PA01
gcuggcccucggcguucacc

SEQ ID NO: 3497153 - RNA, 22 nt, Pseudomonas aeruginosa PA01
gcuggccgagcgacuccgggaa

SEQ ID NO: 3497154 - RNA, 16 nt, Pseudomonas aeruginosa PA01
gcuggccgagcgccgc

SEQ ID NO: 3497155 - RNA, 19 nt, Pseudomonas aeruginosa PA01
gcuggccgagcgccgccug

SEQ ID NO: 3497156 - RNA, 17 nt, Pseudomonas aeruginosa PA01
gcuggccgagcugccgc

SEQ ID NO: 3497157 - RNA, 18 nt, Pseudomonas aeruginosa PA01
gcuggccgaggacccggc

SEQ ID NO: 3497158 - RNA, 16 nt, Pseudomonas aeruginosa PA01
gcuggccgagggcgcg

SEQ ID NO: 3497159 - RNA, 17 nt, Pseudomonas aeruginosa PA01
gcuggccgcccuugcgg

SEQ ID NO: 3497160 - RNA, 15 nt, Pseudomonas aeruginosa PA01
gcuggccgccucgcg

SEQ ID NO: 3497161 - RNA, 17 nt, Pseudomonas aeruginosa PA01
gcuggccgccucgcgcc

SEQ ID NO: 3497162 - RNA, 18 nt, Pseudomonas aeruginosa PA01
gcuggccgccucgcgccg

SEQ ID NO: 3497163 - RNA, 19 nt, Pseudomonas aeruginosa PA01
gcuggccgccucgcgccgc

SEQ ID NO: 3497164 - RNA, 20 nt, Pseudomonas aeruginosa PA01
gcuggccgccuggccggcca

SEQ ID NO: 3497165 - RNA, 13 nt, Pseudomonas aeruginosa PA01
gcuggccgcgcga

SEQ ID NO: 3497166 - RNA, 24 nt, Pseudomonas aeruginosa PA01
gcuggccgcgcgaccgcggcgcuc

SEQ ID NO: 3497167 - RNA, 11 nt, Pseudomonas aeruginosa PA01
gcuggccgcgg

SEQ ID NO: 3497168 - RNA, 13 nt, Pseudomonas aeruginosa PA01
gcuggccgcggug

SEQ ID NO: 3497169 - RNA, 16 nt, Pseudomonas aeruginosa PA01
gcuggccgcggugggc

SEQ ID NO: 3497170 - RNA, 21 nt, Pseudomonas aeruginosa PA01
gcuggccgcggugggcuccag

SEQ ID NO: 3497171 - RNA, 22 nt, Pseudomonas aeruginosa PA01
gcuggccgcggugggcuccagc

SEQ ID NO: 3497172 - RNA, 14 nt, Pseudomonas aeruginosa PA01
gcuggccggcagca

SEQ ID NO: 3497173 - RNA, 23 nt, Pseudomonas aeruginosa PA01
gcuggccggucugcuuguccuuc

SEQ ID NO: 3497174 - RNA, 14 nt, Pseudomonas aeruginosa PA01
gcuggccggugccg

SEQ ID NO: 3497175 - RNA, 18 nt, Pseudomonas aeruginosa PA01
gcuggccggugccgcccu

SEQ ID NO: 3497176 - RNA, 23 nt, Pseudomonas aeruginosa PA01
gcuggccgucgacccgccucacc

SEQ ID NO: 3497177 - RNA, 19 nt, Pseudomonas aeruginosa PA01
gcuggccgucgaggucggc

SEQ ID NO: 3497178 - RNA, 15 nt, Pseudomonas aeruginosa PA01
gcuggccucggcgau

SEQ ID NO: 3497179 - RNA, 22 nt, Pseudomonas aeruginosa PA01
gcuggccucggcgaucgccagg

SEQ ID NO: 3497180 - RNA, 17 nt, Pseudomonas aeruginosa PA01
gcuggccugcagcaggu

SEQ ID NO: 3497181 - RNA, 18 nt, Pseudomonas aeruginosa PA01
gcuggccugcagguccgg

SEQ ID NO: 3497182 - RNA, 14 nt, Pseudomonas aeruginosa PA01
gcuggccugccgau

SEQ ID NO: 3497183 - RNA, 18 nt, Pseudomonas aeruginosa PA01
gcuggccuggccacccuu

SEQ ID NO: 3497184 - RNA, 19 nt, Pseudomonas aeruginosa PA01
gcuggccuggccacccuug

SEQ ID NO: 3497185 - RNA, 21 nt, Pseudomonas aeruginosa PA01
gcuggccugggguagccggcc

SEQ ID NO: 3497186 - RNA, 23 nt, Pseudomonas aeruginosa PA01
gcuggccugggguagccggccga

SEQ ID NO: 3497187 - RNA, 14 nt, Pseudomonas aeruginosa PA01
gcuggccuuggcca

SEQ ID NO: 3497188 - RNA, 20 nt, Pseudomonas aeruginosa PA01
gcuggccuuggccaugccca

SEQ ID NO: 3497189 - RNA, 20 nt, Pseudomonas aeruginosa PA01
gcuggccuuguacagggcgc

SEQ ID NO: 3497190 - RNA, 19 nt, Pseudomonas aeruginosa PA01
gcuggcgaaccaguccagc

SEQ ID NO: 3497191 - RNA, 22 nt, Pseudomonas aeruginosa PA01
gcuggcgaaccaguccagcacg

SEQ ID NO: 3497192 - RNA, 16 nt, Pseudomonas aeruginosa PA01
gcuggcgaaggcgcuc

SEQ ID NO: 3497193 - RNA, 19 nt, Pseudomonas aeruginosa PA01
gcuggcgaaggcgcuccgg

SEQ ID NO: 3497194 - RNA, 20 nt, Pseudomonas aeruginosa PA01
gcuggcgaaggcgcuccgga

SEQ ID NO: 3497195 - RNA, 20 nt, Pseudomonas aeruginosa PA01
gcuggcgaauauccucgucg

SEQ ID NO: 3497196 - RNA, 22 nt, Pseudomonas aeruginosa PA01
gcuggcgaauuuccugcuggcg

SEQ ID NO: 3497197 - RNA, 20 nt, Pseudomonas aeruginosa PA01
gcuggcgacacucugguagc

SEQ ID NO: 3497198 - RNA, 15 nt, Pseudomonas aeruginosa PA01
gcuggcgacggcucu

SEQ ID NO: 3497199 - RNA, 15 nt, Pseudomonas aeruginosa PA01
gcuggcgagcgucga

SEQ ID NO: 3497200 - RNA, 21 nt, Pseudomonas aeruginosa PA01
gcuggcgaggaacacccagaa

SEQ ID NO: 3497201 - RNA, 16 nt, Pseudomonas aeruginosa PA01
gcuggcgaggacgccg

SEQ ID NO: 3497202 - RNA, 20 nt, Pseudomonas aeruginosa PA01
gcuggcgaggacgccgggcu

SEQ ID NO: 3497203 - RNA, 20 nt, Pseudomonas aeruginosa PA01
gcuggcgaggauuuccucgc

SEQ ID NO: 3497204 - RNA, 18 nt, Pseudomonas aeruginosa PA01
gcuggcgaucaugccuuc

SEQ ID NO: 3497205 - RNA, 19 nt, Pseudomonas aeruginosa PA01
gcuggcgaucgaccugccg

SEQ ID NO: 3497206 - RNA, 19 nt, Pseudomonas aeruginosa PA01
gcuggcgauguagcugccg

SEQ ID NO: 3497207 - RNA, 21 nt, Pseudomonas aeruginosa PA01
gcuggcgauguagcugccggc

SEQ ID NO: 3497208 - RNA, 23 nt, Pseudomonas aeruginosa PA01
gcuggcgauguagcugccggcgu

SEQ ID NO: 3497209 - RNA, 18 nt, Pseudomonas aeruginosa PA01
gcuggcgcaacugcgcca

SEQ ID NO: 3497210 - RNA, 19 nt, Pseudomonas aeruginosa PA01
gcuggcgcaacugcgccag

SEQ ID NO: 3497211 - RNA, 22 nt, Pseudomonas aeruginosa PA01
gcuggcgcaauacaccgcugcg

SEQ ID NO: 3497212 - RNA, 18 nt, Pseudomonas aeruginosa PA01
gcuggcgcagccaggcga

SEQ ID NO: 3497213 - RNA, 23 nt, Pseudomonas aeruginosa PA01
gcuggcgcagccaggcgauggug

SEQ ID NO: 3497214 - RNA, 14 nt, Pseudomonas aeruginosa PA01
gcuggcgcagccgc

SEQ ID NO: 3497215 - RNA, 19 nt, Pseudomonas aeruginosa PA01
gcuggcgcagccgcugcug

SEQ ID NO: 3497216 - RNA, 21 nt, Pseudomonas aeruginosa PA01
gcuggcgcagccgcugcugca

SEQ ID NO: 3497217 - RNA, 14 nt, Pseudomonas aeruginosa PA01
gcuggcgcaggccu

SEQ ID NO: 3497218 - RNA, 15 nt, Pseudomonas aeruginosa PA01
gcuggcgcaggccuu

SEQ ID NO: 3497219 - RNA, 24 nt, Pseudomonas aeruginosa PA01
gcuggcgcccaacgucuucaggcg

SEQ ID NO: 3497220 - RNA, 15 nt, Pseudomonas aeruginosa PA01
gcuggcgccgaugcu

SEQ ID NO: 3497221 - RNA, 19 nt, Pseudomonas aeruginosa PA01
gcuggcgccgcgggucugc

SEQ ID NO: 3497222 - RNA, 21 nt, Pseudomonas aeruginosa PA01
gcuggcgccgcgggucugcuc

SEQ ID NO: 3497223 - RNA, 22 nt, Pseudomonas aeruginosa PA01
gcuggcgccgcgggucugcucg

SEQ ID NO: 3497224 - RNA, 16 nt, Pseudomonas aeruginosa PA01
gcuggcgccgcuggcg

SEQ ID NO: 3497225 - RNA, 17 nt, Pseudomonas aeruginosa PA01
gcuggcgccgcuggcgu

SEQ ID NO: 3497226 - RNA, 17 nt, Pseudomonas aeruginosa PA01
gcuggcgccggugcaug

SEQ ID NO: 3497227 - RNA, 15 nt, Pseudomonas aeruginosa PA01
gcuggcgccgucauc

SEQ ID NO: 3497228 - RNA, 20 nt, Pseudomonas aeruginosa PA01
gcuggcgccgucaucgcuga

SEQ ID NO: 3497229 - RNA, 15 nt, Pseudomonas aeruginosa PA01
gcuggcgcgauccgc

SEQ ID NO: 3497230 - RNA, 13 nt, Pseudomonas aeruginosa PA01
gcuggcgcgccuc

SEQ ID NO: 3497231 - RNA, 20 nt, Pseudomonas aeruginosa PA01
gcuggcgcgcgcgcugccag

SEQ ID NO: 3497232 - RNA, 19 nt, Pseudomonas aeruginosa PA01
gcuggcgcgucgcugccgc

SEQ ID NO: 3497233 - RNA, 13 nt, Pseudomonas aeruginosa PA01
gcuggcgcuaccg

SEQ ID NO: 3497234 - RNA, 17 nt, Pseudomonas aeruginosa PA01
gcuggcgcuaccgcgca

SEQ ID NO: 3497235 - RNA, 20 nt, Pseudomonas aeruginosa PA01
gcuggcgcucucgaacacca

SEQ ID NO: 3497236 - RNA, 16 nt, Pseudomonas aeruginosa PA01
gcuggcgcucugcagu

SEQ ID NO: 3497237 - RNA, 14 nt, Pseudomonas aeruginosa PA01
gcuggcgcuggucc

SEQ ID NO: 3497238 - RNA, 20 nt, Pseudomonas aeruginosa PA01
gcuggcgcugguccuugauc

SEQ ID NO: 3497239 - RNA, 19 nt, Pseudomonas aeruginosa PA01
gcuggcgcuguaggcgagc

SEQ ID NO: 3497240 - RNA, 21 nt, Pseudomonas aeruginosa PA01
gcuggcgcuguaggcgagcag

SEQ ID NO: 3497241 - RNA, 14 nt, Pseudomonas aeruginosa PA01
gcuggcgcuugccg

SEQ ID NO: 3497242 - RNA, 22 nt, Pseudomonas aeruginosa PA01
gcuggcgcuugccgcgcccggc

SEQ ID NO: 3497243 - RNA, 16 nt, Pseudomonas aeruginosa PA01
gcuggcggaaggugcc

SEQ ID NO: 3497244 - RNA, 19 nt, Pseudomonas aeruginosa PA01
gcuggcggaaggugccuuc

SEQ ID NO: 3497245 - RNA, 20 nt, Pseudomonas aeruginosa PA01
gcuggcggauguaguccagc

SEQ ID NO: 3497246 - RNA, 23 nt, Pseudomonas aeruginosa PA01
gcuggcggauguaguccagcgcc

SEQ ID NO: 3497247 - RNA, 16 nt, Pseudomonas aeruginosa PA01
gcuggcggcauaggcc

SEQ ID NO: 3497248 - RNA, 12 nt, Pseudomonas aeruginosa PA01
gcuggcggcauc

SEQ ID NO: 3497249 - RNA, 18 nt, Pseudomonas aeruginosa PA01
gcuggcggcaucggcgcc

SEQ ID NO: 3497250 - RNA, 13 nt, Pseudomonas aeruginosa PA01
gcuggcggccagg

SEQ ID NO: 3497251 - RNA, 13 nt, Pseudomonas aeruginosa PA01
gcuggcggccgag

SEQ ID NO: 3497252 - RNA, 22 nt, Pseudomonas aeruginosa PA01
gcuggcggccgaguucgcgcag

SEQ ID NO: 3497253 - RNA, 12 nt, Pseudomonas aeruginosa PA01
gcuggcggccgc

SEQ ID NO: 3497254 - RNA, 17 nt, Pseudomonas aeruginosa PA01
gcuggcggccuucggcg

SEQ ID NO: 3497255 - RNA, 20 nt, Pseudomonas aeruginosa PA01
gcuggcggcgacgaaggucg

SEQ ID NO: 3497256 - RNA, 22 nt, Pseudomonas aeruginosa PA01
gcuggcggcgacgaaggucggc

SEQ ID NO: 3497257 - RNA, 18 nt, Pseudomonas aeruginosa PA01
gcuggcggcgcucaccca

SEQ ID NO: 3497258 - RNA, 16 nt, Pseudomonas aeruginosa PA01
gcuggcggggucgcgc

SEQ ID NO: 3497259 - RNA, 19 nt, Pseudomonas aeruginosa PA01
gcuggcggggucgcgccgg

SEQ ID NO: 3497260 - RNA, 21 nt, Pseudomonas aeruginosa PA01
gcuggcggggucgcgccggug

SEQ ID NO: 3497261 - RNA, 21 nt, Pseudomonas aeruginosa PA01
gcuggcggugcggucggcgcc

SEQ ID NO: 3497262 - RNA, 16 nt, Pseudomonas aeruginosa PA01
gcuggcguaccucgcc

SEQ ID NO: 3497263 - RNA, 21 nt, Pseudomonas aeruginosa PA01
gcuggcguaccucgccaggcu

SEQ ID NO: 3497264 - RNA, 21 nt, Pseudomonas aeruginosa PA01
gcuggcguagaagucguccuc

SEQ ID NO: 3497265 - RNA, 15 nt, Pseudomonas aeruginosa PA01
gcuggcgucgaaugc

SEQ ID NO: 3497266 - RNA, 15 nt, Pseudomonas aeruginosa PA01
gcuggcgucgaccgc

SEQ ID NO: 3497267 - RNA, 19 nt, Pseudomonas aeruginosa PA01
gcuggcgucgacgccgaag

SEQ ID NO: 3497268 - RNA, 13 nt, Pseudomonas aeruginosa PA01
gcuggcgucgccu

SEQ ID NO: 3497269 - RNA, 12 nt, Pseudomonas aeruginosa PA01
gcuggcguggug

SEQ ID NO: 3497270 - RNA, 21 nt, Pseudomonas aeruginosa PA01
gcuggcguucuccagguagau

SEQ ID NO: 3497271 - RNA, 18 nt, Pseudomonas aeruginosa PA01
gcuggcguucucggccag

SEQ ID NO: 3497272 - RNA, 21 nt, Pseudomonas aeruginosa PA01
gcuggcguugacugccugcag

SEQ ID NO: 3497273 - RNA, 20 nt, Pseudomonas aeruginosa PA01
gcuggcguuguugccgccga

SEQ ID NO: 3497274 - RNA, 22 nt, Pseudomonas aeruginosa PA01
gcuggcguuguugccgccgaag

SEQ ID NO: 3497275 - RNA, 21 nt, Pseudomonas aeruginosa PA01
gcuggcuaucuuuuaaccaga

SEQ ID NO: 3497276 - RNA, 17 nt, Pseudomonas aeruginosa PA01
gcuggcugaagccgggc

SEQ ID NO: 3497277 - RNA, 18 nt, Pseudomonas aeruginosa PA01
gcuggcugaagccgggca

SEQ ID NO: 3497278 - RNA, 22 nt, Pseudomonas aeruginosa PA01
gcuggcugacagcuugucggug

SEQ ID NO: 3497279 - RNA, 14 nt, Pseudomonas aeruginosa PA01
gcuggcugcccagu

SEQ ID NO: 3497280 - RNA, 22 nt, Pseudomonas aeruginosa PA01
gcuggcugcccaguugcgcggc

SEQ ID NO: 3497281 - RNA, 15 nt, Pseudomonas aeruginosa PA01
gcuggcugcccucga

SEQ ID NO: 3497282 - RNA, 22 nt, Pseudomonas aeruginosa PA01
gcuggcugguaacgggcgaacc

SEQ ID NO: 3497283 - RNA, 20 nt, Pseudomonas aeruginosa PA01
gcuggcuguaggugcccggc

SEQ ID NO: 3497284 - RNA, 15 nt, Pseudomonas aeruginosa PA01
gcugggacgccuugu

SEQ ID NO: 3497285 - RNA, 15 nt, Pseudomonas aeruginosa PA01
gcugggacggcggcu

SEQ ID NO: 3497286 - RNA, 18 nt, Pseudomonas aeruginosa PA01
gcugggacggcugcccaa

SEQ ID NO: 3497287 - RNA, 12 nt, Pseudomonas aeruginosa PA01
gcugggcagcac

SEQ ID NO: 3497288 - RNA, 14 nt, Pseudomonas aeruginosa PA01
gcugggcagcacgc

SEQ ID NO: 3497289 - RNA, 17 nt, Pseudomonas aeruginosa PA01
gcugggcagcacgcugg

SEQ ID NO: 3497290 - RNA, 20 nt, Pseudomonas aeruginosa PA01
gcugggcagcacgcuggcgu

SEQ ID NO: 3497291 - RNA, 13 nt, Pseudomonas aeruginosa PA01
gcugggcaggugg

SEQ ID NO: 3497292 - RNA, 15 nt, Pseudomonas aeruginosa PA01
gcugggccagcgccg

SEQ ID NO: 3497293 - RNA, 16 nt, Pseudomonas aeruginosa PA01
gcugggccgaaccggg

SEQ ID NO: 3497294 - RNA, 12 nt, Pseudomonas aeruginosa PA01
gcugggccuuga

SEQ ID NO: 3497295 - RNA, 14 nt, Pseudomonas aeruginosa PA01
gcugggccuugagc

SEQ ID NO: 3497296 - RNA, 14 nt, Pseudomonas aeruginosa PA01
gcugggccuugauc

SEQ ID NO: 3497297 - RNA, 20 nt, Pseudomonas aeruginosa PA01
gcugggccuuguucagggug

SEQ ID NO: 3497298 - RNA, 21 nt, Pseudomonas aeruginosa PA01
gcugggccuuguucagggugg

SEQ ID NO: 3497299 - RNA, 22 nt, Pseudomonas aeruginosa PA01
gcugggccuuguucaggguggc

SEQ ID NO: 3497300 - RNA, 19 nt, Pseudomonas aeruginosa PA01
gcugggcgaacagcgagac

SEQ ID NO: 3497301 - RNA, 23 nt, Pseudomonas aeruginosa PA01
gcugggcgaacagcgagacccgg

SEQ ID NO: 3497302 - RNA, 20 nt, Pseudomonas aeruginosa PA01
gcugggcgaccuucagcggg

SEQ ID NO: 3497303 - RNA, 13 nt, Pseudomonas aeruginosa PA01
gcugggcgcagcc

SEQ ID NO: 3497304 - RNA, 15 nt, Pseudomonas aeruginosa PA01
gcugggcgcagcccu

SEQ ID NO: 3497305 - RNA, 17 nt, Pseudomonas aeruginosa PA01
gcugggcgcccuucagc

SEQ ID NO: 3497306 - RNA, 21 nt, Pseudomonas aeruginosa PA01
gcugggcgcccuucagcgccu

SEQ ID NO: 3497307 - RNA, 13 nt, Pseudomonas aeruginosa PA01
gcugggcgccggc

SEQ ID NO: 3497308 - RNA, 15 nt, Pseudomonas aeruginosa PA01
gcugggcgccggcag

SEQ ID NO: 3497309 - RNA, 16 nt, Pseudomonas aeruginosa PA01
gcugggcgccggcagg

SEQ ID NO: 3497310 - RNA, 17 nt, Pseudomonas aeruginosa PA01
gcugggcgccggcaggc

SEQ ID NO: 3497311 - RNA, 19 nt, Pseudomonas aeruginosa PA01
gcugggcgccggcaggccu

SEQ ID NO: 3497312 - RNA, 14 nt, Pseudomonas aeruginosa PA01
gcugggcgccucgu

SEQ ID NO: 3497313 - RNA, 18 nt, Pseudomonas aeruginosa PA01
gcugggcggcgaggccga

SEQ ID NO: 3497314 - RNA, 13 nt, Pseudomonas aeruginosa PA01
gcugggcggcugg

SEQ ID NO: 3497315 - RNA, 14 nt, Pseudomonas aeruginosa PA01
gcugggcggcuggc

SEQ ID NO: 3497316 - RNA, 17 nt, Pseudomonas aeruginosa PA01
gcugggcggcuggccga

SEQ ID NO: 3497317 - RNA, 14 nt, Pseudomonas aeruginosa PA01
gcugggcgucgaac

SEQ ID NO: 3497318 - RNA, 20 nt, Pseudomonas aeruginosa PA01
gcugggcgucgaacaccggc

SEQ ID NO: 3497319 - RNA, 17 nt, Pseudomonas aeruginosa PA01
gcugggcugggucggcu

SEQ ID NO: 3497320 - RNA, 21 nt, Pseudomonas aeruginosa PA01
gcugggcuucgcugaugccgg

SEQ ID NO: 3497321 - RNA, 17 nt, Pseudomonas aeruginosa PA01
gcuggggaacugggcga

SEQ ID NO: 3497322 - RNA, 21 nt, Pseudomonas aeruginosa PA01
gcuggggaacugggcgagcau

SEQ ID NO: 3497323 - RNA, 15 nt, Pseudomonas aeruginosa PA01
gcuggggcuguugcu

SEQ ID NO: 3497324 - RNA, 19 nt, Pseudomonas aeruginosa PA01
gcugggguugcggcgcccg

SEQ ID NO: 3497325 - RNA, 20 nt, Pseudomonas aeruginosa PA01
gcugggguugcggcgcccgc

SEQ ID NO: 3497326 - RNA, 17 nt, Pseudomonas aeruginosa PA01
gcugggucacguggccg

SEQ ID NO: 3497327 - RNA, 20 nt, Pseudomonas aeruginosa PA01
gcugggucacguggccgccc

SEQ ID NO: 3497328 - RNA, 21 nt, Pseudomonas aeruginosa PA01
gcugggucacguggccgccca

SEQ ID NO: 3497329 - RNA, 18 nt, Pseudomonas aeruginosa PA01
gcugggucaucgaggcca

SEQ ID NO: 3497330 - RNA, 19 nt, Pseudomonas aeruginosa PA01
gcugggucaucgaggccau

SEQ ID NO: 3497331 - RNA, 17 nt, Pseudomonas aeruginosa PA01
gcugggucggcuggcag

SEQ ID NO: 3497332 - RNA, 20 nt, Pseudomonas aeruginosa PA01
gcugggucggcuggcagggc

SEQ ID NO: 3497333 - RNA, 16 nt, Pseudomonas aeruginosa PA01
gcugggugcggugggc

SEQ ID NO: 3497334 - RNA, 19 nt, Pseudomonas aeruginosa PA01
gcugggugcggugggcgag

SEQ ID NO: 3497335 - RNA, 16 nt, Pseudomonas aeruginosa PA01
gcuggguggaggccca

SEQ ID NO: 3497336 - RNA, 13 nt, Pseudomonas aeruginosa PA01
gcuggguucggcg

SEQ ID NO: 3497337 - RNA, 15 nt, Pseudomonas aeruginosa PA01
gcuggguucggcgag

SEQ ID NO: 3497338 - RNA, 16 nt, Pseudomonas aeruginosa PA01
gcuggguucggcgagg

SEQ ID NO: 3497339 - RNA, 22 nt, Pseudomonas aeruginosa PA01
gcuggguucggcgaggaucgcc

SEQ ID NO: 3497340 - RNA, 17 nt, Pseudomonas aeruginosa PA01
gcuggguuggcgcgaga

SEQ ID NO: 3497341 - RNA, 15 nt, Pseudomonas aeruginosa PA01
gcuggguuuccugca

SEQ ID NO: 3497342 - RNA, 17 nt, Pseudomonas aeruginosa PA01
gcugguaauccagggag

SEQ ID NO: 3497343 - RNA, 20 nt, Pseudomonas aeruginosa PA01
gcugguaauggugaucaccu

SEQ ID NO: 3497344 - RNA, 22 nt, Pseudomonas aeruginosa PA01
gcugguaccugccggcacgcuc

SEQ ID NO: 3497345 - RNA, 19 nt, Pseudomonas aeruginosa PA01
gcugguacgcccccucccc

SEQ ID NO: 3497346 - RNA, 15 nt, Pseudomonas aeruginosa PA01
gcugguagcccaggc

SEQ ID NO: 3497347 - RNA, 16 nt, Pseudomonas aeruginosa PA01
gcugguagcccaggcc

SEQ ID NO: 3497348 - RNA, 20 nt, Pseudomonas aeruginosa PA01
gcugguagcgcuccagcucc

SEQ ID NO: 3497349 - RNA, 20 nt, Pseudomonas aeruginosa PA01
gcugguagcuaccgucggcc

SEQ ID NO: 3497350 - RNA, 22 nt, Pseudomonas aeruginosa PA01
gcugguagcuaccgucggccug

SEQ ID NO: 3497351 - RNA, 16 nt, Pseudomonas aeruginosa PA01
gcugguaggagccguc

SEQ ID NO: 3497352 - RNA, 18 nt, Pseudomonas aeruginosa PA01
gcugguagugcuggcgca

SEQ ID NO: 3497353 - RNA, 19 nt, Pseudomonas aeruginosa PA01
gcuggucaauaccacccuu

SEQ ID NO: 3497354 - RNA, 18 nt, Pseudomonas aeruginosa PA01
gcuggucagaaccaccgg

SEQ ID NO: 3497355 - RNA, 19 nt, Pseudomonas aeruginosa PA01
gcuggucagaaccaccggu

SEQ ID NO: 3497356 - RNA, 13 nt, Pseudomonas aeruginosa PA01
gcuggucaggcug

SEQ ID NO: 3497357 - RNA, 16 nt, Pseudomonas aeruginosa PA01
gcuggucaguucggcc

SEQ ID NO: 3497358 - RNA, 19 nt, Pseudomonas aeruginosa PA01
gcuggucaguucggcccag

SEQ ID NO: 3497359 - RNA, 20 nt, Pseudomonas aeruginosa PA01
gcuggucaguucggcccagc

SEQ ID NO: 3497360 - RNA, 22 nt, Pseudomonas aeruginosa PA01
gcuggucaguucggcccagcag

SEQ ID NO: 3497361 - RNA, 21 nt, Pseudomonas aeruginosa PA01
gcugguccagcacgcuggcga

SEQ ID NO: 3497362 - RNA, 23 nt, Pseudomonas aeruginosa PA01
gcugguccagcacgcuggcgagg

SEQ ID NO: 3497363 - RNA, 19 nt, Pseudomonas aeruginosa PA01
gcugguccagcuggcgcag

SEQ ID NO: 3497364 - RNA, 17 nt, Pseudomonas aeruginosa PA01
gcugguccuggcgcgag

SEQ ID NO: 3497365 - RNA, 19 nt, Pseudomonas aeruginosa PA01
gcugguccuggcgcgagaa

SEQ ID NO: 3497366 - RNA, 13 nt, Pseudomonas aeruginosa PA01
gcuggucggcauc

SEQ ID NO: 3497367 - RNA, 21 nt, Pseudomonas aeruginosa PA01
gcuggucggcauccggcaggc

SEQ ID NO: 3497368 - RNA, 23 nt, Pseudomonas aeruginosa PA01
gcuggucggcuuccgccgccagg

SEQ ID NO: 3497369 - RNA, 18 nt, Pseudomonas aeruginosa PA01
gcuggucguagcagcgga

SEQ ID NO: 3497370 - RNA, 16 nt, Pseudomonas aeruginosa PA01
gcuggucguaggcgcg

SEQ ID NO: 3497371 - RNA, 17 nt, Pseudomonas aeruginosa PA01
gcuggucguaggcgcgg

SEQ ID NO: 3497372 - RNA, 20 nt, Pseudomonas aeruginosa PA01
gcuggucguucagugccagc

SEQ ID NO: 3497373 - RNA, 18 nt, Pseudomonas aeruginosa PA01
gcuggugaugccgcggac

SEQ ID NO: 3497374 - RNA, 17 nt, Pseudomonas aeruginosa PA01
gcuggugaugucgcggc

SEQ ID NO: 3497375 - RNA, 17 nt, Pseudomonas aeruginosa PA01
gcuggugccgaucagcc

SEQ ID NO: 3497376 - RNA, 18 nt, Pseudomonas aeruginosa PA01
gcuggugccgaucagccc

SEQ ID NO: 3497377 - RNA, 22 nt, Pseudomonas aeruginosa PA01
gcuggugccgaucagcccgucg

SEQ ID NO: 3497378 - RNA, 13 nt, Pseudomonas aeruginosa PA01
gcuggugccgcug

SEQ ID NO: 3497379 - RNA, 15 nt, Pseudomonas aeruginosa PA01
gcuggugcggccgau

SEQ ID NO: 3497380 - RNA, 18 nt, Pseudomonas aeruginosa PA01
gcuggugcugcuccauca

SEQ ID NO: 3497381 - RNA, 17 nt, Pseudomonas aeruginosa PA01
gcugguggacgucgucg

SEQ ID NO: 3497382 - RNA, 19 nt, Pseudomonas aeruginosa PA01
gcugguggacgucgucggc

SEQ ID NO: 3497383 - RNA, 22 nt, Pseudomonas aeruginosa PA01
gcugguggacgucgucggcgac

SEQ ID NO: 3497384 - RNA, 18 nt, Pseudomonas aeruginosa PA01
gcugguggcccugggcgg

SEQ ID NO: 3497385 - RNA, 20 nt, Pseudomonas aeruginosa PA01
gcugguggucaccgccagcg

SEQ ID NO: 3497386 - RNA, 22 nt, Pseudomonas aeruginosa PA01
gcugguggucaccgccagcggg

SEQ ID NO: 3497387 - RNA, 20 nt, Pseudomonas aeruginosa PA01
gcugguucugguccaccagc

SEQ ID NO: 3497388 - RNA, 22 nt, Pseudomonas aeruginosa PA01
gcugguucugguccaccagccc

SEQ ID NO: 3497389 - RNA, 23 nt, Pseudomonas aeruginosa PA01
gcugguucugguccaccagcccg

SEQ ID NO: 3497390 - RNA, 14 nt, Pseudomonas aeruginosa PA01
gcugguugaagccg

SEQ ID NO: 3497391 - RNA, 18 nt, Pseudomonas aeruginosa PA01
gcugguugaagccgaucg

SEQ ID NO: 3497392 - RNA, 15 nt, Pseudomonas aeruginosa PA01
gcugguugaccaggc

SEQ ID NO: 3497393 - RNA, 16 nt, Pseudomonas aeruginosa PA01
gcugguugaggucgac

SEQ ID NO: 3497394 - RNA, 18 nt, Pseudomonas aeruginosa PA01
gcugguugaggucgacga

SEQ ID NO: 3497395 - RNA, 16 nt, Pseudomonas aeruginosa PA01
gcugguugccagcagc

SEQ ID NO: 3497396 - RNA, 15 nt, Pseudomonas aeruginosa PA01
gcugguugcccaggg

SEQ ID NO: 3497397 - RNA, 16 nt, Pseudomonas aeruginosa PA01
gcugguugcccagggu

SEQ ID NO: 3497398 - RNA, 15 nt, Pseudomonas aeruginosa PA01
gcugguuggacaccu

SEQ ID NO: 3497399 - RNA, 12 nt, Pseudomonas aeruginosa PA01
gcugguuggcga

SEQ ID NO: 3497400 - RNA, 14 nt, Pseudomonas aeruginosa PA01
gcugguuggcgagg

SEQ ID NO: 3497401 - RNA, 19 nt, Pseudomonas aeruginosa PA01
gcugguuggcgaggucgcg

SEQ ID NO: 3497402 - RNA, 18 nt, Pseudomonas aeruginosa PA01
gcuguacaagcgcaacgc

SEQ ID NO: 3497403 - RNA, 22 nt, Pseudomonas aeruginosa PA01
gcuguacaagcgcaacgcgcgc

SEQ ID NO: 3497404 - RNA, 19 nt, Pseudomonas aeruginosa PA01
gcuguacagcaggagcgcc

SEQ ID NO: 3497405 - RNA, 16 nt, Pseudomonas aeruginosa PA01
gcuguagaaugcgccu

SEQ ID NO: 3497406 - RNA, 15 nt, Pseudomonas aeruginosa PA01
gcuguagccacggcg

SEQ ID NO: 3497407 - RNA, 23 nt, Pseudomonas aeruginosa PA01
gcuguagccggcgaugugcggcg

SEQ ID NO: 3497408 - RNA, 16 nt, Pseudomonas aeruginosa PA01
gcuguagccggcgccg

SEQ ID NO: 3497409 - RNA, 21 nt, Pseudomonas aeruginosa PA01
gcuguagccggcgccgucgac

SEQ ID NO: 3497410 - RNA, 20 nt, Pseudomonas aeruginosa PA01
gcuguagccucccgccgcgg

SEQ ID NO: 3497411 - RNA, 22 nt, Pseudomonas aeruginosa PA01
gcuguagccucccgccgcggcg

SEQ ID NO: 3497412 - RNA, 17 nt, Pseudomonas aeruginosa PA01
gcuguagcggcucgccg

SEQ ID NO: 3497413 - RNA, 21 nt, Pseudomonas aeruginosa PA01
gcuguagcggcuugcagucga

SEQ ID NO: 3497414 - RNA, 22 nt, Pseudomonas aeruginosa PA01
gcuguaggacagguucaggucg

SEQ ID NO: 3497415 - RNA, 14 nt, Pseudomonas aeruginosa PA01
gcuguagggacagg

SEQ ID NO: 3497416 - RNA, 15 nt, Pseudomonas aeruginosa PA01
gcuguagggacaggc

SEQ ID NO: 3497417 - RNA, 16 nt, Pseudomonas aeruginosa PA01
gcuguagggacaggcu

SEQ ID NO: 3497418 - RNA, 17 nt, Pseudomonas aeruginosa PA01
gcuguagggcgaauaac

SEQ ID NO: 3497419 - RNA, 18 nt, Pseudomonas aeruginosa PA01
gcuguaguaggcgguggc

SEQ ID NO: 3497420 - RNA, 15 nt, Pseudomonas aeruginosa PA01
gcuguagugcuccgg

SEQ ID NO: 3497421 - RNA, 19 nt, Pseudomonas aeruginosa PA01
gcuguaguugacgucgccg

SEQ ID NO: 3497422 - RNA, 23 nt, Pseudomonas aeruginosa PA01
gcuguaguugacgucgccgaugc

SEQ ID NO: 3497423 - RNA, 20 nt, Pseudomonas aeruginosa PA01
gcuguaguuguucggcuggg

SEQ ID NO: 3497424 - RNA, 13 nt, Pseudomonas aeruginosa PA01
gcugucagggcuu

SEQ ID NO: 3497425 - RNA, 16 nt, Pseudomonas aeruginosa PA01
gcugucagggcuugcg

SEQ ID NO: 3497426 - RNA, 20 nt, Pseudomonas aeruginosa PA01
gcugucagggcuugcgcgcc

SEQ ID NO: 3497427 - RNA, 23 nt, Pseudomonas aeruginosa PA01
gcugucagggcuugcgcgccacc

SEQ ID NO: 3497428 - RNA, 14 nt, Pseudomonas aeruginosa PA01
gcuguccacgccga

SEQ ID NO: 3497429 - RNA, 19 nt, Pseudomonas aeruginosa PA01
gcuguccagcaggcguucc

SEQ ID NO: 3497430 - RNA, 16 nt, Pseudomonas aeruginosa PA01
gcuguccagcgcuccu

SEQ ID NO: 3497431 - RNA, 23 nt, Pseudomonas aeruginosa PA01
gcugucccggccauuccuuccag

SEQ ID NO: 3497432 - RNA, 14 nt, Pseudomonas aeruginosa PA01
gcuguccgccgccg

SEQ ID NO: 3497433 - RNA, 15 nt, Pseudomonas aeruginosa PA01
gcuguccgccgccgc

SEQ ID NO: 3497434 - RNA, 14 nt, Pseudomonas aeruginosa PA01
gcuguccgccggcc

SEQ ID NO: 3497435 - RNA, 15 nt, Pseudomonas aeruginosa PA01
gcuguccgccggccu

SEQ ID NO: 3497436 - RNA, 14 nt, Pseudomonas aeruginosa PA01
gcuguccgcgccgc

SEQ ID NO: 3497437 - RNA, 15 nt, Pseudomonas aeruginosa PA01
gcuguccgcgccgcg

SEQ ID NO: 3497438 - RNA, 16 nt, Pseudomonas aeruginosa PA01
gcuguccgcgccgcgu

SEQ ID NO: 3497439 - RNA, 13 nt, Pseudomonas aeruginosa PA01
gcuguccuccagc

SEQ ID NO: 3497440 - RNA, 16 nt, Pseudomonas aeruginosa PA01
gcuguccuccagcggc

SEQ ID NO: 3497441 - RNA, 18 nt, Pseudomonas aeruginosa PA01
gcuguccuccagcggcgg

SEQ ID NO: 3497442 - RNA, 16 nt, Pseudomonas aeruginosa PA01
gcuguccuguggcgcu

SEQ ID NO: 3497443 - RNA, 18 nt, Pseudomonas aeruginosa PA01
gcugucgacgcagccggg

SEQ ID NO: 3497444 - RNA, 21 nt, Pseudomonas aeruginosa PA01
gcugucgacgcagccgggccg

SEQ ID NO: 3497445 - RNA, 18 nt, Pseudomonas aeruginosa PA01
gcugucgagcacggcgcu

SEQ ID NO: 3497446 - RNA, 19 nt, Pseudomonas aeruginosa PA01
gcugucgagggucugcucg

SEQ ID NO: 3497447 - RNA, 23 nt, Pseudomonas aeruginosa PA01
gcugucgagggucugcucgacga

SEQ ID NO: 3497448 - RNA, 17 nt, Pseudomonas aeruginosa PA01
gcugucgcccucgcgga

SEQ ID NO: 3497449 - RNA, 19 nt, Pseudomonas aeruginosa PA01
gcugucgcccucgcggagc

SEQ ID NO: 3497450 - RNA, 21 nt, Pseudomonas aeruginosa PA01
gcugucgccggucaggcugcg

SEQ ID NO: 3497451 - RNA, 22 nt, Pseudomonas aeruginosa PA01
gcugucgccggucaggcugcgg

SEQ ID NO: 3497452 - RNA, 14 nt, Pseudomonas aeruginosa PA01
gcugucgcggaccc

SEQ ID NO: 3497453 - RNA, 18 nt, Pseudomonas aeruginosa PA01
gcugucgcggacccgcgc

SEQ ID NO: 3497454 - RNA, 23 nt, Pseudomonas aeruginosa PA01
gcugucgcggacccgcgccggca

SEQ ID NO: 3497455 - RNA, 22 nt, Pseudomonas aeruginosa PA01
gcugucgcguucccacucgcga

SEQ ID NO: 3497456 - RNA, 23 nt, Pseudomonas aeruginosa PA01
gcugucgcucagcgggccgaucc

SEQ ID NO: 3497457 - RNA, 12 nt, Pseudomonas aeruginosa PA01
gcugucggccag

SEQ ID NO: 3497458 - RNA, 18 nt, Pseudomonas aeruginosa PA01
gcugucggccagccccug

SEQ ID NO: 3497459 - RNA, 13 nt, Pseudomonas aeruginosa PA01
gcugucggcccgc

SEQ ID NO: 3497460 - RNA, 17 nt, Pseudomonas aeruginosa PA01
gcugucggcccgcgcca

SEQ ID NO: 3497461 - RNA, 13 nt, Pseudomonas aeruginosa PA01
gcugucggcgccc

SEQ ID NO: 3497462 - RNA, 21 nt, Pseudomonas aeruginosa PA01
gcugucguaguccugggccgg

SEQ ID NO: 3497463 - RNA, 16 nt, Pseudomonas aeruginosa PA01
gcugucguccagcggg

SEQ ID NO: 3497464 - RNA, 23 nt, Pseudomonas aeruginosa PA01
gcugucgucgaggguggcgccga

SEQ ID NO: 3497465 - RNA, 17 nt, Pseudomonas aeruginosa PA01
gcugucgucuucggcca

SEQ ID NO: 3497466 - RNA, 18 nt, Pseudomonas aeruginosa PA01
gcugucgucuucggccag

SEQ ID NO: 3497467 - RNA, 19 nt, Pseudomonas aeruginosa PA01
gcugucguggacgccggug

SEQ ID NO: 3497468 - RNA, 18 nt, Pseudomonas aeruginosa PA01
gcugucuaucccgugccg

SEQ ID NO: 3497469 - RNA, 14 nt, Pseudomonas aeruginosa PA01
gcugucucgccagc

SEQ ID NO: 3497470 - RNA, 15 nt, Pseudomonas aeruginosa PA01
gcugucucgccagcc

SEQ ID NO: 3497471 - RNA, 22 nt, Pseudomonas aeruginosa PA01
gcugucucgccagcccggcagg

SEQ ID NO: 3497472 - RNA, 18 nt, Pseudomonas aeruginosa PA01
gcugugaggugggcgcgc

SEQ ID NO: 3497473 - RNA, 23 nt, Pseudomonas aeruginosa PA01
gcugugaggugggcgcgccgcag

SEQ ID NO: 3497474 - RNA, 18 nt, Pseudomonas aeruginosa PA01
gcugugcaggaaggcgac

SEQ ID NO: 3497475 - RNA, 13 nt, Pseudomonas aeruginosa PA01
gcugugcagggca

SEQ ID NO: 3497476 - RNA, 15 nt, Pseudomonas aeruginosa PA01
gcugugcagggcagc

SEQ ID NO: 3497477 - RNA, 21 nt, Pseudomonas aeruginosa PA01
gcugugccauuccugggcccc

SEQ ID NO: 3497478 - RNA, 14 nt, Pseudomonas aeruginosa PA01
gcugugccccaggc

SEQ ID NO: 3497479 - RNA, 14 nt, Pseudomonas aeruginosa PA01
gcugugcgccaggc

SEQ ID NO: 3497480 - RNA, 15 nt, Pseudomonas aeruginosa PA01
gcugugcgccaggcc

SEQ ID NO: 3497481 - RNA, 14 nt, Pseudomonas aeruginosa PA01
gcugugcggcagca

SEQ ID NO: 3497482 - RNA, 19 nt, Pseudomonas aeruginosa PA01
gcugugcggcagcaggcug

SEQ ID NO: 3497483 - RNA, 14 nt, Pseudomonas aeruginosa PA01
gcugugcgucgagg

SEQ ID NO: 3497484 - RNA, 23 nt, Pseudomonas aeruginosa PA01
gcugugcgucgagggccuugucg

SEQ ID NO: 3497485 - RNA, 22 nt, Pseudomonas aeruginosa PA01
gcugugcucgaggaagcgcccg

SEQ ID NO: 3497486 - RNA, 18 nt, Pseudomonas aeruginosa PA01
gcugugcugcaccagcag

SEQ ID NO: 3497487 - RNA, 20 nt, Pseudomonas aeruginosa PA01
gcugugcugcaccagcaggu

SEQ ID NO: 3497488 - RNA, 18 nt, Pseudomonas aeruginosa PA01
gcugugcuggccacccuu

SEQ ID NO: 3497489 - RNA, 20 nt, Pseudomonas aeruginosa PA01
gcugugcuggccacccuugc

SEQ ID NO: 3497490 - RNA, 22 nt, Pseudomonas aeruginosa PA01
gcuguggaaguacggcgcggug

SEQ ID NO: 3497491 - RNA, 18 nt, Pseudomonas aeruginosa PA01
gcuguggagccggugccg

SEQ ID NO: 3497492 - RNA, 14 nt, Pseudomonas aeruginosa PA01
gcuguggcgcggcu

SEQ ID NO: 3497493 - RNA, 15 nt, Pseudomonas aeruginosa PA01
gccugcaccugcucg

SEQ ID NO: 3497494 - RNA, 19 nt, Pseudomonas aeruginosa PA01
gccugcaccugcucggggc

SEQ ID NO: 3497495 - RNA, 21 nt, Pseudomonas aeruginosa PA01
gccugcacguggaguucaccg

SEQ ID NO: 3497496 - RNA, 17 nt, Pseudomonas aeruginosa PA01
gccugcagcaccaccuc

SEQ ID NO: 3497497 - RNA, 18 nt, Pseudomonas aeruginosa PA01
gccugcagcaccaccucg

SEQ ID NO: 3497498 - RNA, 21 nt, Pseudomonas aeruginosa PA01
gccugcagcaccaccucgcca

SEQ ID NO: 3497499 - RNA, 15 nt, Pseudomonas aeruginosa PA01
gccugcagcaggucg

SEQ ID NO: 3497500 - RNA, 13 nt, Pseudomonas aeruginosa PA01
gccugcagccagc

SEQ ID NO: 3497501 - RNA, 21 nt, Pseudomonas aeruginosa PA01
gccugcagccagcuucagccg

SEQ ID NO: 3497502 - RNA, 13 nt, Pseudomonas aeruginosa PA01
gccugcagccugg

SEQ ID NO: 3497503 - RNA, 14 nt, Pseudomonas aeruginosa PA01
gccugcagccuggc

SEQ ID NO: 3497504 - RNA, 15 nt, Pseudomonas aeruginosa PA01
gccugcagccuggcg

SEQ ID NO: 3497505 - RNA, 20 nt, Pseudomonas aeruginosa PA01
gccugcagcgacuccagcca

SEQ ID NO: 3497506 - RNA, 16 nt, Pseudomonas aeruginosa PA01
gccugcagcucgguga

SEQ ID NO: 3497507 - RNA, 15 nt, Pseudomonas aeruginosa PA01
gccugcagguccggg

SEQ ID NO: 3497508 - RNA, 20 nt, Pseudomonas aeruginosa PA01
gccugcagguuguccagggc

SEQ ID NO: 3497509 - RNA, 16 nt, Pseudomonas aeruginosa PA01
gccugccagaccgugg

SEQ ID NO: 3497510 - RNA, 20 nt, Pseudomonas aeruginosa PA01
gccugccagaccguggcgcu

SEQ ID NO: 3497511 - RNA, 16 nt, Pseudomonas aeruginosa PA01
gccugccaggcgggga

SEQ ID NO: 3497512 - RNA, 16 nt, Pseudomonas aeruginosa PA01
gccugccccacuuccg

SEQ ID NO: 3497513 - RNA, 18 nt, Pseudomonas aeruginosa PA01
gccugccccgccggcgcu

SEQ ID NO: 3497514 - RNA, 15 nt, Pseudomonas aeruginosa PA01
gccugccguuuuacu

SEQ ID NO: 3497515 - RNA, 22 nt, Pseudomonas aeruginosa PA01
gccugccguuuuacucgucgcc

SEQ ID NO: 3497516 - RNA, 19 nt, Pseudomonas aeruginosa PA01
gccugcgauucguucagag

SEQ ID NO: 3497517 - RNA, 23 nt, Pseudomonas aeruginosa PA01
gccugcgcccucaagucuccagc

SEQ ID NO: 3497518 - RNA, 15 nt, Pseudomonas aeruginosa PA01
gccugcgccucggcc

SEQ ID NO: 3497519 - RNA, 17 nt, Pseudomonas aeruginosa PA01
gccugcgccucggcccu

SEQ ID NO: 3497520 - RNA, 20 nt, Pseudomonas aeruginosa PA01
gccugcgccucggcccuggc

SEQ ID NO: 3497521 - RNA, 18 nt, Pseudomonas aeruginosa PA01
gccugcgcgcaccaggcc

SEQ ID NO: 3497522 - RNA, 19 nt, Pseudomonas aeruginosa PA01
gccugcgcgcaccaggccu

SEQ ID NO: 3497523 - RNA, 15 nt, Pseudomonas aeruginosa PA01
gccugcgcuguucgg

SEQ ID NO: 3497524 - RNA, 19 nt, Pseudomonas aeruginosa PA01
gccugcgcuguucgggucg

SEQ ID NO: 3497525 - RNA, 16 nt, Pseudomonas aeruginosa PA01
gccugcgcuuccggca

SEQ ID NO: 3497526 - RNA, 22 nt, Pseudomonas aeruginosa PA01
gccugcgcuuccggcagccagc

SEQ ID NO: 3497527 - RNA, 18 nt, Pseudomonas aeruginosa PA01
gccugcgcuucguuggcg

SEQ ID NO: 3497528 - RNA, 20 nt, Pseudomonas aeruginosa PA01
gccugcggauagccaaccag

SEQ ID NO: 3497529 - RNA, 12 nt, Pseudomonas aeruginosa PA01
gccugcggccag

SEQ ID NO: 3497530 - RNA, 17 nt, Pseudomonas aeruginosa PA01
gccugcggccagcgcca

SEQ ID NO: 3497531 - RNA, 18 nt, Pseudomonas aeruginosa PA01
gccugcggccagcgccag

SEQ ID NO: 3497532 - RNA, 20 nt, Pseudomonas aeruginosa PA01
gccugcggccagcgccagga

SEQ ID NO: 3497533 - RNA, 21 nt, Pseudomonas aeruginosa PA01
gccugcggcguaguggugcca

SEQ ID NO: 3497534 - RNA, 22 nt, Pseudomonas aeruginosa PA01
gccugcggcguaguggugccac

SEQ ID NO: 3497535 - RNA, 21 nt, Pseudomonas aeruginosa PA01
gccugcggcguuauccgcccu

SEQ ID NO: 3497536 - RNA, 17 nt, Pseudomonas aeruginosa PA01
gccugcggcuugcccug

SEQ ID NO: 3497537 - RNA, 18 nt, Pseudomonas aeruginosa PA01
gccugcggcuugcccugc

SEQ ID NO: 3497538 - RNA, 20 nt, Pseudomonas aeruginosa PA01
gccugcggguucggcgagag

SEQ ID NO: 3497539 - RNA, 13 nt, Pseudomonas aeruginosa PA01
gccugcgguucgc

SEQ ID NO: 3497540 - RNA, 16 nt, Pseudomonas aeruginosa PA01
gccugcgucagcgagg

SEQ ID NO: 3497541 - RNA, 21 nt, Pseudomonas aeruginosa PA01
gccugcgucagcgaggcgggc

SEQ ID NO: 3497542 - RNA, 17 nt, Pseudomonas aeruginosa PA01
gccugcgucgcauccac

SEQ ID NO: 3497543 - RNA, 18 nt, Pseudomonas aeruginosa PA01
gccugcgucgcauccacc

SEQ ID NO: 3497544 - RNA, 19 nt, Pseudomonas aeruginosa PA01
gccugcgucgcauccacca

SEQ ID NO: 3497545 - RNA, 21 nt, Pseudomonas aeruginosa PA01
gccugcgucgcauccaccagc

SEQ ID NO: 3497546 - RNA, 13 nt, Pseudomonas aeruginosa PA01
gccugcguuucgc

SEQ ID NO: 3497547 - RNA, 15 nt, Pseudomonas aeruginosa PA01
gccugcguuucgccg

SEQ ID NO: 3497548 - RNA, 17 nt, Pseudomonas aeruginosa PA01
gccugcguuucgccggg

SEQ ID NO: 3497549 - RNA, 13 nt, Pseudomonas aeruginosa PA01
gccugcucagcgu

SEQ ID NO: 3497550 - RNA, 20 nt, Pseudomonas aeruginosa PA01
gccugcucagcguccucagc

SEQ ID NO: 3497551 - RNA, 12 nt, Pseudomonas aeruginosa PA01
gccugcuccagc

SEQ ID NO: 3497552 - RNA, 13 nt, Pseudomonas aeruginosa PA01
gccugcuccagcg

SEQ ID NO: 3497553 - RNA, 23 nt, Pseudomonas aeruginosa PA01
gccugcuccagcggagcgaccgg

SEQ ID NO: 3497554 - RNA, 23 nt, Pseudomonas aeruginosa PA01
gccugcuccucggcagcgcuggc

SEQ ID NO: 3497555 - RNA, 16 nt, Pseudomonas aeruginosa PA01
gccugcucgccgcuga

SEQ ID NO: 3497556 - RNA, 17 nt, Pseudomonas aeruginosa PA01
gccugcucgcgcagcca

SEQ ID NO: 3497557 - RNA, 17 nt, Pseudomonas aeruginosa PA01
gccugcucgcggcuggc

SEQ ID NO: 3497558 - RNA, 13 nt, Pseudomonas aeruginosa PA01
gccugcucggccu

SEQ ID NO: 3497559 - RNA, 14 nt, Pseudomonas aeruginosa PA01
gccugcucggccug

SEQ ID NO: 3497560 - RNA, 16 nt, Pseudomonas aeruginosa PA01
gccugcucggccugcu

SEQ ID NO: 3497561 - RNA, 18 nt, Pseudomonas aeruginosa PA01
gccugcucggccugcugc

SEQ ID NO: 3497562 - RNA, 16 nt, Pseudomonas aeruginosa PA01
gccugcucggcucgcg

SEQ ID NO: 3497563 - RNA, 19 nt, Pseudomonas aeruginosa PA01
gccugcucggcucgcgguu

SEQ ID NO: 3497564 - RNA, 15 nt, Pseudomonas aeruginosa PA01
gccugcucuucggcg

SEQ ID NO: 3497565 - RNA, 18 nt, Pseudomonas aeruginosa PA01
gccugcucuucggcggcc

SEQ ID NO: 3497566 - RNA, 19 nt, Pseudomonas aeruginosa PA01
gccugcucuucggcggcca

SEQ ID NO: 3497567 - RNA, 20 nt, Pseudomonas aeruginosa PA01
gccugcucuucggcggccag

SEQ ID NO: 3497568 - RNA, 22 nt, Pseudomonas aeruginosa PA01
gccugcucuucggcggccagcg

SEQ ID NO: 3497569 - RNA, 23 nt, Pseudomonas aeruginosa PA01
gccugcucuucggcggccagcgg

SEQ ID NO: 3497570 - RNA, 12 nt, Pseudomonas aeruginosa PA01
gccugcugcgcg

SEQ ID NO: 3497571 - RNA, 15 nt, Pseudomonas aeruginosa PA01
gccugcugcgcgggu

SEQ ID NO: 3497572 - RNA, 19 nt, Pseudomonas aeruginosa PA01
gccugcugcgcgggugucg

SEQ ID NO: 3497573 - RNA, 22 nt, Pseudomonas aeruginosa PA01
gccugcugcgcguguaccccca

SEQ ID NO: 3497574 - RNA, 16 nt, Pseudomonas aeruginosa PA01
gccugcugcgggcgcu

SEQ ID NO: 3497575 - RNA, 22 nt, Pseudomonas aeruginosa PA01
gccugcugcgggcgcugcaugg

SEQ ID NO: 3497576 - RNA, 20 nt, Pseudomonas aeruginosa PA01
gccugcugcucgaccgccug

SEQ ID NO: 3497577 - RNA, 12 nt, Pseudomonas aeruginosa PA01
gccugcuggccg

SEQ ID NO: 3497578 - RNA, 13 nt, Pseudomonas aeruginosa PA01
gccugcuggccgg

SEQ ID NO: 3497579 - RNA, 15 nt, Pseudomonas aeruginosa PA01
gccugcuggccggug

SEQ ID NO: 3497580 - RNA, 16 nt, Pseudomonas aeruginosa PA01
gccugcuggccuggga

SEQ ID NO: 3497581 - RNA, 13 nt, Pseudomonas aeruginosa PA01
gccugcuggcugc

SEQ ID NO: 3497582 - RNA, 16 nt, Pseudomonas aeruginosa PA01
gccugcugguggguga

SEQ ID NO: 3497583 - RNA, 19 nt, Pseudomonas aeruginosa PA01
gccugcuguguccggcgga

SEQ ID NO: 3497584 - RNA, 17 nt, Pseudomonas aeruginosa PA01
gccugcuucagcccggc

SEQ ID NO: 3497585 - RNA, 18 nt, Pseudomonas aeruginosa PA01
gccugcuucagcccggca

SEQ ID NO: 3497586 - RNA, 18 nt, Pseudomonas aeruginosa PA01
gccugcuucagguagugc

SEQ ID NO: 3497587 - RNA, 20 nt, Pseudomonas aeruginosa PA01
gccugcuucaggucgucggg

SEQ ID NO: 3497588 - RNA, 22 nt, Pseudomonas aeruginosa PA01
gccugcuugaaauggcggacga

SEQ ID NO: 3497589 - RNA, 13 nt, Pseudomonas aeruginosa PA01
gccugcuugcagg

SEQ ID NO: 3497590 - RNA, 14 nt, Pseudomonas aeruginosa PA01
gccugcuugcagga

SEQ ID NO: 3497591 - RNA, 16 nt, Pseudomonas aeruginosa PA01
gccugcuuggcggcgg

SEQ ID NO: 3497592 - RNA, 17 nt, Pseudomonas aeruginosa PA01
gccugcuuggcggcggu

SEQ ID NO: 3497593 - RNA, 19 nt, Pseudomonas aeruginosa PA01
gccugcuuucccugcugcg

SEQ ID NO: 3497594 - RNA, 20 nt, Pseudomonas aeruginosa PA01
gccugcuuucccugcugcgg

SEQ ID NO: 3497595 - RNA, 14 nt, Pseudomonas aeruginosa PA01
gccuggaacaccag

SEQ ID NO: 3497596 - RNA, 17 nt, Pseudomonas aeruginosa PA01
gccuggaacaccaggcc

SEQ ID NO: 3497597 - RNA, 14 nt, Pseudomonas aeruginosa PA01
gcgccgcagcaagu

SEQ ID NO: 3497598 - RNA, 13 nt, Pseudomonas aeruginosa PA01
gcgccgcagcgca

SEQ ID NO: 3497599 - RNA, 15 nt, Pseudomonas aeruginosa PA01
gcgccgcagcggcca

SEQ ID NO: 3497600 - RNA, 17 nt, Pseudomonas aeruginosa PA01
gcgccgcagcggccagg

SEQ ID NO: 3497601 - RNA, 13 nt, Pseudomonas aeruginosa PA01
gcgccgcagggcc

SEQ ID NO: 3497602 - RNA, 14 nt, Pseudomonas aeruginosa PA01
gcgccgcagggccc

SEQ ID NO: 3497603 - RNA, 21 nt, Pseudomonas aeruginosa PA01
gcgccgcagggugcggcugcu

SEQ ID NO: 3497604 - RNA, 14 nt, Pseudomonas aeruginosa PA01
gcgccgcauuggcc

SEQ ID NO: 3497605 - RNA, 17 nt, Pseudomonas aeruginosa PA01
gcgccgcauuggccagg

SEQ ID NO: 3497606 - RNA, 18 nt, Pseudomonas aeruginosa PA01
gcgccgcauuggccaggc

SEQ ID NO: 3497607 - RNA, 19 nt, Pseudomonas aeruginosa PA01
gcgccgcauuggccaggcc

SEQ ID NO: 3497608 - RNA, 20 nt, Pseudomonas aeruginosa PA01
gcgccgcauuggccaggccc

SEQ ID NO: 3497609 - RNA, 12 nt, Pseudomonas aeruginosa PA01
gcgccgccaacc

SEQ ID NO: 3497610 - RNA, 14 nt, Pseudomonas aeruginosa PA01
gcgccgccacgugc

SEQ ID NO: 3497611 - RNA, 15 nt, Pseudomonas aeruginosa PA01
gcgccgccacgugca

SEQ ID NO: 3497612 - RNA, 19 nt, Pseudomonas aeruginosa PA01
gcgccgccacgugcacgcc

SEQ ID NO: 3497613 - RNA, 20 nt, Pseudomonas aeruginosa PA01
gcgccgccacgugcacgccg

SEQ ID NO: 3497614 - RNA, 14 nt, Pseudomonas aeruginosa PA01
gcgccgccagcagg

SEQ ID NO: 3497615 - RNA, 15 nt, Pseudomonas aeruginosa PA01
gcgccgccagcagga

SEQ ID NO: 3497616 - RNA, 22 nt, Pseudomonas aeruginosa PA01
gcgccgccagcaggucggccug

SEQ ID NO: 3497617 - RNA, 23 nt, Pseudomonas aeruginosa PA01
gcgccgccagcaggucggccugc

SEQ ID NO: 3497618 - RNA, 13 nt, Pseudomonas aeruginosa PA01
gcgccgccagcca

SEQ ID NO: 3497619 - RNA, 14 nt, Pseudomonas aeruginosa PA01
gcgccgccagccag

SEQ ID NO: 3497620 - RNA, 12 nt, Pseudomonas aeruginosa PA01
gcgccgccaggc

SEQ ID NO: 3497621 - RNA, 22 nt, Pseudomonas aeruginosa PA01
gcgccgccaggcagaccaggcc

SEQ ID NO: 3497622 - RNA, 19 nt, Pseudomonas aeruginosa PA01
gcgccgccaggcaggccgg

SEQ ID NO: 3497623 - RNA, 20 nt, Pseudomonas aeruginosa PA01
gcgccgccaggcaggccggg

SEQ ID NO: 3497624 - RNA, 13 nt, Pseudomonas aeruginosa PA01
gcgccgccaggcc

SEQ ID NO: 3497625 - RNA, 17 nt, Pseudomonas aeruginosa PA01
gcgccgccaggcccugg

SEQ ID NO: 3497626 - RNA, 23 nt, Pseudomonas aeruginosa PA01
gcgccgccaggcccugggcggcg

SEQ ID NO: 3497627 - RNA, 15 nt, Pseudomonas aeruginosa PA01
gcgccgccaggcgcg

SEQ ID NO: 3497628 - RNA, 16 nt, Pseudomonas aeruginosa PA01
gcgccgccaggcgcgu

SEQ ID NO: 3497629 - RNA, 23 nt, Pseudomonas aeruginosa PA01
gcgccgccaggcgcgucuccagc

SEQ ID NO: 3497630 - RNA, 19 nt, Pseudomonas aeruginosa PA01
gcgccgccaguucgcgcag

SEQ ID NO: 3497631 - RNA, 23 nt, Pseudomonas aeruginosa PA01
gcgccgccaguucgcgcaggugc

SEQ ID NO: 3497632 - RNA, 13 nt, Pseudomonas aeruginosa PA01
gcgccgccauggu

SEQ ID NO: 3497633 - RNA, 13 nt, Pseudomonas aeruginosa PA01
gcgccgcccccgg

SEQ ID NO: 3497634 - RNA, 14 nt, Pseudomonas aeruginosa PA01
gcgccgcccccggc

SEQ ID NO: 3497635 - RNA, 20 nt, Pseudomonas aeruginosa PA01
gcgccgccccguuggcgcgg

SEQ ID NO: 3497636 - RNA, 21 nt, Pseudomonas aeruginosa PA01
gcgccgccccguuggcgcggg

SEQ ID NO: 3497637 - RNA, 23 nt, Pseudomonas aeruginosa PA01
gcgccgccccguuggcgcgggcg

SEQ ID NO: 3497638 - RNA, 18 nt, Pseudomonas aeruginosa PA01
gcgccgcccggcucgccg

SEQ ID NO: 3497639 - RNA, 13 nt, Pseudomonas aeruginosa PA01
gcgccgcccuggc

SEQ ID NO: 3497640 - RNA, 16 nt, Pseudomonas aeruginosa PA01
gcgccgcccuggccgc

SEQ ID NO: 3497641 - RNA, 22 nt, Pseudomonas aeruginosa PA01
gcgccgccgaagccgacgccga

SEQ ID NO: 3497642 - RNA, 18 nt, Pseudomonas aeruginosa PA01
gcgccgccgaggauagcg

SEQ ID NO: 3497643 - RNA, 17 nt, Pseudomonas aeruginosa PA01
gcgccgccgccgaccgu

SEQ ID NO: 3497644 - RNA, 20 nt, Pseudomonas aeruginosa PA01
gcgccgccgccgaccgugag

SEQ ID NO: 3497645 - RNA, 16 nt, Pseudomonas aeruginosa PA01
gcgccgccgccgcggu

SEQ ID NO: 3497646 - RNA, 13 nt, Pseudomonas aeruginosa PA01
gcgccgccgcggc

SEQ ID NO: 3497647 - RNA, 14 nt, Pseudomonas aeruginosa PA01
gcgccgccgcggcc

SEQ ID NO: 3497648 - RNA, 16 nt, Pseudomonas aeruginosa PA01
gcgccgccgcggccag

SEQ ID NO: 3497649 - RNA, 13 nt, Pseudomonas aeruginosa PA01
gcgccgccgcugg

SEQ ID NO: 3497650 - RNA, 13 nt, Pseudomonas aeruginosa PA01
gcgccgccggcga

SEQ ID NO: 3497651 - RNA, 12 nt, Pseudomonas aeruginosa PA01
gcgccgccggcu

SEQ ID NO: 3497652 - RNA, 15 nt, Pseudomonas aeruginosa PA01
gcgccgccggcuccu

SEQ ID NO: 3497653 - RNA, 13 nt, Pseudomonas aeruginosa PA01
gcgccgccgggcg

SEQ ID NO: 3497654 - RNA, 14 nt, Pseudomonas aeruginosa PA01
gcgccgccgggcgu

SEQ ID NO: 3497655 - RNA, 19 nt, Pseudomonas aeruginosa PA01
gcgccgccggggaucagcg

SEQ ID NO: 3497656 - RNA, 19 nt, Pseudomonas aeruginosa PA01
gcgccgccgguaucccggc

SEQ ID NO: 3497657 - RNA, 20 nt, Pseudomonas aeruginosa PA01
gcgccgccggugcaccaggc

SEQ ID NO: 3497658 - RNA, 12 nt, Pseudomonas aeruginosa PA01
gcgccgccgucu

SEQ ID NO: 3497659 - RNA, 21 nt, Pseudomonas aeruginosa PA01
gcgccgccucgaaggccggca

SEQ ID NO: 3497660 - RNA, 18 nt, Pseudomonas aeruginosa PA01
gcgccgccucgauggcgg

SEQ ID NO: 3497661 - RNA, 21 nt, Pseudomonas aeruginosa PA01
gcgccgccucgcgcaacgccu

SEQ ID NO: 3497662 - RNA, 21 nt, Pseudomonas aeruginosa PA01
gcgccgccucgcugggcgggc

SEQ ID NO: 3497663 - RNA, 16 nt, Pseudomonas aeruginosa PA01
gcgccgccucgggcag

SEQ ID NO: 3497664 - RNA, 20 nt, Pseudomonas aeruginosa PA01
gcgccgccucgggcagcccc

SEQ ID NO: 3497665 - RNA, 17 nt, Pseudomonas aeruginosa PA01
gcgccgccugcggcuug

SEQ ID NO: 3497666 - RNA, 13 nt, Pseudomonas aeruginosa PA01
gcgccgccugcug

SEQ ID NO: 3497667 - RNA, 13 nt, Pseudomonas aeruginosa PA01
gcgccgccuggcc

SEQ ID NO: 3497668 - RNA, 15 nt, Pseudomonas aeruginosa PA01
gcgccgccuggccgg

SEQ ID NO: 3497669 - RNA, 16 nt, Pseudomonas aeruginosa PA01
gcgccgccuggccggu

SEQ ID NO: 3497670 - RNA, 18 nt, Pseudomonas aeruginosa PA01
gcgccgccuggccgguga

SEQ ID NO: 3497671 - RNA, 19 nt, Pseudomonas aeruginosa PA01
gcgccgccuugagcggcgc

SEQ ID NO: 3497672 - RNA, 20 nt, Pseudomonas aeruginosa PA01
gcgccgccuugagcggcgcc

SEQ ID NO: 3497673 - RNA, 22 nt, Pseudomonas aeruginosa PA01
gcgccgccuugagcggcgcccu

SEQ ID NO: 3497674 - RNA, 22 nt, Pseudomonas aeruginosa PA01
gcgccgcgaacacacccugcgc

SEQ ID NO: 3497675 - RNA, 18 nt, Pseudomonas aeruginosa PA01
gcgccgcgcaccugggcg

SEQ ID NO: 3497676 - RNA, 12 nt, Pseudomonas aeruginosa PA01
gcgccgcgcagc

SEQ ID NO: 3497677 - RNA, 13 nt, Pseudomonas aeruginosa PA01
gcgccgcgcagcg

SEQ ID NO: 3497678 - RNA, 23 nt, Pseudomonas aeruginosa PA01
gcgccgcgcaguucguccaucgc

SEQ ID NO: 3497679 - RNA, 13 nt, Pseudomonas aeruginosa PA01
gcgccgcgcaucc

SEQ ID NO: 3497680 - RNA, 18 nt, Pseudomonas aeruginosa PA01
gcgccgcgcauccucggc

SEQ ID NO: 3497681 - RNA, 14 nt, Pseudomonas aeruginosa PA01
gcgccgcgccaacu

SEQ ID NO: 3497682 - RNA, 13 nt, Pseudomonas aeruginosa PA01
gcgccgcgccagc

SEQ ID NO: 3497683 - RNA, 15 nt, Pseudomonas aeruginosa PA01
gcgccgcgccagcag

SEQ ID NO: 3497684 - RNA, 17 nt, Pseudomonas aeruginosa PA01
gcgccgcgccagcaggc

SEQ ID NO: 3497685 - RNA, 19 nt, Pseudomonas aeruginosa PA01
gcgccgcgccagcaggcgc

SEQ ID NO: 3497686 - RNA, 13 nt, Pseudomonas aeruginosa PA01
gcgccgcgcggca

SEQ ID NO: 3497687 - RNA, 21 nt, Pseudomonas aeruginosa PA01
gcgccgcgcggcaacaccaca

SEQ ID NO: 3497688 - RNA, 12 nt, Pseudomonas aeruginosa PA01
gcgccgcgcugc

SEQ ID NO: 3497689 - RNA, 13 nt, Pseudomonas aeruginosa PA01
gcgccgcgcugcg

SEQ ID NO: 3497690 - RNA, 14 nt, Pseudomonas aeruginosa PA01
gcgccgcgcuuggc

SEQ ID NO: 3497691 - RNA, 16 nt, Pseudomonas aeruginosa PA01
gcgccgcgcuuggccu

SEQ ID NO: 3497692 - RNA, 17 nt, Pseudomonas aeruginosa PA01
gcgccgcggcccggcgc

SEQ ID NO: 3497693 - RNA, 19 nt, Pseudomonas aeruginosa PA01
gcgccgcggcccggcgcug

SEQ ID NO: 3497694 - RNA, 14 nt, Pseudomonas aeruginosa PA01
gcgccgcggcgacc

SEQ ID NO: 3497695 - RNA, 15 nt, Pseudomonas aeruginosa PA01
gcgccgcggcgacca

SEQ ID NO: 3497696 - RNA, 13 nt, Pseudomonas aeruginosa PA01
gcgccgcggcggc

SEQ ID NO: 3497697 - RNA, 14 nt, Pseudomonas aeruginosa PA01
gcgccgcggcggcg

SEQ ID NO: 3497698 - RNA, 16 nt, Pseudomonas aeruginosa PA01
gcgccgcggcggcgga

SEQ ID NO: 3497699 - RNA, 15 nt, Pseudomonas aeruginosa PA01
gcgccgcggcggcgu

SEQ ID NO: 3497700 - RNA, 20 nt, Pseudomonas aeruginosa PA01
gcgccgcggcggcgugcagg

SEQ ID NO: 3497701 - RNA, 12 nt, Pseudomonas aeruginosa PA01
gcgccgcgggcc

SEQ ID NO: 3497702 - RNA, 17 nt, Pseudomonas aeruginosa PA01
gcgccgcgggccagccg

SEQ ID NO: 3497703 - RNA, 14 nt, Pseudomonas aeruginosa PA01
gcgccgcgggcgcu

SEQ ID NO: 3497704 - RNA, 13 nt, Pseudomonas aeruginosa PA01
gcgccgcggguca

SEQ ID NO: 3497705 - RNA, 15 nt, Pseudomonas aeruginosa PA01
gcgccgcgggucacc

SEQ ID NO: 3497706 - RNA, 17 nt, Pseudomonas aeruginosa PA01
gcgccgcgggucaccag

SEQ ID NO: 3497707 - RNA, 18 nt, Pseudomonas aeruginosa PA01
gcgccgcgggucaccagc

SEQ ID NO: 3497708 - RNA, 20 nt, Pseudomonas aeruginosa PA01
gcgccgcgggucaccagcgc

SEQ ID NO: 3497709 - RNA, 22 nt, Pseudomonas aeruginosa PA01
gcgccgcgggucaccagcgccg

SEQ ID NO: 3497710 - RNA, 23 nt, Pseudomonas aeruginosa PA01
gcgccgcgggucugcucggcgcc

SEQ ID NO: 3497711 - RNA, 19 nt, Pseudomonas aeruginosa PA01
gcgccgcgguuuccgugcg

SEQ ID NO: 3497712 - RNA, 20 nt, Pseudomonas aeruginosa PA01
gcgccgcgguuuccgugcgg

SEQ ID NO: 3497713 - RNA, 17 nt, Pseudomonas aeruginosa PA01
gcgccgcgucgccgcca

SEQ ID NO: 3497714 - RNA, 18 nt, Pseudomonas aeruginosa PA01
gcgccgcgucgccgccag

SEQ ID NO: 3497715 - RNA, 21 nt, Pseudomonas aeruginosa PA01
gcgccgcguucgccgagcuga

SEQ ID NO: 3497716 - RNA, 15 nt, Pseudomonas aeruginosa PA01
gcgccgcuaugggca

SEQ ID NO: 3497717 - RNA, 19 nt, Pseudomonas aeruginosa PA01
gcgccgcuaugggcaccgc

SEQ ID NO: 3497718 - RNA, 16 nt, Pseudomonas aeruginosa PA01
gcgccgcucaggcguc

SEQ ID NO: 3497719 - RNA, 18 nt, Pseudomonas aeruginosa PA01
gcgccgcuccuggcaggc

SEQ ID NO: 3497720 - RNA, 19 nt, Pseudomonas aeruginosa PA01
gcgccgcuccuggcaggcu

SEQ ID NO: 3497721 - RNA, 20 nt, Pseudomonas aeruginosa PA01
gcgccgcucgaugcccgcca

SEQ ID NO: 3497722 - RNA, 21 nt, Pseudomonas aeruginosa PA01
gcgccgcucgaugcccgccag

SEQ ID NO: 3497723 - RNA, 22 nt, Pseudomonas aeruginosa PA01
gcgccgcucgaugcccgccagc

SEQ ID NO: 3497724 - RNA, 13 nt, Pseudomonas aeruginosa PA01
gcgccgcucgcgc

SEQ ID NO: 3497725 - RNA, 18 nt, Pseudomonas aeruginosa PA01
gcgccgcucgcgcacggc

SEQ ID NO: 3497726 - RNA, 16 nt, Pseudomonas aeruginosa PA01
gcgccgcucggcgagc

SEQ ID NO: 3497727 - RNA, 20 nt, Pseudomonas aeruginosa PA01
gcgccgcucggcgagccgcc

SEQ ID NO: 3497728 - RNA, 21 nt, Pseudomonas aeruginosa PA01
gcgccgcucggcgagccgccg

SEQ ID NO: 3497729 - RNA, 22 nt, Pseudomonas aeruginosa PA01
gcgccgcucggcgagccgccgg

SEQ ID NO: 3497730 - RNA, 23 nt, Pseudomonas aeruginosa PA01
gcgccgcucggcgagccgccggg

SEQ ID NO: 3497731 - RNA, 15 nt, Pseudomonas aeruginosa PA01
gcgccgcugcccaga

SEQ ID NO: 3497732 - RNA, 15 nt, Pseudomonas aeruginosa PA01
gcgccgcugcggcug

SEQ ID NO: 3497733 - RNA, 18 nt, Pseudomonas aeruginosa PA01
gcgccgcugcggcugcag

SEQ ID NO: 3497734 - RNA, 22 nt, Pseudomonas aeruginosa PA01
gcgccgcugcggcugcagggcc

SEQ ID NO: 3497735 - RNA, 14 nt, Pseudomonas aeruginosa PA01
gcgccgcuggcgug

SEQ ID NO: 3497736 - RNA, 18 nt, Pseudomonas aeruginosa PA01
gcgccgcugucuaucugc

SEQ ID NO: 3497737 - RNA, 23 nt, Pseudomonas aeruginosa PA01
gcgccgcugucuaucugcgccga

SEQ ID NO: 3497738 - RNA, 17 nt, Pseudomonas aeruginosa PA01
gcgccgcuuugcagggu

SEQ ID NO: 3497739 - RNA, 20 nt, Pseudomonas aeruginosa PA01
gcgccggaaguggcagcgcc

SEQ ID NO: 3497740 - RNA, 16 nt, Pseudomonas aeruginosa PA01
gcgccggaaucgacgg

SEQ ID NO: 3497741 - RNA, 18 nt, Pseudomonas aeruginosa PA01
gcgccggacaggccaccc

SEQ ID NO: 3497742 - RNA, 19 nt, Pseudomonas aeruginosa PA01
gcgccggacaggccacccg

SEQ ID NO: 3497743 - RNA, 23 nt, Pseudomonas aeruginosa PA01
gcgccggacaggccacccgccuc

SEQ ID NO: 3497744 - RNA, 14 nt, Pseudomonas aeruginosa PA01
gcgccggaccagau

SEQ ID NO: 3497745 - RNA, 19 nt, Pseudomonas aeruginosa PA01
gcgccggaccagaucggcg

SEQ ID NO: 3497746 - RNA, 19 nt, Pseudomonas aeruginosa PA01
gcgccggaccagccggucc

SEQ ID NO: 3497747 - RNA, 19 nt, Pseudomonas aeruginosa PA01
gcgccggagccaccgggau

SEQ ID NO: 3497748 - RNA, 21 nt, Pseudomonas aeruginosa PA01
gcgccggagccaccgggaucu

SEQ ID NO: 3497749 - RNA, 16 nt, Pseudomonas aeruginosa PA01
gcgccggagcugguca

SEQ ID NO: 3497750 - RNA, 13 nt, Pseudomonas aeruginosa PA01
gcgccggaucggc

SEQ ID NO: 3497751 - RNA, 20 nt, Pseudomonas aeruginosa PA01
gcgccggaucggcugaccgg

SEQ ID NO: 3497752 - RNA, 17 nt, Pseudomonas aeruginosa PA01
gcgccggaugggcgagc

SEQ ID NO: 3497753 - RNA, 15 nt, Pseudomonas aeruginosa PA01
gcgccggcaacagca

SEQ ID NO: 3497754 - RNA, 15 nt, Pseudomonas aeruginosa PA01
gcgccggcacggcau

SEQ ID NO: 3497755 - RNA, 19 nt, Pseudomonas aeruginosa PA01
gcgccggcagcucggccga

SEQ ID NO: 3497756 - RNA, 20 nt, Pseudomonas aeruginosa PA01
gcgccggcaggaacgcccgc

SEQ ID NO: 3497757 - RNA, 14 nt, Pseudomonas aeruginosa PA01
gcgccggcaggccu

SEQ ID NO: 3497758 - RNA, 15 nt, Pseudomonas aeruginosa PA01
gcgccggcaggccuu

SEQ ID NO: 3497759 - RNA, 23 nt, Pseudomonas aeruginosa PA01
gcgccggcaggccuucggcgccg

SEQ ID NO: 3497760 - RNA, 16 nt, Pseudomonas aeruginosa PA01
gcgccggcaucgccau

SEQ ID NO: 3497761 - RNA, 21 nt, Pseudomonas aeruginosa PA01
gcgccggcaucgccauggcgc

SEQ ID NO: 3497762 - RNA, 17 nt, Pseudomonas aeruginosa PA01
gcgccggcaugacggau

SEQ ID NO: 3497763 - RNA, 13 nt, Pseudomonas aeruginosa PA01
gcgccggccagag

SEQ ID NO: 3497764 - RNA, 15 nt, Pseudomonas aeruginosa PA01
gcgccggccagagcu

SEQ ID NO: 3497765 - RNA, 12 nt, Pseudomonas aeruginosa PA01
gcgccggccagg

SEQ ID NO: 3497766 - RNA, 16 nt, Pseudomonas aeruginosa PA01
gcgccggcccagcagg

SEQ ID NO: 3497767 - RNA, 21 nt, Pseudomonas aeruginosa PA01
gcgccggcccagcaggccggc

SEQ ID NO: 3497768 - RNA, 13 nt, Pseudomonas aeruginosa PA01
gcgccggccgggc

SEQ ID NO: 3497769 - RNA, 12 nt, Pseudomonas aeruginosa PA01
gcgccggccguc

SEQ ID NO: 3497770 - RNA, 13 nt, Pseudomonas aeruginosa PA01
gcgccggccucgc

SEQ ID NO: 3497771 - RNA, 17 nt, Pseudomonas aeruginosa PA01
gcgccggcgaucgccag

SEQ ID NO: 3497772 - RNA, 19 nt, Pseudomonas aeruginosa PA01
gcgccggcgaucgccaggc

SEQ ID NO: 3497773 - RNA, 12 nt, Pseudomonas aeruginosa PA01
gcgccggcgcug

SEQ ID NO: 3497774 - RNA, 20 nt, Pseudomonas aeruginosa PA01
gcgccggcgcugcgagcgcu

SEQ ID NO: 3497775 - RNA, 20 nt, Pseudomonas aeruginosa PA01
gcgccggcggaucacaggcu

SEQ ID NO: 3497776 - RNA, 17 nt, Pseudomonas aeruginosa PA01
gcgccggcggaucagcc

SEQ ID NO: 3497777 - RNA, 20 nt, Pseudomonas aeruginosa PA01
gcgccggcggaucagcccgc

SEQ ID NO: 3497778 - RNA, 12 nt, Pseudomonas aeruginosa PA01
gcgccggcggcc

SEQ ID NO: 3497779 - RNA, 16 nt, Pseudomonas aeruginosa PA01
gcgccggcggccggcg

SEQ ID NO: 3497780 - RNA, 20 nt, Pseudomonas aeruginosa PA01
gcgccggcggccggcgcagu

SEQ ID NO: 3497781 - RNA, 14 nt, Pseudomonas aeruginosa PA01
gcgccggcggccug

SEQ ID NO: 3497782 - RNA, 18 nt, Pseudomonas aeruginosa PA01
gcgccggcggccugcccc

SEQ ID NO: 3497783 - RNA, 16 nt, Pseudomonas aeruginosa PA01
gcgccggcggcgcguc

SEQ ID NO: 3497784 - RNA, 18 nt, Pseudomonas aeruginosa PA01
gcgccggcggcgcgucca

SEQ ID NO: 3497785 - RNA, 16 nt, Pseudomonas aeruginosa PA01
gcgccggcucgcccag

SEQ ID NO: 3497786 - RNA, 17 nt, Pseudomonas aeruginosa PA01
gcgccggcucgcccagc

SEQ ID NO: 3497787 - RNA, 19 nt, Pseudomonas aeruginosa PA01
gcgccggcucgcccagcag

SEQ ID NO: 3497788 - RNA, 20 nt, Pseudomonas aeruginosa PA01
gcgccggcucgcccagcagg

SEQ ID NO: 3497789 - RNA, 16 nt, Pseudomonas aeruginosa PA01
gcgccggcucgugcga

SEQ ID NO: 3497790 - RNA, 19 nt, Pseudomonas aeruginosa PA01
gcgccggcugacgcuggcg

SEQ ID NO: 3497791 - RNA, 13 nt, Pseudomonas aeruginosa PA01
gcgccggcugccg

SEQ ID NO: 3497792 - RNA, 15 nt, Pseudomonas aeruginosa PA01
gcgccggcugccgcg

SEQ ID NO: 3497793 - RNA, 16 nt, Pseudomonas aeruginosa PA01
gcgccggcuuggcuca

SEQ ID NO: 3497794 - RNA, 18 nt, Pseudomonas aeruginosa PA01
gcgccggcuuggcucagu

SEQ ID NO: 3497795 - RNA, 21 nt, Pseudomonas aeruginosa PA01
gcgccgggaagcaccgacucg

SEQ ID NO: 3497796 - RNA, 15 nt, Pseudomonas aeruginosa PA01
gcgccgggaugcuca

SEQ ID NO: 3497797 - RNA, 18 nt, Pseudomonas aeruginosa PA01
gcgccgggaugcucaccg

SEQ ID NO: 3497798 - RNA, 18 nt, Pseudomonas aeruginosa PA01
gcgccgggcauucgcagc

SEQ ID NO: 3497799 - RNA, 20 nt, Pseudomonas aeruginosa PA01
gcgccgggcauucgcagcgg

SEQ ID NO: 3497800 - RNA, 12 nt, Pseudomonas aeruginosa PA01
gcgccgggccgc

SEQ ID NO: 3497801 - RNA, 15 nt, Pseudomonas aeruginosa PA01
gcgccgggccucggc

SEQ ID NO: 3497802 - RNA, 14 nt, Pseudomonas aeruginosa PA01
gcgccgggcucagc

SEQ ID NO: 3497803 - RNA, 14 nt, Pseudomonas aeruginosa PA01
gcgccgggcugccg

SEQ ID NO: 3497804 - RNA, 16 nt, Pseudomonas aeruginosa PA01
gcgccgggcugccgaa

SEQ ID NO: 3497805 - RNA, 17 nt, Pseudomonas aeruginosa PA01
gcgccgggcugccgaac

SEQ ID NO: 3497806 - RNA, 14 nt, Pseudomonas aeruginosa PA01
gcgccgggcuggcc

SEQ ID NO: 3497807 - RNA, 16 nt, Pseudomonas aeruginosa PA01
gcgccgggcuggccgu

SEQ ID NO: 3497808 - RNA, 17 nt, Pseudomonas aeruginosa PA01
gcgccgggcuggccguc

SEQ ID NO: 3497809 - RNA, 18 nt, Pseudomonas aeruginosa PA01
gcgccgggcuggccgucg

SEQ ID NO: 3497810 - RNA, 16 nt, Pseudomonas aeruginosa PA01
gcgccggggaucaggu

SEQ ID NO: 3497811 - RNA, 20 nt, Pseudomonas aeruginosa PA01
gcgccggggaucaggucgcc

SEQ ID NO: 3497812 - RNA, 22 nt, Pseudomonas aeruginosa PA01
gcgccggggaucaggucgccgc

SEQ ID NO: 3497813 - RNA, 18 nt, Pseudomonas aeruginosa PA01
gcgccggggcagcagggc

SEQ ID NO: 3497814 - RNA, 20 nt, Pseudomonas aeruginosa PA01
gcgccggggcagcagggcgu

SEQ ID NO: 3497815 - RNA, 19 nt, Pseudomonas aeruginosa PA01
gcgccgggucgacaugcag

SEQ ID NO: 3497816 - RNA, 15 nt, Pseudomonas aeruginosa PA01
gcgccgggucgaccu

SEQ ID NO: 3497817 - RNA, 19 nt, Pseudomonas aeruginosa PA01
gcgccgggucgaccuugcc

SEQ ID NO: 3497818 - RNA, 18 nt, Pseudomonas aeruginosa PA01
gcgccgggucgaugggcc

SEQ ID NO: 3497819 - RNA, 15 nt, Pseudomonas aeruginosa PA01
gcgccgggucggaug

SEQ ID NO: 3497820 - RNA, 14 nt, Pseudomonas aeruginosa PA01
gcgccgggugaccg

SEQ ID NO: 3497821 - RNA, 16 nt, Pseudomonas aeruginosa PA01
gcgccgggugaccgug

SEQ ID NO: 3497822 - RNA, 18 nt, Pseudomonas aeruginosa PA01
gcgccgggugaccgugcg

SEQ ID NO: 3497823 - RNA, 15 nt, Pseudomonas aeruginosa PA01
gcgccgggugccggu

SEQ ID NO: 3497824 - RNA, 18 nt, Pseudomonas aeruginosa PA01
gcgccgggugccggugcg

SEQ ID NO: 3497825 - RNA, 17 nt, Pseudomonas aeruginosa PA01
gcgccggguugcgccgc

SEQ ID NO: 3497826 - RNA, 18 nt, Pseudomonas aeruginosa PA01
gcgccggguugcgccgca

SEQ ID NO: 3497827 - RNA, 16 nt, Pseudomonas aeruginosa PA01
gcgccgguaauaggcu

SEQ ID NO: 3497828 - RNA, 22 nt, Pseudomonas aeruginosa PA01
gcgccgguaaugacgaucucga

SEQ ID NO: 3497829 - RNA, 17 nt, Pseudomonas aeruginosa PA01
gcgccgguagcggcgca

SEQ ID NO: 3497830 - RNA, 23 nt, Pseudomonas aeruginosa PA01
gcgccgguaguucgcugaccgcg

SEQ ID NO: 3497831 - RNA, 17 nt, Pseudomonas aeruginosa PA01
gcgccgguccuuguccg

SEQ ID NO: 3497832 - RNA, 15 nt, Pseudomonas aeruginosa PA01
gcgccggugaggcgc

SEQ ID NO: 3497833 - RNA, 19 nt, Pseudomonas aeruginosa PA01
gcgccggugaggcgcagca

SEQ ID NO: 3497834 - RNA, 21 nt, Pseudomonas aeruginosa PA01
gcgccggugaggcgcagcagc

SEQ ID NO: 3497835 - RNA, 21 nt, Pseudomonas aeruginosa PA01
gcgccggugaucgagccgccg

SEQ ID NO: 3497836 - RNA, 14 nt, Pseudomonas aeruginosa PA01
gcgccggugcauga

SEQ ID NO: 3497837 - RNA, 21 nt, Pseudomonas aeruginosa PA01
gcgccggugcaugaaggcgcu

SEQ ID NO: 3497838 - RNA, 23 nt, Pseudomonas aeruginosa PA01
gcgccggugcaugaaggcgcuga

SEQ ID NO: 3497839 - RNA, 14 nt, Pseudomonas aeruginosa PA01
gcgccgguggccag

SEQ ID NO: 3497840 - RNA, 15 nt, Pseudomonas aeruginosa PA01
gcgccgguggccagg

SEQ ID NO: 3497841 - RNA, 17 nt, Pseudomonas aeruginosa PA01
gcgccgguggccaggac

SEQ ID NO: 3497842 - RNA, 20 nt, Pseudomonas aeruginosa PA01
gcgccgguggccaggacgcu

SEQ ID NO: 3497843 - RNA, 21 nt, Pseudomonas aeruginosa PA01
gcgccgguggccaggacgcug

SEQ ID NO: 3497844 - RNA, 22 nt, Pseudomonas aeruginosa PA01
gcgccgguggcguacccgcccu

SEQ ID NO: 3497845 - RNA, 13 nt, Pseudomonas aeruginosa PA01
gcgccgguugcug

SEQ ID NO: 3497846 - RNA, 16 nt, Pseudomonas aeruginosa PA01
gcgccgguugcugcug

SEQ ID NO: 3497847 - RNA, 18 nt, Pseudomonas aeruginosa PA01
gcgccgguugcugcugcg

SEQ ID NO: 3497848 - RNA, 22 nt, Pseudomonas aeruginosa PA01
gcgccgguuucgaccggcgcgc

SEQ ID NO: 3497849 - RNA, 18 nt, Pseudomonas aeruginosa PA01
gcgccguacgcaccgcgu

SEQ ID NO: 3497850 - RNA, 16 nt, Pseudomonas aeruginosa PA01
gcgccgucaccagcag

SEQ ID NO: 3497851 - RNA, 18 nt, Pseudomonas aeruginosa PA01
gcgccgucaccagcagcc

SEQ ID NO: 3497852 - RNA, 22 nt, Pseudomonas aeruginosa PA01
gcgccguccugcaacugcucga

SEQ ID NO: 3497853 - RNA, 15 nt, Pseudomonas aeruginosa PA01
gcgccgucgaucagg

SEQ ID NO: 3497854 - RNA, 21 nt, Pseudomonas aeruginosa PA01
gcgccgucgaucagguaggcc

SEQ ID NO: 3497855 - RNA, 15 nt, Pseudomonas aeruginosa PA01
gcgccgucgcuggcg

SEQ ID NO: 3497856 - RNA, 14 nt, Pseudomonas aeruginosa PA01
gcgccgucgggggc

SEQ ID NO: 3497857 - RNA, 18 nt, Pseudomonas aeruginosa PA01
gcgccgucgggggcgcgu

SEQ ID NO: 3497858 - RNA, 16 nt, Pseudomonas aeruginosa PA01
gcgccguggaucgccc

SEQ ID NO: 3497859 - RNA, 17 nt, Pseudomonas aeruginosa PA01
gcgccguggcaccaggu

SEQ ID NO: 3497860 - RNA, 15 nt, Pseudomonas aeruginosa PA01
gcgccguuacgccgg

SEQ ID NO: 3497861 - RNA, 16 nt, Pseudomonas aeruginosa PA01
gcgccguuacgccggg

SEQ ID NO: 3497862 - RNA, 16 nt, Pseudomonas aeruginosa PA01
gcgccguucacgccug

SEQ ID NO: 3497863 - RNA, 22 nt, Pseudomonas aeruginosa PA01
gcgccguucacgccuggcggcu

SEQ ID NO: 3497864 - RNA, 15 nt, Pseudomonas aeruginosa PA01
gcgccguugccgaug

SEQ ID NO: 3497865 - RNA, 17 nt, Pseudomonas aeruginosa PA01
gcgccguugccgaugcc

SEQ ID NO: 3497866 - RNA, 14 nt, Pseudomonas aeruginosa PA01
gcgccguugccggu

SEQ ID NO: 3497867 - RNA, 22 nt, Pseudomonas aeruginosa PA01
gcgccguugccgguacucgccg

SEQ ID NO: 3497868 - RNA, 23 nt, Pseudomonas aeruginosa PA01
gcgccguugccgguacucgccgg

SEQ ID NO: 3497869 - RNA, 20 nt, Pseudomonas aeruginosa PA01
gcgccguuguucaggcgcgc

SEQ ID NO: 3497870 - RNA, 18 nt, Pseudomonas aeruginosa PA01
gcgccguuucgacgaugc

SEQ ID NO: 3497871 - RNA, 22 nt, Pseudomonas aeruginosa PA01
gcgccguuuucaaugacgggga

SEQ ID NO: 3497872 - RNA, 18 nt, Pseudomonas aeruginosa PA01
gcgccguuuucguaucac

SEQ ID NO: 3497873 - RNA, 19 nt, Pseudomonas aeruginosa PA01
gcgccuagacccugggcca

SEQ ID NO: 3497874 - RNA, 17 nt, Pseudomonas aeruginosa PA01
gcgccucacggucgcag

SEQ ID NO: 3497875 - RNA, 20 nt, Pseudomonas aeruginosa PA01
gcgccucacggucgcagggg

SEQ ID NO: 3497876 - RNA, 22 nt, Pseudomonas aeruginosa PA01
gcgccucacggucgcaggggcu

SEQ ID NO: 3497877 - RNA, 13 nt, Pseudomonas aeruginosa PA01
gcgccucagcggc

SEQ ID NO: 3497878 - RNA, 15 nt, Pseudomonas aeruginosa PA01
gcgccucagcggccu

SEQ ID NO: 3497879 - RNA, 16 nt, Pseudomonas aeruginosa PA01
gcgccucagcggccuu

SEQ ID NO: 3497880 - RNA, 14 nt, Pseudomonas aeruginosa PA01
gcgccucagcggcu

SEQ ID NO: 3497881 - RNA, 17 nt, Pseudomonas aeruginosa PA01
gcgccucagcggcuggc

SEQ ID NO: 3497882 - RNA, 14 nt, Pseudomonas aeruginosa PA01
gcgccuccagcacc

SEQ ID NO: 3497883 - RNA, 13 nt, Pseudomonas aeruginosa PA01
gcgccuccaggcg

SEQ ID NO: 3497884 - RNA, 15 nt, Pseudomonas aeruginosa PA01
gcgccuccaggcgcg

SEQ ID NO: 3497885 - RNA, 18 nt, Pseudomonas aeruginosa PA01
gcgccuccaggcgcgccu

SEQ ID NO: 3497886 - RNA, 20 nt, Pseudomonas aeruginosa PA01
gcgccuccaggcgcgccugg

SEQ ID NO: 3497887 - RNA, 23 nt, Pseudomonas aeruginosa PA01
gcgccuccagguagaccuugccg

SEQ ID NO: 3497888 - RNA, 16 nt, Pseudomonas aeruginosa PA01
gcgccucccagggucg

SEQ ID NO: 3497889 - RNA, 17 nt, Pseudomonas aeruginosa PA01
gcgccucccgcugaucg

SEQ ID NO: 3497890 - RNA, 13 nt, Pseudomonas aeruginosa PA01
gcgccuccggcag

SEQ ID NO: 3497891 - RNA, 16 nt, Pseudomonas aeruginosa PA01
gcgccuccggcagcgu

SEQ ID NO: 3497892 - RNA, 12 nt, Pseudomonas aeruginosa PA01
gcgccuccucgg

SEQ ID NO: 3497893 - RNA, 16 nt, Pseudomonas aeruginosa PA01
gcgccuccucggcggc

SEQ ID NO: 3497894 - RNA, 17 nt, Pseudomonas aeruginosa PA01
gcgccuccucggcggcc

SEQ ID NO: 3497895 - RNA, 19 nt, Pseudomonas aeruginosa PA01
gcgccuccucggcggccuu

SEQ ID NO: 3497896 - RNA, 14 nt, Pseudomonas aeruginosa PA01
gcgccuccucuacc

SEQ ID NO: 3497897 - RNA, 21 nt, Pseudomonas aeruginosa PA01
gcgccuccucuaccaggcggu

SEQ ID NO: 3497898 - RNA, 13 nt, Pseudomonas aeruginosa PA01
gcgccucgaaggc

SEQ ID NO: 3497899 - RNA, 22 nt, Pseudomonas aeruginosa PA01
gcgccucgaaggccucggucag

SEQ ID NO: 3497900 - RNA, 21 nt, Pseudomonas aeruginosa PA01
gcgccucgaccagaucggcau

SEQ ID NO: 3497901 - RNA, 23 nt, Pseudomonas aeruginosa PA01
gcgccucgaccagaucggcaugg

SEQ ID NO: 3497902 - RNA, 16 nt, Pseudomonas aeruginosa PA01
gcgccucgaccucggc

SEQ ID NO: 3497903 - RNA, 17 nt, Pseudomonas aeruginosa PA01
gcgccucgaccucggcc

SEQ ID NO: 3497904 - RNA, 18 nt, Pseudomonas aeruginosa PA01
gcgccucgaccucggccg

SEQ ID NO: 3497905 - RNA, 15 nt, Pseudomonas aeruginosa PA01
gcgccucgaccuggc

SEQ ID NO: 3497906 - RNA, 17 nt, Pseudomonas aeruginosa PA01
gcgccucgaccuggcca

SEQ ID NO: 3497907 - RNA, 18 nt, Pseudomonas aeruginosa PA01
gcgccucgaccuggccac

SEQ ID NO: 3497908 - RNA, 22 nt, Pseudomonas aeruginosa PA01
gcgccucgaccuggccacgccc

SEQ ID NO: 3497909 - RNA, 22 nt, Pseudomonas aeruginosa PA01
gcgccucgaggaucuugcgccc

SEQ ID NO: 3497910 - RNA, 21 nt, Pseudomonas aeruginosa PA01
gcgccucgcaaaggucggcga

SEQ ID NO: 3497911 - RNA, 22 nt, Pseudomonas aeruginosa PA01
gcgccucgcaaaggucggcgaa

SEQ ID NO: 3497912 - RNA, 13 nt, Pseudomonas aeruginosa PA01
gcgccucgccgag

SEQ ID NO: 3497913 - RNA, 15 nt, Pseudomonas aeruginosa PA01
gcgccucgccgagca

SEQ ID NO: 3497914 - RNA, 14 nt, Pseudomonas aeruginosa PA01
gcgccucgccgccc

SEQ ID NO: 3497915 - RNA, 16 nt, Pseudomonas aeruginosa PA01
gcgccucgccgcggca

SEQ ID NO: 3497916 - RNA, 14 nt, Pseudomonas aeruginosa PA01
gcgccucgcgcaac

SEQ ID NO: 3497917 - RNA, 21 nt, Pseudomonas aeruginosa PA01
gcgccucgcgcaacgccgacg

SEQ ID NO: 3497918 - RNA, 22 nt, Pseudomonas aeruginosa PA01
gcgccucgcgcaacgccgacgg

SEQ ID NO: 3497919 - RNA, 12 nt, Pseudomonas aeruginosa PA01
gcgccucgcggc

SEQ ID NO: 3497920 - RNA, 16 nt, Pseudomonas aeruginosa PA01
gcgccucgcgggucug

SEQ ID NO: 3497921 - RNA, 17 nt, Pseudomonas aeruginosa PA01
gcgccucggcaucgacc

SEQ ID NO: 3497922 - RNA, 18 nt, Pseudomonas aeruginosa PA01
gcgccucggcaucgacca

SEQ ID NO: 3497923 - RNA, 19 nt, Pseudomonas aeruginosa PA01
gcgccucggcaucgaccag

SEQ ID NO: 3497924 - RNA, 18 nt, Pseudomonas aeruginosa PA01
gcgccucggcccuggcgg

SEQ ID NO: 3497925 - RNA, 19 nt, Pseudomonas aeruginosa PA01
gcgccucggcccuggcggc

SEQ ID NO: 3497926 - RNA, 21 nt, Pseudomonas aeruginosa PA01
gcgccucggcccuggcggcga

SEQ ID NO: 3497927 - RNA, 13 nt, Pseudomonas aeruginosa PA01
gcgccucgggccg

SEQ ID NO: 3497928 - RNA, 14 nt, Pseudomonas aeruginosa PA01
gcgccucgggccgg

SEQ ID NO: 3497929 - RNA, 18 nt, Pseudomonas aeruginosa PA01
gcgccucgggccggagca

SEQ ID NO: 3497930 - RNA, 17 nt, Pseudomonas aeruginosa PA01
gcgccucgucgacgccc

SEQ ID NO: 3497931 - RNA, 17 nt, Pseudomonas aeruginosa PA01
gcgccucgucgacgcuc

SEQ ID NO: 3497932 - RNA, 17 nt, Pseudomonas aeruginosa PA01
gcgccucgucgcgccag

SEQ ID NO: 3497933 - RNA, 19 nt, Pseudomonas aeruginosa PA01
gcgccucgucgcgccaggc

SEQ ID NO: 3497934 - RNA, 20 nt, Pseudomonas aeruginosa PA01
gcgccucgucgcgccaggcg

SEQ ID NO: 3497935 - RNA, 21 nt, Pseudomonas aeruginosa PA01
gcgccucgucgcgccaggcga

SEQ ID NO: 3497936 - RNA, 22 nt, Pseudomonas aeruginosa PA01
gcgccucgucgcgccaggcgaa

SEQ ID NO: 3497937 - RNA, 18 nt, Pseudomonas aeruginosa PA01
gcgccucgucggucggcg

SEQ ID NO: 3497938 - RNA, 18 nt, Pseudomonas aeruginosa PA01
gcgccucguggaacagcg

SEQ ID NO: 3497939 - RNA, 20 nt, Pseudomonas aeruginosa PA01
gcgccucguggaacagcgcg

SEQ ID NO: 3497940 - RNA, 17 nt, Pseudomonas aeruginosa PA01
gcgccucuucgcaggag

SEQ ID NO: 3497941 - RNA, 17 nt, Pseudomonas aeruginosa PA01
gcgccugagcagcgcuu

SEQ ID NO: 3497942 - RNA, 14 nt, Pseudomonas aeruginosa PA01
gcgccugagcuggc

SEQ ID NO: 3497943 - RNA, 15 nt, Pseudomonas aeruginosa PA01
gcgccugagcuggcc

SEQ ID NO: 3497944 - RNA, 19 nt, Pseudomonas aeruginosa PA01
gcgccugcaaagaggcgcu

SEQ ID NO: 3497945 - RNA, 21 nt, Pseudomonas aeruginosa PA01
gcgccugcaaagaggcgcuca

SEQ ID NO: 3497946 - RNA, 15 nt, Pseudomonas aeruginosa PA01
gcgccugcaacgcca

SEQ ID NO: 3497947 - RNA, 18 nt, Pseudomonas aeruginosa PA01
gcgccugcaacgccagca

SEQ ID NO: 3497948 - RNA, 21 nt, Pseudomonas aeruginosa PA01
gcgccugcaacgccagcaggc

SEQ ID NO: 3497949 - RNA, 15 nt, Pseudomonas aeruginosa PA01
gcgccugcagcucgg

SEQ ID NO: 3497950 - RNA, 19 nt, Pseudomonas aeruginosa PA01
gcgccugcaggucgaggcg

SEQ ID NO: 3497951 - RNA, 22 nt, Pseudomonas aeruginosa PA01
gcgccugcaggucgaggcgcuc

SEQ ID NO: 3497952 - RNA, 20 nt, Pseudomonas aeruginosa PA01
gcgccugcgcuucguuggcg

SEQ ID NO: 3497953 - RNA, 12 nt, Pseudomonas aeruginosa PA01
gcgccugcugcg

SEQ ID NO: 3497954 - RNA, 21 nt, Pseudomonas aeruginosa PA01
gcgccugcuucagcccggcac

SEQ ID NO: 3497955 - RNA, 22 nt, Pseudomonas aeruginosa PA01
gcgccugcuucagguagugcaa

SEQ ID NO: 3497956 - RNA, 24 nt, Pseudomonas aeruginosa PA01
gcgccuggagcagaaccgccagca

SEQ ID NO: 3497957 - RNA, 17 nt, Pseudomonas aeruginosa PA01
gcgccuggaucagcgcc

SEQ ID NO: 3497958 - RNA, 20 nt, Pseudomonas aeruginosa PA01
gcgccuggaugaucgcgugg

SEQ ID NO: 3497959 - RNA, 20 nt, Pseudomonas aeruginosa PA01
gcgccuggauguggcuaucc

SEQ ID NO: 3497960 - RNA, 14 nt, Pseudomonas aeruginosa PA01
gcgccuggcccugg

SEQ ID NO: 3497961 - RNA, 16 nt, Pseudomonas aeruginosa PA01
gcgccuggcccuggcg

SEQ ID NO: 3497962 - RNA, 18 nt, Pseudomonas aeruginosa PA01
gcgccuggcccuggcggu

SEQ ID NO: 3497963 - RNA, 12 nt, Pseudomonas aeruginosa PA01
gcgccuggccgc

SEQ ID NO: 3497964 - RNA, 13 nt, Pseudomonas aeruginosa PA01
gcgccuggccgcg

SEQ ID NO: 3497965 - RNA, 14 nt, Pseudomonas aeruginosa PA01
gcgccuggccgcgc

SEQ ID NO: 3497966 - RNA, 16 nt, Pseudomonas aeruginosa PA01
gcgccuggccgcgcag

SEQ ID NO: 3497967 - RNA, 12 nt, Pseudomonas aeruginosa PA01
gcgccuggccgu

SEQ ID NO: 3497968 - RNA, 21 nt, Pseudomonas aeruginosa PA01
gcgccuggccgucuuccaggg

SEQ ID NO: 3497969 - RNA, 13 nt, Pseudomonas aeruginosa PA01
gcgccuggccugg

SEQ ID NO: 3497970 - RNA, 17 nt, Pseudomonas aeruginosa PA01
gcgccuggccuggaacu

SEQ ID NO: 3497971 - RNA, 18 nt, Pseudomonas aeruginosa PA01
gcgccuggccuggaacug

SEQ ID NO: 3497972 - RNA, 20 nt, Pseudomonas aeruginosa PA01
gcgccuggcgcaacgccggc

SEQ ID NO: 3497973 - RNA, 21 nt, Pseudomonas aeruginosa PA01
gcgccuggcgcaacgccggca

SEQ ID NO: 3497974 - RNA, 13 nt, Pseudomonas aeruginosa PA01
gcgccuggcgcag

SEQ ID NO: 3497975 - RNA, 13 nt, Pseudomonas aeruginosa PA01
gcgccuggcuggc

SEQ ID NO: 3497976 - RNA, 16 nt, Pseudomonas aeruginosa PA01
gcgccuggcuggccag

SEQ ID NO: 3497977 - RNA, 18 nt, Pseudomonas aeruginosa PA01
gcgccuggcuggccagca

SEQ ID NO: 3497978 - RNA, 19 nt, Pseudomonas aeruginosa PA01
gcgccuggcuggccagcag

SEQ ID NO: 3497979 - RNA, 20 nt, Pseudomonas aeruginosa PA01
gcgccuggcuggccagcagg

SEQ ID NO: 3497980 - RNA, 21 nt, Pseudomonas aeruginosa PA01
gcgccuggcuggccagcaggc

SEQ ID NO: 3497981 - RNA, 14 nt, Pseudomonas aeruginosa PA01
gcgccugggccgcg

SEQ ID NO: 3497982 - RNA, 22 nt, Pseudomonas aeruginosa PA01
gcgccugguauugcgcccagag

SEQ ID NO: 3497983 - RNA, 12 nt, Pseudomonas aeruginosa PA01
gcgccuggucgg

SEQ ID NO: 3497984 - RNA, 13 nt, Pseudomonas aeruginosa PA01
gcgccuggucggc

SEQ ID NO: 3497985 - RNA, 14 nt, Pseudomonas aeruginosa PA01
gcgccuggucggcg

SEQ ID NO: 3497986 - RNA, 16 nt, Pseudomonas aeruginosa PA01
gcgccuggucggcggc

SEQ ID NO: 3497987 - RNA, 19 nt, Pseudomonas aeruginosa PA01
gcgccuguaccccguagcg

SEQ ID NO: 3497988 - RNA, 15 nt, Pseudomonas aeruginosa PA01
gcgccuguuccaggg

SEQ ID NO: 3497989 - RNA, 16 nt, Pseudomonas aeruginosa PA01
gcgccuguuccagggc

SEQ ID NO: 3497990 - RNA, 18 nt, Pseudomonas aeruginosa PA01
gcgccuguuccagggccu

SEQ ID NO: 3497991 - RNA, 23 nt, Pseudomonas aeruginosa PA01
gcgccuguuccagggccugcucc

SEQ ID NO: 3497992 - RNA, 19 nt, Pseudomonas aeruginosa PA01
gcgccuucaccguucccag

SEQ ID NO: 3497993 - RNA, 21 nt, Pseudomonas aeruginosa PA01
gcgccuucaccguucccagca

SEQ ID NO: 3497994 - RNA, 22 nt, Pseudomonas aeruginosa PA01
gcgccuucaccguucccagcag

SEQ ID NO: 3497995 - RNA, 15 nt, Pseudomonas aeruginosa PA01
gcgccuucagcccca

SEQ ID NO: 3497996 - RNA, 14 nt, Pseudomonas aeruginosa PA01
gcgccuucagcgcc

SEQ ID NO: 3497997 - RNA, 16 nt, Pseudomonas aeruginosa PA01
gcgccuucagcgccag

SEQ ID NO: 3497998 - RNA, 18 nt, Pseudomonas aeruginosa PA01
gcgccuucagcgccagca

SEQ ID NO: 3497999 - RNA, 20 nt, Pseudomonas aeruginosa PA01
gcgccuucagcgccagcagg

SEQ ID NO: 3498000 - RNA, 16 nt, Pseudomonas aeruginosa PA01
gcgccuucagcgccgc

SEQ ID NO: 3498001 - RNA, 20 nt, Pseudomonas aeruginosa PA01
gcgccuucagcgccgccagg

SEQ ID NO: 3498002 - RNA, 14 nt, Pseudomonas aeruginosa PA01
gcgccuucaucgcc

SEQ ID NO: 3498003 - RNA, 20 nt, Pseudomonas aeruginosa PA01
gcgccuucccagauaccggc

SEQ ID NO: 3498004 - RNA, 16 nt, Pseudomonas aeruginosa PA01
gcgccuuccugcuuca

SEQ ID NO: 3498005 - RNA, 20 nt, Pseudomonas aeruginosa PA01
gcgccuuccuugauccacuc

SEQ ID NO: 3498006 - RNA, 21 nt, Pseudomonas aeruginosa PA01
gcgccuucgccggaagcuuca

SEQ ID NO: 3498007 - RNA, 14 nt, Pseudomonas aeruginosa PA01
gcgccuucggcgac

SEQ ID NO: 3498008 - RNA, 18 nt, Pseudomonas aeruginosa PA01
gcgccuucggcgacacag

SEQ ID NO: 3498009 - RNA, 23 nt, Pseudomonas aeruginosa PA01
gcgccuucggcgacacagacgca

SEQ ID NO: 3498010 - RNA, 17 nt, Pseudomonas aeruginosa PA01
gcgccuucgggcgccuu

SEQ ID NO: 3498011 - RNA, 21 nt, Pseudomonas aeruginosa PA01
gcgccuucugcaccuuggcca

SEQ ID NO: 3498012 - RNA, 23 nt, Pseudomonas aeruginosa PA01
gcgccuugaaaccggcgaaccag

SEQ ID NO: 3498013 - RNA, 22 nt, Pseudomonas aeruginosa PA01
gcgccuugaccucgacgccgag

SEQ ID NO: 3498014 - RNA, 23 nt, Pseudomonas aeruginosa PA01
gcgccuugaccucgacgccgagc

SEQ ID NO: 3498015 - RNA, 14 nt, Pseudomonas aeruginosa PA01
gcgccuugcgccag

SEQ ID NO: 3498016 - RNA, 17 nt, Pseudomonas aeruginosa PA01
gcgccuugcgccaggcc

SEQ ID NO: 3498017 - RNA, 18 nt, Pseudomonas aeruginosa PA01
gcgccuugcgccaggccu

SEQ ID NO: 3498018 - RNA, 19 nt, Pseudomonas aeruginosa PA01
gcgccuugcgguccagcga

SEQ ID NO: 3498019 - RNA, 16 nt, Pseudomonas aeruginosa PA01
gcgccuugcucagguc

SEQ ID NO: 3498020 - RNA, 14 nt, Pseudomonas aeruginosa PA01
gcgccuuucgcuca

SEQ ID NO: 3498021 - RNA, 18 nt, Pseudomonas aeruginosa PA01
gcgccuuucgcucaggcc

SEQ ID NO: 3498022 - RNA, 16 nt, Pseudomonas aeruginosa PA01
gcgccuuuuucauggc

SEQ ID NO: 3498023 - RNA, 18 nt, Pseudomonas aeruginosa PA01
gcgccuuuuucauggccu

SEQ ID NO: 3498024 - RNA, 18 nt, Pseudomonas aeruginosa PA01
gcgcgaaagcgccccggg

SEQ ID NO: 3498025 - RNA, 19 nt, Pseudomonas aeruginosa PA01
gcgcgaaagggucaggccu

SEQ ID NO: 3498026 - RNA, 20 nt, Pseudomonas aeruginosa PA01
gcgcgaaagggucaggccuu

SEQ ID NO: 3498027 - RNA, 20 nt, Pseudomonas aeruginosa PA01
gcgcgaacaguuccgacugc

SEQ ID NO: 3498028 - RNA, 15 nt, Pseudomonas aeruginosa PA01
gcgcgaaccagcagc

SEQ ID NO: 3498029 - RNA, 17 nt, Pseudomonas aeruginosa PA01
gcgcgaaccagcagcag

SEQ ID NO: 3498030 - RNA, 22 nt, Pseudomonas aeruginosa PA01
gcgcgaagccaggaagcggcgg

SEQ ID NO: 3498031 - RNA, 23 nt, Pseudomonas aeruginosa PA01
gcgcgaagccaggaagcggcggu

SEQ ID NO: 3498032 - RNA, 20 nt, Pseudomonas aeruginosa PA01
gcgcgaaggcgccuuccagg

SEQ ID NO: 3498033 - RNA, 19 nt, Pseudomonas aeruginosa PA01
gcgcgaauaccgcgcgcgc

SEQ ID NO: 3498034 - RNA, 18 nt, Pseudomonas aeruginosa PA01
gcgcgaaucuucggcgcg

SEQ ID NO: 3498035 - RNA, 19 nt, Pseudomonas aeruginosa PA01
gcgcgaaucuucggcgcgc

SEQ ID NO: 3498036 - RNA, 15 nt, Pseudomonas aeruginosa PA01
gcgcgaauggcauuc

SEQ ID NO: 3498037 - RNA, 21 nt, Pseudomonas aeruginosa PA01
gcgcgacacauggucggccag

SEQ ID NO: 3498038 - RNA, 22 nt, Pseudomonas aeruginosa PA01
gcgcgacacauggucggccagg

SEQ ID NO: 3498039 - RNA, 21 nt, Pseudomonas aeruginosa PA01
gcgcgacagcucguggcuggc

SEQ ID NO: 3498040 - RNA, 14 nt, Pseudomonas aeruginosa PA01
gcgcgacagcucug

SEQ ID NO: 3498041 - RNA, 22 nt, Pseudomonas aeruginosa PA01
gcgcgacagcucuggggucagu

SEQ ID NO: 3498042 - RNA, 16 nt, Pseudomonas aeruginosa PA01
gcgcgacaucggcgau

SEQ ID NO: 3498043 - RNA, 19 nt, Pseudomonas aeruginosa PA01
gcgcgacaucggcgauggc

SEQ ID NO: 3498044 - RNA, 15 nt, Pseudomonas aeruginosa PA01
gcgcgaccgcccgcc

SEQ ID NO: 3498045 - RNA, 17 nt, Pseudomonas aeruginosa PA01
gcgcgaccgcccgccuc

SEQ ID NO: 3498046 - RNA, 20 nt, Pseudomonas aeruginosa PA01
gcgcgaccgcccgccucagg

SEQ ID NO: 3498047 - RNA, 13 nt, Pseudomonas aeruginosa PA01
gcgcgaccgcggc

SEQ ID NO: 3498048 - RNA, 15 nt, Pseudomonas aeruginosa PA01
gcgcgaccgcggcgc

SEQ ID NO: 3498049 - RNA, 16 nt, Pseudomonas aeruginosa PA01
gcgcgaccgcggcgcu

SEQ ID NO: 3498050 - RNA, 19 nt, Pseudomonas aeruginosa PA01
gcgcgaccgcggcgcucgg

SEQ ID NO: 3498051 - RNA, 18 nt, Pseudomonas aeruginosa PA01
gcgcgaccgucggccggg

SEQ ID NO: 3498052 - RNA, 21 nt, Pseudomonas aeruginosa PA01
gcgcgacgagaaaaagcccgg

SEQ ID NO: 3498053 - RNA, 12 nt, Pseudomonas aeruginosa PA01
gcgcgacgaggc

SEQ ID NO: 3498054 - RNA, 14 nt, Pseudomonas aeruginosa PA01
gcgcgacgaggcgc

SEQ ID NO: 3498055 - RNA, 16 nt, Pseudomonas aeruginosa PA01
gcgcgacgaggcgcgg

SEQ ID NO: 3498056 - RNA, 18 nt, Pseudomonas aeruginosa PA01
gcgcgacgaggcgcggcg

SEQ ID NO: 3498057 - RNA, 23 nt, Pseudomonas aeruginosa PA01
gcgcgacggaacaagccgccuuc

SEQ ID NO: 3498058 - RNA, 23 nt, Pseudomonas aeruginosa PA01
gcgcgacucgguaaagcccaggu

SEQ ID NO: 3498059 - RNA, 16 nt, Pseudomonas aeruginosa PA01
gcgcgacugucgagca

SEQ ID NO: 3498060 - RNA, 18 nt, Pseudomonas aeruginosa PA01
gcgcgacugucgagcagg

SEQ ID NO: 3498061 - RNA, 17 nt, Pseudomonas aeruginosa PA01
gcgcgacuuggacagcg

SEQ ID NO: 3498062 - RNA, 20 nt, Pseudomonas aeruginosa PA01
gcgcgacuuggacagcgucu

SEQ ID NO: 3498063 - RNA, 13 nt, Pseudomonas aeruginosa PA01
gcgcgagaaaaac

SEQ ID NO: 3498064 - RNA, 15 nt, Pseudomonas aeruginosa PA01
gcgcgagaagccagc

SEQ ID NO: 3498065 - RNA, 20 nt, Pseudomonas aeruginosa PA01
gcgcgagaagccagccaggu

SEQ ID NO: 3498066 - RNA, 21 nt, Pseudomonas aeruginosa PA01
gcgcgagaugaagcgccgcag

SEQ ID NO: 3498067 - RNA, 17 nt, Pseudomonas aeruginosa PA01
gcgcgagcaccgcgcag

SEQ ID NO: 3498068 - RNA, 18 nt, Pseudomonas aeruginosa PA01
gcgcgagcaccgcgcaga

SEQ ID NO: 3498069 - RNA, 12 nt, Pseudomonas aeruginosa PA01
gcgcgagcggca

SEQ ID NO: 3498070 - RNA, 14 nt, Pseudomonas aeruginosa PA01
gcgcgaggcgagua

SEQ ID NO: 3498071 - RNA, 14 nt, Pseudomonas aeruginosa PA01
gcgcgaggcgcagg

SEQ ID NO: 3498072 - RNA, 12 nt, Pseudomonas aeruginosa PA01
gcgcgaggcgcu

SEQ ID NO: 3498073 - RNA, 20 nt, Pseudomonas aeruginosa PA01
gcgcgaggcguucgucgacc

SEQ ID NO: 3498074 - RNA, 14 nt, Pseudomonas aeruginosa PA01
gcgcgaggggcgga

SEQ ID NO: 3498075 - RNA, 17 nt, Pseudomonas aeruginosa PA01
gcgcgaggggcggagca

SEQ ID NO: 3498076 - RNA, 18 nt, Pseudomonas aeruginosa PA01
gcgcgagggggccucggc

SEQ ID NO: 3498077 - RNA, 20 nt, Pseudomonas aeruginosa PA01
gcgcgagggggccucggcca

SEQ ID NO: 3498078 - RNA, 21 nt, Pseudomonas aeruginosa PA01
gcgcgagggggccucggccag

SEQ ID NO: 3498079 - RNA, 18 nt, Pseudomonas aeruginosa PA01
gcgcgaguaguaggucgg

SEQ ID NO: 3498080 - RNA, 14 nt, Pseudomonas aeruginosa PA01
gcgcgagugcagcg

SEQ ID NO: 3498081 - RNA, 22 nt, Pseudomonas aeruginosa PA01
gcgcgauaaaaagccccgcuuc

SEQ ID NO: 3498082 - RNA, 21 nt, Pseudomonas aeruginosa PA01
gcgcgauacccuggccggccu

SEQ ID NO: 3498083 - RNA, 16 nt, Pseudomonas aeruginosa PA01
gcgcgauauccgccag

SEQ ID NO: 3498084 - RNA, 18 nt, Pseudomonas aeruginosa PA01
gcgcgauauccgccaggg

SEQ ID NO: 3498085 - RNA, 20 nt, Pseudomonas aeruginosa PA01
gcgcgauauccgccagggag

SEQ ID NO: 3498086 - RNA, 15 nt, Pseudomonas aeruginosa PA01
gcgcgauaucgcagg

SEQ ID NO: 3498087 - RNA, 18 nt, Pseudomonas aeruginosa PA01
gcgcgauaucgcaggcca

SEQ ID NO: 3498088 - RNA, 22 nt, Pseudomonas aeruginosa PA01
gcgcgauaucgcaggccaggcc

SEQ ID NO: 3498089 - RNA, 12 nt, Pseudomonas aeruginosa PA01
gcgcgaucagcc

SEQ ID NO: 3498090 - RNA, 13 nt, Pseudomonas aeruginosa PA01
gcgcgaucagccg

SEQ ID NO: 3498091 - RNA, 17 nt, Pseudomonas aeruginosa PA01
gcgcgaucagccgcucc

SEQ ID NO: 3498092 - RNA, 19 nt, Pseudomonas aeruginosa PA01
gcgcgauccgcgcggcaac

SEQ ID NO: 3498093 - RNA, 17 nt, Pseudomonas aeruginosa PA01
gcgcgauccuccgccag

SEQ ID NO: 3498094 - RNA, 23 nt, Pseudomonas aeruginosa PA01
gcgcgauccuccgccagccccag

SEQ ID NO: 3498095 - RNA, 22 nt, Pseudomonas aeruginosa PA01
gcgcgaucgaggccuacccgcg

SEQ ID NO: 3498096 - RNA, 12 nt, Pseudomonas aeruginosa PA01
gcgcgaucgcgu

SEQ ID NO: 3498097 - RNA, 22 nt, Pseudomonas aeruginosa PA01
gcgcgaugccccauccgacgcc

SEQ ID NO: 3498098 - RNA, 13 nt, Pseudomonas aeruginosa PA01
gcgcgaugccgau

SEQ ID NO: 3498099 - RNA, 17 nt, Pseudomonas aeruginosa PA01
gcgcgaugcucccgagc

SEQ ID NO: 3498100 - RNA, 18 nt, Pseudomonas aeruginosa PA01
gcgcgauggccggcggag

SEQ ID NO: 3498101 - RNA, 19 nt, Pseudomonas aeruginosa PA01
gcgcgauggccggcggaga

SEQ ID NO: 3498102 - RNA, 20 nt, Pseudomonas aeruginosa PA01
gcgcgcaaaaaaaggggaug

SEQ ID NO: 3498103 - RNA, 15 nt, Pseudomonas aeruginosa PA01
gcgcgcaacuggucg

SEQ ID NO: 3498104 - RNA, 19 nt, Pseudomonas aeruginosa PA01
gcgcgcaacuggucgcggc

SEQ ID NO: 3498105 - RNA, 13 nt, Pseudomonas aeruginosa PA01
gcgcgcaaggccg

SEQ ID NO: 3498106 - RNA, 14 nt, Pseudomonas aeruginosa PA01
gcgcgcaaggccga

SEQ ID NO: 3498107 - RNA, 15 nt, Pseudomonas aeruginosa PA01
gcgcgcaaggccgaa

SEQ ID NO: 3498108 - RNA, 16 nt, Pseudomonas aeruginosa PA01
gcgcgcaaggccgaag

SEQ ID NO: 3498109 - RNA, 12 nt, Pseudomonas aeruginosa PA01
gcgcgcaccagc

SEQ ID NO: 3498110 - RNA, 13 nt, Pseudomonas aeruginosa PA01
gcgcgcaccagcg

SEQ ID NO: 3498111 - RNA, 19 nt, Pseudomonas aeruginosa PA01
gcgcgcaccagcgggucgu

SEQ ID NO: 3498112 - RNA, 13 nt, Pseudomonas aeruginosa PA01
gcgcgcaccaggc

SEQ ID NO: 3498113 - RNA, 14 nt, Pseudomonas aeruginosa PA01
gcgcgcacggucuu

SEQ ID NO: 3498114 - RNA, 22 nt, Pseudomonas aeruginosa PA01
gcgcgcacuuccucggcgacca

SEQ ID NO: 3498115 - RNA, 18 nt, Pseudomonas aeruginosa PA01
gcgcgcaggaccagacgc

SEQ ID NO: 3498116 - RNA, 13 nt, Pseudomonas aeruginosa PA01
gcgcgcaggcgcu

SEQ ID NO: 3498117 - RNA, 15 nt, Pseudomonas aeruginosa PA01
gcgcgcagggccagc

SEQ ID NO: 3498118 - RNA, 18 nt, Pseudomonas aeruginosa PA01
gcgcgcagggccagcaac

SEQ ID NO: 3498119 - RNA, 15 nt, Pseudomonas aeruginosa PA01
gcgcgcagggugagc

SEQ ID NO: 3498120 - RNA, 22 nt, Pseudomonas aeruginosa PA01
gcgcgcagggugagcauggcgu

SEQ ID NO: 3498121 - RNA, 17 nt, Pseudomonas aeruginosa PA01
gcgcgcaguaggcgcug

SEQ ID NO: 3498122 - RNA, 18 nt, Pseudomonas aeruginosa PA01
gcgcgcaguaggcgcugc

SEQ ID NO: 3498123 - RNA, 21 nt, Pseudomonas aeruginosa PA01
gcgcgcaguaggcgcugccgu

SEQ ID NO: 3498124 - RNA, 14 nt, Pseudomonas aeruginosa PA01
gcgcgcaguucagg

SEQ ID NO: 3498125 - RNA, 17 nt, Pseudomonas aeruginosa PA01
gcgcgcauagcaggccu

SEQ ID NO: 3498126 - RNA, 22 nt, Pseudomonas aeruginosa PA01
gcgcgcaucuggugcgcgucca

SEQ ID NO: 3498127 - RNA, 21 nt, Pseudomonas aeruginosa PA01
gcgcgcaugaaaaagcccggc

SEQ ID NO: 3498128 - RNA, 16 nt, Pseudomonas aeruginosa PA01
gcgcgccaaggccgcc

SEQ ID NO: 3498129 - RNA, 19 nt, Pseudomonas aeruginosa PA01
gcgcgccaaggccgccagg

SEQ ID NO: 3498130 - RNA, 21 nt, Pseudomonas aeruginosa PA01
gcgcgccaaggccgccaggcc

SEQ ID NO: 3498131 - RNA, 22 nt, Pseudomonas aeruginosa PA01
gcgcgccaaggccgccaggccu

SEQ ID NO: 3498132 - RNA, 13 nt, Pseudomonas aeruginosa PA01
gcgcgccaccagc

SEQ ID NO: 3498133 - RNA, 15 nt, Pseudomonas aeruginosa PA01
gcgcgccaccagcgu

SEQ ID NO: 3498134 - RNA, 16 nt, Pseudomonas aeruginosa PA01
gcgcgccaccgccugg

SEQ ID NO: 3498135 - RNA, 13 nt, Pseudomonas aeruginosa PA01
gcgcgccagaagc

SEQ ID NO: 3498136 - RNA, 21 nt, Pseudomonas aeruginosa PA01
gcgcgccagaagcggccgacc

SEQ ID NO: 3498137 - RNA, 17 nt, Pseudomonas aeruginosa PA01
gcgcgccagcaacgccu

SEQ ID NO: 3498138 - RNA, 20 nt, Pseudomonas aeruginosa PA01
gcgcgccagcacggcgcagg

SEQ ID NO: 3498139 - RNA, 12 nt, Pseudomonas aeruginosa PA01
gcgcgccagcgc

SEQ ID NO: 3498140 - RNA, 13 nt, Pseudomonas aeruginosa PA01
gcgcgccagcgcc

SEQ ID NO: 3498141 - RNA, 16 nt, Pseudomonas aeruginosa PA01
gcgcgccagcgccacg

SEQ ID NO: 3498142 - RNA, 12 nt, Pseudomonas aeruginosa PA01
gcgcgccaggcc

SEQ ID NO: 3498143 - RNA, 14 nt, Pseudomonas aeruginosa PA01
gcgcgccaggccca

SEQ ID NO: 3498144 - RNA, 13 nt, Pseudomonas aeruginosa PA01
gcgcgccagucca

SEQ ID NO: 3498145 - RNA, 17 nt, Pseudomonas aeruginosa PA01
gcgcgccauggccugga

SEQ ID NO: 3498146 - RNA, 15 nt, Pseudomonas aeruginosa PA01
gcgcgccauggcggu

SEQ ID NO: 3498147 - RNA, 21 nt, Pseudomonas aeruginosa PA01
gcgcgccauuccgcggcacuc

SEQ ID NO: 3498148 - RNA, 12 nt, Pseudomonas aeruginosa PA01
gcgcgcccaggc

SEQ ID NO: 3498149 - RNA, 16 nt, Pseudomonas aeruginosa PA01
gcgcgcccaggcaggc

SEQ ID NO: 3498150 - RNA, 13 nt, Pseudomonas aeruginosa PA01
gcgcgcccaggcc

SEQ ID NO: 3498151 - RNA, 15 nt, Pseudomonas aeruginosa PA01
gcgcgcccaggccca

SEQ ID NO: 3498152 - RNA, 17 nt, Pseudomonas aeruginosa PA01
gcgcgcccaggcccagc

SEQ ID NO: 3498153 - RNA, 13 nt, Pseudomonas aeruginosa PA01
gcgcgcccccugg

SEQ ID NO: 3498154 - RNA, 20 nt, Pseudomonas aeruginosa PA01
gcgcgccccggcgagcgagc

SEQ ID NO: 3498155 - RNA, 14 nt, Pseudomonas aeruginosa PA01
gcgcgccccguccc

SEQ ID NO: 3498156 - RNA, 15 nt, Pseudomonas aeruginosa PA01
gcgcgccccgucccu

SEQ ID NO: 3498157 - RNA, 12 nt, Pseudomonas aeruginosa PA01
gcgcgccccugc

SEQ ID NO: 3498158 - RNA, 15 nt, Pseudomonas aeruginosa PA01
gcgcgccccugcgcc

SEQ ID NO: 3498159 - RNA, 13 nt, Pseudomonas aeruginosa PA01
gcgcgcccgccag

SEQ ID NO: 3498160 - RNA, 15 nt, Pseudomonas aeruginosa PA01
gcgcgcccgccaggu

SEQ ID NO: 3498161 - RNA, 14 nt, Pseudomonas aeruginosa PA01
gcgcgcccggcgca

SEQ ID NO: 3498162 - RNA, 17 nt, Pseudomonas aeruginosa PA01
gcgcgcccggcgcagaa

SEQ ID NO: 3498163 - RNA, 16 nt, Pseudomonas aeruginosa PA01
gcgcgcccggcgcccu

SEQ ID NO: 3498164 - RNA, 16 nt, Pseudomonas aeruginosa PA01
gcgcgcccuugagcac

SEQ ID NO: 3498165 - RNA, 14 nt, Pseudomonas aeruginosa PA01
gcgcgccgaacucg

SEQ ID NO: 3498166 - RNA, 22 nt, Pseudomonas aeruginosa PA01
gcgcgccgacagcacgauggcg

SEQ ID NO: 3498167 - RNA, 12 nt, Pseudomonas aeruginosa PA01
gcgcgccgagca

SEQ ID NO: 3498168 - RNA, 12 nt, Pseudomonas aeruginosa PA01
gcgcgccgagcc

SEQ ID NO: 3498169 - RNA, 14 nt, Pseudomonas aeruginosa PA01
gcgcgccgagccag

SEQ ID NO: 3498170 - RNA, 15 nt, Pseudomonas aeruginosa PA01
gcgcgccgagccagg

SEQ ID NO: 3498171 - RNA, 16 nt, Pseudomonas aeruginosa PA01
gcgcgccgagccaggu

SEQ ID NO: 3498172 - RNA, 18 nt, Pseudomonas aeruginosa PA01
gcgcgccgagccagguac

SEQ ID NO: 3498173 - RNA, 20 nt, Pseudomonas aeruginosa PA01
gcgcgccgagcccccggcgc

SEQ ID NO: 3498174 - RNA, 20 nt, Pseudomonas aeruginosa PA01
gcgcgccgaguucgccgcga

SEQ ID NO: 3498175 - RNA, 23 nt, Pseudomonas aeruginosa PA01
gcgcgccgccgaucugcuggguc

SEQ ID NO: 3498176 - RNA, 14 nt, Pseudomonas aeruginosa PA01
gcgcgccgccgggc

SEQ ID NO: 3498177 - RNA, 22 nt, Pseudomonas aeruginosa PA01
gcgcgccgccgggcgcccggcc

SEQ ID NO: 3498178 - RNA, 16 nt, Pseudomonas aeruginosa PA01
gcgcgccggacaggcc

SEQ ID NO: 3498179 - RNA, 14 nt, Pseudomonas aeruginosa PA01
gcgcgccggagcca

SEQ ID NO: 3498180 - RNA, 21 nt, Pseudomonas aeruginosa PA01
gcgcgccggcccgggucacgg

SEQ ID NO: 3498181 - RNA, 12 nt, Pseudomonas aeruginosa PA01
gcgcgccgggcu

SEQ ID NO: 3498182 - RNA, 12 nt, Pseudomonas aeruginosa PA01
gcgcgccgguga

SEQ ID NO: 3498183 - RNA, 14 nt, Pseudomonas aeruginosa PA01
gcgcgccgugcggc

SEQ ID NO: 3498184 - RNA, 18 nt, Pseudomonas aeruginosa PA01
gcgcgccucagcggcugg

SEQ ID NO: 3498185 - RNA, 17 nt, Pseudomonas aeruginosa PA01
gcgcgccuccugcggau

SEQ ID NO: 3498186 - RNA, 17 nt, Pseudomonas aeruginosa PA01
gcgcgccucgccccaga

SEQ ID NO: 3498187 - RNA, 23 nt, Pseudomonas aeruginosa PA01
gcgcgccucgccccagacccagg

SEQ ID NO: 3498188 - RNA, 18 nt, Pseudomonas aeruginosa PA01
gcgcgccucgcggcguuc

SEQ ID NO: 3498189 - RNA, 15 nt, Pseudomonas aeruginosa PA01
gcgcgccucuuccug

SEQ ID NO: 3498190 - RNA, 15 nt, Pseudomonas aeruginosa PA01
gcgcgccugagcugg

SEQ ID NO: 3498191 - RNA, 19 nt, Pseudomonas aeruginosa PA01
gcgcgccugcaacgccagc

SEQ ID NO: 3498192 - RNA, 20 nt, Pseudomonas aeruginosa PA01
gcgcgccugcaacgccagca

SEQ ID NO: 3498193 - RNA, 21 nt, Pseudomonas aeruginosa PA01
gcgcgccuggcccuggcgguu

SEQ ID NO: 3498194 - RNA, 18 nt, Pseudomonas aeruginosa PA01
gcgcgccuggcuggccag

SEQ ID NO: 3498195 - RNA, 21 nt, Pseudomonas aeruginosa PA01
gcgcgccuggcuggccagcag

SEQ ID NO: 3498196 - RNA, 12 nt, Pseudomonas aeruginosa PA01
gcgcgccuggua

SEQ ID NO: 3498197 - RNA, 15 nt, Pseudomonas aeruginosa PA01
gcgcgccuucagccc

SEQ ID NO: 3498198 - RNA, 20 nt, Pseudomonas aeruginosa PA01
gcgcgccuucagccccagca

SEQ ID NO: 3498199 - RNA, 17 nt, Pseudomonas aeruginosa PA01
gcgcgccuucagcgccu

SEQ ID NO: 3498200 - RNA, 18 nt, Pseudomonas aeruginosa PA01
gcgcgccuucagcgccuc

SEQ ID NO: 3498201 - RNA, 15 nt, Pseudomonas aeruginosa PA01
gcgcgccuucgacgc

SEQ ID NO: 3498202 - RNA, 21 nt, Pseudomonas aeruginosa PA01
gcgcgcgacacauggucggcc

SEQ ID NO: 3498203 - RNA, 17 nt, Pseudomonas aeruginosa PA01
gcgcgcgacagauagca

SEQ ID NO: 3498204 - RNA, 20 nt, Pseudomonas aeruginosa PA01
gcgcgcgauaccgacaagca

SEQ ID NO: 3498205 - RNA, 13 nt, Pseudomonas aeruginosa PA01
gcgcgcgcaaggc

SEQ ID NO: 3498206 - RNA, 14 nt, Pseudomonas aeruginosa PA01
gcgcgcgcaaggcc

SEQ ID NO: 3498207 - RNA, 15 nt, Pseudomonas aeruginosa PA01
gcgcgcgcaaggccg

SEQ ID NO: 3498208 - RNA, 13 nt, Pseudomonas aeruginosa PA01
gcgcgcgccaccg

SEQ ID NO: 3498209 - RNA, 20 nt, Pseudomonas aeruginosa PA01
gcgcgcgccaccgccugguc

SEQ ID NO: 3498210 - RNA, 13 nt, Pseudomonas aeruginosa PA01
gcgcgcgccaguc

SEQ ID NO: 3498211 - RNA, 11 nt, Pseudomonas aeruginosa PA01
gcgcgcgccga

SEQ ID NO: 3498212 - RNA, 13 nt, Pseudomonas aeruginosa PA01
gcgcgcgccgaac

SEQ ID NO: 3498213 - RNA, 13 nt, Pseudomonas aeruginosa PA01
gcgcgcgccgaca

SEQ ID NO: 3498214 - RNA, 14 nt, Pseudomonas aeruginosa PA01
gcgcgcgccgagca

SEQ ID NO: 3498215 - RNA, 15 nt, Pseudomonas aeruginosa PA01
gcgcgcgccgagcaa

SEQ ID NO: 3498216 - RNA, 11 nt, Pseudomonas aeruginosa PA01
gcgcgcgccgg

SEQ ID NO: 3498217 - RNA, 12 nt, Pseudomonas aeruginosa PA01
gcgcgcgccggg

SEQ ID NO: 3498218 - RNA, 13 nt, Pseudomonas aeruginosa PA01
gcgcgcgccgggc

SEQ ID NO: 3498219 - RNA, 14 nt, Pseudomonas aeruginosa PA01
gcgcgcgcgccagg

SEQ ID NO: 3498220 - RNA, 13 nt, Pseudomonas aeruginosa PA01
gcgcgcgcgcugc

SEQ ID NO: 3498221 - RNA, 15 nt, Pseudomonas aeruginosa PA01
gcgcgcgcuccucga

SEQ ID NO: 3498222 - RNA, 13 nt, Pseudomonas aeruginosa PA01
gcgcgcgcuggcg

SEQ ID NO: 3498223 - RNA, 14 nt, Pseudomonas aeruginosa PA01
gcgcgcgcuggucg

SEQ ID NO: 3498224 - RNA, 15 nt, Pseudomonas aeruginosa PA01
gcgcgcgcuggucgu

SEQ ID NO: 3498225 - RNA, 21 nt, Pseudomonas aeruginosa PA01
gcgcgcgcuucuugucgucgg

SEQ ID NO: 3498226 - RNA, 14 nt, Pseudomonas aeruginosa PA01
gcgcgcggaccgaa

SEQ ID NO: 3498227 - RNA, 13 nt, Pseudomonas aeruginosa PA01
gcgcgcggcagca

SEQ ID NO: 3498228 - RNA, 15 nt, Pseudomonas aeruginosa PA01
gcgcgcggcauccag

SEQ ID NO: 3498229 - RNA, 12 nt, Pseudomonas aeruginosa PA01
gcgcgcggccag

SEQ ID NO: 3498230 - RNA, 21 nt, Pseudomonas aeruginosa PA01
gcgcgcggccagcucgccggu

SEQ ID NO: 3498231 - RNA, 23 nt, Pseudomonas aeruginosa PA01
gcgcgcggccagcucgccgguca

SEQ ID NO: 3498232 - RNA, 16 nt, Pseudomonas aeruginosa PA01
gcgcgcggccaguucg

SEQ ID NO: 3498233 - RNA, 17 nt, Pseudomonas aeruginosa PA01
gcgcgcggccuguucgg

SEQ ID NO: 3498234 - RNA, 12 nt, Pseudomonas aeruginosa PA01
gcgcgcggcgag

SEQ ID NO: 3498235 - RNA, 13 nt, Pseudomonas aeruginosa PA01
gcgcgcggcgagc

SEQ ID NO: 3498236 - RNA, 18 nt, Pseudomonas aeruginosa PA01
gcgcgcggcgagccgcga

SEQ ID NO: 3498237 - RNA, 12 nt, Pseudomonas aeruginosa PA01
gcgcgcggcggg

SEQ ID NO: 3498238 - RNA, 15 nt, Pseudomonas aeruginosa PA01
gcgcgcggcggguag

SEQ ID NO: 3498239 - RNA, 18 nt, Pseudomonas aeruginosa PA01
gcgcgcggcgucgaccac

SEQ ID NO: 3498240 - RNA, 19 nt, Pseudomonas aeruginosa PA01
gcgcgcggcgucgaccacg

SEQ ID NO: 3498241 - RNA, 18 nt, Pseudomonas aeruginosa PA01
gcgcgcggggucuggccg

SEQ ID NO: 3498242 - RNA, 21 nt, Pseudomonas aeruginosa PA01
gcgcgcggggucuggccggcg

SEQ ID NO: 3498243 - RNA, 16 nt, Pseudomonas aeruginosa PA01
gcgcgcguagcgugcc

SEQ ID NO: 3498244 - RNA, 22 nt, Pseudomonas aeruginosa PA01
gcgcgcguuccaggucgcugcu

SEQ ID NO: 3498245 - RNA, 22 nt, Pseudomonas aeruginosa PA01
gcgcgcucagcgcuucucggca

SEQ ID NO: 3498246 - RNA, 17 nt, Pseudomonas aeruginosa PA01
gcgcgcuccggcgcgcc

SEQ ID NO: 3498247 - RNA, 15 nt, Pseudomonas aeruginosa PA01
gcgcgcuccucgauc

SEQ ID NO: 3498248 - RNA, 17 nt, Pseudomonas aeruginosa PA01
gcgcgcuccucgauccg

SEQ ID NO: 3498249 - RNA, 16 nt, Pseudomonas aeruginosa PA01
gcgcgcucgcugucgc

SEQ ID NO: 3498250 - RNA, 12 nt, Pseudomonas aeruginosa PA01
gcgcgcucggcc

SEQ ID NO: 3498251 - RNA, 17 nt, Pseudomonas aeruginosa PA01
gcgcgcucgggaucgcc

SEQ ID NO: 3498252 - RNA, 21 nt, Pseudomonas aeruginosa PA01
gcgcgcucgggaucgccucgu

SEQ ID NO: 3498253 - RNA, 15 nt, Pseudomonas aeruginosa PA01
gcgcgcucucgccgg

SEQ ID NO: 3498254 - RNA, 16 nt, Pseudomonas aeruginosa PA01
gcgcgcucuucgccgc

SEQ ID NO: 3498255 - RNA, 20 nt, Pseudomonas aeruginosa PA01
gcgcgcucuucgccgcggcg

SEQ ID NO: 3498256 - RNA, 14 nt, Pseudomonas aeruginosa PA01
gcgcgcugcggcag

SEQ ID NO: 3498257 - RNA, 15 nt, Pseudomonas aeruginosa PA01
gcgcgcuggaugccc

SEQ ID NO: 3498258 - RNA, 23 nt, Pseudomonas aeruginosa PA01
gcgcgcuggaugcccuccugggc

SEQ ID NO: 3498259 - RNA, 19 nt, Pseudomonas aeruginosa PA01
gcgcgcuggauuucgccga

SEQ ID NO: 3498260 - RNA, 20 nt, Pseudomonas aeruginosa PA01
gcgcgcuggauuucgccgag

SEQ ID NO: 3498261 - RNA, 21 nt, Pseudomonas aeruginosa PA01
gcgcgcuggauuucgccgagu

SEQ ID NO: 3498262 - RNA, 20 nt, Pseudomonas aeruginosa PA01
gcgcgcuggcagaacgcguc

SEQ ID NO: 3498263 - RNA, 14 nt, Pseudomonas aeruginosa PA01
gcgcgcuggcgcag

SEQ ID NO: 3498264 - RNA, 20 nt, Pseudomonas aeruginosa PA01
gcgcgcuggcgcagcggguc

SEQ ID NO: 3498265 - RNA, 22 nt, Pseudomonas aeruginosa PA01
gcgcgcuggucguaggcgcggg

SEQ ID NO: 3498266 - RNA, 24 nt, Pseudomonas aeruginosa PA01
gcgcgcuggucguaggcgcgggcg

SEQ ID NO: 3498267 - RNA, 20 nt, Pseudomonas aeruginosa PA01
gcgcgcuggucguucucgcg

SEQ ID NO: 3498268 - RNA, 21 nt, Pseudomonas aeruginosa PA01
gcgcgcuggucguucucgcgc

SEQ ID NO: 3498269 - RNA, 17 nt, Pseudomonas aeruginosa PA01
gcgcgcuguagccggcg

SEQ ID NO: 3498270 - RNA, 18 nt, Pseudomonas aeruginosa PA01
gcgcgcuguagccggcgc

SEQ ID NO: 3498271 - RNA, 19 nt, Pseudomonas aeruginosa PA01
gcgcgcuguagccggcgcc

SEQ ID NO: 3498272 - RNA, 18 nt, Pseudomonas aeruginosa PA01
gcgcgcugugcacggucu

SEQ ID NO: 3498273 - RNA, 16 nt, Pseudomonas aeruginosa PA01
gcgcgcuuccaggcac

SEQ ID NO: 3498274 - RNA, 15 nt, Pseudomonas aeruginosa PA01
gcgcgcuuccuccag

SEQ ID NO: 3498275 - RNA, 20 nt, Pseudomonas aeruginosa PA01
gcgcgcuucuugucgucgga

SEQ ID NO: 3498276 - RNA, 12 nt, Pseudomonas aeruginosa PA01
gcgcgcuugccg

SEQ ID NO: 3498277 - RNA, 15 nt, Pseudomonas aeruginosa PA01
gcgcgcuugccgcug

SEQ ID NO: 3498278 - RNA, 19 nt, Pseudomonas aeruginosa PA01
gcgcgcuuuccggcgcggc

SEQ ID NO: 3498279 - RNA, 23 nt, Pseudomonas aeruginosa PA01
gcgcgcuuuccggcgcggccugc

SEQ ID NO: 3498280 - RNA, 18 nt, Pseudomonas aeruginosa PA01
gcgcgcuuuuccggcgcc

SEQ ID NO: 3498281 - RNA, 19 nt, Pseudomonas aeruginosa PA01
gcgcgcuuuuccggcgccg

SEQ ID NO: 3498282 - RNA, 21 nt, Pseudomonas aeruginosa PA01
gcgcgcuuuuccggcgccggc

SEQ ID NO: 3498283 - RNA, 21 nt, Pseudomonas aeruginosa PA01
gcgcggaaaaucaaaaccagc

SEQ ID NO: 3498284 - RNA, 16 nt, Pseudomonas aeruginosa PA01
gcgcggaacaucgccc

SEQ ID NO: 3498285 - RNA, 17 nt, Pseudomonas aeruginosa PA01
gcgcggaacaucgcccg

SEQ ID NO: 3498286 - RNA, 20 nt, Pseudomonas aeruginosa PA01
gcgcggaagcgccugcggug

SEQ ID NO: 3498287 - RNA, 17 nt, Pseudomonas aeruginosa PA01
gcgcggaauccuucgcg

SEQ ID NO: 3498288 - RNA, 14 nt, Pseudomonas aeruginosa PA01
gcgcggaccgcaac

SEQ ID NO: 3498289 - RNA, 21 nt, Pseudomonas aeruginosa PA01
gcgcggaccgcaaccgguccu

SEQ ID NO: 3498290 - RNA, 22 nt, Pseudomonas aeruginosa PA01
gcgcggaccgcaaccgguccuc

SEQ ID NO: 3498291 - RNA, 22 nt, Pseudomonas aeruginosa PA01
gcgcggaccuucgacggcaggu

SEQ ID NO: 3498292 - RNA, 14 nt, Pseudomonas aeruginosa PA01
gcgcggacggccug

SEQ ID NO: 3498293 - RNA, 19 nt, Pseudomonas aeruginosa PA01
gcgcggacggccugcgccc

SEQ ID NO: 3498294 - RNA, 12 nt, Pseudomonas aeruginosa PA01
gcgcggagaucc

SEQ ID NO: 3498295 - RNA, 17 nt, Pseudomonas aeruginosa PA01
gcgcggagcguccacca

SEQ ID NO: 3498296 - RNA, 18 nt, Pseudomonas aeruginosa PA01
gcgcggauccccucccgc

SEQ ID NO: 3498297 - RNA, 19 nt, Pseudomonas aeruginosa PA01
gcgcggauccccucccgcg

SEQ ID NO: 3498298 - RNA, 20 nt, Pseudomonas aeruginosa PA01
gcgcggauccccucccgcgc

SEQ ID NO: 3498299 - RNA, 21 nt, Pseudomonas aeruginosa PA01
gcgcggauccccucccgcgcc

SEQ ID NO: 3498300 - RNA, 23 nt, Pseudomonas aeruginosa PA01
gcgcggauccccucccgcgccag

SEQ ID NO: 3498301 - RNA, 24 nt, Pseudomonas aeruginosa PA01
gcgcggauccccucccgcgccagc

SEQ ID NO: 3498302 - RNA, 22 nt, Pseudomonas aeruginosa PA01
gcgcggauguucgccacgcugc

SEQ ID NO: 3498303 - RNA, 19 nt, Pseudomonas aeruginosa PA01
gcgcggcaaagugcggucg

SEQ ID NO: 3498304 - RNA, 21 nt, Pseudomonas aeruginosa PA01
gcgcggcacagcguggccagc

SEQ ID NO: 3498305 - RNA, 15 nt, Pseudomonas aeruginosa PA01
gcgcggcacaggcgg

SEQ ID NO: 3498306 - RNA, 17 nt, Pseudomonas aeruginosa PA01
gcgcggcacaggcggcu

SEQ ID NO: 3498307 - RNA, 18 nt, Pseudomonas aeruginosa PA01
gcgcggcacaggcggcug

SEQ ID NO: 3498308 - RNA, 22 nt, Pseudomonas aeruginosa PA01
gcgcggcaccccuugcagccag

SEQ ID NO: 3498309 - RNA, 15 nt, Pseudomonas aeruginosa PA01
gcgcggcagcaccag

SEQ ID NO: 3498310 - RNA, 17 nt, Pseudomonas aeruginosa PA01
gcgcggcagcaccaggc

SEQ ID NO: 3498311 - RNA, 19 nt, Pseudomonas aeruginosa PA01
gcgcggcagcaccaggcca

SEQ ID NO: 3498312 - RNA, 23 nt, Pseudomonas aeruginosa PA01
gcgcggcagcaccaggccaucga

SEQ ID NO: 3498313 - RNA, 14 nt, Pseudomonas aeruginosa PA01
gcgcggcagcaggc

SEQ ID NO: 3498314 - RNA, 14 nt, Pseudomonas aeruginosa PA01
gcgcggcagcgcca

SEQ ID NO: 3498315 - RNA, 23 nt, Pseudomonas aeruginosa PA01
gcgcggcagcgccaucaggcccu

SEQ ID NO: 3498316 - RNA, 20 nt, Pseudomonas aeruginosa PA01
gcgcggcaggaaauccgccg

SEQ ID NO: 3498317 - RNA, 13 nt, Pseudomonas aeruginosa PA01
gcgcggcaggacc

SEQ ID NO: 3498318 - RNA, 16 nt, Pseudomonas aeruginosa PA01
gcgcggcaggccgucc

SEQ ID NO: 3498319 - RNA, 15 nt, Pseudomonas aeruginosa PA01
gcgcggcagguagcc

SEQ ID NO: 3498320 - RNA, 14 nt, Pseudomonas aeruginosa PA01
gcgcggcagguggc

SEQ ID NO: 3498321 - RNA, 20 nt, Pseudomonas aeruginosa PA01
gcgcggcagguggcuggcca

SEQ ID NO: 3498322 - RNA, 23 nt, Pseudomonas aeruginosa PA01
gcgcggcagugcucgaucaggcu

SEQ ID NO: 3498323 - RNA, 17 nt, Pseudomonas aeruginosa PA01
gcgcggcauagcgcagc

SEQ ID NO: 3498324 - RNA, 12 nt, Pseudomonas aeruginosa PA01
gcgcggccagcu

SEQ ID NO: 3498325 - RNA, 14 nt, Pseudomonas aeruginosa PA01
gcgcggccagcuuc

SEQ ID NO: 3498326 - RNA, 22 nt, Pseudomonas aeruginosa PA01
gcgcggccagcuucuccagcag

SEQ ID NO: 3498327 - RNA, 13 nt, Pseudomonas aeruginosa PA01
gcgcggcccacca

SEQ ID NO: 3498328 - RNA, 15 nt, Pseudomonas aeruginosa PA01
gcgcggcccaccaga

SEQ ID NO: 3498329 - RNA, 14 nt, Pseudomonas aeruginosa PA01
gcgcggccgccgcc

SEQ ID NO: 3498330 - RNA, 16 nt, Pseudomonas aeruginosa PA01
gcgcggccgccgccga

SEQ ID NO: 3498331 - RNA, 13 nt, Pseudomonas aeruginosa PA01
gcgcggccggcca

SEQ ID NO: 3498332 - RNA, 12 nt, Pseudomonas aeruginosa PA01
gcgcggccggcg

SEQ ID NO: 3498333 - RNA, 15 nt, Pseudomonas aeruginosa PA01
gcgcggccggcgccg

SEQ ID NO: 3498334 - RNA, 16 nt, Pseudomonas aeruginosa PA01
gcgcggccggcgccgc

SEQ ID NO: 3498335 - RNA, 12 nt, Pseudomonas aeruginosa PA01
gcgcggccgugc

SEQ ID NO: 3498336 - RNA, 15 nt, Pseudomonas aeruginosa PA01
gcgcggccgugccuc

SEQ ID NO: 3498337 - RNA, 12 nt, Pseudomonas aeruginosa PA01
gcgcggccucgg

SEQ ID NO: 3498338 - RNA, 19 nt, Pseudomonas aeruginosa PA01
gcgcggccugcgccggacc

SEQ ID NO: 3498339 - RNA, 21 nt, Pseudomonas aeruginosa PA01
gcgcggccuucuugcugccgg

SEQ ID NO: 3498340 - RNA, 14 nt, Pseudomonas aeruginosa PA01
gcgcggcgacgauc

SEQ ID NO: 3498341 - RNA, 20 nt, Pseudomonas aeruginosa PA01
gcgcggcgaguugcgcgagg

SEQ ID NO: 3498342 - RNA, 15 nt, Pseudomonas aeruginosa PA01
gcgcggcgcagcggc

SEQ ID NO: 3498343 - RNA, 17 nt, Pseudomonas aeruginosa PA01
gcgcggcgcagcggcga

SEQ ID NO: 3498344 - RNA, 18 nt, Pseudomonas aeruginosa PA01
gcgcggcgcagcggcgaa

SEQ ID NO: 3498345 - RNA, 17 nt, Pseudomonas aeruginosa PA01
gcgcggcgcaggcgaug

SEQ ID NO: 3498346 - RNA, 18 nt, Pseudomonas aeruginosa PA01
gcgcggcgccagcgcccc

SEQ ID NO: 3498347 - RNA, 22 nt, Pseudomonas aeruginosa PA01
gcgcggcgccagcgccccacca

SEQ ID NO: 3498348 - RNA, 16 nt, Pseudomonas aeruginosa PA01
gcgcggcgcccugccg

SEQ ID NO: 3498349 - RNA, 17 nt, Pseudomonas aeruginosa PA01
gcgcggcgcccugccgg

SEQ ID NO: 3498350 - RNA, 12 nt, Pseudomonas aeruginosa PA01
gcgcggcgccgg

SEQ ID NO: 3498351 - RNA, 17 nt, Pseudomonas aeruginosa PA01
gcgcggcgccgguugcu

SEQ ID NO: 3498352 - RNA, 21 nt, Pseudomonas aeruginosa PA01
gcgcggcgccuucagcgccgc

SEQ ID NO: 3498353 - RNA, 20 nt, Pseudomonas aeruginosa PA01
gcgcggcgcguuccgggucg

SEQ ID NO: 3498354 - RNA, 12 nt, Pseudomonas aeruginosa PA01
gcgcggcgcucc

SEQ ID NO: 3498355 - RNA, 13 nt, Pseudomonas aeruginosa PA01
gcgcggcgcucca

SEQ ID NO: 3498356 - RNA, 16 nt, Pseudomonas aeruginosa PA01
gcgcggcgcuuggcga

SEQ ID NO: 3498357 - RNA, 12 nt, Pseudomonas aeruginosa PA01
gcgcggcggaag

SEQ ID NO: 3498358 - RNA, 17 nt, Pseudomonas aeruginosa PA01
gcgcggcggccgccucg

SEQ ID NO: 3498359 - RNA, 11 nt, Pseudomonas aeruginosa PA01
gcgcggcggcg

SEQ ID NO: 3498360 - RNA, 13 nt, Pseudomonas aeruginosa PA01
gcgcggcggcgcg

SEQ ID NO: 3498361 - RNA, 15 nt, Pseudomonas aeruginosa PA01
gcgcggcggcgcgga

SEQ ID NO: 3498362 - RNA, 14 nt, Pseudomonas aeruginosa PA01
gcgcggcggcggcc

SEQ ID NO: 3498363 - RNA, 17 nt, Pseudomonas aeruginosa PA01
gcgcggcggcggccgca

SEQ ID NO: 3498364 - RNA, 14 nt, Pseudomonas aeruginosa PA01
gcgcggcggguggc

SEQ ID NO: 3498365 - RNA, 15 nt, Pseudomonas aeruginosa PA01
gcgcggcggguggcg

SEQ ID NO: 3498366 - RNA, 16 nt, Pseudomonas aeruginosa PA01
gcgcggcggguggcgc

SEQ ID NO: 3498367 - RNA, 15 nt, Pseudomonas aeruginosa PA01
gcgcggcggugcaga

SEQ ID NO: 3498368 - RNA, 17 nt, Pseudomonas aeruginosa PA01
gcgcggcguaccuucga

SEQ ID NO: 3498369 - RNA, 14 nt, Pseudomonas aeruginosa PA01
gcgcggcgucgacc

SEQ ID NO: 3498370 - RNA, 14 nt, Pseudomonas aeruginosa PA01
gcgcggcgucggcg

SEQ ID NO: 3498371 - RNA, 16 nt, Pseudomonas aeruginosa PA01
gcgcggcgucggcgaa

SEQ ID NO: 3498372 - RNA, 13 nt, Pseudomonas aeruginosa PA01
gcgcggcgucggg

SEQ ID NO: 3498373 - RNA, 15 nt, Pseudomonas aeruginosa PA01
gcgcggcguucgccc

SEQ ID NO: 3498374 - RNA, 13 nt, Pseudomonas aeruginosa PA01
gcgcggcucggcg

SEQ ID NO: 3498375 - RNA, 17 nt, Pseudomonas aeruginosa PA01
gcgcggcucgggcggca

SEQ ID NO: 3498376 - RNA, 19 nt, Pseudomonas aeruginosa PA01
gcgcggcugaucggccgcc

SEQ ID NO: 3498377 - RNA, 12 nt, Pseudomonas aeruginosa PA01
gcgcggcugcuu

SEQ ID NO: 3498378 - RNA, 18 nt, Pseudomonas aeruginosa PA01
gcgcggcugcuugccgcu

SEQ ID NO: 3498379 - RNA, 23 nt, Pseudomonas aeruginosa PA01
gcgcggcugcuugccgcucaggc

SEQ ID NO: 3498380 - RNA, 15 nt, Pseudomonas aeruginosa PA01
gcgcggcuggugcga

SEQ ID NO: 3498381 - RNA, 18 nt, Pseudomonas aeruginosa PA01
gcgcggcuucagagcugg

SEQ ID NO: 3498382 - RNA, 13 nt, Pseudomonas aeruginosa PA01
gcgcggcuugccg

SEQ ID NO: 3498383 - RNA, 19 nt, Pseudomonas aeruginosa PA01
gcgcggcuugccggcgcgc

SEQ ID NO: 3498384 - RNA, 14 nt, Pseudomonas aeruginosa PA01
gcgcgggcaaucgg

SEQ ID NO: 3498385 - RNA, 14 nt, Pseudomonas aeruginosa PA01
gcgcgggccgacgg

SEQ ID NO: 3498386 - RNA, 22 nt, Pseudomonas aeruginosa PA01
gcgcgggccgacggcccuccgg

SEQ ID NO: 3498387 - RNA, 14 nt, Pseudomonas aeruginosa PA01
gcgcgggccgaggu

SEQ ID NO: 3498388 - RNA, 13 nt, Pseudomonas aeruginosa PA01
gcgcgggccggcg

SEQ ID NO: 3498389 - RNA, 16 nt, Pseudomonas aeruginosa PA01
gcgcgggccggcgaug

SEQ ID NO: 3498390 - RNA, 20 nt, Pseudomonas aeruginosa PA01
gcgcgggccuucaggcugcg

SEQ ID NO: 3498391 - RNA, 15 nt, Pseudomonas aeruginosa PA01
gcgcgggccuucgcc

SEQ ID NO: 3498392 - RNA, 12 nt, Pseudomonas aeruginosa PA01
gcgcgggcgccg

SEQ ID NO: 3498393 - RNA, 13 nt, Pseudomonas aeruginosa PA01
gcgcgggcgccga

SEQ ID NO: 3498394 - RNA, 14 nt, Pseudomonas aeruginosa PA01
gcgcgggcgccgau

SEQ ID NO: 3498395 - RNA, 13 nt, Pseudomonas aeruginosa PA01
gcgcgggcggccu

SEQ ID NO: 3498396 - RNA, 14 nt, Pseudomonas aeruginosa PA01
gcgcgggcggccuc

SEQ ID NO: 3498397 - RNA, 16 nt, Pseudomonas aeruginosa PA01
gcgcgggcggccucga

SEQ ID NO: 3498398 - RNA, 17 nt, Pseudomonas aeruginosa PA01
gcgcgggcggcggcgcg

SEQ ID NO: 3498399 - RNA, 18 nt, Pseudomonas aeruginosa PA01
gcgcgggcggcggcgcgg

SEQ ID NO: 3498400 - RNA, 13 nt, Pseudomonas aeruginosa PA01
gcgcggggccccg

SEQ ID NO: 3498401 - RNA, 18 nt, Pseudomonas aeruginosa PA01
gcgcggggcccggcucca

SEQ ID NO: 3498402 - RNA, 23 nt, Pseudomonas aeruginosa PA01
gcgcggggcccggcuccagccgg

SEQ ID NO: 3498403 - RNA, 13 nt, Pseudomonas aeruginosa PA01
gcgcggggcgagg

SEQ ID NO: 3498404 - RNA, 17 nt, Pseudomonas aeruginosa PA01
gcgcggggcgaggucgg

SEQ ID NO: 3498405 - RNA, 19 nt, Pseudomonas aeruginosa PA01
gcgcggggcgaggucggcc

SEQ ID NO: 3498406 - RNA, 23 nt, Pseudomonas aeruginosa PA01
gcgcgggguagggguggccaggc

SEQ ID NO: 3498407 - RNA, 14 nt, Pseudomonas aeruginosa PA01
gcgcgggguggccg

SEQ ID NO: 3498408 - RNA, 13 nt, Pseudomonas aeruginosa PA01
gcgcgggucaucg

SEQ ID NO: 3498409 - RNA, 17 nt, Pseudomonas aeruginosa PA01
gcgcgggucaucggccc

SEQ ID NO: 3498410 - RNA, 23 nt, Pseudomonas aeruginosa PA01
gcgcgggucguacaccgcgcggc

SEQ ID NO: 3498411 - RNA, 24 nt, Pseudomonas aeruginosa PA01
gcgcgggucguacaccgcgcggca

SEQ ID NO: 3498412 - RNA, 18 nt, Pseudomonas aeruginosa PA01
gcgcgggucuugccgguc

SEQ ID NO: 3498413 - RNA, 22 nt, Pseudomonas aeruginosa PA01
gcgcgggucuugccggucugcu

SEQ ID NO: 3498414 - RNA, 14 nt, Pseudomonas aeruginosa PA01
gcgcgggugcggcu

SEQ ID NO: 3498415 - RNA, 16 nt, Pseudomonas aeruginosa PA01
gcgcggguguccucga

SEQ ID NO: 3498416 - RNA, 19 nt, Pseudomonas aeruginosa PA01
gcgcgguaggugaugcggc

SEQ ID NO: 3498417 - RNA, 16 nt, Pseudomonas aeruginosa PA01
gcgcgguaucccugga

SEQ ID NO: 3498418 - RNA, 17 nt, Pseudomonas aeruginosa PA01
gcgcgguaucccuggaa

SEQ ID NO: 3498419 - RNA, 14 nt, Pseudomonas aeruginosa PA01
gcgcggucaccagg

SEQ ID NO: 3498420 - RNA, 21 nt, Pseudomonas aeruginosa PA01
gcgcggucaccagggucacgc

SEQ ID NO: 3498421 - RNA, 16 nt, Pseudomonas aeruginosa PA01
gcgcggucauccgccc

SEQ ID NO: 3498422 - RNA, 16 nt, Pseudomonas aeruginosa PA01
gcgcggucccuggauc

SEQ ID NO: 3498423 - RNA, 12 nt, Pseudomonas aeruginosa PA01
gcgcggucgagc

SEQ ID NO: 3498424 - RNA, 15 nt, Pseudomonas aeruginosa PA01
gcgcggucgagcagc

SEQ ID NO: 3498425 - RNA, 16 nt, Pseudomonas aeruginosa PA01
gcgcggucgagcagcg

SEQ ID NO: 3498426 - RNA, 19 nt, Pseudomonas aeruginosa PA01
gcgcggucgagcagcgccg

SEQ ID NO: 3498427 - RNA, 20 nt, Pseudomonas aeruginosa PA01
gcgcggucgagcagcgccgc

SEQ ID NO: 3498428 - RNA, 22 nt, Pseudomonas aeruginosa PA01
gcgcggucgagcagcgccgcgg

SEQ ID NO: 3498429 - RNA, 14 nt, Pseudomonas aeruginosa PA01
gcgcggucgagcuc

SEQ ID NO: 3498430 - RNA, 19 nt, Pseudomonas aeruginosa PA01
gcgcggucggguccgggcc

SEQ ID NO: 3498431 - RNA, 20 nt, Pseudomonas aeruginosa PA01
gcgcggucucuucgucgguc

SEQ ID NO: 3498432 - RNA, 13 nt, Pseudomonas aeruginosa PA01
gcgcggugcgcgc

SEQ ID NO: 3498433 - RNA, 13 nt, Pseudomonas aeruginosa PA01
gcgcggugggccu

SEQ ID NO: 3498434 - RNA, 19 nt, Pseudomonas aeruginosa PA01
gcgcggugggccuugagca

SEQ ID NO: 3498435 - RNA, 21 nt, Pseudomonas aeruginosa PA01
gcgcgguuauccgccggugcg

SEQ ID NO: 3498436 - RNA, 16 nt, Pseudomonas aeruginosa PA01
gcgcgguugccgcugc

SEQ ID NO: 3498437 - RNA, 17 nt, Pseudomonas aeruginosa PA01
gcgcgguugccgcugcg

SEQ ID NO: 3498438 - RNA, 15 nt, Pseudomonas aeruginosa PA01
gcgcgguuucgcagc

SEQ ID NO: 3498439 - RNA, 19 nt, Pseudomonas aeruginosa PA01
gcgcgguuucgcagcgcuc

SEQ ID NO: 3498440 - RNA, 15 nt, Pseudomonas aeruginosa PA01
gcgcgguuucuucgc

SEQ ID NO: 3498441 - RNA, 21 nt, Pseudomonas aeruginosa PA01
gcgcgguuucuucgccuugcc

SEQ ID NO: 3498442 - RNA, 17 nt, Pseudomonas aeruginosa PA01
gcgcguacgcccgcagc

SEQ ID NO: 3498443 - RNA, 19 nt, Pseudomonas aeruginosa PA01
gcgcguacucaggccgggc

SEQ ID NO: 3498444 - RNA, 14 nt, Pseudomonas aeruginosa PA01
gcgcguacuugcca

SEQ ID NO: 3498445 - RNA, 20 nt, Pseudomonas aeruginosa PA01
gcgcguacuugccagggcag

SEQ ID NO: 3498446 - RNA, 18 nt, Pseudomonas aeruginosa PA01
gcgcguagaggaugccgg

SEQ ID NO: 3498447 - RNA, 20 nt, Pseudomonas aeruginosa PA01
gcgcguagaggaugccggcc

SEQ ID NO: 3498448 - RNA, 21 nt, Pseudomonas aeruginosa PA01
gcgcguagaggaugccggccu

SEQ ID NO: 3498449 - RNA, 17 nt, Pseudomonas aeruginosa PA01
gcgcguagcgugccgcc

SEQ ID NO: 3498450 - RNA, 19 nt, Pseudomonas aeruginosa PA01
gcgcguagcuuuccgcggc

SEQ ID NO: 3498451 - RNA, 21 nt, Pseudomonas aeruginosa PA01
gcgcguaggcgaacacgucgg

SEQ ID NO: 3498452 - RNA, 19 nt, Pseudomonas aeruginosa PA01
gcgcguaggcuuggucggg

SEQ ID NO: 3498453 - RNA, 23 nt, Pseudomonas aeruginosa PA01
gcgcgucaucaggcucaggccgg

SEQ ID NO: 3498454 - RNA, 17 nt, Pseudomonas aeruginosa PA01
gcgcgucaugccgccgu

SEQ ID NO: 3498455 - RNA, 15 nt, Pseudomonas aeruginosa PA01
gcgcguccaccuggc

SEQ ID NO: 3498456 - RNA, 17 nt, Pseudomonas aeruginosa PA01
gcgcguccaccuggcgg

SEQ ID NO: 3498457 - RNA, 18 nt, Pseudomonas aeruginosa PA01
gcgcguccaccuggcggc

SEQ ID NO: 3498458 - RNA, 19 nt, Pseudomonas aeruginosa PA01
gcgcguccaccuggcggcu

SEQ ID NO: 3498459 - RNA, 20 nt, Pseudomonas aeruginosa PA01
gcgcguccaccuggcggcug

SEQ ID NO: 3498460 - RNA, 16 nt, Pseudomonas aeruginosa PA01
gcgcguccagccggua

SEQ ID NO: 3498461 - RNA, 18 nt, Pseudomonas aeruginosa PA01
gcgcguccagccgguagg

SEQ ID NO: 3498462 - RNA, 22 nt, Pseudomonas aeruginosa PA01
gcgcguccagcuccaccaggcc

SEQ ID NO: 3498463 - RNA, 21 nt, Pseudomonas aeruginosa PA01
gcgcgucccugcccgcgccuc

SEQ ID NO: 3498464 - RNA, 16 nt, Pseudomonas aeruginosa PA01
gcgcgucccugggcgc

SEQ ID NO: 3498465 - RNA, 15 nt, Pseudomonas aeruginosa PA01
gcgcguccggaguga

SEQ ID NO: 3498466 - RNA, 16 nt, Pseudomonas aeruginosa PA01
gcgcgucgaccaccgc

SEQ ID NO: 3498467 - RNA, 20 nt, Pseudomonas aeruginosa PA01
gcgcgucgaccaccgcgugg

SEQ ID NO: 3498468 - RNA, 15 nt, Pseudomonas aeruginosa PA01
gcgcgucgaccacga

SEQ ID NO: 3498469 - RNA, 22 nt, Pseudomonas aeruginosa PA01
gcgcgucgaugcuuucgagcaa

SEQ ID NO: 3498470 - RNA, 14 nt, Pseudomonas aeruginosa PA01
gcgcgucgccgaac

SEQ ID NO: 3498471 - RNA, 20 nt, Pseudomonas aeruginosa PA01
gcgcgucgccgaacggcagc

SEQ ID NO: 3498472 - RNA, 14 nt, Pseudomonas aeruginosa PA01
gcgcgucgcggccu

SEQ ID NO: 3498473 - RNA, 22 nt, Pseudomonas aeruginosa PA01
gcgcgucgcggucuuccgccga

SEQ ID NO: 3498474 - RNA, 15 nt, Pseudomonas aeruginosa PA01
gcgcgucgcugccgc

SEQ ID NO: 3498475 - RNA, 18 nt, Pseudomonas aeruginosa PA01
gcgcgucgcugccgccgc

SEQ ID NO: 3498476 - RNA, 20 nt, Pseudomonas aeruginosa PA01
gcgcgucgcugccgccgcgc

SEQ ID NO: 3498477 - RNA, 13 nt, Pseudomonas aeruginosa PA01
gcgcgucgcugcg

SEQ ID NO: 3498478 - RNA, 16 nt, Pseudomonas aeruginosa PA01
gcgcgucggcacgccg

SEQ ID NO: 3498479 - RNA, 17 nt, Pseudomonas aeruginosa PA01
gcgcgucggcacgccga

SEQ ID NO: 3498480 - RNA, 19 nt, Pseudomonas aeruginosa PA01
gcgcgucggcacgccgaag

SEQ ID NO: 3498481 - RNA, 14 nt, Pseudomonas aeruginosa PA01
gcgcgucggccgcu

SEQ ID NO: 3498482 - RNA, 13 nt, Pseudomonas aeruginosa PA01
gcgcgucggcggc

SEQ ID NO: 3498483 - RNA, 13 nt, Pseudomonas aeruginosa PA01
gcgcgucggcggu

SEQ ID NO: 3498484 - RNA, 13 nt, Pseudomonas aeruginosa PA01
gcgcgucggucag

SEQ ID NO: 3498485 - RNA, 16 nt, Pseudomonas aeruginosa PA01
gcgcgucgguggcagg

SEQ ID NO: 3498486 - RNA, 14 nt, Pseudomonas aeruginosa PA01
gcgcgucuccagcu

SEQ ID NO: 3498487 - RNA, 17 nt, Pseudomonas aeruginosa PA01
gcgcgucuccagcucgg

SEQ ID NO: 3498488 - RNA, 21 nt, Pseudomonas aeruginosa PA01
gcgcgugcaggcgcccuggcc

SEQ ID NO: 3498489 - RNA, 14 nt, Pseudomonas aeruginosa PA01
gcgcgugccccgug

SEQ ID NO: 3498490 - RNA, 20 nt, Pseudomonas aeruginosa PA01
gcgcgugccccguggcgggc

SEQ ID NO: 3498491 - RNA, 15 nt, Pseudomonas aeruginosa PA01
gcgcgugcuggugcc

SEQ ID NO: 3498492 - RNA, 18 nt, Pseudomonas aeruginosa PA01
gcgcgugcuggugccgau

SEQ ID NO: 3498493 - RNA, 15 nt, Pseudomonas aeruginosa PA01
gcgcguggccgccag

SEQ ID NO: 3498494 - RNA, 18 nt, Pseudomonas aeruginosa PA01
gcgcguggccgccagggu

SEQ ID NO: 3498495 - RNA, 19 nt, Pseudomonas aeruginosa PA01
gcgcguggccgccaggguc

SEQ ID NO: 3498496 - RNA, 16 nt, Pseudomonas aeruginosa PA01
gcgcguggcuucgucc

SEQ ID NO: 3498497 - RNA, 17 nt, Pseudomonas aeruginosa PA01
gcgcguguugcgccgca

SEQ ID NO: 3498498 - RNA, 22 nt, Pseudomonas aeruginosa PA01
gcgcguguugcgccgcaccacg

SEQ ID NO: 3498499 - RNA, 15 nt, Pseudomonas aeruginosa PA01
gcgcguucaccccgc

SEQ ID NO: 3498500 - RNA, 21 nt, Pseudomonas aeruginosa PA01
gcgcguucaccccgcccuugg

SEQ ID NO: 3498501 - RNA, 20 nt, Pseudomonas aeruginosa PA01
gcgcguucacuccacgagga

SEQ ID NO: 3498502 - RNA, 23 nt, Pseudomonas aeruginosa PA01
gcgcguuccacguccuccaggcu

SEQ ID NO: 3498503 - RNA, 20 nt, Pseudomonas aeruginosa PA01
gcgcguuccaggucgcugcu

SEQ ID NO: 3498504 - RNA, 16 nt, Pseudomonas aeruginosa PA01
gcgcguugcagcgccu

SEQ ID NO: 3498505 - RNA, 16 nt, Pseudomonas aeruginosa PA01
gcgcguugcccagccc

SEQ ID NO: 3498506 - RNA, 17 nt, Pseudomonas aeruginosa PA01
gcgcguugcccagcccc

SEQ ID NO: 3498507 - RNA, 18 nt, Pseudomonas aeruginosa PA01
gcgcguugcccagcccca

SEQ ID NO: 3498508 - RNA, 22 nt, Pseudomonas aeruginosa PA01
gcgcguugcccagccccaccgc

SEQ ID NO: 3498509 - RNA, 18 nt, Pseudomonas aeruginosa PA01
gcgcguugcuuccaggca

SEQ ID NO: 3498510 - RNA, 20 nt, Pseudomonas aeruginosa PA01
gcgcguugcuuccaggcacc

SEQ ID NO: 3498511 - RNA, 15 nt, Pseudomonas aeruginosa PA01
gcgcguuggcuggcg

SEQ ID NO: 3498512 - RNA, 16 nt, Pseudomonas aeruginosa PA01
gcgcguuggcuggcgg

SEQ ID NO: 3498513 - RNA, 16 nt, Pseudomonas aeruginosa PA01
gcgcguuucagcgcuu

SEQ ID NO: 3498514 - RNA, 14 nt, Pseudomonas aeruginosa PA01
gcgcguuucucagc

SEQ ID NO: 3498515 - RNA, 18 nt, Pseudomonas aeruginosa PA01
gcgcguuucucagcgccg

SEQ ID NO: 3498516 - RNA, 13 nt, Pseudomonas aeruginosa PA01
gcgcuaccgcgca

SEQ ID NO: 3498517 - RNA, 16 nt, Pseudomonas aeruginosa PA01
gcgcuaccgcgcaugg

SEQ ID NO: 3498518 - RNA, 19 nt, Pseudomonas aeruginosa PA01
gcgcuaccgcgcauggcgg

SEQ ID NO: 3498519 - RNA, 20 nt, Pseudomonas aeruginosa PA01
gcgcuaccgcgcauggcggc

SEQ ID NO: 3498520 - RNA, 13 nt, Pseudomonas aeruginosa PA01
gcgcuacgaaggc

SEQ ID NO: 3498521 - RNA, 16 nt, Pseudomonas aeruginosa PA01
gcgcuacgaaggcgug

SEQ ID NO: 3498522 - RNA, 16 nt, Pseudomonas aeruginosa PA01
gcgcuacgcaggcccu

SEQ ID NO: 3498523 - RNA, 17 nt, Pseudomonas aeruginosa PA01
gcgcuacgcucgccgac

SEQ ID NO: 3498524 - RNA, 18 nt, Pseudomonas aeruginosa PA01
gcgcuacgcucgccgacg

SEQ ID NO: 3498525 - RNA, 19 nt, Pseudomonas aeruginosa PA01
gcgcuacgcucgccgacgg

SEQ ID NO: 3498526 - RNA, 17 nt, Pseudomonas aeruginosa PA01
gcgcuagcgcauggcga

SEQ ID NO: 3498527 - RNA, 23 nt, Pseudomonas aeruginosa PA01
gcgcuauccgccguuacgccgga

SEQ ID NO: 3498528 - RNA, 14 nt, Pseudomonas aeruginosa PA01
gcgcuaucggcccg

SEQ ID NO: 3498529 - RNA, 16 nt, Pseudomonas aeruginosa PA01
gcgcucaacgccucgc

SEQ ID NO: 3498530 - RNA, 21 nt, Pseudomonas aeruginosa PA01
gcgcucaacgccucgcggcua

SEQ ID NO: 3498531 - RNA, 15 nt, Pseudomonas aeruginosa PA01
gcgcucacccacaug

SEQ ID NO: 3498532 - RNA, 20 nt, Pseudomonas aeruginosa PA01
gcgcucacccacauggcggu

SEQ ID NO: 3498533 - RNA, 23 nt, Pseudomonas aeruginosa PA01
gcgcucaccgaggcgaacggcag

SEQ ID NO: 3498534 - RNA, 20 nt, Pseudomonas aeruginosa PA01
gcgcucaccgcauagucgcg

SEQ ID NO: 3498535 - RNA, 21 nt, Pseudomonas aeruginosa PA01
gcgcucaccgcauagucgcga

SEQ ID NO: 3498536 - RNA, 23 nt, Pseudomonas aeruginosa PA01
gcgcucaccgcauagucgcgaug

SEQ ID NO: 3498537 - RNA, 20 nt, Pseudomonas aeruginosa PA01
gcgcucagccgaggucgccg

SEQ ID NO: 3498538 - RNA, 12 nt, Pseudomonas aeruginosa PA01
gcgcucagcgcc

SEQ ID NO: 3498539 - RNA, 13 nt, Pseudomonas aeruginosa PA01
gcgcucagcgccg

SEQ ID NO: 3498540 - RNA, 13 nt, Pseudomonas aeruginosa PA01
gcgcucagcgcga

SEQ ID NO: 3498541 - RNA, 14 nt, Pseudomonas aeruginosa PA01
gcgcucagcgcgag

SEQ ID NO: 3498542 - RNA, 22 nt, Pseudomonas aeruginosa PA01
gcgcucagcgcgagggggccuc

SEQ ID NO: 3498543 - RNA, 14 nt, Pseudomonas aeruginosa PA01
gcgcucaggcgcag

SEQ ID NO: 3498544 - RNA, 12 nt, Pseudomonas aeruginosa PA01
gcgcucagggaa

SEQ ID NO: 3498545 - RNA, 15 nt, Pseudomonas aeruginosa PA01
gcgcuccaacagcag

SEQ ID NO: 3498546 - RNA, 17 nt, Pseudomonas aeruginosa PA01
gcgcuccacagcugcca

SEQ ID NO: 3498547 - RNA, 16 nt, Pseudomonas aeruginosa PA01
gcgcuccaccagggcc

SEQ ID NO: 3498548 - RNA, 20 nt, Pseudomonas aeruginosa PA01
gcgcuccaccagggccucgg

SEQ ID NO: 3498549 - RNA, 23 nt, Pseudomonas aeruginosa PA01
gcgcuccaccagggccucggggc

SEQ ID NO: 3498550 - RNA, 14 nt, Pseudomonas aeruginosa PA01
gcgcuccacccagg

SEQ ID NO: 3498551 - RNA, 18 nt, Pseudomonas aeruginosa PA01
gcgcuccacccaggcgcc

SEQ ID NO: 3498552 - RNA, 19 nt, Pseudomonas aeruginosa PA01
gcgcuccacccaggcgccg

SEQ ID NO: 3498553 - RNA, 12 nt, Pseudomonas aeruginosa PA01
gcgcuccaccgc

SEQ ID NO: 3498554 - RNA, 14 nt, Pseudomonas aeruginosa PA01
gcgcuccaccgccc

SEQ ID NO: 3498555 - RNA, 18 nt, Pseudomonas aeruginosa PA01
gcgcuccaccgcccccgg

SEQ ID NO: 3498556 - RNA, 23 nt, Pseudomonas aeruginosa PA01
gcgcuccaccgcccccggcgcca

SEQ ID NO: 3498557 - RNA, 16 nt, Pseudomonas aeruginosa PA01
gcgcuccaggcccggc

SEQ ID NO: 3498558 - RNA, 17 nt, Pseudomonas aeruginosa PA01
gcgcuccaggcccggca

SEQ ID NO: 3498559 - RNA, 12 nt, Pseudomonas aeruginosa PA01
gcgcuccaggcg

SEQ ID NO: 3498560 - RNA, 15 nt, Pseudomonas aeruginosa PA01
gcgcuccaggcgggu

SEQ ID NO: 3498561 - RNA, 18 nt, Pseudomonas aeruginosa PA01
gcgcuccaggcgggugaa

SEQ ID NO: 3498562 - RNA, 11 nt, Pseudomonas aeruginosa PA01
gcgcuccaggg

SEQ ID NO: 3498563 - RNA, 13 nt, Pseudomonas aeruginosa PA01
gcgcuccagggcg

SEQ ID NO: 3498564 - RNA, 23 nt, Pseudomonas aeruginosa PA01
gcgcuccaguucguugaccacgc

SEQ ID NO: 3498565 - RNA, 20 nt, Pseudomonas aeruginosa PA01
gcgcuccauccagucggcgc

SEQ ID NO: 3498566 - RNA, 21 nt, Pseudomonas aeruginosa PA01
gcgcuccauccagucggcgcu

SEQ ID NO: 3498567 - RNA, 23 nt, Pseudomonas aeruginosa PA01
gcgcuccauccagucggcgcugg

SEQ ID NO: 3498568 - RNA, 19 nt, Pseudomonas aeruginosa PA01
gcgcucccauucgcugucg

SEQ ID NO: 3498569 - RNA, 16 nt, Pseudomonas aeruginosa PA01
gcgcuccgacuccugc

SEQ ID NO: 3498570 - RNA, 15 nt, Pseudomonas aeruginosa PA01
gcgcuccgccaggcc

SEQ ID NO: 3498571 - RNA, 16 nt, Pseudomonas aeruginosa PA01
gcgcuccgccaggccg

SEQ ID NO: 3498572 - RNA, 17 nt, Pseudomonas aeruginosa PA01
gcgcuccgccaggccgc

SEQ ID NO: 3498573 - RNA, 12 nt, Pseudomonas aeruginosa PA01
gcgcuccgcugg

SEQ ID NO: 3498574 - RNA, 18 nt, Pseudomonas aeruginosa PA01
gcgcuccggaacgccugc

SEQ ID NO: 3498575 - RNA, 13 nt, Pseudomonas aeruginosa PA01
gcgcuccggcgcg

SEQ ID NO: 3498576 - RNA, 14 nt, Pseudomonas aeruginosa PA01
gcgcuccggcgcgc

SEQ ID NO: 3498577 - RNA, 18 nt, Pseudomonas aeruginosa PA01
gcgcuccggcgcgccaug

SEQ ID NO: 3498578 - RNA, 20 nt, Pseudomonas aeruginosa PA01
gcgcuccgguggcggacugg

SEQ ID NO: 3498579 - RNA, 18 nt, Pseudomonas aeruginosa PA01
gcgcuccuccagcgccgc

SEQ ID NO: 3498580 - RNA, 20 nt, Pseudomonas aeruginosa PA01
gcgcuccuccagcgccgcca

SEQ ID NO: 3498581 - RNA, 16 nt, Pseudomonas aeruginosa PA01
gcgcuccucgauccgc

SEQ ID NO: 3498582 - RNA, 16 nt, Pseudomonas aeruginosa PA01
gcgcuccucgcgcugc

SEQ ID NO: 3498583 - RNA, 17 nt, Pseudomonas aeruginosa PA01
gcgcuccucgcgcugcc

SEQ ID NO: 3498584 - RNA, 20 nt, Pseudomonas aeruginosa PA01
gcgcuccucgcgcugcccgg

SEQ ID NO: 3498585 - RNA, 22 nt, Pseudomonas aeruginosa PA01
gcgcuccucgcgcugcccggcg

SEQ ID NO: 3498586 - RNA, 20 nt, Pseudomonas aeruginosa PA01
gcgcuccuggugcggcacca

SEQ ID NO: 3498587 - RNA, 19 nt, Pseudomonas aeruginosa PA01
gcgcuccuguucgucgcgu

SEQ ID NO: 3498588 - RNA, 18 nt, Pseudomonas aeruginosa PA01
gcgcuccuucuccggggc

SEQ ID NO: 3498589 - RNA, 13 nt, Pseudomonas aeruginosa PA01
gcgcuccuugagc

SEQ ID NO: 3498590 - RNA, 14 nt, Pseudomonas aeruginosa PA01
gcgcuccuugcgcc

SEQ ID NO: 3498591 - RNA, 17 nt, Pseudomonas aeruginosa PA01
gcgcuccuugcgccagg

SEQ ID NO: 3498592 - RNA, 19 nt, Pseudomonas aeruginosa PA01
gcgcuccuugcgccaggcc

SEQ ID NO: 3498593 - RNA, 23 nt, Pseudomonas aeruginosa PA01
gcgcuccuugcgccaggcccggc

SEQ ID NO: 3498594 - RNA, 15 nt, Pseudomonas aeruginosa PA01
gcgcuccuuggcugg

SEQ ID NO: 3498595 - RNA, 17 nt, Pseudomonas aeruginosa PA01
gcgcuccuuggcuggcc

SEQ ID NO: 3498596 - RNA, 19 nt, Pseudomonas aeruginosa PA01
gcgcuccuuggcuggccag

SEQ ID NO: 3498597 - RNA, 20 nt, Pseudomonas aeruginosa PA01
gcgcuccuuggcuggccagc

SEQ ID NO: 3498598 - RNA, 17 nt, Pseudomonas aeruginosa PA01
gcgcucgacgaucaggu

SEQ ID NO: 3498599 - RNA, 19 nt, Pseudomonas aeruginosa PA01
gcgcucgacgaugcugaac

SEQ ID NO: 3498600 - RNA, 16 nt, Pseudomonas aeruginosa PA01
gcgcucgacggucagc

SEQ ID NO: 3498601 - RNA, 21 nt, Pseudomonas aeruginosa PA01
gcgcucgacggucagcggaca

SEQ ID NO: 3498602 - RNA, 23 nt, Pseudomonas aeruginosa PA01
gcgcucgagcuugaggucggccu

SEQ ID NO: 3498603 - RNA, 15 nt, Pseudomonas aeruginosa PA01
gcgcucgaggggcga

SEQ ID NO: 3498604 - RNA, 17 nt, Pseudomonas aeruginosa PA01
gcgcucgauagcgucca

SEQ ID NO: 3498605 - RNA, 21 nt, Pseudomonas aeruginosa PA01
gcgcucgauagcguccaggug

SEQ ID NO: 3498606 - RNA, 13 nt, Pseudomonas aeruginosa PA01
gcgcucgaucagg

SEQ ID NO: 3498607 - RNA, 19 nt, Pseudomonas aeruginosa PA01
gcgcucgcccuugcgccgc

SEQ ID NO: 3498608 - RNA, 12 nt, Pseudomonas aeruginosa PA01
gcgcucgccguc

SEQ ID NO: 3498609 - RNA, 16 nt, Pseudomonas aeruginosa PA01
gcgcucgccuaccggc

SEQ ID NO: 3498610 - RNA, 21 nt, Pseudomonas aeruginosa PA01
gcgcucgccuaccggcgccgc

SEQ ID NO: 3498611 - RNA, 13 nt, Pseudomonas aeruginosa PA01
gcgcucgcgcagc

SEQ ID NO: 3498612 - RNA, 19 nt, Pseudomonas aeruginosa PA01
gcgcucgcgcagccacugg

SEQ ID NO: 3498613 - RNA, 13 nt, Pseudomonas aeruginosa PA01
gcgcucgcgcugc

SEQ ID NO: 3498614 - RNA, 13 nt, Pseudomonas aeruginosa PA01
gcgcucgcgcuuc

SEQ ID NO: 3498615 - RNA, 14 nt, Pseudomonas aeruginosa PA01
gcgcucgcggaccu

SEQ ID NO: 3498616 - RNA, 18 nt, Pseudomonas aeruginosa PA01
gcgcucgcgggccgccug

SEQ ID NO: 3498617 - RNA, 16 nt, Pseudomonas aeruginosa PA01
gcgcucgcugcgugcg

SEQ ID NO: 3498618 - RNA, 14 nt, Pseudomonas aeruginosa PA01
gcgcucgcugucgc

SEQ ID NO: 3498619 - RNA, 20 nt, Pseudomonas aeruginosa PA01
gcgcucgcugucgcucagcg

SEQ ID NO: 3498620 - RNA, 19 nt, Pseudomonas aeruginosa PA01
gcgcucggaucaggcgggc

SEQ ID NO: 3498621 - RNA, 23 nt, Pseudomonas aeruginosa PA01
gcgcucggaucaggcgggcuccg

SEQ ID NO: 3498622 - RNA, 22 nt, Pseudomonas aeruginosa PA01
gcgcucggauuccagcgcggug

SEQ ID NO: 3498623 - RNA, 12 nt, Pseudomonas aeruginosa PA01
gcgcucggccag

SEQ ID NO: 3498624 - RNA, 16 nt, Pseudomonas aeruginosa PA01
gcgcucggccaggucg

SEQ ID NO: 3498625 - RNA, 17 nt, Pseudomonas aeruginosa PA01
gcgcucggccaggucgc

SEQ ID NO: 3498626 - RNA, 20 nt, Pseudomonas aeruginosa PA01
gcgcucggccaguucgucga

SEQ ID NO: 3498627 - RNA, 17 nt, Pseudomonas aeruginosa PA01
gcgcucggccgccuggc

SEQ ID NO: 3498628 - RNA, 13 nt, Pseudomonas aeruginosa PA01
gcgcucggccugc

SEQ ID NO: 3498629 - RNA, 14 nt, Pseudomonas aeruginosa PA01
gcgcucggccuggu

SEQ ID NO: 3498630 - RNA, 16 nt, Pseudomonas aeruginosa PA01
gcgcucggccuggugc

SEQ ID NO: 3498631 - RNA, 17 nt, Pseudomonas aeruginosa PA01
gcgcucggccuggugca

SEQ ID NO: 3498632 - RNA, 21 nt, Pseudomonas aeruginosa PA01
gcgcucggcgaccuugcgcac

SEQ ID NO: 3498633 - RNA, 14 nt, Pseudomonas aeruginosa PA01
gcgcucggcgacgc

SEQ ID NO: 3498634 - RNA, 18 nt, Pseudomonas aeruginosa PA01
gcgcucggcgaggccggc

SEQ ID NO: 3498635 - RNA, 13 nt, Pseudomonas aeruginosa PA01
gcgcucggcgcuc

SEQ ID NO: 3498636 - RNA, 19 nt, Pseudomonas aeruginosa PA01
gcgcucggcgcucggcucc

SEQ ID NO: 3498637 - RNA, 12 nt, Pseudomonas aeruginosa PA01
gcgcucggcggc

SEQ ID NO: 3498638 - RNA, 15 nt, Pseudomonas aeruginosa PA01
gcgcucggcggccuc

SEQ ID NO: 3498639 - RNA, 16 nt, Pseudomonas aeruginosa PA01
gcgcucggcggccucg

SEQ ID NO: 3498640 - RNA, 19 nt, Pseudomonas aeruginosa PA01
gcgcucggcggcgcgcagc

SEQ ID NO: 3498641 - RNA, 20 nt, Pseudomonas aeruginosa PA01
gcgcucggcggcgcgcagcg

SEQ ID NO: 3498642 - RNA, 17 nt, Pseudomonas aeruginosa PA01
gcgcucggcggucaggc

SEQ ID NO: 3498643 - RNA, 18 nt, Pseudomonas aeruginosa PA01
gcgcucggcggucaggcc

SEQ ID NO: 3498644 - RNA, 17 nt, Pseudomonas aeruginosa PA01
gcgcucggcuccagcca

SEQ ID NO: 3498645 - RNA, 21 nt, Pseudomonas aeruginosa PA01
gcgcucggcuccagccaggcc

SEQ ID NO: 3498646 - RNA, 22 nt, Pseudomonas aeruginosa PA01
gcgcucggcuccagccaggccc

SEQ ID NO: 3498647 - RNA, 20 nt, Pseudomonas aeruginosa PA01
gcgcucgggauggcccccac

SEQ ID NO: 3498648 - RNA, 14 nt, Pseudomonas aeruginosa PA01
gcgcucggucagcu

SEQ ID NO: 3498649 - RNA, 23 nt, Pseudomonas aeruginosa PA01
gcgcucgguccagaucgccaccc

SEQ ID NO: 3498650 - RNA, 17 nt, Pseudomonas aeruginosa PA01
gcgcucgguggcauggu

SEQ ID NO: 3498651 - RNA, 15 nt, Pseudomonas aeruginosa PA01
gcgcucguagaacuc

SEQ ID NO: 3498652 - RNA, 19 nt, Pseudomonas aeruginosa PA01
gcgcucguagaacucgccc

SEQ ID NO: 3498653 - RNA, 15 nt, Pseudomonas aeruginosa PA01
gcgcucguagccggc

SEQ ID NO: 3498654 - RNA, 20 nt, Pseudomonas aeruginosa PA01
gcgcucguagccggcgcggc

SEQ ID NO: 3498655 - RNA, 22 nt, Pseudomonas aeruginosa PA01
gcgcucguagccggcgcggcgc

SEQ ID NO: 3498656 - RNA, 23 nt, Pseudomonas aeruginosa PA01
gcgcucguagguuuccggguccu

SEQ ID NO: 3498657 - RNA, 21 nt, Pseudomonas aeruginosa PA01
gcgcucguugauccgcguggc

SEQ ID NO: 3498658 - RNA, 20 nt, Pseudomonas aeruginosa PA01
gcgcucucgaacaccaggcg

SEQ ID NO: 3498659 - RNA, 14 nt, Pseudomonas aeruginosa PA01
gcgcucucgccgcc

SEQ ID NO: 3498660 - RNA, 13 nt, Pseudomonas aeruginosa PA01
gcgcucucgccgg

SEQ ID NO: 3498661 - RNA, 15 nt, Pseudomonas aeruginosa PA01
gcgcucucgccggcc

SEQ ID NO: 3498662 - RNA, 16 nt, Pseudomonas aeruginosa PA01
gcgcucuggccgcgcu

SEQ ID NO: 3498663 - RNA, 13 nt, Pseudomonas aeruginosa PA01
gcgcucuucaccg

SEQ ID NO: 3498664 - RNA, 22 nt, Pseudomonas aeruginosa PA01
gcgcucuucacuuccagcugcc

SEQ ID NO: 3498665 - RNA, 17 nt, Pseudomonas aeruginosa PA01
gcgcugaacaagcccug

SEQ ID NO: 3498666 - RNA, 18 nt, Pseudomonas aeruginosa PA01
gcgcugaacaagcccugg

SEQ ID NO: 3498667 - RNA, 19 nt, Pseudomonas aeruginosa PA01
gcgcugaacaagcccuggu

SEQ ID NO: 3498668 - RNA, 22 nt, Pseudomonas aeruginosa PA01
gcgcugaacaagcccugguggu

SEQ ID NO: 3498669 - RNA, 13 nt, Pseudomonas aeruginosa PA01
gcgcugaacagcu

SEQ ID NO: 3498670 - RNA, 18 nt, Pseudomonas aeruginosa PA01
gcgcugaacagcuggcgc

SEQ ID NO: 3498671 - RNA, 21 nt, Pseudomonas aeruginosa PA01
gcgcugaacagcuggcgcguc

SEQ ID NO: 3498672 - RNA, 14 nt, Pseudomonas aeruginosa PA01
gcgcugaagcggcc

SEQ ID NO: 3498673 - RNA, 14 nt, Pseudomonas aeruginosa PA01
gcgcugaaggcggu

SEQ ID NO: 3498674 - RNA, 13 nt, Pseudomonas aeruginosa PA01
gcgcugaccaggu

SEQ ID NO: 3498675 - RNA, 16 nt, Pseudomonas aeruginosa PA01
gcgcugaccaggucgu

SEQ ID NO: 3498676 - RNA, 15 nt, Pseudomonas aeruginosa PA01
gcgcugaccgcuccc

SEQ ID NO: 3498677 - RNA, 17 nt, Pseudomonas aeruginosa PA01
gcgcugaccucgauggc

SEQ ID NO: 3498678 - RNA, 11 nt, Pseudomonas aeruginosa PA01
gcgcugaccug

SEQ ID NO: 3498679 - RNA, 15 nt, Pseudomonas aeruginosa PA01
gcgcugaccuggucg

SEQ ID NO: 3498680 - RNA, 17 nt, Pseudomonas aeruginosa PA01
gcgcugacgaaacggug

SEQ ID NO: 3498681 - RNA, 14 nt, Pseudomonas aeruginosa PA01
gcgcugagcgagac

SEQ ID NO: 3498682 - RNA, 14 nt, Pseudomonas aeruginosa PA01
gcgcugagcgccuc

SEQ ID NO: 3498683 - RNA, 16 nt, Pseudomonas aeruginosa PA01
gcgcugagcgccucga

SEQ ID NO: 3498684 - RNA, 13 nt, Pseudomonas aeruginosa PA01
gcgcugagcgcgg

SEQ ID NO: 3498685 - RNA, 14 nt, Pseudomonas aeruginosa PA01
gcgcugagcgcggu

SEQ ID NO: 3498686 - RNA, 20 nt, Pseudomonas aeruginosa PA01
gcgcugagcgcggucaccca

SEQ ID NO: 3498687 - RNA, 19 nt, Pseudomonas aeruginosa PA01
gcgcugaucacgaucggca

SEQ ID NO: 3498688 - RNA, 22 nt, Pseudomonas aeruginosa PA01
gcgcugcaagggcacuucgucc

SEQ ID NO: 3498689 - RNA, 18 nt, Pseudomonas aeruginosa PA01
gcgcugcaucggcgcgcc

SEQ ID NO: 3498690 - RNA, 19 nt, Pseudomonas aeruginosa PA01
gcgcugcaucggcgcgccg

SEQ ID NO: 3498691 - RNA, 22 nt, Pseudomonas aeruginosa PA01
gcgcugcaucggcgcgccgaag

SEQ ID NO: 3498692 - RNA, 21 nt, Pseudomonas aeruginosa PA01
gcgcugccaaacgccgucugg

SEQ ID NO: 3498693 - RNA, 21 nt, Pseudomonas aeruginosa PA01
gcgcugccacaguuucauggu

SEQ ID NO: 3498694 - RNA, 23 nt, Pseudomonas aeruginosa PA01
gcgcugccacaguuucauggugc

SEQ ID NO: 3498695 - RNA, 13 nt, Pseudomonas aeruginosa PA01
gcgcugccagcgc

SEQ ID NO: 3498696 - RNA, 16 nt, Pseudomonas aeruginosa PA01
gcgcugccagcgccgc

SEQ ID NO: 3498697 - RNA, 18 nt, Pseudomonas aeruginosa PA01
gcgcugccagcgccgccg

SEQ ID NO: 3498698 - RNA, 19 nt, Pseudomonas aeruginosa PA01
gcgcugccagcgccgccgc

SEQ ID NO: 3498699 - RNA, 21 nt, Pseudomonas aeruginosa PA01
gcgcugccagcgccgccgcgu

SEQ ID NO: 3498700 - RNA, 18 nt, Pseudomonas aeruginosa PA01
gcgcugccaguggcggcg

SEQ ID NO: 3498701 - RNA, 20 nt, Pseudomonas aeruginosa PA01
gcgcugccccuggcucaggc

SEQ ID NO: 3498702 - RNA, 15 nt, Pseudomonas aeruginosa PA01
gcgcugcccggcgcg

SEQ ID NO: 3498703 - RNA, 16 nt, Pseudomonas aeruginosa PA01
gcgcugcccggcgcga

SEQ ID NO: 3498704 - RNA, 21 nt, Pseudomonas aeruginosa PA01
gcgcugccgaacagcagggag

SEQ ID NO: 3498705 - RNA, 16 nt, Pseudomonas aeruginosa PA01
gcgcugccgaucagcc

SEQ ID NO: 3498706 - RNA, 12 nt, Pseudomonas aeruginosa PA01
gcgcugccggcc

SEQ ID NO: 3498707 - RNA, 21 nt, Pseudomonas aeruginosa PA01
gcgcugccggccagggucgcc

SEQ ID NO: 3498708 - RNA, 23 nt, Pseudomonas aeruginosa PA01
gcgcugccggccagggucgccag

SEQ ID NO: 3498709 - RNA, 18 nt, Pseudomonas aeruginosa PA01
gcgcugccugcaccgggc

SEQ ID NO: 3498710 - RNA, 19 nt, Pseudomonas aeruginosa PA01
gcgcugccugcaccgggcc

SEQ ID NO: 3498711 - RNA, 19 nt, Pseudomonas aeruginosa PA01
gcgcugccuucgaagccgg

SEQ ID NO: 3498712 - RNA, 20 nt, Pseudomonas aeruginosa PA01
gcgcugccuucgaagccggc

SEQ ID NO: 3498713 - RNA, 21 nt, Pseudomonas aeruginosa PA01
gcgcugccuucgaagccggca

SEQ ID NO: 3498714 - RNA, 14 nt, Pseudomonas aeruginosa PA01
gcgcugcgccaggc

SEQ ID NO: 3498715 - RNA, 15 nt, Pseudomonas aeruginosa PA01
gcgcugcgccaggcc

SEQ ID NO: 3498716 - RNA, 18 nt, Pseudomonas aeruginosa PA01
gcgcugcgcccgcucgac

SEQ ID NO: 3498717 - RNA, 16 nt, Pseudomonas aeruginosa PA01
gcgcugcgcggccugc

SEQ ID NO: 3498718 - RNA, 13 nt, Pseudomonas aeruginosa PA01
gcgcugcgcggcg

SEQ ID NO: 3498719 - RNA, 16 nt, Pseudomonas aeruginosa PA01
gcgcugcgcggcgucg

SEQ ID NO: 3498720 - RNA, 22 nt, Pseudomonas aeruginosa PA01
gcgcugcgcggcgucggcgaag

SEQ ID NO: 3498721 - RNA, 17 nt, Pseudomonas aeruginosa PA01
gcgcugcggcagggugg

SEQ ID NO: 3498722 - RNA, 17 nt, Pseudomonas aeruginosa PA01
gcgcugcgggucauugg

SEQ ID NO: 3498723 - RNA, 18 nt, Pseudomonas aeruginosa PA01
gcgcugcgguaccagcgc

SEQ ID NO: 3498724 - RNA, 20 nt, Pseudomonas aeruginosa PA01
gcgcugcgguaccagcgcac

SEQ ID NO: 3498725 - RNA, 22 nt, Pseudomonas aeruginosa PA01
gcgcugcgguaccagcgcacca

SEQ ID NO: 3498726 - RNA, 23 nt, Pseudomonas aeruginosa PA01
gcgcugcguaguugagccccagg

SEQ ID NO: 3498727 - RNA, 16 nt, Pseudomonas aeruginosa PA01
gcgcugcgugcgccgc

SEQ ID NO: 3498728 - RNA, 21 nt, Pseudomonas aeruginosa PA01
gcgcugcgugcgccgcucgcg

SEQ ID NO: 3498729 - RNA, 17 nt, Pseudomonas aeruginosa PA01
gcgcugcguggguagcc

SEQ ID NO: 3498730 - RNA, 20 nt, Pseudomonas aeruginosa PA01
gcgcugcugccauccgcgcc

SEQ ID NO: 3498731 - RNA, 15 nt, Pseudomonas aeruginosa PA01
gcgcugcugggcggc

SEQ ID NO: 3498732 - RNA, 17 nt, Pseudomonas aeruginosa PA01
gcgcugcugggcggcga

SEQ ID NO: 3498733 - RNA, 22 nt, Pseudomonas aeruginosa PA01
gcgcugcugguagugcuggcgc

SEQ ID NO: 3498734 - RNA, 20 nt, Pseudomonas aeruginosa PA01
gcgcuggaacggccaggucu

SEQ ID NO: 3498735 - RNA, 13 nt, Pseudomonas aeruginosa PA01
gcgcuggaccaug

SEQ ID NO: 3498736 - RNA, 14 nt, Pseudomonas aeruginosa PA01
gcgcuggaccaugg

SEQ ID NO: 3498737 - RNA, 16 nt, Pseudomonas aeruginosa PA01
gcgcuggaccauggcc

SEQ ID NO: 3498738 - RNA, 17 nt, Pseudomonas aeruginosa PA01
gcgcuggaccauggccg

SEQ ID NO: 3498739 - RNA, 19 nt, Pseudomonas aeruginosa PA01
gcgcuggaccauggccggc

SEQ ID NO: 3498740 - RNA, 17 nt, Pseudomonas aeruginosa PA01
gcgcuggacccgcaccu

SEQ ID NO: 3498741 - RNA, 19 nt, Pseudomonas aeruginosa PA01
gcgcuggacccgcaccugg

SEQ ID NO: 3498742 - RNA, 15 nt, Pseudomonas aeruginosa PA01
gcgcuggaccuggcc

SEQ ID NO: 3498743 - RNA, 17 nt, Pseudomonas aeruginosa PA01
gcgcuggaccuggccgg

SEQ ID NO: 3498744 - RNA, 19 nt, Pseudomonas aeruginosa PA01
gcgcuggaccuggccggcg

SEQ ID NO: 3498745 - RNA, 20 nt, Pseudomonas aeruginosa PA01
gcgcuggaccuggccggcga

SEQ ID NO: 3498746 - RNA, 22 nt, Pseudomonas aeruginosa PA01
gcgcuggaccuggccggcgacc

SEQ ID NO: 3498747 - RNA, 17 nt, Pseudomonas aeruginosa PA01
gcgcuggaguaucgccc

SEQ ID NO: 3498748 - RNA, 20 nt, Pseudomonas aeruginosa PA01
gcgcuggaguaucgcccugg

SEQ ID NO: 3498749 - RNA, 20 nt, Pseudomonas aeruginosa PA01
gcgcuggaugaaacgggcga

SEQ ID NO: 3498750 - RNA, 23 nt, Pseudomonas aeruginosa PA01
gcgcuggaugaaacgggcgaucu

SEQ ID NO: 3498751 - RNA, 14 nt, Pseudomonas aeruginosa PA01
gcgcuggaugcccu

SEQ ID NO: 3498752 - RNA, 15 nt, Pseudomonas aeruginosa PA01
gcgcuggaugcccuc

SEQ ID NO: 3498753 - RNA, 15 nt, Pseudomonas aeruginosa PA01
gcgcuggcagguugc

SEQ ID NO: 3498754 - RNA, 22 nt, Pseudomonas aeruginosa PA01
gcgcuggcagguugcacggccg

SEQ ID NO: 3498755 - RNA, 23 nt, Pseudomonas aeruginosa PA01
gcgcuggcagguugcacggccgg

SEQ ID NO: 3498756 - RNA, 13 nt, Pseudomonas aeruginosa PA01
gcgcuggccagcg

SEQ ID NO: 3498757 - RNA, 14 nt, Pseudomonas aeruginosa PA01
gcgcuggccagcgc

SEQ ID NO: 3498758 - RNA, 18 nt, Pseudomonas aeruginosa PA01
gcgcuggccagcgcuucc

SEQ ID NO: 3498759 - RNA, 19 nt, Pseudomonas aeruginosa PA01
gcgcuggccaguuccaugu

SEQ ID NO: 3498760 - RNA, 14 nt, Pseudomonas aeruginosa PA01
gcgcuggccgagcu

SEQ ID NO: 3498761 - RNA, 18 nt, Pseudomonas aeruginosa PA01
gcgcuggccgagcugccg

SEQ ID NO: 3498762 - RNA, 17 nt, Pseudomonas aeruginosa PA01
gcgcuggccgcgcgacc

SEQ ID NO: 3498763 - RNA, 13 nt, Pseudomonas aeruginosa PA01
gcgcuggccggca

SEQ ID NO: 3498764 - RNA, 18 nt, Pseudomonas aeruginosa PA01
gcgcuggcgaucaccagg

SEQ ID NO: 3498765 - RNA, 21 nt, Pseudomonas aeruginosa PA01
gcgcuggcgaucaccagggug

SEQ ID NO: 3498766 - RNA, 16 nt, Pseudomonas aeruginosa PA01
gcgcuggcgcagcagc

SEQ ID NO: 3498767 - RNA, 20 nt, Pseudomonas aeruginosa PA01
gcgcuggcgcagcagcaggu

SEQ ID NO: 3498768 - RNA, 14 nt, Pseudomonas aeruginosa PA01
gcgcuggcgccagu

SEQ ID NO: 3498769 - RNA, 13 nt, Pseudomonas aeruginosa PA01
gcgcuggcgccga

SEQ ID NO: 3498770 - RNA, 14 nt, Pseudomonas aeruginosa PA01
gcgcuggcgccgau

SEQ ID NO: 3498771 - RNA, 16 nt, Pseudomonas aeruginosa PA01
gcgcuggcgccgaugc

SEQ ID NO: 3498772 - RNA, 18 nt, Pseudomonas aeruginosa PA01
gcgcuggcgcuguaggcg

SEQ ID NO: 3498773 - RNA, 22 nt, Pseudomonas aeruginosa PA01
gcgcugggcgagguguucccgg

SEQ ID NO: 3498774 - RNA, 15 nt, Pseudomonas aeruginosa PA01
gcgcugggcgcagcc

SEQ ID NO: 3498775 - RNA, 17 nt, Pseudomonas aeruginosa PA01
gcgcugggcgcagcccu

SEQ ID NO: 3498776 - RNA, 15 nt, Pseudomonas aeruginosa PA01
gcgcugggcggcugg

SEQ ID NO: 3498777 - RNA, 19 nt, Pseudomonas aeruginosa PA01
gcgcugggcggcuggccga

SEQ ID NO: 3498778 - RNA, 21 nt, Pseudomonas aeruginosa PA01
gcgcugggucaugcucggggu

SEQ ID NO: 3498779 - RNA, 18 nt, Pseudomonas aeruginosa PA01
gcgcugguaccugccggc

SEQ ID NO: 3498780 - RNA, 19 nt, Pseudomonas aeruginosa PA01
gcgcugguaccugccggca

SEQ ID NO: 3498781 - RNA, 20 nt, Pseudomonas aeruginosa PA01
gcgcugguaccugccggcac

SEQ ID NO: 3498782 - RNA, 18 nt, Pseudomonas aeruginosa PA01
gcgcugguagcgcuccag

SEQ ID NO: 3498783 - RNA, 20 nt, Pseudomonas aeruginosa PA01
gcgcugguagcgcuccagcu

SEQ ID NO: 3498784 - RNA, 22 nt, Pseudomonas aeruginosa PA01
gcgcugguagcgcuccagcucc

SEQ ID NO: 3498785 - RNA, 23 nt, Pseudomonas aeruginosa PA01
gcgcugguagcgcuccagcuccu

SEQ ID NO: 3498786 - RNA, 21 nt, Pseudomonas aeruginosa PA01
gcgcugguccagcacgcuggc

SEQ ID NO: 3498787 - RNA, 20 nt, Pseudomonas aeruginosa PA01
gcgcuggucguucagugcca

SEQ ID NO: 3498788 - RNA, 21 nt, Pseudomonas aeruginosa PA01
gcgcuggucguucucgcgcau

SEQ ID NO: 3498789 - RNA, 14 nt, Pseudomonas aeruginosa PA01
gcgcuggucucuuc

SEQ ID NO: 3498790 - RNA, 24 nt, Pseudomonas aeruginosa PA01
gcgcuggucucuuccagcaugcuc

SEQ ID NO: 3498791 - RNA, 13 nt, Pseudomonas aeruginosa PA01
gcgcuggugaucg

SEQ ID NO: 3498792 - RNA, 15 nt, Pseudomonas aeruginosa PA01
gcgcugguugacgaa

SEQ ID NO: 3498793 - RNA, 17 nt, Pseudomonas aeruginosa PA01
gcgcugguugcccaggg

SEQ ID NO: 3498794 - RNA, 14 nt, Pseudomonas aeruginosa PA01
gcgcugguuggcga

SEQ ID NO: 3498795 - RNA, 20 nt, Pseudomonas aeruginosa PA01
gcgcugguuuagcucggcga

SEQ ID NO: 3498796 - RNA, 23 nt, Pseudomonas aeruginosa PA01
gcgcugguuuagcucggcgaugg

SEQ ID NO: 3498797 - RNA, 16 nt, Pseudomonas aeruginosa PA01
gcgcuguagccggcgc

SEQ ID NO: 3498798 - RNA, 17 nt, Pseudomonas aeruginosa PA01
gcgcuguagccggcgcc

SEQ ID NO: 3498799 - RNA, 20 nt, Pseudomonas aeruginosa PA01
gcgcuguaggcgagcagcgg

SEQ ID NO: 3498800 - RNA, 17 nt, Pseudomonas aeruginosa PA01
gcgcugucgcccgggcg

SEQ ID NO: 3498801 - RNA, 14 nt, Pseudomonas aeruginosa PA01
gcgcugucgccggu

SEQ ID NO: 3498802 - RNA, 15 nt, Pseudomonas aeruginosa PA01
gcgcugucgccgguc

SEQ ID NO: 3498803 - RNA, 16 nt, Pseudomonas aeruginosa PA01
gcgcugucgccgguca

SEQ ID NO: 3498804 - RNA, 14 nt, Pseudomonas aeruginosa PA01
gcgcugucggccuc

SEQ ID NO: 3498805 - RNA, 14 nt, Pseudomonas aeruginosa PA01
gcgcugugcacggu

SEQ ID NO: 3498806 - RNA, 17 nt, Pseudomonas aeruginosa PA01
gcgcugugcacggucug

SEQ ID NO: 3498807 - RNA, 17 nt, Pseudomonas aeruginosa PA01
gcgcuguuccgccgugg

SEQ ID NO: 3498808 - RNA, 15 nt, Pseudomonas aeruginosa PA01
gcgcuguuggccugg

SEQ ID NO: 3498809 - RNA, 17 nt, Pseudomonas aeruginosa PA01
gcgcuguuggccugggc

SEQ ID NO: 3498810 - RNA, 11 nt, Pseudomonas aeruginosa PA01
gcgcuucacca

SEQ ID NO: 3498811 - RNA, 21 nt, Pseudomonas aeruginosa PA01
gcgcuucagauaacgucgcag

SEQ ID NO: 3498812 - RNA, 21 nt, Pseudomonas aeruginosa PA01
gcgcuucagcucgaggccagg

SEQ ID NO: 3498813 - RNA, 17 nt, Pseudomonas aeruginosa PA01
gcgcuucaggcaguccu

SEQ ID NO: 3498814 - RNA, 21 nt, Pseudomonas aeruginosa PA01
gcgcuucauccugcgcgccuc

SEQ ID NO: 3498815 - RNA, 16 nt, Pseudomonas aeruginosa PA01
gcgcuuccaccgccug

SEQ ID NO: 3498816 - RNA, 17 nt, Pseudomonas aeruginosa PA01
gcgcuuccaccgccugc

SEQ ID NO: 3498817 - RNA, 14 nt, Pseudomonas aeruginosa PA01
gcgcuuccaggcac

SEQ ID NO: 3498818 - RNA, 12 nt, Pseudomonas aeruginosa PA01
gcgcuuccaggg

SEQ ID NO: 3498819 - RNA, 22 nt, Pseudomonas aeruginosa PA01
gcgcuuccaggguagcgccgcg

SEQ ID NO: 3498820 - RNA, 14 nt, Pseudomonas aeruginosa PA01
gcgcuucccgcggc

SEQ ID NO: 3498821 - RNA, 21 nt, Pseudomonas aeruginosa PA01
gcgcuucccgcggcuccagcc

SEQ ID NO: 3498822 - RNA, 16 nt, Pseudomonas aeruginosa PA01
gcgcuuccgcaucggc

SEQ ID NO: 3498823 - RNA, 17 nt, Pseudomonas aeruginosa PA01
gcgcuuccgcaucggcc

SEQ ID NO: 3498824 - RNA, 13 nt, Pseudomonas aeruginosa PA01
gcgcuuccggcag

SEQ ID NO: 3498825 - RNA, 19 nt, Pseudomonas aeruginosa PA01
gcgcuuccggcagccagcc

SEQ ID NO: 3498826 - RNA, 20 nt, Pseudomonas aeruginosa PA01
gcgcuuccggcagccagccg

SEQ ID NO: 3498827 - RNA, 23 nt, Pseudomonas aeruginosa PA01
gcgcuuccggcagccagccgccg

SEQ ID NO: 3498828 - RNA, 15 nt, Pseudomonas aeruginosa PA01
gcgcuuccuccagua

SEQ ID NO: 3498829 - RNA, 13 nt, Pseudomonas aeruginosa PA01
gcgcuucgcgcag

SEQ ID NO: 3498830 - RNA, 16 nt, Pseudomonas aeruginosa PA01
gcgcuucgcgcagcuc

SEQ ID NO: 3498831 - RNA, 19 nt, Pseudomonas aeruginosa PA01
gcgcuucgcgcagcucggc

SEQ ID NO: 3498832 - RNA, 22 nt, Pseudomonas aeruginosa PA01
gcgcuucgcgcagcucggccaa

SEQ ID NO: 3498833 - RNA, 13 nt, Pseudomonas aeruginosa PA01
gcgcuucggcgga

SEQ ID NO: 3498834 - RNA, 14 nt, Pseudomonas aeruginosa PA01
gcgcuucggcggcu

SEQ ID NO: 3498835 - RNA, 23 nt, Pseudomonas aeruginosa PA01
gcgcuucggcggcuucgcgcucc

SEQ ID NO: 3498836 - RNA, 18 nt, Pseudomonas aeruginosa PA01
gcgcuucugcucggccug

SEQ ID NO: 3498837 - RNA, 19 nt, Pseudomonas aeruginosa PA01
gcgcuucugcucggccugg

SEQ ID NO: 3498838 - RNA, 18 nt, Pseudomonas aeruginosa PA01
gcgcuucuugucgucgga

SEQ ID NO: 3498839 - RNA, 23 nt, Pseudomonas aeruginosa PA01
gcgcuucuugucgucggacuuga

SEQ ID NO: 3498840 - RNA, 19 nt, Pseudomonas aeruginosa PA01
gcgcuugaacgcgcgccug

SEQ ID NO: 3498841 - RNA, 15 nt, Pseudomonas aeruginosa PA01
gcgcuugaagccggc

SEQ ID NO: 3498842 - RNA, 17 nt, Pseudomonas aeruginosa PA01
gcgcuugaagccggcgu

SEQ ID NO: 3498843 - RNA, 13 nt, Pseudomonas aeruginosa PA01
gcgcuugagcagc

SEQ ID NO: 3498844 - RNA, 18 nt, Pseudomonas aeruginosa PA01
gcgcuugagcagccaggc

SEQ ID NO: 3498845 - RNA, 20 nt, Pseudomonas aeruginosa PA01
gcgcuugagcagccaggcga

SEQ ID NO: 3498846 - RNA, 19 nt, Pseudomonas aeruginosa PA01
gcgcuugaguugccagacg

SEQ ID NO: 3498847 - RNA, 14 nt, Pseudomonas aeruginosa PA01
gcgcuugcauggca

SEQ ID NO: 3498848 - RNA, 13 nt, Pseudomonas aeruginosa PA01
gcgcuugcccagg

SEQ ID NO: 3498849 - RNA, 14 nt, Pseudomonas aeruginosa PA01
gcgcuugccgcgcc

SEQ ID NO: 3498850 - RNA, 15 nt, Pseudomonas aeruginosa PA01
gcgcuugccgcgccc

SEQ ID NO: 3498851 - RNA, 17 nt, Pseudomonas aeruginosa PA01
gcgcuugccgcgcccgg

SEQ ID NO: 3498852 - RNA, 19 nt, Pseudomonas aeruginosa PA01
gcgcuugccgcgcccggcc

SEQ ID NO: 3498853 - RNA, 21 nt, Pseudomonas aeruginosa PA01
gcgcuugccgcgcccggccag

SEQ ID NO: 3498854 - RNA, 17 nt, Pseudomonas aeruginosa PA01
gcgcuugccggccgcca

SEQ ID NO: 3498855 - RNA, 18 nt, Pseudomonas aeruginosa PA01
gcgcuugccggccgccag

SEQ ID NO: 3498856 - RNA, 20 nt, Pseudomonas aeruginosa PA01
gcgcuugccggccgccagca

SEQ ID NO: 3498857 - RNA, 21 nt, Pseudomonas aeruginosa PA01
gcgcuugccggccgccagcag

SEQ ID NO: 3498858 - RNA, 22 nt, Pseudomonas aeruginosa PA01
gcgcuugccgucgcggaagccg

SEQ ID NO: 3498859 - RNA, 20 nt, Pseudomonas aeruginosa PA01
gcgcuugccuuccugggcgu

SEQ ID NO: 3498860 - RNA, 18 nt, Pseudomonas aeruginosa PA01
gcgcuugcgaucgaagaa

SEQ ID NO: 3498861 - RNA, 20 nt, Pseudomonas aeruginosa PA01
gcgcuugcgcagcaucuucu

SEQ ID NO: 3498862 - RNA, 16 nt, Pseudomonas aeruginosa PA01
gcgcuugcgguagucc

SEQ ID NO: 3498863 - RNA, 19 nt, Pseudomonas aeruginosa PA01
gcgcuugcugccauggcgg

SEQ ID NO: 3498864 - RNA, 20 nt, Pseudomonas aeruginosa PA01
gcgcuugcugccauggcggc

SEQ ID NO: 3498865 - RNA, 16 nt, Pseudomonas aeruginosa PA01
gcgcuugcuggcgcga

SEQ ID NO: 3498866 - RNA, 18 nt, Pseudomonas aeruginosa PA01
gcgcuugcuggcgcgauc

SEQ ID NO: 3498867 - RNA, 14 nt, Pseudomonas aeruginosa PA01
gcgcuuggacagcu

SEQ ID NO: 3498868 - RNA, 13 nt, Pseudomonas aeruginosa PA01
gcgcuuguagcag

SEQ ID NO: 3498869 - RNA, 21 nt, Pseudomonas aeruginosa PA01
gcgcuuguagcagccgcagga

SEQ ID NO: 3498870 - RNA, 16 nt, Pseudomonas aeruginosa PA01
gcgcuuguagcccagg

SEQ ID NO: 3498871 - RNA, 16 nt, Pseudomonas aeruginosa PA01
gcgcuuguccgagacc

SEQ ID NO: 3498872 - RNA, 22 nt, Pseudomonas aeruginosa PA01
gcgcuuguccgagaccggcagc

SEQ ID NO: 3498873 - RNA, 23 nt, Pseudomonas aeruginosa PA01
gcgcuuguccuccagcugcgccu

SEQ ID NO: 3498874 - RNA, 18 nt, Pseudomonas aeruginosa PA01
gcgcuuucaucaggcgcu

SEQ ID NO: 3498875 - RNA, 13 nt, Pseudomonas aeruginosa PA01
gcgcuuucccgcu

SEQ ID NO: 3498876 - RNA, 15 nt, Pseudomonas aeruginosa PA01
gcgcuuucgcucugg

SEQ ID NO: 3498877 - RNA, 19 nt, Pseudomonas aeruginosa PA01
gcgcuuucgcucuggucga

SEQ ID NO: 3498878 - RNA, 17 nt, Pseudomonas aeruginosa PA01
gcgcuuuuccggcgccg

SEQ ID NO: 3498879 - RNA, 17 nt, Pseudomonas aeruginosa PA01
gcgcuuuuuucuugccg

SEQ ID NO: 3498880 - RNA, 14 nt, Pseudomonas aeruginosa PA01
gcggaaaacgccgc

SEQ ID NO: 3498881 - RNA, 19 nt, Pseudomonas aeruginosa PA01
gcggaaaacgccgcgaagc

SEQ ID NO: 3498882 - RNA, 23 nt, Pseudomonas aeruginosa PA01
gcggaaacccgugguccgccagc

SEQ ID NO: 3498883 - RNA, 22 nt, Pseudomonas aeruginosa PA01
gcggaaacccuuccagccgccc

SEQ ID NO: 3498884 - RNA, 21 nt, Pseudomonas aeruginosa PA01
gcggaaaccgcauugacccgg

SEQ ID NO: 3498885 - RNA, 17 nt, Pseudomonas aeruginosa PA01
gcggaaaccgcggccgg

SEQ ID NO: 3498886 - RNA, 22 nt, Pseudomonas aeruginosa PA01
gcggaaaccugcaacucggcgc

SEQ ID NO: 3498887 - RNA, 23 nt, Pseudomonas aeruginosa PA01
gcggaaaccugugcugcgcgccg

SEQ ID NO: 3498888 - RNA, 16 nt, Pseudomonas aeruginosa PA01
gcggaaagcgacgccg

SEQ ID NO: 3498889 - RNA, 18 nt, Pseudomonas aeruginosa PA01
gcggaaaugaaaaaggcc

SEQ ID NO: 3498890 - RNA, 15 nt, Pseudomonas aeruginosa PA01
gcggaacaccgccug

SEQ ID NO: 3498891 - RNA, 17 nt, Pseudomonas aeruginosa PA01
gcggaacaccgccugga

SEQ ID NO: 3498892 - RNA, 16 nt, Pseudomonas aeruginosa PA01
gcggaacaucgcccgg

SEQ ID NO: 3498893 - RNA, 22 nt, Pseudomonas aeruginosa PA01
gcggaaccagugcgcgguccgc

SEQ ID NO: 3498894 - RNA, 21 nt, Pseudomonas aeruginosa PA01
gcggaaccucuccccucgccc

SEQ ID NO: 3498895 - RNA, 22 nt, Pseudomonas aeruginosa PA01
gcggaacgaaggacaggucgcg

SEQ ID NO: 3498896 - RNA, 16 nt, Pseudomonas aeruginosa PA01
gcggaacggcucgcgg

SEQ ID NO: 3498897 - RNA, 19 nt, Pseudomonas aeruginosa PA01
gcggaacgggacgccuggc

SEQ ID NO: 3498898 - RNA, 23 nt, Pseudomonas aeruginosa PA01
gcggaacgggacgccuggcgucc

SEQ ID NO: 3498899 - RNA, 14 nt, Pseudomonas aeruginosa PA01
gcggaacucgauga

SEQ ID NO: 3498900 - RNA, 18 nt, Pseudomonas aeruginosa PA01
gcggaacuugcgccgacc

SEQ ID NO: 3498901 - RNA, 19 nt, Pseudomonas aeruginosa PA01
gcggaacuugcgccgaccg

SEQ ID NO: 3498902 - RNA, 18 nt, Pseudomonas aeruginosa PA01
gcggaacuugucgccgcu

SEQ ID NO: 3498903 - RNA, 21 nt, Pseudomonas aeruginosa PA01
gcggaacuugucgccgcugga

SEQ ID NO: 3498904 - RNA, 15 nt, Pseudomonas aeruginosa PA01
gcggaagaagcccuu

SEQ ID NO: 3498905 - RNA, 19 nt, Pseudomonas aeruginosa PA01
gcggaagaauaccgccagc

SEQ ID NO: 3498906 - RNA, 19 nt, Pseudomonas aeruginosa PA01
gcggaagaaucgcagccau

SEQ ID NO: 3498907 - RNA, 23 nt, Pseudomonas aeruginosa PA01
gcggaagacgaaguugagcaccg

SEQ ID NO: 3498908 - RNA, 15 nt, Pseudomonas aeruginosa PA01
gcggaagcacggcuc

SEQ ID NO: 3498909 - RNA, 20 nt, Pseudomonas aeruginosa PA01
gcggaagcacggcucggcga

SEQ ID NO: 3498910 - RNA, 19 nt, Pseudomonas aeruginosa PA01
gcggaagcccagcaggucg

SEQ ID NO: 3498911 - RNA, 20 nt, Pseudomonas aeruginosa PA01
gcggaagcccagcaggucga

SEQ ID NO: 3498912 - RNA, 21 nt, Pseudomonas aeruginosa PA01
gcggaagccgggaagccgcuc

SEQ ID NO: 3498913 - RNA, 19 nt, Pseudomonas aeruginosa PA01
gcggaagccgucggcgauc

SEQ ID NO: 3498914 - RNA, 24 nt, Pseudomonas aeruginosa PA01
gcggaagcgcagccauucgccgcg

SEQ ID NO: 3498915 - RNA, 17 nt, Pseudomonas aeruginosa PA01
gcggaagcgccugcggu

SEQ ID NO: 3498916 - RNA, 14 nt, Pseudomonas aeruginosa PA01
gcggaagcggcaau

SEQ ID NO: 3498917 - RNA, 23 nt, Pseudomonas aeruginosa PA01
gcggaaggcccgcgagccgcgca

SEQ ID NO: 3498918 - RNA, 13 nt, Pseudomonas aeruginosa PA01
gcggaaggcggcg

SEQ ID NO: 3498919 - RNA, 14 nt, Pseudomonas aeruginosa PA01
gcggaaggcggcga

SEQ ID NO: 3498920 - RNA, 14 nt, Pseudomonas aeruginosa PA01
gcggaaggcuuccu

SEQ ID NO: 3498921 - RNA, 16 nt, Pseudomonas aeruginosa PA01
gcggaaggcuuccugg

SEQ ID NO: 3498922 - RNA, 20 nt, Pseudomonas aeruginosa PA01
gcggaaggcuuccuggugga

SEQ ID NO: 3498923 - RNA, 13 nt, Pseudomonas aeruginosa PA01
gcggaaggucagg

SEQ ID NO: 3498924 - RNA, 14 nt, Pseudomonas aeruginosa PA01
gcggaaggucaggu

SEQ ID NO: 3498925 - RNA, 22 nt, Pseudomonas aeruginosa PA01
gcggaaggucagguagguggag

SEQ ID NO: 3498926 - RNA, 16 nt, Pseudomonas aeruginosa PA01
gcggaaggugccuucg

SEQ ID NO: 3498927 - RNA, 18 nt, Pseudomonas aeruginosa PA01
gcggaaguaggcggcgga

SEQ ID NO: 3498928 - RNA, 15 nt, Pseudomonas aeruginosa PA01
gcggaagucggcggg

SEQ ID NO: 3498929 - RNA, 14 nt, Pseudomonas aeruginosa PA01
gcggaagugcgccg

SEQ ID NO: 3498930 - RNA, 19 nt, Pseudomonas aeruginosa PA01
gcggaagugcgccgguugc

SEQ ID NO: 3498931 - RNA, 23 nt, Pseudomonas aeruginosa PA01
gcggaauacguacucgucgcucu

SEQ ID NO: 3498932 - RNA, 16 nt, Pseudomonas aeruginosa PA01
gcggaaucgcgcccuu

SEQ ID NO: 3498933 - RNA, 14 nt, Pseudomonas aeruginosa PA01
gcggaauggcgcgc

SEQ ID NO: 3498934 - RNA, 14 nt, Pseudomonas aeruginosa PA01
gcggaauuccugcu

SEQ ID NO: 3498935 - RNA, 20 nt, Pseudomonas aeruginosa PA01
gcggaauuccugcucgagau

SEQ ID NO: 3498936 - RNA, 17 nt, Pseudomonas aeruginosa PA01
gcggacaacccggcgcu

SEQ ID NO: 3498937 - RNA, 15 nt, Pseudomonas aeruginosa PA01
gcggacaagcccagc

SEQ ID NO: 3498938 - RNA, 15 nt, Pseudomonas aeruginosa PA01
gcggacaccgcggug

SEQ ID NO: 3498939 - RNA, 17 nt, Pseudomonas aeruginosa PA01
gcggacacgcaggcgcc

SEQ ID NO: 3498940 - RNA, 15 nt, Pseudomonas aeruginosa PA01
gcggacagcccgcgc

SEQ ID NO: 3498941 - RNA, 17 nt, Pseudomonas aeruginosa PA01
gcggacagcccgcgcuc

SEQ ID NO: 3498942 - RNA, 18 nt, Pseudomonas aeruginosa PA01
gcggacagcccgcgcucg

SEQ ID NO: 3498943 - RNA, 13 nt, Pseudomonas aeruginosa PA01
gcggacauggcgc

SEQ ID NO: 3498944 - RNA, 19 nt, Pseudomonas aeruginosa PA01
gcggacauguugcaggguc

SEQ ID NO: 3498945 - RNA, 20 nt, Pseudomonas aeruginosa PA01
gcggacauguugcagggucg

SEQ ID NO: 3498946 - RNA, 22 nt, Pseudomonas aeruginosa PA01
gcggacauguugcagggucgcc

SEQ ID NO: 3498947 - RNA, 16 nt, Pseudomonas aeruginosa PA01
gcggaccacagggcaa

SEQ ID NO: 3498948 - RNA, 21 nt, Pseudomonas aeruginosa PA01
gcggacccaguugggccagga

SEQ ID NO: 3498949 - RNA, 20 nt, Pseudomonas aeruginosa PA01
gcggaccccggccuccaggc

SEQ ID NO: 3498950 - RNA, 21 nt, Pseudomonas aeruginosa PA01
gcggaccccggccuccaggcu

SEQ ID NO: 3498951 - RNA, 17 nt, Pseudomonas aeruginosa PA01
gcggacccgcgccggca

SEQ ID NO: 3498952 - RNA, 20 nt, Pseudomonas aeruginosa PA01
gcggaccgaaggcaacagcc

SEQ ID NO: 3498953 - RNA, 16 nt, Pseudomonas aeruginosa PA01
gcggaccgccucgacc

SEQ ID NO: 3498954 - RNA, 14 nt, Pseudomonas aeruginosa PA01
gcggaccuccagcc

SEQ ID NO: 3498955 - RNA, 19 nt, Pseudomonas aeruginosa PA01
gcggaccuccagccggcca

SEQ ID NO: 3498956 - RNA, 15 nt, Pseudomonas aeruginosa PA01
gcggaccuccgccag

SEQ ID NO: 3498957 - RNA, 22 nt, Pseudomonas aeruginosa PA01
gcggaccucugcguucugcugc

SEQ ID NO: 3498958 - RNA, 18 nt, Pseudomonas aeruginosa PA01
gcggaccuucgacggcag

SEQ ID NO: 3498959 - RNA, 19 nt, Pseudomonas aeruginosa PA01
gcggaccuucgacggcagg

SEQ ID NO: 3498960 - RNA, 20 nt, Pseudomonas aeruginosa PA01
gcggaccuucgacggcaggu

SEQ ID NO: 3498961 - RNA, 19 nt, Pseudomonas aeruginosa PA01
gcggaccuugucgccggug

SEQ ID NO: 3498962 - RNA, 18 nt, Pseudomonas aeruginosa PA01
gcggacgaggauggucag

SEQ ID NO: 3498963 - RNA, 22 nt, Pseudomonas aeruginosa PA01
gcggacgaggauggucaggccg

SEQ ID NO: 3498964 - RNA, 19 nt, Pseudomonas aeruginosa PA01
gcggacgaucacucccugc

SEQ ID NO: 3498965 - RNA, 13 nt, Pseudomonas aeruginosa PA01
gcggacgaugguc

SEQ ID NO: 3498966 - RNA, 20 nt, Pseudomonas aeruginosa PA01
gcggacgauggucgccgcga

SEQ ID NO: 3498967 - RNA, 12 nt, Pseudomonas aeruginosa PA01
gcggacgcaggc

SEQ ID NO: 3498968 - RNA, 14 nt, Pseudomonas aeruginosa PA01
gcggacgcaggccg

SEQ ID NO: 3498969 - RNA, 15 nt, Pseudomonas aeruginosa PA01
gcggacgcaggccga

SEQ ID NO: 3498970 - RNA, 21 nt, Pseudomonas aeruginosa PA01
gcggacgcaggccgaccucgg

SEQ ID NO: 3498971 - RNA, 15 nt, Pseudomonas aeruginosa PA01
gcggacgccgaagcg

SEQ ID NO: 3498972 - RNA, 15 nt, Pseudomonas aeruginosa PA01
gcggacgcuggcgau

SEQ ID NO: 3498973 - RNA, 15 nt, Pseudomonas aeruginosa PA01
gcggacgcuuguccu

SEQ ID NO: 3498974 - RNA, 17 nt, Pseudomonas aeruginosa PA01
gcggacggcacggggcg

SEQ ID NO: 3498975 - RNA, 13 nt, Pseudomonas aeruginosa PA01
gcggacggccugc

SEQ ID NO: 3498976 - RNA, 13 nt, Pseudomonas aeruginosa PA01
gcggacgggccgc

SEQ ID NO: 3498977 - RNA, 14 nt, Pseudomonas aeruginosa PA01
gcggacgggccgcg

SEQ ID NO: 3498978 - RNA, 18 nt, Pseudomonas aeruginosa PA01
gcggacgggccgcgccgc

SEQ ID NO: 3498979 - RNA, 14 nt, Pseudomonas aeruginosa PA01
gcggacuaccuucg

SEQ ID NO: 3498980 - RNA, 16 nt, Pseudomonas aeruginosa PA01
gcggacuccggaggcg

SEQ ID NO: 3498981 - RNA, 23 nt, Pseudomonas aeruginosa PA01
gcggacuccggaggcgcacaggc

SEQ ID NO: 3498982 - RNA, 21 nt, Pseudomonas aeruginosa PA01
gcggacugguaggacagggcc

SEQ ID NO: 3498983 - RNA, 23 nt, Pseudomonas aeruginosa PA01
gcggacugguaggacagggccag

SEQ ID NO: 3498984 - RNA, 22 nt, Pseudomonas aeruginosa PA01
gcggagaaacuuucuucgccau

SEQ ID NO: 3498985 - RNA, 16 nt, Pseudomonas aeruginosa PA01
gcggagaauccgcucg

SEQ ID NO: 3498986 - RNA, 18 nt, Pseudomonas aeruginosa PA01
gcggagaauccgcucggu

SEQ ID NO: 3498987 - RNA, 20 nt, Pseudomonas aeruginosa PA01
gcggagaauccgcucggugc

SEQ ID NO: 3498988 - RNA, 12 nt, Pseudomonas aeruginosa PA01
gcggagagucgg

SEQ ID NO: 3498989 - RNA, 19 nt, Pseudomonas aeruginosa PA01
gcggagauccccuccucca

SEQ ID NO: 3498990 - RNA, 16 nt, Pseudomonas aeruginosa PA01
gcggagcaccgcgccu

SEQ ID NO: 3498991 - RNA, 20 nt, Pseudomonas aeruginosa PA01
gcggagcaccgcgccuucca

SEQ ID NO: 3498992 - RNA, 23 nt, Pseudomonas aeruginosa PA01
gcggagcaccgcgccuuccagcc

SEQ ID NO: 3498993 - RNA, 16 nt, Pseudomonas aeruginosa PA01
gcggagcaggcggaga

SEQ ID NO: 3498994 - RNA, 17 nt, Pseudomonas aeruginosa PA01
gcggagcguccaccagc

SEQ ID NO: 3498995 - RNA, 21 nt, Pseudomonas aeruginosa PA01
gcggagcguccaccagcgccc

SEQ ID NO: 3498996 - RNA, 19 nt, Pseudomonas aeruginosa PA01
gcggagcgucggaagcguc

SEQ ID NO: 3498997 - RNA, 14 nt, Pseudomonas aeruginosa PA01
gcggagcgucgggc

SEQ ID NO: 3498998 - RNA, 14 nt, Pseudomonas aeruginosa PA01
gcggagcugcauga

SEQ ID NO: 3498999 - RNA, 22 nt, Pseudomonas aeruginosa PA01
gcggagcuggaaauggcggucg

SEQ ID NO: 3499000 - RNA, 13 nt, Pseudomonas aeruginosa PA01
gcggaggcgaggu

SEQ ID NO: 3499001 - RNA, 15 nt, Pseudomonas aeruginosa PA01
gcggaguagccggcg

SEQ ID NO: 3499002 - RNA, 21 nt, Pseudomonas aeruginosa PA01
gcggaguagccggcggcgaac

SEQ ID NO: 3499003 - RNA, 14 nt, Pseudomonas aeruginosa PA01
gcggagucgccggu

SEQ ID NO: 3499004 - RNA, 21 nt, Pseudomonas aeruginosa PA01
gcggauaacaccguuggcguu

SEQ ID NO: 3499005 - RNA, 17 nt, Pseudomonas aeruginosa PA01
gcggauaaccgcgagcg

SEQ ID NO: 3499006 - RNA, 14 nt, Pseudomonas aeruginosa PA01
gcggauaacgccac

SEQ ID NO: 3499007 - RNA, 16 nt, Pseudomonas aeruginosa PA01
gcggauaacgccagga

SEQ ID NO: 3499008 - RNA, 14 nt, Pseudomonas aeruginosa PA01
gcggauaacgccgc

SEQ ID NO: 3499009 - RNA, 16 nt, Pseudomonas aeruginosa PA01
gcggauaacgccggug

SEQ ID NO: 3499010 - RNA, 17 nt, Pseudomonas aeruginosa PA01
gcggauaacgccggugg

SEQ ID NO: 3499011 - RNA, 14 nt, Pseudomonas aeruginosa PA01
gcggauaacgccug

SEQ ID NO: 3499012 - RNA, 19 nt, Pseudomonas aeruginosa PA01
gcggauaacgccuguggcg

SEQ ID NO: 3499013 - RNA, 19 nt, Pseudomonas aeruginosa PA01
gcggauaagcaagcgcaac

SEQ ID NO: 3499014 - RNA, 21 nt, Pseudomonas aeruginosa PA01
gcggauaagcaagcgcaacgc

SEQ ID NO: 3499015 - RNA, 23 nt, Pseudomonas aeruginosa PA01
gcggauaagcaagcgcaacgcgg

SEQ ID NO: 3499016 - RNA, 17 nt, Pseudomonas aeruginosa PA01
gcggauaaucgcagcgc

SEQ ID NO: 3499017 - RNA, 15 nt, Pseudomonas aeruginosa PA01
gcggauacaggcgca

SEQ ID NO: 3499018 - RNA, 20 nt, Pseudomonas aeruginosa PA01
gcggauacaggcgcagcagc

SEQ ID NO: 3499019 - RNA, 21 nt, Pseudomonas aeruginosa PA01
gcggauacaggcgcagcagca

SEQ ID NO: 3499020 - RNA, 20 nt, Pseudomonas aeruginosa PA01
gcggauaccgagggugcaga

SEQ ID NO: 3499021 - RNA, 17 nt, Pseudomonas aeruginosa PA01
gcggauacggcaggggc

SEQ ID NO: 3499022 - RNA, 14 nt, Pseudomonas aeruginosa PA01
gcggauagccgcaa

SEQ ID NO: 3499023 - RNA, 19 nt, Pseudomonas aeruginosa PA01
gcggauagcgcgcaggcgc

SEQ ID NO: 3499024 - RNA, 18 nt, Pseudomonas aeruginosa PA01
gcggauauagcuggucaa

SEQ ID NO: 3499025 - RNA, 16 nt, Pseudomonas aeruginosa PA01
gcggauaucgcgccgc

SEQ ID NO: 3499026 - RNA, 18 nt, Pseudomonas aeruginosa PA01
gcggauaucgcgccgcga

SEQ ID NO: 3499027 - RNA, 16 nt, Pseudomonas aeruginosa PA01
gcggauaucgcuggcg

SEQ ID NO: 3499028 - RNA, 17 nt, Pseudomonas aeruginosa PA01
gcggauaucggccucgg

SEQ ID NO: 3499029 - RNA, 17 nt, Pseudomonas aeruginosa PA01
gcggauauucgacgcgc

SEQ ID NO: 3499030 - RNA, 17 nt, Pseudomonas aeruginosa PA01
gcggaucaacgccgguc

SEQ ID NO: 3499031 - RNA, 22 nt, Pseudomonas aeruginosa PA01
gcggaucaacuccgccaggcgc

SEQ ID NO: 3499032 - RNA, 16 nt, Pseudomonas aeruginosa PA01
gcggaucacaggcucu

SEQ ID NO: 3499033 - RNA, 23 nt, Pseudomonas aeruginosa PA01
gcggaucaccacguaaucgccau

SEQ ID NO: 3499034 - RNA, 20 nt, Pseudomonas aeruginosa PA01
gcggaucaccggcuggcccu

SEQ ID NO: 3499035 - RNA, 12 nt, Pseudomonas aeruginosa PA01
gcggaucagccg

SEQ ID NO: 3499036 - RNA, 16 nt, Pseudomonas aeruginosa PA01
gcggaucagccggccc

SEQ ID NO: 3499037 - RNA, 15 nt, Pseudomonas aeruginosa PA01
gcggaucagcucgau

SEQ ID NO: 3499038 - RNA, 14 nt, Pseudomonas aeruginosa PA01
gcggaucaggcugg

SEQ ID NO: 3499039 - RNA, 17 nt, Pseudomonas aeruginosa PA01
gcggauccacgccuggc

SEQ ID NO: 3499040 - RNA, 17 nt, Pseudomonas aeruginosa PA01
gcggauccccucccgcg

SEQ ID NO: 3499041 - RNA, 19 nt, Pseudomonas aeruginosa PA01
gcggauccggguggagagg

SEQ ID NO: 3499042 - RNA, 14 nt, Pseudomonas aeruginosa PA01
gcggaucgagcagc

SEQ ID NO: 3499043 - RNA, 17 nt, Pseudomonas aeruginosa PA01
gcggaucgagcagcggc

SEQ ID NO: 3499044 - RNA, 13 nt, Pseudomonas aeruginosa PA01
gcggaucgaucag

SEQ ID NO: 3499045 - RNA, 16 nt, Pseudomonas aeruginosa PA01
gcggaucgaucagcag

SEQ ID NO: 3499046 - RNA, 17 nt, Pseudomonas aeruginosa PA01
gcggaucgaucagcagc

SEQ ID NO: 3499047 - RNA, 17 nt, Pseudomonas aeruginosa PA01
gcggaucgcccggcgcu

SEQ ID NO: 3499048 - RNA, 19 nt, Pseudomonas aeruginosa PA01
gcggaucgcccggcgcucc

SEQ ID NO: 3499049 - RNA, 12 nt, Pseudomonas aeruginosa PA01
gcggaucgccgc

SEQ ID NO: 3499050 - RNA, 14 nt, Pseudomonas aeruginosa PA01
gcggaucgcgccgu

SEQ ID NO: 3499051 - RNA, 23 nt, Pseudomonas aeruginosa PA01
gcggaucgcgccgucgcuggcga

SEQ ID NO: 3499052 - RNA, 19 nt, Pseudomonas aeruginosa PA01
gcggaucggcguguucagg

SEQ ID NO: 3499053 - RNA, 12 nt, Pseudomonas aeruginosa PA01
gcggaucgucgc

SEQ ID NO: 3499054 - RNA, 16 nt, Pseudomonas aeruginosa PA01
gcggaucucaggaccu

SEQ ID NO: 3499055 - RNA, 14 nt, Pseudomonas aeruginosa PA01
gcggaucucgucgc

SEQ ID NO: 3499056 - RNA, 17 nt, Pseudomonas aeruginosa PA01
gcggaucucgucgccga

SEQ ID NO: 3499057 - RNA, 19 nt, Pseudomonas aeruginosa PA01
gcggaucucgucgccgacc

SEQ ID NO: 3499058 - RNA, 13 nt, Pseudomonas aeruginosa PA01
gcggaucugcucc

SEQ ID NO: 3499059 - RNA, 20 nt, Pseudomonas aeruginosa PA01
gcggaucugcuccugcaggc

SEQ ID NO: 3499060 - RNA, 14 nt, Pseudomonas aeruginosa PA01
gcggaucugcucga

SEQ ID NO: 3499061 - RNA, 16 nt, Pseudomonas aeruginosa PA01
gcggaugacguucccg

SEQ ID NO: 3499062 - RNA, 17 nt, Pseudomonas aeruginosa PA01
gcggaugacguucccgu

SEQ ID NO: 3499063 - RNA, 16 nt, Pseudomonas aeruginosa PA01
gcggaugagccgcugg

SEQ ID NO: 3499064 - RNA, 17 nt, Pseudomonas aeruginosa PA01
gcggaugagccgcuggu

SEQ ID NO: 3499065 - RNA, 18 nt, Pseudomonas aeruginosa PA01
gcggaugcccuggucggc

SEQ ID NO: 3499066 - RNA, 22 nt, Pseudomonas aeruginosa PA01
gcggaugcccuggucggcgguc

SEQ ID NO: 3499067 - RNA, 13 nt, Pseudomonas aeruginosa PA01
gcggaugccggcg

SEQ ID NO: 3499068 - RNA, 14 nt, Pseudomonas aeruginosa PA01
gcggaugccggcgc

SEQ ID NO: 3499069 - RNA, 16 nt, Pseudomonas aeruginosa PA01
gcggaugccggcgcug

SEQ ID NO: 3499070 - RNA, 23 nt, Pseudomonas aeruginosa PA01
gcggaugccggcgcugucucgcc

SEQ ID NO: 3499071 - RNA, 17 nt, Pseudomonas aeruginosa PA01
gcggaugcguugcucgc

SEQ ID NO: 3499072 - RNA, 22 nt, Pseudomonas aeruginosa PA01
gcggaugcguugcucgcaccag

SEQ ID NO: 3499073 - RNA, 18 nt, Pseudomonas aeruginosa PA01
gcggauggcaauggcggu

SEQ ID NO: 3499074 - RNA, 14 nt, Pseudomonas aeruginosa PA01
gcggauggcgaucg

SEQ ID NO: 3499075 - RNA, 17 nt, Pseudomonas aeruginosa PA01
gcggaugggcgacgacg

SEQ ID NO: 3499076 - RNA, 20 nt, Pseudomonas aeruginosa PA01
gcggauguaguccagcgccg

SEQ ID NO: 3499077 - RNA, 23 nt, Pseudomonas aeruginosa PA01
gcggauguaguccagcgccgcgc

SEQ ID NO: 3499078 - RNA, 14 nt, Pseudomonas aeruginosa PA01
gcggaugucgucgc

SEQ ID NO: 3499079 - RNA, 15 nt, Pseudomonas aeruginosa PA01
gcggaugucgucgca

SEQ ID NO: 3499080 - RNA, 16 nt, Pseudomonas aeruginosa PA01
gcggaugugcaggguc

SEQ ID NO: 3499081 - RNA, 13 nt, Pseudomonas aeruginosa PA01
gcggauguucgcc

SEQ ID NO: 3499082 - RNA, 17 nt, Pseudomonas aeruginosa PA01
gcggauguucgccacgc

SEQ ID NO: 3499083 - RNA, 21 nt, Pseudomonas aeruginosa PA01
gcggauguucgccacgcugcu

SEQ ID NO: 3499084 - RNA, 15 nt, Pseudomonas aeruginosa PA01
gcggauguucuucac

SEQ ID NO: 3499085 - RNA, 17 nt, Pseudomonas aeruginosa PA01
gcggauuacuccgccgg

SEQ ID NO: 3499086 - RNA, 14 nt, Pseudomonas aeruginosa PA01
gcggauucaggcgc

SEQ ID NO: 3499087 - RNA, 15 nt, Pseudomonas aeruginosa PA01
gcggauucaggcgcg

SEQ ID NO: 3499088 - RNA, 16 nt, Pseudomonas aeruginosa PA01
gcggauucaggcgcgc

SEQ ID NO: 3499089 - RNA, 15 nt, Pseudomonas aeruginosa PA01
gcggauucaucggcg

SEQ ID NO: 3499090 - RNA, 23 nt, Pseudomonas aeruginosa PA01
gcggauucaucggcggcaggccg

SEQ ID NO: 3499091 - RNA, 20 nt, Pseudomonas aeruginosa PA01
gcggauugacgauggccagc

SEQ ID NO: 3499092 - RNA, 21 nt, Pseudomonas aeruginosa PA01
gcggauugcguacgcccagca

SEQ ID NO: 3499093 - RNA, 17 nt, Pseudomonas aeruginosa PA01
gcggauuggccgggccg

SEQ ID NO: 3499094 - RNA, 15 nt, Pseudomonas aeruginosa PA01
gcggauuugccgccg

SEQ ID NO: 3499095 - RNA, 16 nt, Pseudomonas aeruginosa PA01
gcggauuugccgccga

SEQ ID NO: 3499096 - RNA, 17 nt, Pseudomonas aeruginosa PA01
gcggauuugccgccgag

SEQ ID NO: 3499097 - RNA, 18 nt, Pseudomonas aeruginosa PA01
gcggauuugccgccgagg

SEQ ID NO: 3499098 - RNA, 22 nt, Pseudomonas aeruginosa PA01
gcggauuugccgccgagggcga

SEQ ID NO: 3499099 - RNA, 23 nt, Pseudomonas aeruginosa PA01
gcggauuugccgccgagggcgaa

SEQ ID NO: 3499100 - RNA, 16 nt, Pseudomonas aeruginosa PA01
gcggcaaaggcccggc

SEQ ID NO: 3499101 - RNA, 22 nt, Pseudomonas aeruginosa PA01
gcggcaacaccacaaggugggc

SEQ ID NO: 3499102 - RNA, 15 nt, Pseudomonas aeruginosa PA01
gcggcaacgacggca

SEQ ID NO: 3499103 - RNA, 16 nt, Pseudomonas aeruginosa PA01
gcggcaacgacggcaa

SEQ ID NO: 3499104 - RNA, 21 nt, Pseudomonas aeruginosa PA01
gcggcaacgacggcaaguucg

SEQ ID NO: 3499105 - RNA, 16 nt, Pseudomonas aeruginosa PA01
gcggcaacgucaggcu

SEQ ID NO: 3499106 - RNA, 13 nt, Pseudomonas aeruginosa PA01
gcggcaaggccaa

SEQ ID NO: 3499107 - RNA, 21 nt, Pseudomonas aeruginosa PA01
gcggcaaggccaagucggccg

SEQ ID NO: 3499108 - RNA, 21 nt, Pseudomonas aeruginosa PA01
gcggcaaggcgaucccggcgu

SEQ ID NO: 3499109 - RNA, 14 nt, Pseudomonas aeruginosa PA01
gcggcaagggcacg

SEQ ID NO: 3499110 - RNA, 22 nt, Pseudomonas aeruginosa PA01
gcggcaagggcacgugcagcgg

SEQ ID NO: 3499111 - RNA, 15 nt, Pseudomonas aeruginosa PA01
gcggcaaguggguca

SEQ ID NO: 3499112 - RNA, 18 nt, Pseudomonas aeruginosa PA01
gcggcaagugggucacgg

SEQ ID NO: 3499113 - RNA, 18 nt, Pseudomonas aeruginosa PA01
gcggcaaugcggcgaugg

SEQ ID NO: 3499114 - RNA, 22 nt, Pseudomonas aeruginosa PA01
gcggcaauguccgagcaggucg

SEQ ID NO: 3499115 - RNA, 23 nt, Pseudomonas aeruginosa PA01
gcggcaauguccgagcaggucgc

SEQ ID NO: 3499116 - RNA, 20 nt, Pseudomonas aeruginosa PA01
gcggcacagcguggccagcg

SEQ ID NO: 3499117 - RNA, 23 nt, Pseudomonas aeruginosa PA01
gcggcacagcguggccagcgccc

SEQ ID NO: 3499118 - RNA, 14 nt, Pseudomonas aeruginosa PA01
gcggcacaggcggc

SEQ ID NO: 3499119 - RNA, 15 nt, Pseudomonas aeruginosa PA01
gcggcacaggcggcu

SEQ ID NO: 3499120 - RNA, 12 nt, Pseudomonas aeruginosa PA01
gcggcaccagca

SEQ ID NO: 3499121 - RNA, 13 nt, Pseudomonas aeruginosa PA01
gcggcaccagcac

SEQ ID NO: 3499122 - RNA, 13 nt, Pseudomonas aeruginosa PA01
gcggcaccagcca

SEQ ID NO: 3499123 - RNA, 22 nt, Pseudomonas aeruginosa PA01
gcggcaccccuugcagccagcc

SEQ ID NO: 3499124 - RNA, 23 nt, Pseudomonas aeruginosa PA01
gcggcaccccuugcagccagccg

SEQ ID NO: 3499125 - RNA, 16 nt, Pseudomonas aeruginosa PA01
gcggcacccggcuggg

SEQ ID NO: 3499126 - RNA, 21 nt, Pseudomonas aeruginosa PA01
gcggcacccucuuccgcgcug

SEQ ID NO: 3499127 - RNA, 15 nt, Pseudomonas aeruginosa PA01
gcggcaccgacgccg

SEQ ID NO: 3499128 - RNA, 23 nt, Pseudomonas aeruginosa PA01
gcggcaccgacgccgaaggacag

SEQ ID NO: 3499129 - RNA, 16 nt, Pseudomonas aeruginosa PA01
gcggcaccggcgacga

SEQ ID NO: 3499130 - RNA, 17 nt, Pseudomonas aeruginosa PA01
gcggcaccucgauggcg

SEQ ID NO: 3499131 - RNA, 20 nt, Pseudomonas aeruginosa PA01
gcggcaccucgauggcggcg

SEQ ID NO: 3499132 - RNA, 21 nt, Pseudomonas aeruginosa PA01
gcggcacgaaccauugcggcc

SEQ ID NO: 3499133 - RNA, 18 nt, Pseudomonas aeruginosa PA01
gcggcacgcucuggccgu

SEQ ID NO: 3499134 - RNA, 21 nt, Pseudomonas aeruginosa PA01
gcggcacgcugcuugcgcacc

SEQ ID NO: 3499135 - RNA, 19 nt, Pseudomonas aeruginosa PA01
gcggcacggucauggccag

SEQ ID NO: 3499136 - RNA, 21 nt, Pseudomonas aeruginosa PA01
gcggcacggucauggccagcu

SEQ ID NO: 3499137 - RNA, 14 nt, Pseudomonas aeruginosa PA01
gcggcacuccagga

SEQ ID NO: 3499138 - RNA, 19 nt, Pseudomonas aeruginosa PA01
gcggcacuucccgcccccu

SEQ ID NO: 3499139 - RNA, 15 nt, Pseudomonas aeruginosa PA01
gcggcagauccgccg

SEQ ID NO: 3499140 - RNA, 18 nt, Pseudomonas aeruginosa PA01
gcggcagauccgccguga

SEQ ID NO: 3499141 - RNA, 19 nt, Pseudomonas aeruginosa PA01
gcggcagauccgccgugag

SEQ ID NO: 3499142 - RNA, 19 nt, Pseudomonas aeruginosa PA01
gcggcagaucggugcgggc

SEQ ID NO: 3499143 - RNA, 15 nt, Pseudomonas aeruginosa PA01
gcggcagcaccaggc

SEQ ID NO: 3499144 - RNA, 16 nt, Pseudomonas aeruginosa PA01
gcggcagcaccaggcc

SEQ ID NO: 3499145 - RNA, 18 nt, Pseudomonas aeruginosa PA01
gcggcagcaccaggccau

SEQ ID NO: 3499146 - RNA, 20 nt, Pseudomonas aeruginosa PA01
gcggcagcacgaugaggcgu

SEQ ID NO: 3499147 - RNA, 20 nt, Pseudomonas aeruginosa PA01
gcggcagcagccaaccgucg

SEQ ID NO: 3499148 - RNA, 12 nt, Pseudomonas aeruginosa PA01
gcggcagcaggc

SEQ ID NO: 3499149 - RNA, 18 nt, Pseudomonas aeruginosa PA01
gcggcagcaggcgggcga

SEQ ID NO: 3499150 - RNA, 17 nt, Pseudomonas aeruginosa PA01
gcggcagccacucggcc

SEQ ID NO: 3499151 - RNA, 18 nt, Pseudomonas aeruginosa PA01
gcggcagccacucggcca

SEQ ID NO: 3499152 - RNA, 19 nt, Pseudomonas aeruginosa PA01
gcggcagccacucggccag

SEQ ID NO: 3499153 - RNA, 20 nt, Pseudomonas aeruginosa PA01
gcggcagccacucggccagg

SEQ ID NO: 3499154 - RNA, 22 nt, Pseudomonas aeruginosa PA01
gcggcagccacucggccaggcg

SEQ ID NO: 3499155 - RNA, 15 nt, Pseudomonas aeruginosa PA01
gcggcagccgcggcu

SEQ ID NO: 3499156 - RNA, 13 nt, Pseudomonas aeruginosa PA01
gcggcagcgccag

SEQ ID NO: 3499157 - RNA, 15 nt, Pseudomonas aeruginosa PA01
gcggcagcgccaggu

SEQ ID NO: 3499158 - RNA, 16 nt, Pseudomonas aeruginosa PA01
gcggcagcggcucguc

SEQ ID NO: 3499159 - RNA, 23 nt, Pseudomonas aeruginosa PA01
gcggcagcgucucggcugccgcc

SEQ ID NO: 3499160 - RNA, 23 nt, Pseudomonas aeruginosa PA01
gcggcagcugcggcggcaccacg

SEQ ID NO: 3499161 - RNA, 18 nt, Pseudomonas aeruginosa PA01
gcggcaggaaauccgccg

SEQ ID NO: 3499162 - RNA, 15 nt, Pseudomonas aeruginosa PA01
gcggcaggagcauga

SEQ ID NO: 3499163 - RNA, 17 nt, Pseudomonas aeruginosa PA01
gcggcaggagcaugaag

SEQ ID NO: 3499164 - RNA, 23 nt, Pseudomonas aeruginosa PA01
gcggcaggagcaugaaggucgac

SEQ ID NO: 3499165 - RNA, 17 nt, Pseudomonas aeruginosa PA01
gcggcaggagcguugcg

SEQ ID NO: 3499166 - RNA, 23 nt, Pseudomonas aeruginosa PA01
gcggcaggaucaggcucgagccg

SEQ ID NO: 3499167 - RNA, 15 nt, Pseudomonas aeruginosa PA01
gcggcaggcacgcug

SEQ ID NO: 3499168 - RNA, 16 nt, Pseudomonas aeruginosa PA01
gcggcaggcacgcugc

SEQ ID NO: 3499169 - RNA, 16 nt, Pseudomonas aeruginosa PA01
gcggcaggccacggcc

SEQ ID NO: 3499170 - RNA, 18 nt, Pseudomonas aeruginosa PA01
gcggcaggccacggccgc

SEQ ID NO: 3499171 - RNA, 12 nt, Pseudomonas aeruginosa PA01
gcggcaggccag

SEQ ID NO: 3499172 - RNA, 16 nt, Pseudomonas aeruginosa PA01
gcggcaggccgauguc

SEQ ID NO: 3499173 - RNA, 12 nt, Pseudomonas aeruginosa PA01
gcggcaggccgc

SEQ ID NO: 3499174 - RNA, 13 nt, Pseudomonas aeruginosa PA01
gcggcaggccgcc

SEQ ID NO: 3499175 - RNA, 15 nt, Pseudomonas aeruginosa PA01
gcggcaggccgccga

SEQ ID NO: 3499176 - RNA, 16 nt, Pseudomonas aeruginosa PA01
gcggcaggccguccuu

SEQ ID NO: 3499177 - RNA, 18 nt, Pseudomonas aeruginosa PA01
gcggcaggccuuccacgc

SEQ ID NO: 3499178 - RNA, 15 nt, Pseudomonas aeruginosa PA01
gcggcaggcgcauca

SEQ ID NO: 3499179 - RNA, 12 nt, Pseudomonas aeruginosa PA01
gcggcaggcgcc

SEQ ID NO: 3499180 - RNA, 13 nt, Pseudomonas aeruginosa PA01
gcggcaggcgccg

SEQ ID NO: 3499181 - RNA, 15 nt, Pseudomonas aeruginosa PA01
gcggcaggcgccggc

SEQ ID NO: 3499182 - RNA, 18 nt, Pseudomonas aeruginosa PA01
gcggcaggcgccggccgg

SEQ ID NO: 3499183 - RNA, 14 nt, Pseudomonas aeruginosa PA01
gcggcaggcggcgg

SEQ ID NO: 3499184 - RNA, 15 nt, Pseudomonas aeruginosa PA01
gcggcaggcggcggc

SEQ ID NO: 3499185 - RNA, 16 nt, Pseudomonas aeruginosa PA01
gcggcaggcggcggcg

SEQ ID NO: 3499186 - RNA, 23 nt, Pseudomonas aeruginosa PA01
gcggcaggcggcggcguuggccg

SEQ ID NO: 3499187 - RNA, 17 nt, Pseudomonas aeruginosa PA01
gcggcaggcugcgccgc

SEQ ID NO: 3499188 - RNA, 18 nt, Pseudomonas aeruginosa PA01
gcggcaggcugcgccgcu

SEQ ID NO: 3499189 - RNA, 20 nt, Pseudomonas aeruginosa PA01
gcggcaggcugcgccgcugc

SEQ ID NO: 3499190 - RNA, 12 nt, Pseudomonas aeruginosa PA01
gcggcagggcgg

SEQ ID NO: 3499191 - RNA, 23 nt, Pseudomonas aeruginosa PA01
gcggcagggggucuucgaagguc

SEQ ID NO: 3499192 - RNA, 20 nt, Pseudomonas aeruginosa PA01
gcggcaggguggcgcaugag

SEQ ID NO: 3499193 - RNA, 19 nt, Pseudomonas aeruginosa PA01
gcggcagguagccgccuug

SEQ ID NO: 3499194 - RNA, 15 nt, Pseudomonas aeruginosa PA01
gcggcagguaguggc

SEQ ID NO: 3499195 - RNA, 18 nt, Pseudomonas aeruginosa PA01
gcggcagguaguggcccu

SEQ ID NO: 3499196 - RNA, 13 nt, Pseudomonas aeruginosa PA01
gcggcagguggcu

SEQ ID NO: 3499197 - RNA, 18 nt, Pseudomonas aeruginosa PA01
gcggcagguggcuggcca

SEQ ID NO: 3499198 - RNA, 15 nt, Pseudomonas aeruginosa PA01
gcggcagugcucgau

SEQ ID NO: 3499199 - RNA, 21 nt, Pseudomonas aeruginosa PA01
gcggcagugcucgaucaggcu

SEQ ID NO: 3499200 - RNA, 22 nt, Pseudomonas aeruginosa PA01
gcggcagugcucgaucaggcug

SEQ ID NO: 3499201 - RNA, 15 nt, Pseudomonas aeruginosa PA01
gcggcauagcgcagc

SEQ ID NO: 3499202 - RNA, 16 nt, Pseudomonas aeruginosa PA01
gcggcauagcgcagcc

SEQ ID NO: 3499203 - RNA, 17 nt, Pseudomonas aeruginosa PA01
gcggcauccgccgcugg

SEQ ID NO: 3499204 - RNA, 18 nt, Pseudomonas aeruginosa PA01
gcggcauccgccgcuggg

SEQ ID NO: 3499205 - RNA, 20 nt, Pseudomonas aeruginosa PA01
gcggcauccgccgcugggga

SEQ ID NO: 3499206 - RNA, 14 nt, Pseudomonas aeruginosa PA01
gcggcaucgcguag

SEQ ID NO: 3499207 - RNA, 17 nt, Pseudomonas aeruginosa PA01
gcggcaucgcguagggc

SEQ ID NO: 3499208 - RNA, 23 nt, Pseudomonas aeruginosa PA01
gcggcaucgcguagggcgacggc

SEQ ID NO: 3499209 - RNA, 20 nt, Pseudomonas aeruginosa PA01
gcggcaucggccugguugua

SEQ ID NO: 3499210 - RNA, 12 nt, Pseudomonas aeruginosa PA01
gcggcaucggcg

SEQ ID NO: 3499211 - RNA, 16 nt, Pseudomonas aeruginosa PA01
gcggcaugcccugccg

SEQ ID NO: 3499212 - RNA, 22 nt, Pseudomonas aeruginosa PA01
gcggcaugcccugccggcgcag

SEQ ID NO: 3499213 - RNA, 20 nt, Pseudomonas aeruginosa PA01
gcggcaugccguugggccag

SEQ ID NO: 3499214 - RNA, 23 nt, Pseudomonas aeruginosa PA01
gcggcaugggcauccugccgccu

SEQ ID NO: 3499215 - RNA, 15 nt, Pseudomonas aeruginosa PA01
gcggcauuccgggcg

SEQ ID NO: 3499216 - RNA, 16 nt, Pseudomonas aeruginosa PA01
gcggcauucgcgcugg

SEQ ID NO: 3499217 - RNA, 18 nt, Pseudomonas aeruginosa PA01
gcggcauucgcgcugguu

SEQ ID NO: 3499218 - RNA, 15 nt, Pseudomonas aeruginosa PA01
gcggcauugagcgcc

SEQ ID NO: 3499219 - RNA, 17 nt, Pseudomonas aeruginosa PA01
gcggcauugagcgccag

SEQ ID NO: 3499220 - RNA, 19 nt, Pseudomonas aeruginosa PA01
gcggcauugagcgccagca

SEQ ID NO: 3499221 - RNA, 17 nt, Pseudomonas aeruginosa PA01
gcggcauugagggcgag

SEQ ID NO: 3499222 - RNA, 18 nt, Pseudomonas aeruginosa PA01
gcggcauugagggcgagg

SEQ ID NO: 3499223 - RNA, 16 nt, Pseudomonas aeruginosa PA01
gcggccaaccucuccc

SEQ ID NO: 3499224 - RNA, 18 nt, Pseudomonas aeruginosa PA01
gcggccaaccucucccca

SEQ ID NO: 3499225 - RNA, 22 nt, Pseudomonas aeruginosa PA01
gcggccaaccucuccccagacc

SEQ ID NO: 3499226 - RNA, 14 nt, Pseudomonas aeruginosa PA01
gcggccacccgaag

SEQ ID NO: 3499227 - RNA, 19 nt, Pseudomonas aeruginosa PA01
gcggccacuucguccggcc

SEQ ID NO: 3499228 - RNA, 23 nt, Pseudomonas aeruginosa PA01
gcggccacuucguccggccgccc

SEQ ID NO: 3499229 - RNA, 12 nt, Pseudomonas aeruginosa PA01
gcggccagcagc

SEQ ID NO: 3499230 - RNA, 13 nt, Pseudomonas aeruginosa PA01
gcggccagcagca

SEQ ID NO: 3499231 - RNA, 17 nt, Pseudomonas aeruginosa PA01
gcggccagcagcacgcc

SEQ ID NO: 3499232 - RNA, 21 nt, Pseudomonas aeruginosa PA01
gcggccagcagcacgcccugg

SEQ ID NO: 3499233 - RNA, 16 nt, Pseudomonas aeruginosa PA01
gcggccagcagcacgg

SEQ ID NO: 3499234 - RNA, 17 nt, Pseudomonas aeruginosa PA01
gcggccagcagcacggc

SEQ ID NO: 3499235 - RNA, 19 nt, Pseudomonas aeruginosa PA01
gcggccagcauuuugcgga

SEQ ID NO: 3499236 - RNA, 13 nt, Pseudomonas aeruginosa PA01
gcggccagccccc

SEQ ID NO: 3499237 - RNA, 14 nt, Pseudomonas aeruginosa PA01
gcggccagcccccu

SEQ ID NO: 3499238 - RNA, 19 nt, Pseudomonas aeruginosa PA01
gcggccagcccccucgccc

SEQ ID NO: 3499239 - RNA, 14 nt, Pseudomonas aeruginosa PA01
gcggccagccgcua

SEQ ID NO: 3499240 - RNA, 19 nt, Pseudomonas aeruginosa PA01
gcggccagccgcuagcggu

SEQ ID NO: 3499241 - RNA, 14 nt, Pseudomonas aeruginosa PA01
gcggccagcgccag

SEQ ID NO: 3499242 - RNA, 16 nt, Pseudomonas aeruginosa PA01
gcggccagcgccagga

SEQ ID NO: 3499243 - RNA, 13 nt, Pseudomonas aeruginosa PA01
gcggccagcgcgg

SEQ ID NO: 3499244 - RNA, 15 nt, Pseudomonas aeruginosa PA01
gcggccagcgcggcc

SEQ ID NO: 3499245 - RNA, 21 nt, Pseudomonas aeruginosa PA01
gcggccagcuucuccagcagg

SEQ ID NO: 3499246 - RNA, 13 nt, Pseudomonas aeruginosa PA01
gcggccaggcgcu

SEQ ID NO: 3499247 - RNA, 14 nt, Pseudomonas aeruginosa PA01
gcggccaggcgcuc

SEQ ID NO: 3499248 - RNA, 20 nt, Pseudomonas aeruginosa PA01
gcggccagggaaaagcccag

SEQ ID NO: 3499249 - RNA, 19 nt, Pseudomonas aeruginosa PA01
gcggccagggcauggguca

SEQ ID NO: 3499250 - RNA, 21 nt, Pseudomonas aeruginosa PA01
gcggccagggcaugggucagc

SEQ ID NO: 3499251 - RNA, 22 nt, Pseudomonas aeruginosa PA01
gcggccagggcaugggucagcg

SEQ ID NO: 3499252 - RNA, 24 nt, Pseudomonas aeruginosa PA01
gcggccagggcaugggucagcgcc

SEQ ID NO: 3499253 - RNA, 22 nt, Pseudomonas aeruginosa PA01
gcggccagggcgaggccgcucu

SEQ ID NO: 3499254 - RNA, 18 nt, Pseudomonas aeruginosa PA01
gcggccaguucggggucg

SEQ ID NO: 3499255 - RNA, 21 nt, Pseudomonas aeruginosa PA01
gcggccaguucggggucggcc

SEQ ID NO: 3499256 - RNA, 22 nt, Pseudomonas aeruginosa PA01
gcggccaguucggggucggccu

SEQ ID NO: 3499257 - RNA, 21 nt, Pseudomonas aeruginosa PA01
gcggccaguuguuccggcugg

SEQ ID NO: 3499258 - RNA, 15 nt, Pseudomonas aeruginosa PA01
gcggccaucaggcgc

SEQ ID NO: 3499259 - RNA, 16 nt, Pseudomonas aeruginosa PA01
gcggccaucaggcgcu

SEQ ID NO: 3499260 - RNA, 13 nt, Pseudomonas aeruginosa PA01
gcggccaucggcg

SEQ ID NO: 3499261 - RNA, 15 nt, Pseudomonas aeruginosa PA01
gcggccaucggcgaa

SEQ ID NO: 3499262 - RNA, 17 nt, Pseudomonas aeruginosa PA01
gcggccaucggcgaagc

SEQ ID NO: 3499263 - RNA, 22 nt, Pseudomonas aeruginosa PA01
gcggccaucggcgaagcggaag

SEQ ID NO: 3499264 - RNA, 19 nt, Pseudomonas aeruginosa PA01
gcggccauugcccgguggc

SEQ ID NO: 3499265 - RNA, 22 nt, Pseudomonas aeruginosa PA01
gcggccauugcccgguggccuc

SEQ ID NO: 3499266 - RNA, 17 nt, Pseudomonas aeruginosa PA01
gcggccauugucggccu

SEQ ID NO: 3499267 - RNA, 15 nt, Pseudomonas aeruginosa PA01
gcggcccaccaccac

SEQ ID NO: 3499268 - RNA, 13 nt, Pseudomonas aeruginosa PA01
gcggcccagcgcc

SEQ ID NO: 3499269 - RNA, 14 nt, Pseudomonas aeruginosa PA01
gcggcccagcgccc

SEQ ID NO: 3499270 - RNA, 18 nt, Pseudomonas aeruginosa PA01
gcggcccagcgccccgcc

SEQ ID NO: 3499271 - RNA, 12 nt, Pseudomonas aeruginosa PA01
gcggcccaugcg

SEQ ID NO: 3499272 - RNA, 18 nt, Pseudomonas aeruginosa PA01
gcggccccaaggggccgc

SEQ ID NO: 3499273 - RNA, 19 nt, Pseudomonas aeruginosa PA01
gcggccccaaggggccgcg

SEQ ID NO: 3499274 - RNA, 13 nt, Pseudomonas aeruginosa PA01
gcggccccagcac

SEQ ID NO: 3499275 - RNA, 13 nt, Pseudomonas aeruginosa PA01
gcggccccgagcg

SEQ ID NO: 3499276 - RNA, 17 nt, Pseudomonas aeruginosa PA01
gcggccccgagcgggcc

SEQ ID NO: 3499277 - RNA, 15 nt, Pseudomonas aeruginosa PA01
gcggccccggcgcuc

SEQ ID NO: 3499278 - RNA, 17 nt, Pseudomonas aeruginosa PA01
gcggccccggcgcucgc

SEQ ID NO: 3499279 - RNA, 20 nt, Pseudomonas aeruginosa PA01
gcggccccuucagcuccagc

SEQ ID NO: 3499280 - RNA, 22 nt, Pseudomonas aeruginosa PA01
gcggccccuucagcuccagcag

SEQ ID NO: 3499281 - RNA, 23 nt, Pseudomonas aeruginosa PA01
gcggccccuucagcuccagcagu

SEQ ID NO: 3499282 - RNA, 16 nt, Pseudomonas aeruginosa PA01
gcggcccgagcaggcu

SEQ ID NO: 3499283 - RNA, 18 nt, Pseudomonas aeruginosa PA01
gcggcccgagcaggcugc

SEQ ID NO: 3499284 - RNA, 14 nt, Pseudomonas aeruginosa PA01
gcggcccgagggcg

SEQ ID NO: 3499285 - RNA, 17 nt, Pseudomonas aeruginosa PA01
gcggcccgagggcggca

SEQ ID NO: 3499286 - RNA, 18 nt, Pseudomonas aeruginosa PA01
gcggcccgagggcggcag

SEQ ID NO: 3499287 - RNA, 19 nt, Pseudomonas aeruginosa PA01
gcggcccgagggcggcagg

SEQ ID NO: 3499288 - RNA, 12 nt, Pseudomonas aeruginosa PA01
gcggcccgcaca

SEQ ID NO: 3499289 - RNA, 22 nt, Pseudomonas aeruginosa PA01
gcggcccgccgccggggcgggc

SEQ ID NO: 3499290 - RNA, 12 nt, Pseudomonas aeruginosa PA01
gcggcccgccgg

SEQ ID NO: 3499291 - RNA, 14 nt, Pseudomonas aeruginosa PA01
gcggcccgccggcg

SEQ ID NO: 3499292 - RNA, 15 nt, Pseudomonas aeruginosa PA01
gcggcccgccggcga

SEQ ID NO: 3499293 - RNA, 14 nt, Pseudomonas aeruginosa PA01
gcggcccgcgguca

SEQ ID NO: 3499294 - RNA, 16 nt, Pseudomonas aeruginosa PA01
gcggcccggaaugcaa

SEQ ID NO: 3499295 - RNA, 17 nt, Pseudomonas aeruginosa PA01
gcggcccggcaggcgca

SEQ ID NO: 3499296 - RNA, 18 nt, Pseudomonas aeruginosa PA01
gcggcccggcaggcgcac

SEQ ID NO: 3499297 - RNA, 20 nt, Pseudomonas aeruginosa PA01
gcggcccggcaggcgcacgc

SEQ ID NO: 3499298 - RNA, 16 nt, Pseudomonas aeruginosa PA01
gcggcccguccgcgcc

SEQ ID NO: 3499299 - RNA, 19 nt, Pseudomonas aeruginosa PA01
gcggcccguccgcgccacg

SEQ ID NO: 3499300 - RNA, 13 nt, Pseudomonas aeruginosa PA01
gcggcccugcgcc

SEQ ID NO: 3499301 - RNA, 14 nt, Pseudomonas aeruginosa PA01
gcggcccugcgccg

SEQ ID NO: 3499302 - RNA, 13 nt, Pseudomonas aeruginosa PA01
gcggcccugcucg

SEQ ID NO: 3499303 - RNA, 17 nt, Pseudomonas aeruginosa PA01
gcggcccugcucgccgg

SEQ ID NO: 3499304 - RNA, 19 nt, Pseudomonas aeruginosa PA01
gcggcccugcucgccggcg

SEQ ID NO: 3499305 - RNA, 20 nt, Pseudomonas aeruginosa PA01
gcggcccugcucgccggcgc

SEQ ID NO: 3499306 - RNA, 22 nt, Pseudomonas aeruginosa PA01
gcggcccuucgacgacaccugc

SEQ ID NO: 3499307 - RNA, 13 nt, Pseudomonas aeruginosa PA01
gcggcccuugucg

SEQ ID NO: 3499308 - RNA, 22 nt, Pseudomonas aeruginosa PA01
gcggcccuugucgccgcugggc

SEQ ID NO: 3499309 - RNA, 19 nt, Pseudomonas aeruginosa PA01
gcggcccuuguucgcggcg

SEQ ID NO: 3499310 - RNA, 20 nt, Pseudomonas aeruginosa PA01
gcggcccuuguucgcggcga

SEQ ID NO: 3499311 - RNA, 17 nt, Pseudomonas aeruginosa PA01
gcggccgaacucuggcg

SEQ ID NO: 3499312 - RNA, 18 nt, Pseudomonas aeruginosa PA01
gcggccgaacucuggcgg

SEQ ID NO: 3499313 - RNA, 19 nt, Pseudomonas aeruginosa PA01
gcggccgaacucuggcggc

SEQ ID NO: 3499314 - RNA, 20 nt, Pseudomonas aeruginosa PA01
gcggccgaacucuggcggcg

SEQ ID NO: 3499315 - RNA, 13 nt, Pseudomonas aeruginosa PA01
gcggccgaacugg

SEQ ID NO: 3499316 - RNA, 21 nt, Pseudomonas aeruginosa PA01
gcggccgaacuggaugauggu

SEQ ID NO: 3499317 - RNA, 21 nt, Pseudomonas aeruginosa PA01
gcggccgaauccuccagccgg

SEQ ID NO: 3499318 - RNA, 22 nt, Pseudomonas aeruginosa PA01
gcggccgaauccuccagccggc

SEQ ID NO: 3499319 - RNA, 17 nt, Pseudomonas aeruginosa PA01
gcggccgaccaggccgu

SEQ ID NO: 3499320 - RNA, 18 nt, Pseudomonas aeruginosa PA01
gcggccgagauccugcag

SEQ ID NO: 3499321 - RNA, 20 nt, Pseudomonas aeruginosa PA01
gcggccgagauccugcagca

SEQ ID NO: 3499322 - RNA, 19 nt, Pseudomonas aeruginosa PA01
gcggccgagcaccacgcgc

SEQ ID NO: 3499323 - RNA, 20 nt, Pseudomonas aeruginosa PA01
gcggccgagcaccacgcgca

SEQ ID NO: 3499324 - RNA, 22 nt, Pseudomonas aeruginosa PA01
gcggccgagcaggcgcgccagg

SEQ ID NO: 3499325 - RNA, 21 nt, Pseudomonas aeruginosa PA01
gcggccgagcauguaggcgca

SEQ ID NO: 3499326 - RNA, 20 nt, Pseudomonas aeruginosa PA01
gcggccgaggaaggcgcugg

SEQ ID NO: 3499327 - RNA, 16 nt, Pseudomonas aeruginosa PA01
gcggccgaggcuuccu

SEQ ID NO: 3499328 - RNA, 18 nt, Pseudomonas aeruginosa PA01
gcggccgaggcuuccucg

SEQ ID NO: 3499329 - RNA, 15 nt, Pseudomonas aeruginosa PA01
gcggccgagggcgag

SEQ ID NO: 3499330 - RNA, 14 nt, Pseudomonas aeruginosa PA01
gcggccgaguucgc

SEQ ID NO: 3499331 - RNA, 19 nt, Pseudomonas aeruginosa PA01
gcggccgaguucgcgcagg

SEQ ID NO: 3499332 - RNA, 22 nt, Pseudomonas aeruginosa PA01
gcggccgaguucgcgcaggcgc

SEQ ID NO: 3499333 - RNA, 18 nt, Pseudomonas aeruginosa PA01
gcggccgaucaucggcug

SEQ ID NO: 3499334 - RNA, 19 nt, Pseudomonas aeruginosa PA01
gcggccgaucaucggcugg

SEQ ID NO: 3499335 - RNA, 21 nt, Pseudomonas aeruginosa PA01
gcggccgaugaucuccgcgcc

SEQ ID NO: 3499336 - RNA, 21 nt, Pseudomonas aeruginosa PA01
gcggccgaugcuaucgcgugg

SEQ ID NO: 3499337 - RNA, 18 nt, Pseudomonas aeruginosa PA01
gcggccgcaugccggggu

SEQ ID NO: 3499338 - RNA, 12 nt, Pseudomonas aeruginosa PA01
gcggccgccauc

SEQ ID NO: 3499339 - RNA, 18 nt, Pseudomonas aeruginosa PA01
gcggccgccaucgcccgg

SEQ ID NO: 3499340 - RNA, 16 nt, Pseudomonas aeruginosa PA01
gcggccgccauuccgg

SEQ ID NO: 3499341 - RNA, 13 nt, Pseudomonas aeruginosa PA01
gcggccgccgaaa

SEQ ID NO: 3499342 - RNA, 12 nt, Pseudomonas aeruginosa PA01
gcggccgccgag

SEQ ID NO: 3499343 - RNA, 13 nt, Pseudomonas aeruginosa PA01
gcggccgccgagc

SEQ ID NO: 3499344 - RNA, 16 nt, Pseudomonas aeruginosa PA01
gcggccgccgccgaca

SEQ ID NO: 3499345 - RNA, 22 nt, Pseudomonas aeruginosa PA01
gcggccgccgccgacaggucgc

SEQ ID NO: 3499346 - RNA, 14 nt, Pseudomonas aeruginosa PA01
gcggccgccgcgca

SEQ ID NO: 3499347 - RNA, 15 nt, Pseudomonas aeruginosa PA01
gcggccgccgcgcag

SEQ ID NO: 3499348 - RNA, 11 nt, Pseudomonas aeruginosa PA01
gcggccgccgg

SEQ ID NO: 3499349 - RNA, 13 nt, Pseudomonas aeruginosa PA01
gcggccgccggcg

SEQ ID NO: 3499350 - RNA, 15 nt, Pseudomonas aeruginosa PA01
gcggccgccggcgcc

SEQ ID NO: 3499351 - RNA, 16 nt, Pseudomonas aeruginosa PA01
gcggccgccggcgccc

SEQ ID NO: 3499352 - RNA, 17 nt, Pseudomonas aeruginosa PA01
gcggccgccggcgcccu

SEQ ID NO: 3499353 - RNA, 19 nt, Pseudomonas aeruginosa PA01
gcggccgccggcgcccugc

SEQ ID NO: 3499354 - RNA, 23 nt, Pseudomonas aeruginosa PA01
gcggccgccuugaccugcugggc

SEQ ID NO: 3499355 - RNA, 17 nt, Pseudomonas aeruginosa PA01
gcggccgcgagcgcggc

SEQ ID NO: 3499356 - RNA, 19 nt, Pseudomonas aeruginosa PA01
gcggccgcgagcgcggccg

SEQ ID NO: 3499357 - RNA, 17 nt, Pseudomonas aeruginosa PA01
gcggccggauggccgcc

SEQ ID NO: 3499358 - RNA, 19 nt, Pseudomonas aeruginosa PA01
gcggccggauggccgccgu

SEQ ID NO: 3499359 - RNA, 11 nt, Pseudomonas aeruginosa PA01
gcggccggcag

SEQ ID NO: 3499360 - RNA, 16 nt, Pseudomonas aeruginosa PA01
gcggccggcaggccga

SEQ ID NO: 3499361 - RNA, 13 nt, Pseudomonas aeruginosa PA01
gcggccggccagg

SEQ ID NO: 3499362 - RNA, 14 nt, Pseudomonas aeruginosa PA01
gcggccggccaggu

SEQ ID NO: 3499363 - RNA, 14 nt, Pseudomonas aeruginosa PA01
gcggccggcgaccu

SEQ ID NO: 3499364 - RNA, 14 nt, Pseudomonas aeruginosa PA01
gcggccggcgcggc

SEQ ID NO: 3499365 - RNA, 16 nt, Pseudomonas aeruginosa PA01
gcggccgggucgaggu

SEQ ID NO: 3499366 - RNA, 21 nt, Pseudomonas aeruginosa PA01
gcggccggugccuucggcggc

SEQ ID NO: 3499367 - RNA, 23 nt, Pseudomonas aeruginosa PA01
gcggccggugccuucggcggcgc

SEQ ID NO: 3499368 - RNA, 16 nt, Pseudomonas aeruginosa PA01
gcggccguagccgucg

SEQ ID NO: 3499369 - RNA, 17 nt, Pseudomonas aeruginosa PA01
gcggccguagccgucga

SEQ ID NO: 3499370 - RNA, 23 nt, Pseudomonas aeruginosa PA01
gcggccguagccgucgaacagca

SEQ ID NO: 3499371 - RNA, 15 nt, Pseudomonas aeruginosa PA01
gcggccgucggccug

SEQ ID NO: 3499372 - RNA, 17 nt, Pseudomonas aeruginosa PA01
gcggccgugcaugccga

SEQ ID NO: 3499373 - RNA, 20 nt, Pseudomonas aeruginosa PA01
gcggccgugcaugccgacga

SEQ ID NO: 3499374 - RNA, 13 nt, Pseudomonas aeruginosa PA01
gcggccguucgcc

SEQ ID NO: 3499375 - RNA, 22 nt, Pseudomonas aeruginosa PA01
gcggccguucuccgggucgggc

SEQ ID NO: 3499376 - RNA, 23 nt, Pseudomonas aeruginosa PA01
gcggccguucuccgggucgggcu

SEQ ID NO: 3499377 - RNA, 18 nt, Pseudomonas aeruginosa PA01
gcggccuacuugaucagc

SEQ ID NO: 3499378 - RNA, 22 nt, Pseudomonas aeruginosa PA01
gcggccuacuugaucagccgca

SEQ ID NO: 3499379 - RNA, 13 nt, Pseudomonas aeruginosa PA01
gcggccucaggcc

SEQ ID NO: 3499380 - RNA, 18 nt, Pseudomonas aeruginosa PA01
gcggccucaggccuggcg

SEQ ID NO: 3499381 - RNA, 19 nt, Pseudomonas aeruginosa PA01
gcggccucgaggucggccu

SEQ ID NO: 3499382 - RNA, 20 nt, Pseudomonas aeruginosa PA01
gcggccucgaggucggccug

SEQ ID NO: 3499383 - RNA, 21 nt, Pseudomonas aeruginosa PA01
gcggccucgaggucggccugg

SEQ ID NO: 3499384 - RNA, 17 nt, Pseudomonas aeruginosa PA01
gcggccucgauggcggc

SEQ ID NO: 3499385 - RNA, 18 nt, Pseudomonas aeruginosa PA01
gcggccucgauggcggca

SEQ ID NO: 3499386 - RNA, 12 nt, Pseudomonas aeruginosa PA01
gcggccucggcc

SEQ ID NO: 3499387 - RNA, 14 nt, Pseudomonas aeruginosa PA01
gcggccucggccuc

SEQ ID NO: 3499388 - RNA, 17 nt, Pseudomonas aeruginosa PA01
gcggccucggccucguc

SEQ ID NO: 3499389 - RNA, 20 nt, Pseudomonas aeruginosa PA01
gcggccucguucggcgacca

SEQ ID NO: 3499390 - RNA, 16 nt, Pseudomonas aeruginosa PA01
gcggccucuucgucgg

SEQ ID NO: 3499391 - RNA, 15 nt, Pseudomonas aeruginosa PA01
gcggccugagccggc

SEQ ID NO: 3499392 - RNA, 16 nt, Pseudomonas aeruginosa PA01
gcggccugagccggcc

SEQ ID NO: 3499393 - RNA, 17 nt, Pseudomonas aeruginosa PA01
gcggccugagccggccg

SEQ ID NO: 3499394 - RNA, 16 nt, Pseudomonas aeruginosa PA01
gcggccugagcugccg

SEQ ID NO: 3499395 - RNA, 14 nt, Pseudomonas aeruginosa PA01
gcggccugcaacgc

SEQ ID NO: 3499396 - RNA, 19 nt, Pseudomonas aeruginosa PA01
gcggccugcaacgccgcca

SEQ ID NO: 3499397 - RNA, 15 nt, Pseudomonas aeruginosa PA01
gcggccugcagcgac

SEQ ID NO: 3499398 - RNA, 16 nt, Pseudomonas aeruginosa PA01
gcggccugcagcgacu

SEQ ID NO: 3499399 - RNA, 15 nt, Pseudomonas aeruginosa PA01
gcggccugccccgcc

SEQ ID NO: 3499400 - RNA, 15 nt, Pseudomonas aeruginosa PA01
gcggccugcucgcgc

SEQ ID NO: 3499401 - RNA, 18 nt, Pseudomonas aeruginosa PA01
gcggccugcucgcgcagc

SEQ ID NO: 3499402 - RNA, 22 nt, Pseudomonas aeruginosa PA01
gcggccugcucgcgcagccagg

SEQ ID NO: 3499403 - RNA, 18 nt, Pseudomonas aeruginosa PA01
gcggccugcucggcucgc

SEQ ID NO: 3499404 - RNA, 19 nt, Pseudomonas aeruginosa PA01
gcggccugggccgaaggcc

SEQ ID NO: 3499405 - RNA, 21 nt, Pseudomonas aeruginosa PA01
gcggccugggccgaaggccag

SEQ ID NO: 3499406 - RNA, 17 nt, Pseudomonas aeruginosa PA01
gcggccuguucggccuu

SEQ ID NO: 3499407 - RNA, 19 nt, Pseudomonas aeruginosa PA01
gcggccuucagcgguggcg

SEQ ID NO: 3499408 - RNA, 17 nt, Pseudomonas aeruginosa PA01
gcggccuucucgucgcc

SEQ ID NO: 3499409 - RNA, 19 nt, Pseudomonas aeruginosa PA01
gcggccuucucgucgccgc

SEQ ID NO: 3499410 - RNA, 21 nt, Pseudomonas aeruginosa PA01
gcggccuucucgucgccgccc

SEQ ID NO: 3499411 - RNA, 19 nt, Pseudomonas aeruginosa PA01
gcggccuucuugcugccgg

SEQ ID NO: 3499412 - RNA, 21 nt, Pseudomonas aeruginosa PA01
gcggccuucuugcugccggcg

SEQ ID NO: 3499413 - RNA, 18 nt, Pseudomonas aeruginosa PA01
gcggccuuggucucgauc

SEQ ID NO: 3499414 - RNA, 23 nt, Pseudomonas aeruginosa PA01
gcggccuuuucggcggccaggcg

SEQ ID NO: 3499415 - RNA, 17 nt, Pseudomonas aeruginosa PA01
gcggccuuuucucugca

SEQ ID NO: 3499416 - RNA, 22 nt, Pseudomonas aeruginosa PA01
gcggccuuuucuuuauuccucc

SEQ ID NO: 3499417 - RNA, 22 nt, Pseudomonas aeruginosa PA01
gcggcgaaauggguucccagca

SEQ ID NO: 3499418 - RNA, 16 nt, Pseudomonas aeruginosa PA01
gcggcgaacaucaucc

SEQ ID NO: 3499419 - RNA, 17 nt, Pseudomonas aeruginosa PA01
gcggcgaacaucaucca

SEQ ID NO: 3499420 - RNA, 18 nt, Pseudomonas aeruginosa PA01
gcggcgaacaucauccac

SEQ ID NO: 3499421 - RNA, 22 nt, Pseudomonas aeruginosa PA01
gcggcgaacccucggugcggcc

SEQ ID NO: 3499422 - RNA, 15 nt, Pseudomonas aeruginosa PA01
gcggcgaacggaccg

SEQ ID NO: 3499423 - RNA, 17 nt, Pseudomonas aeruginosa PA01
gcggcgaagcgcaggcu

SEQ ID NO: 3499424 - RNA, 14 nt, Pseudomonas aeruginosa PA01
gcggcgaagcgcuc

SEQ ID NO: 3499425 - RNA, 19 nt, Pseudomonas aeruginosa PA01
gcggcgaagcguugcagcg

SEQ ID NO: 3499426 - RNA, 23 nt, Pseudomonas aeruginosa PA01
gcggcgaagcguugcagcgucug

SEQ ID NO: 3499427 - RNA, 15 nt, Pseudomonas aeruginosa PA01
gcggcgaagggcgcu

SEQ ID NO: 3499428 - RNA, 20 nt, Pseudomonas aeruginosa PA01
gcggcgaagggcgcuucggc

SEQ ID NO: 3499429 - RNA, 20 nt, Pseudomonas aeruginosa PA01
gcggcgaagguggcgaccug

SEQ ID NO: 3499430 - RNA, 22 nt, Pseudomonas aeruginosa PA01
gcggcgaagguggcgaccuggu

SEQ ID NO: 3499431 - RNA, 16 nt, Pseudomonas aeruginosa PA01
gcggcgaagucugccu

SEQ ID NO: 3499432 - RNA, 15 nt, Pseudomonas aeruginosa PA01
gcggcgacaccgcca

SEQ ID NO: 3499433 - RNA, 22 nt, Pseudomonas aeruginosa PA01
gcggcgacaccgccagcaccug

SEQ ID NO: 3499434 - RNA, 23 nt, Pseudomonas aeruginosa PA01
gcggcgacaccgccagcaccugg

SEQ ID NO: 3499435 - RNA, 24 nt, Pseudomonas aeruginosa PA01
gcggcgacaccgccagcaccuggc

SEQ ID NO: 3499436 - RNA, 14 nt, Pseudomonas aeruginosa PA01
gcggcgacagcacc

SEQ ID NO: 3499437 - RNA, 16 nt, Pseudomonas aeruginosa PA01
gcggcgaccauccagc

SEQ ID NO: 3499438 - RNA, 20 nt, Pseudomonas aeruginosa PA01
gcggcgaccauccagccugc

SEQ ID NO: 3499439 - RNA, 20 nt, Pseudomonas aeruginosa PA01
gcggcgaccauguucaccag

SEQ ID NO: 3499440 - RNA, 15 nt, Pseudomonas aeruginosa PA01
gcggcgacccagacc

SEQ ID NO: 3499441 - RNA, 13 nt, Pseudomonas aeruginosa PA01
gcggcgaccccga

SEQ ID NO: 3499442 - RNA, 17 nt, Pseudomonas aeruginosa PA01
gcggcgaccccgaucac

SEQ ID NO: 3499443 - RNA, 16 nt, Pseudomonas aeruginosa PA01
gcggcgaccggccuca

SEQ ID NO: 3499444 - RNA, 21 nt, Pseudomonas aeruginosa PA01
gcggcgaccggccucacgggu

SEQ ID NO: 3499445 - RNA, 19 nt, Pseudomonas aeruginosa PA01
gcggcgaccugcggcaagu

SEQ ID NO: 3499446 - RNA, 12 nt, Pseudomonas aeruginosa PA01
gcggcgaccugg

SEQ ID NO: 3499447 - RNA, 14 nt, Pseudomonas aeruginosa PA01
gcggcgaccugggc

SEQ ID NO: 3499448 - RNA, 19 nt, Pseudomonas aeruginosa PA01
gcggcgacgaagcccaggc

SEQ ID NO: 3499449 - RNA, 20 nt, Pseudomonas aeruginosa PA01
gcggcgacgaagcccaggcu

SEQ ID NO: 3499450 - RNA, 16 nt, Pseudomonas aeruginosa PA01
gcggcgacgaaggucg

SEQ ID NO: 3499451 - RNA, 17 nt, Pseudomonas aeruginosa PA01
gcggcgacgaaggucgg

SEQ ID NO: 3499452 - RNA, 19 nt, Pseudomonas aeruginosa PA01
gcggcgacgaaggucggcg

SEQ ID NO: 3499453 - RNA, 13 nt, Pseudomonas aeruginosa PA01
gcggcgacgauca

SEQ ID NO: 3499454 - RNA, 16 nt, Pseudomonas aeruginosa PA01
gcggcgacgccacccg

SEQ ID NO: 3499455 - RNA, 13 nt, Pseudomonas aeruginosa PA01
gcggcgacgcugg

SEQ ID NO: 3499456 - RNA, 14 nt, Pseudomonas aeruginosa PA01
gcggcgacggcucu

SEQ ID NO: 3499457 - RNA, 23 nt, Pseudomonas aeruginosa PA01
gcggcgagaucuucaggccgaag

SEQ ID NO: 3499458 - RNA, 14 nt, Pseudomonas aeruginosa PA01
gcggcgagcagcgg

SEQ ID NO: 3499459 - RNA, 23 nt, Pseudomonas aeruginosa PA01
gcggcgagcaggcgaacagggcc

SEQ ID NO: 3499460 - RNA, 14 nt, Pseudomonas aeruginosa PA01
gcggcgagcaucuc

SEQ ID NO: 3499461 - RNA, 17 nt, Pseudomonas aeruginosa PA01
gcggcgagcaucucggc

SEQ ID NO: 3499462 - RNA, 20 nt, Pseudomonas aeruginosa PA01
gcggcgagcaucucggccag

SEQ ID NO: 3499463 - RNA, 22 nt, Pseudomonas aeruginosa PA01
gcggcgagcaucucggccaggc

SEQ ID NO: 3499464 - RNA, 15 nt, Pseudomonas aeruginosa PA01
gcgcagggcggcgag

SEQ ID NO: 3499465 - RNA, 19 nt, Pseudomonas aeruginosa PA01
gcgcagggcggcgagcugg

SEQ ID NO: 3499466 - RNA, 21 nt, Pseudomonas aeruginosa PA01
gcgcagggcgucgaaggcggc

SEQ ID NO: 3499467 - RNA, 23 nt, Pseudomonas aeruginosa PA01
gcgcaggggcgagagacugaacu

SEQ ID NO: 3499468 - RNA, 14 nt, Pseudomonas aeruginosa PA01
gcgcaggggcgcgc

SEQ ID NO: 3499469 - RNA, 15 nt, Pseudomonas aeruginosa PA01
gcgcaggggcgcgcc

SEQ ID NO: 3499470 - RNA, 16 nt, Pseudomonas aeruginosa PA01
gcgcaggggcgcgccg

SEQ ID NO: 3499471 - RNA, 19 nt, Pseudomonas aeruginosa PA01
gcgcaggggcgcgccggcu

SEQ ID NO: 3499472 - RNA, 20 nt, Pseudomonas aeruginosa PA01
gcgcaggggcgcgccggcuu

SEQ ID NO: 3499473 - RNA, 18 nt, Pseudomonas aeruginosa PA01
gcgcaggggcgcggcgcg

SEQ ID NO: 3499474 - RNA, 19 nt, Pseudomonas aeruginosa PA01
gcgcaggggcgcggcgcgg

SEQ ID NO: 3499475 - RNA, 12 nt, Pseudomonas aeruginosa PA01
gcgcagggucag

SEQ ID NO: 3499476 - RNA, 14 nt, Pseudomonas aeruginosa PA01
gcgcagggucaggc

SEQ ID NO: 3499477 - RNA, 15 nt, Pseudomonas aeruginosa PA01
gcgcagggucaggcc

SEQ ID NO: 3499478 - RNA, 17 nt, Pseudomonas aeruginosa PA01
gcgcagggucaggcccu

SEQ ID NO: 3499479 - RNA, 16 nt, Pseudomonas aeruginosa PA01
gcgcagggugagcaug

SEQ ID NO: 3499480 - RNA, 16 nt, Pseudomonas aeruginosa PA01
gcgcagguacucgccg

SEQ ID NO: 3499481 - RNA, 19 nt, Pseudomonas aeruginosa PA01
gcgcagguacucgccggcg

SEQ ID NO: 3499482 - RNA, 22 nt, Pseudomonas aeruginosa PA01
gcgcagguacucgccggcgauc

SEQ ID NO: 3499483 - RNA, 22 nt, Pseudomonas aeruginosa PA01
gcgcagguagaaggugcccagc

SEQ ID NO: 3499484 - RNA, 23 nt, Pseudomonas aeruginosa PA01
gcgcagguagaaggugcccagcg

SEQ ID NO: 3499485 - RNA, 16 nt, Pseudomonas aeruginosa PA01
gcgcagguagcggcga

SEQ ID NO: 3499486 - RNA, 18 nt, Pseudomonas aeruginosa PA01
gcgcagguagcggcgaag

SEQ ID NO: 3499487 - RNA, 15 nt, Pseudomonas aeruginosa PA01
gcgcaggucgcuggc

SEQ ID NO: 3499488 - RNA, 18 nt, Pseudomonas aeruginosa PA01
gcgcaggucgcuggcguc

SEQ ID NO: 3499489 - RNA, 22 nt, Pseudomonas aeruginosa PA01
gcgcaggucgcuggcgucgacc

SEQ ID NO: 3499490 - RNA, 15 nt, Pseudomonas aeruginosa PA01
gcgcaggucggccuc

SEQ ID NO: 3499491 - RNA, 17 nt, Pseudomonas aeruginosa PA01
gcgcaggugcaccgcgc

SEQ ID NO: 3499492 - RNA, 16 nt, Pseudomonas aeruginosa PA01
gcgcaggugcuuggca

SEQ ID NO: 3499493 - RNA, 23 nt, Pseudomonas aeruginosa PA01
gcgcaggugcuuggcaccgcgca

SEQ ID NO: 3499494 - RNA, 14 nt, Pseudomonas aeruginosa PA01
gcgcaggugcuugu

SEQ ID NO: 3499495 - RNA, 18 nt, Pseudomonas aeruginosa PA01
gcgcaggugcuugucacg

SEQ ID NO: 3499496 - RNA, 16 nt, Pseudomonas aeruginosa PA01
gcgcagguucaucgcc

SEQ ID NO: 3499497 - RNA, 17 nt, Pseudomonas aeruginosa PA01
gcgcagguucaucgccg

SEQ ID NO: 3499498 - RNA, 18 nt, Pseudomonas aeruginosa PA01
gcgcagguucaucgccgc

SEQ ID NO: 3499499 - RNA, 18 nt, Pseudomonas aeruginosa PA01
gcgcagguugagggccgc

SEQ ID NO: 3499500 - RNA, 17 nt, Pseudomonas aeruginosa PA01
gcgcagguugcgcuggc

SEQ ID NO: 3499501 - RNA, 19 nt, Pseudomonas aeruginosa PA01
gcgcagguugcgcuggcgc

SEQ ID NO: 3499502 - RNA, 21 nt, Pseudomonas aeruginosa PA01
gcgcagguugcgcuggcgcag

SEQ ID NO: 3499503 - RNA, 17 nt, Pseudomonas aeruginosa PA01
gcgcaguacccggccgc

SEQ ID NO: 3499504 - RNA, 18 nt, Pseudomonas aeruginosa PA01
gcgcaguacccggccgcc

SEQ ID NO: 3499505 - RNA, 18 nt, Pseudomonas aeruginosa PA01
gcgcaguagcuggaucug

SEQ ID NO: 3499506 - RNA, 16 nt, Pseudomonas aeruginosa PA01
gcgcaguaggccuggu

SEQ ID NO: 3499507 - RNA, 14 nt, Pseudomonas aeruginosa PA01
gcgcaguaggcgcu

SEQ ID NO: 3499508 - RNA, 13 nt, Pseudomonas aeruginosa PA01
gcgcaguagucga

SEQ ID NO: 3499509 - RNA, 16 nt, Pseudomonas aeruginosa PA01
gcgcagucccgcgcgg

SEQ ID NO: 3499510 - RNA, 17 nt, Pseudomonas aeruginosa PA01
gcgcagucccgcgcggc

SEQ ID NO: 3499511 - RNA, 18 nt, Pseudomonas aeruginosa PA01
gcgcagucccgcgcggcc

SEQ ID NO: 3499512 - RNA, 19 nt, Pseudomonas aeruginosa PA01
gcgcaguccgguagcgcgc

SEQ ID NO: 3499513 - RNA, 22 nt, Pseudomonas aeruginosa PA01
gcgcaguccgguagcgcgccug

SEQ ID NO: 3499514 - RNA, 16 nt, Pseudomonas aeruginosa PA01
gcgcaguucagggcgu

SEQ ID NO: 3499515 - RNA, 22 nt, Pseudomonas aeruginosa PA01
gcgcaguuccuucaccggacgg

SEQ ID NO: 3499516 - RNA, 17 nt, Pseudomonas aeruginosa PA01
gcgcaguucgccgccga

SEQ ID NO: 3499517 - RNA, 22 nt, Pseudomonas aeruginosa PA01
gcgcaguucgccgccgagcgcc

SEQ ID NO: 3499518 - RNA, 23 nt, Pseudomonas aeruginosa PA01
gcgcaguucguccaucgccaggc

SEQ ID NO: 3499519 - RNA, 18 nt, Pseudomonas aeruginosa PA01
gcgcaguucgucgcccau

SEQ ID NO: 3499520 - RNA, 23 nt, Pseudomonas aeruginosa PA01
gcgcaguucgucuuccagcggcc

SEQ ID NO: 3499521 - RNA, 24 nt, Pseudomonas aeruginosa PA01
gcgcaguucgucuuccagcggcca

SEQ ID NO: 3499522 - RNA, 17 nt, Pseudomonas aeruginosa PA01
gcgcaguugccaggagg

SEQ ID NO: 3499523 - RNA, 19 nt, Pseudomonas aeruginosa PA01
gcgcauaaccgcucgcggu

SEQ ID NO: 3499524 - RNA, 17 nt, Pseudomonas aeruginosa PA01
gcgcauacggaugcuga

SEQ ID NO: 3499525 - RNA, 14 nt, Pseudomonas aeruginosa PA01
gcgcauagcaggcc

SEQ ID NO: 3499526 - RNA, 17 nt, Pseudomonas aeruginosa PA01
gcgcauagccaccgccg

SEQ ID NO: 3499527 - RNA, 13 nt, Pseudomonas aeruginosa PA01
gcgcauagcggcc

SEQ ID NO: 3499528 - RNA, 15 nt, Pseudomonas aeruginosa PA01
gcgcaucagcgccgg

SEQ ID NO: 3499529 - RNA, 22 nt, Pseudomonas aeruginosa PA01
gcgcaucaggucggucuggcgg

SEQ ID NO: 3499530 - RNA, 19 nt, Pseudomonas aeruginosa PA01
gcgcauccgcccgaucgcc

SEQ ID NO: 3499531 - RNA, 14 nt, Pseudomonas aeruginosa PA01
gcgcauccucggca

SEQ ID NO: 3499532 - RNA, 15 nt, Pseudomonas aeruginosa PA01
gcgcaucgaggccgg

SEQ ID NO: 3499533 - RNA, 14 nt, Pseudomonas aeruginosa PA01
gcgcaucgaugccu

SEQ ID NO: 3499534 - RNA, 16 nt, Pseudomonas aeruginosa PA01
gcgcaucgccugggcc

SEQ ID NO: 3499535 - RNA, 14 nt, Pseudomonas aeruginosa PA01
gcgcaucgcggaca

SEQ ID NO: 3499536 - RNA, 16 nt, Pseudomonas aeruginosa PA01
gcgcaucggcgccucc

SEQ ID NO: 3499537 - RNA, 22 nt, Pseudomonas aeruginosa PA01
gcgcaucggugccggcaggccu

SEQ ID NO: 3499538 - RNA, 12 nt, Pseudomonas aeruginosa PA01
gcgcaucgucga

SEQ ID NO: 3499539 - RNA, 23 nt, Pseudomonas aeruginosa PA01
gcgcaucgucgaaacgcuggcgg

SEQ ID NO: 3499540 - RNA, 24 nt, Pseudomonas aeruginosa PA01
gcgcaucgucgaaacgcuggcggc

SEQ ID NO: 3499541 - RNA, 17 nt, Pseudomonas aeruginosa PA01
gcgcaucgugcagccag

SEQ ID NO: 3499542 - RNA, 20 nt, Pseudomonas aeruginosa PA01
gcgcaucgugcagccagacc

SEQ ID NO: 3499543 - RNA, 19 nt, Pseudomonas aeruginosa PA01
gcgcaucuggugcgcgucc

SEQ ID NO: 3499544 - RNA, 19 nt, Pseudomonas aeruginosa PA01
gcgcaugaaaaagcccggc

SEQ ID NO: 3499545 - RNA, 20 nt, Pseudomonas aeruginosa PA01
gcgcaugaaaaagcccggca

SEQ ID NO: 3499546 - RNA, 21 nt, Pseudomonas aeruginosa PA01
gcgcaugaaaaagccgcccac

SEQ ID NO: 3499547 - RNA, 20 nt, Pseudomonas aeruginosa PA01
gcgcaugaccuucagcaccu

SEQ ID NO: 3499548 - RNA, 18 nt, Pseudomonas aeruginosa PA01
gcgcaugaggcuggccag

SEQ ID NO: 3499549 - RNA, 13 nt, Pseudomonas aeruginosa PA01
gcgcaugaucgcc

SEQ ID NO: 3499550 - RNA, 21 nt, Pseudomonas aeruginosa PA01
gcgcaugaucgccucggcgcg

SEQ ID NO: 3499551 - RNA, 17 nt, Pseudomonas aeruginosa PA01
gcgcaugcagggcgucc

SEQ ID NO: 3499552 - RNA, 21 nt, Pseudomonas aeruginosa PA01
gcgcaugcccagggccagcag

SEQ ID NO: 3499553 - RNA, 14 nt, Pseudomonas aeruginosa PA01
gcgcaugcccgcgu

SEQ ID NO: 3499554 - RNA, 13 nt, Pseudomonas aeruginosa PA01
gcgcaugccguug

SEQ ID NO: 3499555 - RNA, 21 nt, Pseudomonas aeruginosa PA01
gcgcaugccguuggccgagcg

SEQ ID NO: 3499556 - RNA, 16 nt, Pseudomonas aeruginosa PA01
gcgcaugcgcagcgcg

SEQ ID NO: 3499557 - RNA, 19 nt, Pseudomonas aeruginosa PA01
gcgcaugcgcagcgcguug

SEQ ID NO: 3499558 - RNA, 13 nt, Pseudomonas aeruginosa PA01
gcgcaugcugggu

SEQ ID NO: 3499559 - RNA, 15 nt, Pseudomonas aeruginosa PA01
gcgcauggacagguc

SEQ ID NO: 3499560 - RNA, 17 nt, Pseudomonas aeruginosa PA01
gcgcauggacaggucga

SEQ ID NO: 3499561 - RNA, 21 nt, Pseudomonas aeruginosa PA01
gcgcauggacaggucgacggc

SEQ ID NO: 3499562 - RNA, 14 nt, Pseudomonas aeruginosa PA01
gcgcauggcgaccu

SEQ ID NO: 3499563 - RNA, 20 nt, Pseudomonas aeruginosa PA01
gcgcauggcgaccugguggc

SEQ ID NO: 3499564 - RNA, 22 nt, Pseudomonas aeruginosa PA01
gcgcauggcgaccugguggcgc

SEQ ID NO: 3499565 - RNA, 13 nt, Pseudomonas aeruginosa PA01
gcgcauggcgcuc

SEQ ID NO: 3499566 - RNA, 12 nt, Pseudomonas aeruginosa PA01
gcgcauggcggc

SEQ ID NO: 3499567 - RNA, 13 nt, Pseudomonas aeruginosa PA01
gcgcauggcggcg

SEQ ID NO: 3499568 - RNA, 14 nt, Pseudomonas aeruginosa PA01
gcgcauggcggcga

SEQ ID NO: 3499569 - RNA, 15 nt, Pseudomonas aeruginosa PA01
gcgcauggcggcgac

SEQ ID NO: 3499570 - RNA, 19 nt, Pseudomonas aeruginosa PA01
gcgcauggcguucugcgac

SEQ ID NO: 3499571 - RNA, 20 nt, Pseudomonas aeruginosa PA01
gcgcaugguuaccucguugc

SEQ ID NO: 3499572 - RNA, 14 nt, Pseudomonas aeruginosa PA01
gcgcauguccagcc

SEQ ID NO: 3499573 - RNA, 15 nt, Pseudomonas aeruginosa PA01
gcgcauguccagcca

SEQ ID NO: 3499574 - RNA, 16 nt, Pseudomonas aeruginosa PA01
gcgcauguccagccag

SEQ ID NO: 3499575 - RNA, 21 nt, Pseudomonas aeruginosa PA01
gcgcauguccagccaguggcu

SEQ ID NO: 3499576 - RNA, 14 nt, Pseudomonas aeruginosa PA01
gcgcaugucgcgau

SEQ ID NO: 3499577 - RNA, 20 nt, Pseudomonas aeruginosa PA01
gcgccaaaaagcaggacggc

SEQ ID NO: 3499578 - RNA, 21 nt, Pseudomonas aeruginosa PA01
gcgccaaaaagcaggacggcg

SEQ ID NO: 3499579 - RNA, 15 nt, Pseudomonas aeruginosa PA01
gcgccaaccgggcag

SEQ ID NO: 3499580 - RNA, 20 nt, Pseudomonas aeruginosa PA01
gcgccaaccgggcagcagcc

SEQ ID NO: 3499581 - RNA, 21 nt, Pseudomonas aeruginosa PA01
gcgccaaccgggcagcagccg

SEQ ID NO: 3499582 - RNA, 21 nt, Pseudomonas aeruginosa PA01
gcgccaacuggcgcaacugca

SEQ ID NO: 3499583 - RNA, 19 nt, Pseudomonas aeruginosa PA01
gcgccaaggccgccaggcc

SEQ ID NO: 3499584 - RNA, 22 nt, Pseudomonas aeruginosa PA01
gcgccacacggcuaucagguga

SEQ ID NO: 3499585 - RNA, 19 nt, Pseudomonas aeruginosa PA01
gcgccaccaccgucacggc

SEQ ID NO: 3499586 - RNA, 13 nt, Pseudomonas aeruginosa PA01
gcgccaccagcag

SEQ ID NO: 3499587 - RNA, 15 nt, Pseudomonas aeruginosa PA01
gcgccaccagcaggg

SEQ ID NO: 3499588 - RNA, 19 nt, Pseudomonas aeruginosa PA01
gcgccaccagcagggccag

SEQ ID NO: 3499589 - RNA, 20 nt, Pseudomonas aeruginosa PA01
gcgccaccagcagggccagg

SEQ ID NO: 3499590 - RNA, 22 nt, Pseudomonas aeruginosa PA01
gcgccaccagcagggccaggcc

SEQ ID NO: 3499591 - RNA, 15 nt, Pseudomonas aeruginosa PA01
gcgccaccagcaugc

SEQ ID NO: 3499592 - RNA, 20 nt, Pseudomonas aeruginosa PA01
gcgccaccagcaugcccagc

SEQ ID NO: 3499593 - RNA, 17 nt, Pseudomonas aeruginosa PA01
gcgccaccagcguggcg

SEQ ID NO: 3499594 - RNA, 20 nt, Pseudomonas aeruginosa PA01
gcgccaccagcguggcgcgc

SEQ ID NO: 3499595 - RNA, 20 nt, Pseudomonas aeruginosa PA01
gcgccaccaggaaaucgccg

SEQ ID NO: 3499596 - RNA, 14 nt, Pseudomonas aeruginosa PA01
gcgccaccccgccg

SEQ ID NO: 3499597 - RNA, 18 nt, Pseudomonas aeruginosa PA01
gcgccaccccgccgcgca

SEQ ID NO: 3499598 - RNA, 14 nt, Pseudomonas aeruginosa PA01
gcgccacccucggc

SEQ ID NO: 3499599 - RNA, 15 nt, Pseudomonas aeruginosa PA01
gcgccaccgauagcg

SEQ ID NO: 3499600 - RNA, 19 nt, Pseudomonas aeruginosa PA01
gcgccaccgauagcggcgc

SEQ ID NO: 3499601 - RNA, 22 nt, Pseudomonas aeruginosa PA01
gcgccaccgauagcggcgcgag

SEQ ID NO: 3499602 - RNA, 19 nt, Pseudomonas aeruginosa PA01
gcgccaccgauucgccggc

SEQ ID NO: 3499603 - RNA, 21 nt, Pseudomonas aeruginosa PA01
gcgccaccgauucgccggcca

SEQ ID NO: 3499604 - RNA, 17 nt, Pseudomonas aeruginosa PA01
gcgccaccgcgacgcgc

SEQ ID NO: 3499605 - RNA, 20 nt, Pseudomonas aeruginosa PA01
gcgccaccgcguugaccgug

SEQ ID NO: 3499606 - RNA, 17 nt, Pseudomonas aeruginosa PA01
gcgccaccugguucauc

SEQ ID NO: 3499607 - RNA, 21 nt, Pseudomonas aeruginosa PA01
gcgccacgcaaacccauuucc

SEQ ID NO: 3499608 - RNA, 13 nt, Pseudomonas aeruginosa PA01
gcgccacgcagga

SEQ ID NO: 3499609 - RNA, 14 nt, Pseudomonas aeruginosa PA01
gcgccacgcaggaa

SEQ ID NO: 3499610 - RNA, 15 nt, Pseudomonas aeruginosa PA01
gcgccacgcaggaac

SEQ ID NO: 3499611 - RNA, 21 nt, Pseudomonas aeruginosa PA01
gcgccacgcaggaacagcucc

SEQ ID NO: 3499612 - RNA, 20 nt, Pseudomonas aeruginosa PA01
gcgccacgcgagaagccgcc

SEQ ID NO: 3499613 - RNA, 21 nt, Pseudomonas aeruginosa PA01
gcgccacgcugaucaucagca

SEQ ID NO: 3499614 - RNA, 22 nt, Pseudomonas aeruginosa PA01
gcgccacgcugaucaucagcag

SEQ ID NO: 3499615 - RNA, 13 nt, Pseudomonas aeruginosa PA01
gcgccacggccag

SEQ ID NO: 3499616 - RNA, 16 nt, Pseudomonas aeruginosa PA01
gcgccacggccagcag

SEQ ID NO: 3499617 - RNA, 17 nt, Pseudomonas aeruginosa PA01
gcgccacggccagcagg

SEQ ID NO: 3499618 - RNA, 18 nt, Pseudomonas aeruginosa PA01
gcgccacggcgaucgccg

SEQ ID NO: 3499619 - RNA, 15 nt, Pseudomonas aeruginosa PA01
gcgccacuuccagcu

SEQ ID NO: 3499620 - RNA, 22 nt, Pseudomonas aeruginosa PA01
gcgccagaacggcuuguucagc

SEQ ID NO: 3499621 - RNA, 23 nt, Pseudomonas aeruginosa PA01
gcgccagaagcggccgaccaggc

SEQ ID NO: 3499622 - RNA, 18 nt, Pseudomonas aeruginosa PA01
gcgccagaagguaucggc

SEQ ID NO: 3499623 - RNA, 23 nt, Pseudomonas aeruginosa PA01
gcgccagaagguaucggccaugg

SEQ ID NO: 3499624 - RNA, 16 nt, Pseudomonas aeruginosa PA01
gcgccagaccagcccc

SEQ ID NO: 3499625 - RNA, 18 nt, Pseudomonas aeruginosa PA01
gcgccagagaucgcccag

SEQ ID NO: 3499626 - RNA, 22 nt, Pseudomonas aeruginosa PA01
gcgccagagaucgcccagcggc

SEQ ID NO: 3499627 - RNA, 24 nt, Pseudomonas aeruginosa PA01
gcgccagagaucgcccagcggcug

SEQ ID NO: 3499628 - RNA, 13 nt, Pseudomonas aeruginosa PA01
gcgccagagcagg

SEQ ID NO: 3499629 - RNA, 14 nt, Pseudomonas aeruginosa PA01
gcgccagagcaggc

SEQ ID NO: 3499630 - RNA, 17 nt, Pseudomonas aeruginosa PA01
gcgccagagcaggcgga

SEQ ID NO: 3499631 - RNA, 14 nt, Pseudomonas aeruginosa PA01
gcgccagagcgcgc

SEQ ID NO: 3499632 - RNA, 16 nt, Pseudomonas aeruginosa PA01
gcgccagcaccagcag

SEQ ID NO: 3499633 - RNA, 17 nt, Pseudomonas aeruginosa PA01
gcgccagcaccagcagg

SEQ ID NO: 3499634 - RNA, 19 nt, Pseudomonas aeruginosa PA01
gcgccagcaccguggucag

SEQ ID NO: 3499635 - RNA, 18 nt, Pseudomonas aeruginosa PA01
gcgccagcacggcgcagg

SEQ ID NO: 3499636 - RNA, 14 nt, Pseudomonas aeruginosa PA01
gcgccagcaggcga

SEQ ID NO: 3499637 - RNA, 15 nt, Pseudomonas aeruginosa PA01
gcgccagcaggcgau

SEQ ID NO: 3499638 - RNA, 15 nt, Pseudomonas aeruginosa PA01
gcgccagcaggcgca

SEQ ID NO: 3499639 - RNA, 16 nt, Pseudomonas aeruginosa PA01
gcgccagcaggcgcag

SEQ ID NO: 3499640 - RNA, 20 nt, Pseudomonas aeruginosa PA01
gcgccagcagguacagcagc

SEQ ID NO: 3499641 - RNA, 16 nt, Pseudomonas aeruginosa PA01
gcgccagcaggucgcg

SEQ ID NO: 3499642 - RNA, 19 nt, Pseudomonas aeruginosa PA01
gcgccagcaggucgcgcug

SEQ ID NO: 3499643 - RNA, 17 nt, Pseudomonas aeruginosa PA01
gcgccagcagguggucg

SEQ ID NO: 3499644 - RNA, 12 nt, Pseudomonas aeruginosa PA01
gcgccagcaucg

SEQ ID NO: 3499645 - RNA, 14 nt, Pseudomonas aeruginosa PA01
gcgccagcaucgca

SEQ ID NO: 3499646 - RNA, 23 nt, Pseudomonas aeruginosa PA01
gcgccagcaucgcaucggcgacc

SEQ ID NO: 3499647 - RNA, 13 nt, Pseudomonas aeruginosa PA01
gcgccagccacuc

SEQ ID NO: 3499648 - RNA, 18 nt, Pseudomonas aeruginosa PA01
gcgccagccacucccggc

SEQ ID NO: 3499649 - RNA, 21 nt, Pseudomonas aeruginosa PA01
gcgccagccacucccggcccu

SEQ ID NO: 3499650 - RNA, 12 nt, Pseudomonas aeruginosa PA01
gcgccagccagc

SEQ ID NO: 3499651 - RNA, 15 nt, Pseudomonas aeruginosa PA01
gcgccagccagcccg

SEQ ID NO: 3499652 - RNA, 16 nt, Pseudomonas aeruginosa PA01
gcgccagccagcccgg

SEQ ID NO: 3499653 - RNA, 14 nt, Pseudomonas aeruginosa PA01
gcgccagccagcgc

SEQ ID NO: 3499654 - RNA, 19 nt, Pseudomonas aeruginosa PA01
gcgccagccagcgcggcuc

SEQ ID NO: 3499655 - RNA, 21 nt, Pseudomonas aeruginosa PA01
gcgccagccagcgcggcucgg

SEQ ID NO: 3499656 - RNA, 22 nt, Pseudomonas aeruginosa PA01
gcgccagccaggaagagcccgc

SEQ ID NO: 3499657 - RNA, 14 nt, Pseudomonas aeruginosa PA01
gcgccagccagggu

SEQ ID NO: 3499658 - RNA, 19 nt, Pseudomonas aeruginosa PA01
gcgccagccccaggcgcgg

SEQ ID NO: 3499659 - RNA, 20 nt, Pseudomonas aeruginosa PA01
gcgccagccccaggcgcggc

SEQ ID NO: 3499660 - RNA, 13 nt, Pseudomonas aeruginosa PA01
gcgccagccgacu

SEQ ID NO: 3499661 - RNA, 21 nt, Pseudomonas aeruginosa PA01
gcgccagccuacugggcgugg

SEQ ID NO: 3499662 - RNA, 12 nt, Pseudomonas aeruginosa PA01
gcgccagcgaga

SEQ ID NO: 3499663 - RNA, 22 nt, Pseudomonas aeruginosa PA01
gcgccagcgagacgggcgaggc

SEQ ID NO: 3499664 - RNA, 11 nt, Pseudomonas aeruginosa PA01
gcgccagcgcc

SEQ ID NO: 3499665 - RNA, 12 nt, Pseudomonas aeruginosa PA01
gcgccagcgcca

SEQ ID NO: 3499666 - RNA, 13 nt, Pseudomonas aeruginosa PA01
gcgccagcgccac

SEQ ID NO: 3499667 - RNA, 19 nt, Pseudomonas aeruginosa PA01
gcgccagcgccacggcgau

SEQ ID NO: 3499668 - RNA, 14 nt, Pseudomonas aeruginosa PA01
gcgccagcgcccca

SEQ ID NO: 3499669 - RNA, 15 nt, Pseudomonas aeruginosa PA01
gcgccagcgccccac

SEQ ID NO: 3499670 - RNA, 16 nt, Pseudomonas aeruginosa PA01
gcgccagcgccccacc

SEQ ID NO: 3499671 - RNA, 19 nt, Pseudomonas aeruginosa PA01
gccuuuuuugugcccggcg

SEQ ID NO: 3499672 - RNA, 24 nt, Pseudomonas aeruginosa PA01
gcgaaaaauacuccgcgacgucca

SEQ ID NO: 3499673 - RNA, 11 nt, Pseudomonas aeruginosa PA01
gcgaaaaccgg

SEQ ID NO: 3499674 - RNA, 14 nt, Pseudomonas aeruginosa PA01
gcgaaaacggcgac

SEQ ID NO: 3499675 - RNA, 15 nt, Pseudomonas aeruginosa PA01
gcgaaaacggcgacc

SEQ ID NO: 3499676 - RNA, 16 nt, Pseudomonas aeruginosa PA01
gcgaaaacggcgaccc

SEQ ID NO: 3499677 - RNA, 19 nt, Pseudomonas aeruginosa PA01
gcgaaaacucccggccugg

SEQ ID NO: 3499678 - RNA, 15 nt, Pseudomonas aeruginosa PA01
gcgaaaagcccgcca

SEQ ID NO: 3499679 - RNA, 13 nt, Pseudomonas aeruginosa PA01
gcgaaaccggcca

SEQ ID NO: 3499680 - RNA, 14 nt, Pseudomonas aeruginosa PA01
gcgaaaccggccag

SEQ ID NO: 3499681 - RNA, 20 nt, Pseudomonas aeruginosa PA01
gcgaaaccggccagcgcggc

SEQ ID NO: 3499682 - RNA, 16 nt, Pseudomonas aeruginosa PA01
gcgaaacggcaggcca

SEQ ID NO: 3499683 - RNA, 19 nt, Pseudomonas aeruginosa PA01
gcgaaacggcaggccagca

SEQ ID NO: 3499684 - RNA, 15 nt, Pseudomonas aeruginosa PA01
gcgaaacggcgcuga

SEQ ID NO: 3499685 - RNA, 18 nt, Pseudomonas aeruginosa PA01
gcgaaacucgugcuccac

SEQ ID NO: 3499686 - RNA, 15 nt, Pseudomonas aeruginosa PA01
gcgaaagaacaacuc

SEQ ID NO: 3499687 - RNA, 15 nt, Pseudomonas aeruginosa PA01
gcgaaagcgccccgg

SEQ ID NO: 3499688 - RNA, 21 nt, Pseudomonas aeruginosa PA01
gcgaaagcgucagcgcgccag

SEQ ID NO: 3499689 - RNA, 20 nt, Pseudomonas aeruginosa PA01
gcgaaagggucaggccuuga

SEQ ID NO: 3499690 - RNA, 16 nt, Pseudomonas aeruginosa PA01
gcgaaagucggcgcga

SEQ ID NO: 3499691 - RNA, 16 nt, Pseudomonas aeruginosa PA01
gcgaaauggcagaaca

SEQ ID NO: 3499692 - RNA, 22 nt, Pseudomonas aeruginosa PA01
gcgaaauggguucccagcagca

SEQ ID NO: 3499693 - RNA, 22 nt, Pseudomonas aeruginosa PA01
gcgaaauugccuccgcucugcu

SEQ ID NO: 3499694 - RNA, 13 nt, Pseudomonas aeruginosa PA01
gcgaacaaccgcu

SEQ ID NO: 3499695 - RNA, 14 nt, Pseudomonas aeruginosa PA01
gcgaacaacgccgc

SEQ ID NO: 3499696 - RNA, 20 nt, Pseudomonas aeruginosa PA01
gcgaacaacgccgccggcgu

SEQ ID NO: 3499697 - RNA, 17 nt, Pseudomonas aeruginosa PA01
gcgaacaaucggucgcc

SEQ ID NO: 3499698 - RNA, 18 nt, Pseudomonas aeruginosa PA01
gcgaacaaucggucgccc

SEQ ID NO: 3499699 - RNA, 21 nt, Pseudomonas aeruginosa PA01
gcgaacacacccugcgcaagg

SEQ ID NO: 3499700 - RNA, 17 nt, Pseudomonas aeruginosa PA01
gcgaacacaccgaccgc

SEQ ID NO: 3499701 - RNA, 19 nt, Pseudomonas aeruginosa PA01
gcgaacaccgggccgccgg

SEQ ID NO: 3499702 - RNA, 16 nt, Pseudomonas aeruginosa PA01
gcgaacacgucggcgc

SEQ ID NO: 3499703 - RNA, 21 nt, Pseudomonas aeruginosa PA01
gcgaacagcaccuuggccaug

SEQ ID NO: 3499704 - RNA, 23 nt, Pseudomonas aeruginosa PA01
gcgaacagcagcgguaggcgcgu

SEQ ID NO: 3499705 - RNA, 18 nt, Pseudomonas aeruginosa PA01
gcgaacagcgagacccgg

SEQ ID NO: 3499706 - RNA, 14 nt, Pseudomonas aeruginosa PA01
gcgaacagcgccgc

SEQ ID NO: 3499707 - RNA, 17 nt, Pseudomonas aeruginosa PA01
gcgaacagcgccgcggc

SEQ ID NO: 3499708 - RNA, 20 nt, Pseudomonas aeruginosa PA01
gcgaacagcgccgcggcugg

SEQ ID NO: 3499709 - RNA, 16 nt, Pseudomonas aeruginosa PA01
gcgaacagcgcuuccu

SEQ ID NO: 3499710 - RNA, 18 nt, Pseudomonas aeruginosa PA01
gcgaacagcgcuuccugg

SEQ ID NO: 3499711 - RNA, 15 nt, Pseudomonas aeruginosa PA01
gcgaacaggcagcgg

SEQ ID NO: 3499712 - RNA, 21 nt, Pseudomonas aeruginosa PA01
gcgaacaggcagcgggccagg

SEQ ID NO: 3499713 - RNA, 18 nt, Pseudomonas aeruginosa PA01
gcgaacaguuccgacugc

SEQ ID NO: 3499714 - RNA, 15 nt, Pseudomonas aeruginosa PA01
gcgaacaucauccac

SEQ ID NO: 3499715 - RNA, 21 nt, Pseudomonas aeruginosa PA01
gcgaacaugaagccgcgcgcc

SEQ ID NO: 3499716 - RNA, 14 nt, Pseudomonas aeruginosa PA01
gcgaaccacaccag

SEQ ID NO: 3499717 - RNA, 17 nt, Pseudomonas aeruginosa PA01
gcgaaccacaccagguc

SEQ ID NO: 3499718 - RNA, 22 nt, Pseudomonas aeruginosa PA01
gcgaaccacaccaggucgccgc

SEQ ID NO: 3499719 - RNA, 23 nt, Pseudomonas aeruginosa PA01
gcgaaccacaccaggucgccgca

SEQ ID NO: 3499720 - RNA, 13 nt, Pseudomonas aeruginosa PA01
gcgaaccagcagc

SEQ ID NO: 3499721 - RNA, 14 nt, Pseudomonas aeruginosa PA01
gcgaaccagcagca

SEQ ID NO: 3499722 - RNA, 17 nt, Pseudomonas aeruginosa PA01
gcgaaccagcagcaggu

SEQ ID NO: 3499723 - RNA, 22 nt, Pseudomonas aeruginosa PA01
gcgaaccaggcaauggccggcg

SEQ ID NO: 3499724 - RNA, 23 nt, Pseudomonas aeruginosa PA01
gcgaaccaggcaauggccggcgg

SEQ ID NO: 3499725 - RNA, 17 nt, Pseudomonas aeruginosa PA01
gcgaaccaggcggccga

SEQ ID NO: 3499726 - RNA, 15 nt, Pseudomonas aeruginosa PA01
gcgaaccaguccagc

SEQ ID NO: 3499727 - RNA, 16 nt, Pseudomonas aeruginosa PA01
gcgaaccaguccagca

SEQ ID NO: 3499728 - RNA, 19 nt, Pseudomonas aeruginosa PA01
gcgaaccagugcaccgccg

SEQ ID NO: 3499729 - RNA, 20 nt, Pseudomonas aeruginosa PA01
gcgaaccagugcaccgccgg

SEQ ID NO: 3499730 - RNA, 12 nt, Pseudomonas aeruginosa PA01
gcgaacccaggc

SEQ ID NO: 3499731 - RNA, 14 nt, Pseudomonas aeruginosa PA01
gcgaacccaggccg

SEQ ID NO: 3499732 - RNA, 17 nt, Pseudomonas aeruginosa PA01
gcgaacccaggccgcgc

SEQ ID NO: 3499733 - RNA, 22 nt, Pseudomonas aeruginosa PA01
gcgaacccgaaucccuuggcug

SEQ ID NO: 3499734 - RNA, 18 nt, Pseudomonas aeruginosa PA01
gcgaacccggcgcggcgc

SEQ ID NO: 3499735 - RNA, 21 nt, Pseudomonas aeruginosa PA01
gcgaacccucggugcggccga

SEQ ID NO: 3499736 - RNA, 18 nt, Pseudomonas aeruginosa PA01
gcgaaccgagacccuggc

SEQ ID NO: 3499737 - RNA, 22 nt, Pseudomonas aeruginosa PA01
gcgaaccgagacccuggcgcug

SEQ ID NO: 3499738 - RNA, 13 nt, Pseudomonas aeruginosa PA01
gcgaaccgccggc

SEQ ID NO: 3499739 - RNA, 14 nt, Pseudomonas aeruginosa PA01
gcgaaccgccggcc

SEQ ID NO: 3499740 - RNA, 22 nt, Pseudomonas aeruginosa PA01
gcgaaccgccggccucgcugcc

SEQ ID NO: 3499741 - RNA, 14 nt, Pseudomonas aeruginosa PA01
gcgaaccgcuggug

SEQ ID NO: 3499742 - RNA, 21 nt, Pseudomonas aeruginosa PA01
gcgaaccucgguagccggcca

SEQ ID NO: 3499743 - RNA, 22 nt, Pseudomonas aeruginosa PA01
gcgaacgacagcaccaugcccu

SEQ ID NO: 3499744 - RNA, 22 nt, Pseudomonas aeruginosa PA01
gcgaacgaugguggucggcagc

SEQ ID NO: 3499745 - RNA, 14 nt, Pseudomonas aeruginosa PA01
gcgaacgcccggcu

SEQ ID NO: 3499746 - RNA, 15 nt, Pseudomonas aeruginosa PA01
gcgaacgccgcagcu

SEQ ID NO: 3499747 - RNA, 15 nt, Pseudomonas aeruginosa PA01
gcgaacgcucccagc

SEQ ID NO: 3499748 - RNA, 16 nt, Pseudomonas aeruginosa PA01
gcgaacggaccgacgu

SEQ ID NO: 3499749 - RNA, 15 nt, Pseudomonas aeruginosa PA01
gcgaacuccgccagc

SEQ ID NO: 3499750 - RNA, 14 nt, Pseudomonas aeruginosa PA01
gcgaacucggcgcc

SEQ ID NO: 3499751 - RNA, 15 nt, Pseudomonas aeruginosa PA01
gcgaacucggcgccg

SEQ ID NO: 3499752 - RNA, 23 nt, Pseudomonas aeruginosa PA01
gcgaacucguagacgaauaccgg

SEQ ID NO: 3499753 - RNA, 15 nt, Pseudomonas aeruginosa PA01
gcgaacugccgacgg

SEQ ID NO: 3499754 - RNA, 19 nt, Pseudomonas aeruginosa PA01
gcgaacugccgacggcggc

SEQ ID NO: 3499755 - RNA, 15 nt, Pseudomonas aeruginosa PA01
gcgaacuggccaccg

SEQ ID NO: 3499756 - RNA, 18 nt, Pseudomonas aeruginosa PA01
gcgaacuucaggccggcg

SEQ ID NO: 3499757 - RNA, 19 nt, Pseudomonas aeruginosa PA01
gcgaacuucaggccggcgc

SEQ ID NO: 3499758 - RNA, 20 nt, Pseudomonas aeruginosa PA01
gcgaacuucaggccggcgcc

SEQ ID NO: 3499759 - RNA, 22 nt, Pseudomonas aeruginosa PA01
gcgaacuucaggccggcgccga

SEQ ID NO: 3499760 - RNA, 17 nt, Pseudomonas aeruginosa PA01
gcgaagaacagcggguc

SEQ ID NO: 3499761 - RNA, 15 nt, Pseudomonas aeruginosa PA01
gcgaagaccggccgg

SEQ ID NO: 3499762 - RNA, 19 nt, Pseudomonas aeruginosa PA01
gcgaagaucucgccauggc

SEQ ID NO: 3499763 - RNA, 23 nt, Pseudomonas aeruginosa PA01
gcgaagaucucgccauggcggac

SEQ ID NO: 3499764 - RNA, 12 nt, Pseudomonas aeruginosa PA01
gcgaagcccagc

SEQ ID NO: 3499765 - RNA, 15 nt, Pseudomonas aeruginosa PA01
gcgaagcccagcgag

SEQ ID NO: 3499766 - RNA, 16 nt, Pseudomonas aeruginosa PA01
gcgaagcccagcgagc

SEQ ID NO: 3499767 - RNA, 20 nt, Pseudomonas aeruginosa PA01
gcgaagcccagcgagccgau

SEQ ID NO: 3499768 - RNA, 16 nt, Pseudomonas aeruginosa PA01
gcgaagcccagcgccg

SEQ ID NO: 3499769 - RNA, 17 nt, Pseudomonas aeruginosa PA01
gcgaagcccagcgccgc

SEQ ID NO: 3499770 - RNA, 13 nt, Pseudomonas aeruginosa PA01
gcgaagccgcgcc

SEQ ID NO: 3499771 - RNA, 14 nt, Pseudomonas aeruginosa PA01
gcgaagccgcgccc

SEQ ID NO: 3499772 - RNA, 15 nt, Pseudomonas aeruginosa PA01
gcgaagccgcgcccg

SEQ ID NO: 3499773 - RNA, 13 nt, Pseudomonas aeruginosa PA01
gcgaagccggcgg

SEQ ID NO: 3499774 - RNA, 14 nt, Pseudomonas aeruginosa PA01
gcgaagcgcaggcu

SEQ ID NO: 3499775 - RNA, 13 nt, Pseudomonas aeruginosa PA01
gcgaagcgcuugc

SEQ ID NO: 3499776 - RNA, 18 nt, Pseudomonas aeruginosa PA01
gcgaagcgcuugcccagg

SEQ ID NO: 3499777 - RNA, 18 nt, Pseudomonas aeruginosa PA01
gcgaagcggaagcgcagc

SEQ ID NO: 3499778 - RNA, 21 nt, Pseudomonas aeruginosa PA01
gcgaagcggcccuugucgccg

SEQ ID NO: 3499779 - RNA, 23 nt, Pseudomonas aeruginosa PA01
gcgaagcggcccuugucgccgcu

SEQ ID NO: 3499780 - RNA, 19 nt, Pseudomonas aeruginosa PA01
gcgaagcggcucggccagg

SEQ ID NO: 3499781 - RNA, 20 nt, Pseudomonas aeruginosa PA01
gcgaagcggcucggccaggg

SEQ ID NO: 3499782 - RNA, 23 nt, Pseudomonas aeruginosa PA01
gcgaagcggcucggccagggccg

SEQ ID NO: 3499783 - RNA, 13 nt, Pseudomonas aeruginosa PA01
gcgaagcggcugg

SEQ ID NO: 3499784 - RNA, 20 nt, Pseudomonas aeruginosa PA01
gcgaagcggcuggccgcggu

SEQ ID NO: 3499785 - RNA, 19 nt, Pseudomonas aeruginosa PA01
gcgaagcgguuagccggcg

SEQ ID NO: 3499786 - RNA, 21 nt, Pseudomonas aeruginosa PA01
gcgaagcgguuagccggcgau

SEQ ID NO: 3499787 - RNA, 14 nt, Pseudomonas aeruginosa PA01
gcgaagcuccucga

SEQ ID NO: 3499788 - RNA, 18 nt, Pseudomonas aeruginosa PA01
gcgaagcucggccgcucg

SEQ ID NO: 3499789 - RNA, 14 nt, Pseudomonas aeruginosa PA01
gcgaagcuggcgca

SEQ ID NO: 3499790 - RNA, 16 nt, Pseudomonas aeruginosa PA01
gcgaagcuggcgcaac

SEQ ID NO: 3499791 - RNA, 15 nt, Pseudomonas aeruginosa PA01
gcgaagcuucuucgg

SEQ ID NO: 3499792 - RNA, 13 nt, Pseudomonas aeruginosa PA01
gcgaaggccacca

SEQ ID NO: 3499793 - RNA, 20 nt, Pseudomonas aeruginosa PA01
gcgaaggccaccaucgcggc

SEQ ID NO: 3499794 - RNA, 19 nt, Pseudomonas aeruginosa PA01
gcgaaggccacgccgacgc

SEQ ID NO: 3499795 - RNA, 21 nt, Pseudomonas aeruginosa PA01
gcgaaggccacgccgacgccg

SEQ ID NO: 3499796 - RNA, 13 nt, Pseudomonas aeruginosa PA01
gcgaaggcgaacc

SEQ ID NO: 3499797 - RNA, 11 nt, Pseudomonas aeruginosa PA01
gcgaaggcgau

SEQ ID NO: 3499798 - RNA, 16 nt, Pseudomonas aeruginosa PA01
gcgaaggcgccuucca

SEQ ID NO: 3499799 - RNA, 18 nt, Pseudomonas aeruginosa PA01
gcgaaggcuccgcugcuc

SEQ ID NO: 3499800 - RNA, 15 nt, Pseudomonas aeruginosa PA01
gcgaagggcaggccg

SEQ ID NO: 3499801 - RNA, 16 nt, Pseudomonas aeruginosa PA01
gcgaaggucugccccg

SEQ ID NO: 3499802 - RNA, 13 nt, Pseudomonas aeruginosa PA01
gcgaaguagaagc

SEQ ID NO: 3499803 - RNA, 15 nt, Pseudomonas aeruginosa PA01
gcgaaguccaccagg

SEQ ID NO: 3499804 - RNA, 16 nt, Pseudomonas aeruginosa PA01
gcgaaguccaccaggc

SEQ ID NO: 3499805 - RNA, 16 nt, Pseudomonas aeruginosa PA01
gcgaagucgccgucgu

SEQ ID NO: 3499806 - RNA, 22 nt, Pseudomonas aeruginosa PA01
gcgaagucgccgucguccgggu

SEQ ID NO: 3499807 - RNA, 14 nt, Pseudomonas aeruginosa PA01
gcgaagucggcgcg

SEQ ID NO: 3499808 - RNA, 16 nt, Pseudomonas aeruginosa PA01
gcgaagucggcgcgcc

SEQ ID NO: 3499809 - RNA, 18 nt, Pseudomonas aeruginosa PA01
gcgaagucggcgcgccag

SEQ ID NO: 3499810 - RNA, 20 nt, Pseudomonas aeruginosa PA01
gcgaagucugccuguccgcu

SEQ ID NO: 3499811 - RNA, 17 nt, Pseudomonas aeruginosa PA01
gcgaaguucccgccgcu

SEQ ID NO: 3499812 - RNA, 22 nt, Pseudomonas aeruginosa PA01
gcgaaguucccgccgcucugcu

SEQ ID NO: 3499813 - RNA, 17 nt, Pseudomonas aeruginosa PA01
gcgaaguugaaacggcg

SEQ ID NO: 3499814 - RNA, 18 nt, Pseudomonas aeruginosa PA01
gcgaaguugaaacggcgg

SEQ ID NO: 3499815 - RNA, 20 nt, Pseudomonas aeruginosa PA01
gcgaaguugaaacggcggaa

SEQ ID NO: 3499816 - RNA, 22 nt, Pseudomonas aeruginosa PA01
gcgaaguugccgccgcuggccu

SEQ ID NO: 3499817 - RNA, 15 nt, Pseudomonas aeruginosa PA01
gcgaauaaccauugc

SEQ ID NO: 3499818 - RNA, 14 nt, Pseudomonas aeruginosa PA01
gcgaauaaccgcau

SEQ ID NO: 3499819 - RNA, 20 nt, Pseudomonas aeruginosa PA01
gcgaauaaccgcugcgcggu

SEQ ID NO: 3499820 - RNA, 14 nt, Pseudomonas aeruginosa PA01
gcgaauaacgccac

SEQ ID NO: 3499821 - RNA, 19 nt, Pseudomonas aeruginosa PA01
gcgaauaacgccacaggcg

SEQ ID NO: 3499822 - RNA, 16 nt, Pseudomonas aeruginosa PA01
gcgaauaacgccaccg

SEQ ID NO: 3499823 - RNA, 14 nt, Pseudomonas aeruginosa PA01
gcgaauaccagugc

SEQ ID NO: 3499824 - RNA, 23 nt, Pseudomonas aeruginosa PA01
gcgaauaccgcgcgcgcaaggcc

SEQ ID NO: 3499825 - RNA, 15 nt, Pseudomonas aeruginosa PA01
gcgaauagacgccgc

SEQ ID NO: 3499826 - RNA, 14 nt, Pseudomonas aeruginosa PA01
gcgaauagggcggc

SEQ ID NO: 3499827 - RNA, 18 nt, Pseudomonas aeruginosa PA01
gcgaauagggcggcgcca

SEQ ID NO: 3499828 - RNA, 23 nt, Pseudomonas aeruginosa PA01
gcgaauauccucgucgauccgcg

SEQ ID NO: 3499829 - RNA, 18 nt, Pseudomonas aeruginosa PA01
gcgaauaucgcggcgcga

SEQ ID NO: 3499830 - RNA, 14 nt, Pseudomonas aeruginosa PA01
gcgaauccgcggcc

SEQ ID NO: 3499831 - RNA, 15 nt, Pseudomonas aeruginosa PA01
gcgaauccgcggccc

SEQ ID NO: 3499832 - RNA, 16 nt, Pseudomonas aeruginosa PA01
gcgaauccgcggcccu

SEQ ID NO: 3499833 - RNA, 20 nt, Pseudomonas aeruginosa PA01
gcgaauccgcggcccugcuc

SEQ ID NO: 3499834 - RNA, 21 nt, Pseudomonas aeruginosa PA01
gcgaauccgcggcccugcucg

SEQ ID NO: 3499835 - RNA, 19 nt, Pseudomonas aeruginosa PA01
gcgaauccuguccguccga

SEQ ID NO: 3499836 - RNA, 16 nt, Pseudomonas aeruginosa PA01
gcgaaucgucgccgga

SEQ ID NO: 3499837 - RNA, 17 nt, Pseudomonas aeruginosa PA01
gcgaaucgucgccggag

SEQ ID NO: 3499838 - RNA, 15 nt, Pseudomonas aeruginosa PA01
gcgaaucugcagggc

SEQ ID NO: 3499839 - RNA, 20 nt, Pseudomonas aeruginosa PA01
gcgaaucuucggcgcgccgg

SEQ ID NO: 3499840 - RNA, 15 nt, Pseudomonas aeruginosa PA01
gcgaaugcccggcag

SEQ ID NO: 3499841 - RNA, 20 nt, Pseudomonas aeruginosa PA01
gcgaaugcccggcagcgccg

SEQ ID NO: 3499842 - RNA, 14 nt, Pseudomonas aeruginosa PA01
gcgaaugccgggcu

SEQ ID NO: 3499843 - RNA, 14 nt, Pseudomonas aeruginosa PA01
gcgaaugcuccggg

SEQ ID NO: 3499844 - RNA, 20 nt, Pseudomonas aeruginosa PA01
gcgaaugcuccggggucagu

SEQ ID NO: 3499845 - RNA, 16 nt, Pseudomonas aeruginosa PA01
gcgaauggagggaucg

SEQ ID NO: 3499846 - RNA, 17 nt, Pseudomonas aeruginosa PA01
gcgaauggagggaucgc

SEQ ID NO: 3499847 - RNA, 21 nt, Pseudomonas aeruginosa PA01
gcgaauggagggaucgcgcgg

SEQ ID NO: 3499848 - RNA, 15 nt, Pseudomonas aeruginosa PA01
gcgaauucgucgccg

SEQ ID NO: 3499849 - RNA, 19 nt, Pseudomonas aeruginosa PA01
gcgaauucgucgccgccga

SEQ ID NO: 3499850 - RNA, 22 nt, Pseudomonas aeruginosa PA01
gcgaauucgucgccgccgaggc

SEQ ID NO: 3499851 - RNA, 18 nt, Pseudomonas aeruginosa PA01
gcgaauugcgcuggaagu

SEQ ID NO: 3499852 - RNA, 16 nt, Pseudomonas aeruginosa PA01
gcgaauuuccugcugg

SEQ ID NO: 3499853 - RNA, 12 nt, Pseudomonas aeruginosa PA01
gcgacaacggcc

SEQ ID NO: 3499854 - RNA, 15 nt, Pseudomonas aeruginosa PA01
gcgacaacggccguc

SEQ ID NO: 3499855 - RNA, 18 nt, Pseudomonas aeruginosa PA01
gcgacaacggccguccca

SEQ ID NO: 3499856 - RNA, 21 nt, Pseudomonas aeruginosa PA01
gcgacaaggcugaggccgacg

SEQ ID NO: 3499857 - RNA, 22 nt, Pseudomonas aeruginosa PA01
gcgacacauggucggccagguc

SEQ ID NO: 3499858 - RNA, 22 nt, Pseudomonas aeruginosa PA01
gcgacaccaugcuccgccuggc

SEQ ID NO: 3499859 - RNA, 23 nt, Pseudomonas aeruginosa PA01
gcgacaccaugcuccgccuggcg

SEQ ID NO: 3499860 - RNA, 13 nt, Pseudomonas aeruginosa PA01
gcgacaccgccag

SEQ ID NO: 3499861 - RNA, 18 nt, Pseudomonas aeruginosa PA01
gcgacaccgccagcaccu

SEQ ID NO: 3499862 - RNA, 16 nt, Pseudomonas aeruginosa PA01
gcgacacgaugucgcg

SEQ ID NO: 3499863 - RNA, 16 nt, Pseudomonas aeruginosa PA01
gcgacacgugccccag

SEQ ID NO: 3499864 - RNA, 21 nt, Pseudomonas aeruginosa PA01
gcgacacucugguagcugcgg

SEQ ID NO: 3499865 - RNA, 22 nt, Pseudomonas aeruginosa PA01
gcgacacucugguagcugcggc

SEQ ID NO: 3499866 - RNA, 17 nt, Pseudomonas aeruginosa PA01
gcgacagauagcagguc

SEQ ID NO: 3499867 - RNA, 23 nt, Pseudomonas aeruginosa PA01
gcgacagcauggccuugccggca

SEQ ID NO: 3499868 - RNA, 18 nt, Pseudomonas aeruginosa PA01
gcgacagccgggcagccg

SEQ ID NO: 3499869 - RNA, 20 nt, Pseudomonas aeruginosa PA01
gcgacagcucguggcuggcg

SEQ ID NO: 3499870 - RNA, 21 nt, Pseudomonas aeruginosa PA01
gcgacagcucguggcuggcgc

SEQ ID NO: 3499871 - RNA, 18 nt, Pseudomonas aeruginosa PA01
gcgacagcucugggguca

SEQ ID NO: 3499872 - RNA, 16 nt, Pseudomonas aeruginosa PA01
gcgacagcuuccagug

SEQ ID NO: 3499873 - RNA, 12 nt, Pseudomonas aeruginosa PA01
gcgacaggaugg

SEQ ID NO: 3499874 - RNA, 21 nt, Pseudomonas aeruginosa PA01
gcgacaggcccuugaacaggc

SEQ ID NO: 3499875 - RNA, 13 nt, Pseudomonas aeruginosa PA01
gcgacaggcgauc

SEQ ID NO: 3499876 - RNA, 17 nt, Pseudomonas aeruginosa PA01
gcgacagguucaggacg

SEQ ID NO: 3499877 - RNA, 19 nt, Pseudomonas aeruginosa PA01
gcgacagguucaggacgcu

SEQ ID NO: 3499878 - RNA, 16 nt, Pseudomonas aeruginosa PA01
gcgacaguucgccgcc

SEQ ID NO: 3499879 - RNA, 17 nt, Pseudomonas aeruginosa PA01
gcgacaguucgccgccc

SEQ ID NO: 3499880 - RNA, 18 nt, Pseudomonas aeruginosa PA01
gcgacaguucgccgcccg

SEQ ID NO: 3499881 - RNA, 13 nt, Pseudomonas aeruginosa PA01
gcgacaguucgcg

SEQ ID NO: 3499882 - RNA, 17 nt, Pseudomonas aeruginosa PA01
gcgacauagccggcgaa

SEQ ID NO: 3499883 - RNA, 15 nt, Pseudomonas aeruginosa PA01
gcgacauagcggcug

SEQ ID NO: 3499884 - RNA, 13 nt, Pseudomonas aeruginosa PA01
gcgacaucggcga

SEQ ID NO: 3499885 - RNA, 13 nt, Pseudomonas aeruginosa PA01
gcgacaucuccag

SEQ ID NO: 3499886 - RNA, 14 nt, Pseudomonas aeruginosa PA01
gcgacaucuccagg

SEQ ID NO: 3499887 - RNA, 16 nt, Pseudomonas aeruginosa PA01
gcgacaucuccaggcc

SEQ ID NO: 3499888 - RNA, 17 nt, Pseudomonas aeruginosa PA01
gcgacaucuccaggccg

SEQ ID NO: 3499889 - RNA, 19 nt, Pseudomonas aeruginosa PA01
gcgacaucuccaggccgcu

SEQ ID NO: 3499890 - RNA, 21 nt, Pseudomonas aeruginosa PA01
gcgacaucuccaggccgcuca

SEQ ID NO: 3499891 - RNA, 22 nt, Pseudomonas aeruginosa PA01
gcgacaugccgguucccgcagc

SEQ ID NO: 3499892 - RNA, 15 nt, Pseudomonas aeruginosa PA01
gcgaccacaggcggc

SEQ ID NO: 3499893 - RNA, 16 nt, Pseudomonas aeruginosa PA01
gcgaccacaggcggcg

SEQ ID NO: 3499894 - RNA, 16 nt, Pseudomonas aeruginosa PA01
gcgaccaccaccaggu

SEQ ID NO: 3499895 - RNA, 17 nt, Pseudomonas aeruginosa PA01
gcgaccaccaccagguc

SEQ ID NO: 3499896 - RNA, 19 nt, Pseudomonas aeruginosa PA01
gcgaccaccaccaggucgg

SEQ ID NO: 3499897 - RNA, 22 nt, Pseudomonas aeruginosa PA01
gcgaccaccaccaggucggcgc

SEQ ID NO: 3499898 - RNA, 20 nt, Pseudomonas aeruginosa PA01
gcgaccaccacgucgaugcc

SEQ ID NO: 3499899 - RNA, 17 nt, Pseudomonas aeruginosa PA01
gcgaccacccggcgguc

SEQ ID NO: 3499900 - RNA, 22 nt, Pseudomonas aeruginosa PA01
gcgaccacccggcgguccgccg

SEQ ID NO: 3499901 - RNA, 15 nt, Pseudomonas aeruginosa PA01
gcgaccaccgccggg

SEQ ID NO: 3499902 - RNA, 16 nt, Pseudomonas aeruginosa PA01
gcgaccaccgccggga

SEQ ID NO: 3499903 - RNA, 23 nt, Pseudomonas aeruginosa PA01
gcgaccaccgccgggaccacgcu

SEQ ID NO: 3499904 - RNA, 13 nt, Pseudomonas aeruginosa PA01
gcgaccaccgcga

SEQ ID NO: 3499905 - RNA, 21 nt, Pseudomonas aeruginosa PA01
gcgaccaccgcgaauccgcgg

SEQ ID NO: 3499906 - RNA, 13 nt, Pseudomonas aeruginosa PA01
gcgaccagcccgc

SEQ ID NO: 3499907 - RNA, 13 nt, Pseudomonas aeruginosa PA01
gcgaccagccggg

SEQ ID NO: 3499908 - RNA, 16 nt, Pseudomonas aeruginosa PA01
gcgaccagcgccaggc

SEQ ID NO: 3499909 - RNA, 17 nt, Pseudomonas aeruginosa PA01
gcgaccagcgccaggcg

SEQ ID NO: 3499910 - RNA, 19 nt, Pseudomonas aeruginosa PA01
gcgaccagcgccaggcgcg

SEQ ID NO: 3499911 - RNA, 21 nt, Pseudomonas aeruginosa PA01
gcgaccagcucgaagccgccg

SEQ ID NO: 3499912 - RNA, 15 nt, Pseudomonas aeruginosa PA01
gcgaccaggacagca

SEQ ID NO: 3499913 - RNA, 18 nt, Pseudomonas aeruginosa PA01
gcgaccaggacagcacgc

SEQ ID NO: 3499914 - RNA, 24 nt, Pseudomonas aeruginosa PA01
gcgaccaggacagcacgcucaggc

SEQ ID NO: 3499915 - RNA, 17 nt, Pseudomonas aeruginosa PA01
gcgaccagggggcgaca

SEQ ID NO: 3499916 - RNA, 19 nt, Pseudomonas aeruginosa PA01
gcgaccagguccggagggc

SEQ ID NO: 3499917 - RNA, 20 nt, Pseudomonas aeruginosa PA01
gcgaccagguccggagggcc

SEQ ID NO: 3499918 - RNA, 22 nt, Pseudomonas aeruginosa PA01
gcgaccagguccggagggcccg

SEQ ID NO: 3499919 - RNA, 21 nt, Pseudomonas aeruginosa PA01
gcgaccauguucaccagcgcu

SEQ ID NO: 3499920 - RNA, 15 nt, Pseudomonas aeruginosa PA01
gcgacccagaccugc

SEQ ID NO: 3499921 - RNA, 17 nt, Pseudomonas aeruginosa PA01
gcgacccagaccugccg

SEQ ID NO: 3499922 - RNA, 19 nt, Pseudomonas aeruginosa PA01
gcgacccagaccugccgcc

SEQ ID NO: 3499923 - RNA, 20 nt, Pseudomonas aeruginosa PA01
gcgacccagaccugccgccc

SEQ ID NO: 3499924 - RNA, 13 nt, Pseudomonas aeruginosa PA01
gcgacccagcgcu

SEQ ID NO: 3499925 - RNA, 17 nt, Pseudomonas aeruginosa PA01
gcgacccagcgcugguu

SEQ ID NO: 3499926 - RNA, 22 nt, Pseudomonas aeruginosa PA01
gcgacccaggccgacagcggcu

SEQ ID NO: 3499927 - RNA, 16 nt, Pseudomonas aeruginosa PA01
gcgaccccgaucaccg

SEQ ID NO: 3499928 - RNA, 18 nt, Pseudomonas aeruginosa PA01
gcgacccgaaggucgccg

SEQ ID NO: 3499929 - RNA, 18 nt, Pseudomonas aeruginosa PA01
gcgacccgccguucgccc

SEQ ID NO: 3499930 - RNA, 19 nt, Pseudomonas aeruginosa PA01
gcgacccgccguucgcccg

SEQ ID NO: 3499931 - RNA, 13 nt, Pseudomonas aeruginosa PA01
gcgacccggguca

SEQ ID NO: 3499932 - RNA, 14 nt, Pseudomonas aeruginosa PA01
gcgacccgggucag

SEQ ID NO: 3499933 - RNA, 16 nt, Pseudomonas aeruginosa PA01
gcgacccgggucaggc

SEQ ID NO: 3499934 - RNA, 17 nt, Pseudomonas aeruginosa PA01
gcgacccgggucaggcc

SEQ ID NO: 3499935 - RNA, 18 nt, Pseudomonas aeruginosa PA01
gcgacccgggucaggccg

SEQ ID NO: 3499936 - RNA, 21 nt, Pseudomonas aeruginosa PA01
gcgacccgggucaggccgaga

SEQ ID NO: 3499937 - RNA, 17 nt, Pseudomonas aeruginosa PA01
gcgacccucagucgccc

SEQ ID NO: 3499938 - RNA, 18 nt, Pseudomonas aeruginosa PA01
gcgacccucagucgcccc

SEQ ID NO: 3499939 - RNA, 13 nt, Pseudomonas aeruginosa PA01
gcgacccuggccg

SEQ ID NO: 3499940 - RNA, 14 nt, Pseudomonas aeruginosa PA01
gcgacccuggccgc

SEQ ID NO: 3499941 - RNA, 17 nt, Pseudomonas aeruginosa PA01
gcgacccuggccgcgcg

SEQ ID NO: 3499942 - RNA, 23 nt, Pseudomonas aeruginosa PA01
gcgacccuggccgcgcggcuugc

SEQ ID NO: 3499943 - RNA, 17 nt, Pseudomonas aeruginosa PA01
gcgacccuggggucgcc

SEQ ID NO: 3499944 - RNA, 17 nt, Pseudomonas aeruginosa PA01
gcgaccgaacagcgcgc

SEQ ID NO: 3499945 - RNA, 15 nt, Pseudomonas aeruginosa PA01
gcgaccgaagccgcg

SEQ ID NO: 3499946 - RNA, 22 nt, Pseudomonas aeruginosa PA01
gcgaccgagaugcucgcgcagc

SEQ ID NO: 3499947 - RNA, 19 nt, Pseudomonas aeruginosa PA01
gcgaccgagaugcugccga

SEQ ID NO: 3499948 - RNA, 13 nt, Pseudomonas aeruginosa PA01
gcgaccgaucaug

SEQ ID NO: 3499949 - RNA, 21 nt, Pseudomonas aeruginosa PA01
gcgaccgcaucguuggcgccg

SEQ ID NO: 3499950 - RNA, 17 nt, Pseudomonas aeruginosa PA01
gcgaccgccaggcggcc

SEQ ID NO: 3499951 - RNA, 15 nt, Pseudomonas aeruginosa PA01
gcgaccgcccgccuc

SEQ ID NO: 3499952 - RNA, 13 nt, Pseudomonas aeruginosa PA01
gcgaccgcggcgc

SEQ ID NO: 3499953 - RNA, 14 nt, Pseudomonas aeruginosa PA01
gcgaccgcggcgcu

SEQ ID NO: 3499954 - RNA, 12 nt, Pseudomonas aeruginosa PA01
gcgaccgcugga

SEQ ID NO: 3499955 - RNA, 13 nt, Pseudomonas aeruginosa PA01
gcgaccgcuggac

SEQ ID NO: 3499956 - RNA, 23 nt, Pseudomonas aeruginosa PA01
gcgaccgcuggaccaguucagcg

SEQ ID NO: 3499957 - RNA, 13 nt, Pseudomonas aeruginosa PA01
gcgaccggaugcu

SEQ ID NO: 3499958 - RNA, 17 nt, Pseudomonas aeruginosa PA01
gcgaccggaugcuccag

SEQ ID NO: 3499959 - RNA, 16 nt, Pseudomonas aeruginosa PA01
gcgaccgggcaugccg

SEQ ID NO: 3499960 - RNA, 15 nt, Pseudomonas aeruginosa PA01
gcgaccgguuccgcg

SEQ ID NO: 3499961 - RNA, 21 nt, Pseudomonas aeruginosa PA01
gcgaccgguuccgcgucgccu

SEQ ID NO: 3499962 - RNA, 15 nt, Pseudomonas aeruginosa PA01
gcgaccgugaggcgc

SEQ ID NO: 3499963 - RNA, 21 nt, Pseudomonas aeruginosa PA01
gcgaccgugaggcgcaggggc

SEQ ID NO: 3499964 - RNA, 22 nt, Pseudomonas aeruginosa PA01
gcgaccucagucgugcaggugu

SEQ ID NO: 3499965 - RNA, 16 nt, Pseudomonas aeruginosa PA01
gcgaccuccggcgcca

SEQ ID NO: 3499966 - RNA, 17 nt, Pseudomonas aeruginosa PA01
gcgaccuccggcgccag

SEQ ID NO: 3499967 - RNA, 19 nt, Pseudomonas aeruginosa PA01
gcgaccuccggcgccaggc

SEQ ID NO: 3499968 - RNA, 19 nt, Pseudomonas aeruginosa PA01
gcgaccucguugcaggcac

SEQ ID NO: 3499969 - RNA, 20 nt, Pseudomonas aeruginosa PA01
gcgaccucguugcaggcacg

SEQ ID NO: 3499970 - RNA, 18 nt, Pseudomonas aeruginosa PA01
gcgaccugcucgaaccgg

SEQ ID NO: 3499971 - RNA, 13 nt, Pseudomonas aeruginosa PA01
gcgaccugcucgc

SEQ ID NO: 3499972 - RNA, 18 nt, Pseudomonas aeruginosa PA01
gcgaccugcucgcgcacc

SEQ ID NO: 3499973 - RNA, 19 nt, Pseudomonas aeruginosa PA01
gcgaccugcucgcgcaccg

SEQ ID NO: 3499974 - RNA, 20 nt, Pseudomonas aeruginosa PA01
gcgaccugcucgcgcaccgc

SEQ ID NO: 3499975 - RNA, 23 nt, Pseudomonas aeruginosa PA01
gcgaccugcucgcgcaccgcggc

SEQ ID NO: 3499976 - RNA, 13 nt, Pseudomonas aeruginosa PA01
gcgaccugcucgu

SEQ ID NO: 3499977 - RNA, 14 nt, Pseudomonas aeruginosa PA01
gcgaccuggcgccg

SEQ ID NO: 3499978 - RNA, 16 nt, Pseudomonas aeruginosa PA01
gcgaccugggcgucgc

SEQ ID NO: 3499979 - RNA, 18 nt, Pseudomonas aeruginosa PA01
gcgaccugguggcgccgg

SEQ ID NO: 3499980 - RNA, 19 nt, Pseudomonas aeruginosa PA01
gcgaccugguggcgccggc

SEQ ID NO: 3499981 - RNA, 20 nt, Pseudomonas aeruginosa PA01
gcgaccugguggcgccggcu

SEQ ID NO: 3499982 - RNA, 13 nt, Pseudomonas aeruginosa PA01
gcgaccuguucga

SEQ ID NO: 3499983 - RNA, 17 nt, Pseudomonas aeruginosa PA01
gcgaccuucagcggguc

SEQ ID NO: 3499984 - RNA, 22 nt, Pseudomonas aeruginosa PA01
gcgaccuucagcgggucgagcc

SEQ ID NO: 3499985 - RNA, 19 nt, Pseudomonas aeruginosa PA01
gcgaccuugacgaagccgg

SEQ ID NO: 3499986 - RNA, 21 nt, Pseudomonas aeruginosa PA01
gcgaccuugacgaagccggcg

SEQ ID NO: 3499987 - RNA, 18 nt, Pseudomonas aeruginosa PA01
gcgaccuugcgcaccagg

SEQ ID NO: 3499988 - RNA, 15 nt, Pseudomonas aeruginosa PA01
gcgaccuuggccagc

SEQ ID NO: 3499989 - RNA, 15 nt, Pseudomonas aeruginosa PA01
gcgaccuuguccagg

SEQ ID NO: 3499990 - RNA, 18 nt, Pseudomonas aeruginosa PA01
gcgaccuuguccaggcgc

SEQ ID NO: 3499991 - RNA, 19 nt, Pseudomonas aeruginosa PA01
gcgaccuuguccaggcgcu

SEQ ID NO: 3499992 - RNA, 21 nt, Pseudomonas aeruginosa PA01
gcgaccuuguccaggcgcugc

SEQ ID NO: 3499993 - RNA, 13 nt, Pseudomonas aeruginosa PA01
gcgaccuugucga

SEQ ID NO: 3499994 - RNA, 15 nt, Pseudomonas aeruginosa PA01
gcgacgaaacggcuc

SEQ ID NO: 3499995 - RNA, 19 nt, Pseudomonas aeruginosa PA01
gcgacgaagacgcugcgca

SEQ ID NO: 3499996 - RNA, 22 nt, Pseudomonas aeruginosa PA01
gcgacgaagacgcugcgcacgu

SEQ ID NO: 3499997 - RNA, 16 nt, Pseudomonas aeruginosa PA01
gcgacgaagcuggcga

SEQ ID NO: 3499998 - RNA, 17 nt, Pseudomonas aeruginosa PA01
gcgacgaagcuggcgau

SEQ ID NO: 3499999 - RNA, 14 nt, Pseudomonas aeruginosa PA01
gcgacgacgaacgc

SEQ ID NO: 3500000 - RNA, 15 nt, Pseudomonas aeruginosa PA01
gcgacgacgaacgcc

SEQ ID NO: 3500001 - RNA, 18 nt, Pseudomonas aeruginosa PA01
gcgacgacgaucccggcg

SEQ ID NO: 3500002 - RNA, 20 nt, Pseudomonas aeruginosa PA01
gcgacgacgggagcgcgagg

SEQ ID NO: 3500003 - RNA, 16 nt, Pseudomonas aeruginosa PA01
gcgacgacugcggcag

SEQ ID NO: 3500004 - RNA, 18 nt, Pseudomonas aeruginosa PA01
gcgacgacugcggcagcu

SEQ ID NO: 3500005 - RNA, 22 nt, Pseudomonas aeruginosa PA01
gcgacgacuugcccaccccgga

SEQ ID NO: 3500006 - RNA, 20 nt, Pseudomonas aeruginosa PA01
gcgacgagaaaaagcccggc

SEQ ID NO: 3500007 - RNA, 21 nt, Pseudomonas aeruginosa PA01
gcgacgagaaaaagcccggca

SEQ ID NO: 3500008 - RNA, 12 nt, Pseudomonas aeruginosa PA01
gcgacgagccgg

SEQ ID NO: 3500009 - RNA, 15 nt, Pseudomonas aeruginosa PA01
gcgacgagccggacg

SEQ ID NO: 3500010 - RNA, 17 nt, Pseudomonas aeruginosa PA01
gcgacgagccggacggc

SEQ ID NO: 3500011 - RNA, 13 nt, Pseudomonas aeruginosa PA01
gcgacgaggcgcg

SEQ ID NO: 3500012 - RNA, 19 nt, Pseudomonas aeruginosa PA01
gcgacgaggcgcggcggag

SEQ ID NO: 3500013 - RNA, 19 nt, Pseudomonas aeruginosa PA01
gcgacgaguaaaacggcag

SEQ ID NO: 3500014 - RNA, 13 nt, Pseudomonas aeruginosa PA01
gcgacgaucaccc

SEQ ID NO: 3500015 - RNA, 20 nt, Pseudomonas aeruginosa PA01
gcgacgaucacccccagcga

SEQ ID NO: 3500016 - RNA, 17 nt, Pseudomonas aeruginosa PA01
gcgacgaucagcccgcc

SEQ ID NO: 3500017 - RNA, 19 nt, Pseudomonas aeruginosa PA01
gcgacgaucagcccgccgg

SEQ ID NO: 3500018 - RNA, 20 nt, Pseudomonas aeruginosa PA01
gcgacgaucagcccgccggc

SEQ ID NO: 3500019 - RNA, 21 nt, Pseudomonas aeruginosa PA01
gcgacgaucagcccgccggcg

SEQ ID NO: 3500020 - RNA, 14 nt, Pseudomonas aeruginosa PA01
gcgacgaugccgcc

SEQ ID NO: 3500021 - RNA, 16 nt, Pseudomonas aeruginosa PA01
gcgacgaugccgccgc

SEQ ID NO: 3500022 - RNA, 23 nt, Pseudomonas aeruginosa PA01
gcgacgaugccgccgccgcccca

SEQ ID NO: 3500023 - RNA, 15 nt, Pseudomonas aeruginosa PA01
gcgacgaugcgcccc

SEQ ID NO: 3500024 - RNA, 16 nt, Pseudomonas aeruginosa PA01
gcgacgaugcgcccca

SEQ ID NO: 3500025 - RNA, 21 nt, Pseudomonas aeruginosa PA01
gcgacgaugcgccccagcgcc

SEQ ID NO: 3500026 - RNA, 20 nt, Pseudomonas aeruginosa PA01
gcgacgauguucuccacguc

SEQ ID NO: 3500027 - RNA, 17 nt, Pseudomonas aeruginosa PA01
gcgacgcagcacggcgg

SEQ ID NO: 3500028 - RNA, 13 nt, Pseudomonas aeruginosa PA01
gcgacgcagcaga

SEQ ID NO: 3500029 - RNA, 21 nt, Pseudomonas aeruginosa PA01
gcgacgcaggacgucguagcc

SEQ ID NO: 3500030 - RNA, 23 nt, Pseudomonas aeruginosa PA01
gcgacgcccauguagaccaccag

SEQ ID NO: 3500031 - RNA, 13 nt, Pseudomonas aeruginosa PA01
gcgacgcccgagg

SEQ ID NO: 3500032 - RNA, 21 nt, Pseudomonas aeruginosa PA01
gcgacgcccuugcggcgcggc

SEQ ID NO: 3500033 - RNA, 12 nt, Pseudomonas aeruginosa PA01
gcgacgccgcga

SEQ ID NO: 3500034 - RNA, 13 nt, Pseudomonas aeruginosa PA01
gcgacgccgcgau

SEQ ID NO: 3500035 - RNA, 12 nt, Pseudomonas aeruginosa PA01
gcgacgccgcgc

SEQ ID NO: 3500036 - RNA, 13 nt, Pseudomonas aeruginosa PA01
gcgacgccgcgcu

SEQ ID NO: 3500037 - RNA, 15 nt, Pseudomonas aeruginosa PA01
gcgacgcgacauccu

SEQ ID NO: 3500038 - RNA, 14 nt, Pseudomonas aeruginosa PA01
gcgacgcgaccucc

SEQ ID NO: 3500039 - RNA, 19 nt, Pseudomonas aeruginosa PA01
gcgacgcgaccuccggcgc

SEQ ID NO: 3500040 - RNA, 21 nt, Pseudomonas aeruginosa PA01
gcgacgcgaccuccggcgcca

SEQ ID NO: 3500041 - RNA, 22 nt, Pseudomonas aeruginosa PA01
gcgacgcgaccuccggcgccag

SEQ ID NO: 3500042 - RNA, 12 nt, Pseudomonas aeruginosa PA01
gcgacgcgcagg

SEQ ID NO: 3500043 - RNA, 13 nt, Pseudomonas aeruginosa PA01
gcgacgcgcaggc

SEQ ID NO: 3500044 - RNA, 23 nt, Pseudomonas aeruginosa PA01
gcgacgcgcuggaccauggccgg

SEQ ID NO: 3500045 - RNA, 18 nt, Pseudomonas aeruginosa PA01
gcgacgcguccggugacg

SEQ ID NO: 3500046 - RNA, 18 nt, Pseudomonas aeruginosa PA01
gcgacgcuccagcggcag

SEQ ID NO: 3500047 - RNA, 19 nt, Pseudomonas aeruginosa PA01
gcgacgcuccagcggcagc

SEQ ID NO: 3500048 - RNA, 20 nt, Pseudomonas aeruginosa PA01
gcgacgcuccagcggcagcu

SEQ ID NO: 3500049 - RNA, 13 nt, Pseudomonas aeruginosa PA01
gcgacgcuccagg

SEQ ID NO: 3500050 - RNA, 15 nt, Pseudomonas aeruginosa PA01
gcgacgcuccaggug

SEQ ID NO: 3500051 - RNA, 16 nt, Pseudomonas aeruginosa PA01
gcgacgcuccaggugc

SEQ ID NO: 3500052 - RNA, 23 nt, Pseudomonas aeruginosa PA01
gcgacgcugaugaugccgcggcg

SEQ ID NO: 3500053 - RNA, 17 nt, Pseudomonas aeruginosa PA01
gcgacgcugaugccggc

SEQ ID NO: 3500054 - RNA, 13 nt, Pseudomonas aeruginosa PA01
gcgacgcuggcgg

SEQ ID NO: 3500055 - RNA, 21 nt, Pseudomonas aeruginosa PA01
gcgacgcugucguggacgccg

SEQ ID NO: 3500056 - RNA, 18 nt, Pseudomonas aeruginosa PA01
gcgacggaaacgacaggc

SEQ ID NO: 3500057 - RNA, 19 nt, Pseudomonas aeruginosa PA01
gcgacggaaacgacaggcu

SEQ ID NO: 3500058 - RNA, 20 nt, Pseudomonas aeruginosa PA01
gcgacggaaacgacaggcug

SEQ ID NO: 3500059 - RNA, 15 nt, Pseudomonas aeruginosa PA01
gcgacggaccgcgac

SEQ ID NO: 3500060 - RNA, 16 nt, Pseudomonas aeruginosa PA01
gcgacggcucuucccc

SEQ ID NO: 3500061 - RNA, 17 nt, Pseudomonas aeruginosa PA01
gcgacgggaagcgaacc

SEQ ID NO: 3500062 - RNA, 22 nt, Pseudomonas aeruginosa PA01
gcgacgggugcguccauccagg

SEQ ID NO: 3500063 - RNA, 19 nt, Pseudomonas aeruginosa PA01
gcgacggucagcaggcccg

SEQ ID NO: 3500064 - RNA, 12 nt, Pseudomonas aeruginosa PA01
gcgacggucagg

SEQ ID NO: 3500065 - RNA, 13 nt, Pseudomonas aeruginosa PA01
gcgacggucaggc

SEQ ID NO: 3500066 - RNA, 16 nt, Pseudomonas aeruginosa PA01
gcgacggucaggccga

SEQ ID NO: 3500067 - RNA, 19 nt, Pseudomonas aeruginosa PA01
gcgacggucaggccgagca

SEQ ID NO: 3500068 - RNA, 13 nt, Pseudomonas aeruginosa PA01
gcgacggugaagu

SEQ ID NO: 3500069 - RNA, 22 nt, Pseudomonas aeruginosa PA01
gcgacggugauagagcacgccc

SEQ ID NO: 3500070 - RNA, 14 nt, Pseudomonas aeruginosa PA01
gcgacggugccggu

SEQ ID NO: 3500071 - RNA, 15 nt, Pseudomonas aeruginosa PA01
gcgacggugccgguc

SEQ ID NO: 3500072 - RNA, 14 nt, Pseudomonas aeruginosa PA01
gcgacguccacugc

SEQ ID NO: 3500073 - RNA, 13 nt, Pseudomonas aeruginosa PA01
gcgacguccugcg

SEQ ID NO: 3500074 - RNA, 15 nt, Pseudomonas aeruginosa PA01
gcgacgucgccguga

SEQ ID NO: 3500075 - RNA, 19 nt, Pseudomonas aeruginosa PA01
gcgacgugggccugcuccu

SEQ ID NO: 3500076 - RNA, 22 nt, Pseudomonas aeruginosa PA01
gcgacguucugcucgcugcccg

SEQ ID NO: 3500077 - RNA, 23 nt, Pseudomonas aeruginosa PA01
gcgacguugcaauugcaggcccg

SEQ ID NO: 3500078 - RNA, 15 nt, Pseudomonas aeruginosa PA01
gcgacguugcgcagg

SEQ ID NO: 3500079 - RNA, 14 nt, Pseudomonas aeruginosa PA01
gcgacuaccagguu

SEQ ID NO: 3500080 - RNA, 14 nt, Pseudomonas aeruginosa PA01
gcgacuccagccag

SEQ ID NO: 3500081 - RNA, 19 nt, Pseudomonas aeruginosa PA01
gcgacuccagccaggcgau

SEQ ID NO: 3500082 - RNA, 15 nt, Pseudomonas aeruginosa PA01
gcgacucgaagcucu

SEQ ID NO: 3500083 - RNA, 22 nt, Pseudomonas aeruginosa PA01
gcgacucgaagcucuucgccag

SEQ ID NO: 3500084 - RNA, 13 nt, Pseudomonas aeruginosa PA01
gcgacucgaugcg

SEQ ID NO: 3500085 - RNA, 18 nt, Pseudomonas aeruginosa PA01
gcgacucgaugcgcagcu

SEQ ID NO: 3500086 - RNA, 18 nt, Pseudomonas aeruginosa PA01
gcgacucgcucgcuucag

SEQ ID NO: 3500087 - RNA, 15 nt, Pseudomonas aeruginosa PA01
gcgacucgcugccgg

SEQ ID NO: 3500088 - RNA, 14 nt, Pseudomonas aeruginosa PA01
gcgacucgcugggc

SEQ ID NO: 3500089 - RNA, 20 nt, Pseudomonas aeruginosa PA01
gcgacucgcugggcgccggc

SEQ ID NO: 3500090 - RNA, 22 nt, Pseudomonas aeruginosa PA01
gcgacucgcugggcgccggcag

SEQ ID NO: 3500091 - RNA, 16 nt, Pseudomonas aeruginosa PA01
gcgacucggcugcaac

SEQ ID NO: 3500092 - RNA, 18 nt, Pseudomonas aeruginosa PA01
gcgacucggcugcaacgc

SEQ ID NO: 3500093 - RNA, 23 nt, Pseudomonas aeruginosa PA01
gcgacucggcugcaacgccgcgg

SEQ ID NO: 3500094 - RNA, 22 nt, Pseudomonas aeruginosa PA01
gcgacucggggcgccuccagcg

SEQ ID NO: 3500095 - RNA, 20 nt, Pseudomonas aeruginosa PA01
gcgacucgguaaagcccagg

SEQ ID NO: 3500096 - RNA, 20 nt, Pseudomonas aeruginosa PA01
gcgacucguagucgaucagg

SEQ ID NO: 3500097 - RNA, 20 nt, Pseudomonas aeruginosa PA01
gcgacucguugcacgcaggc

SEQ ID NO: 3500098 - RNA, 20 nt, Pseudomonas aeruginosa PA01
gcgacugaccacgcagagcg

SEQ ID NO: 3500099 - RNA, 13 nt, Pseudomonas aeruginosa PA01
gcgacugccgucg

SEQ ID NO: 3500100 - RNA, 19 nt, Pseudomonas aeruginosa PA01
gcgacugccgucggcgccc

SEQ ID NO: 3500101 - RNA, 18 nt, Pseudomonas aeruginosa PA01
gcgacugcgcuggccgag

SEQ ID NO: 3500102 - RNA, 21 nt, Pseudomonas aeruginosa PA01
gcgacugcgcuggccgagcug

SEQ ID NO: 3500103 - RNA, 14 nt, Pseudomonas aeruginosa PA01
gcgacugcugauca

SEQ ID NO: 3500104 - RNA, 17 nt, Pseudomonas aeruginosa PA01
gcgacugcugaucagcu

SEQ ID NO: 3500105 - RNA, 13 nt, Pseudomonas aeruginosa PA01
gcgacugcugcug

SEQ ID NO: 3500106 - RNA, 15 nt, Pseudomonas aeruginosa PA01
gcgacugcugcugcg

SEQ ID NO: 3500107 - RNA, 16 nt, Pseudomonas aeruginosa PA01
gcgacugcugcugcgg

SEQ ID NO: 3500108 - RNA, 18 nt, Pseudomonas aeruginosa PA01
gcgacuggaugaacagcg

SEQ ID NO: 3500109 - RNA, 19 nt, Pseudomonas aeruginosa PA01
gcgacuggaugcagccgau

SEQ ID NO: 3500110 - RNA, 14 nt, Pseudomonas aeruginosa PA01
gcgacuggcccugg

SEQ ID NO: 3500111 - RNA, 20 nt, Pseudomonas aeruginosa PA01
gcgacuggggcaucucggcc

SEQ ID NO: 3500112 - RNA, 13 nt, Pseudomonas aeruginosa PA01
gcgacuggugguc

SEQ ID NO: 3500113 - RNA, 17 nt, Pseudomonas aeruginosa PA01
gcgacugguggucgagg

SEQ ID NO: 3500114 - RNA, 20 nt, Pseudomonas aeruginosa PA01
gcgacugucgagcagggucg

SEQ ID NO: 3500115 - RNA, 23 nt, Pseudomonas aeruginosa PA01
gcgacuucgcauuccaccuuggc

SEQ ID NO: 3500116 - RNA, 18 nt, Pseudomonas aeruginosa PA01
gcgacuuggacagcgucu

SEQ ID NO: 3500117 - RNA, 22 nt, Pseudomonas aeruginosa PA01
gcgagaaaaaccacgggaaugg

SEQ ID NO: 3500118 - RNA, 15 nt, Pseudomonas aeruginosa PA01
gcgagaaaggcugcu

SEQ ID NO: 3500119 - RNA, 23 nt, Pseudomonas aeruginosa PA01
gcgagaaaggcugcuucggcagc

SEQ ID NO: 3500120 - RNA, 14 nt, Pseudomonas aeruginosa PA01
gcgagaacagcucc

SEQ ID NO: 3500121 - RNA, 15 nt, Pseudomonas aeruginosa PA01
gcgagaagccagcca

SEQ ID NO: 3500122 - RNA, 16 nt, Pseudomonas aeruginosa PA01
gcgagaagccagccag

SEQ ID NO: 3500123 - RNA, 21 nt, Pseudomonas aeruginosa PA01
gcgagaagccagccaggucgg

SEQ ID NO: 3500124 - RNA, 14 nt, Pseudomonas aeruginosa PA01
gcgagaagccgccc

SEQ ID NO: 3500125 - RNA, 18 nt, Pseudomonas aeruginosa PA01
gcgagaaucgccgaggcg

SEQ ID NO: 3500126 - RNA, 13 nt, Pseudomonas aeruginosa PA01
gcgagaauggcga

SEQ ID NO: 3500127 - RNA, 18 nt, Pseudomonas aeruginosa PA01
gcgagaccaucuggauca

SEQ ID NO: 3500128 - RNA, 23 nt, Pseudomonas aeruginosa PA01
gcgagaccaucuggaucaggaag

SEQ ID NO: 3500129 - RNA, 16 nt, Pseudomonas aeruginosa PA01
gcgagaccccggcggc

SEQ ID NO: 3500130 - RNA, 17 nt, Pseudomonas aeruginosa PA01
gcgagaccccggcggcg

SEQ ID NO: 3500131 - RNA, 21 nt, Pseudomonas aeruginosa PA01
gcgagacccgguacuccucca

SEQ ID NO: 3500132 - RNA, 18 nt, Pseudomonas aeruginosa PA01
gcgagaccggggaucagc

SEQ ID NO: 3500133 - RNA, 15 nt, Pseudomonas aeruginosa PA01
gcgagaccucgccca

SEQ ID NO: 3500134 - RNA, 16 nt, Pseudomonas aeruginosa PA01
gcgagaccucgcccau

SEQ ID NO: 3500135 - RNA, 21 nt, Pseudomonas aeruginosa PA01
gcgagaccucgcccaucgcca

SEQ ID NO: 3500136 - RNA, 22 nt, Pseudomonas aeruginosa PA01
gcgagaccucgcccaucgccag

SEQ ID NO: 3500137 - RNA, 15 nt, Pseudomonas aeruginosa PA01
gcgagacgccgcccc

SEQ ID NO: 3500138 - RNA, 16 nt, Pseudomonas aeruginosa PA01
gcgagacgccgcccca

SEQ ID NO: 3500139 - RNA, 18 nt, Pseudomonas aeruginosa PA01
gcgagacgccgccccagc

SEQ ID NO: 3500140 - RNA, 15 nt, Pseudomonas aeruginosa PA01
gcgagacgggcgagg

SEQ ID NO: 3500141 - RNA, 16 nt, Pseudomonas aeruginosa PA01
gcgagacgggcgaggc

SEQ ID NO: 3500142 - RNA, 15 nt, Pseudomonas aeruginosa PA01
gcgagagcgccgacc

SEQ ID NO: 3500143 - RNA, 21 nt, Pseudomonas aeruginosa PA01
gcgagagcguccggcagggcc

SEQ ID NO: 3500144 - RNA, 22 nt, Pseudomonas aeruginosa PA01
gcgagagcguccggcagggccu

SEQ ID NO: 3500145 - RNA, 21 nt, Pseudomonas aeruginosa PA01
gcgagagcuguccggcgcuga

SEQ ID NO: 3500146 - RNA, 14 nt, Pseudomonas aeruginosa PA01
gcgagaggggcgcu

SEQ ID NO: 3500147 - RNA, 17 nt, Pseudomonas aeruginosa PA01
gcgagaggucggcgcgc

SEQ ID NO: 3500148 - RNA, 18 nt, Pseudomonas aeruginosa PA01
gcgagaggucggcgcgcc

SEQ ID NO: 3500149 - RNA, 23 nt, Pseudomonas aeruginosa PA01
gcgagaggucggcgcgcccggcg

SEQ ID NO: 3500150 - RNA, 15 nt, Pseudomonas aeruginosa PA01
gcgagauugcgcuga

SEQ ID NO: 3500151 - RNA, 17 nt, Pseudomonas aeruginosa PA01
gcgagcaacgcagguca

SEQ ID NO: 3500152 - RNA, 23 nt, Pseudomonas aeruginosa PA01
gcgagcaaugaaaaaggcgaucg

SEQ ID NO: 3500153 - RNA, 14 nt, Pseudomonas aeruginosa PA01
gcgagcaccaugca

SEQ ID NO: 3500154 - RNA, 19 nt, Pseudomonas aeruginosa PA01
gcgagcaccaugcagcggc

SEQ ID NO: 3500155 - RNA, 15 nt, Pseudomonas aeruginosa PA01
gcgagcaccaugccg

SEQ ID NO: 3500156 - RNA, 17 nt, Pseudomonas aeruginosa PA01
gcgagcaccaugccgau

SEQ ID NO: 3500157 - RNA, 18 nt, Pseudomonas aeruginosa PA01
gcgagcaccaugccgaug

SEQ ID NO: 3500158 - RNA, 19 nt, Pseudomonas aeruginosa PA01
gcgagcaccaugccgauga

SEQ ID NO: 3500159 - RNA, 13 nt, Pseudomonas aeruginosa PA01
gcgagcaccgcgc

SEQ ID NO: 3500160 - RNA, 14 nt, Pseudomonas aeruginosa PA01
gcgagcagcggcac

SEQ ID NO: 3500161 - RNA, 19 nt, Pseudomonas aeruginosa PA01
gcgagcagcggcacgcucu

SEQ ID NO: 3500162 - RNA, 15 nt, Pseudomonas aeruginosa PA01
gcgagcagcggcgcu

SEQ ID NO: 3500163 - RNA, 20 nt, Pseudomonas aeruginosa PA01
gcgagcagcggcgcuuucca

SEQ ID NO: 3500164 - RNA, 21 nt, Pseudomonas aeruginosa PA01
gcgagcagggaggagggcgag

SEQ ID NO: 3500165 - RNA, 17 nt, Pseudomonas aeruginosa PA01
gcgagcagggcgaugcc

SEQ ID NO: 3500166 - RNA, 19 nt, Pseudomonas aeruginosa PA01
gcgagcagggcgaugccga

SEQ ID NO: 3500167 - RNA, 13 nt, Pseudomonas aeruginosa PA01
gcgagcagguaga

SEQ ID NO: 3500168 - RNA, 15 nt, Pseudomonas aeruginosa PA01
gcgagcaucucggcc

SEQ ID NO: 3500169 - RNA, 17 nt, Pseudomonas aeruginosa PA01
gcgagcaucucggccag

SEQ ID NO: 3500170 - RNA, 18 nt, Pseudomonas aeruginosa PA01
gcgagcaucucggccagg

SEQ ID NO: 3500171 - RNA, 19 nt, Pseudomonas aeruginosa PA01
gcgagcaucucggccaggc

SEQ ID NO: 3500172 - RNA, 21 nt, Pseudomonas aeruginosa PA01
gcgagcaucucggccaggccc

SEQ ID NO: 3500173 - RNA, 22 nt, Pseudomonas aeruginosa PA01
gcgagcaucucggccaggcccu

SEQ ID NO: 3500174 - RNA, 21 nt, Pseudomonas aeruginosa PA01
gcgagcauuccucagcgccgg

SEQ ID NO: 3500175 - RNA, 16 nt, Pseudomonas aeruginosa PA01
gcgagccacauccagu

SEQ ID NO: 3500176 - RNA, 19 nt, Pseudomonas aeruginosa PA01
gcgagccagccguggcagg

SEQ ID NO: 3500177 - RNA, 12 nt, Pseudomonas aeruginosa PA01
gcgagccgagca

SEQ ID NO: 3500178 - RNA, 18 nt, Pseudomonas aeruginosa PA01
gcgagccgaucaccagca

SEQ ID NO: 3500179 - RNA, 20 nt, Pseudomonas aeruginosa PA01
gcgagccgaucaccagcaau

SEQ ID NO: 3500180 - RNA, 12 nt, Pseudomonas aeruginosa PA01
gcgagccgcagc

SEQ ID NO: 3500181 - RNA, 12 nt, Pseudomonas aeruginosa PA01
gcgagccgccgg

SEQ ID NO: 3500182 - RNA, 20 nt, Pseudomonas aeruginosa PA01
gcgagccgcgacggcugcuc

SEQ ID NO: 3500183 - RNA, 14 nt, Pseudomonas aeruginosa PA01
gcgagccgcgcagc

SEQ ID NO: 3500184 - RNA, 12 nt, Pseudomonas aeruginosa PA01
gcgagccgcgcg

SEQ ID NO: 3500185 - RNA, 13 nt, Pseudomonas aeruginosa PA01
gcgagccgcgcug

SEQ ID NO: 3500186 - RNA, 16 nt, Pseudomonas aeruginosa PA01
gcgagccgcgcugcug

SEQ ID NO: 3500187 - RNA, 20 nt, Pseudomonas aeruginosa PA01
gcgagccgguagugcuucag

SEQ ID NO: 3500188 - RNA, 14 nt, Pseudomonas aeruginosa PA01
gcgagccguccugc

SEQ ID NO: 3500189 - RNA, 19 nt, Pseudomonas aeruginosa PA01
gcgagccguccugcggccg

SEQ ID NO: 3500190 - RNA, 15 nt, Pseudomonas aeruginosa PA01
gcgagccuucagcac

SEQ ID NO: 3500191 - RNA, 17 nt, Pseudomonas aeruginosa PA01
gcgagcgaaacggcgcu

SEQ ID NO: 3500192 - RNA, 19 nt, Pseudomonas aeruginosa PA01
gcgagcgaaacggcgcuga

SEQ ID NO: 3500193 - RNA, 17 nt, Pseudomonas aeruginosa PA01
gcgagcgacggugauag

SEQ ID NO: 3500194 - RNA, 19 nt, Pseudomonas aeruginosa PA01
gcgagcgauccgcugcaug

SEQ ID NO: 3500195 - RNA, 19 nt, Pseudomonas aeruginosa PA01
gcgagcgcacaacgccuuc

SEQ ID NO: 3500196 - RNA, 23 nt, Pseudomonas aeruginosa PA01
gcgagcgcagacgggugcugaag

SEQ ID NO: 3500197 - RNA, 15 nt, Pseudomonas aeruginosa PA01
gcgagcgcccgccgu

SEQ ID NO: 3500198 - RNA, 14 nt, Pseudomonas aeruginosa PA01
gcgagcgccgccgg

SEQ ID NO: 3500199 - RNA, 16 nt, Pseudomonas aeruginosa PA01
gcgagcgccgccuuga

SEQ ID NO: 3500200 - RNA, 13 nt, Pseudomonas aeruginosa PA01
gcgagcgccgcgg

SEQ ID NO: 3500201 - RNA, 14 nt, Pseudomonas aeruginosa PA01
gcgagcgccgcggc

SEQ ID NO: 3500202 - RNA, 14 nt, Pseudomonas aeruginosa PA01
gcgagcgcggccgg

SEQ ID NO: 3500203 - RNA, 16 nt, Pseudomonas aeruginosa PA01
gcgagcgcggccggcc

SEQ ID NO: 3500204 - RNA, 17 nt, Pseudomonas aeruginosa PA01
gcgagcgcggccggcca

SEQ ID NO: 3500205 - RNA, 20 nt, Pseudomonas aeruginosa PA01
gcgagcgcggcuucagagcu

SEQ ID NO: 3500206 - RNA, 19 nt, Pseudomonas aeruginosa PA01
gcgagcgcuucauccugcg

SEQ ID NO: 3500207 - RNA, 18 nt, Pseudomonas aeruginosa PA01
gcgagcggcagauccgcc

SEQ ID NO: 3500208 - RNA, 19 nt, Pseudomonas aeruginosa PA01
gcgagcgggucagcagcac

SEQ ID NO: 3500209 - RNA, 14 nt, Pseudomonas aeruginosa PA01
gcgagcggucggcc

SEQ ID NO: 3500210 - RNA, 16 nt, Pseudomonas aeruginosa PA01
gcgagcggucggccau

SEQ ID NO: 3500211 - RNA, 19 nt, Pseudomonas aeruginosa PA01
gcgagcgguuauucgcccu

SEQ ID NO: 3500212 - RNA, 21 nt, Pseudomonas aeruginosa PA01
gcgagcguucggaucggcccg

SEQ ID NO: 3500213 - RNA, 16 nt, Pseudomonas aeruginosa PA01
gcgagcuaucgccucc

SEQ ID NO: 3500214 - RNA, 18 nt, Pseudomonas aeruginosa PA01
gcgagcuggaucggcagg

SEQ ID NO: 3500215 - RNA, 19 nt, Pseudomonas aeruginosa PA01
gcgagcuggaucggcaggc

SEQ ID NO: 3500216 - RNA, 20 nt, Pseudomonas aeruginosa PA01
gcgagcuggaucggcaggcu

SEQ ID NO: 3500217 - RNA, 12 nt, Pseudomonas aeruginosa PA01
gcgagcuggcgc

SEQ ID NO: 3500218 - RNA, 15 nt, Pseudomonas aeruginosa PA01
gcgagcuggcgccgu

SEQ ID NO: 3500219 - RNA, 16 nt, Pseudomonas aeruginosa PA01
gcgagcuggcgccguc

SEQ ID NO: 3500220 - RNA, 14 nt, Pseudomonas aeruginosa PA01
gcgagcuucgccgc

SEQ ID NO: 3500221 - RNA, 17 nt, Pseudomonas aeruginosa PA01
gcgagcuucgccgcgca

SEQ ID NO: 3500222 - RNA, 20 nt, Pseudomonas aeruginosa PA01
gcgagcuucgccgcgcaagc

SEQ ID NO: 3500223 - RNA, 21 nt, Pseudomonas aeruginosa PA01
gcgagcuugcaauccgugcgc

SEQ ID NO: 3500224 - RNA, 18 nt, Pseudomonas aeruginosa PA01
gcgagcuuggcccuggcc

SEQ ID NO: 3500225 - RNA, 19 nt, Pseudomonas aeruginosa PA01
gcgaggaaaaggaucgccg

SEQ ID NO: 3500226 - RNA, 22 nt, Pseudomonas aeruginosa PA01
gcgaggaaaaggaucgccgcga

SEQ ID NO: 3500227 - RNA, 20 nt, Pseudomonas aeruginosa PA01
gcgaggaacacccagaagcc

SEQ ID NO: 3500228 - RNA, 15 nt, Pseudomonas aeruginosa PA01
gcgaggaacagcacc

SEQ ID NO: 3500229 - RNA, 12 nt, Pseudomonas aeruginosa PA01
gcgaggacgccg

SEQ ID NO: 3500230 - RNA, 23 nt, Pseudomonas aeruginosa PA01
gcgaggagccuuucacuuucagg

SEQ ID NO: 3500231 - RNA, 17 nt, Pseudomonas aeruginosa PA01
gcgaggagguuggucug

SEQ ID NO: 3500232 - RNA, 22 nt, Pseudomonas aeruginosa PA01
gcgaggagguuggucugcucgg

SEQ ID NO: 3500233 - RNA, 19 nt, Pseudomonas aeruginosa PA01
gcgaggaucacgcagcagg

SEQ ID NO: 3500234 - RNA, 13 nt, Pseudomonas aeruginosa PA01
gcgaggaucagcc

SEQ ID NO: 3500235 - RNA, 14 nt, Pseudomonas aeruginosa PA01
gcgaggaucgccag

SEQ ID NO: 3500236 - RNA, 15 nt, Pseudomonas aeruginosa PA01
gcgaggaucgccagc

SEQ ID NO: 3500237 - RNA, 16 nt, Pseudomonas aeruginosa PA01
gcgaggaucgccagca

SEQ ID NO: 3500238 - RNA, 13 nt, Pseudomonas aeruginosa PA01
gcgaggaucgcgc

SEQ ID NO: 3500239 - RNA, 14 nt, Pseudomonas aeruginosa PA01
gcgaggaucgcgcu

SEQ ID NO: 3500240 - RNA, 21 nt, Pseudomonas aeruginosa PA01
gcgaggaucgcgcuggccagu

SEQ ID NO: 3500241 - RNA, 20 nt, Pseudomonas aeruginosa PA01
gcgaggaucgcucccaggcu

SEQ ID NO: 3500242 - RNA, 22 nt, Pseudomonas aeruginosa PA01
gcgaggaucgcucccaggcuca

SEQ ID NO: 3500243 - RNA, 23 nt, Pseudomonas aeruginosa PA01
gcgaggauuuccggcuugccgau

SEQ ID NO: 3500244 - RNA, 17 nt, Pseudomonas aeruginosa PA01
gcgaggauuuccucgcg

SEQ ID NO: 3500245 - RNA, 19 nt, Pseudomonas aeruginosa PA01
gcgaggauuuccucgcgca

SEQ ID NO: 3500246 - RNA, 15 nt, Pseudomonas aeruginosa PA01
gcgaggcauucucgc

SEQ ID NO: 3500247 - RNA, 23 nt, Pseudomonas aeruginosa PA01
gcgaggcauucucgcgacccugg

SEQ ID NO: 3500248 - RNA, 15 nt, Pseudomonas aeruginosa PA01
gcgaggcccgcgccg

SEQ ID NO: 3500249 - RNA, 16 nt, Pseudomonas aeruginosa PA01
gcgaggcccgcgccgc

SEQ ID NO: 3500250 - RNA, 19 nt, Pseudomonas aeruginosa PA01
gcgaggcccgcgccgccgg

SEQ ID NO: 3500251 - RNA, 20 nt, Pseudomonas aeruginosa PA01
gcgaggcccguauggcgggc

SEQ ID NO: 3500252 - RNA, 12 nt, Pseudomonas aeruginosa PA01
gcgaggccgacc

SEQ ID NO: 3500253 - RNA, 12 nt, Pseudomonas aeruginosa PA01
gcgaggccgcuc

SEQ ID NO: 3500254 - RNA, 12 nt, Pseudomonas aeruginosa PA01
gcgaggccggcg

SEQ ID NO: 3500255 - RNA, 20 nt, Pseudomonas aeruginosa PA01
gcgaggccguaccagucgcc

SEQ ID NO: 3500256 - RNA, 21 nt, Pseudomonas aeruginosa PA01
gcgaggccguaccagucgccc

SEQ ID NO: 3500257 - RNA, 12 nt, Pseudomonas aeruginosa PA01
gcgaggcgcccg

SEQ ID NO: 3500258 - RNA, 13 nt, Pseudomonas aeruginosa PA01
gcgaggcgcccgc

SEQ ID NO: 3500259 - RNA, 19 nt, Pseudomonas aeruginosa PA01
gcgaggcgcccgccggccg

SEQ ID NO: 3500260 - RNA, 12 nt, Pseudomonas aeruginosa PA01
gcgaggcgcgcc

SEQ ID NO: 3500261 - RNA, 13 nt, Pseudomonas aeruginosa PA01
gcgaggcgcgccu

SEQ ID NO: 3500262 - RNA, 15 nt, Pseudomonas aeruginosa PA01
gcgaggcgcgccugg

SEQ ID NO: 3500263 - RNA, 20 nt, Pseudomonas aeruginosa PA01
gcgaggcgcucuucacuucc

SEQ ID NO: 3500264 - RNA, 19 nt, Pseudomonas aeruginosa PA01
gcgaggcggucaugcgccc

SEQ ID NO: 3500265 - RNA, 18 nt, Pseudomonas aeruginosa PA01
gcgaggcuaacgccgagg

SEQ ID NO: 3500266 - RNA, 19 nt, Pseudomonas aeruginosa PA01
gcgaggcuaacgccgagga

SEQ ID NO: 3500267 - RNA, 19 nt, Pseudomonas aeruginosa PA01
gcgagggauguuccaggcc

SEQ ID NO: 3500268 - RNA, 20 nt, Pseudomonas aeruginosa PA01
gcgagggauguuccaggccc

SEQ ID NO: 3500269 - RNA, 21 nt, Pseudomonas aeruginosa PA01
gcgagggauguuccaggcccg

SEQ ID NO: 3500270 - RNA, 13 nt, Pseudomonas aeruginosa PA01
gcgagggcgccgg

SEQ ID NO: 3500271 - RNA, 13 nt, Pseudomonas aeruginosa PA01
gcgagggcgcgca

SEQ ID NO: 3500272 - RNA, 13 nt, Pseudomonas aeruginosa PA01
gcgagggcggcgc

SEQ ID NO: 3500273 - RNA, 19 nt, Pseudomonas aeruginosa PA01
gcgagggcggcgcgggcgc

SEQ ID NO: 3500274 - RNA, 15 nt, Pseudomonas aeruginosa PA01
gcgagggcggcggcu

SEQ ID NO: 3500275 - RNA, 16 nt, Pseudomonas aeruginosa PA01
gcgagggcggcggcuc

SEQ ID NO: 3500276 - RNA, 15 nt, Pseudomonas aeruginosa PA01
gcgagggcucgggcg

SEQ ID NO: 3500277 - RNA, 16 nt, Pseudomonas aeruginosa PA01
gcgagggcucgggcgc

SEQ ID NO: 3500278 - RNA, 12 nt, Pseudomonas aeruginosa PA01
gcgaggggcgga

SEQ ID NO: 3500279 - RNA, 19 nt, Pseudomonas aeruginosa PA01
gcgagggggccucggccag

SEQ ID NO: 3500280 - RNA, 20 nt, Pseudomonas aeruginosa PA01
gcgagggggccucggccagc

SEQ ID NO: 3500281 - RNA, 13 nt, Pseudomonas aeruginosa PA01
gcgaggguggcgc

SEQ ID NO: 3500282 - RNA, 14 nt, Pseudomonas aeruginosa PA01
gcgaggguggcgcc

SEQ ID NO: 3500283 - RNA, 15 nt, Pseudomonas aeruginosa PA01
gcgaggguggcgccc

SEQ ID NO: 3500284 - RNA, 16 nt, Pseudomonas aeruginosa PA01
gcgaggucugugccgu

SEQ ID NO: 3500285 - RNA, 18 nt, Pseudomonas aeruginosa PA01
gcgaggugaucgagggcc

SEQ ID NO: 3500286 - RNA, 18 nt, Pseudomonas aeruginosa PA01
gcgagguggaugaacagc

SEQ ID NO: 3500287 - RNA, 19 nt, Pseudomonas aeruginosa PA01
gcgagguggaugaacagcg

SEQ ID NO: 3500288 - RNA, 20 nt, Pseudomonas aeruginosa PA01
gcgagguggaugaacagcgg

SEQ ID NO: 3500289 - RNA, 17 nt, Pseudomonas aeruginosa PA01
gcgagguuccgcggcga

SEQ ID NO: 3500290 - RNA, 19 nt, Pseudomonas aeruginosa PA01
gcgagguuccgcggcgacg

SEQ ID NO: 3500291 - RNA, 16 nt, Pseudomonas aeruginosa PA01
gcgagguugcccacgg

SEQ ID NO: 3500292 - RNA, 18 nt, Pseudomonas aeruginosa PA01
gcgagguugcccacggcc

SEQ ID NO: 3500293 - RNA, 19 nt, Pseudomonas aeruginosa PA01
gcgagguugcccacggcca

SEQ ID NO: 3500294 - RNA, 21 nt, Pseudomonas aeruginosa PA01
gcgagguuucgcuuuccucgg

SEQ ID NO: 3500295 - RNA, 15 nt, Pseudomonas aeruginosa PA01
gcgaguaaccaccgc

SEQ ID NO: 3500296 - RNA, 22 nt, Pseudomonas aeruginosa PA01
gcgaguaccaccgugcccgccg

SEQ ID NO: 3500297 - RNA, 24 nt, Pseudomonas aeruginosa PA01
gcgaguaccaccgugcccgccggc

SEQ ID NO: 3500298 - RNA, 23 nt, Pseudomonas aeruginosa PA01
gcgaguaguagcguuccuggcgc

SEQ ID NO: 3500299 - RNA, 23 nt, Pseudomonas aeruginosa PA01
gcgaguaguaggucgguucgccc

SEQ ID NO: 3500300 - RNA, 18 nt, Pseudomonas aeruginosa PA01
gcgaguagucgcggggcg

SEQ ID NO: 3500301 - RNA, 23 nt, Pseudomonas aeruginosa PA01
gcgagucaccccgaccagcgcgc

SEQ ID NO: 3500302 - RNA, 17 nt, Pseudomonas aeruginosa PA01
gcgaguccuucggcgca

SEQ ID NO: 3500303 - RNA, 23 nt, Pseudomonas aeruginosa PA01
gcgagucgacccaggcccagccg

SEQ ID NO: 3500304 - RNA, 15 nt, Pseudomonas aeruginosa PA01
gcgagucgaucaggu

SEQ ID NO: 3500305 - RNA, 22 nt, Pseudomonas aeruginosa PA01
gcgagucgaucaggucgccgcc

SEQ ID NO: 3500306 - RNA, 13 nt, Pseudomonas aeruginosa PA01
gcgagucgucgga

SEQ ID NO: 3500307 - RNA, 21 nt, Pseudomonas aeruginosa PA01
gcgagucguuacgaaacggcg

SEQ ID NO: 3500308 - RNA, 19 nt, Pseudomonas aeruginosa PA01
gcgagucuugaggaagucg

SEQ ID NO: 3500309 - RNA, 19 nt, Pseudomonas aeruginosa PA01
gcgagugcugaacaucagg

SEQ ID NO: 3500310 - RNA, 16 nt, Pseudomonas aeruginosa PA01
gcgaguucgccggcca

SEQ ID NO: 3500311 - RNA, 17 nt, Pseudomonas aeruginosa PA01
gcgaguucgccggccag

SEQ ID NO: 3500312 - RNA, 21 nt, Pseudomonas aeruginosa PA01
gcgaguucggcguuguccagg

SEQ ID NO: 3500313 - RNA, 23 nt, Pseudomonas aeruginosa PA01
gcgauacaccugcaacucggcgu

SEQ ID NO: 3500314 - RNA, 14 nt, Pseudomonas aeruginosa PA01
gcgauacaggcggu

SEQ ID NO: 3500315 - RNA, 16 nt, Pseudomonas aeruginosa PA01
gcgauacaggcgguga

SEQ ID NO: 3500316 - RNA, 15 nt, Pseudomonas aeruginosa PA01
gcgauacccaggccg

SEQ ID NO: 3500317 - RNA, 16 nt, Pseudomonas aeruginosa PA01
gcgauacccaggccgu

SEQ ID NO: 3500318 - RNA, 19 nt, Pseudomonas aeruginosa PA01
gcgauacccaggccgucga

SEQ ID NO: 3500319 - RNA, 14 nt, Pseudomonas aeruginosa PA01
gcgauacccuggcc

SEQ ID NO: 3500320 - RNA, 17 nt, Pseudomonas aeruginosa PA01
gcgauacccuggccggc

SEQ ID NO: 3500321 - RNA, 24 nt, Pseudomonas aeruginosa PA01
gcgauacccuggccggccucggcg

SEQ ID NO: 3500322 - RNA, 22 nt, Pseudomonas aeruginosa PA01
gcgauagaccaggaaggccggg

SEQ ID NO: 3500323 - RNA, 23 nt, Pseudomonas aeruginosa PA01
gcgauagaccaggaaggccgggc

SEQ ID NO: 3500324 - RNA, 13 nt, Pseudomonas aeruginosa PA01
gcgauagaccgcu

SEQ ID NO: 3500325 - RNA, 13 nt, Pseudomonas aeruginosa PA01
gcgauagccgggg

SEQ ID NO: 3500326 - RNA, 12 nt, Pseudomonas aeruginosa PA01
gcgauagcucag

SEQ ID NO: 3500327 - RNA, 13 nt, Pseudomonas aeruginosa PA01
gcgauaggcgcgc

SEQ ID NO: 3500328 - RNA, 19 nt, Pseudomonas aeruginosa PA01
gcgauaggcgcgcaacgcu

SEQ ID NO: 3500329 - RNA, 23 nt, Pseudomonas aeruginosa PA01
gcgauaucccgccgccgcgccuu

SEQ ID NO: 3500330 - RNA, 14 nt, Pseudomonas aeruginosa PA01
gcgauauccgccag

SEQ ID NO: 3500331 - RNA, 17 nt, Pseudomonas aeruginosa PA01
gcgauauccgccaggcg

SEQ ID NO: 3500332 - RNA, 16 nt, Pseudomonas aeruginosa PA01
gcgauauccgccaggg

SEQ ID NO: 3500333 - RNA, 17 nt, Pseudomonas aeruginosa PA01
gcgauauccgccaggga

SEQ ID NO: 3500334 - RNA, 12 nt, Pseudomonas aeruginosa PA01
gcgauaucgcag

SEQ ID NO: 3500335 - RNA, 17 nt, Pseudomonas aeruginosa PA01
gcgauaucgcaggccag

SEQ ID NO: 3500336 - RNA, 18 nt, Pseudomonas aeruginosa PA01
gcgauauggccguagccg

SEQ ID NO: 3500337 - RNA, 18 nt, Pseudomonas aeruginosa PA01
gcgaucacauagcuguag

SEQ ID NO: 3500338 - RNA, 23 nt, Pseudomonas aeruginosa PA01
gcgaucacauagcuguagcggcu

SEQ ID NO: 3500339 - RNA, 12 nt, Pseudomonas aeruginosa PA01
gcgaucacccgg

SEQ ID NO: 3500340 - RNA, 16 nt, Pseudomonas aeruginosa PA01
gcgaucaccgcgucca

SEQ ID NO: 3500341 - RNA, 19 nt, Pseudomonas aeruginosa PA01
gcgaucaccgcguccaucc

SEQ ID NO: 3500342 - RNA, 16 nt, Pseudomonas aeruginosa PA01
gcgaucacgccgcgca

SEQ ID NO: 3500343 - RNA, 15 nt, Pseudomonas aeruginosa PA01
gcgaucacgguggua

SEQ ID NO: 3500344 - RNA, 18 nt, Pseudomonas aeruginosa PA01
gcgaucagcaccagcgga

SEQ ID NO: 3500345 - RNA, 21 nt, Pseudomonas aeruginosa PA01
gcgaucagcgaaauggucacc

SEQ ID NO: 3500346 - RNA, 22 nt, Pseudomonas aeruginosa PA01
gcgaucaggccgaugcgcaacg

SEQ ID NO: 3500347 - RNA, 16 nt, Pseudomonas aeruginosa PA01
gcgaucagggccucgc

SEQ ID NO: 3500348 - RNA, 18 nt, Pseudomonas aeruginosa PA01
gcgaucagggccucgcca

SEQ ID NO: 3500349 - RNA, 16 nt, Pseudomonas aeruginosa PA01
gcgaucauccagcccc

SEQ ID NO: 3500350 - RNA, 14 nt, Pseudomonas aeruginosa PA01
gcgaucaucgccac

SEQ ID NO: 3500351 - RNA, 15 nt, Pseudomonas aeruginosa PA01
gcgaucaucgccacc

SEQ ID NO: 3500352 - RNA, 16 nt, Pseudomonas aeruginosa PA01
gcgaucaucgccaccg

SEQ ID NO: 3500353 - RNA, 13 nt, Pseudomonas aeruginosa PA01
gcgauccaccgcc

SEQ ID NO: 3500354 - RNA, 15 nt, Pseudomonas aeruginosa PA01
gcgauccaccgccag

SEQ ID NO: 3500355 - RNA, 22 nt, Pseudomonas aeruginosa PA01
gcgauccaccgccagggcgcuc

SEQ ID NO: 3500356 - RNA, 19 nt, Pseudomonas aeruginosa PA01
gcgaucccaggucggcggg

SEQ ID NO: 3500357 - RNA, 13 nt, Pseudomonas aeruginosa PA01
gcgauccgcgcgg

SEQ ID NO: 3500358 - RNA, 15 nt, Pseudomonas aeruginosa PA01
gcgauccgcgcggca

SEQ ID NO: 3500359 - RNA, 13 nt, Pseudomonas aeruginosa PA01
gcgauccgcugca

SEQ ID NO: 3500360 - RNA, 13 nt, Pseudomonas aeruginosa PA01
gcgauccuccgcc

SEQ ID NO: 3500361 - RNA, 16 nt, Pseudomonas aeruginosa PA01
gcgauccuccgccagc

SEQ ID NO: 3500362 - RNA, 22 nt, Pseudomonas aeruginosa PA01
gcgauccuccgccagccccagg

SEQ ID NO: 3500363 - RNA, 14 nt, Pseudomonas aeruginosa PA01
gcgauccugaccgu

SEQ ID NO: 3500364 - RNA, 20 nt, Pseudomonas aeruginosa PA01
gcgauccugaccguccuggc

SEQ ID NO: 3500365 - RNA, 23 nt, Pseudomonas aeruginosa PA01
gcgauccugaccguccuggcccu

SEQ ID NO: 3500366 - RNA, 13 nt, Pseudomonas aeruginosa PA01
gcgaucgaccugc

SEQ ID NO: 3500367 - RNA, 14 nt, Pseudomonas aeruginosa PA01
gcgaucgaccugcc

SEQ ID NO: 3500368 - RNA, 20 nt, Pseudomonas aeruginosa PA01
gcgaucgaccugccgguagu

SEQ ID NO: 3500369 - RNA, 16 nt, Pseudomonas aeruginosa PA01
gcgaucgagcugucca

SEQ ID NO: 3500370 - RNA, 17 nt, Pseudomonas aeruginosa PA01
gcgaucgagcuguccau

SEQ ID NO: 3500371 - RNA, 22 nt, Pseudomonas aeruginosa PA01
gcgaucgaggccuacccgcgcu

SEQ ID NO: 3500372 - RNA, 15 nt, Pseudomonas aeruginosa PA01
gcgaucgaucggcug

SEQ ID NO: 3500373 - RNA, 18 nt, Pseudomonas aeruginosa PA01
gcgaucgaucggcugguc

SEQ ID NO: 3500374 - RNA, 14 nt, Pseudomonas aeruginosa PA01
gcgaucgccaggcg

SEQ ID NO: 3500375 - RNA, 16 nt, Pseudomonas aeruginosa PA01
gcgaucgccaggcgau

SEQ ID NO: 3500376 - RNA, 18 nt, Pseudomonas aeruginosa PA01
gcgaucgccaggcgaucc

SEQ ID NO: 3500377 - RNA, 19 nt, Pseudomonas aeruginosa PA01
gcgaucgccaggcgaucca

SEQ ID NO: 3500378 - RNA, 22 nt, Pseudomonas aeruginosa PA01
gcgaucgccaggcgauccagcg

SEQ ID NO: 3500379 - RNA, 21 nt, Pseudomonas aeruginosa PA01
gcgaucgccaguuccgugucg

SEQ ID NO: 3500380 - RNA, 13 nt, Pseudomonas aeruginosa PA01
gcgaucgccccgu

SEQ ID NO: 3500381 - RNA, 18 nt, Pseudomonas aeruginosa PA01
gcgaucgccccguuggug

SEQ ID NO: 3500382 - RNA, 13 nt, Pseudomonas aeruginosa PA01
gcgaucgccgcca

SEQ ID NO: 3500383 - RNA, 15 nt, Pseudomonas aeruginosa PA01
gcgaucgccgcggcg

SEQ ID NO: 3500384 - RNA, 16 nt, Pseudomonas aeruginosa PA01
gcgaucgccgcggcga

SEQ ID NO: 3500385 - RNA, 13 nt, Pseudomonas aeruginosa PA01
gcgaucgccggcg

SEQ ID NO: 3500386 - RNA, 14 nt, Pseudomonas aeruginosa PA01
gcgaucgccggcgu

SEQ ID NO: 3500387 - RNA, 19 nt, Pseudomonas aeruginosa PA01
gcgaucgcggccagccgcu

SEQ ID NO: 3500388 - RNA, 19 nt, Pseudomonas aeruginosa PA01
gcgaucggguagagcgcgg

SEQ ID NO: 3500389 - RNA, 15 nt, Pseudomonas aeruginosa PA01
gcgaucuccgccagg

SEQ ID NO: 3500390 - RNA, 16 nt, Pseudomonas aeruginosa PA01
gcgaucuccgccaggc

SEQ ID NO: 3500391 - RNA, 17 nt, Pseudomonas aeruginosa PA01
gcgaucuccgccaggcg

SEQ ID NO: 3500392 - RNA, 21 nt, Pseudomonas aeruginosa PA01
gcgaucuccgccaggcggccg

SEQ ID NO: 3500393 - RNA, 14 nt, Pseudomonas aeruginosa PA01
gcgaucuccugccg

SEQ ID NO: 3500394 - RNA, 19 nt, Pseudomonas aeruginosa PA01
gcgaucuccugccgcggcg

SEQ ID NO: 3500395 - RNA, 15 nt, Pseudomonas aeruginosa PA01
gcgaucucggcgcgg

SEQ ID NO: 3500396 - RNA, 16 nt, Pseudomonas aeruginosa PA01
gcgaucucucagucca

SEQ ID NO: 3500397 - RNA, 12 nt, Pseudomonas aeruginosa PA01
gcgaucugcugg

SEQ ID NO: 3500398 - RNA, 16 nt, Pseudomonas aeruginosa PA01
gcgaucugcugguuga

SEQ ID NO: 3500399 - RNA, 20 nt, Pseudomonas aeruginosa PA01
gcgaucuucagguaggcgcg

SEQ ID NO: 3500400 - RNA, 22 nt, Pseudomonas aeruginosa PA01
gcgaucuucagguaggcgcggg

SEQ ID NO: 3500401 - RNA, 13 nt, Pseudomonas aeruginosa PA01
gcgaucuucuccg

SEQ ID NO: 3500402 - RNA, 17 nt, Pseudomonas aeruginosa PA01
gcgaucuugaucgccag

SEQ ID NO: 3500403 - RNA, 18 nt, Pseudomonas aeruginosa PA01
gcgaucuugaucgccagc

SEQ ID NO: 3500404 - RNA, 15 nt, Pseudomonas aeruginosa PA01
gcgaugaacggcguc

SEQ ID NO: 3500405 - RNA, 20 nt, Pseudomonas aeruginosa PA01
gcgaugaccaggguggcggc

SEQ ID NO: 3500406 - RNA, 16 nt, Pseudomonas aeruginosa PA01
gcgaugaccgccccgg

SEQ ID NO: 3500407 - RNA, 14 nt, Pseudomonas aeruginosa PA01
gcgaugaggcuguc

SEQ ID NO: 3500408 - RNA, 16 nt, Pseudomonas aeruginosa PA01
gcgaugaucagcccuu

SEQ ID NO: 3500409 - RNA, 23 nt, Pseudomonas aeruginosa PA01
gcgaugaucggcagccguccgcc

SEQ ID NO: 3500410 - RNA, 13 nt, Pseudomonas aeruginosa PA01
gcgaugaucuggc

SEQ ID NO: 3500411 - RNA, 15 nt, Pseudomonas aeruginosa PA01
gcgaugaucuggcca

SEQ ID NO: 3500412 - RNA, 16 nt, Pseudomonas aeruginosa PA01
gcgaugaugccgccgu

SEQ ID NO: 3500413 - RNA, 22 nt, Pseudomonas aeruginosa PA01
gcgaugauggucaacaccagcg

SEQ ID NO: 3500414 - RNA, 18 nt, Pseudomonas aeruginosa PA01
gcgaugcccaggccgccg

SEQ ID NO: 3500415 - RNA, 19 nt, Pseudomonas aeruginosa PA01
gcgaugcccaggccgccga

SEQ ID NO: 3500416 - RNA, 20 nt, Pseudomonas aeruginosa PA01
gcgaugcccaggccgccgau

SEQ ID NO: 3500417 - RNA, 20 nt, Pseudomonas aeruginosa PA01
gcgaugccccauccgacgcc

SEQ ID NO: 3500418 - RNA, 22 nt, Pseudomonas aeruginosa PA01
gcgaugccccauccgacgccgg

SEQ ID NO: 3500419 - RNA, 14 nt, Pseudomonas aeruginosa PA01
gcgaugcccuggcc

SEQ ID NO: 3500420 - RNA, 19 nt, Pseudomonas aeruginosa PA01
gcgaugcccuggccgcugc

SEQ ID NO: 3500421 - RNA, 14 nt, Pseudomonas aeruginosa PA01
gcgaugcccuggcu

SEQ ID NO: 3500422 - RNA, 19 nt, Pseudomonas aeruginosa PA01
gcgaugcccuuggccagcg

SEQ ID NO: 3500423 - RNA, 19 nt, Pseudomonas aeruginosa PA01
gcgaugccgaugccgccga

SEQ ID NO: 3500424 - RNA, 14 nt, Pseudomonas aeruginosa PA01
gcgaugccgauggc

SEQ ID NO: 3500425 - RNA, 22 nt, Pseudomonas aeruginosa PA01
gcgaugccgauggcgccgccga

SEQ ID NO: 3500426 - RNA, 15 nt, Pseudomonas aeruginosa PA01
gcgaugccgccgggc

SEQ ID NO: 3500427 - RNA, 16 nt, Pseudomonas aeruginosa PA01
gcgaugccgccgggca

SEQ ID NO: 3500428 - RNA, 13 nt, Pseudomonas aeruginosa PA01
gcgaugccgcgcc

SEQ ID NO: 3500429 - RNA, 14 nt, Pseudomonas aeruginosa PA01
gcgaugccgcgcca

SEQ ID NO: 3500430 - RNA, 18 nt, Pseudomonas aeruginosa PA01
gcgaugccgcgccaggcg

SEQ ID NO: 3500431 - RNA, 23 nt, Pseudomonas aeruginosa PA01
gcgaugccggagagcagcacggc

SEQ ID NO: 3500432 - RNA, 15 nt, Pseudomonas aeruginosa PA01
gcgaugcgcaggccg

SEQ ID NO: 3500433 - RNA, 11 nt, Pseudomonas aeruginosa PA01
gcgaugcgccg

SEQ ID NO: 3500434 - RNA, 14 nt, Pseudomonas aeruginosa PA01
gcgaugcgccgguc

SEQ ID NO: 3500435 - RNA, 14 nt, Pseudomonas aeruginosa PA01
gcgaugcgcuggaa

SEQ ID NO: 3500436 - RNA, 16 nt, Pseudomonas aeruginosa PA01
gcgaugcggcggaacu

SEQ ID NO: 3500437 - RNA, 20 nt, Pseudomonas aeruginosa PA01
gcgaugcgguuccuggcugg

SEQ ID NO: 3500438 - RNA, 17 nt, Pseudomonas aeruginosa PA01
gcgaugcguuccagggc

SEQ ID NO: 3500439 - RNA, 15 nt, Pseudomonas aeruginosa PA01
gcgaugcucagcgcc

SEQ ID NO: 3500440 - RNA, 16 nt, Pseudomonas aeruginosa PA01
gcgaugcucagcgccg

SEQ ID NO: 3500441 - RNA, 18 nt, Pseudomonas aeruginosa PA01
gcgaugcucagcgccggc

SEQ ID NO: 3500442 - RNA, 13 nt, Pseudomonas aeruginosa PA01
gcgaugcugaccc

SEQ ID NO: 3500443 - RNA, 14 nt, Pseudomonas aeruginosa PA01
gcgaugcugcugau

SEQ ID NO: 3500444 - RNA, 22 nt, Pseudomonas aeruginosa PA01
gcgaugcugugcagggaggcau

SEQ ID NO: 3500445 - RNA, 21 nt, Pseudomonas aeruginosa PA01
gcgauggaacgagcgcgacuc

SEQ ID NO: 3500446 - RNA, 22 nt, Pseudomonas aeruginosa PA01
gcgauggaugacccgcucgccg

SEQ ID NO: 3500447 - RNA, 23 nt, Pseudomonas aeruginosa PA01
gcgauggaugacccgcucgccgg

SEQ ID NO: 3500448 - RNA, 17 nt, Pseudomonas aeruginosa PA01
gcgauggaugcgcggca

SEQ ID NO: 3500449 - RNA, 13 nt, Pseudomonas aeruginosa PA01
gcgauggccagcg

SEQ ID NO: 3500450 - RNA, 15 nt, Pseudomonas aeruginosa PA01
gcgauggccagcgcg

SEQ ID NO: 3500451 - RNA, 17 nt, Pseudomonas aeruginosa PA01
gcgauggcccagaugau

SEQ ID NO: 3500452 - RNA, 14 nt, Pseudomonas aeruginosa PA01
gcgauggcccguuc

SEQ ID NO: 3500453 - RNA, 21 nt, Pseudomonas aeruginosa PA01
gcgauggcccguuccaccgcc

SEQ ID NO: 3500454 - RNA, 16 nt, Pseudomonas aeruginosa PA01
gcgauggccgccagca

SEQ ID NO: 3500455 - RNA, 21 nt, Pseudomonas aeruginosa PA01
gcgauggccgccagcaggccg

SEQ ID NO: 3500456 - RNA, 13 nt, Pseudomonas aeruginosa PA01
gcgauggccgccu

SEQ ID NO: 3500457 - RNA, 21 nt, Pseudomonas aeruginosa PA01
gcgauggccgccugcagggcg

SEQ ID NO: 3500458 - RNA, 15 nt, Pseudomonas aeruginosa PA01
gcgauggccggcacc

SEQ ID NO: 3500459 - RNA, 13 nt, Pseudomonas aeruginosa PA01
gcgauggccggcg

SEQ ID NO: 3500460 - RNA, 16 nt, Pseudomonas aeruginosa PA01
gcgauggccggcggag

SEQ ID NO: 3500461 - RNA, 16 nt, Pseudomonas aeruginosa PA01
gcgauggccuggucgg

SEQ ID NO: 3500462 - RNA, 19 nt, Pseudomonas aeruginosa PA01
gcgauggccuggucggcgc

SEQ ID NO: 3500463 - RNA, 20 nt, Pseudomonas aeruginosa PA01
gcgauggccuggucggcgcg

SEQ ID NO: 3500464 - RNA, 16 nt, Pseudomonas aeruginosa PA01
gcgauggcucgcggcg

SEQ ID NO: 3500465 - RNA, 17 nt, Pseudomonas aeruginosa PA01
gcgauggcucgcggcgc

SEQ ID NO: 3500466 - RNA, 18 nt, Pseudomonas aeruginosa PA01
gcgauggcucgcggcgcu

SEQ ID NO: 3500467 - RNA, 19 nt, Pseudomonas aeruginosa PA01
gcgauggcucgcggcgcuc

SEQ ID NO: 3500468 - RNA, 16 nt, Pseudomonas aeruginosa PA01
gcgaugggugccgcgc

SEQ ID NO: 3500469 - RNA, 19 nt, Pseudomonas aeruginosa PA01
gcgaugggugccgcgcagg

SEQ ID NO: 3500470 - RNA, 16 nt, Pseudomonas aeruginosa PA01
gcgaugguaguccgcu

SEQ ID NO: 3500471 - RNA, 19 nt, Pseudomonas aeruginosa PA01
gcgaugguaguccgcugcg

SEQ ID NO: 3500472 - RNA, 22 nt, Pseudomonas aeruginosa PA01
gcgaugguugccguacuucagg

SEQ ID NO: 3500473 - RNA, 19 nt, Pseudomonas aeruginosa PA01
gcgauguaggucaccgcgc

SEQ ID NO: 3500474 - RNA, 21 nt, Pseudomonas aeruginosa PA01
gcgauguaggucaccgcgccg

SEQ ID NO: 3500475 - RNA, 22 nt, Pseudomonas aeruginosa PA01
gcgauguaggucaccgcgccgg

SEQ ID NO: 3500476 - RNA, 15 nt, Pseudomonas aeruginosa PA01
gcgauguccaggccg

SEQ ID NO: 3500477 - RNA, 16 nt, Pseudomonas aeruginosa PA01
gcgauguccccggcca

SEQ ID NO: 3500478 - RNA, 19 nt, Pseudomonas aeruginosa PA01
gcgauguccuggaucggca

SEQ ID NO: 3500479 - RNA, 20 nt, Pseudomonas aeruginosa PA01
gcgauguccuggaucggcag

SEQ ID NO: 3500480 - RNA, 15 nt, Pseudomonas aeruginosa PA01
gcgaugugcggcgug

SEQ ID NO: 3500481 - RNA, 19 nt, Pseudomonas aeruginosa PA01
gcgauguucaccgcggccu

SEQ ID NO: 3500482 - RNA, 20 nt, Pseudomonas aeruginosa PA01
gcgauguucaccgcggccuu

SEQ ID NO: 3500483 - RNA, 15 nt, Pseudomonas aeruginosa PA01
gcgauguugaacagc

SEQ ID NO: 3500484 - RNA, 21 nt, Pseudomonas aeruginosa PA01
gcgauguugaacagcgccgga

SEQ ID NO: 3500485 - RNA, 19 nt, Pseudomonas aeruginosa PA01
gcgauuccaugggcagacg

SEQ ID NO: 3500486 - RNA, 13 nt, Pseudomonas aeruginosa PA01
gcgauucccagug

SEQ ID NO: 3500487 - RNA, 24 nt, Pseudomonas aeruginosa PA01
gcgauucccgaggguggcgcuggc

SEQ ID NO: 3500488 - RNA, 15 nt, Pseudomonas aeruginosa PA01
gcgauucgccgggcu

SEQ ID NO: 3500489 - RNA, 15 nt, Pseudomonas aeruginosa PA01
gcgauugcagcuccu

SEQ ID NO: 3500490 - RNA, 15 nt, Pseudomonas aeruginosa PA01
gcgauugcagguagu

SEQ ID NO: 3500491 - RNA, 23 nt, Pseudomonas aeruginosa PA01
gcgauuggagaugcucaggcgcu

SEQ ID NO: 3500492 - RNA, 14 nt, Pseudomonas aeruginosa PA01
gcgauuuccaccgg

SEQ ID NO: 3500493 - RNA, 15 nt, Pseudomonas aeruginosa PA01
gcgauuuccaccggc

SEQ ID NO: 3500494 - RNA, 16 nt, Pseudomonas aeruginosa PA01
gcgauuucgcugcgca

SEQ ID NO: 3500495 - RNA, 16 nt, Pseudomonas aeruginosa PA01
gcgauuuugggcucag

SEQ ID NO: 3500496 - RNA, 15 nt, Pseudomonas aeruginosa PA01
gcgcaaaaaaagggg

SEQ ID NO: 3500497 - RNA, 14 nt, Pseudomonas aeruginosa PA01
gcgcaaaccggcag

SEQ ID NO: 3500498 - RNA, 16 nt, Pseudomonas aeruginosa PA01
gcgcaaaccggcagca

SEQ ID NO: 3500499 - RNA, 22 nt, Pseudomonas aeruginosa PA01
gcgcaacaccuugcgcaccgcc

SEQ ID NO: 3500500 - RNA, 23 nt, Pseudomonas aeruginosa PA01
gcgcaacaccuugcgcaccgccu

SEQ ID NO: 3500501 - RNA, 20 nt, Pseudomonas aeruginosa PA01
gcgcaaccagaccagcagga

SEQ ID NO: 3500502 - RNA, 15 nt, Pseudomonas aeruginosa PA01
gcgcaaccagcgcuc

SEQ ID NO: 3500503 - RNA, 17 nt, Pseudomonas aeruginosa PA01
gcgcaaccguuccagcg

SEQ ID NO: 3500504 - RNA, 22 nt, Pseudomonas aeruginosa PA01
gcgcaaccugguucacggucgu

SEQ ID NO: 3500505 - RNA, 20 nt, Pseudomonas aeruginosa PA01
gcgcaacgaaaagccgcccc

SEQ ID NO: 3500506 - RNA, 15 nt, Pseudomonas aeruginosa PA01
gcgcaacgccgacgg

SEQ ID NO: 3500507 - RNA, 20 nt, Pseudomonas aeruginosa PA01
gcgcaacgccgacggcgugc

SEQ ID NO: 3500508 - RNA, 14 nt, Pseudomonas aeruginosa PA01
gcgcaacgcgcgca

SEQ ID NO: 3500509 - RNA, 17 nt, Pseudomonas aeruginosa PA01
gcgcaacgcgcgcagga

SEQ ID NO: 3500510 - RNA, 22 nt, Pseudomonas aeruginosa PA01
gcgcaacgcgguuauccgccgc

SEQ ID NO: 3500511 - RNA, 17 nt, Pseudomonas aeruginosa PA01
gcgcaacgcuuccagca

SEQ ID NO: 3500512 - RNA, 22 nt, Pseudomonas aeruginosa PA01
gcgcaacgcuuccagcaccucc

SEQ ID NO: 3500513 - RNA, 13 nt, Pseudomonas aeruginosa PA01
gcgcaacggcagc

SEQ ID NO: 3500514 - RNA, 17 nt, Pseudomonas aeruginosa PA01
gcgcaacggcagcgcuu

SEQ ID NO: 3500515 - RNA, 21 nt, Pseudomonas aeruginosa PA01
gcgcaacugccggucggccuu

SEQ ID NO: 3500516 - RNA, 15 nt, Pseudomonas aeruginosa PA01
gcgcaacugcgccag

SEQ ID NO: 3500517 - RNA, 15 nt, Pseudomonas aeruginosa PA01
gcgcaacugcggggc

SEQ ID NO: 3500518 - RNA, 22 nt, Pseudomonas aeruginosa PA01
gcgcaacugcggggcgcucagg

SEQ ID NO: 3500519 - RNA, 23 nt, Pseudomonas aeruginosa PA01
gcgcaacugcucgaacugcuccu

SEQ ID NO: 3500520 - RNA, 17 nt, Pseudomonas aeruginosa PA01
gcgcaacuggucgcggc

SEQ ID NO: 3500521 - RNA, 18 nt, Pseudomonas aeruginosa PA01
gcgcaacuggucgcggcu

SEQ ID NO: 3500522 - RNA, 20 nt, Pseudomonas aeruginosa PA01
gcgcaacuggucgcggcugc

SEQ ID NO: 3500523 - RNA, 12 nt, Pseudomonas aeruginosa PA01
gcgcaagccagc

SEQ ID NO: 3500524 - RNA, 15 nt, Pseudomonas aeruginosa PA01
gcgcaagcgcccggc

SEQ ID NO: 3500525 - RNA, 20 nt, Pseudomonas aeruginosa PA01
gcgcaagcgcccggcgaaca

SEQ ID NO: 3500526 - RNA, 23 nt, Pseudomonas aeruginosa PA01
gcgcaagcgcccggcgaacagcg

SEQ ID NO: 3500527 - RNA, 15 nt, Pseudomonas aeruginosa PA01
gcgcaagcggcggcu

SEQ ID NO: 3500528 - RNA, 16 nt, Pseudomonas aeruginosa PA01
gcgcaagcggcggcuu

SEQ ID NO: 3500529 - RNA, 16 nt, Pseudomonas aeruginosa PA01
gcgcaagcgguugagu

SEQ ID NO: 3500530 - RNA, 18 nt, Pseudomonas aeruginosa PA01
gcgcaagcucgucacccg

SEQ ID NO: 3500531 - RNA, 23 nt, Pseudomonas aeruginosa PA01
gcgcaagcucgucacccgcgccu

SEQ ID NO: 3500532 - RNA, 15 nt, Pseudomonas aeruginosa PA01
gcgcaaggaacugga

SEQ ID NO: 3500533 - RNA, 15 nt, Pseudomonas aeruginosa PA01
gcgcaaggcagcguc

SEQ ID NO: 3500534 - RNA, 16 nt, Pseudomonas aeruginosa PA01
gcgcaaggcagcgucc

SEQ ID NO: 3500535 - RNA, 17 nt, Pseudomonas aeruginosa PA01
gcgcaaggccagcggca

SEQ ID NO: 3500536 - RNA, 19 nt, Pseudomonas aeruginosa PA01
gcgcaaggccagcggcauc

SEQ ID NO: 3500537 - RNA, 15 nt, Pseudomonas aeruginosa PA01
gcgcaaggccgaaga

SEQ ID NO: 3500538 - RNA, 18 nt, Pseudomonas aeruginosa PA01
gcgcaagggcgccgccga

SEQ ID NO: 3500539 - RNA, 13 nt, Pseudomonas aeruginosa PA01
gcgcaaggugccg

SEQ ID NO: 3500540 - RNA, 19 nt, Pseudomonas aeruginosa PA01
gcgcaaggugccgaggucg

SEQ ID NO: 3500541 - RNA, 21 nt, Pseudomonas aeruginosa PA01
gcgcaagucggccugcaccag

SEQ ID NO: 3500542 - RNA, 16 nt, Pseudomonas aeruginosa PA01
gcgcaauacaccgcug

SEQ ID NO: 3500543 - RNA, 22 nt, Pseudomonas aeruginosa PA01
gcgcaauacaccgcugcgccgc

SEQ ID NO: 3500544 - RNA, 19 nt, Pseudomonas aeruginosa PA01
gcgcaaucagggcugggcg

SEQ ID NO: 3500545 - RNA, 21 nt, Pseudomonas aeruginosa PA01
gcgcaaucagggcugggcgcc

SEQ ID NO: 3500546 - RNA, 18 nt, Pseudomonas aeruginosa PA01
gcgcacaaaaaagcccgc

SEQ ID NO: 3500547 - RNA, 23 nt, Pseudomonas aeruginosa PA01
gcgcacaaaaaagcccgccaggu

SEQ ID NO: 3500548 - RNA, 13 nt, Pseudomonas aeruginosa PA01
gcgcacaacgccu

SEQ ID NO: 3500549 - RNA, 17 nt, Pseudomonas aeruginosa PA01
gcgcacacggucgagac

SEQ ID NO: 3500550 - RNA, 16 nt, Pseudomonas aeruginosa PA01
gcgcacaugccgagcg

SEQ ID NO: 3500551 - RNA, 20 nt, Pseudomonas aeruginosa PA01
gcgcaccacccaucugccgg

SEQ ID NO: 3500552 - RNA, 21 nt, Pseudomonas aeruginosa PA01
gcgcaccaccgagagcggcgc

SEQ ID NO: 3500553 - RNA, 23 nt, Pseudomonas aeruginosa PA01
gcgcaccaccgagagcggcgcca

SEQ ID NO: 3500554 - RNA, 13 nt, Pseudomonas aeruginosa PA01
gcgcaccaccugc

SEQ ID NO: 3500555 - RNA, 14 nt, Pseudomonas aeruginosa PA01
gcgcaccaccuggc

SEQ ID NO: 3500556 - RNA, 15 nt, Pseudomonas aeruginosa PA01
gcgcaccaccuggca

SEQ ID NO: 3500557 - RNA, 17 nt, Pseudomonas aeruginosa PA01
gcgcaccaccuggcagg

SEQ ID NO: 3500558 - RNA, 15 nt, Pseudomonas aeruginosa PA01
gcgcaccagcaggcg

SEQ ID NO: 3500559 - RNA, 16 nt, Pseudomonas aeruginosa PA01
gcgcaccagcaggcgc

SEQ ID NO: 3500560 - RNA, 22 nt, Pseudomonas aeruginosa PA01
gcgcaccagcaggcgcaaccag

SEQ ID NO: 3500561 - RNA, 13 nt, Pseudomonas aeruginosa PA01
gcgcaccagcggg

SEQ ID NO: 3500562 - RNA, 16 nt, Pseudomonas aeruginosa PA01
gcgcaccagcgggucg

SEQ ID NO: 3500563 - RNA, 14 nt, Pseudomonas aeruginosa PA01
gcgcaccaggccag

SEQ ID NO: 3500564 - RNA, 16 nt, Pseudomonas aeruginosa PA01
gcgcaccaggccaggc

SEQ ID NO: 3500565 - RNA, 22 nt, Pseudomonas aeruginosa PA01
gcgcaccaggccaggcugcgcu

SEQ ID NO: 3500566 - RNA, 13 nt, Pseudomonas aeruginosa PA01
gcgcaccagggcc

SEQ ID NO: 3500567 - RNA, 15 nt, Pseudomonas aeruginosa PA01
gcgcaccagggccag

SEQ ID NO: 3500568 - RNA, 16 nt, Pseudomonas aeruginosa PA01
gcgcaccagggccagg

SEQ ID NO: 3500569 - RNA, 20 nt, Pseudomonas aeruginosa PA01
gcgcaccagggccaggagca

SEQ ID NO: 3500570 - RNA, 16 nt, Pseudomonas aeruginosa PA01
gcgcaccagggucggg

SEQ ID NO: 3500571 - RNA, 22 nt, Pseudomonas aeruginosa PA01
gcgcaccagggucgggccgcgc

SEQ ID NO: 3500572 - RNA, 23 nt, Pseudomonas aeruginosa PA01
gcgcaccagggucgggccgcgcu

SEQ ID NO: 3500573 - RNA, 16 nt, Pseudomonas aeruginosa PA01
gcgcaccauagcgagc

SEQ ID NO: 3500574 - RNA, 20 nt, Pseudomonas aeruginosa PA01
gcgcaccauagcgagccgcg

SEQ ID NO: 3500575 - RNA, 21 nt, Pseudomonas aeruginosa PA01
gcgcaccauagcgagccgcgc

SEQ ID NO: 3500576 - RNA, 14 nt, Pseudomonas aeruginosa PA01
gcgcacccgcucgg

SEQ ID NO: 3500577 - RNA, 16 nt, Pseudomonas aeruginosa PA01
gcgcacccgcucggcc

SEQ ID NO: 3500578 - RNA, 15 nt, Pseudomonas aeruginosa PA01
gcgcaccgacgccgc

SEQ ID NO: 3500579 - RNA, 19 nt, Pseudomonas aeruginosa PA01
gcgcaccgacgccgccugc

SEQ ID NO: 3500580 - RNA, 14 nt, Pseudomonas aeruginosa PA01
gcgcaccgcccugc

SEQ ID NO: 3500581 - RNA, 13 nt, Pseudomonas aeruginosa PA01
gcgcaccgccucg

SEQ ID NO: 3500582 - RNA, 14 nt, Pseudomonas aeruginosa PA01
gcgcaccgccucga

SEQ ID NO: 3500583 - RNA, 16 nt, Pseudomonas aeruginosa PA01
gcgcaccgccucgugc

SEQ ID NO: 3500584 - RNA, 14 nt, Pseudomonas aeruginosa PA01
gcgcaccgccugca

SEQ ID NO: 3500585 - RNA, 11 nt, Pseudomonas aeruginosa PA01
gcgcaccgcgc

SEQ ID NO: 3500586 - RNA, 14 nt, Pseudomonas aeruginosa PA01
gcgcaccgcgccgg

SEQ ID NO: 3500587 - RNA, 12 nt, Pseudomonas aeruginosa PA01
gcgcaccgcggc

SEQ ID NO: 3500588 - RNA, 19 nt, Pseudomonas aeruginosa PA01
gcgcaccgcggcgagccgg

SEQ ID NO: 3500589 - RNA, 17 nt, Pseudomonas aeruginosa PA01
gcgcaccuccucgggcg

SEQ ID NO: 3500590 - RNA, 13 nt, Pseudomonas aeruginosa PA01
gcgcaccuccuug

SEQ ID NO: 3500591 - RNA, 17 nt, Pseudomonas aeruginosa PA01
gcgcaccucgaccgcgc

SEQ ID NO: 3500592 - RNA, 20 nt, Pseudomonas aeruginosa PA01
gcgcaccucgaccgcgccgg

SEQ ID NO: 3500593 - RNA, 14 nt, Pseudomonas aeruginosa PA01
gcgcaccucgcccu

SEQ ID NO: 3500594 - RNA, 16 nt, Pseudomonas aeruginosa PA01
gcgcaccucggccagg

SEQ ID NO: 3500595 - RNA, 17 nt, Pseudomonas aeruginosa PA01
gcgcaccucggccaggc

SEQ ID NO: 3500596 - RNA, 14 nt, Pseudomonas aeruginosa PA01
gcgcaccuggcggu

SEQ ID NO: 3500597 - RNA, 21 nt, Pseudomonas aeruginosa PA01
gcgcaccuggcgguaggcguu

SEQ ID NO: 3500598 - RNA, 16 nt, Pseudomonas aeruginosa PA01
gcgcaccuggcggucg

SEQ ID NO: 3500599 - RNA, 17 nt, Pseudomonas aeruginosa PA01
gcgcaccuggcggucgc

SEQ ID NO: 3500600 - RNA, 23 nt, Pseudomonas aeruginosa PA01
gcgcaccuggcggucgccgccgg

SEQ ID NO: 3500601 - RNA, 21 nt, Pseudomonas aeruginosa PA01
gcgcaccuugcuggacaaggu

SEQ ID NO: 3500602 - RNA, 24 nt, Pseudomonas aeruginosa PA01
gcgcaccuuggcuugcagguagcu

SEQ ID NO: 3500603 - RNA, 21 nt, Pseudomonas aeruginosa PA01
gcgcacgaggauuuccgcgcc

SEQ ID NO: 3500604 - RNA, 13 nt, Pseudomonas aeruginosa PA01
gcgcacgccgcgg

SEQ ID NO: 3500605 - RNA, 21 nt, Pseudomonas aeruginosa PA01
gcgcacgccgcggaaggcccg

SEQ ID NO: 3500606 - RNA, 15 nt, Pseudomonas aeruginosa PA01
gcgcacgccggccuc

SEQ ID NO: 3500607 - RNA, 23 nt, Pseudomonas aeruginosa PA01
gcgcacgcucuguuucgggucgc

SEQ ID NO: 3500608 - RNA, 14 nt, Pseudomonas aeruginosa PA01
gcgcacgcuucucc

SEQ ID NO: 3500609 - RNA, 18 nt, Pseudomonas aeruginosa PA01
gcgcacgcuucuccucgg

SEQ ID NO: 3500610 - RNA, 22 nt, Pseudomonas aeruginosa PA01
gcgcacgcuucuccucggccga

SEQ ID NO: 3500611 - RNA, 13 nt, Pseudomonas aeruginosa PA01
gcgcacggaucgc

SEQ ID NO: 3500612 - RNA, 15 nt, Pseudomonas aeruginosa PA01
gcgcacggaucgcgc

SEQ ID NO: 3500613 - RNA, 17 nt, Pseudomonas aeruginosa PA01
gcgcacggaucgcgcug

SEQ ID NO: 3500614 - RNA, 16 nt, Pseudomonas aeruginosa PA01
gcgcacggccugcacc

SEQ ID NO: 3500615 - RNA, 19 nt, Pseudomonas aeruginosa PA01
gcgcacggccugcaccugc

SEQ ID NO: 3500616 - RNA, 13 nt, Pseudomonas aeruginosa PA01
gcgcacggucucc

SEQ ID NO: 3500617 - RNA, 13 nt, Pseudomonas aeruginosa PA01
gcgcacgucgagg

SEQ ID NO: 3500618 - RNA, 18 nt, Pseudomonas aeruginosa PA01
gcgcacugagggucagcc

SEQ ID NO: 3500619 - RNA, 15 nt, Pseudomonas aeruginosa PA01
gcgcacugccaggag

SEQ ID NO: 3500620 - RNA, 17 nt, Pseudomonas aeruginosa PA01
gcgcacugccaggagca

SEQ ID NO: 3500621 - RNA, 18 nt, Pseudomonas aeruginosa PA01
gcgcacugccaggagcac

SEQ ID NO: 3500622 - RNA, 10 nt, Pseudomonas aeruginosa PA01
gcgcacugcg

SEQ ID NO: 3500623 - RNA, 15 nt, Pseudomonas aeruginosa PA01
gcgcacuuccucggc

SEQ ID NO: 3500624 - RNA, 20 nt, Pseudomonas aeruginosa PA01
gcgcacuuccucggcgacca

SEQ ID NO: 3500625 - RNA, 21 nt, Pseudomonas aeruginosa PA01
gcgcacuuccucggcgaccac

SEQ ID NO: 3500626 - RNA, 15 nt, Pseudomonas aeruginosa PA01
gcgcagaacugccgg

SEQ ID NO: 3500627 - RNA, 23 nt, Pseudomonas aeruginosa PA01
gcgcagaacugccgggccagcuc

SEQ ID NO: 3500628 - RNA, 13 nt, Pseudomonas aeruginosa PA01
gcgcagacaggcc

SEQ ID NO: 3500629 - RNA, 20 nt, Pseudomonas aeruginosa PA01
gcgcagacaggccuccagca

SEQ ID NO: 3500630 - RNA, 15 nt, Pseudomonas aeruginosa PA01
gcgcagaccaucagc

SEQ ID NO: 3500631 - RNA, 21 nt, Pseudomonas aeruginosa PA01
gcgcagacgaucuccugcugg

SEQ ID NO: 3500632 - RNA, 19 nt, Pseudomonas aeruginosa PA01
gcgcagagcggugaaaccg

SEQ ID NO: 3500633 - RNA, 12 nt, Pseudomonas aeruginosa PA01
gcgcagaggcgc

SEQ ID NO: 3500634 - RNA, 13 nt, Pseudomonas aeruginosa PA01
gcgcagaggcgcu

SEQ ID NO: 3500635 - RNA, 14 nt, Pseudomonas aeruginosa PA01
gcgcagaggcgcuc

SEQ ID NO: 3500636 - RNA, 13 nt, Pseudomonas aeruginosa PA01
gcgcagaucgccg

SEQ ID NO: 3500637 - RNA, 16 nt, Pseudomonas aeruginosa PA01
gcgcagaucgccgcgu

SEQ ID NO: 3500638 - RNA, 21 nt, Pseudomonas aeruginosa PA01
gcgcagaucgccgcguagcgc

SEQ ID NO: 3500639 - RNA, 12 nt, Pseudomonas aeruginosa PA01
gcgcagaucgcg

SEQ ID NO: 3500640 - RNA, 22 nt, Pseudomonas aeruginosa PA01
gcgcagaucgcggcgcaggcug

SEQ ID NO: 3500641 - RNA, 16 nt, Pseudomonas aeruginosa PA01
gcgcagaucgcgucca

SEQ ID NO: 3500642 - RNA, 20 nt, Pseudomonas aeruginosa PA01
gcgcagaucgcguccagggu

SEQ ID NO: 3500643 - RNA, 16 nt, Pseudomonas aeruginosa PA01
gcgcagaugaucgcca

SEQ ID NO: 3500644 - RNA, 21 nt, Pseudomonas aeruginosa PA01
gcgcagaugaucgccaccggg

SEQ ID NO: 3500645 - RNA, 17 nt, Pseudomonas aeruginosa PA01
gcgcagaugcggggcga

SEQ ID NO: 3500646 - RNA, 19 nt, Pseudomonas aeruginosa PA01
gcgcagaugcggggcgacc

SEQ ID NO: 3500647 - RNA, 19 nt, Pseudomonas aeruginosa PA01
gcgcagcaacuggucgccg

SEQ ID NO: 3500648 - RNA, 21 nt, Pseudomonas aeruginosa PA01
gcgcagcaacuggucgccgca

SEQ ID NO: 3500649 - RNA, 17 nt, Pseudomonas aeruginosa PA01
gcgcagcaacuguccga

SEQ ID NO: 3500650 - RNA, 13 nt, Pseudomonas aeruginosa PA01
gcgcagcaccacg

SEQ ID NO: 3500651 - RNA, 17 nt, Pseudomonas aeruginosa PA01
gcgcagcaccacgaugc

SEQ ID NO: 3500652 - RNA, 13 nt, Pseudomonas aeruginosa PA01
gcgcagcaccggc

SEQ ID NO: 3500653 - RNA, 14 nt, Pseudomonas aeruginosa PA01
gcgcagcaccggcu

SEQ ID NO: 3500654 - RNA, 18 nt, Pseudomonas aeruginosa PA01
gcgcagcacgaugcacag

SEQ ID NO: 3500655 - RNA, 19 nt, Pseudomonas aeruginosa PA01
gcgcagcacgaugcacagg

SEQ ID NO: 3500656 - RNA, 13 nt, Pseudomonas aeruginosa PA01
gcgcagcacuucc

SEQ ID NO: 3500657 - RNA, 24 nt, Pseudomonas aeruginosa PA01
gcgcagcacuuccugaaggcgcgg

SEQ ID NO: 3500658 - RNA, 14 nt, Pseudomonas aeruginosa PA01
gcgcagcagcaggu

SEQ ID NO: 3500659 - RNA, 13 nt, Pseudomonas aeruginosa PA01
gcgcagcagcgcc

SEQ ID NO: 3500660 - RNA, 13 nt, Pseudomonas aeruginosa PA01
gcgcagcagcguc

SEQ ID NO: 3500661 - RNA, 20 nt, Pseudomonas aeruginosa PA01
gcgcagcagcgucgcgucgg

SEQ ID NO: 3500662 - RNA, 13 nt, Pseudomonas aeruginosa PA01
gcgcagcaggauc

SEQ ID NO: 3500663 - RNA, 19 nt, Pseudomonas aeruginosa PA01
gcgcagcaggauccaggug

SEQ ID NO: 3500664 - RNA, 16 nt, Pseudomonas aeruginosa PA01
gcgcagcaggcggccc

SEQ ID NO: 3500665 - RNA, 17 nt, Pseudomonas aeruginosa PA01
gcgcagcaggcggccca

SEQ ID NO: 3500666 - RNA, 12 nt, Pseudomonas aeruginosa PA01
gcgcagcagggc

SEQ ID NO: 3500667 - RNA, 14 nt, Pseudomonas aeruginosa PA01
gcgcagcagggcgu

SEQ ID NO: 3500668 - RNA, 15 nt, Pseudomonas aeruginosa PA01
gcgcagcagggcguc

SEQ ID NO: 3500669 - RNA, 21 nt, Pseudomonas aeruginosa PA01
gcgcagcagguagugcggcgg

SEQ ID NO: 3500670 - RNA, 22 nt, Pseudomonas aeruginosa PA01
gcgcagcagguagugcggcggg

SEQ ID NO: 3500671 - RNA, 21 nt, Pseudomonas aeruginosa PA01
gcgcagcaggucuuccaccgc

SEQ ID NO: 3500672 - RNA, 19 nt, Pseudomonas aeruginosa PA01
gcgcagcaguaccuggcgg

SEQ ID NO: 3500673 - RNA, 17 nt, Pseudomonas aeruginosa PA01
gcgcagcaucuucucgg

SEQ ID NO: 3500674 - RNA, 13 nt, Pseudomonas aeruginosa PA01
gcgcagccacccg

SEQ ID NO: 3500675 - RNA, 15 nt, Pseudomonas aeruginosa PA01
gcgcagccacccgcu

SEQ ID NO: 3500676 - RNA, 21 nt, Pseudomonas aeruginosa PA01
gcgcagccacccgcucgaccu

SEQ ID NO: 3500677 - RNA, 23 nt, Pseudomonas aeruginosa PA01
gcgcagccacuggcggaccgccu

SEQ ID NO: 3500678 - RNA, 17 nt, Pseudomonas aeruginosa PA01
gcgcagccagagcucca

SEQ ID NO: 3500679 - RNA, 19 nt, Pseudomonas aeruginosa PA01
gcgcagccagagcuccagg

SEQ ID NO: 3500680 - RNA, 13 nt, Pseudomonas aeruginosa PA01
gcgcagccaggcg

SEQ ID NO: 3500681 - RNA, 14 nt, Pseudomonas aeruginosa PA01
gcgcagccaggcga

SEQ ID NO: 3500682 - RNA, 17 nt, Pseudomonas aeruginosa PA01
gcgcagccaggcgagga

SEQ ID NO: 3500683 - RNA, 23 nt, Pseudomonas aeruginosa PA01
gcgcagccaggcgaggaacagcg

SEQ ID NO: 3500684 - RNA, 17 nt, Pseudomonas aeruginosa PA01
gcgcagccaggcgaugg

SEQ ID NO: 3500685 - RNA, 18 nt, Pseudomonas aeruginosa PA01
gcgcagccauucgccgcg

SEQ ID NO: 3500686 - RNA, 24 nt, Pseudomonas aeruginosa PA01
gcgcagccauucgccgcgacgcuc

SEQ ID NO: 3500687 - RNA, 14 nt, Pseudomonas aeruginosa PA01
gcgcagcccagccg

SEQ ID NO: 3500688 - RNA, 15 nt, Pseudomonas aeruginosa PA01
gcgcagcccagccgc

SEQ ID NO: 3500689 - RNA, 17 nt, Pseudomonas aeruginosa PA01
gcgcagcccagccgcuc

SEQ ID NO: 3500690 - RNA, 19 nt, Pseudomonas aeruginosa PA01
gcgcagcccagccgcucgc

SEQ ID NO: 3500691 - RNA, 22 nt, Pseudomonas aeruginosa PA01
gcgcagcccagccgcucgcguc

SEQ ID NO: 3500692 - RNA, 15 nt, Pseudomonas aeruginosa PA01
gcgcagccgcaaggc

SEQ ID NO: 3500693 - RNA, 17 nt, Pseudomonas aeruginosa PA01
gcgcagccgcaaggcca

SEQ ID NO: 3500694 - RNA, 19 nt, Pseudomonas aeruginosa PA01
gcgcagccgcaaggccagg

SEQ ID NO: 3500695 - RNA, 17 nt, Pseudomonas aeruginosa PA01
gcgcagccgcucggccg

SEQ ID NO: 3500696 - RNA, 18 nt, Pseudomonas aeruginosa PA01
gcgcagccgcucggccgc

SEQ ID NO: 3500697 - RNA, 22 nt, Pseudomonas aeruginosa PA01
gcgcagccgcucggccgccagc

SEQ ID NO: 3500698 - RNA, 14 nt, Pseudomonas aeruginosa PA01
gcgcagccgcugcu

SEQ ID NO: 3500699 - RNA, 19 nt, Pseudomonas aeruginosa PA01
gcgcagccgcugggccacg

SEQ ID NO: 3500700 - RNA, 23 nt, Pseudomonas aeruginosa PA01
gcgcagccguucccggucgaggu

SEQ ID NO: 3500701 - RNA, 14 nt, Pseudomonas aeruginosa PA01
gcgcagccucgcgc

SEQ ID NO: 3500702 - RNA, 23 nt, Pseudomonas aeruginosa PA01
gcgcagccucgcgcucggcggcc

SEQ ID NO: 3500703 - RNA, 24 nt, Pseudomonas aeruginosa PA01
gcgcagccucgcgcucggcggccu

SEQ ID NO: 3500704 - RNA, 13 nt, Pseudomonas aeruginosa PA01
gcgcagccugcug

SEQ ID NO: 3500705 - RNA, 14 nt, Pseudomonas aeruginosa PA01
gcgcagccugcugg

SEQ ID NO: 3500706 - RNA, 18 nt, Pseudomonas aeruginosa PA01
gcgcagccugcuggccug

SEQ ID NO: 3500707 - RNA, 15 nt, Pseudomonas aeruginosa PA01
gcgcagcgaacgggc

SEQ ID NO: 3500708 - RNA, 21 nt, Pseudomonas aeruginosa PA01
gcgcagcgacucgaugaacgc

SEQ ID NO: 3500709 - RNA, 23 nt, Pseudomonas aeruginosa PA01
gcgcagcgacucgaugaacgccc

SEQ ID NO: 3500710 - RNA, 12 nt, Pseudomonas aeruginosa PA01
gcgcagcgccgc

SEQ ID NO: 3500711 - RNA, 14 nt, Pseudomonas aeruginosa PA01
gcgcagcgccgccg

SEQ ID NO: 3500712 - RNA, 15 nt, Pseudomonas aeruginosa PA01
gcgcagcgccgccgc

SEQ ID NO: 3500713 - RNA, 14 nt, Pseudomonas aeruginosa PA01
gcgcagcgccucca

SEQ ID NO: 3500714 - RNA, 18 nt, Pseudomonas aeruginosa PA01
gcgcagcgccuccagcgu

SEQ ID NO: 3500715 - RNA, 21 nt, Pseudomonas aeruginosa PA01
gcgcagcgccuccagcgucug

SEQ ID NO: 3500716 - RNA, 14 nt, Pseudomonas aeruginosa PA01
gcgcagcgcggggg

SEQ ID NO: 3500717 - RNA, 12 nt, Pseudomonas aeruginosa PA01
gcgcagcggcag

SEQ ID NO: 3500718 - RNA, 13 nt, Pseudomonas aeruginosa PA01
gcgcagcggcagg

SEQ ID NO: 3500719 - RNA, 15 nt, Pseudomonas aeruginosa PA01
gcgcagcggcaggcc

SEQ ID NO: 3500720 - RNA, 19 nt, Pseudomonas aeruginosa PA01
gcgcagcggcgaacccucg

SEQ ID NO: 3500721 - RNA, 14 nt, Pseudomonas aeruginosa PA01
gcgcagcggcgccg

SEQ ID NO: 3500722 - RNA, 15 nt, Pseudomonas aeruginosa PA01
gcgcagcggcgccga

SEQ ID NO: 3500723 - RNA, 19 nt, Pseudomonas aeruginosa PA01
gcgcagcggcgccgagggc

SEQ ID NO: 3500724 - RNA, 13 nt, Pseudomonas aeruginosa PA01
gcgcagcggcgcg

SEQ ID NO: 3500725 - RNA, 14 nt, Pseudomonas aeruginosa PA01
gcgcagcggcgcgu

SEQ ID NO: 3500726 - RNA, 15 nt, Pseudomonas aeruginosa PA01
gcgcagcggcgcguc

SEQ ID NO: 3500727 - RNA, 13 nt, Pseudomonas aeruginosa PA01
gcgcagcggcgga

SEQ ID NO: 3500728 - RNA, 19 nt, Pseudomonas aeruginosa PA01
gcgcagcggcggauacagg

SEQ ID NO: 3500729 - RNA, 13 nt, Pseudomonas aeruginosa PA01
gcgcagcggcucc

SEQ ID NO: 3500730 - RNA, 14 nt, Pseudomonas aeruginosa PA01
gcgcagcggcuccc

SEQ ID NO: 3500731 - RNA, 18 nt, Pseudomonas aeruginosa PA01
gcgcagcgguacaggcgg

SEQ ID NO: 3500732 - RNA, 18 nt, Pseudomonas aeruginosa PA01
gcgcagcgguaguucagu

SEQ ID NO: 3500733 - RNA, 14 nt, Pseudomonas aeruginosa PA01
gcgcagcguccugc

SEQ ID NO: 3500734 - RNA, 16 nt, Pseudomonas aeruginosa PA01
gcgcagcguccugccc

SEQ ID NO: 3500735 - RNA, 17 nt, Pseudomonas aeruginosa PA01
gcgcagcguccugcccu

SEQ ID NO: 3500736 - RNA, 23 nt, Pseudomonas aeruginosa PA01
gcgcagcuaggcgaggaucgcuc

SEQ ID NO: 3500737 - RNA, 17 nt, Pseudomonas aeruginosa PA01
gcgcagcuccggcagca

SEQ ID NO: 3500738 - RNA, 19 nt, Pseudomonas aeruginosa PA01
gcgcagcuccggcagcagg

SEQ ID NO: 3500739 - RNA, 13 nt, Pseudomonas aeruginosa PA01
gcgcagcuccucg

SEQ ID NO: 3500740 - RNA, 14 nt, Pseudomonas aeruginosa PA01
gcgcagcuccucgg

SEQ ID NO: 3500741 - RNA, 17 nt, Pseudomonas aeruginosa PA01
gcgcagcuucugcaggg

SEQ ID NO: 3500742 - RNA, 21 nt, Pseudomonas aeruginosa PA01
gcgcagcuucugcagggcggc

SEQ ID NO: 3500743 - RNA, 22 nt, Pseudomonas aeruginosa PA01
gcgcagcuucugcagggcggcu

SEQ ID NO: 3500744 - RNA, 13 nt, Pseudomonas aeruginosa PA01
gcgcagcuugccu

SEQ ID NO: 3500745 - RNA, 17 nt, Pseudomonas aeruginosa PA01
gcgcagcuugccuucca

SEQ ID NO: 3500746 - RNA, 21 nt, Pseudomonas aeruginosa PA01
gcgcagcuugccuuccaggcu

SEQ ID NO: 3500747 - RNA, 22 nt, Pseudomonas aeruginosa PA01
gcgcagcuugccuuccaggcug

SEQ ID NO: 3500748 - RNA, 14 nt, Pseudomonas aeruginosa PA01
gcgcaggaagaagg

SEQ ID NO: 3500749 - RNA, 16 nt, Pseudomonas aeruginosa PA01
gcgcaggaccacgcug

SEQ ID NO: 3500750 - RNA, 18 nt, Pseudomonas aeruginosa PA01
gcgcaggaccagacgcgg

SEQ ID NO: 3500751 - RNA, 19 nt, Pseudomonas aeruginosa PA01
gcgcaggaccagacgcgga

SEQ ID NO: 3500752 - RNA, 14 nt, Pseudomonas aeruginosa PA01
gcgcaggaccgcca

SEQ ID NO: 3500753 - RNA, 15 nt, Pseudomonas aeruginosa PA01
gcgcaggaccuggcu

SEQ ID NO: 3500754 - RNA, 22 nt, Pseudomonas aeruginosa PA01
gcgcaggacgaggaaggcgcgc

SEQ ID NO: 3500755 - RNA, 21 nt, Pseudomonas aeruginosa PA01
gcgcaggacggauaacggcag

SEQ ID NO: 3500756 - RNA, 19 nt, Pseudomonas aeruginosa PA01
gcgcaggagugugggacag

SEQ ID NO: 3500757 - RNA, 20 nt, Pseudomonas aeruginosa PA01
gcgcaggagugugggacagg

SEQ ID NO: 3500758 - RNA, 14 nt, Pseudomonas aeruginosa PA01
gcgcaggauguuga

SEQ ID NO: 3500759 - RNA, 21 nt, Pseudomonas aeruginosa PA01
gcgcaggauguugaacaggcu

SEQ ID NO: 3500760 - RNA, 23 nt, Pseudomonas aeruginosa PA01
gcgcaggauguugaacaggcucg

SEQ ID NO: 3500761 - RNA, 13 nt, Pseudomonas aeruginosa PA01
gcgcaggccgaga

SEQ ID NO: 3500762 - RNA, 13 nt, Pseudomonas aeruginosa PA01
gcgcaggccgagg

SEQ ID NO: 3500763 - RNA, 14 nt, Pseudomonas aeruginosa PA01
gcgcaggccgaggu

SEQ ID NO: 3500764 - RNA, 17 nt, Pseudomonas aeruginosa PA01
gcgcaggccgccggcgg

SEQ ID NO: 3500765 - RNA, 18 nt, Pseudomonas aeruginosa PA01
gcgcaggccgccggcggc

SEQ ID NO: 3500766 - RNA, 21 nt, Pseudomonas aeruginosa PA01
gcgcaggccgccggcggccag

SEQ ID NO: 3500767 - RNA, 22 nt, Pseudomonas aeruginosa PA01
gcgcaggccgccggcggccagg

SEQ ID NO: 3500768 - RNA, 23 nt, Pseudomonas aeruginosa PA01
gcgcaggccgccggcggccaggg

SEQ ID NO: 3500769 - RNA, 13 nt, Pseudomonas aeruginosa PA01
gcgcaggccggga

SEQ ID NO: 3500770 - RNA, 14 nt, Pseudomonas aeruginosa PA01
gcgcaggccgggaa

SEQ ID NO: 3500771 - RNA, 13 nt, Pseudomonas aeruginosa PA01
gcgcaggccgggc

SEQ ID NO: 3500772 - RNA, 21 nt, Pseudomonas aeruginosa PA01
gcgcaggccggugaucucgcg

SEQ ID NO: 3500773 - RNA, 19 nt, Pseudomonas aeruginosa PA01
gcgcaggcgaggauggccg

SEQ ID NO: 3500774 - RNA, 21 nt, Pseudomonas aeruginosa PA01
gcgcaggcgaggauggccguc

SEQ ID NO: 3500775 - RNA, 19 nt, Pseudomonas aeruginosa PA01
gcgcaggcgaugaucagcc

SEQ ID NO: 3500776 - RNA, 13 nt, Pseudomonas aeruginosa PA01
gcgcaggcgcucg

SEQ ID NO: 3500777 - RNA, 14 nt, Pseudomonas aeruginosa PA01
gcgcaggcgcucgc

SEQ ID NO: 3500778 - RNA, 17 nt, Pseudomonas aeruginosa PA01
gcgcaggcgcucgcggg

SEQ ID NO: 3500779 - RNA, 21 nt, Pseudomonas aeruginosa PA01
gcgcaggcgcucgcgggccgc

SEQ ID NO: 3500780 - RNA, 18 nt, Pseudomonas aeruginosa PA01
gcgcaggcgcuggcgggc

SEQ ID NO: 3500781 - RNA, 20 nt, Pseudomonas aeruginosa PA01
gcgcaggcggacacgcaggc

SEQ ID NO: 3500782 - RNA, 14 nt, Pseudomonas aeruginosa PA01
gcgcaggcggcugg

SEQ ID NO: 3500783 - RNA, 16 nt, Pseudomonas aeruginosa PA01
gcgcaggcggcuggcg

SEQ ID NO: 3500784 - RNA, 17 nt, Pseudomonas aeruginosa PA01
gcgcaggcggcuggcgc

SEQ ID NO: 3500785 - RNA, 15 nt, Pseudomonas aeruginosa PA01
gcgcaggcgggcggc

SEQ ID NO: 3500786 - RNA, 18 nt, Pseudomonas aeruginosa PA01
gcgcaggcgggcggcguc

SEQ ID NO: 3500787 - RNA, 20 nt, Pseudomonas aeruginosa PA01
gcgcaggcgggcggcgucga

SEQ ID NO: 3500788 - RNA, 12 nt, Pseudomonas aeruginosa PA01
gcgcaggcggua

SEQ ID NO: 3500789 - RNA, 16 nt, Pseudomonas aeruginosa PA01
gcgcaggcgguaggug

SEQ ID NO: 3500790 - RNA, 21 nt, Pseudomonas aeruginosa PA01
gcgcaggcgguaggugagcga

SEQ ID NO: 3500791 - RNA, 20 nt, Pseudomonas aeruginosa PA01
gcgcaggcggucgccgaaca

SEQ ID NO: 3500792 - RNA, 14 nt, Pseudomonas aeruginosa PA01
gcgcaggcggucgg

SEQ ID NO: 3500793 - RNA, 23 nt, Pseudomonas aeruginosa PA01
gcgcaggcugcgggcgacaaggc

SEQ ID NO: 3500794 - RNA, 11 nt, Pseudomonas aeruginosa PA01
gcgcaggcugg

SEQ ID NO: 3500795 - RNA, 15 nt, Pseudomonas aeruginosa PA01
gcgcaggcuggccga

SEQ ID NO: 3500796 - RNA, 21 nt, Pseudomonas aeruginosa PA01
gcgcaggcuggccgagcgccg

SEQ ID NO: 3500797 - RNA, 14 nt, Pseudomonas aeruginosa PA01
gcgcaggcugguau

SEQ ID NO: 3500798 - RNA, 14 nt, Pseudomonas aeruginosa PA01
gcgcaggcugucgg

SEQ ID NO: 3500799 - RNA, 19 nt, Pseudomonas aeruginosa PA01
gcgcaggcugucggccagc

SEQ ID NO: 3500800 - RNA, 21 nt, Pseudomonas aeruginosa PA01
gcgcaggcugucggccagccc

SEQ ID NO: 3500801 - RNA, 22 nt, Pseudomonas aeruginosa PA01
gcgcaggcugucggccagcccc

SEQ ID NO: 3500802 - RNA, 23 nt, Pseudomonas aeruginosa PA01
gcgcaggcugucggccagccccu

SEQ ID NO: 3500803 - RNA, 18 nt, Pseudomonas aeruginosa PA01
gcgcaggcuuggucaggg

SEQ ID NO: 3500804 - RNA, 21 nt, Pseudomonas aeruginosa PA01
gcgcaggcuuggucagggucg

SEQ ID NO: 3500805 - RNA, 13 nt, Pseudomonas aeruginosa PA01
gcgcagggccagc

SEQ ID NO: 3500806 - RNA, 16 nt, Pseudomonas aeruginosa PA01
gcgcagggccagcaac

SEQ ID NO: 3500807 - RNA, 17 nt, Pseudomonas aeruginosa PA01
gcgcagggccagcaaca

SEQ ID NO: 3500808 - RNA, 14 nt, Pseudomonas aeruginosa PA01
gcgcagggccaggg

SEQ ID NO: 3500809 - RNA, 18 nt, Pseudomonas aeruginosa PA01
gcgcagggccagggcggc

SEQ ID NO: 3500810 - RNA, 15 nt, Pseudomonas aeruginosa PA01
gcgcagggccgcggc

SEQ ID NO: 3500811 - RNA, 16 nt, Pseudomonas aeruginosa PA01
gcgcagggccgcggcg

SEQ ID NO: 3500812 - RNA, 18 nt, Pseudomonas aeruginosa PA01
gcgcagggccgcggcguu

SEQ ID NO: 3500813 - RNA, 16 nt, Pseudomonas aeruginosa PA01
gcgcagggcgccgucg

SEQ ID NO: 3500814 - RNA, 18 nt, Pseudomonas aeruginosa PA01
gccuucgacgguucgcga

SEQ ID NO: 3500815 - RNA, 18 nt, Pseudomonas aeruginosa PA01
gccuucgacuucgacgaa

SEQ ID NO: 3500816 - RNA, 15 nt, Pseudomonas aeruginosa PA01
gccuucgaucucaug

SEQ ID NO: 3500817 - RNA, 17 nt, Pseudomonas aeruginosa PA01
gccuucgcaaagcgagc

SEQ ID NO: 3500818 - RNA, 23 nt, Pseudomonas aeruginosa PA01
gccuucgcaaagcgagcgcccgc

SEQ ID NO: 3500819 - RNA, 14 nt, Pseudomonas aeruginosa PA01
gccuucgccagcgg

SEQ ID NO: 3500820 - RNA, 16 nt, Pseudomonas aeruginosa PA01
gccuucgccagcggcc

SEQ ID NO: 3500821 - RNA, 18 nt, Pseudomonas aeruginosa PA01
gccuucgccagcggccag

SEQ ID NO: 3500822 - RNA, 12 nt, Pseudomonas aeruginosa PA01
gccuucgcccag

SEQ ID NO: 3500823 - RNA, 14 nt, Pseudomonas aeruginosa PA01
gccuucgcccaggu

SEQ ID NO: 3500824 - RNA, 24 nt, Pseudomonas aeruginosa PA01
gccuucgcccagguaggcgaugcg

SEQ ID NO: 3500825 - RNA, 12 nt, Pseudomonas aeruginosa PA01
gccuucgccgac

SEQ ID NO: 3500826 - RNA, 22 nt, Pseudomonas aeruginosa PA01
gccuucgccgucgagccagccc

SEQ ID NO: 3500827 - RNA, 23 nt, Pseudomonas aeruginosa PA01
gccuucgccgucgagccagccca

SEQ ID NO: 3500828 - RNA, 16 nt, Pseudomonas aeruginosa PA01
gccuucgccuucggcg

SEQ ID NO: 3500829 - RNA, 14 nt, Pseudomonas aeruginosa PA01
gccuucgcggccga

SEQ ID NO: 3500830 - RNA, 18 nt, Pseudomonas aeruginosa PA01
gccuucgcgggccaggcc

SEQ ID NO: 3500831 - RNA, 21 nt, Pseudomonas aeruginosa PA01
gccuucgcgggccaggccgag

SEQ ID NO: 3500832 - RNA, 18 nt, Pseudomonas aeruginosa PA01
gccuucgcugagaccgau

SEQ ID NO: 3500833 - RNA, 21 nt, Pseudomonas aeruginosa PA01
gccuucggcaggaaggccugg

SEQ ID NO: 3500834 - RNA, 16 nt, Pseudomonas aeruginosa PA01
gccuucggcaggaccu

SEQ ID NO: 3500835 - RNA, 15 nt, Pseudomonas aeruginosa PA01
gccuucggcggccgg

SEQ ID NO: 3500836 - RNA, 16 nt, Pseudomonas aeruginosa PA01
gccuucggcggccggg

SEQ ID NO: 3500837 - RNA, 17 nt, Pseudomonas aeruginosa PA01
gccuucggcggccgggu

SEQ ID NO: 3500838 - RNA, 13 nt, Pseudomonas aeruginosa PA01
gccuucggcggcg

SEQ ID NO: 3500839 - RNA, 16 nt, Pseudomonas aeruginosa PA01
gccuucggcggcgccu

SEQ ID NO: 3500840 - RNA, 19 nt, Pseudomonas aeruginosa PA01
gccuucgggagagcccggg

SEQ ID NO: 3500841 - RNA, 22 nt, Pseudomonas aeruginosa PA01
gccuucgggagagcccgggcgc

SEQ ID NO: 3500842 - RNA, 23 nt, Pseudomonas aeruginosa PA01
gccuucgggagagcccgggcgca

SEQ ID NO: 3500843 - RNA, 14 nt, Pseudomonas aeruginosa PA01
gccuucgggccccg

SEQ ID NO: 3500844 - RNA, 15 nt, Pseudomonas aeruginosa PA01
gccuucgggcggcuu

SEQ ID NO: 3500845 - RNA, 20 nt, Pseudomonas aeruginosa PA01
gccuucguccaugcucgcca

SEQ ID NO: 3500846 - RNA, 18 nt, Pseudomonas aeruginosa PA01
gccuucgucggcuucugg

SEQ ID NO: 3500847 - RNA, 17 nt, Pseudomonas aeruginosa PA01
gccuucucgucgucgga

SEQ ID NO: 3500848 - RNA, 15 nt, Pseudomonas aeruginosa PA01
gccuucuugcugccg

SEQ ID NO: 3500849 - RNA, 17 nt, Pseudomonas aeruginosa PA01
gccuucuugcugccggc

SEQ ID NO: 3500850 - RNA, 22 nt, Pseudomonas aeruginosa PA01
gccuucuugcugccggcguccu

SEQ ID NO: 3500851 - RNA, 16 nt, Pseudomonas aeruginosa PA01
gccuucuuuucuuccg

SEQ ID NO: 3500852 - RNA, 16 nt, Pseudomonas aeruginosa PA01
gccuugaaaccggcga

SEQ ID NO: 3500853 - RNA, 20 nt, Pseudomonas aeruginosa PA01
gccuugaccaccgccaggcu

SEQ ID NO: 3500854 - RNA, 21 nt, Pseudomonas aeruginosa PA01
gccuugaccagcggcccggcg

SEQ ID NO: 3500855 - RNA, 19 nt, Pseudomonas aeruginosa PA01
gccuugacccgcaguuccu

SEQ ID NO: 3500856 - RNA, 21 nt, Pseudomonas aeruginosa PA01
gccuugacccgcaguuccuug

SEQ ID NO: 3500857 - RNA, 23 nt, Pseudomonas aeruginosa PA01
gccuugacccgcaguuccuuggg

SEQ ID NO: 3500858 - RNA, 12 nt, Pseudomonas aeruginosa PA01
gccuugaccugc

SEQ ID NO: 3500859 - RNA, 22 nt, Pseudomonas aeruginosa PA01
gccuugaccugcugggccagcg

SEQ ID NO: 3500860 - RNA, 14 nt, Pseudomonas aeruginosa PA01
gccuugagcaggcg

SEQ ID NO: 3500861 - RNA, 18 nt, Pseudomonas aeruginosa PA01
gccuugagcaggcggccg

SEQ ID NO: 3500862 - RNA, 14 nt, Pseudomonas aeruginosa PA01
gccuugagcgccga

SEQ ID NO: 3500863 - RNA, 21 nt, Pseudomonas aeruginosa PA01
gccuugagcggcgcccuggcu

SEQ ID NO: 3500864 - RNA, 20 nt, Pseudomonas aeruginosa PA01
gccuugaggaugucgcggcu

SEQ ID NO: 3500865 - RNA, 14 nt, Pseudomonas aeruginosa PA01
gccuugaggcgggc

SEQ ID NO: 3500866 - RNA, 18 nt, Pseudomonas aeruginosa PA01
gccuugaggcgggccagc

SEQ ID NO: 3500867 - RNA, 23 nt, Pseudomonas aeruginosa PA01
gccuugaggcgggccagcagggu

SEQ ID NO: 3500868 - RNA, 16 nt, Pseudomonas aeruginosa PA01
gccuugaugccggcga

SEQ ID NO: 3500869 - RNA, 23 nt, Pseudomonas aeruginosa PA01
gccuugcagcaacucgccgccga

SEQ ID NO: 3500870 - RNA, 14 nt, Pseudomonas aeruginosa PA01
gccuugcagcaccg

SEQ ID NO: 3500871 - RNA, 23 nt, Pseudomonas aeruginosa PA01
gccuugcagcaccgccuggucga

SEQ ID NO: 3500872 - RNA, 14 nt, Pseudomonas aeruginosa PA01
gccuugcagcgcca

SEQ ID NO: 3500873 - RNA, 20 nt, Pseudomonas aeruginosa PA01
gccuugcagggccgccagcc

SEQ ID NO: 3500874 - RNA, 21 nt, Pseudomonas aeruginosa PA01
gccuugcagggccgccagccg

SEQ ID NO: 3500875 - RNA, 15 nt, Pseudomonas aeruginosa PA01
gccuugcccuggccg

SEQ ID NO: 3500876 - RNA, 16 nt, Pseudomonas aeruginosa PA01
gccuugcccuggccgg

SEQ ID NO: 3500877 - RNA, 14 nt, Pseudomonas aeruginosa PA01
gccuugccgcgacc

SEQ ID NO: 3500878 - RNA, 15 nt, Pseudomonas aeruginosa PA01
gccuugccguccagc

SEQ ID NO: 3500879 - RNA, 17 nt, Pseudomonas aeruginosa PA01
gccuugccguccagccg

SEQ ID NO: 3500880 - RNA, 22 nt, Pseudomonas aeruginosa PA01
gccuugccguccagccggcgcu

SEQ ID NO: 3500881 - RNA, 21 nt, Pseudomonas aeruginosa PA01
gccuugcgaccagguccggag

SEQ ID NO: 3500882 - RNA, 19 nt, Pseudomonas aeruginosa PA01
gccuugcgcggcgccgguu

SEQ ID NO: 3500883 - RNA, 16 nt, Pseudomonas aeruginosa PA01
gccuugcggcccccag

SEQ ID NO: 3500884 - RNA, 19 nt, Pseudomonas aeruginosa PA01
gccuugcggggcggcgcau

SEQ ID NO: 3500885 - RNA, 19 nt, Pseudomonas aeruginosa PA01
gccuugcgguccagcgagc

SEQ ID NO: 3500886 - RNA, 19 nt, Pseudomonas aeruginosa PA01
gccuugcguaccagcgcgc

SEQ ID NO: 3500887 - RNA, 21 nt, Pseudomonas aeruginosa PA01
gccuugcguaccagcgcgcag

SEQ ID NO: 3500888 - RNA, 16 nt, Pseudomonas aeruginosa PA01
gccuugcucaggucgu

SEQ ID NO: 3500889 - RNA, 22 nt, Pseudomonas aeruginosa PA01
gccuugcucgacccgguacagc

SEQ ID NO: 3500890 - RNA, 23 nt, Pseudomonas aeruginosa PA01
gccuugcucgacccgguacagcc

SEQ ID NO: 3500891 - RNA, 18 nt, Pseudomonas aeruginosa PA01
gccuuggcaucgccgccc

SEQ ID NO: 3500892 - RNA, 14 nt, Pseudomonas aeruginosa PA01
gccuuggccacggc

SEQ ID NO: 3500893 - RNA, 15 nt, Pseudomonas aeruginosa PA01
gccuuggccacggca

SEQ ID NO: 3500894 - RNA, 21 nt, Pseudomonas aeruginosa PA01
gccuuggucucgaucagcgag

SEQ ID NO: 3500895 - RNA, 19 nt, Pseudomonas aeruginosa PA01
gccuuggucucgcgggcga

SEQ ID NO: 3500896 - RNA, 19 nt, Pseudomonas aeruginosa PA01
gccuugguguagccgagca

SEQ ID NO: 3500897 - RNA, 16 nt, Pseudomonas aeruginosa PA01
gccuuguacagggcgc

SEQ ID NO: 3500898 - RNA, 21 nt, Pseudomonas aeruginosa PA01
gccuuguagaguuugccgaac

SEQ ID NO: 3500899 - RNA, 17 nt, Pseudomonas aeruginosa PA01
gccuuguccgcgcgcuu

SEQ ID NO: 3500900 - RNA, 13 nt, Pseudomonas aeruginosa PA01
gccuuguccggca

SEQ ID NO: 3500901 - RNA, 19 nt, Pseudomonas aeruginosa PA01
gccuugugacuaucgucga

SEQ ID NO: 3500902 - RNA, 22 nt, Pseudomonas aeruginosa PA01
gccuugugacuaucgucgaggg

SEQ ID NO: 3500903 - RNA, 19 nt, Pseudomonas aeruginosa PA01
gccuugugcgccagcucgg

SEQ ID NO: 3500904 - RNA, 22 nt, Pseudomonas aeruginosa PA01
gccuugugcgccagcucggccu

SEQ ID NO: 3500905 - RNA, 17 nt, Pseudomonas aeruginosa PA01
gccuuguucaggguggc

SEQ ID NO: 3500906 - RNA, 20 nt, Pseudomonas aeruginosa PA01
gccuuguucaggguggcgac

SEQ ID NO: 3500907 - RNA, 18 nt, Pseudomonas aeruginosa PA01
gccuuguucgccagcacc

SEQ ID NO: 3500908 - RNA, 13 nt, Pseudomonas aeruginosa PA01
gccuuucgcucag

SEQ ID NO: 3500909 - RNA, 18 nt, Pseudomonas aeruginosa PA01
gccuuucgcucaggccuc

SEQ ID NO: 3500910 - RNA, 19 nt, Pseudomonas aeruginosa PA01
gccuuucggggugcagggg

SEQ ID NO: 3500911 - RNA, 16 nt, Pseudomonas aeruginosa PA01
gccuuucugcccggcu

SEQ ID NO: 3500912 - RNA, 23 nt, Pseudomonas aeruginosa PA01
gccuuucuuuucugccacccggc

SEQ ID NO: 3500913 - RNA, 17 nt, Pseudomonas aeruginosa PA01
gccuuuucuuuggcgac

SEQ ID NO: 3500914 - RNA, 21 nt, Pseudomonas aeruginosa PA01
gccuuuugacuugacccgacu

SEQ ID NO: 3500915 - RNA, 20 nt, Pseudomonas aeruginosa PA01
gccuuuuucauggccuggcg

SEQ ID NO: 3500916 - RNA, 19 nt, Pseudomonas aeruginosa PA01
gccuuuuuucauuucguug

SEQ ID NO: 3500917 - RNA, 19 nt, Pseudomonas aeruginosa PA01
gcccggcgcuuguugaugg

SEQ ID NO: 3500918 - RNA, 12 nt, Pseudomonas aeruginosa PA01
gcccggcggaaa

SEQ ID NO: 3500919 - RNA, 14 nt, Pseudomonas aeruginosa PA01
gcccggcggcggca

SEQ ID NO: 3500920 - RNA, 22 nt, Pseudomonas aeruginosa PA01
gcccggcgggaaacgcgagugg

SEQ ID NO: 3500921 - RNA, 17 nt, Pseudomonas aeruginosa PA01
gcccggcguccucgcga

SEQ ID NO: 3500922 - RNA, 18 nt, Pseudomonas aeruginosa PA01
gcccggcgugagcagggc

SEQ ID NO: 3500923 - RNA, 19 nt, Pseudomonas aeruginosa PA01
gcccggcgugagcagggcc

SEQ ID NO: 3500924 - RNA, 20 nt, Pseudomonas aeruginosa PA01
gcccggcgugagcagggccg

SEQ ID NO: 3500925 - RNA, 15 nt, Pseudomonas aeruginosa PA01
gcccggcgugccgca

SEQ ID NO: 3500926 - RNA, 18 nt, Pseudomonas aeruginosa PA01
gcccggcgugggcggucg

SEQ ID NO: 3500927 - RNA, 22 nt, Pseudomonas aeruginosa PA01
gcccggcgugggcggucggcga

SEQ ID NO: 3500928 - RNA, 17 nt, Pseudomonas aeruginosa PA01
gcccggcguuucgccgg

SEQ ID NO: 3500929 - RNA, 19 nt, Pseudomonas aeruginosa PA01
gcccggcguuucgccgggc

SEQ ID NO: 3500930 - RNA, 20 nt, Pseudomonas aeruginosa PA01
gcccggcguuucgccgggcc

SEQ ID NO: 3500931 - RNA, 21 nt, Pseudomonas aeruginosa PA01
gcccggcguuucgccgggccu

SEQ ID NO: 3500932 - RNA, 22 nt, Pseudomonas aeruginosa PA01
gcccggcuccggguacuggcgc

SEQ ID NO: 3500933 - RNA, 19 nt, Pseudomonas aeruginosa PA01
gcccggcucgcccaugcgc

SEQ ID NO: 3500934 - RNA, 13 nt, Pseudomonas aeruginosa PA01
gcccggcucgccg

SEQ ID NO: 3500935 - RNA, 16 nt, Pseudomonas aeruginosa PA01
gcccggcucgccgccg

SEQ ID NO: 3500936 - RNA, 17 nt, Pseudomonas aeruginosa PA01
gcccggcucgccgccgg

SEQ ID NO: 3500937 - RNA, 21 nt, Pseudomonas aeruginosa PA01
gcccggcucgccgccgggcgc

SEQ ID NO: 3500938 - RNA, 13 nt, Pseudomonas aeruginosa PA01
gcccggcucggcc

SEQ ID NO: 3500939 - RNA, 14 nt, Pseudomonas aeruginosa PA01
gcccggcucggccg

SEQ ID NO: 3500940 - RNA, 14 nt, Pseudomonas aeruginosa PA01
gcccggcugcacag

SEQ ID NO: 3500941 - RNA, 13 nt, Pseudomonas aeruginosa PA01
gcccggcuggcca

SEQ ID NO: 3500942 - RNA, 13 nt, Pseudomonas aeruginosa PA01
gcccggcuggcgu

SEQ ID NO: 3500943 - RNA, 14 nt, Pseudomonas aeruginosa PA01
gcccggcuggcgua

SEQ ID NO: 3500944 - RNA, 23 nt, Pseudomonas aeruginosa PA01
gcccggcugguugccagcagcgc

SEQ ID NO: 3500945 - RNA, 16 nt, Pseudomonas aeruginosa PA01
gcccggcugugcucga

SEQ ID NO: 3500946 - RNA, 18 nt, Pseudomonas aeruginosa PA01
gcccggcuucgcggguga

SEQ ID NO: 3500947 - RNA, 19 nt, Pseudomonas aeruginosa PA01
gcccggcuucgcgggugac

SEQ ID NO: 3500948 - RNA, 16 nt, Pseudomonas aeruginosa PA01
gcccggcuucgcuggu

SEQ ID NO: 3500949 - RNA, 21 nt, Pseudomonas aeruginosa PA01
gcccggcuucggcggcgcgcu

SEQ ID NO: 3500950 - RNA, 17 nt, Pseudomonas aeruginosa PA01
gcccggcuugaggaagu

SEQ ID NO: 3500951 - RNA, 16 nt, Pseudomonas aeruginosa PA01
gcccggcuugccgucg

SEQ ID NO: 3500952 - RNA, 16 nt, Pseudomonas aeruginosa PA01
gcccggcuuuccucgg

SEQ ID NO: 3500953 - RNA, 19 nt, Pseudomonas aeruginosa PA01
gcccggcuuuccucggcca

SEQ ID NO: 3500954 - RNA, 22 nt, Pseudomonas aeruginosa PA01
gcccgggaucgaugcgcgcccu

SEQ ID NO: 3500955 - RNA, 14 nt, Pseudomonas aeruginosa PA01
gcccgggcaacugc

SEQ ID NO: 3500956 - RNA, 18 nt, Pseudomonas aeruginosa PA01
gcccgggcaacugccgau

SEQ ID NO: 3500957 - RNA, 19 nt, Pseudomonas aeruginosa PA01
gcccgggcaacugccgaug

SEQ ID NO: 3500958 - RNA, 14 nt, Pseudomonas aeruginosa PA01
gcccgggccuggug

SEQ ID NO: 3500959 - RNA, 16 nt, Pseudomonas aeruginosa PA01
gcccgggccuggugca

SEQ ID NO: 3500960 - RNA, 22 nt, Pseudomonas aeruginosa PA01
gcccgggcgccaccgauagcgg

SEQ ID NO: 3500961 - RNA, 14 nt, Pseudomonas aeruginosa PA01
gcccgggcguuggc

SEQ ID NO: 3500962 - RNA, 18 nt, Pseudomonas aeruginosa PA01
gcccggggcucugccggu

SEQ ID NO: 3500963 - RNA, 16 nt, Pseudomonas aeruginosa PA01
gcccgggucacgguca

SEQ ID NO: 3500964 - RNA, 21 nt, Pseudomonas aeruginosa PA01
gcccggguggauaucgucggg

SEQ ID NO: 3500965 - RNA, 19 nt, Pseudomonas aeruginosa PA01
gcccggguugcccucgcag

SEQ ID NO: 3500966 - RNA, 16 nt, Pseudomonas aeruginosa PA01
gcccggguugccguag

SEQ ID NO: 3500967 - RNA, 20 nt, Pseudomonas aeruginosa PA01
gcccgguauucagccagagc

SEQ ID NO: 3500968 - RNA, 17 nt, Pseudomonas aeruginosa PA01
gcccggucaccacccag

SEQ ID NO: 3500969 - RNA, 14 nt, Pseudomonas aeruginosa PA01
gcccggucagcuuc

SEQ ID NO: 3500970 - RNA, 20 nt, Pseudomonas aeruginosa PA01
gcccggucagcuucgccgcc

SEQ ID NO: 3500971 - RNA, 21 nt, Pseudomonas aeruginosa PA01
gcccggucagguuggacaggu

SEQ ID NO: 3500972 - RNA, 16 nt, Pseudomonas aeruginosa PA01
gcccgguccguccagc

SEQ ID NO: 3500973 - RNA, 19 nt, Pseudomonas aeruginosa PA01
gcccgguccguccagcgcg

SEQ ID NO: 3500974 - RNA, 20 nt, Pseudomonas aeruginosa PA01
gcccgguccguccagcgcgc

SEQ ID NO: 3500975 - RNA, 22 nt, Pseudomonas aeruginosa PA01
gcccgguccguccagcgcgccc

SEQ ID NO: 3500976 - RNA, 15 nt, Pseudomonas aeruginosa PA01
gcccggucuagccgg

SEQ ID NO: 3500977 - RNA, 17 nt, Pseudomonas aeruginosa PA01
gcccggucuagccgggc

SEQ ID NO: 3500978 - RNA, 18 nt, Pseudomonas aeruginosa PA01
gcccggucuagccgggcc

SEQ ID NO: 3500979 - RNA, 21 nt, Pseudomonas aeruginosa PA01
gcccggucuagcgccccggcc

SEQ ID NO: 3500980 - RNA, 23 nt, Pseudomonas aeruginosa PA01
gcccggucuagcgccccggccgc

SEQ ID NO: 3500981 - RNA, 19 nt, Pseudomonas aeruginosa PA01
gcccggucucagccggcgc

SEQ ID NO: 3500982 - RNA, 20 nt, Pseudomonas aeruginosa PA01
gcccggucucagccggcgcu

SEQ ID NO: 3500983 - RNA, 11 nt, Pseudomonas aeruginosa PA01
gcccgguggaa

SEQ ID NO: 3500984 - RNA, 22 nt, Pseudomonas aeruginosa PA01
gcccgguggaggucugccacca

SEQ ID NO: 3500985 - RNA, 18 nt, Pseudomonas aeruginosa PA01
gcccgguggggcgggcga

SEQ ID NO: 3500986 - RNA, 17 nt, Pseudomonas aeruginosa PA01
gcccggugucgacgacg

SEQ ID NO: 3500987 - RNA, 15 nt, Pseudomonas aeruginosa PA01
gcccgguguucaccg

SEQ ID NO: 3500988 - RNA, 17 nt, Pseudomonas aeruginosa PA01
gcccgguucagcgggac

SEQ ID NO: 3500989 - RNA, 20 nt, Pseudomonas aeruginosa PA01
gcccgguucguagaguucgc

SEQ ID NO: 3500990 - RNA, 21 nt, Pseudomonas aeruginosa PA01
gcccgguucguagaguucgcu

SEQ ID NO: 3500991 - RNA, 21 nt, Pseudomonas aeruginosa PA01
gcccgguugagauccuggccg

SEQ ID NO: 3500992 - RNA, 22 nt, Pseudomonas aeruginosa PA01
gcccgguugagauccuggccgg

SEQ ID NO: 3500993 - RNA, 23 nt, Pseudomonas aeruginosa PA01
gcccgguugagauccuggccggc

SEQ ID NO: 3500994 - RNA, 21 nt, Pseudomonas aeruginosa PA01
gcccgguugccuucgucgcug

SEQ ID NO: 3500995 - RNA, 15 nt, Pseudomonas aeruginosa PA01
gcccgguuggccagg

SEQ ID NO: 3500996 - RNA, 17 nt, Pseudomonas aeruginosa PA01
gcccgguuggccaggac

SEQ ID NO: 3500997 - RNA, 14 nt, Pseudomonas aeruginosa PA01
gcccguagcacaug

SEQ ID NO: 3500998 - RNA, 18 nt, Pseudomonas aeruginosa PA01
gcccguagggcgaacaac

SEQ ID NO: 3500999 - RNA, 21 nt, Pseudomonas aeruginosa PA01
gcccguagggcgaacaacgcc

SEQ ID NO: 3501000 - RNA, 15 nt, Pseudomonas aeruginosa PA01
gcccguauggcgggc

SEQ ID NO: 3501001 - RNA, 18 nt, Pseudomonas aeruginosa PA01
gcccgucacuucacgaca

SEQ ID NO: 3501002 - RNA, 12 nt, Pseudomonas aeruginosa PA01
gcccgucaggcc

SEQ ID NO: 3501003 - RNA, 24 nt, Pseudomonas aeruginosa PA01
gcccgucaggccuugcgcggcgcc

SEQ ID NO: 3501004 - RNA, 18 nt, Pseudomonas aeruginosa PA01
gcccgucaugaccagagc

SEQ ID NO: 3501005 - RNA, 19 nt, Pseudomonas aeruginosa PA01
gcccgucaugaccagagcc

SEQ ID NO: 3501006 - RNA, 21 nt, Pseudomonas aeruginosa PA01
gcccgucaugaccagagccgc

SEQ ID NO: 3501007 - RNA, 22 nt, Pseudomonas aeruginosa PA01
gcccgucaugaccagagccgcc

SEQ ID NO: 3501008 - RNA, 23 nt, Pseudomonas aeruginosa PA01
gcccgucaugaccagagccgccg

SEQ ID NO: 3501009 - RNA, 15 nt, Pseudomonas aeruginosa PA01
gcccguccgcgccac

SEQ ID NO: 3501010 - RNA, 16 nt, Pseudomonas aeruginosa PA01
gcccguccgcgccacg

SEQ ID NO: 3501011 - RNA, 20 nt, Pseudomonas aeruginosa PA01
gcccguccgucccacaggcc

SEQ ID NO: 3501012 - RNA, 14 nt, Pseudomonas aeruginosa PA01
gcccguccuaggcc

SEQ ID NO: 3501013 - RNA, 22 nt, Pseudomonas aeruginosa PA01
gcccgucgaagaucaccggggc

SEQ ID NO: 3501014 - RNA, 23 nt, Pseudomonas aeruginosa PA01
gcccgucgaagaucaccggggcc

SEQ ID NO: 3501015 - RNA, 19 nt, Pseudomonas aeruginosa PA01
gcccgucgaagccaggcac

SEQ ID NO: 3501016 - RNA, 20 nt, Pseudomonas aeruginosa PA01
gcccgucgaagccaggcacc

SEQ ID NO: 3501017 - RNA, 20 nt, Pseudomonas aeruginosa PA01
gcccgucgaccaucaccagc

SEQ ID NO: 3501018 - RNA, 22 nt, Pseudomonas aeruginosa PA01
gcccgucgaccaucaccagcgc

SEQ ID NO: 3501019 - RNA, 13 nt, Pseudomonas aeruginosa PA01
gcccgucgcgccg

SEQ ID NO: 3501020 - RNA, 23 nt, Pseudomonas aeruginosa PA01
gaaguuguagguauacgacaggc

SEQ ID NO: 3501021 - RNA, 16 nt, Pseudomonas aeruginosa PA01
gaaguuguucgaugcg

SEQ ID NO: 3501022 - RNA, 11 nt, Pseudomonas aeruginosa PA01
gaauaaccgca

SEQ ID NO: 3501023 - RNA, 19 nt, Pseudomonas aeruginosa PA01
gaauaccacguggccggcg

SEQ ID NO: 3501024 - RNA, 21 nt, Pseudomonas aeruginosa PA01
gaauaccgcgcgcgcaaggcc

SEQ ID NO: 3501025 - RNA, 15 nt, Pseudomonas aeruginosa PA01
gaauaccgcugcgcg

SEQ ID NO: 3501026 - RNA, 14 nt, Pseudomonas aeruginosa PA01
gaauaccggccugu

SEQ ID NO: 3501027 - RNA, 23 nt, Pseudomonas aeruginosa PA01
gaauaccugcgaauugcgcugga

SEQ ID NO: 3501028 - RNA, 16 nt, Pseudomonas aeruginosa PA01
gaauacgugggggauu

SEQ ID NO: 3501029 - RNA, 17 nt, Pseudomonas aeruginosa PA01
gaauaguggaucgcccg

SEQ ID NO: 3501030 - RNA, 18 nt, Pseudomonas aeruginosa PA01
gaauaguggaucgcccga

SEQ ID NO: 3501031 - RNA, 21 nt, Pseudomonas aeruginosa PA01
gaauaguggaucgcccgaacg

SEQ ID NO: 3501032 - RNA, 20 nt, Pseudomonas aeruginosa PA01
gaauauccucgucgauccgc

SEQ ID NO: 3501033 - RNA, 15 nt, Pseudomonas aeruginosa PA01
gaaucacgcugcucg

SEQ ID NO: 3501034 - RNA, 15 nt, Pseudomonas aeruginosa PA01
gaauccaggccgacg

SEQ ID NO: 3501035 - RNA, 11 nt, Pseudomonas aeruginosa PA01
gaauccagggc

SEQ ID NO: 3501036 - RNA, 16 nt, Pseudomonas aeruginosa PA01
gaauccagggccgagc

SEQ ID NO: 3501037 - RNA, 18 nt, Pseudomonas aeruginosa PA01
gaaucccuuggcugcucg

SEQ ID NO: 3501038 - RNA, 17 nt, Pseudomonas aeruginosa PA01
gaauccgcggcccugcu

SEQ ID NO: 3501039 - RNA, 20 nt, Pseudomonas aeruginosa PA01
gaauccgcggcccugcucgc

SEQ ID NO: 3501040 - RNA, 18 nt, Pseudomonas aeruginosa PA01
gaauccggucggacuccg

SEQ ID NO: 3501041 - RNA, 20 nt, Pseudomonas aeruginosa PA01
gaauccuccagccggcgacg

SEQ ID NO: 3501042 - RNA, 17 nt, Pseudomonas aeruginosa PA01
gaauccuccugagugcg

SEQ ID NO: 3501043 - RNA, 19 nt, Pseudomonas aeruginosa PA01
gaauccuguccguccgaac

SEQ ID NO: 3501044 - RNA, 19 nt, Pseudomonas aeruginosa PA01
gaauccuucgcggcggcgc

SEQ ID NO: 3501045 - RNA, 13 nt, Pseudomonas aeruginosa PA01
gaaucgaaccccc

SEQ ID NO: 3501046 - RNA, 14 nt, Pseudomonas aeruginosa PA01
gaaucgacccagcc

SEQ ID NO: 3501047 - RNA, 23 nt, Pseudomonas aeruginosa PA01
gaaucgcaggcgaaaaaaagccc

SEQ ID NO: 3501048 - RNA, 15 nt, Pseudomonas aeruginosa PA01
gaaucgccagcaggc

SEQ ID NO: 3501049 - RNA, 18 nt, Pseudomonas aeruginosa PA01
gaaucgccgaggcgucga

SEQ ID NO: 3501050 - RNA, 23 nt, Pseudomonas aeruginosa PA01
gaaucgcuaauaucacuccugcg

SEQ ID NO: 3501051 - RNA, 14 nt, Pseudomonas aeruginosa PA01
gaaucggacgaucg

SEQ ID NO: 3501052 - RNA, 14 nt, Pseudomonas aeruginosa PA01
gaaucgucacggcg

SEQ ID NO: 3501053 - RNA, 19 nt, Pseudomonas aeruginosa PA01
gaaucucccgcaggcgcuu

SEQ ID NO: 3501054 - RNA, 14 nt, Pseudomonas aeruginosa PA01
gaaucugcccggcc

SEQ ID NO: 3501055 - RNA, 13 nt, Pseudomonas aeruginosa PA01
gaaugaaaaaggg

SEQ ID NO: 3501056 - RNA, 13 nt, Pseudomonas aeruginosa PA01
gaaugaagaagcc

SEQ ID NO: 3501057 - RNA, 14 nt, Pseudomonas aeruginosa PA01
gaaugaagaagccc

SEQ ID NO: 3501058 - RNA, 17 nt, Pseudomonas aeruginosa PA01
gaaugacgagccgcagg

SEQ ID NO: 3501059 - RNA, 17 nt, Pseudomonas aeruginosa PA01
gaaugauguacucgcgg

SEQ ID NO: 3501060 - RNA, 18 nt, Pseudomonas aeruginosa PA01
gaaugcccggcagcgccg

SEQ ID NO: 3501061 - RNA, 17 nt, Pseudomonas aeruginosa PA01
gaaugcccgugcgcugc

SEQ ID NO: 3501062 - RNA, 21 nt, Pseudomonas aeruginosa PA01
gaaugccggccggggccggca

SEQ ID NO: 3501063 - RNA, 23 nt, Pseudomonas aeruginosa PA01
gaaugccggccggggccggcacc

SEQ ID NO: 3501064 - RNA, 16 nt, Pseudomonas aeruginosa PA01
gaaugccuugaggccu

SEQ ID NO: 3501065 - RNA, 16 nt, Pseudomonas aeruginosa PA01
gaaugcgccucccgcu

SEQ ID NO: 3501066 - RNA, 14 nt, Pseudomonas aeruginosa PA01
gaaugcggcgugga

SEQ ID NO: 3501067 - RNA, 20 nt, Pseudomonas aeruginosa PA01
gaaugcucagcacggcgacg

SEQ ID NO: 3501068 - RNA, 22 nt, Pseudomonas aeruginosa PA01
gaaugcugcccggagcggcugc

SEQ ID NO: 3501069 - RNA, 13 nt, Pseudomonas aeruginosa PA01
gaaugcuugccgg

SEQ ID NO: 3501070 - RNA, 16 nt, Pseudomonas aeruginosa PA01
gaaugcuugccggcgc

SEQ ID NO: 3501071 - RNA, 23 nt, Pseudomonas aeruginosa PA01
gaauggaguuuccgcgaggauca

SEQ ID NO: 3501072 - RNA, 15 nt, Pseudomonas aeruginosa PA01
gaauggcagcaggca

SEQ ID NO: 3501073 - RNA, 16 nt, Pseudomonas aeruginosa PA01
gaauggcgccggccag

SEQ ID NO: 3501074 - RNA, 18 nt, Pseudomonas aeruginosa PA01
gaauggcggauaaccgca

SEQ ID NO: 3501075 - RNA, 15 nt, Pseudomonas aeruginosa PA01
gaauggcguggcuug

SEQ ID NO: 3501076 - RNA, 22 nt, Pseudomonas aeruginosa PA01
gaauggcguggcuuggcccugc

SEQ ID NO: 3501077 - RNA, 21 nt, Pseudomonas aeruginosa PA01
gaauggcuugaucgagucgcc

SEQ ID NO: 3501078 - RNA, 15 nt, Pseudomonas aeruginosa PA01
gaauguccggcgacc

SEQ ID NO: 3501079 - RNA, 15 nt, Pseudomonas aeruginosa PA01
gaauguccugccgca

SEQ ID NO: 3501080 - RNA, 16 nt, Pseudomonas aeruginosa PA01
gaauguccugccgcag

SEQ ID NO: 3501081 - RNA, 22 nt, Pseudomonas aeruginosa PA01
gaauguccugccgcaggcgggc

SEQ ID NO: 3501082 - RNA, 15 nt, Pseudomonas aeruginosa PA01
gaauucaggcuuccu

SEQ ID NO: 3501083 - RNA, 16 nt, Pseudomonas aeruginosa PA01
gaauuccgauuucagc

SEQ ID NO: 3501084 - RNA, 14 nt, Pseudomonas aeruginosa PA01
gaauucgucgccgc

SEQ ID NO: 3501085 - RNA, 17 nt, Pseudomonas aeruginosa PA01
gaauucgucgccgccga

SEQ ID NO: 3501086 - RNA, 15 nt, Pseudomonas aeruginosa PA01
gaauugcgcacgcaa

SEQ ID NO: 3501087 - RNA, 16 nt, Pseudomonas aeruginosa PA01
gaauugggucugcugg

SEQ ID NO: 3501088 - RNA, 13 nt, Pseudomonas aeruginosa PA01
gaauuucacgccg

SEQ ID NO: 3501089 - RNA, 16 nt, Pseudomonas aeruginosa PA01
gaauuucacgccgaag

SEQ ID NO: 3501090 - RNA, 17 nt, Pseudomonas aeruginosa PA01
gaauuucacgccgaagg

SEQ ID NO: 3501091 - RNA, 11 nt, Pseudomonas aeruginosa PA01
gaauuuccugc

SEQ ID NO: 3501092 - RNA, 20 nt, Pseudomonas aeruginosa PA01
gaauuuccugcuggcgagcg

SEQ ID NO: 3501093 - RNA, 22 nt, Pseudomonas aeruginosa PA01
gaauuugaacgcuguagaaugc

SEQ ID NO: 3501094 - RNA, 18 nt, Pseudomonas aeruginosa PA01
gacaacaggccgggcggc

SEQ ID NO: 3501095 - RNA, 20 nt, Pseudomonas aeruginosa PA01
gacaacaggccgggcggcgg

SEQ ID NO: 3501096 - RNA, 22 nt, Pseudomonas aeruginosa PA01
gacaacaggccgggcggcggcg

SEQ ID NO: 3501097 - RNA, 20 nt, Pseudomonas aeruginosa PA01
gacaacccggcgcuggccgc

SEQ ID NO: 3501098 - RNA, 22 nt, Pseudomonas aeruginosa PA01
gacaacccggcgcuggccgcgc

SEQ ID NO: 3501099 - RNA, 23 nt, Pseudomonas aeruginosa PA01
gacaacccggcgcuggccgcgcg

SEQ ID NO: 3501100 - RNA, 12 nt, Pseudomonas aeruginosa PA01
gacaacccugac

SEQ ID NO: 3501101 - RNA, 22 nt, Pseudomonas aeruginosa PA01
gacaaccgccguagccgucgua

SEQ ID NO: 3501102 - RNA, 20 nt, Pseudomonas aeruginosa PA01
gacaacgaaaagagccgcgc

SEQ ID NO: 3501103 - RNA, 21 nt, Pseudomonas aeruginosa PA01
gacaacgaaaagagccgcgcc

SEQ ID NO: 3501104 - RNA, 22 nt, Pseudomonas aeruginosa PA01
gacaacgaaaagagccgcgccu

SEQ ID NO: 3501105 - RNA, 18 nt, Pseudomonas aeruginosa PA01
gacaacgacagccccggc

SEQ ID NO: 3501106 - RNA, 16 nt, Pseudomonas aeruginosa PA01
gacaacggccguccca

SEQ ID NO: 3501107 - RNA, 22 nt, Pseudomonas aeruginosa PA01
gacaagcauucagcgcgccccg

SEQ ID NO: 3501108 - RNA, 21 nt, Pseudomonas aeruginosa PA01
gacaagccuccagcgccgccu

SEQ ID NO: 3501109 - RNA, 19 nt, Pseudomonas aeruginosa PA01
gacaagcgucgccggccgc

SEQ ID NO: 3501110 - RNA, 20 nt, Pseudomonas aeruginosa PA01
gacaagcgucgccggccgcu

SEQ ID NO: 3501111 - RNA, 20 nt, Pseudomonas aeruginosa PA01
gacaaggagacucagcgcga

SEQ ID NO: 3501112 - RNA, 20 nt, Pseudomonas aeruginosa PA01
gacaaggcugaggccgacga

SEQ ID NO: 3501113 - RNA, 14 nt, Pseudomonas aeruginosa PA01
gacaagguuugcgc

SEQ ID NO: 3501114 - RNA, 18 nt, Pseudomonas aeruginosa PA01
gacaagguuugcgccgcc

SEQ ID NO: 3501115 - RNA, 20 nt, Pseudomonas aeruginosa PA01
gacaagguuugcgccgccgu

SEQ ID NO: 3501116 - RNA, 14 nt, Pseudomonas aeruginosa PA01
gacacagacgcagc

SEQ ID NO: 3501117 - RNA, 16 nt, Pseudomonas aeruginosa PA01
gacacauggucggcca

SEQ ID NO: 3501118 - RNA, 22 nt, Pseudomonas aeruginosa PA01
gacacauggucggccaggucgc

SEQ ID NO: 3501119 - RNA, 15 nt, Pseudomonas aeruginosa PA01
gacaccaccagguug

SEQ ID NO: 3501120 - RNA, 17 nt, Pseudomonas aeruginosa PA01
gacaccaugcuccgccu

SEQ ID NO: 3501121 - RNA, 22 nt, Pseudomonas aeruginosa PA01
gacaccccgaaacgguccacca

SEQ ID NO: 3501122 - RNA, 23 nt, Pseudomonas aeruginosa PA01
gacaccccgaaacgguccaccag

SEQ ID NO: 3501123 - RNA, 15 nt, Pseudomonas aeruginosa PA01
gccucggcagggcgc

SEQ ID NO: 3501124 - RNA, 22 nt, Pseudomonas aeruginosa PA01
gccucggcagggcgcccgcccg

SEQ ID NO: 3501125 - RNA, 23 nt, Pseudomonas aeruginosa PA01
gccucggcagggcgcccgcccgg

SEQ ID NO: 3501126 - RNA, 16 nt, Pseudomonas aeruginosa PA01
gccucggcaucgacca

SEQ ID NO: 3501127 - RNA, 21 nt, Pseudomonas aeruginosa PA01
gccucggcaucgaccagggcc

SEQ ID NO: 3501128 - RNA, 16 nt, Pseudomonas aeruginosa PA01
gccucggccagcgccg

SEQ ID NO: 3501129 - RNA, 17 nt, Pseudomonas aeruginosa PA01
gccucggccagcgccgc

SEQ ID NO: 3501130 - RNA, 19 nt, Pseudomonas aeruginosa PA01
gccucggcccuggcggcga

SEQ ID NO: 3501131 - RNA, 13 nt, Pseudomonas aeruginosa PA01
gccucggccucgu

SEQ ID NO: 3501132 - RNA, 16 nt, Pseudomonas aeruginosa PA01
gccucggccucgucga

SEQ ID NO: 3501133 - RNA, 13 nt, Pseudomonas aeruginosa PA01
gccucggcgaagu

SEQ ID NO: 3501134 - RNA, 19 nt, Pseudomonas aeruginosa PA01
gccucggcgaagucgccgu

SEQ ID NO: 3501135 - RNA, 17 nt, Pseudomonas aeruginosa PA01
gccucggcgaucgccag

SEQ ID NO: 3501136 - RNA, 19 nt, Pseudomonas aeruginosa PA01
gccucggcgaucgccaggu

SEQ ID NO: 3501137 - RNA, 14 nt, Pseudomonas aeruginosa PA01
gccucggcgaugcc

SEQ ID NO: 3501138 - RNA, 17 nt, Pseudomonas aeruginosa PA01
gccucggcgaugccgga

SEQ ID NO: 3501139 - RNA, 15 nt, Pseudomonas aeruginosa PA01
gccucggcgcaguag

SEQ ID NO: 3501140 - RNA, 13 nt, Pseudomonas aeruginosa PA01
gccucggcgcgcg

SEQ ID NO: 3501141 - RNA, 14 nt, Pseudomonas aeruginosa PA01
gccucggcgcgcgc

SEQ ID NO: 3501142 - RNA, 18 nt, Pseudomonas aeruginosa PA01
gccucggcgcgcgccccc

SEQ ID NO: 3501143 - RNA, 16 nt, Pseudomonas aeruginosa PA01
gccucggcgcgggccu

SEQ ID NO: 3501144 - RNA, 19 nt, Pseudomonas aeruginosa PA01
gccucggcggacagcccgc

SEQ ID NO: 3501145 - RNA, 11 nt, Pseudomonas aeruginosa PA01
gccucggcggc

SEQ ID NO: 3501146 - RNA, 14 nt, Pseudomonas aeruginosa PA01
gccucggcggcgcg

SEQ ID NO: 3501147 - RNA, 22 nt, Pseudomonas aeruginosa PA01
gccucggcggcgcgaaccagca

SEQ ID NO: 3501148 - RNA, 23 nt, Pseudomonas aeruginosa PA01
gccucggcggcgcgaaccagcag

SEQ ID NO: 3501149 - RNA, 13 nt, Pseudomonas aeruginosa PA01
gccucggcggcgg

SEQ ID NO: 3501150 - RNA, 14 nt, Pseudomonas aeruginosa PA01
gccucggcggcggc

SEQ ID NO: 3501151 - RNA, 12 nt, Pseudomonas aeruginosa PA01
gccucggcggga

SEQ ID NO: 3501152 - RNA, 22 nt, Pseudomonas aeruginosa PA01
gccucggcgggagagggcggcg

SEQ ID NO: 3501153 - RNA, 23 nt, Pseudomonas aeruginosa PA01
gccucggcgggagagggcggcga

SEQ ID NO: 3501154 - RNA, 15 nt, Pseudomonas aeruginosa PA01
gccucggcgucgcgc

SEQ ID NO: 3501155 - RNA, 14 nt, Pseudomonas aeruginosa PA01
gccucgggcagccc

SEQ ID NO: 3501156 - RNA, 21 nt, Pseudomonas aeruginosa PA01
gccucgggccggagcaggcca

SEQ ID NO: 3501157 - RNA, 13 nt, Pseudomonas aeruginosa PA01
gccucgggcgagc

SEQ ID NO: 3501158 - RNA, 16 nt, Pseudomonas aeruginosa PA01
gccucgggcgagcgca

SEQ ID NO: 3501159 - RNA, 24 nt, Pseudomonas aeruginosa PA01
gccucgggcgggaucuccgcgcca

SEQ ID NO: 3501160 - RNA, 20 nt, Pseudomonas aeruginosa PA01
gccucggggccguccgccag

SEQ ID NO: 3501161 - RNA, 23 nt, Pseudomonas aeruginosa PA01
gccucgguagaccccggugugcg

SEQ ID NO: 3501162 - RNA, 13 nt, Pseudomonas aeruginosa PA01
gccucggucaggu

SEQ ID NO: 3501163 - RNA, 21 nt, Pseudomonas aeruginosa PA01
gccucgguggcccacuccaga

SEQ ID NO: 3501164 - RNA, 17 nt, Pseudomonas aeruginosa PA01
gccucgguuuccggcca

SEQ ID NO: 3501165 - RNA, 20 nt, Pseudomonas aeruginosa PA01
gccucgguuuccggccaggc

SEQ ID NO: 3501166 - RNA, 22 nt, Pseudomonas aeruginosa PA01
gccucgguuuccggccaggcgc

SEQ ID NO: 3501167 - RNA, 23 nt, Pseudomonas aeruginosa PA01
gccucgguuuccggccaggcgcg

SEQ ID NO: 3501168 - RNA, 16 nt, Pseudomonas aeruginosa PA01
gccucgucgaaacgga

SEQ ID NO: 3501169 - RNA, 21 nt, Pseudomonas aeruginosa PA01
gccucgucgaaacggaacagg

SEQ ID NO: 3501170 - RNA, 15 nt, Pseudomonas aeruginosa PA01
gccucgucgacgccc

SEQ ID NO: 3501171 - RNA, 19 nt, Pseudomonas aeruginosa PA01
gccucgucgacgcccuggc

SEQ ID NO: 3501172 - RNA, 15 nt, Pseudomonas aeruginosa PA01
gccucgucgacgcuc

SEQ ID NO: 3501173 - RNA, 21 nt, Pseudomonas aeruginosa PA01
gccucgucgagcaucugccgg

SEQ ID NO: 3501174 - RNA, 17 nt, Pseudomonas aeruginosa PA01
gccucgucgagcgcagc

SEQ ID NO: 3501175 - RNA, 20 nt, Pseudomonas aeruginosa PA01
gccucgucgagcgcagcgac

SEQ ID NO: 3501176 - RNA, 17 nt, Pseudomonas aeruginosa PA01
gccucgucgaucucgcc

SEQ ID NO: 3501177 - RNA, 20 nt, Pseudomonas aeruginosa PA01
gccucgucgaucucgccgaa

SEQ ID NO: 3501178 - RNA, 13 nt, Pseudomonas aeruginosa PA01
gccucgucgccau

SEQ ID NO: 3501179 - RNA, 15 nt, Pseudomonas aeruginosa PA01
gccucgucgccaugc

SEQ ID NO: 3501180 - RNA, 18 nt, Pseudomonas aeruginosa PA01
gccucgucgccaugcggc

SEQ ID NO: 3501181 - RNA, 23 nt, Pseudomonas aeruginosa PA01
gccucgucgccaugcggcaggcc

SEQ ID NO: 3501182 - RNA, 19 nt, Pseudomonas aeruginosa PA01
gccucgucgcgccaggcga

SEQ ID NO: 3501183 - RNA, 12 nt, Pseudomonas aeruginosa PA01
gccucgucgguc

SEQ ID NO: 3501184 - RNA, 16 nt, Pseudomonas aeruginosa PA01
gccucguggaacagcg

SEQ ID NO: 3501185 - RNA, 19 nt, Pseudomonas aeruginosa PA01
gccucguggaacagcgcgu

SEQ ID NO: 3501186 - RNA, 20 nt, Pseudomonas aeruginosa PA01
gccucguggaacagcgcguc

SEQ ID NO: 3501187 - RNA, 14 nt, Pseudomonas aeruginosa PA01
gccucguucagcag

SEQ ID NO: 3501188 - RNA, 15 nt, Pseudomonas aeruginosa PA01
gccucguucagcagc

SEQ ID NO: 3501189 - RNA, 22 nt, Pseudomonas aeruginosa PA01
gccucuaugaaccggggcggcc

SEQ ID NO: 3501190 - RNA, 23 nt, Pseudomonas aeruginosa PA01
gccucuaugaaccggggcggccg

SEQ ID NO: 3501191 - RNA, 14 nt, Pseudomonas aeruginosa PA01
gccucuccgagacg

SEQ ID NO: 3501192 - RNA, 20 nt, Pseudomonas aeruginosa PA01
gccucuccgagacgcugcac

SEQ ID NO: 3501193 - RNA, 17 nt, Pseudomonas aeruginosa PA01
gccucugaccgcgcccg

SEQ ID NO: 3501194 - RNA, 18 nt, Pseudomonas aeruginosa PA01
gccucugaccgcgcccgg

SEQ ID NO: 3501195 - RNA, 12 nt, Pseudomonas aeruginosa PA01
gccucugcgcug

SEQ ID NO: 3501196 - RNA, 12 nt, Pseudomonas aeruginosa PA01
gccucuuccugg

SEQ ID NO: 3501197 - RNA, 15 nt, Pseudomonas aeruginosa PA01
gccucuuccuggacc

SEQ ID NO: 3501198 - RNA, 17 nt, Pseudomonas aeruginosa PA01
gccucuuccuggaccuc

SEQ ID NO: 3501199 - RNA, 16 nt, Pseudomonas aeruginosa PA01
gccucuucgucggcga

SEQ ID NO: 3501200 - RNA, 19 nt, Pseudomonas aeruginosa PA01
gccucuugaaaacugucgg

SEQ ID NO: 3501201 - RNA, 23 nt, Pseudomonas aeruginosa PA01
gccucuugaaaacugucggcgga

SEQ ID NO: 3501202 - RNA, 15 nt, Pseudomonas aeruginosa PA01
gccugagcugccgcu

SEQ ID NO: 3501203 - RNA, 16 nt, Pseudomonas aeruginosa PA01
gccugagcugccgcuu

SEQ ID NO: 3501204 - RNA, 14 nt, Pseudomonas aeruginosa PA01
gccugagcuggccc

SEQ ID NO: 3501205 - RNA, 19 nt, Pseudomonas aeruginosa PA01
gccugagcuggcccaguug

SEQ ID NO: 3501206 - RNA, 19 nt, Pseudomonas aeruginosa PA01
gccugaucaucugggccau

SEQ ID NO: 3501207 - RNA, 19 nt, Pseudomonas aeruginosa PA01
gccugaugcaggagaugca

SEQ ID NO: 3501208 - RNA, 14 nt, Pseudomonas aeruginosa PA01
gccugcaaagaggc

SEQ ID NO: 3501209 - RNA, 18 nt, Pseudomonas aeruginosa PA01
gccugcaacacccaggcc

SEQ ID NO: 3501210 - RNA, 20 nt, Pseudomonas aeruginosa PA01
gccugcaacacccaggccug

SEQ ID NO: 3501211 - RNA, 22 nt, Pseudomonas aeruginosa PA01
gccugcaacacccaggccuggg

SEQ ID NO: 3501212 - RNA, 23 nt, Pseudomonas aeruginosa PA01
gccugcaacagaaguugcuggcg

SEQ ID NO: 3501213 - RNA, 14 nt, Pseudomonas aeruginosa PA01
gccugcaacgccgc

SEQ ID NO: 3501214 - RNA, 18 nt, Pseudomonas aeruginosa PA01
gccugcaacgccgccaac

SEQ ID NO: 3501215 - RNA, 21 nt, Pseudomonas aeruginosa PA01
gccugcaacguccucgcgccg

SEQ ID NO: 3501216 - RNA, 14 nt, Pseudomonas aeruginosa PA01
gccugcaacucguc

SEQ ID NO: 3501217 - RNA, 16 nt, Pseudomonas aeruginosa PA01
gccugcaacucgucgu

SEQ ID NO: 3501218 - RNA, 21 nt, Pseudomonas aeruginosa PA01
gccugcaacucgucguccagc

SEQ ID NO: 3501219 - RNA, 22 nt, Pseudomonas aeruginosa PA01
gccugcaacucgucguccagcg

SEQ ID NO: 3501220 - RNA, 13 nt, Pseudomonas aeruginosa PA01
gccugcaccacgc

SEQ ID NO: 3501221 - RNA, 19 nt, Pseudomonas aeruginosa PA01
gccugcaccacgcaggcgc

SEQ ID NO: 3501222 - RNA, 13 nt, Pseudomonas aeruginosa PA01
gccugcaccagcc

SEQ ID NO: 3501223 - RNA, 22 nt, Pseudomonas aeruginosa PA01
gccugcaccagccaguccggca

SEQ ID NO: 3501224 - RNA, 23 nt, Pseudomonas aeruginosa PA01
gccugcaccagccaguccggcag

SEQ ID NO: 3501225 - RNA, 14 nt, Pseudomonas aeruginosa PA01
gccugcaccgggcc

SEQ ID NO: 3501226 - RNA, 21 nt, Pseudomonas aeruginosa PA01
gccuccggcacgcugccgccg

SEQ ID NO: 3501227 - RNA, 22 nt, Pseudomonas aeruginosa PA01
gccuccggcacgcugccgccga

SEQ ID NO: 3501228 - RNA, 24 nt, Pseudomonas aeruginosa PA01
gccuccggcacgcugccgccgaug

SEQ ID NO: 3501229 - RNA, 16 nt, Pseudomonas aeruginosa PA01
gccuccuccggcucgc

SEQ ID NO: 3501230 - RNA, 19 nt, Pseudomonas aeruginosa PA01
gccuccuccggcucgcuga

SEQ ID NO: 3501231 - RNA, 16 nt, Pseudomonas aeruginosa PA01
gccuccucggcggccu

SEQ ID NO: 3501232 - RNA, 22 nt, Pseudomonas aeruginosa PA01
gccuccucguaggcguccuggc

SEQ ID NO: 3501233 - RNA, 18 nt, Pseudomonas aeruginosa PA01
gccuccucuaccaggcgg

SEQ ID NO: 3501234 - RNA, 17 nt, Pseudomonas aeruginosa PA01
gccuccugcaacgccug

SEQ ID NO: 3501235 - RNA, 15 nt, Pseudomonas aeruginosa PA01
gccuccuggcggcgu

SEQ ID NO: 3501236 - RNA, 18 nt, Pseudomonas aeruginosa PA01
gccuccuggcggcguggc

SEQ ID NO: 3501237 - RNA, 20 nt, Pseudomonas aeruginosa PA01
gccuccuucaucuuggccca

SEQ ID NO: 3501238 - RNA, 15 nt, Pseudomonas aeruginosa PA01
gccucgaacauggcc

SEQ ID NO: 3501239 - RNA, 16 nt, Pseudomonas aeruginosa PA01
gccucgaacauggcca

SEQ ID NO: 3501240 - RNA, 20 nt, Pseudomonas aeruginosa PA01
gccucgaacauggccaccga

SEQ ID NO: 3501241 - RNA, 20 nt, Pseudomonas aeruginosa PA01
gccucgaagaaaaggcccgg

SEQ ID NO: 3501242 - RNA, 20 nt, Pseudomonas aeruginosa PA01
gccucgaaggccggcaaagu

SEQ ID NO: 3501243 - RNA, 17 nt, Pseudomonas aeruginosa PA01
gccucgaaggccucggu

SEQ ID NO: 3501244 - RNA, 16 nt, Pseudomonas aeruginosa PA01
gccucgaaggucagcc

SEQ ID NO: 3501245 - RNA, 18 nt, Pseudomonas aeruginosa PA01
gccucgaaggucagcccg

SEQ ID NO: 3501246 - RNA, 19 nt, Pseudomonas aeruginosa PA01
gccucgaccagaucggcau

SEQ ID NO: 3501247 - RNA, 22 nt, Pseudomonas aeruginosa PA01
gccucgaccagcgccgcggcga

SEQ ID NO: 3501248 - RNA, 20 nt, Pseudomonas aeruginosa PA01
gccucgaccaucggcggcgg

SEQ ID NO: 3501249 - RNA, 18 nt, Pseudomonas aeruginosa PA01
gccucgaccccggaaagg

SEQ ID NO: 3501250 - RNA, 15 nt, Pseudomonas aeruginosa PA01
gccucgaccucggcc

SEQ ID NO: 3501251 - RNA, 14 nt, Pseudomonas aeruginosa PA01
gccucgaccuggcc

SEQ ID NO: 3501252 - RNA, 17 nt, Pseudomonas aeruginosa PA01
gccucgaccuggccacg

SEQ ID NO: 3501253 - RNA, 22 nt, Pseudomonas aeruginosa PA01
gccucgacgagguugcucuggg

SEQ ID NO: 3501254 - RNA, 23 nt, Pseudomonas aeruginosa PA01
gccucgacgagguugcucugggc

SEQ ID NO: 3501255 - RNA, 18 nt, Pseudomonas aeruginosa PA01
gccucgacgcagagcgcc

SEQ ID NO: 3501256 - RNA, 23 nt, Pseudomonas aeruginosa PA01
gccucgacgcucuccgucagggc

SEQ ID NO: 3501257 - RNA, 15 nt, Pseudomonas aeruginosa PA01
gccucgaggaacagg

SEQ ID NO: 3501258 - RNA, 17 nt, Pseudomonas aeruginosa PA01
gccucgaggaacagguc

SEQ ID NO: 3501259 - RNA, 21 nt, Pseudomonas aeruginosa PA01
gccucgaggaacaggucgacg

SEQ ID NO: 3501260 - RNA, 23 nt, Pseudomonas aeruginosa PA01
gccucgaggaucuugcgcccggc

SEQ ID NO: 3501261 - RNA, 17 nt, Pseudomonas aeruginosa PA01
gccucgaggucggccug

SEQ ID NO: 3501262 - RNA, 18 nt, Pseudomonas aeruginosa PA01
gccucgaggucggccugg

SEQ ID NO: 3501263 - RNA, 19 nt, Pseudomonas aeruginosa PA01
gccucgaggucggccuggc

SEQ ID NO: 3501264 - RNA, 20 nt, Pseudomonas aeruginosa PA01
gccucgaggucggccuggcu

SEQ ID NO: 3501265 - RNA, 22 nt, Pseudomonas aeruginosa PA01
gccucgaggucggccuggcugc

SEQ ID NO: 3501266 - RNA, 19 nt, Pseudomonas aeruginosa PA01
gccucgagguucucgaccc

SEQ ID NO: 3501267 - RNA, 21 nt, Pseudomonas aeruginosa PA01
gccucgaucgccucgggcgag

SEQ ID NO: 3501268 - RNA, 23 nt, Pseudomonas aeruginosa PA01
gccucgaucgccucgggcgagcg

SEQ ID NO: 3501269 - RNA, 19 nt, Pseudomonas aeruginosa PA01
gccucgaucucguccucgg

SEQ ID NO: 3501270 - RNA, 22 nt, Pseudomonas aeruginosa PA01
gccucgaucucguccucggcgu

SEQ ID NO: 3501271 - RNA, 15 nt, Pseudomonas aeruginosa PA01
gccucgaucuucuuc

SEQ ID NO: 3501272 - RNA, 19 nt, Pseudomonas aeruginosa PA01
gccucgaucuucuuccccg

SEQ ID NO: 3501273 - RNA, 22 nt, Pseudomonas aeruginosa PA01
gccucgaucuucuuccccgcca

SEQ ID NO: 3501274 - RNA, 19 nt, Pseudomonas aeruginosa PA01
gccucgaugaucgccgggu

SEQ ID NO: 3501275 - RNA, 16 nt, Pseudomonas aeruginosa PA01
gccucgaugauggugc

SEQ ID NO: 3501276 - RNA, 11 nt, Pseudomonas aeruginosa PA01
gccucgauggc

SEQ ID NO: 3501277 - RNA, 15 nt, Pseudomonas aeruginosa PA01
gccucgauggcggca

SEQ ID NO: 3501278 - RNA, 21 nt, Pseudomonas aeruginosa PA01
gccucgaugugcuugagucgc

SEQ ID NO: 3501279 - RNA, 17 nt, Pseudomonas aeruginosa PA01
gccucgcaaaggucggc

SEQ ID NO: 3501280 - RNA, 19 nt, Pseudomonas aeruginosa PA01
gccucgcaaaggucggcga

SEQ ID NO: 3501281 - RNA, 20 nt, Pseudomonas aeruginosa PA01
gccucgcaaaggucggcgaa

SEQ ID NO: 3501282 - RNA, 23 nt, Pseudomonas aeruginosa PA01
gccucgcaaaggucggcgaaggc

SEQ ID NO: 3501283 - RNA, 17 nt, Pseudomonas aeruginosa PA01
gccucgcagagcgccag

SEQ ID NO: 3501284 - RNA, 21 nt, Pseudomonas aeruginosa PA01
gccucgcagagcgccagccag

SEQ ID NO: 3501285 - RNA, 22 nt, Pseudomonas aeruginosa PA01
gccucgcagagcgccagccagc

SEQ ID NO: 3501286 - RNA, 24 nt, Pseudomonas aeruginosa PA01
gccucgccccagacccaggugcgc

SEQ ID NO: 3501287 - RNA, 13 nt, Pseudomonas aeruginosa PA01
gccucgccgagca

SEQ ID NO: 3501288 - RNA, 15 nt, Pseudomonas aeruginosa PA01
gccucgccgaugucg

SEQ ID NO: 3501289 - RNA, 13 nt, Pseudomonas aeruginosa PA01
gccucgccgcccg

SEQ ID NO: 3501290 - RNA, 12 nt, Pseudomonas aeruginosa PA01
gccucgccggcc

SEQ ID NO: 3501291 - RNA, 18 nt, Pseudomonas aeruginosa PA01
gccucgccggucgcgcuc

SEQ ID NO: 3501292 - RNA, 13 nt, Pseudomonas aeruginosa PA01
gccucgcgacugc

SEQ ID NO: 3501293 - RNA, 17 nt, Pseudomonas aeruginosa PA01
gccucgcgacugcugau

SEQ ID NO: 3501294 - RNA, 19 nt, Pseudomonas aeruginosa PA01
gccucgcgacugcugauca

SEQ ID NO: 3501295 - RNA, 18 nt, Pseudomonas aeruginosa PA01
gccucgcgcaacugcucg

SEQ ID NO: 3501296 - RNA, 19 nt, Pseudomonas aeruginosa PA01
gccucgcgccagagaucgc

SEQ ID NO: 3501297 - RNA, 22 nt, Pseudomonas aeruginosa PA01
gccucgcgccagagaucgccca

SEQ ID NO: 3501298 - RNA, 16 nt, Pseudomonas aeruginosa PA01
gccucgcgccgcgcca

SEQ ID NO: 3501299 - RNA, 19 nt, Pseudomonas aeruginosa PA01
gccucgcgccgcgccagca

SEQ ID NO: 3501300 - RNA, 20 nt, Pseudomonas aeruginosa PA01
gccucgcgccgcgccagcag

SEQ ID NO: 3501301 - RNA, 12 nt, Pseudomonas aeruginosa PA01
gccucgcgccgu

SEQ ID NO: 3501302 - RNA, 15 nt, Pseudomonas aeruginosa PA01
gccucgcgcguggcc

SEQ ID NO: 3501303 - RNA, 19 nt, Pseudomonas aeruginosa PA01
gccucgcgcucggcggccu

SEQ ID NO: 3501304 - RNA, 18 nt, Pseudomonas aeruginosa PA01
gccucgcggaccucgggc

SEQ ID NO: 3501305 - RNA, 14 nt, Pseudomonas aeruginosa PA01
gccucgcggcgcuc

SEQ ID NO: 3501306 - RNA, 22 nt, Pseudomonas aeruginosa PA01
gccucgcggguaucgauccagc

SEQ ID NO: 3501307 - RNA, 23 nt, Pseudomonas aeruginosa PA01
gccucgcggguaucgauccagcc

SEQ ID NO: 3501308 - RNA, 18 nt, Pseudomonas aeruginosa PA01
gccucgcguucgcggucg

SEQ ID NO: 3501309 - RNA, 22 nt, Pseudomonas aeruginosa PA01
gccucgcuagucuuccugcacg

SEQ ID NO: 3501310 - RNA, 20 nt, Pseudomonas aeruginosa PA01
gccucgcugagcaccgggac

SEQ ID NO: 3501311 - RNA, 15 nt, Pseudomonas aeruginosa PA01
gccucgcugccgccg

SEQ ID NO: 3501312 - RNA, 17 nt, Pseudomonas aeruginosa PA01
gccucgcugccgccgca

SEQ ID NO: 3501313 - RNA, 18 nt, Pseudomonas aeruginosa PA01
gccucgcugccgccgcag

SEQ ID NO: 3501314 - RNA, 19 nt, Pseudomonas aeruginosa PA01
gccucgcugccgccgcaga

SEQ ID NO: 3501315 - RNA, 17 nt, Pseudomonas aeruginosa PA01
gccucgcugccugggga

SEQ ID NO: 3501316 - RNA, 16 nt, Pseudomonas aeruginosa PA01
gccucgcugcgcagau

SEQ ID NO: 3501317 - RNA, 23 nt, Pseudomonas aeruginosa PA01
gccucgcugcgcagaugcggggc

SEQ ID NO: 3501318 - RNA, 12 nt, Pseudomonas aeruginosa PA01
gccucgcuggcg

SEQ ID NO: 3501319 - RNA, 13 nt, Pseudomonas aeruginosa PA01
gccucgcuggcga

SEQ ID NO: 3501320 - RNA, 13 nt, Pseudomonas aeruginosa PA01
gccucgcuggcgu

SEQ ID NO: 3501321 - RNA, 19 nt, Pseudomonas aeruginosa PA01
gccucgcuggcguucucca

SEQ ID NO: 3501322 - RNA, 17 nt, Pseudomonas aeruginosa PA01
gccucgcugggcgggcg

SEQ ID NO: 3501323 - RNA, 21 nt, Pseudomonas aeruginosa PA01
gccucgcugggcgggcguccg

SEQ ID NO: 3501324 - RNA, 22 nt, Pseudomonas aeruginosa PA01
gccucgcugggcgggcguccgu

SEQ ID NO: 3501325 - RNA, 17 nt, Pseudomonas aeruginosa PA01
gccucggagaacagcag

SEQ ID NO: 3501326 - RNA, 18 nt, Pseudomonas aeruginosa PA01
gccucggagaacagcagc

SEQ ID NO: 3501327 - RNA, 19 nt, Pseudomonas aeruginosa PA01
gccucggagaacagcagcg

SEQ ID NO: 3501328 - RNA, 20 nt, Pseudomonas aeruginosa PA01
gccugggcgccgccagccag

SEQ ID NO: 3501329 - RNA, 13 nt, Pseudomonas aeruginosa PA01
gccugggcgcuca

SEQ ID NO: 3501330 - RNA, 18 nt, Pseudomonas aeruginosa PA01
gccugggcggcuuccugc

SEQ ID NO: 3501331 - RNA, 20 nt, Pseudomonas aeruginosa PA01
gccugggcggucggcucagc

SEQ ID NO: 3501332 - RNA, 22 nt, Pseudomonas aeruginosa PA01
gccugggcggucggcucagccg

SEQ ID NO: 3501333 - RNA, 22 nt, Pseudomonas aeruginosa PA01
gccugggcguacaggccccagg

SEQ ID NO: 3501334 - RNA, 23 nt, Pseudomonas aeruginosa PA01
gccugggcguagaguucgcugcg

SEQ ID NO: 3501335 - RNA, 18 nt, Pseudomonas aeruginosa PA01
gccuggggcucggcuucc

SEQ ID NO: 3501336 - RNA, 21 nt, Pseudomonas aeruginosa PA01
gccuggggcucggcuuccauc

SEQ ID NO: 3501337 - RNA, 14 nt, Pseudomonas aeruginosa PA01
gccugggguagccg

SEQ ID NO: 3501338 - RNA, 16 nt, Pseudomonas aeruginosa PA01
gccugggguagccggc

SEQ ID NO: 3501339 - RNA, 18 nt, Pseudomonas aeruginosa PA01
gccugggguagccggccg

SEQ ID NO: 3501340 - RNA, 17 nt, Pseudomonas aeruginosa PA01
gccuggguacgcaccgg

SEQ ID NO: 3501341 - RNA, 15 nt, Pseudomonas aeruginosa PA01
gccugggucaccagc

SEQ ID NO: 3501342 - RNA, 18 nt, Pseudomonas aeruginosa PA01
gccugggugaacagcggc

SEQ ID NO: 3501343 - RNA, 16 nt, Pseudomonas aeruginosa PA01
gccugguagaaacgcu

SEQ ID NO: 3501344 - RNA, 18 nt, Pseudomonas aeruginosa PA01
gccugguagaucugugcg

SEQ ID NO: 3501345 - RNA, 21 nt, Pseudomonas aeruginosa PA01
gccugguagaucugugcggug

SEQ ID NO: 3501346 - RNA, 17 nt, Pseudomonas aeruginosa PA01
gccugguaggccucgau

SEQ ID NO: 3501347 - RNA, 16 nt, Pseudomonas aeruginosa PA01
gccugguaggcggcga

SEQ ID NO: 3501348 - RNA, 14 nt, Pseudomonas aeruginosa PA01
gccugguagucgcc

SEQ ID NO: 3501349 - RNA, 17 nt, Pseudomonas aeruginosa PA01
gccugguagucgccggu

SEQ ID NO: 3501350 - RNA, 20 nt, Pseudomonas aeruginosa PA01
gccugguauugcgcccagag

SEQ ID NO: 3501351 - RNA, 17 nt, Pseudomonas aeruginosa PA01
gccuggucauccuggcc

SEQ ID NO: 3501352 - RNA, 21 nt, Pseudomonas aeruginosa PA01
gccuggucauccuggcccugg

SEQ ID NO: 3501353 - RNA, 22 nt, Pseudomonas aeruginosa PA01
gccuggucauccuggcccugga

SEQ ID NO: 3501354 - RNA, 14 nt, Pseudomonas aeruginosa PA01
gccugguccagcag

SEQ ID NO: 3501355 - RNA, 22 nt, Pseudomonas aeruginosa PA01
gccuggucgaaagccugccggg

SEQ ID NO: 3501356 - RNA, 15 nt, Pseudomonas aeruginosa PA01
gccuggucgccggga

SEQ ID NO: 3501357 - RNA, 18 nt, Pseudomonas aeruginosa PA01
gccuggucggcgcggcgc

SEQ ID NO: 3501358 - RNA, 23 nt, Pseudomonas aeruginosa PA01
gccuggucggcgcggcgcuccag

SEQ ID NO: 3501359 - RNA, 15 nt, Pseudomonas aeruginosa PA01
gccuggucggcggcc

SEQ ID NO: 3501360 - RNA, 16 nt, Pseudomonas aeruginosa PA01
gccuggucggcggccu

SEQ ID NO: 3501361 - RNA, 13 nt, Pseudomonas aeruginosa PA01
gccuggucggggc

SEQ ID NO: 3501362 - RNA, 17 nt, Pseudomonas aeruginosa PA01
gccuggucgucguagug

SEQ ID NO: 3501363 - RNA, 18 nt, Pseudomonas aeruginosa PA01
gccuggucgucguagugg

SEQ ID NO: 3501364 - RNA, 19 nt, Pseudomonas aeruginosa PA01
gccuggucgucguaguggc

SEQ ID NO: 3501365 - RNA, 17 nt, Pseudomonas aeruginosa PA01
gccuggugacccggaca

SEQ ID NO: 3501366 - RNA, 18 nt, Pseudomonas aeruginosa PA01
gccuggugagcggaacgg

SEQ ID NO: 3501367 - RNA, 14 nt, Pseudomonas aeruginosa PA01
gccuggugcaccug

SEQ ID NO: 3501368 - RNA, 13 nt, Pseudomonas aeruginosa PA01
gccuggugcaggu

SEQ ID NO: 3501369 - RNA, 17 nt, Pseudomonas aeruginosa PA01
gccuggugcccgaugcc

SEQ ID NO: 3501370 - RNA, 18 nt, Pseudomonas aeruginosa PA01
gccuggugcccgaugccg

SEQ ID NO: 3501371 - RNA, 16 nt, Pseudomonas aeruginosa PA01
gccugguucccucaac

SEQ ID NO: 3501372 - RNA, 15 nt, Pseudomonas aeruginosa PA01
gccugguucugcucc

SEQ ID NO: 3501373 - RNA, 22 nt, Pseudomonas aeruginosa PA01
gccugguuguaggcgccgccgu

SEQ ID NO: 3501374 - RNA, 13 nt, Pseudomonas aeruginosa PA01
gccugucacgccg

SEQ ID NO: 3501375 - RNA, 15 nt, Pseudomonas aeruginosa PA01
gccugucacgccggg

SEQ ID NO: 3501376 - RNA, 21 nt, Pseudomonas aeruginosa PA01
gccugucacucaggcaugcgg

SEQ ID NO: 3501377 - RNA, 18 nt, Pseudomonas aeruginosa PA01
gccuguccaccgguggcg

SEQ ID NO: 3501378 - RNA, 13 nt, Pseudomonas aeruginosa PA01
gccuguccagcuc

SEQ ID NO: 3501379 - RNA, 18 nt, Pseudomonas aeruginosa PA01
gccuguccagcuccccca

SEQ ID NO: 3501380 - RNA, 15 nt, Pseudomonas aeruginosa PA01
gccuguccgaagaca

SEQ ID NO: 3501381 - RNA, 14 nt, Pseudomonas aeruginosa PA01
gccuguccgcugcg

SEQ ID NO: 3501382 - RNA, 17 nt, Pseudomonas aeruginosa PA01
gccuguccgggaaugcu

SEQ ID NO: 3501383 - RNA, 13 nt, Pseudomonas aeruginosa PA01
gccugucgcuccg

SEQ ID NO: 3501384 - RNA, 16 nt, Pseudomonas aeruginosa PA01
gccugucgcuccggca

SEQ ID NO: 3501385 - RNA, 17 nt, Pseudomonas aeruginosa PA01
gccugucgcuccggcag

SEQ ID NO: 3501386 - RNA, 13 nt, Pseudomonas aeruginosa PA01
gccugucggcacg

SEQ ID NO: 3501387 - RNA, 19 nt, Pseudomonas aeruginosa PA01
gccugucgggggcugcgca

SEQ ID NO: 3501388 - RNA, 13 nt, Pseudomonas aeruginosa PA01
gccuguuccuccg

SEQ ID NO: 3501389 - RNA, 16 nt, Pseudomonas aeruginosa PA01
gccuguucgcccaagg

SEQ ID NO: 3501390 - RNA, 22 nt, Pseudomonas aeruginosa PA01
gccuguugagugggaugacgau

SEQ ID NO: 3501391 - RNA, 18 nt, Pseudomonas aeruginosa PA01
gccuguuuccagaaggcu

SEQ ID NO: 3501392 - RNA, 19 nt, Pseudomonas aeruginosa PA01
gccuuaccagaagccggcc

SEQ ID NO: 3501393 - RNA, 23 nt, Pseudomonas aeruginosa PA01
gccuuaccagaagccggccgggu

SEQ ID NO: 3501394 - RNA, 20 nt, Pseudomonas aeruginosa PA01
gccuuagcgguugcggguca

SEQ ID NO: 3501395 - RNA, 14 nt, Pseudomonas aeruginosa PA01
gccuucaccgcgcc

SEQ ID NO: 3501396 - RNA, 19 nt, Pseudomonas aeruginosa PA01
gccuucaccgcgccgcgcu

SEQ ID NO: 3501397 - RNA, 15 nt, Pseudomonas aeruginosa PA01
gccuucaccggcgga

SEQ ID NO: 3501398 - RNA, 19 nt, Pseudomonas aeruginosa PA01
gccuucaccggcggaugac

SEQ ID NO: 3501399 - RNA, 21 nt, Pseudomonas aeruginosa PA01
gccuucaccguucccagcagc

SEQ ID NO: 3501400 - RNA, 19 nt, Pseudomonas aeruginosa PA01
gccuucagacgcaccgagg

SEQ ID NO: 3501401 - RNA, 21 nt, Pseudomonas aeruginosa PA01
gccuucagagcagggugaagc

SEQ ID NO: 3501402 - RNA, 17 nt, Pseudomonas aeruginosa PA01
gccuucagcgccagcag

SEQ ID NO: 3501403 - RNA, 20 nt, Pseudomonas aeruginosa PA01
gccuucagcgccagcaggcg

SEQ ID NO: 3501404 - RNA, 16 nt, Pseudomonas aeruginosa PA01
gccuucagcgccgcca

SEQ ID NO: 3501405 - RNA, 20 nt, Pseudomonas aeruginosa PA01
gccuucagcgccgccaggcc

SEQ ID NO: 3501406 - RNA, 18 nt, Pseudomonas aeruginosa PA01
gccuucagcgccuccagc

SEQ ID NO: 3501407 - RNA, 21 nt, Pseudomonas aeruginosa PA01
gccuucagcgccuccagcacc

SEQ ID NO: 3501408 - RNA, 16 nt, Pseudomonas aeruginosa PA01
gccuucaggcugcgcg

SEQ ID NO: 3501409 - RNA, 15 nt, Pseudomonas aeruginosa PA01
gccuuccacgccuuc

SEQ ID NO: 3501410 - RNA, 14 nt, Pseudomonas aeruginosa PA01
gccuuccagcaggu

SEQ ID NO: 3501411 - RNA, 15 nt, Pseudomonas aeruginosa PA01
gccuuccagcccuuc

SEQ ID NO: 3501412 - RNA, 22 nt, Pseudomonas aeruginosa PA01
gccuuccagcuugcgccagagc

SEQ ID NO: 3501413 - RNA, 19 nt, Pseudomonas aeruginosa PA01
gccuuccaggcuguagccg

SEQ ID NO: 3501414 - RNA, 21 nt, Pseudomonas aeruginosa PA01
gccuuccaggcuguagccggc

SEQ ID NO: 3501415 - RNA, 19 nt, Pseudomonas aeruginosa PA01
gccuuccagguaguccagc

SEQ ID NO: 3501416 - RNA, 20 nt, Pseudomonas aeruginosa PA01
gccuuccagguaguccagcu

SEQ ID NO: 3501417 - RNA, 18 nt, Pseudomonas aeruginosa PA01
gccuucccagacguccag

SEQ ID NO: 3501418 - RNA, 20 nt, Pseudomonas aeruginosa PA01
gccuucccggucgacggcgu

SEQ ID NO: 3501419 - RNA, 17 nt, Pseudomonas aeruginosa PA01
gccuuccgacgccgcgu

SEQ ID NO: 3501420 - RNA, 22 nt, Pseudomonas aeruginosa PA01
gccuuccgcgcccaggcugccg

SEQ ID NO: 3501421 - RNA, 17 nt, Pseudomonas aeruginosa PA01
gccuuccggcaccacca

SEQ ID NO: 3501422 - RNA, 13 nt, Pseudomonas aeruginosa PA01
gccuuccgggaag

SEQ ID NO: 3501423 - RNA, 14 nt, Pseudomonas aeruginosa PA01
gccuuccucggccg

SEQ ID NO: 3501424 - RNA, 18 nt, Pseudomonas aeruginosa PA01
gccuuccucggccgccag

SEQ ID NO: 3501425 - RNA, 20 nt, Pseudomonas aeruginosa PA01
gccuuccucggccgccaggc

SEQ ID NO: 3501426 - RNA, 21 nt, Pseudomonas aeruginosa PA01
gccuuccucggccgccaggcg

SEQ ID NO: 3501427 - RNA, 23 nt, Pseudomonas aeruginosa PA01
gccuuccucggccgccaggcgcg

SEQ ID NO: 3501428 - RNA, 14 nt, Pseudomonas aeruginosa PA01
gccuuccugggcgu

SEQ ID NO: 3501429 - RNA, 16 nt, Pseudomonas aeruginosa PA01
gccuucgaagccggca

SEQ ID NO: 3501430 - RNA, 16 nt, Pseudomonas aeruginosa PA01
gccuucgacgguucgc

SEQ ID NO: 3501431 - RNA, 22 nt, Pseudomonas aeruginosa PA01
gccuggaacaccaggccgcaag

SEQ ID NO: 3501432 - RNA, 21 nt, Pseudomonas aeruginosa PA01
gccuggaacuggucggggcgc

SEQ ID NO: 3501433 - RNA, 14 nt, Pseudomonas aeruginosa PA01
gccuggaaggcgcu

SEQ ID NO: 3501434 - RNA, 21 nt, Pseudomonas aeruginosa PA01
gccuggaaggcgcugggcggc

SEQ ID NO: 3501435 - RNA, 22 nt, Pseudomonas aeruginosa PA01
gccuggaaggcgcugggcggcu

SEQ ID NO: 3501436 - RNA, 18 nt, Pseudomonas aeruginosa PA01
gccuggaaguauucggcg

SEQ ID NO: 3501437 - RNA, 17 nt, Pseudomonas aeruginosa PA01
gccuggaauaccccgcg

SEQ ID NO: 3501438 - RNA, 20 nt, Pseudomonas aeruginosa PA01
gccuggaauaccccgcggac

SEQ ID NO: 3501439 - RNA, 21 nt, Pseudomonas aeruginosa PA01
gccuggaauaccccgcggacg

SEQ ID NO: 3501440 - RNA, 17 nt, Pseudomonas aeruginosa PA01
gccuggaauucaggcuu

SEQ ID NO: 3501441 - RNA, 22 nt, Pseudomonas aeruginosa PA01
gccuggaauucaggcuuccucg

SEQ ID NO: 3501442 - RNA, 15 nt, Pseudomonas aeruginosa PA01
gccuggaccaggucg

SEQ ID NO: 3501443 - RNA, 17 nt, Pseudomonas aeruginosa PA01
gccuggaccaggucgag

SEQ ID NO: 3501444 - RNA, 19 nt, Pseudomonas aeruginosa PA01
gccuggagaaacucgcggg

SEQ ID NO: 3501445 - RNA, 22 nt, Pseudomonas aeruginosa PA01
gccuggagaaacucgcgggcgc

SEQ ID NO: 3501446 - RNA, 12 nt, Pseudomonas aeruginosa PA01
gccuggagcaga

SEQ ID NO: 3501447 - RNA, 19 nt, Pseudomonas aeruginosa PA01
gccuggagcagaaccgcca

SEQ ID NO: 3501448 - RNA, 16 nt, Pseudomonas aeruginosa PA01
gccuggagcagggcgc

SEQ ID NO: 3501449 - RNA, 23 nt, Pseudomonas aeruginosa PA01
gccuggagcgccucgaaggccuc

SEQ ID NO: 3501450 - RNA, 18 nt, Pseudomonas aeruginosa PA01
gccuggaguugugccagc

SEQ ID NO: 3501451 - RNA, 16 nt, Pseudomonas aeruginosa PA01
gccuggauacgggcgc

SEQ ID NO: 3501452 - RNA, 17 nt, Pseudomonas aeruginosa PA01
gccuggauacgggcgcc

SEQ ID NO: 3501453 - RNA, 18 nt, Pseudomonas aeruginosa PA01
gccuggauacgggcgcca

SEQ ID NO: 3501454 - RNA, 19 nt, Pseudomonas aeruginosa PA01
gccuggauacgggcgccag

SEQ ID NO: 3501455 - RNA, 16 nt, Pseudomonas aeruginosa PA01
gccuggaucagcgccu

SEQ ID NO: 3501456 - RNA, 18 nt, Pseudomonas aeruginosa PA01
gccuggaucgccuugcgc

SEQ ID NO: 3501457 - RNA, 16 nt, Pseudomonas aeruginosa PA01
gccuggaucucggcgg

SEQ ID NO: 3501458 - RNA, 18 nt, Pseudomonas aeruginosa PA01
gccuggaugucgaagcgc

SEQ ID NO: 3501459 - RNA, 19 nt, Pseudomonas aeruginosa PA01
gccuggaugucgaagcgca

SEQ ID NO: 3501460 - RNA, 21 nt, Pseudomonas aeruginosa PA01
gccuggaugucgaagcgcagg

SEQ ID NO: 3501461 - RNA, 13 nt, Pseudomonas aeruginosa PA01
gccuggcaggucc

SEQ ID NO: 3501462 - RNA, 14 nt, Pseudomonas aeruginosa PA01
gccuggcaggucgu

SEQ ID NO: 3501463 - RNA, 13 nt, Pseudomonas aeruginosa PA01
gccuggccacccu

SEQ ID NO: 3501464 - RNA, 17 nt, Pseudomonas aeruginosa PA01
gccuggccagcgcuucg

SEQ ID NO: 3501465 - RNA, 19 nt, Pseudomonas aeruginosa PA01
gccuggccagcgcuucgcg

SEQ ID NO: 3501466 - RNA, 16 nt, Pseudomonas aeruginosa PA01
gccuggccagcgucgc

SEQ ID NO: 3501467 - RNA, 12 nt, Pseudomonas aeruginosa PA01
gccuggccaggc

SEQ ID NO: 3501468 - RNA, 15 nt, Pseudomonas aeruginosa PA01
gccuggccaggcgcu

SEQ ID NO: 3501469 - RNA, 20 nt, Pseudomonas aeruginosa PA01
gccuggccaggcgcuccucc

SEQ ID NO: 3501470 - RNA, 21 nt, Pseudomonas aeruginosa PA01
gccuggccaggcgcuccucca

SEQ ID NO: 3501471 - RNA, 23 nt, Pseudomonas aeruginosa PA01
gccuggccaggcgcuccuccagc

SEQ ID NO: 3501472 - RNA, 15 nt, Pseudomonas aeruginosa PA01
gccuggcccuggacc

SEQ ID NO: 3501473 - RNA, 13 nt, Pseudomonas aeruginosa PA01
gccuggcccuggc

SEQ ID NO: 3501474 - RNA, 16 nt, Pseudomonas aeruginosa PA01
gccuggcccuggcgca

SEQ ID NO: 3501475 - RNA, 17 nt, Pseudomonas aeruginosa PA01
gccuggcccuggcgcag

SEQ ID NO: 3501476 - RNA, 18 nt, Pseudomonas aeruginosa PA01
gccuggcccuggcgcagg

SEQ ID NO: 3501477 - RNA, 21 nt, Pseudomonas aeruginosa PA01
gccuggcccuggcgcaggcgg

SEQ ID NO: 3501478 - RNA, 15 nt, Pseudomonas aeruginosa PA01
gccuggcccuggcgg

SEQ ID NO: 3501479 - RNA, 17 nt, Pseudomonas aeruginosa PA01
gccuggccgcgcaggac

SEQ ID NO: 3501480 - RNA, 15 nt, Pseudomonas aeruginosa PA01
gccuggccggccagc

SEQ ID NO: 3501481 - RNA, 13 nt, Pseudomonas aeruginosa PA01
gccuggccggcga

SEQ ID NO: 3501482 - RNA, 15 nt, Pseudomonas aeruginosa PA01
gccuggccguugcgc

SEQ ID NO: 3501483 - RNA, 18 nt, Pseudomonas aeruginosa PA01
gccuggccguugcgcagg

SEQ ID NO: 3501484 - RNA, 21 nt, Pseudomonas aeruginosa PA01
gccuggccguugcgcaggcgg

SEQ ID NO: 3501485 - RNA, 22 nt, Pseudomonas aeruginosa PA01
gccuggccguugcgcaggcggu

SEQ ID NO: 3501486 - RNA, 20 nt, Pseudomonas aeruginosa PA01
gccuggccuggaacuggucg

SEQ ID NO: 3501487 - RNA, 18 nt, Pseudomonas aeruginosa PA01
gccuggcgcaacaggcgc

SEQ ID NO: 3501488 - RNA, 19 nt, Pseudomonas aeruginosa PA01
gccuggcgcaacaggcgca

SEQ ID NO: 3501489 - RNA, 17 nt, Pseudomonas aeruginosa PA01
gccuggcgcaacgccgg

SEQ ID NO: 3501490 - RNA, 22 nt, Pseudomonas aeruginosa PA01
gccuggcgcaacgccggcaggu

SEQ ID NO: 3501491 - RNA, 19 nt, Pseudomonas aeruginosa PA01
gccuggcgcaaggugccga

SEQ ID NO: 3501492 - RNA, 16 nt, Pseudomonas aeruginosa PA01
gccuggcgcacggccu

SEQ ID NO: 3501493 - RNA, 15 nt, Pseudomonas aeruginosa PA01
gccuggcgcagcggc

SEQ ID NO: 3501494 - RNA, 18 nt, Pseudomonas aeruginosa PA01
gccuggcgcagcggcagc

SEQ ID NO: 3501495 - RNA, 14 nt, Pseudomonas aeruginosa PA01
gccuggcgcauggc

SEQ ID NO: 3501496 - RNA, 18 nt, Pseudomonas aeruginosa PA01
gccuggcgcauggcgcuc

SEQ ID NO: 3501497 - RNA, 19 nt, Pseudomonas aeruginosa PA01
gccuggcgcauggcgcucu

SEQ ID NO: 3501498 - RNA, 19 nt, Pseudomonas aeruginosa PA01
gccuggcgcgcgcgccagg

SEQ ID NO: 3501499 - RNA, 17 nt, Pseudomonas aeruginosa PA01
gccuggcgcucagcgcc

SEQ ID NO: 3501500 - RNA, 20 nt, Pseudomonas aeruginosa PA01
gccuggcgcucagcgccgcu

SEQ ID NO: 3501501 - RNA, 18 nt, Pseudomonas aeruginosa PA01
gccuggcggauaucgcgu

SEQ ID NO: 3501502 - RNA, 19 nt, Pseudomonas aeruginosa PA01
gccuggcggauaucgcgug

SEQ ID NO: 3501503 - RNA, 14 nt, Pseudomonas aeruginosa PA01
gccuggcggcuggc

SEQ ID NO: 3501504 - RNA, 16 nt, Pseudomonas aeruginosa PA01
gccuggcggcuggcgu

SEQ ID NO: 3501505 - RNA, 20 nt, Pseudomonas aeruginosa PA01
gccuggcgguugaugccgac

SEQ ID NO: 3501506 - RNA, 22 nt, Pseudomonas aeruginosa PA01
gccuggcguagcguugcgcgag

SEQ ID NO: 3501507 - RNA, 17 nt, Pseudomonas aeruginosa PA01
gccuggcgucgaugccg

SEQ ID NO: 3501508 - RNA, 18 nt, Pseudomonas aeruginosa PA01
gccuggcgucgcacugcu

SEQ ID NO: 3501509 - RNA, 20 nt, Pseudomonas aeruginosa PA01
gccuggcgugccgccaggcc

SEQ ID NO: 3501510 - RNA, 18 nt, Pseudomonas aeruginosa PA01
gccuggcucgaucggcag

SEQ ID NO: 3501511 - RNA, 21 nt, Pseudomonas aeruginosa PA01
gccuggcucgaucggcagggc

SEQ ID NO: 3501512 - RNA, 14 nt, Pseudomonas aeruginosa PA01
gccuggcugcaacg

SEQ ID NO: 3501513 - RNA, 13 nt, Pseudomonas aeruginosa PA01
gccuggcugccga

SEQ ID NO: 3501514 - RNA, 14 nt, Pseudomonas aeruginosa PA01
gccuggcugccgag

SEQ ID NO: 3501515 - RNA, 21 nt, Pseudomonas aeruginosa PA01
gccuggcugccgagcaggugc

SEQ ID NO: 3501516 - RNA, 15 nt, Pseudomonas aeruginosa PA01
gccuggcuggccagc

SEQ ID NO: 3501517 - RNA, 13 nt, Pseudomonas aeruginosa PA01
gccuggcuggccu

SEQ ID NO: 3501518 - RNA, 21 nt, Pseudomonas aeruginosa PA01
gccuggcuggccucagggcgc

SEQ ID NO: 3501519 - RNA, 15 nt, Pseudomonas aeruginosa PA01
gccuggcuggccuug

SEQ ID NO: 3501520 - RNA, 23 nt, Pseudomonas aeruginosa PA01
gccugggacggaacgucggccug

SEQ ID NO: 3501521 - RNA, 22 nt, Pseudomonas aeruginosa PA01
gccugggcaagcugcacggcga

SEQ ID NO: 3501522 - RNA, 17 nt, Pseudomonas aeruginosa PA01
gccugggccgaaggcca

SEQ ID NO: 3501523 - RNA, 19 nt, Pseudomonas aeruginosa PA01
gccugggccgaaggccagg

SEQ ID NO: 3501524 - RNA, 20 nt, Pseudomonas aeruginosa PA01
gccugggccgaaggccaggc

SEQ ID NO: 3501525 - RNA, 23 nt, Pseudomonas aeruginosa PA01
gccugggccgaaggccaggccgg

SEQ ID NO: 3501526 - RNA, 13 nt, Pseudomonas aeruginosa PA01
gccugggccgccu

SEQ ID NO: 3501527 - RNA, 18 nt, Pseudomonas aeruginosa PA01
gccugggccgcgcugucg

SEQ ID NO: 3501528 - RNA, 14 nt, Pseudomonas aeruginosa PA01
gccugggccggcgu

SEQ ID NO: 3501529 - RNA, 12 nt, Pseudomonas aeruginosa PA01
gccugggccggg

SEQ ID NO: 3501530 - RNA, 13 nt, Pseudomonas aeruginosa PA01
gccugggcgccgc

SEQ ID NO: 3501531 - RNA, 14 nt, Pseudomonas aeruginosa PA01
gccugggcgccgcc

SEQ ID NO: 3501532 - RNA, 15 nt, Pseudomonas aeruginosa PA01
gccugggcgccgcca

SEQ ID NO: 3501533 - RNA, 17 nt, Pseudomonas aeruginosa PA01
gccugggcgccgccagc

SEQ ID NO: 3501534 - RNA, 14 nt, Pseudomonas aeruginosa PA01
gcccgucgcgccgg

SEQ ID NO: 3501535 - RNA, 16 nt, Pseudomonas aeruginosa PA01
gcccgucgcgccggcc

SEQ ID NO: 3501536 - RNA, 17 nt, Pseudomonas aeruginosa PA01
gcccgucgcgccggcca

SEQ ID NO: 3501537 - RNA, 12 nt, Pseudomonas aeruginosa PA01
gcccgucggccu

SEQ ID NO: 3501538 - RNA, 15 nt, Pseudomonas aeruginosa PA01
gcccgucggccucgc

SEQ ID NO: 3501539 - RNA, 17 nt, Pseudomonas aeruginosa PA01
gcccgucggccucgccg

SEQ ID NO: 3501540 - RNA, 15 nt, Pseudomonas aeruginosa PA01
gcccgucgucguggc

SEQ ID NO: 3501541 - RNA, 19 nt, Pseudomonas aeruginosa PA01
gcccgucgucguggcgaac

SEQ ID NO: 3501542 - RNA, 14 nt, Pseudomonas aeruginosa PA01
gcccgucuagcgca

SEQ ID NO: 3501543 - RNA, 16 nt, Pseudomonas aeruginosa PA01
gcccgucuagcgcagg

SEQ ID NO: 3501544 - RNA, 18 nt, Pseudomonas aeruginosa PA01
gcccgucuagcgcaggcg

SEQ ID NO: 3501545 - RNA, 19 nt, Pseudomonas aeruginosa PA01
gcccgucuagcgcaggcgg

SEQ ID NO: 3501546 - RNA, 17 nt, Pseudomonas aeruginosa PA01
gcccgugcccguccuag

SEQ ID NO: 3501547 - RNA, 13 nt, Pseudomonas aeruginosa PA01
gcccgugccgacu

SEQ ID NO: 3501548 - RNA, 14 nt, Pseudomonas aeruginosa PA01
gcccgugccgacua

SEQ ID NO: 3501549 - RNA, 16 nt, Pseudomonas aeruginosa PA01
gcccgugccucggcgg

SEQ ID NO: 3501550 - RNA, 22 nt, Pseudomonas aeruginosa PA01
gcccgugccucggcggacagcc

SEQ ID NO: 3501551 - RNA, 15 nt, Pseudomonas aeruginosa PA01
gcccgugcggcacgc

SEQ ID NO: 3501552 - RNA, 17 nt, Pseudomonas aeruginosa PA01
gcccgugcggcacgcug

SEQ ID NO: 3501553 - RNA, 13 nt, Pseudomonas aeruginosa PA01
gcccguggcaggu

SEQ ID NO: 3501554 - RNA, 23 nt, Pseudomonas aeruginosa PA01
gcccguggcuggggccggccugg

SEQ ID NO: 3501555 - RNA, 22 nt, Pseudomonas aeruginosa PA01
gcccgugguagucgagccggau

SEQ ID NO: 3501556 - RNA, 14 nt, Pseudomonas aeruginosa PA01
gcccgugucgccuu

SEQ ID NO: 3501557 - RNA, 15 nt, Pseudomonas aeruginosa PA01
gcccguguucggcca

SEQ ID NO: 3501558 - RNA, 17 nt, Pseudomonas aeruginosa PA01
gcccguguucggccagc

SEQ ID NO: 3501559 - RNA, 18 nt, Pseudomonas aeruginosa PA01
gcccguguucggccagcc

SEQ ID NO: 3501560 - RNA, 19 nt, Pseudomonas aeruginosa PA01
gcccguguucggccagccg

SEQ ID NO: 3501561 - RNA, 21 nt, Pseudomonas aeruginosa PA01
gcccguguucggccagccggc

SEQ ID NO: 3501562 - RNA, 24 nt, Pseudomonas aeruginosa PA01
gcccguguucggccagccggcgcc

SEQ ID NO: 3501563 - RNA, 20 nt, Pseudomonas aeruginosa PA01
gcccguuccaccgccuggac

SEQ ID NO: 3501564 - RNA, 21 nt, Pseudomonas aeruginosa PA01
gcccguucgaucaauugccgg

SEQ ID NO: 3501565 - RNA, 16 nt, Pseudomonas aeruginosa PA01
gcccuacaaugauggc

SEQ ID NO: 3501566 - RNA, 19 nt, Pseudomonas aeruginosa PA01
gcccuacaaugauggcccu

SEQ ID NO: 3501567 - RNA, 20 nt, Pseudomonas aeruginosa PA01
gcccuacagcccccccagca

SEQ ID NO: 3501568 - RNA, 14 nt, Pseudomonas aeruginosa PA01
gcccuaccccaggg

SEQ ID NO: 3501569 - RNA, 17 nt, Pseudomonas aeruginosa PA01
gcccuaccccagggguc

SEQ ID NO: 3501570 - RNA, 16 nt, Pseudomonas aeruginosa PA01
gcccuaccccccaauu

SEQ ID NO: 3501571 - RNA, 18 nt, Pseudomonas aeruginosa PA01
gcccuacccgacaggcag

SEQ ID NO: 3501572 - RNA, 19 nt, Pseudomonas aeruginosa PA01
gcccuaccgcccacccugc

SEQ ID NO: 3501573 - RNA, 14 nt, Pseudomonas aeruginosa PA01
gcccuaccuguccc

SEQ ID NO: 3501574 - RNA, 15 nt, Pseudomonas aeruginosa PA01
gcccuaccugucccg

SEQ ID NO: 3501575 - RNA, 23 nt, Pseudomonas aeruginosa PA01
gcccuaccugucccggacgacga

SEQ ID NO: 3501576 - RNA, 15 nt, Pseudomonas aeruginosa PA01
gcccuacgaaagcgg

SEQ ID NO: 3501577 - RNA, 19 nt, Pseudomonas aeruginosa PA01
gcccuacgaaagcggugcc

SEQ ID NO: 3501578 - RNA, 17 nt, Pseudomonas aeruginosa PA01
gcccuacgcaacccgcc

SEQ ID NO: 3501579 - RNA, 18 nt, Pseudomonas aeruginosa PA01
gcccuacgcaacccgccc

SEQ ID NO: 3501580 - RNA, 20 nt, Pseudomonas aeruginosa PA01
gcccuacgcaacccgcccgg

SEQ ID NO: 3501581 - RNA, 21 nt, Pseudomonas aeruginosa PA01
gcccuacgcaacccgcccggc

SEQ ID NO: 3501582 - RNA, 22 nt, Pseudomonas aeruginosa PA01
gcccuacggaccggugccccgc

SEQ ID NO: 3501583 - RNA, 23 nt, Pseudomonas aeruginosa PA01
gcccuacggaccggugccccgcu

SEQ ID NO: 3501584 - RNA, 18 nt, Pseudomonas aeruginosa PA01
gcccuacggccccaggcu

SEQ ID NO: 3501585 - RNA, 22 nt, Pseudomonas aeruginosa PA01
gcccuacggggacaugucgagg

SEQ ID NO: 3501586 - RNA, 21 nt, Pseudomonas aeruginosa PA01
gcccuacggggcgugucgagg

SEQ ID NO: 3501587 - RNA, 22 nt, Pseudomonas aeruginosa PA01
gcccuacgggggcgugucgagg

SEQ ID NO: 3501588 - RNA, 17 nt, Pseudomonas aeruginosa PA01
gcccuacuccagggguc

SEQ ID NO: 3501589 - RNA, 18 nt, Pseudomonas aeruginosa PA01
gcccucaagucuccagcg

SEQ ID NO: 3501590 - RNA, 18 nt, Pseudomonas aeruginosa PA01
gcccucagagcaugucga

SEQ ID NO: 3501591 - RNA, 17 nt, Pseudomonas aeruginosa PA01
gcccucagcagcgccgc

SEQ ID NO: 3501592 - RNA, 18 nt, Pseudomonas aeruginosa PA01
gcccucagcagcgccgcc

SEQ ID NO: 3501593 - RNA, 20 nt, Pseudomonas aeruginosa PA01
gcccucagcagcgccgcccu

SEQ ID NO: 3501594 - RNA, 12 nt, Pseudomonas aeruginosa PA01
gcccucagcggc

SEQ ID NO: 3501595 - RNA, 19 nt, Pseudomonas aeruginosa PA01
gcccucagcggcggugcgc

SEQ ID NO: 3501596 - RNA, 21 nt, Pseudomonas aeruginosa PA01
gcccucagcggcggugcgccg

SEQ ID NO: 3501597 - RNA, 17 nt, Pseudomonas aeruginosa PA01
gcccucagggaagaugc

SEQ ID NO: 3501598 - RNA, 23 nt, Pseudomonas aeruginosa PA01
gcccuccaaagaaaagcccggcc

SEQ ID NO: 3501599 - RNA, 12 nt, Pseudomonas aeruginosa PA01
gcccuccagcac

SEQ ID NO: 3501600 - RNA, 13 nt, Pseudomonas aeruginosa PA01
gcccuccagcacc

SEQ ID NO: 3501601 - RNA, 14 nt, Pseudomonas aeruginosa PA01
gcccuccagcaccg

SEQ ID NO: 3501602 - RNA, 16 nt, Pseudomonas aeruginosa PA01
gcccuccagcaccgcc

SEQ ID NO: 3501603 - RNA, 20 nt, Pseudomonas aeruginosa PA01
gcccuccagcaccgccuggc

SEQ ID NO: 3501604 - RNA, 22 nt, Pseudomonas aeruginosa PA01
gcccuccagcaccgccuggcgc

SEQ ID NO: 3501605 - RNA, 14 nt, Pseudomonas aeruginosa PA01
gcccuccccuggcc

SEQ ID NO: 3501606 - RNA, 19 nt, Pseudomonas aeruginosa PA01
gcccuccccuggcccugca

SEQ ID NO: 3501607 - RNA, 14 nt, Pseudomonas aeruginosa PA01
gcccuccggcgcgu

SEQ ID NO: 3501608 - RNA, 14 nt, Pseudomonas aeruginosa PA01
gcccuccugggccu

SEQ ID NO: 3501609 - RNA, 17 nt, Pseudomonas aeruginosa PA01
gcccucgaagcccugca

SEQ ID NO: 3501610 - RNA, 22 nt, Pseudomonas aeruginosa PA01
gcccucgaccagguccggcagc

SEQ ID NO: 3501611 - RNA, 14 nt, Pseudomonas aeruginosa PA01
gcccucgaccuggc

SEQ ID NO: 3501612 - RNA, 21 nt, Pseudomonas aeruginosa PA01
gcccucgauguaggccucggc

SEQ ID NO: 3501613 - RNA, 16 nt, Pseudomonas aeruginosa PA01
gcccucgcagccggcg

SEQ ID NO: 3501614 - RNA, 17 nt, Pseudomonas aeruginosa PA01
gcccucgcagccggcgg

SEQ ID NO: 3501615 - RNA, 14 nt, Pseudomonas aeruginosa PA01
gcccucgcccaggu

SEQ ID NO: 3501616 - RNA, 14 nt, Pseudomonas aeruginosa PA01
gcccucgcgacggc

SEQ ID NO: 3501617 - RNA, 13 nt, Pseudomonas aeruginosa PA01
gcccucgcgcugg

SEQ ID NO: 3501618 - RNA, 11 nt, Pseudomonas aeruginosa PA01
gcccucgcgga

SEQ ID NO: 3501619 - RNA, 21 nt, Pseudomonas aeruginosa PA01
gcccucgcggacgcuggcgau

SEQ ID NO: 3501620 - RNA, 16 nt, Pseudomonas aeruginosa PA01
gcccucgcggagcugg

SEQ ID NO: 3501621 - RNA, 23 nt, Pseudomonas aeruginosa PA01
gcccucgcggcggcaggccagcu

SEQ ID NO: 3501622 - RNA, 24 nt, Pseudomonas aeruginosa PA01
gcccucgcucguuccgcggagucg

SEQ ID NO: 3501623 - RNA, 17 nt, Pseudomonas aeruginosa PA01
gcccucgcugagcagga

SEQ ID NO: 3501624 - RNA, 14 nt, Pseudomonas aeruginosa PA01
gcccucggccaggc

SEQ ID NO: 3501625 - RNA, 15 nt, Pseudomonas aeruginosa PA01
gcccucggccaggca

SEQ ID NO: 3501626 - RNA, 14 nt, Pseudomonas aeruginosa PA01
gcccucggcccgga

SEQ ID NO: 3501627 - RNA, 15 nt, Pseudomonas aeruginosa PA01
gcccucggcgcccgc

SEQ ID NO: 3501628 - RNA, 16 nt, Pseudomonas aeruginosa PA01
gcccucggcgcccgcc

SEQ ID NO: 3501629 - RNA, 17 nt, Pseudomonas aeruginosa PA01
gcccucggcgcccgccu

SEQ ID NO: 3501630 - RNA, 22 nt, Pseudomonas aeruginosa PA01
gcccucggcgcccgccugcagg

SEQ ID NO: 3501631 - RNA, 23 nt, Pseudomonas aeruginosa PA01
gcccucggcgcccgccugcagga

SEQ ID NO: 3501632 - RNA, 16 nt, Pseudomonas aeruginosa PA01
gcccucggcgccgagc

SEQ ID NO: 3501633 - RNA, 17 nt, Pseudomonas aeruginosa PA01
gcccucggcgccgagca

SEQ ID NO: 3501634 - RNA, 15 nt, Pseudomonas aeruginosa PA01
gcccucggcgcuggc

SEQ ID NO: 3501635 - RNA, 14 nt, Pseudomonas aeruginosa PA01
gcccucggcggcga

SEQ ID NO: 3501636 - RNA, 21 nt, Pseudomonas aeruginosa PA01
gcccucggugauaccgccggc

SEQ ID NO: 3501637 - RNA, 20 nt, Pseudomonas aeruginosa PA01
gcccucguugauuccgccgg

SEQ ID NO: 3501638 - RNA, 22 nt, Pseudomonas aeruginosa PA01
gcccucguugauuccgccggaa

SEQ ID NO: 3501639 - RNA, 19 nt, Pseudomonas aeruginosa PA01
gcccucucaggagcgccgc

SEQ ID NO: 3501640 - RNA, 22 nt, Pseudomonas aeruginosa PA01
gcccucucaggagcgccgcgca

SEQ ID NO: 3501641 - RNA, 23 nt, Pseudomonas aeruginosa PA01
gcccucucaggagcgccgcgcag

SEQ ID NO: 3501642 - RNA, 17 nt, Pseudomonas aeruginosa PA01
gcccugacccgcaccgg

SEQ ID NO: 3501643 - RNA, 17 nt, Pseudomonas aeruginosa PA01
gcccugacgaugcaggg

SEQ ID NO: 3501644 - RNA, 19 nt, Pseudomonas aeruginosa PA01
gcccugaggcuuuccugcg

SEQ ID NO: 3501645 - RNA, 20 nt, Pseudomonas aeruginosa PA01
gcccugaggcuuuccugcgc

SEQ ID NO: 3501646 - RNA, 18 nt, Pseudomonas aeruginosa PA01
gcccugcaacaggaccca

SEQ ID NO: 3501647 - RNA, 23 nt, Pseudomonas aeruginosa PA01
gcccugcaacaggacccagccau

SEQ ID NO: 3501648 - RNA, 16 nt, Pseudomonas aeruginosa PA01
gcccugcagcgccaug

SEQ ID NO: 3501649 - RNA, 15 nt, Pseudomonas aeruginosa PA01
gcccugcagcgcgcg

SEQ ID NO: 3501650 - RNA, 17 nt, Pseudomonas aeruginosa PA01
gcccugcagcgcgcgcu

SEQ ID NO: 3501651 - RNA, 22 nt, Pseudomonas aeruginosa PA01
gcccugcagcgcgcgcuggucg

SEQ ID NO: 3501652 - RNA, 23 nt, Pseudomonas aeruginosa PA01
gcccugcagcgcgcgcuggucgu

SEQ ID NO: 3501653 - RNA, 14 nt, Pseudomonas aeruginosa PA01
gcccugcaggccga

SEQ ID NO: 3501654 - RNA, 23 nt, Pseudomonas aeruginosa PA01
gcccugcaggccgaauccgccgg

SEQ ID NO: 3501655 - RNA, 14 nt, Pseudomonas aeruginosa PA01
gcccugcaucgcga

SEQ ID NO: 3501656 - RNA, 19 nt, Pseudomonas aeruginosa PA01
gcccugccacuugcgggug

SEQ ID NO: 3501657 - RNA, 15 nt, Pseudomonas aeruginosa PA01
gcccugccagcgggc

SEQ ID NO: 3501658 - RNA, 16 nt, Pseudomonas aeruginosa PA01
gcccugccagcgggcg

SEQ ID NO: 3501659 - RNA, 18 nt, Pseudomonas aeruginosa PA01
gcccugccagcgggcgcc

SEQ ID NO: 3501660 - RNA, 20 nt, Pseudomonas aeruginosa PA01
gcccugccccuucggcugca

SEQ ID NO: 3501661 - RNA, 22 nt, Pseudomonas aeruginosa PA01
gcccugcccgguggggcgggcg

SEQ ID NO: 3501662 - RNA, 23 nt, Pseudomonas aeruginosa PA01
gcccugcccgguggggcgggcga

SEQ ID NO: 3501663 - RNA, 12 nt, Pseudomonas aeruginosa PA01
gcccugccggcg

SEQ ID NO: 3501664 - RNA, 13 nt, Pseudomonas aeruginosa PA01
gcccugccggcgc

SEQ ID NO: 3501665 - RNA, 19 nt, Pseudomonas aeruginosa PA01
gcccugcgcagcuaggcga

SEQ ID NO: 3501666 - RNA, 16 nt, Pseudomonas aeruginosa PA01
gcccugcgccagcauc

SEQ ID NO: 3501667 - RNA, 13 nt, Pseudomonas aeruginosa PA01
gcccugcgccgca

SEQ ID NO: 3501668 - RNA, 14 nt, Pseudomonas aeruginosa PA01
gcccugcgccgcag

SEQ ID NO: 3501669 - RNA, 15 nt, Pseudomonas aeruginosa PA01
gcccugcgccgcagc

SEQ ID NO: 3501670 - RNA, 16 nt, Pseudomonas aeruginosa PA01
gcccugcgccgcagcg

SEQ ID NO: 3501671 - RNA, 17 nt, Pseudomonas aeruginosa PA01
gcccugcgccgcagcgg

SEQ ID NO: 3501672 - RNA, 20 nt, Pseudomonas aeruginosa PA01
gcccugcgccgcagcggcca

SEQ ID NO: 3501673 - RNA, 21 nt, Pseudomonas aeruginosa PA01
gcccugcgccgcagcggccag

SEQ ID NO: 3501674 - RNA, 14 nt, Pseudomonas aeruginosa PA01
gcccugcgcgcgcg

SEQ ID NO: 3501675 - RNA, 15 nt, Pseudomonas aeruginosa PA01
gcccugcggauggcg

SEQ ID NO: 3501676 - RNA, 16 nt, Pseudomonas aeruginosa PA01
gcccugcggauggcgc

SEQ ID NO: 3501677 - RNA, 16 nt, Pseudomonas aeruginosa PA01
gcccugcgggaugccc

SEQ ID NO: 3501678 - RNA, 20 nt, Pseudomonas aeruginosa PA01
gcccugcguggaaccgcggc

SEQ ID NO: 3501679 - RNA, 21 nt, Pseudomonas aeruginosa PA01
gcccugcguggaaccgcggcg

SEQ ID NO: 3501680 - RNA, 24 nt, Pseudomonas aeruginosa PA01
gcccugcguggaaccgcggcgccc

SEQ ID NO: 3501681 - RNA, 21 nt, Pseudomonas aeruginosa PA01
gcccugcuccuccaggcucuu

SEQ ID NO: 3501682 - RNA, 15 nt, Pseudomonas aeruginosa PA01
gcccugcucgccggc

SEQ ID NO: 3501683 - RNA, 17 nt, Pseudomonas aeruginosa PA01
gcccugcucgccggcgc

SEQ ID NO: 3501684 - RNA, 23 nt, Pseudomonas aeruginosa PA01
gcccugcucgccggcgcgggcgg

SEQ ID NO: 3501685 - RNA, 13 nt, Pseudomonas aeruginosa PA01
gcccugcucgucg

SEQ ID NO: 3501686 - RNA, 14 nt, Pseudomonas aeruginosa PA01
gcccugcucgucgc

SEQ ID NO: 3501687 - RNA, 15 nt, Pseudomonas aeruginosa PA01
gcccugcucgucgcu

SEQ ID NO: 3501688 - RNA, 13 nt, Pseudomonas aeruginosa PA01
gcccugcucuucc

SEQ ID NO: 3501689 - RNA, 14 nt, Pseudomonas aeruginosa PA01
gcccugcugcaggg

SEQ ID NO: 3501690 - RNA, 20 nt, Pseudomonas aeruginosa PA01
gcccugcugcagggccucgc

SEQ ID NO: 3501691 - RNA, 21 nt, Pseudomonas aeruginosa PA01
gcccugcugcagggccucgcu

SEQ ID NO: 3501692 - RNA, 14 nt, Pseudomonas aeruginosa PA01
gcccugcugcucgc

SEQ ID NO: 3501693 - RNA, 16 nt, Pseudomonas aeruginosa PA01
gcccugcugcucgcca

SEQ ID NO: 3501694 - RNA, 21 nt, Pseudomonas aeruginosa PA01
gcccugcugcucgccaugggc

SEQ ID NO: 3501695 - RNA, 16 nt, Pseudomonas aeruginosa PA01
gcccugcuggcgcagc

SEQ ID NO: 3501696 - RNA, 21 nt, Pseudomonas aeruginosa PA01
gcccugcuggcgcagccaggc

SEQ ID NO: 3501697 - RNA, 23 nt, Pseudomonas aeruginosa PA01
gcccugcuggcgcagccaggcga

SEQ ID NO: 3501698 - RNA, 19 nt, Pseudomonas aeruginosa PA01
gcccugcuuggccagcgcg

SEQ ID NO: 3501699 - RNA, 22 nt, Pseudomonas aeruginosa PA01
gcccugcuuggccagcgcggug

SEQ ID NO: 3501700 - RNA, 18 nt, Pseudomonas aeruginosa PA01
gcccuggaaaggccucgg

SEQ ID NO: 3501701 - RNA, 20 nt, Pseudomonas aeruginosa PA01
gcccuggaaaggccucggcg

SEQ ID NO: 3501702 - RNA, 23 nt, Pseudomonas aeruginosa PA01
gcccuggaaaggccucggcgaug

SEQ ID NO: 3501703 - RNA, 16 nt, Pseudomonas aeruginosa PA01
gcccuggaagccggca

SEQ ID NO: 3501704 - RNA, 17 nt, Pseudomonas aeruginosa PA01
gcccuggaagccggcag

SEQ ID NO: 3501705 - RNA, 17 nt, Pseudomonas aeruginosa PA01
gcccuggagcggaaacc

SEQ ID NO: 3501706 - RNA, 17 nt, Pseudomonas aeruginosa PA01
gcccuggauaucugggc

SEQ ID NO: 3501707 - RNA, 20 nt, Pseudomonas aeruginosa PA01
gcccuggauaucugggccau

SEQ ID NO: 3501708 - RNA, 16 nt, Pseudomonas aeruginosa PA01
gcccuggaucaccgcg

SEQ ID NO: 3501709 - RNA, 20 nt, Pseudomonas aeruginosa PA01
gcccuggaucaccgcggcgc

SEQ ID NO: 3501710 - RNA, 22 nt, Pseudomonas aeruginosa PA01
gcccuggaucaccgcggcgcug

SEQ ID NO: 3501711 - RNA, 19 nt, Pseudomonas aeruginosa PA01
gcccuggaugaucucgcag

SEQ ID NO: 3501712 - RNA, 13 nt, Pseudomonas aeruginosa PA01
gcccuggccgacg

SEQ ID NO: 3501713 - RNA, 14 nt, Pseudomonas aeruginosa PA01
gcccuggccgagcg

SEQ ID NO: 3501714 - RNA, 18 nt, Pseudomonas aeruginosa PA01
gcccuggccgagcgggaa

SEQ ID NO: 3501715 - RNA, 13 nt, Pseudomonas aeruginosa PA01
gcccuggccgauc

SEQ ID NO: 3501716 - RNA, 16 nt, Pseudomonas aeruginosa PA01
gcccuggccgaucagc

SEQ ID NO: 3501717 - RNA, 23 nt, Pseudomonas aeruginosa PA01
gcccuggccgaucagcuuggccu

SEQ ID NO: 3501718 - RNA, 13 nt, Pseudomonas aeruginosa PA01
gcccuggccgccc

SEQ ID NO: 3501719 - RNA, 14 nt, Pseudomonas aeruginosa PA01
gcccuggccgccca

SEQ ID NO: 3501720 - RNA, 14 nt, Pseudomonas aeruginosa PA01
gcccuggccgcugc

SEQ ID NO: 3501721 - RNA, 12 nt, Pseudomonas aeruginosa PA01
gcccuggccggc

SEQ ID NO: 3501722 - RNA, 14 nt, Pseudomonas aeruginosa PA01
gcccuggccgucgg

SEQ ID NO: 3501723 - RNA, 17 nt, Pseudomonas aeruginosa PA01
gcccuggccgucggccu

SEQ ID NO: 3501724 - RNA, 20 nt, Pseudomonas aeruginosa PA01
gcccuggccgucggccugcu

SEQ ID NO: 3501725 - RNA, 14 nt, Pseudomonas aeruginosa PA01
gcccuggccucggc

SEQ ID NO: 3501726 - RNA, 19 nt, Pseudomonas aeruginosa PA01
gcccuggccuuggccacga

SEQ ID NO: 3501727 - RNA, 14 nt, Pseudomonas aeruginosa PA01
gcccuggcgcagac

SEQ ID NO: 3501728 - RNA, 21 nt, Pseudomonas aeruginosa PA01
gcccuggcgcagacaggccuc

SEQ ID NO: 3501729 - RNA, 23 nt, Pseudomonas aeruginosa PA01
gcccuggcgcagacaggccucca

SEQ ID NO: 3501730 - RNA, 17 nt, Pseudomonas aeruginosa PA01
gcccuggcgcaggcggc

SEQ ID NO: 3501731 - RNA, 14 nt, Pseudomonas aeruginosa PA01
gcccuggcgccagc

SEQ ID NO: 3501732 - RNA, 14 nt, Pseudomonas aeruginosa PA01
gcccuggcgcgcgc

SEQ ID NO: 3501733 - RNA, 14 nt, Pseudomonas aeruginosa PA01
gcccuggcgcggca

SEQ ID NO: 3501734 - RNA, 15 nt, Pseudomonas aeruginosa PA01
gcccuggcgcggcaa

SEQ ID NO: 3501735 - RNA, 22 nt, Pseudomonas aeruginosa PA01
gcccuggcgguuuuccgguugc

SEQ ID NO: 3501736 - RNA, 20 nt, Pseudomonas aeruginosa PA01
gcccuggcguggccggcgag

SEQ ID NO: 3501737 - RNA, 16 nt, Pseudomonas aeruginosa PA01
gcccuggcucugggcc

SEQ ID NO: 3501738 - RNA, 19 nt, Pseudomonas aeruginosa PA01
gcccuggcucuugccgcga

SEQ ID NO: 3501739 - RNA, 21 nt, Pseudomonas aeruginosa PA01
gcccuggcucuugccgcgagc

SEQ ID NO: 3501740 - RNA, 15 nt, Pseudomonas aeruginosa PA01
gcccugggccccggc

SEQ ID NO: 3501741 - RNA, 15 nt, Pseudomonas aeruginosa PA01
gcccugggccggcgc

SEQ ID NO: 3501742 - RNA, 17 nt, Pseudomonas aeruginosa PA01
gcccugggccggcgcca

SEQ ID NO: 3501743 - RNA, 18 nt, Pseudomonas aeruginosa PA01
gcccugggccggcgccag

SEQ ID NO: 3501744 - RNA, 19 nt, Pseudomonas aeruginosa PA01
gcccugggccggcgccagc

SEQ ID NO: 3501745 - RNA, 22 nt, Pseudomonas aeruginosa PA01
gcccugggcgaacagcacccag

SEQ ID NO: 3501746 - RNA, 16 nt, Pseudomonas aeruginosa PA01
gcccugggcgaugcgg

SEQ ID NO: 3501747 - RNA, 21 nt, Pseudomonas aeruginosa PA01
gcccugggcgaugcggcggaa

SEQ ID NO: 3501748 - RNA, 14 nt, Pseudomonas aeruginosa PA01
gcccugggcgccgc

SEQ ID NO: 3501749 - RNA, 17 nt, Pseudomonas aeruginosa PA01
gcccugggcgccgccgg

SEQ ID NO: 3501750 - RNA, 19 nt, Pseudomonas aeruginosa PA01
gcccugggcgccgccggug

SEQ ID NO: 3501751 - RNA, 20 nt, Pseudomonas aeruginosa PA01
gcccugggcgccgccggugc

SEQ ID NO: 3501752 - RNA, 11 nt, Pseudomonas aeruginosa PA01
gcccugggcgg

SEQ ID NO: 3501753 - RNA, 16 nt, Pseudomonas aeruginosa PA01
gcccugggcggcgacc

SEQ ID NO: 3501754 - RNA, 18 nt, Pseudomonas aeruginosa PA01
gcccugggcggcgaccug

SEQ ID NO: 3501755 - RNA, 23 nt, Pseudomonas aeruginosa PA01
gcccugggcggcgaccugcggca

SEQ ID NO: 3501756 - RNA, 14 nt, Pseudomonas aeruginosa PA01
gcccugggcggcgg

SEQ ID NO: 3501757 - RNA, 16 nt, Pseudomonas aeruginosa PA01
gcccugggcgucgacg

SEQ ID NO: 3501758 - RNA, 15 nt, Pseudomonas aeruginosa PA01
gcccugggguuucug

SEQ ID NO: 3501759 - RNA, 19 nt, Pseudomonas aeruginosa PA01
gcccugggguuucugcugg

SEQ ID NO: 3501760 - RNA, 23 nt, Pseudomonas aeruginosa PA01
gcccugggguuucugcuggccac

SEQ ID NO: 3501761 - RNA, 17 nt, Pseudomonas aeruginosa PA01
gcccugguacagcgccu

SEQ ID NO: 3501762 - RNA, 18 nt, Pseudomonas aeruginosa PA01
gcccugguacagcgccug

SEQ ID NO: 3501763 - RNA, 14 nt, Pseudomonas aeruginosa PA01
gcccugguccaacc

SEQ ID NO: 3501764 - RNA, 16 nt, Pseudomonas aeruginosa PA01
gcccugguccaaccgg

SEQ ID NO: 3501765 - RNA, 20 nt, Pseudomonas aeruginosa PA01
gcccuggucggcggucucga

SEQ ID NO: 3501766 - RNA, 15 nt, Pseudomonas aeruginosa PA01
gcccuggugcacggc

SEQ ID NO: 3501767 - RNA, 23 nt, Pseudomonas aeruginosa PA01
gcccugguugcggaacggcucgc

SEQ ID NO: 3501768 - RNA, 16 nt, Pseudomonas aeruginosa PA01
gcccuguucggcggga

SEQ ID NO: 3501769 - RNA, 19 nt, Pseudomonas aeruginosa PA01
gcccuguucggcgggaucg

SEQ ID NO: 3501770 - RNA, 16 nt, Pseudomonas aeruginosa PA01
gcccuguucgucuggc

SEQ ID NO: 3501771 - RNA, 21 nt, Pseudomonas aeruginosa PA01
gcccuguucgucuggcgccug

SEQ ID NO: 3501772 - RNA, 22 nt, Pseudomonas aeruginosa PA01
gcccuguucgucuggcgccugg

SEQ ID NO: 3501773 - RNA, 22 nt, Pseudomonas aeruginosa PA01
gcccuguuucggguccaggcgc

SEQ ID NO: 3501774 - RNA, 23 nt, Pseudomonas aeruginosa PA01
gcccuucacgagaccaccgacgg

SEQ ID NO: 3501775 - RNA, 13 nt, Pseudomonas aeruginosa PA01
gcccuucagcgcc

SEQ ID NO: 3501776 - RNA, 20 nt, Pseudomonas aeruginosa PA01
gcccuucaggucgacaugca

SEQ ID NO: 3501777 - RNA, 16 nt, Pseudomonas aeruginosa PA01
gcccuucgaacccgcc

SEQ ID NO: 3501778 - RNA, 22 nt, Pseudomonas aeruginosa PA01
gcccuucgacaugggccgcgca

SEQ ID NO: 3501779 - RNA, 23 nt, Pseudomonas aeruginosa PA01
gcccuucgacaugggccgcgcag

SEQ ID NO: 3501780 - RNA, 18 nt, Pseudomonas aeruginosa PA01
gcccuucgacgacaccug

SEQ ID NO: 3501781 - RNA, 20 nt, Pseudomonas aeruginosa PA01
gcccuucgacgacaccugca

SEQ ID NO: 3501782 - RNA, 17 nt, Pseudomonas aeruginosa PA01
gcccuucgacgucgauc

SEQ ID NO: 3501783 - RNA, 11 nt, Pseudomonas aeruginosa PA01
gcccuucgccc

SEQ ID NO: 3501784 - RNA, 14 nt, Pseudomonas aeruginosa PA01
gcccuucgcccugc

SEQ ID NO: 3501785 - RNA, 15 nt, Pseudomonas aeruginosa PA01
gcccuucgcccugcg

SEQ ID NO: 3501786 - RNA, 13 nt, Pseudomonas aeruginosa PA01
gcccuucgcgcuc

SEQ ID NO: 3501787 - RNA, 14 nt, Pseudomonas aeruginosa PA01
gcccuucgcgcucg

SEQ ID NO: 3501788 - RNA, 14 nt, Pseudomonas aeruginosa PA01
gcccuucuccgcca

SEQ ID NO: 3501789 - RNA, 16 nt, Pseudomonas aeruginosa PA01
gcccuucuccgccagc

SEQ ID NO: 3501790 - RNA, 22 nt, Pseudomonas aeruginosa PA01
gcccuucuccgccagccagccg

SEQ ID NO: 3501791 - RNA, 16 nt, Pseudomonas aeruginosa PA01
gcccuucugucuuguc

SEQ ID NO: 3501792 - RNA, 19 nt, Pseudomonas aeruginosa PA01
gcccuugaagcgcuucugc

SEQ ID NO: 3501793 - RNA, 22 nt, Pseudomonas aeruginosa PA01
gcccuugacgucguucagcggc

SEQ ID NO: 3501794 - RNA, 23 nt, Pseudomonas aeruginosa PA01
gcccuugagcauggcguuccagu

SEQ ID NO: 3501795 - RNA, 22 nt, Pseudomonas aeruginosa PA01
gcccuugaggaaguugcgcagc

SEQ ID NO: 3501796 - RNA, 18 nt, Pseudomonas aeruginosa PA01
gcccuugaggucguuggc

SEQ ID NO: 3501797 - RNA, 23 nt, Pseudomonas aeruginosa PA01
gcccuugaugaucaggucggccg

SEQ ID NO: 3501798 - RNA, 20 nt, Pseudomonas aeruginosa PA01
gcccuugauggugugcagca

SEQ ID NO: 3501799 - RNA, 21 nt, Pseudomonas aeruginosa PA01
gcccuugauggugugcagcag

SEQ ID NO: 3501800 - RNA, 23 nt, Pseudomonas aeruginosa PA01
gcccuugauggugugcagcagca

SEQ ID NO: 3501801 - RNA, 16 nt, Pseudomonas aeruginosa PA01
gcccuugccauccucc

SEQ ID NO: 3501802 - RNA, 20 nt, Pseudomonas aeruginosa PA01
gcccuugccauccuccagca

SEQ ID NO: 3501803 - RNA, 11 nt, Pseudomonas aeruginosa PA01
gcccuugccgg

SEQ ID NO: 3501804 - RNA, 14 nt, Pseudomonas aeruginosa PA01
gcccuugcgccgcg

SEQ ID NO: 3501805 - RNA, 15 nt, Pseudomonas aeruginosa PA01
gcccuugcgccgcgg

SEQ ID NO: 3501806 - RNA, 17 nt, Pseudomonas aeruginosa PA01
gcccuugcggcgcggcc

SEQ ID NO: 3501807 - RNA, 15 nt, Pseudomonas aeruginosa PA01
gcccuugcucgcggc

SEQ ID NO: 3501808 - RNA, 17 nt, Pseudomonas aeruginosa PA01
gcccuugcucgcggcgu

SEQ ID NO: 3501809 - RNA, 19 nt, Pseudomonas aeruginosa PA01
gcccuugcucgcggcguag

SEQ ID NO: 3501810 - RNA, 14 nt, Pseudomonas aeruginosa PA01
gcccuugcuguucg

SEQ ID NO: 3501811 - RNA, 13 nt, Pseudomonas aeruginosa PA01
gcccuuggccagc

SEQ ID NO: 3501812 - RNA, 16 nt, Pseudomonas aeruginosa PA01
gcccuuggcggcgcca

SEQ ID NO: 3501813 - RNA, 16 nt, Pseudomonas aeruginosa PA01
gcccuuggcuuccugg

SEQ ID NO: 3501814 - RNA, 18 nt, Pseudomonas aeruginosa PA01
gcccuuggcuuccuggcg

SEQ ID NO: 3501815 - RNA, 17 nt, Pseudomonas aeruginosa PA01
gcccuugggaccgggca

SEQ ID NO: 3501816 - RNA, 18 nt, Pseudomonas aeruginosa PA01
gcccuugggaccgggcau

SEQ ID NO: 3501817 - RNA, 16 nt, Pseudomonas aeruginosa PA01
gcccuuggucaggccg

SEQ ID NO: 3501818 - RNA, 17 nt, Pseudomonas aeruginosa PA01
gcccuuggucaggccga

SEQ ID NO: 3501819 - RNA, 24 nt, Pseudomonas aeruginosa PA01
gcccuuguacagcuucaggcgcac

SEQ ID NO: 3501820 - RNA, 19 nt, Pseudomonas aeruginosa PA01
gcccuuguccggcccggag

SEQ ID NO: 3501821 - RNA, 15 nt, Pseudomonas aeruginosa PA01
gcccuugucgccgcu

SEQ ID NO: 3501822 - RNA, 15 nt, Pseudomonas aeruginosa PA01
gcccuuguucgcggc

SEQ ID NO: 3501823 - RNA, 20 nt, Pseudomonas aeruginosa PA01
gcccuuguucgggucgcggc

SEQ ID NO: 3501824 - RNA, 16 nt, Pseudomonas aeruginosa PA01
gcccuuucacggcggu

SEQ ID NO: 3501825 - RNA, 19 nt, Pseudomonas aeruginosa PA01
gcccuuucgaacugcaugu

SEQ ID NO: 3501826 - RNA, 22 nt, Pseudomonas aeruginosa PA01
gcccuuuucaauuccgccgcgg

SEQ ID NO: 3501827 - RNA, 19 nt, Pseudomonas aeruginosa PA01
gcccuuuuccaccggccgc

SEQ ID NO: 3501828 - RNA, 21 nt, Pseudomonas aeruginosa PA01
gcccuuuuccuccagggugcc

SEQ ID NO: 3501829 - RNA, 19 nt, Pseudomonas aeruginosa PA01
gcccuuuuucgucgccagc

SEQ ID NO: 3501830 - RNA, 21 nt, Pseudomonas aeruginosa PA01
gccgaaaaaaaggggcccgaa

SEQ ID NO: 3501831 - RNA, 21 nt, Pseudomonas aeruginosa PA01
gccgaaaaauucagcgcagcg

SEQ ID NO: 3501832 - RNA, 13 nt, Pseudomonas aeruginosa PA01
gccgaaagcacug

SEQ ID NO: 3501833 - RNA, 18 nt, Pseudomonas aeruginosa PA01
gccgaaagcacugcggcg

SEQ ID NO: 3501834 - RNA, 18 nt, Pseudomonas aeruginosa PA01
gccgaaauagcgcgccca

SEQ ID NO: 3501835 - RNA, 20 nt, Pseudomonas aeruginosa PA01
gccgaaaucgaugucgcggc

SEQ ID NO: 3501836 - RNA, 23 nt, Pseudomonas aeruginosa PA01
gccgaaaucgaugucgcggcgcu

SEQ ID NO: 3501837 - RNA, 17 nt, Pseudomonas aeruginosa PA01
gccgaaaugcugcaggc

SEQ ID NO: 3501838 - RNA, 20 nt, Pseudomonas aeruginosa PA01
gccgaaaugcugcaggccga

SEQ ID NO: 3501839 - RNA, 21 nt, Pseudomonas aeruginosa PA01
gccgaaauugaccagguacgg

SEQ ID NO: 3501840 - RNA, 17 nt, Pseudomonas aeruginosa PA01
gccgaacaccugcauca

SEQ ID NO: 3501841 - RNA, 23 nt, Pseudomonas aeruginosa PA01
gccgaacaccugcaucaccaggc

SEQ ID NO: 3501842 - RNA, 17 nt, Pseudomonas aeruginosa PA01
gccgaacacgcacaaug

SEQ ID NO: 3501843 - RNA, 16 nt, Pseudomonas aeruginosa PA01
gccgaacagacgcagg

SEQ ID NO: 3501844 - RNA, 22 nt, Pseudomonas aeruginosa PA01
gccgaacagacgcaggcagguc

SEQ ID NO: 3501845 - RNA, 14 nt, Pseudomonas aeruginosa PA01
gccgaacagcaaca

SEQ ID NO: 3501846 - RNA, 21 nt, Pseudomonas aeruginosa PA01
gccgaacagcaacaccgcgca

SEQ ID NO: 3501847 - RNA, 13 nt, Pseudomonas aeruginosa PA01
gccgaacagcagg

SEQ ID NO: 3501848 - RNA, 14 nt, Pseudomonas aeruginosa PA01
gccgaacagcaggg

SEQ ID NO: 3501849 - RNA, 20 nt, Pseudomonas aeruginosa PA01
gccgaacagcagggaggcgc

SEQ ID NO: 3501850 - RNA, 21 nt, Pseudomonas aeruginosa PA01
gccgaacagcagggaggcgca

SEQ ID NO: 3501851 - RNA, 23 nt, Pseudomonas aeruginosa PA01
gccgaacagcagggaggcgcaca

SEQ ID NO: 3501852 - RNA, 15 nt, Pseudomonas aeruginosa PA01
gccgaacagccgccc

SEQ ID NO: 3501853 - RNA, 22 nt, Pseudomonas aeruginosa PA01
gccgaacaggcgucccauggcg

SEQ ID NO: 3501854 - RNA, 14 nt, Pseudomonas aeruginosa PA01
gccgaacagggcga

SEQ ID NO: 3501855 - RNA, 17 nt, Pseudomonas aeruginosa PA01
gccgaacagggcgagca

SEQ ID NO: 3501856 - RNA, 23 nt, Pseudomonas aeruginosa PA01
gccgaacagggcgagcagggcgc

SEQ ID NO: 3501857 - RNA, 24 nt, Pseudomonas aeruginosa PA01
gccgaacagggcgagcagggcgcu

SEQ ID NO: 3501858 - RNA, 17 nt, Pseudomonas aeruginosa PA01
gccgaacaggguugggc

SEQ ID NO: 3501859 - RNA, 19 nt, Pseudomonas aeruginosa PA01
gccgaacaggguugggcga

SEQ ID NO: 3501860 - RNA, 18 nt, Pseudomonas aeruginosa PA01
gccgaacaguucggcggu

SEQ ID NO: 3501861 - RNA, 21 nt, Pseudomonas aeruginosa PA01
gccgaacaguucggcggugga

SEQ ID NO: 3501862 - RNA, 13 nt, Pseudomonas aeruginosa PA01
gccgaacaugccg

SEQ ID NO: 3501863 - RNA, 17 nt, Pseudomonas aeruginosa PA01
gccgaacaugccgaaga

SEQ ID NO: 3501864 - RNA, 20 nt, Pseudomonas aeruginosa PA01
gccgaacaugccgaagagcu

SEQ ID NO: 3501865 - RNA, 16 nt, Pseudomonas aeruginosa PA01
gccgaaccgccucaga

SEQ ID NO: 3501866 - RNA, 13 nt, Pseudomonas aeruginosa PA01
gccgaaccggggc

SEQ ID NO: 3501867 - RNA, 16 nt, Pseudomonas aeruginosa PA01
gccgaacgccaccagg

SEQ ID NO: 3501868 - RNA, 20 nt, Pseudomonas aeruginosa PA01
gccgaacgccaccagggccu

SEQ ID NO: 3501869 - RNA, 20 nt, Pseudomonas aeruginosa PA01
gccgaacggcagcuggaucc

SEQ ID NO: 3501870 - RNA, 16 nt, Pseudomonas aeruginosa PA01
gccgaacgggaaguag

SEQ ID NO: 3501871 - RNA, 22 nt, Pseudomonas aeruginosa PA01
gccgaacggguagagcgggccg

SEQ ID NO: 3501872 - RNA, 19 nt, Pseudomonas aeruginosa PA01
gccgaacgguagguagcgu

SEQ ID NO: 3501873 - RNA, 20 nt, Pseudomonas aeruginosa PA01
gccgaacucacggaugccgg

SEQ ID NO: 3501874 - RNA, 14 nt, Pseudomonas aeruginosa PA01
gccgaacucaugcc

SEQ ID NO: 3501875 - RNA, 19 nt, Pseudomonas aeruginosa PA01
gccgaacuccgagcaggac

SEQ ID NO: 3501876 - RNA, 22 nt, Pseudomonas aeruginosa PA01
gccgaacuccgccagcaccacc

SEQ ID NO: 3501877 - RNA, 17 nt, Pseudomonas aeruginosa PA01
gccgaacucuggcggcg

SEQ ID NO: 3501878 - RNA, 12 nt, Pseudomonas aeruginosa PA01
gccgaacugcag

SEQ ID NO: 3501879 - RNA, 15 nt, Pseudomonas aeruginosa PA01
gccgaacugcagggc

SEQ ID NO: 3501880 - RNA, 21 nt, Pseudomonas aeruginosa PA01
gccgaacugcagggcgucgcc

SEQ ID NO: 3501881 - RNA, 22 nt, Pseudomonas aeruginosa PA01
gccgaacugcagggcgucgccg

SEQ ID NO: 3501882 - RNA, 19 nt, Pseudomonas aeruginosa PA01
gccgaagaacaccacgcgg

SEQ ID NO: 3501883 - RNA, 17 nt, Pseudomonas aeruginosa PA01
gccgaagaacucggcgc

SEQ ID NO: 3501884 - RNA, 20 nt, Pseudomonas aeruginosa PA01
gccgaagaacucggcgcugc

SEQ ID NO: 3501885 - RNA, 21 nt, Pseudomonas aeruginosa PA01
gccgaagaacucggcgcugcc

SEQ ID NO: 3501886 - RNA, 16 nt, Pseudomonas aeruginosa PA01
gccgaagaagcuucgc

SEQ ID NO: 3501887 - RNA, 20 nt, Pseudomonas aeruginosa PA01
gccgaagaagcuucgcuggg

SEQ ID NO: 3501888 - RNA, 12 nt, Pseudomonas aeruginosa PA01
gccgaagacgcc

SEQ ID NO: 3501889 - RNA, 14 nt, Pseudomonas aeruginosa PA01
gccgaagacgccug

SEQ ID NO: 3501890 - RNA, 18 nt, Pseudomonas aeruginosa PA01
gccgaagacgccugucgg

SEQ ID NO: 3501891 - RNA, 14 nt, Pseudomonas aeruginosa PA01
gccgaagagcuuuu

SEQ ID NO: 3501892 - RNA, 18 nt, Pseudomonas aeruginosa PA01
gccgaagaggcccucggc

SEQ ID NO: 3501893 - RNA, 22 nt, Pseudomonas aeruginosa PA01
gccgaagaggcccucggcgccg

SEQ ID NO: 3501894 - RNA, 23 nt, Pseudomonas aeruginosa PA01
gccgaagaggcccucggcgccga

SEQ ID NO: 3501895 - RNA, 19 nt, Pseudomonas aeruginosa PA01
gccgaagauacccagcggg

SEQ ID NO: 3501896 - RNA, 13 nt, Pseudomonas aeruginosa PA01
gccgaagauccgc

SEQ ID NO: 3501897 - RNA, 19 nt, Pseudomonas aeruginosa PA01
gccgaagauccgcuccagg

SEQ ID NO: 3501898 - RNA, 21 nt, Pseudomonas aeruginosa PA01
gccgaagauccgcuccaggcu

SEQ ID NO: 3501899 - RNA, 20 nt, Pseudomonas aeruginosa PA01
gccgaagaucgacaggccgc

SEQ ID NO: 3501900 - RNA, 23 nt, Pseudomonas aeruginosa PA01
gccgaagaucgacaggccgccgu

SEQ ID NO: 3501901 - RNA, 22 nt, Pseudomonas aeruginosa PA01
gccgaagcccuuggaguugaug

SEQ ID NO: 3501902 - RNA, 16 nt, Pseudomonas aeruginosa PA01
gccgaagccuucgucg

SEQ ID NO: 3501903 - RNA, 18 nt, Pseudomonas aeruginosa PA01
gccgaagccuucgucgau

SEQ ID NO: 3501904 - RNA, 23 nt, Pseudomonas aeruginosa PA01
gccgaagcgcucggucagcuccc

SEQ ID NO: 3501905 - RNA, 14 nt, Pseudomonas aeruginosa PA01
gccgaagcgugggc

SEQ ID NO: 3501906 - RNA, 21 nt, Pseudomonas aeruginosa PA01
gccgaagcgugggcggccggc

SEQ ID NO: 3501907 - RNA, 17 nt, Pseudomonas aeruginosa PA01
gccgaagcugucgagca

SEQ ID NO: 3501908 - RNA, 22 nt, Pseudomonas aeruginosa PA01
gccgaagcugucgagcacggcg

SEQ ID NO: 3501909 - RNA, 24 nt, Pseudomonas aeruginosa PA01
gccgaagcugucgagcacggcgcu

SEQ ID NO: 3501910 - RNA, 19 nt, Pseudomonas aeruginosa PA01
gccgaaggccaggaccgcg

SEQ ID NO: 3501911 - RNA, 20 nt, Pseudomonas aeruginosa PA01
gccgaaggccaggaccgcga

SEQ ID NO: 3501912 - RNA, 14 nt, Pseudomonas aeruginosa PA01
gccgaaggccaggc

SEQ ID NO: 3501913 - RNA, 17 nt, Pseudomonas aeruginosa PA01
gccgaaggccaggccgg

SEQ ID NO: 3501914 - RNA, 20 nt, Pseudomonas aeruginosa PA01
gccgaaggccaggccggcgc

SEQ ID NO: 3501915 - RNA, 21 nt, Pseudomonas aeruginosa PA01
gccgaaggccaggccggcgcc

SEQ ID NO: 3501916 - RNA, 13 nt, Pseudomonas aeruginosa PA01
gccgaaggccugg

SEQ ID NO: 3501917 - RNA, 17 nt, Pseudomonas aeruginosa PA01
gccgaaggccuggccgu

SEQ ID NO: 3501918 - RNA, 19 nt, Pseudomonas aeruginosa PA01
gccgaaggcgucauccgcc

SEQ ID NO: 3501919 - RNA, 20 nt, Pseudomonas aeruginosa PA01
gccgaaggcgucauccgcca

SEQ ID NO: 3501920 - RNA, 23 nt, Pseudomonas aeruginosa PA01
gccgaaggcgucauccgccaacc

SEQ ID NO: 3501921 - RNA, 21 nt, Pseudomonas aeruginosa PA01
gccgaaggcgugggcgccggc

SEQ ID NO: 3501922 - RNA, 23 nt, Pseudomonas aeruginosa PA01
gccgaaggcgugggcgccggcgc

SEQ ID NO: 3501923 - RNA, 19 nt, Pseudomonas aeruginosa PA01
gccgaagggaaacaccagg

SEQ ID NO: 3501924 - RNA, 22 nt, Pseudomonas aeruginosa PA01
gccgaagggaaacaccaggccg

SEQ ID NO: 3501925 - RNA, 23 nt, Pseudomonas aeruginosa PA01
gccgaagggaaacaccaggccga

SEQ ID NO: 3501926 - RNA, 17 nt, Pseudomonas aeruginosa PA01
gccgaagggccgcaggu

SEQ ID NO: 3501927 - RNA, 17 nt, Pseudomonas aeruginosa PA01
gccgaaggucaaugcca

SEQ ID NO: 3501928 - RNA, 17 nt, Pseudomonas aeruginosa PA01
gccgaaggugcaggccg

SEQ ID NO: 3501929 - RNA, 14 nt, Pseudomonas aeruginosa PA01
gccgaaguccugca

SEQ ID NO: 3501930 - RNA, 18 nt, Pseudomonas aeruginosa PA01
gccgaaguccugcaacag

SEQ ID NO: 3501931 - RNA, 14 nt, Pseudomonas aeruginosa PA01
gccgaagucggcga

SEQ ID NO: 3501932 - RNA, 17 nt, Pseudomonas aeruginosa PA01
gccgaagucggcgagcc

SEQ ID NO: 3501933 - RNA, 19 nt, Pseudomonas aeruginosa PA01
gccgaagucggcgagccgg

SEQ ID NO: 3501934 - RNA, 20 nt, Pseudomonas aeruginosa PA01
gccgaagucggcgagccggc

SEQ ID NO: 3501935 - RNA, 14 nt, Pseudomonas aeruginosa PA01
gccgaauccaggcc

SEQ ID NO: 3501936 - RNA, 16 nt, Pseudomonas aeruginosa PA01
gccgaauccaggccga

SEQ ID NO: 3501937 - RNA, 14 nt, Pseudomonas aeruginosa PA01
gccgaauccgccgg

SEQ ID NO: 3501938 - RNA, 15 nt, Pseudomonas aeruginosa PA01
gccgaauccgccggc

SEQ ID NO: 3501939 - RNA, 16 nt, Pseudomonas aeruginosa PA01
gccgaauccgccggcg

SEQ ID NO: 3501940 - RNA, 18 nt, Pseudomonas aeruginosa PA01
gccgaauccgccggcgau

SEQ ID NO: 3501941 - RNA, 19 nt, Pseudomonas aeruginosa PA01
gccgaauccgccggcgaug

SEQ ID NO: 3501942 - RNA, 20 nt, Pseudomonas aeruginosa PA01
gccgaauccgccggcgaugc

SEQ ID NO: 3501943 - RNA, 17 nt, Pseudomonas aeruginosa PA01
gccgaauccuccagccg

SEQ ID NO: 3501944 - RNA, 19 nt, Pseudomonas aeruginosa PA01
gccgaauccuccagccggc

SEQ ID NO: 3501945 - RNA, 23 nt, Pseudomonas aeruginosa PA01
gccgaauccuccagccggcgacg

SEQ ID NO: 3501946 - RNA, 15 nt, Pseudomonas aeruginosa PA01
gccgaaucgaacagg

SEQ ID NO: 3501947 - RNA, 16 nt, Pseudomonas aeruginosa PA01
gccgaaucgaacaggg

SEQ ID NO: 3501948 - RNA, 22 nt, Pseudomonas aeruginosa PA01
gccgacaacgaaaagagccgcg

SEQ ID NO: 3501949 - RNA, 23 nt, Pseudomonas aeruginosa PA01
gccgacaacgaaaagagccgcgc

SEQ ID NO: 3501950 - RNA, 17 nt, Pseudomonas aeruginosa PA01
gccgacaagccuccagc

SEQ ID NO: 3501951 - RNA, 18 nt, Pseudomonas aeruginosa PA01
gccgacaagccuccagcg

SEQ ID NO: 3501952 - RNA, 20 nt, Pseudomonas aeruginosa PA01
gccgacaagccuccagcgcc

SEQ ID NO: 3501953 - RNA, 22 nt, Pseudomonas aeruginosa PA01
gccgacaagccuccagcgccgc

SEQ ID NO: 3501954 - RNA, 16 nt, Pseudomonas aeruginosa PA01
gccgacacccgcgccg

SEQ ID NO: 3501955 - RNA, 17 nt, Pseudomonas aeruginosa PA01
gccgacacccgcgccgc

SEQ ID NO: 3501956 - RNA, 13 nt, Pseudomonas aeruginosa PA01
gccgacaccucga

SEQ ID NO: 3501957 - RNA, 17 nt, Pseudomonas aeruginosa PA01
gccgacaccucgaucag

SEQ ID NO: 3501958 - RNA, 20 nt, Pseudomonas aeruginosa PA01
gccgacacgugugucgacac

SEQ ID NO: 3501959 - RNA, 21 nt, Pseudomonas aeruginosa PA01
gccgacacgugugucgacacc

SEQ ID NO: 3501960 - RNA, 16 nt, Pseudomonas aeruginosa PA01
gccgacagagcggccg

SEQ ID NO: 3501961 - RNA, 20 nt, Pseudomonas aeruginosa PA01
gccgacagagcggccggcgc

SEQ ID NO: 3501962 - RNA, 23 nt, Pseudomonas aeruginosa PA01
gccgacagagcggccggcgcggc

SEQ ID NO: 3501963 - RNA, 18 nt, Pseudomonas aeruginosa PA01
gccgacagcacgauggcg

SEQ ID NO: 3501964 - RNA, 13 nt, Pseudomonas aeruginosa PA01
gccgacagcggcu

SEQ ID NO: 3501965 - RNA, 14 nt, Pseudomonas aeruginosa PA01
gccgacagcggcug

SEQ ID NO: 3501966 - RNA, 15 nt, Pseudomonas aeruginosa PA01
gccgacagcggcugg

SEQ ID NO: 3501967 - RNA, 18 nt, Pseudomonas aeruginosa PA01
gccgacagcggcuggcgc

SEQ ID NO: 3501968 - RNA, 19 nt, Pseudomonas aeruginosa PA01
gccgacagcggcuggcgcu

SEQ ID NO: 3501969 - RNA, 22 nt, Pseudomonas aeruginosa PA01
gccgacagcggcuggcgcuugc

SEQ ID NO: 3501970 - RNA, 15 nt, Pseudomonas aeruginosa PA01
gccgacaggccggug

SEQ ID NO: 3501971 - RNA, 19 nt, Pseudomonas aeruginosa PA01
gccgacaggccggugccgc

SEQ ID NO: 3501972 - RNA, 13 nt, Pseudomonas aeruginosa PA01
gccgacaggucgc

SEQ ID NO: 3501973 - RNA, 19 nt, Pseudomonas aeruginosa PA01
gccgacaggucgcuuucgc

SEQ ID NO: 3501974 - RNA, 14 nt, Pseudomonas aeruginosa PA01
gccgacaggucggc

SEQ ID NO: 3501975 - RNA, 12 nt, Pseudomonas aeruginosa PA01
gccgacaucgga

SEQ ID NO: 3501976 - RNA, 17 nt, Pseudomonas aeruginosa PA01
gccgaccacaugggcga

SEQ ID NO: 3501977 - RNA, 20 nt, Pseudomonas aeruginosa PA01
gccgaccacaugggcgaccg

SEQ ID NO: 3501978 - RNA, 21 nt, Pseudomonas aeruginosa PA01
gccgaccacaugggcgaccgg

SEQ ID NO: 3501979 - RNA, 21 nt, Pseudomonas aeruginosa PA01
gccgaccaccuucaggcugcu

SEQ ID NO: 3501980 - RNA, 23 nt, Pseudomonas aeruginosa PA01
gccgaccaccuucaggcugcuca

SEQ ID NO: 3501981 - RNA, 15 nt, Pseudomonas aeruginosa PA01
gccgaccacgaccgc

SEQ ID NO: 3501982 - RNA, 15 nt, Pseudomonas aeruginosa PA01
gccgaccacuuccag

SEQ ID NO: 3501983 - RNA, 16 nt, Pseudomonas aeruginosa PA01
gccgaccagcacggcg

SEQ ID NO: 3501984 - RNA, 19 nt, Pseudomonas aeruginosa PA01
gccgaccagcagggccagc

SEQ ID NO: 3501985 - RNA, 14 nt, Pseudomonas aeruginosa PA01
gccgaccagccgca

SEQ ID NO: 3501986 - RNA, 14 nt, Pseudomonas aeruginosa PA01
gccgaccagcgccg

SEQ ID NO: 3501987 - RNA, 15 nt, Pseudomonas aeruginosa PA01
gccgaccagcgccga

SEQ ID NO: 3501988 - RNA, 13 nt, Pseudomonas aeruginosa PA01
gccgaccagcuuc

SEQ ID NO: 3501989 - RNA, 14 nt, Pseudomonas aeruginosa PA01
gccgaccaggccga

SEQ ID NO: 3501990 - RNA, 15 nt, Pseudomonas aeruginosa PA01
gccgaccaggccgau

SEQ ID NO: 3501991 - RNA, 14 nt, Pseudomonas aeruginosa PA01
gccgaccaggccgu

SEQ ID NO: 3501992 - RNA, 16 nt, Pseudomonas aeruginosa PA01
gccgaccaggcggccg

SEQ ID NO: 3501993 - RNA, 15 nt, Pseudomonas aeruginosa PA01
gccgaccagguccgc

SEQ ID NO: 3501994 - RNA, 19 nt, Pseudomonas aeruginosa PA01
gccgaccagguccgccacu

SEQ ID NO: 3501995 - RNA, 14 nt, Pseudomonas aeruginosa PA01
gccgacccagagcg

SEQ ID NO: 3501996 - RNA, 15 nt, Pseudomonas aeruginosa PA01
gccgacccagagcgc

SEQ ID NO: 3501997 - RNA, 22 nt, Pseudomonas aeruginosa PA01
gccgacccagagcgcgcccugc

SEQ ID NO: 3501998 - RNA, 17 nt, Pseudomonas aeruginosa PA01
gccgacccgcagcggcg

SEQ ID NO: 3501999 - RNA, 19 nt, Pseudomonas aeruginosa PA01
gccgacccgcagcggcgcu

SEQ ID NO: 3502000 - RNA, 16 nt, Pseudomonas aeruginosa PA01
gccgacccgcaggccg

SEQ ID NO: 3502001 - RNA, 18 nt, Pseudomonas aeruginosa PA01
gccgacccgcaggccggc

SEQ ID NO: 3502002 - RNA, 19 nt, Pseudomonas aeruginosa PA01
gccgacccgcaggccggcc

SEQ ID NO: 3502003 - RNA, 20 nt, Pseudomonas aeruginosa PA01
gccgacccgcaggccggcca

SEQ ID NO: 3502004 - RNA, 18 nt, Pseudomonas aeruginosa PA01
gccgacccgcuugagcca

SEQ ID NO: 3502005 - RNA, 18 nt, Pseudomonas aeruginosa PA01
gccgacccgugcgccgcg

SEQ ID NO: 3502006 - RNA, 22 nt, Pseudomonas aeruginosa PA01
gccgacccgugcgccgcggguc

SEQ ID NO: 3502007 - RNA, 23 nt, Pseudomonas aeruginosa PA01
gccgacccgugcgccgcggguca

SEQ ID NO: 3502008 - RNA, 18 nt, Pseudomonas aeruginosa PA01
gccgacccuagggucggc

SEQ ID NO: 3502009 - RNA, 19 nt, Pseudomonas aeruginosa PA01
gccgacccuagggucggcg

SEQ ID NO: 3502010 - RNA, 19 nt, Pseudomonas aeruginosa PA01
gccgacccugcacccuugg

SEQ ID NO: 3502011 - RNA, 13 nt, Pseudomonas aeruginosa PA01
gccgaccgagcag

SEQ ID NO: 3502012 - RNA, 18 nt, Pseudomonas aeruginosa PA01
gccgaccgcaccgccagc

SEQ ID NO: 3502013 - RNA, 15 nt, Pseudomonas aeruginosa PA01
gccgaccgccaaggu

SEQ ID NO: 3502014 - RNA, 18 nt, Pseudomonas aeruginosa PA01
gccgaccgccaaggucgg

SEQ ID NO: 3502015 - RNA, 14 nt, Pseudomonas aeruginosa PA01
gccgaccgccaggc

SEQ ID NO: 3502016 - RNA, 16 nt, Pseudomonas aeruginosa PA01
gccgaccgccaggccg

SEQ ID NO: 3502017 - RNA, 17 nt, Pseudomonas aeruginosa PA01
gccgaccgccaggccga

SEQ ID NO: 3502018 - RNA, 21 nt, Pseudomonas aeruginosa PA01
gccgaccgccaggccgacccg

SEQ ID NO: 3502019 - RNA, 17 nt, Pseudomonas aeruginosa PA01
gccgaccgcgcgccugc

SEQ ID NO: 3502020 - RNA, 22 nt, Pseudomonas aeruginosa PA01
gccgaccgcgcgccugcaacgc

SEQ ID NO: 3502021 - RNA, 15 nt, Pseudomonas aeruginosa PA01
gccgaccggcgccgg

SEQ ID NO: 3502022 - RNA, 18 nt, Pseudomonas aeruginosa PA01
gccgaccggcgccgggau

SEQ ID NO: 3502023 - RNA, 12 nt, Pseudomonas aeruginosa PA01
gccgaccgggcg

SEQ ID NO: 3502024 - RNA, 16 nt, Pseudomonas aeruginosa PA01
gccgaccguccgccug

SEQ ID NO: 3502025 - RNA, 18 nt, Pseudomonas aeruginosa PA01
gccgaccguccgccugcg

SEQ ID NO: 3502026 - RNA, 22 nt, Pseudomonas aeruginosa PA01
gccgaccguggcgacaggcgau

SEQ ID NO: 3502027 - RNA, 19 nt, Pseudomonas aeruginosa PA01
gccgaccucggccgccagg

SEQ ID NO: 3502028 - RNA, 14 nt, Pseudomonas aeruginosa PA01
gccgaccucggcgg

SEQ ID NO: 3502029 - RNA, 15 nt, Pseudomonas aeruginosa PA01
gccgaccucggcggu

SEQ ID NO: 3502030 - RNA, 17 nt, Pseudomonas aeruginosa PA01
gccgaccucggcgguca

SEQ ID NO: 3502031 - RNA, 15 nt, Pseudomonas aeruginosa PA01
gccgaccugcccgcu

SEQ ID NO: 3502032 - RNA, 17 nt, Pseudomonas aeruginosa PA01
gccgaccugcccgcugu

SEQ ID NO: 3502033 - RNA, 17 nt, Pseudomonas aeruginosa PA01
gccgaccuguaccgcuc

SEQ ID NO: 3502034 - RNA, 22 nt, Pseudomonas aeruginosa PA01
gccgaccuguaccgcuccccac

SEQ ID NO: 3502035 - RNA, 17 nt, Pseudomonas aeruginosa PA01
gccgaccuucaccacca

SEQ ID NO: 3502036 - RNA, 18 nt, Pseudomonas aeruginosa PA01
gccgaccuucaccaccag

SEQ ID NO: 3502037 - RNA, 21 nt, Pseudomonas aeruginosa PA01
gccgaccuucaccaccagcga

SEQ ID NO: 3502038 - RNA, 22 nt, Pseudomonas aeruginosa PA01
gccgaccuucaccaccagcgag

SEQ ID NO: 3502039 - RNA, 20 nt, Pseudomonas aeruginosa PA01
gccgaccuucaucaggcggc

SEQ ID NO: 3502040 - RNA, 14 nt, Pseudomonas aeruginosa PA01
gccgaccuugccgg

SEQ ID NO: 3502041 - RNA, 15 nt, Pseudomonas aeruginosa PA01
gccgaccuugccggu

SEQ ID NO: 3502042 - RNA, 21 nt, Pseudomonas aeruginosa PA01
gccgaccuugcgucuucgccg

SEQ ID NO: 3502043 - RNA, 23 nt, Pseudomonas aeruginosa PA01
gccgaccuuguccacgucguagg

SEQ ID NO: 3502044 - RNA, 14 nt, Pseudomonas aeruginosa PA01
gccgacgaacagcc

SEQ ID NO: 3502045 - RNA, 16 nt, Pseudomonas aeruginosa PA01
gccgacgaacagccag

SEQ ID NO: 3502046 - RNA, 15 nt, Pseudomonas aeruginosa PA01
gccgacgaagaccuu

SEQ ID NO: 3502047 - RNA, 16 nt, Pseudomonas aeruginosa PA01
gccgacgaaggccgcg

SEQ ID NO: 3502048 - RNA, 19 nt, Pseudomonas aeruginosa PA01
gccgacgaaggccgcgguc

SEQ ID NO: 3502049 - RNA, 13 nt, Pseudomonas aeruginosa PA01
gccgacgagcagc

SEQ ID NO: 3502050 - RNA, 15 nt, Pseudomonas aeruginosa PA01
gccgacgagcagcuc

SEQ ID NO: 3502051 - RNA, 20 nt, Pseudomonas aeruginosa PA01
gccgacgagcagcucgccgg

SEQ ID NO: 3502052 - RNA, 21 nt, Pseudomonas aeruginosa PA01
gccgacgagcagcucgccggc

SEQ ID NO: 3502053 - RNA, 16 nt, Pseudomonas aeruginosa PA01
gccgacgauccggccg

SEQ ID NO: 3502054 - RNA, 18 nt, Pseudomonas aeruginosa PA01
gccgacgauccggccgau

SEQ ID NO: 3502055 - RNA, 23 nt, Pseudomonas aeruginosa PA01
gccgacgauccggccgaucuccu

SEQ ID NO: 3502056 - RNA, 18 nt, Pseudomonas aeruginosa PA01
gccgacgauguucgaggc

SEQ ID NO: 3502057 - RNA, 21 nt, Pseudomonas aeruginosa PA01
gccgacgccaccagccaggcg

SEQ ID NO: 3502058 - RNA, 21 nt, Pseudomonas aeruginosa PA01
gccgacgcccgcagccagccu

SEQ ID NO: 3502059 - RNA, 20 nt, Pseudomonas aeruginosa PA01
gccgacgccgagcagcacca

SEQ ID NO: 3502060 - RNA, 22 nt, Pseudomonas aeruginosa PA01
gccgacgccgagcagcaccagg

SEQ ID NO: 3502061 - RNA, 15 nt, Pseudomonas aeruginosa PA01
gccgacgccgcggcc

SEQ ID NO: 3502062 - RNA, 16 nt, Pseudomonas aeruginosa PA01
gccgacgccgcggccg

SEQ ID NO: 3502063 - RNA, 20 nt, Pseudomonas aeruginosa PA01
gccgacgccgcggccggcga

SEQ ID NO: 3502064 - RNA, 13 nt, Pseudomonas aeruginosa PA01
gccgacgccgcug

SEQ ID NO: 3502065 - RNA, 14 nt, Pseudomonas aeruginosa PA01
gccgacgccgcugg

SEQ ID NO: 3502066 - RNA, 15 nt, Pseudomonas aeruginosa PA01
gccgacgccgcugga

SEQ ID NO: 3502067 - RNA, 14 nt, Pseudomonas aeruginosa PA01
gccgacgccggacg

SEQ ID NO: 3502068 - RNA, 23 nt, Pseudomonas aeruginosa PA01
gccgacgccggacgagcuuuccu

SEQ ID NO: 3502069 - RNA, 22 nt, Pseudomonas aeruginosa PA01
gccgacgcgcugccccuggcuc

SEQ ID NO: 3502070 - RNA, 18 nt, Pseudomonas aeruginosa PA01
gccgacgcugaggaucac

SEQ ID NO: 3502071 - RNA, 20 nt, Pseudomonas aeruginosa PA01
gccgacgcugaggaucacga

SEQ ID NO: 3502072 - RNA, 15 nt, Pseudomonas aeruginosa PA01
gccgacgcuuccucg

SEQ ID NO: 3502073 - RNA, 16 nt, Pseudomonas aeruginosa PA01
gccgacggacguccuc

SEQ ID NO: 3502074 - RNA, 12 nt, Pseudomonas aeruginosa PA01
gccgacggcccu

SEQ ID NO: 3502075 - RNA, 13 nt, Pseudomonas aeruginosa PA01
gccgacggcccuc

SEQ ID NO: 3502076 - RNA, 19 nt, Pseudomonas aeruginosa PA01
gccgacggcccuccggcgc

SEQ ID NO: 3502077 - RNA, 20 nt, Pseudomonas aeruginosa PA01
gccgacggcccuccggcgcg

SEQ ID NO: 3502078 - RNA, 13 nt, Pseudomonas aeruginosa PA01
gccgacggcgcgc

SEQ ID NO: 3502079 - RNA, 24 nt, Pseudomonas aeruginosa PA01
gccgacggcgcgcugcgugcgccg

SEQ ID NO: 3502080 - RNA, 14 nt, Pseudomonas aeruginosa PA01
gccgacggcggcgg

SEQ ID NO: 3502081 - RNA, 16 nt, Pseudomonas aeruginosa PA01
gccgacggcgugccgu

SEQ ID NO: 3502082 - RNA, 17 nt, Pseudomonas aeruginosa PA01
gccgacggcgugccgug

SEQ ID NO: 3502083 - RNA, 20 nt, Pseudomonas aeruginosa PA01
gccgacggcgugccguggcu

SEQ ID NO: 3502084 - RNA, 19 nt, Pseudomonas aeruginosa PA01
gccgacggcuucgaccacg

SEQ ID NO: 3502085 - RNA, 21 nt, Pseudomonas aeruginosa PA01
gccgacggguucuucucgucg

SEQ ID NO: 3502086 - RNA, 19 nt, Pseudomonas aeruginosa PA01
gccgacgguaguaccucga

SEQ ID NO: 3502087 - RNA, 20 nt, Pseudomonas aeruginosa PA01
gccgacguagggcaucgccg

SEQ ID NO: 3502088 - RNA, 21 nt, Pseudomonas aeruginosa PA01
gccgacguagggcaucgccga

SEQ ID NO: 3502089 - RNA, 23 nt, Pseudomonas aeruginosa PA01
gccgacguagggcaucgccgaca

SEQ ID NO: 3502090 - RNA, 17 nt, Pseudomonas aeruginosa PA01
gccgacguccaucagcg

SEQ ID NO: 3502091 - RNA, 22 nt, Pseudomonas aeruginosa PA01
gccgacguccaucagcgucugc

SEQ ID NO: 3502092 - RNA, 23 nt, Pseudomonas aeruginosa PA01
gccgacguccaucagcgucugca

SEQ ID NO: 3502093 - RNA, 19 nt, Pseudomonas aeruginosa PA01
gccgacguccuccaggacc

SEQ ID NO: 3502094 - RNA, 20 nt, Pseudomonas aeruginosa PA01
gccgacguccuccaggacca

SEQ ID NO: 3502095 - RNA, 22 nt, Pseudomonas aeruginosa PA01
gccgacguccuccaggaccagg

SEQ ID NO: 3502096 - RNA, 22 nt, Pseudomonas aeruginosa PA01
gccgacgucguggauaggcggc

SEQ ID NO: 3502097 - RNA, 23 nt, Pseudomonas aeruginosa PA01
gccgacgucguggauaggcggcg

SEQ ID NO: 3502098 - RNA, 16 nt, Pseudomonas aeruginosa PA01
gccgacgugcacccgc

SEQ ID NO: 3502099 - RNA, 17 nt, Pseudomonas aeruginosa PA01
gccgacgugcacccgcu

SEQ ID NO: 3502100 - RNA, 18 nt, Pseudomonas aeruginosa PA01
gccgacuagaucgggauc

SEQ ID NO: 3502101 - RNA, 23 nt, Pseudomonas aeruginosa PA01
gccgacucgcgaucgaucggcug

SEQ ID NO: 3502102 - RNA, 16 nt, Pseudomonas aeruginosa PA01
gccgacugcaacuggc

SEQ ID NO: 3502103 - RNA, 19 nt, Pseudomonas aeruginosa PA01
gccgacugcaacuggccga

SEQ ID NO: 3502104 - RNA, 20 nt, Pseudomonas aeruginosa PA01
gccgacugcgguuuuccugc

SEQ ID NO: 3502105 - RNA, 17 nt, Pseudomonas aeruginosa PA01
gccgacuggcgguacgc

SEQ ID NO: 3502106 - RNA, 14 nt, Pseudomonas aeruginosa PA01
gccgacuuccagcu

SEQ ID NO: 3502107 - RNA, 15 nt, Pseudomonas aeruginosa PA01
gccgacuuccaggcg

SEQ ID NO: 3502108 - RNA, 19 nt, Pseudomonas aeruginosa PA01
gccgacuuccaggcgcagg

SEQ ID NO: 3502109 - RNA, 19 nt, Pseudomonas aeruginosa PA01
gccgacuuccucgauggug

SEQ ID NO: 3502110 - RNA, 14 nt, Pseudomonas aeruginosa PA01
gccgacuucggcaa

SEQ ID NO: 3502111 - RNA, 15 nt, Pseudomonas aeruginosa PA01
gccgacuugcucauc

SEQ ID NO: 3502112 - RNA, 15 nt, Pseudomonas aeruginosa PA01
gccgagaaaccgcca

SEQ ID NO: 3502113 - RNA, 18 nt, Pseudomonas aeruginosa PA01
gccgagaacccggccagg

SEQ ID NO: 3502114 - RNA, 22 nt, Pseudomonas aeruginosa PA01
gccgagaacccggccaggcccu

SEQ ID NO: 3502115 - RNA, 16 nt, Pseudomonas aeruginosa PA01
gccgagaacgcggcga

SEQ ID NO: 3502116 - RNA, 21 nt, Pseudomonas aeruginosa PA01
gccgagaacgcggcgaagggc

SEQ ID NO: 3502117 - RNA, 22 nt, Pseudomonas aeruginosa PA01
gccgagaagguucucggccacc

SEQ ID NO: 3502118 - RNA, 15 nt, Pseudomonas aeruginosa PA01
gccgagaaucugccc

SEQ ID NO: 3502119 - RNA, 20 nt, Pseudomonas aeruginosa PA01
gccgagaaucugcccggcca

SEQ ID NO: 3502120 - RNA, 17 nt, Pseudomonas aeruginosa PA01
gccgagaccgcagccca

SEQ ID NO: 3502121 - RNA, 20 nt, Pseudomonas aeruginosa PA01
gccgagacuccggagaaccg

SEQ ID NO: 3502122 - RNA, 17 nt, Pseudomonas aeruginosa PA01
gccgagauccugcagca

SEQ ID NO: 3502123 - RNA, 15 nt, Pseudomonas aeruginosa PA01
gccgagaucggucac

SEQ ID NO: 3502124 - RNA, 18 nt, Pseudomonas aeruginosa PA01
gccgagcaaccgcgaugg

SEQ ID NO: 3502125 - RNA, 20 nt, Pseudomonas aeruginosa PA01
gccgagcaaccgcgauggcg

SEQ ID NO: 3502126 - RNA, 17 nt, Pseudomonas aeruginosa PA01
gccgagcaacggcagca

SEQ ID NO: 3502127 - RNA, 18 nt, Pseudomonas aeruginosa PA01
gccgagcaacggcagcau

SEQ ID NO: 3502128 - RNA, 17 nt, Pseudomonas aeruginosa PA01
gccgagcaacucggcgg

SEQ ID NO: 3502129 - RNA, 19 nt, Pseudomonas aeruginosa PA01
gccgagcaacucggcggcg

SEQ ID NO: 3502130 - RNA, 17 nt, Pseudomonas aeruginosa PA01
gccgagcaacugcaugu

SEQ ID NO: 3502131 - RNA, 17 nt, Pseudomonas aeruginosa PA01
gccgagcaagccuucca

SEQ ID NO: 3502132 - RNA, 20 nt, Pseudomonas aeruginosa PA01
gccgagcaauccggcgcugc

SEQ ID NO: 3502133 - RNA, 22 nt, Pseudomonas aeruginosa PA01
gccgagcaauccggcgcugccg

SEQ ID NO: 3502134 - RNA, 14 nt, Pseudomonas aeruginosa PA01
gccgagcaccacgc

SEQ ID NO: 3502135 - RNA, 16 nt, Pseudomonas aeruginosa PA01
gccgagcaccggcagg

SEQ ID NO: 3502136 - RNA, 17 nt, Pseudomonas aeruginosa PA01
gccgagcacgcacuggu

SEQ ID NO: 3502137 - RNA, 11 nt, Pseudomonas aeruginosa PA01
gccgagcagca

SEQ ID NO: 3502138 - RNA, 17 nt, Pseudomonas aeruginosa PA01
gccgagcagcaccaggc

SEQ ID NO: 3502139 - RNA, 23 nt, Pseudomonas aeruginosa PA01
gccgagcagcaccaggcuggcca

SEQ ID NO: 3502140 - RNA, 12 nt, Pseudomonas aeruginosa PA01
gccgagcagcgc

SEQ ID NO: 3502141 - RNA, 15 nt, Pseudomonas aeruginosa PA01
gccgagcagcgccag

SEQ ID NO: 3502142 - RNA, 18 nt, Pseudomonas aeruginosa PA01
gccgagcagcgccagcca

SEQ ID NO: 3502143 - RNA, 22 nt, Pseudomonas aeruginosa PA01
gccgagcagcgccagccagggu

SEQ ID NO: 3502144 - RNA, 17 nt, Pseudomonas aeruginosa PA01
gccgagcaggaugauca

SEQ ID NO: 3502145 - RNA, 13 nt, Pseudomonas aeruginosa PA01
gccgagcaggcca

SEQ ID NO: 3502146 - RNA, 14 nt, Pseudomonas aeruginosa PA01
gccgagcaggcgcg

SEQ ID NO: 3502147 - RNA, 16 nt, Pseudomonas aeruginosa PA01
gccgagcaggcgcgcc

SEQ ID NO: 3502148 - RNA, 21 nt, Pseudomonas aeruginosa PA01
gccgagcagggucacgccgau

SEQ ID NO: 3502149 - RNA, 22 nt, Pseudomonas aeruginosa PA01
gccgagcagggucacgccgauc

SEQ ID NO: 3502150 - RNA, 14 nt, Pseudomonas aeruginosa PA01
gccgagcaucagcg

SEQ ID NO: 3502151 - RNA, 15 nt, Pseudomonas aeruginosa PA01
gccgagcaucagcga

SEQ ID NO: 3502152 - RNA, 16 nt, Pseudomonas aeruginosa PA01
gccgagcaucagcgac

SEQ ID NO: 3502153 - RNA, 20 nt, Pseudomonas aeruginosa PA01
gccgagcauguaggcgcacc

SEQ ID NO: 3502154 - RNA, 21 nt, Pseudomonas aeruginosa PA01
gccgagcauguaggcgcacca

SEQ ID NO: 3502155 - RNA, 19 nt, Pseudomonas aeruginosa PA01
gccgagccagccgcggauc

SEQ ID NO: 3502156 - RNA, 12 nt, Pseudomonas aeruginosa PA01
gccgagccaggu

SEQ ID NO: 3502157 - RNA, 12 nt, Pseudomonas aeruginosa PA01
gccgagcccacc

SEQ ID NO: 3502158 - RNA, 13 nt, Pseudomonas aeruginosa PA01
gccgagcccaccg

SEQ ID NO: 3502159 - RNA, 15 nt, Pseudomonas aeruginosa PA01
gccgagcccagcggc

SEQ ID NO: 3502160 - RNA, 16 nt, Pseudomonas aeruginosa PA01
gccgagcccagcggca

SEQ ID NO: 3502161 - RNA, 18 nt, Pseudomonas aeruginosa PA01
gccgagcccagcggcagg

SEQ ID NO: 3502162 - RNA, 20 nt, Pseudomonas aeruginosa PA01
gccgagcccagcggcagggc

SEQ ID NO: 3502163 - RNA, 21 nt, Pseudomonas aeruginosa PA01
gccgagcccagcggcagggcg

SEQ ID NO: 3502164 - RNA, 12 nt, Pseudomonas aeruginosa PA01
gccgagccccca

SEQ ID NO: 3502165 - RNA, 22 nt, Pseudomonas aeruginosa PA01
gccgagcccccauaccgccucg

SEQ ID NO: 3502166 - RNA, 21 nt, Pseudomonas aeruginosa PA01
gccgagcccccggcgcccaga

SEQ ID NO: 3502167 - RNA, 21 nt, Pseudomonas aeruginosa PA01
gccgagccgacauccugucga

SEQ ID NO: 3502168 - RNA, 15 nt, Pseudomonas aeruginosa PA01
gccgagccgcuugga

SEQ ID NO: 3502169 - RNA, 15 nt, Pseudomonas aeruginosa PA01
gccgagccggcaucc

SEQ ID NO: 3502170 - RNA, 15 nt, Pseudomonas aeruginosa PA01
gccgagccggcugcc

SEQ ID NO: 3502171 - RNA, 16 nt, Pseudomonas aeruginosa PA01
gccgagccggcugccg

SEQ ID NO: 3502172 - RNA, 20 nt, Pseudomonas aeruginosa PA01
gccgagcgaaaucggcaggc

SEQ ID NO: 3502173 - RNA, 22 nt, Pseudomonas aeruginosa PA01
gccgagcgaaaucggcaggcug

SEQ ID NO: 3502174 - RNA, 14 nt, Pseudomonas aeruginosa PA01
gccgagcgcagcgc

SEQ ID NO: 3502175 - RNA, 16 nt, Pseudomonas aeruginosa PA01
gccgagcgcagcgcca

SEQ ID NO: 3502176 - RNA, 18 nt, Pseudomonas aeruginosa PA01
gccgagcgcagcgccacc

SEQ ID NO: 3502177 - RNA, 21 nt, Pseudomonas aeruginosa PA01
gccgagcgcagcgccaccagg

SEQ ID NO: 3502178 - RNA, 13 nt, Pseudomonas aeruginosa PA01
gccgagcgccagg

SEQ ID NO: 3502179 - RNA, 19 nt, Pseudomonas aeruginosa PA01
gccgagcgccagggccagg

SEQ ID NO: 3502180 - RNA, 12 nt, Pseudomonas aeruginosa PA01
gccgagcgccgc

SEQ ID NO: 3502181 - RNA, 13 nt, Pseudomonas aeruginosa PA01
gccgagcgccgcc

SEQ ID NO: 3502182 - RNA, 17 nt, Pseudomonas aeruginosa PA01
gccgagcgccgccaggc

SEQ ID NO: 3502183 - RNA, 21 nt, Pseudomonas aeruginosa PA01
gccgagcgccgccaggcaggc

SEQ ID NO: 3502184 - RNA, 23 nt, Pseudomonas aeruginosa PA01
gccgagcgccgccaggcaggccg

SEQ ID NO: 3502185 - RNA, 15 nt, Pseudomonas aeruginosa PA01
gccgagcgccgccug

SEQ ID NO: 3502186 - RNA, 16 nt, Pseudomonas aeruginosa PA01
gccgagcgccgccugg

SEQ ID NO: 3502187 - RNA, 18 nt, Pseudomonas aeruginosa PA01
gccgagcgccgccugggc

SEQ ID NO: 3502188 - RNA, 19 nt, Pseudomonas aeruginosa PA01
gccgagcgccgccugggcc

SEQ ID NO: 3502189 - RNA, 23 nt, Pseudomonas aeruginosa PA01
gccgagcgccgccugggccgccu

SEQ ID NO: 3502190 - RNA, 14 nt, Pseudomonas aeruginosa PA01
gccgagcgccuggc

SEQ ID NO: 3502191 - RNA, 19 nt, Pseudomonas aeruginosa PA01
gccgagcgcgagugcagcg

SEQ ID NO: 3502192 - RNA, 22 nt, Pseudomonas aeruginosa PA01
gccgagcgcgagugcagcgagu

SEQ ID NO: 3502193 - RNA, 17 nt, Pseudomonas aeruginosa PA01
gccgagcgcgaucagcc

SEQ ID NO: 3502194 - RNA, 23 nt, Pseudomonas aeruginosa PA01
gccgagcgcgaucagccgcucca

SEQ ID NO: 3502195 - RNA, 13 nt, Pseudomonas aeruginosa PA01
gccgagcgcgccg

SEQ ID NO: 3502196 - RNA, 15 nt, Pseudomonas aeruginosa PA01
gccgagcgcgccgcc

SEQ ID NO: 3502197 - RNA, 17 nt, Pseudomonas aeruginosa PA01
gccgagcgcgccgccga

SEQ ID NO: 3502198 - RNA, 18 nt, Pseudomonas aeruginosa PA01
gccgagcggcaaggccaa

SEQ ID NO: 3502199 - RNA, 20 nt, Pseudomonas aeruginosa PA01
gccgagcggcaaggccaagu

SEQ ID NO: 3502200 - RNA, 14 nt, Pseudomonas aeruginosa PA01
gccgagcgggaagc

SEQ ID NO: 3502201 - RNA, 15 nt, Pseudomonas aeruginosa PA01
gccgagcgggaagcg

SEQ ID NO: 3502202 - RNA, 16 nt, Pseudomonas aeruginosa PA01
gccgagcgggaagcgu

SEQ ID NO: 3502203 - RNA, 20 nt, Pseudomonas aeruginosa PA01
gccgagcgggaagcguuccu

SEQ ID NO: 3502204 - RNA, 22 nt, Pseudomonas aeruginosa PA01
gccgagcgggaagcguuccugg

SEQ ID NO: 3502205 - RNA, 23 nt, Pseudomonas aeruginosa PA01
gccgagcgggaagcguuccugga

SEQ ID NO: 3502206 - RNA, 21 nt, Pseudomonas aeruginosa PA01
gccgagcgugcgcaugcccgc

SEQ ID NO: 3502207 - RNA, 20 nt, Pseudomonas aeruginosa PA01
gccgagcguugggccucgcu

SEQ ID NO: 3502208 - RNA, 22 nt, Pseudomonas aeruginosa PA01
gccgagcguugggccucgcugc

SEQ ID NO: 3502209 - RNA, 20 nt, Pseudomonas aeruginosa PA01
gccgagcugaccaccagggc

SEQ ID NO: 3502210 - RNA, 22 nt, Pseudomonas aeruginosa PA01
gccgagcugaccaccagggcga

SEQ ID NO: 3502211 - RNA, 19 nt, Pseudomonas aeruginosa PA01
gccgagcugccgcaccgcc

SEQ ID NO: 3502212 - RNA, 23 nt, Pseudomonas aeruginosa PA01
gccgagcugccgcaccgccucga

SEQ ID NO: 3502213 - RNA, 14 nt, Pseudomonas aeruginosa PA01
gccgagcugccggg

SEQ ID NO: 3502214 - RNA, 17 nt, Pseudomonas aeruginosa PA01
gccgagcugccgggcga

SEQ ID NO: 3502215 - RNA, 22 nt, Pseudomonas aeruginosa PA01
gccgagcugccgggcgagcugc

SEQ ID NO: 3502216 - RNA, 22 nt, Pseudomonas aeruginosa PA01
gccgagcugcucgaagcaauac

SEQ ID NO: 3502217 - RNA, 15 nt, Pseudomonas aeruginosa PA01
gccgagcuugaccuu

SEQ ID NO: 3502218 - RNA, 16 nt, Pseudomonas aeruginosa PA01
gccgagcuugaccuug

SEQ ID NO: 3502219 - RNA, 17 nt, Pseudomonas aeruginosa PA01
gccgagcuugaccuugc

SEQ ID NO: 3502220 - RNA, 21 nt, Pseudomonas aeruginosa PA01
gccgagcuugaccuugccgcc

SEQ ID NO: 3502221 - RNA, 14 nt, Pseudomonas aeruginosa PA01
gccgaggaacgccg

SEQ ID NO: 3502222 - RNA, 17 nt, Pseudomonas aeruginosa PA01
gccgaggaacgccgaca

SEQ ID NO: 3502223 - RNA, 21 nt, Pseudomonas aeruginosa PA01
gccgaggaacuccuccucgcu

SEQ ID NO: 3502224 - RNA, 13 nt, Pseudomonas aeruginosa PA01
gccgaggaacucg

SEQ ID NO: 3502225 - RNA, 16 nt, Pseudomonas aeruginosa PA01
gccgaggaacucgcgg

SEQ ID NO: 3502226 - RNA, 14 nt, Pseudomonas aeruginosa PA01
gccgaggaagccga

SEQ ID NO: 3502227 - RNA, 16 nt, Pseudomonas aeruginosa PA01
gccgaggaagccgacc

SEQ ID NO: 3502228 - RNA, 20 nt, Pseudomonas aeruginosa PA01
gccgaggaagccgaccggcg

SEQ ID NO: 3502229 - RNA, 23 nt, Pseudomonas aeruginosa PA01
gccgaggaagccgaccggcgccg

SEQ ID NO: 3502230 - RNA, 18 nt, Pseudomonas aeruginosa PA01
gccgaggaaggcgcuggc

SEQ ID NO: 3502231 - RNA, 19 nt, Pseudomonas aeruginosa PA01
gccgaggaagucggcggcc

SEQ ID NO: 3502232 - RNA, 20 nt, Pseudomonas aeruginosa PA01
gccgaggaagucggcggccg

SEQ ID NO: 3502233 - RNA, 22 nt, Pseudomonas aeruginosa PA01
gccgaggaagucggcggccgcc

SEQ ID NO: 3502234 - RNA, 13 nt, Pseudomonas aeruginosa PA01
gccgaggacccgg

SEQ ID NO: 3502235 - RNA, 16 nt, Pseudomonas aeruginosa PA01
gccgaggagacgcggc

SEQ ID NO: 3502236 - RNA, 20 nt, Pseudomonas aeruginosa PA01
gccgaggaggacgucgcggu

SEQ ID NO: 3502237 - RNA, 18 nt, Pseudomonas aeruginosa PA01
gccgaggaggaugccgau

SEQ ID NO: 3502238 - RNA, 20 nt, Pseudomonas aeruginosa PA01
gccgaggaggaugccgauca

SEQ ID NO: 3502239 - RNA, 13 nt, Pseudomonas aeruginosa PA01
gccgaggaggcca

SEQ ID NO: 3502240 - RNA, 18 nt, Pseudomonas aeruginosa PA01
gccgaggaggccagcagc

SEQ ID NO: 3502241 - RNA, 20 nt, Pseudomonas aeruginosa PA01
gccgaggauagcguccagcu

SEQ ID NO: 3502242 - RNA, 19 nt, Pseudomonas aeruginosa PA01
gccgaggaugcucgccugg

SEQ ID NO: 3502243 - RNA, 13 nt, Pseudomonas aeruginosa PA01
gccgaggcagccg

SEQ ID NO: 3502244 - RNA, 15 nt, Pseudomonas aeruginosa PA01
gccgaggcagccguc

SEQ ID NO: 3502245 - RNA, 17 nt, Pseudomonas aeruginosa PA01
gccgaggcagccgucgg

SEQ ID NO: 3502246 - RNA, 15 nt, Pseudomonas aeruginosa PA01
gccgaggcccagcga

SEQ ID NO: 3502247 - RNA, 14 nt, Pseudomonas aeruginosa PA01
gccgaggccgaggu

SEQ ID NO: 3502248 - RNA, 12 nt, Pseudomonas aeruginosa PA01
gccgaggccgcc

SEQ ID NO: 3502249 - RNA, 16 nt, Pseudomonas aeruginosa PA01
gccgaggccgccgcgg

SEQ ID NO: 3502250 - RNA, 14 nt, Pseudomonas aeruginosa PA01
gccgaggccggcga

SEQ ID NO: 3502251 - RNA, 16 nt, Pseudomonas aeruginosa PA01
gccgaggccggcgaag

SEQ ID NO: 3502252 - RNA, 16 nt, Pseudomonas aeruginosa PA01
gccgaggcggaagacg

SEQ ID NO: 3502253 - RNA, 14 nt, Pseudomonas aeruginosa PA01
gccgaggcggccga

SEQ ID NO: 3502254 - RNA, 16 nt, Pseudomonas aeruginosa PA01
gccgaggcggccgagg

SEQ ID NO: 3502255 - RNA, 21 nt, Pseudomonas aeruginosa PA01
gccgaggcggccguagccguc

SEQ ID NO: 3502256 - RNA, 23 nt, Pseudomonas aeruginosa PA01
gccgaggcggccguagccgucga

SEQ ID NO: 3502257 - RNA, 14 nt, Pseudomonas aeruginosa PA01
gccgaggcggcgca

SEQ ID NO: 3502258 - RNA, 16 nt, Pseudomonas aeruginosa PA01
gccgaggcggcgcagc

SEQ ID NO: 3502259 - RNA, 24 nt, Pseudomonas aeruginosa PA01
gccgaggcguaccggcuacaggcc

SEQ ID NO: 3502260 - RNA, 13 nt, Pseudomonas aeruginosa PA01
gccgaggcgucga

SEQ ID NO: 3502261 - RNA, 19 nt, Pseudomonas aeruginosa PA01
gccgaggcuuuccagcagg

SEQ ID NO: 3502262 - RNA, 23 nt, Pseudomonas aeruginosa PA01
gccgaggcuuuccagcaggcgcu

SEQ ID NO: 3502263 - RNA, 16 nt, Pseudomonas aeruginosa PA01
gccgagggcagccuca

SEQ ID NO: 3502264 - RNA, 16 nt, Pseudomonas aeruginosa PA01
gccgagggcgaagacu

SEQ ID NO: 3502265 - RNA, 20 nt, Pseudomonas aeruginosa PA01
gccgagggcgaagacuucga

SEQ ID NO: 3502266 - RNA, 19 nt, Pseudomonas aeruginosa PA01
gccgagggcgaguucggcg

SEQ ID NO: 3502267 - RNA, 21 nt, Pseudomonas aeruginosa PA01
gccgagggcgaguucggcgag

SEQ ID NO: 3502268 - RNA, 21 nt, Pseudomonas aeruginosa PA01
gccgagggcgccaggugcagg

SEQ ID NO: 3502269 - RNA, 14 nt, Pseudomonas aeruginosa PA01
gccgagggcgcgca

SEQ ID NO: 3502270 - RNA, 16 nt, Pseudomonas aeruginosa PA01
gccgagggcgcgcagu

SEQ ID NO: 3502271 - RNA, 14 nt, Pseudomonas aeruginosa PA01
gccgagggcgcggc

SEQ ID NO: 3502272 - RNA, 15 nt, Pseudomonas aeruginosa PA01
gccgagggcgcggcg

SEQ ID NO: 3502273 - RNA, 16 nt, Pseudomonas aeruginosa PA01
gccgagggcgcggcgc

SEQ ID NO: 3502274 - RNA, 17 nt, Pseudomonas aeruginosa PA01
gccgagggcgcggcgcc

SEQ ID NO: 3502275 - RNA, 18 nt, Pseudomonas aeruginosa PA01
gccgagggcgcggcgcca

SEQ ID NO: 3502276 - RNA, 19 nt, Pseudomonas aeruginosa PA01
gccgagggcgcggcgccag

SEQ ID NO: 3502277 - RNA, 14 nt, Pseudomonas aeruginosa PA01
gccgagggcugccg

SEQ ID NO: 3502278 - RNA, 20 nt, Pseudomonas aeruginosa PA01
gccgagggcuguaaucgccg

SEQ ID NO: 3502279 - RNA, 14 nt, Pseudomonas aeruginosa PA01
gccgaggggcggga

SEQ ID NO: 3502280 - RNA, 17 nt, Pseudomonas aeruginosa PA01
gccgagggguacagggc

SEQ ID NO: 3502281 - RNA, 20 nt, Pseudomonas aeruginosa PA01
gccgagggugaucagccgag

SEQ ID NO: 3502282 - RNA, 19 nt, Pseudomonas aeruginosa PA01
gccgagguaguaggucugg

SEQ ID NO: 3502283 - RNA, 23 nt, Pseudomonas aeruginosa PA01
gccgaggucaguucggugccgcc

SEQ ID NO: 3502284 - RNA, 16 nt, Pseudomonas aeruginosa PA01
gccgaggucgaccagc

SEQ ID NO: 3502285 - RNA, 15 nt, Pseudomonas aeruginosa PA01
gccgaggucgaggau

SEQ ID NO: 3502286 - RNA, 13 nt, Pseudomonas aeruginosa PA01
gccgaggucgccg

SEQ ID NO: 3502287 - RNA, 16 nt, Pseudomonas aeruginosa PA01
gccgaggucgccgcca

SEQ ID NO: 3502288 - RNA, 18 nt, Pseudomonas aeruginosa PA01
gccgaggucgccgccagc

SEQ ID NO: 3502289 - RNA, 18 nt, Pseudomonas aeruginosa PA01
gccgaggucgcgggccag

SEQ ID NO: 3502290 - RNA, 19 nt, Pseudomonas aeruginosa PA01
gccgaggucgcgggccagg

SEQ ID NO: 3502291 - RNA, 21 nt, Pseudomonas aeruginosa PA01
gccgaggucgcgggccaggcc

SEQ ID NO: 3502292 - RNA, 23 nt, Pseudomonas aeruginosa PA01
gccgaggucgcgggccaggcccu

SEQ ID NO: 3502293 - RNA, 15 nt, Pseudomonas aeruginosa PA01
gccgaggucggcggc

SEQ ID NO: 3502294 - RNA, 16 nt, Pseudomonas aeruginosa PA01
gccgaggucggcggcg

SEQ ID NO: 3502295 - RNA, 20 nt, Pseudomonas aeruginosa PA01
gccgaggucggcggcgggga

SEQ ID NO: 3502296 - RNA, 16 nt, Pseudomonas aeruginosa PA01
gccgaggucgucgcug

SEQ ID NO: 3502297 - RNA, 16 nt, Pseudomonas aeruginosa PA01
gccgaggucuuggcca

SEQ ID NO: 3502298 - RNA, 21 nt, Pseudomonas aeruginosa PA01
gccgaggucuuggccagccgc

SEQ ID NO: 3502299 - RNA, 22 nt, Pseudomonas aeruginosa PA01
gccgaggucuuggccagccgcg

SEQ ID NO: 3502300 - RNA, 13 nt, Pseudomonas aeruginosa PA01
gccgaggugcggc

SEQ ID NO: 3502301 - RNA, 23 nt, Pseudomonas aeruginosa PA01
gccgaggugcggcuugcguucgc

SEQ ID NO: 3502302 - RNA, 13 nt, Pseudomonas aeruginosa PA01
gccgaggugcugc

SEQ ID NO: 3502303 - RNA, 18 nt, Pseudomonas aeruginosa PA01
gccgaggugcugcaccgg

SEQ ID NO: 3502304 - RNA, 19 nt, Pseudomonas aeruginosa PA01
gccgaggugcugcaccggg

SEQ ID NO: 3502305 - RNA, 19 nt, Pseudomonas aeruginosa PA01
gccgagguggagaucagcg

SEQ ID NO: 3502306 - RNA, 22 nt, Pseudomonas aeruginosa PA01
gccgaggugguauugcagcucg

SEQ ID NO: 3502307 - RNA, 14 nt, Pseudomonas aeruginosa PA01
gccgagguguagaa

SEQ ID NO: 3502308 - RNA, 19 nt, Pseudomonas aeruginosa PA01
gccgagguucuugcccagc

SEQ ID NO: 3502309 - RNA, 23 nt, Pseudomonas aeruginosa PA01
gccgagguucuugcccagcaacg

SEQ ID NO: 3502310 - RNA, 17 nt, Pseudomonas aeruginosa PA01
gccgagguugacgaacg

SEQ ID NO: 3502311 - RNA, 20 nt, Pseudomonas aeruginosa PA01
gccgagguugacgaacggca

SEQ ID NO: 3502312 - RNA, 15 nt, Pseudomonas aeruginosa PA01
gccgagguuuccagu

SEQ ID NO: 3502313 - RNA, 15 nt, Pseudomonas aeruginosa PA01
gccgaguccgcgcgc

SEQ ID NO: 3502314 - RNA, 20 nt, Pseudomonas aeruginosa PA01
gccgaguccgcgcgcgcgcu

SEQ ID NO: 3502315 - RNA, 21 nt, Pseudomonas aeruginosa PA01
gccgaguccgcgcgcgcgcuc

SEQ ID NO: 3502316 - RNA, 17 nt, Pseudomonas aeruginosa PA01
gccgaguggccgaaggc

SEQ ID NO: 3502317 - RNA, 16 nt, Pseudomonas aeruginosa PA01
gccgaguggccgcuga

SEQ ID NO: 3502318 - RNA, 23 nt, Pseudomonas aeruginosa PA01
gccgaguggccgcugagcagcag

SEQ ID NO: 3502319 - RNA, 23 nt, Pseudomonas aeruginosa PA01
gccgagugugccggccaugcagg

SEQ ID NO: 3502320 - RNA, 14 nt, Pseudomonas aeruginosa PA01
gccgaguucgcgca

SEQ ID NO: 3502321 - RNA, 18 nt, Pseudomonas aeruginosa PA01
gccgaguucgcgcaggcg

SEQ ID NO: 3502322 - RNA, 23 nt, Pseudomonas aeruginosa PA01
gccgaguucgcgcaggcgcuggc

SEQ ID NO: 3502323 - RNA, 23 nt, Pseudomonas aeruginosa PA01
gccgaguuggaaccaguugccga

SEQ ID NO: 3502324 - RNA, 15 nt, Pseudomonas aeruginosa PA01
gccgauacagcgcgc

SEQ ID NO: 3502325 - RNA, 16 nt, Pseudomonas aeruginosa PA01
gccgauacagcgcgcg

SEQ ID NO: 3502326 - RNA, 18 nt, Pseudomonas aeruginosa PA01
gccgauacagcgcgcgau

SEQ ID NO: 3502327 - RNA, 16 nt, Pseudomonas aeruginosa PA01
gccgauaccggccucg

SEQ ID NO: 3502328 - RNA, 18 nt, Pseudomonas aeruginosa PA01
gccgauaccggccucgau

SEQ ID NO: 3502329 - RNA, 23 nt, Pseudomonas aeruginosa PA01
gccgauauugaacgacucgucgc

SEQ ID NO: 3502330 - RNA, 17 nt, Pseudomonas aeruginosa PA01
gccgaucaacgcggcca

SEQ ID NO: 3502331 - RNA, 20 nt, Pseudomonas aeruginosa PA01
gccgaucaacgcggccagca

SEQ ID NO: 3502332 - RNA, 23 nt, Pseudomonas aeruginosa PA01
gccgaucaacgcggccagcagca

SEQ ID NO: 3502333 - RNA, 21 nt, Pseudomonas aeruginosa PA01
gccgaucaaugcguuccuguc

SEQ ID NO: 3502334 - RNA, 13 nt, Pseudomonas aeruginosa PA01
gccgaucaccacc

SEQ ID NO: 3502335 - RNA, 17 nt, Pseudomonas aeruginosa PA01
gccgaucaccaccagca

SEQ ID NO: 3502336 - RNA, 23 nt, Pseudomonas aeruginosa PA01
gccgaucaccaccagcaucagca

SEQ ID NO: 3502337 - RNA, 19 nt, Pseudomonas aeruginosa PA01
gccgaucaccaccagcgcc

SEQ ID NO: 3502338 - RNA, 21 nt, Pseudomonas aeruginosa PA01
gccgaucaccaccagcgccgc

SEQ ID NO: 3502339 - RNA, 23 nt, Pseudomonas aeruginosa PA01
gccgaucaccaccagcgccgcca

SEQ ID NO: 3502340 - RNA, 16 nt, Pseudomonas aeruginosa PA01
gccgaucaccaccugg

SEQ ID NO: 3502341 - RNA, 14 nt, Pseudomonas aeruginosa PA01
gccgaucaccagca

SEQ ID NO: 3502342 - RNA, 16 nt, Pseudomonas aeruginosa PA01
gccgaucaccagcaau

SEQ ID NO: 3502343 - RNA, 21 nt, Pseudomonas aeruginosa PA01
gccgaucaccagcgccaggcc

SEQ ID NO: 3502344 - RNA, 17 nt, Pseudomonas aeruginosa PA01
gccgaucaccaggaucg

SEQ ID NO: 3502345 - RNA, 20 nt, Pseudomonas aeruginosa PA01
gccgaucaccaggaucgccg

SEQ ID NO: 3502346 - RNA, 22 nt, Pseudomonas aeruginosa PA01
gccgaucaccaggaucgccggg

SEQ ID NO: 3502347 - RNA, 23 nt, Pseudomonas aeruginosa PA01
gccgaucaccaggaucgccgggc

SEQ ID NO: 3502348 - RNA, 19 nt, Pseudomonas aeruginosa PA01
gccgaucaccccgcccagu

SEQ ID NO: 3502349 - RNA, 12 nt, Pseudomonas aeruginosa PA01
gccgaucagcca

SEQ ID NO: 3502350 - RNA, 16 nt, Pseudomonas aeruginosa PA01
gccgaucagcccgucg

SEQ ID NO: 3502351 - RNA, 14 nt, Pseudomonas aeruginosa PA01
gccgaucagcgcgc

SEQ ID NO: 3502352 - RNA, 16 nt, Pseudomonas aeruginosa PA01
gccgaucagcgcgccu

SEQ ID NO: 3502353 - RNA, 17 nt, Pseudomonas aeruginosa PA01
gccgaucagcgcgccuu

SEQ ID NO: 3502354 - RNA, 13 nt, Pseudomonas aeruginosa PA01
gccgaucagcggc

SEQ ID NO: 3502355 - RNA, 17 nt, Pseudomonas aeruginosa PA01
gccgaucagcggcgguc

SEQ ID NO: 3502356 - RNA, 22 nt, Pseudomonas aeruginosa PA01
gccgaucaggauguggccgucg

SEQ ID NO: 3502357 - RNA, 21 nt, Pseudomonas aeruginosa PA01
gccgaucaggcguaggccguc

SEQ ID NO: 3502358 - RNA, 23 nt, Pseudomonas aeruginosa PA01
gccgaucaggcugaagcggccgc

SEQ ID NO: 3502359 - RNA, 14 nt, Pseudomonas aeruginosa PA01
gccgaucaggucgc

SEQ ID NO: 3502360 - RNA, 15 nt, Pseudomonas aeruginosa PA01
gccgaucaggucgcg

SEQ ID NO: 3502361 - RNA, 20 nt, Pseudomonas aeruginosa PA01
gccgaucaggucgcgcgccu

SEQ ID NO: 3502362 - RNA, 13 nt, Pseudomonas aeruginosa PA01
gccgaucaucggc

SEQ ID NO: 3502363 - RNA, 19 nt, Pseudomonas aeruginosa PA01
gccgaucaucuucuggaca

SEQ ID NO: 3502364 - RNA, 16 nt, Pseudomonas aeruginosa PA01
gccgaucaugcucggc

SEQ ID NO: 3502365 - RNA, 20 nt, Pseudomonas aeruginosa PA01
gccgauccaggaaccggcca

SEQ ID NO: 3502366 - RNA, 17 nt, Pseudomonas aeruginosa PA01
gccgauccaggcguggg

SEQ ID NO: 3502367 - RNA, 15 nt, Pseudomonas aeruginosa PA01
gccgaucccgacgcc

SEQ ID NO: 3502368 - RNA, 22 nt, Pseudomonas aeruginosa PA01
gccgaucccgacgcccuccagc

SEQ ID NO: 3502369 - RNA, 13 nt, Pseudomonas aeruginosa PA01
gccgaucccggcg

SEQ ID NO: 3502370 - RNA, 15 nt, Pseudomonas aeruginosa PA01
gccgaucccggcggc

SEQ ID NO: 3502371 - RNA, 16 nt, Pseudomonas aeruginosa PA01
gccgaucccggcggcg

SEQ ID NO: 3502372 - RNA, 18 nt, Pseudomonas aeruginosa PA01
gccgaucccggcggcgac

SEQ ID NO: 3502373 - RNA, 23 nt, Pseudomonas aeruginosa PA01
gccgauccgcgaauagggcggcg

SEQ ID NO: 3502374 - RNA, 19 nt, Pseudomonas aeruginosa PA01
gccgaucgaagaaggcuca

SEQ ID NO: 3502375 - RNA, 15 nt, Pseudomonas aeruginosa PA01
gccgaucgagcggcc

SEQ ID NO: 3502376 - RNA, 16 nt, Pseudomonas aeruginosa PA01
gccgaucgagcggccc

SEQ ID NO: 3502377 - RNA, 14 nt, Pseudomonas aeruginosa PA01
gccgaucgccgcgc

SEQ ID NO: 3502378 - RNA, 16 nt, Pseudomonas aeruginosa PA01
gccgaucgccgcgcgg

SEQ ID NO: 3502379 - RNA, 19 nt, Pseudomonas aeruginosa PA01
gccgaucgccgcgcggucg

SEQ ID NO: 3502380 - RNA, 14 nt, Pseudomonas aeruginosa PA01
gccgaucgccucgu

SEQ ID NO: 3502381 - RNA, 21 nt, Pseudomonas aeruginosa PA01
gccgaucgccucguucagcag

SEQ ID NO: 3502382 - RNA, 23 nt, Pseudomonas aeruginosa PA01
gccgaucgccucguucagcagca

SEQ ID NO: 3502383 - RNA, 14 nt, Pseudomonas aeruginosa PA01
gccgaucuccgcuu

SEQ ID NO: 3502384 - RNA, 16 nt, Pseudomonas aeruginosa PA01
gccgaucuccgcuucc

SEQ ID NO: 3502385 - RNA, 16 nt, Pseudomonas aeruginosa PA01
gccgaucuccuccgcc

SEQ ID NO: 3502386 - RNA, 16 nt, Pseudomonas aeruginosa PA01
gccgaucuccuggcgg

SEQ ID NO: 3502387 - RNA, 17 nt, Pseudomonas aeruginosa PA01
gccgaucuccuggcggg

SEQ ID NO: 3502388 - RNA, 19 nt, Pseudomonas aeruginosa PA01
gccgaucuccuggcgggug

SEQ ID NO: 3502389 - RNA, 12 nt, Pseudomonas aeruginosa PA01
gccgaucucgcc

SEQ ID NO: 3502390 - RNA, 14 nt, Pseudomonas aeruginosa PA01
gccgaucucgccca

SEQ ID NO: 3502391 - RNA, 16 nt, Pseudomonas aeruginosa PA01
gccgaucucgcccagu

SEQ ID NO: 3502392 - RNA, 22 nt, Pseudomonas aeruginosa PA01
gccgaucucguggacccgugcg

SEQ ID NO: 3502393 - RNA, 14 nt, Pseudomonas aeruginosa PA01
gccgaucugcaggu

SEQ ID NO: 3502394 - RNA, 17 nt, Pseudomonas aeruginosa PA01
gccgaucuucagcagca

SEQ ID NO: 3502395 - RNA, 14 nt, Pseudomonas aeruginosa PA01
gccgaucuucgccg

SEQ ID NO: 3502396 - RNA, 16 nt, Pseudomonas aeruginosa PA01
gccgaucuucgccgac

SEQ ID NO: 3502397 - RNA, 18 nt, Pseudomonas aeruginosa PA01
gccgaugaaagagcccgc

SEQ ID NO: 3502398 - RNA, 17 nt, Pseudomonas aeruginosa PA01
gccgaugaacgccgcga

SEQ ID NO: 3502399 - RNA, 12 nt, Pseudomonas aeruginosa PA01
gccgaugaucuc

SEQ ID NO: 3502400 - RNA, 19 nt, Pseudomonas aeruginosa PA01
gccgaugaucuccgcgccg

SEQ ID NO: 3502401 - RNA, 22 nt, Pseudomonas aeruginosa PA01
gccgaugaucuccgcgccgggc

SEQ ID NO: 3502402 - RNA, 13 nt, Pseudomonas aeruginosa PA01
gccgaugccgacc

SEQ ID NO: 3502403 - RNA, 14 nt, Pseudomonas aeruginosa PA01
gccgaugccgccga

SEQ ID NO: 3502404 - RNA, 15 nt, Pseudomonas aeruginosa PA01
gccgaugccgccgac

SEQ ID NO: 3502405 - RNA, 21 nt, Pseudomonas aeruginosa PA01
gccgaugccggaaagccuggc

SEQ ID NO: 3502406 - RNA, 22 nt, Pseudomonas aeruginosa PA01
gccgaugccggaaagccuggcc

SEQ ID NO: 3502407 - RNA, 15 nt, Pseudomonas aeruginosa PA01
gccgaugccggccgg

SEQ ID NO: 3502408 - RNA, 21 nt, Pseudomonas aeruginosa PA01
gccgaugccggccggcagcga

SEQ ID NO: 3502409 - RNA, 13 nt, Pseudomonas aeruginosa PA01
gccgaugccgggc

SEQ ID NO: 3502410 - RNA, 23 nt, Pseudomonas aeruginosa PA01
gccgaugccgggcaacgcgcaga

SEQ ID NO: 3502411 - RNA, 22 nt, Pseudomonas aeruginosa PA01
gccgaugcgcaacgggcggcgg

SEQ ID NO: 3502412 - RNA, 16 nt, Pseudomonas aeruginosa PA01
gccgaugcgccgacgc

SEQ ID NO: 3502413 - RNA, 18 nt, Pseudomonas aeruginosa PA01
gccgaugcgcuacggcau

SEQ ID NO: 3502414 - RNA, 20 nt, Pseudomonas aeruginosa PA01
gccgaugcgcuacggcauca

SEQ ID NO: 3502415 - RNA, 22 nt, Pseudomonas aeruginosa PA01
gccgaugcgcuacggcaucacc

SEQ ID NO: 3502416 - RNA, 21 nt, Pseudomonas aeruginosa PA01
gccgaugcgguagucgcugcu

SEQ ID NO: 3502417 - RNA, 18 nt, Pseudomonas aeruginosa PA01
gccgaugcucgcgccagc

SEQ ID NO: 3502418 - RNA, 19 nt, Pseudomonas aeruginosa PA01
gccgaugcucgcgccagcc

SEQ ID NO: 3502419 - RNA, 22 nt, Pseudomonas aeruginosa PA01
gccgaugcucgcgccagcccca

SEQ ID NO: 3502420 - RNA, 13 nt, Pseudomonas aeruginosa PA01
gccgaugcucggu

SEQ ID NO: 3502421 - RNA, 21 nt, Pseudomonas aeruginosa PA01
gccgaugcuguauuccuugcg

SEQ ID NO: 3502422 - RNA, 20 nt, Pseudomonas aeruginosa PA01
gccgaugcuguucagcagga

SEQ ID NO: 3502423 - RNA, 22 nt, Pseudomonas aeruginosa PA01
gccgaugcuguucagcaggagc

SEQ ID NO: 3502424 - RNA, 14 nt, Pseudomonas aeruginosa PA01
gccgauggaaaucg

SEQ ID NO: 3502425 - RNA, 19 nt, Pseudomonas aeruginosa PA01
gccgauggaaaucggccac

SEQ ID NO: 3502426 - RNA, 20 nt, Pseudomonas aeruginosa PA01
gccgauggaaaucggccacu

SEQ ID NO: 3502427 - RNA, 15 nt, Pseudomonas aeruginosa PA01
gccgauggacaggcu

SEQ ID NO: 3502428 - RNA, 20 nt, Pseudomonas aeruginosa PA01
gccgauggacaggcugggca

SEQ ID NO: 3502429 - RNA, 17 nt, Pseudomonas aeruginosa PA01
gccgauggagauguagu

SEQ ID NO: 3502430 - RNA, 15 nt, Pseudomonas aeruginosa PA01
gccgauggccccggc

SEQ ID NO: 3502431 - RNA, 18 nt, Pseudomonas aeruginosa PA01
gccgauggcgcaccacug

SEQ ID NO: 3502432 - RNA, 19 nt, Pseudomonas aeruginosa PA01
gccgauggcgcaccacugc

SEQ ID NO: 3502433 - RNA, 20 nt, Pseudomonas aeruginosa PA01
gccgauggcgcaccacugca

SEQ ID NO: 3502434 - RNA, 19 nt, Pseudomonas aeruginosa PA01
gccgauggcgccgccgagg

SEQ ID NO: 3502435 - RNA, 20 nt, Pseudomonas aeruginosa PA01
gccgauggcguuauucgccc

SEQ ID NO: 3502436 - RNA, 18 nt, Pseudomonas aeruginosa PA01
gccgauggcugucggcgc

SEQ ID NO: 3502437 - RNA, 20 nt, Pseudomonas aeruginosa PA01
gccgauggcugucggcgccc

SEQ ID NO: 3502438 - RNA, 15 nt, Pseudomonas aeruginosa PA01
gccgaugggccuuca

SEQ ID NO: 3502439 - RNA, 14 nt, Pseudomonas aeruginosa PA01
gccgaugucgccgg

SEQ ID NO: 3502440 - RNA, 15 nt, Pseudomonas aeruginosa PA01
gccgaugucgccggc

SEQ ID NO: 3502441 - RNA, 19 nt, Pseudomonas aeruginosa PA01
gccgaugucguagccgcgc

SEQ ID NO: 3502442 - RNA, 20 nt, Pseudomonas aeruginosa PA01
gccgaugucguagccgcgcg

SEQ ID NO: 3502443 - RNA, 22 nt, Pseudomonas aeruginosa PA01
gccgaugucguagccgcgcgcc

SEQ ID NO: 3502444 - RNA, 16 nt, Pseudomonas aeruginosa PA01
gccgauuccugggcga

SEQ ID NO: 3502445 - RNA, 16 nt, Pseudomonas aeruginosa PA01
gccgauugcaugaccu

SEQ ID NO: 3502446 - RNA, 18 nt, Pseudomonas aeruginosa PA01
gccgauugcaugaccuuc

SEQ ID NO: 3502447 - RNA, 19 nt, Pseudomonas aeruginosa PA01
gccgauugccagaguugcc

SEQ ID NO: 3502448 - RNA, 16 nt, Pseudomonas aeruginosa PA01
gccgauugugcagggc

SEQ ID NO: 3502449 - RNA, 18 nt, Pseudomonas aeruginosa PA01
gccgauugugcagggccg

SEQ ID NO: 3502450 - RNA, 14 nt, Pseudomonas aeruginosa PA01
gccgcaaacccccu

SEQ ID NO: 3502451 - RNA, 15 nt, Pseudomonas aeruginosa PA01
gccgcaaacccccug

SEQ ID NO: 3502452 - RNA, 16 nt, Pseudomonas aeruginosa PA01
gccgcaaccagcccug

SEQ ID NO: 3502453 - RNA, 20 nt, Pseudomonas aeruginosa PA01
gccgcaaccagcccuggcgc

SEQ ID NO: 3502454 - RNA, 21 nt, Pseudomonas aeruginosa PA01
gccgcaaccagcccuggcgca

SEQ ID NO: 3502455 - RNA, 22 nt, Pseudomonas aeruginosa PA01
gccgcaaccagcccuggcgcag

SEQ ID NO: 3502456 - RNA, 23 nt, Pseudomonas aeruginosa PA01
gccgcaacgaaaaagggcggcca

SEQ ID NO: 3502457 - RNA, 16 nt, Pseudomonas aeruginosa PA01
gccgcaacgaucucgc

SEQ ID NO: 3502458 - RNA, 14 nt, Pseudomonas aeruginosa PA01
gccgcaaggccagg

SEQ ID NO: 3502459 - RNA, 19 nt, Pseudomonas aeruginosa PA01
gccgcaaggccagggcggc

SEQ ID NO: 3502460 - RNA, 20 nt, Pseudomonas aeruginosa PA01
gccgcaaggccagggcggcg

SEQ ID NO: 3502461 - RNA, 23 nt, Pseudomonas aeruginosa PA01
gccgcaaggccagggcggcgccg

SEQ ID NO: 3502462 - RNA, 21 nt, Pseudomonas aeruginosa PA01
gccgcaaguaccgccggcagu

SEQ ID NO: 3502463 - RNA, 15 nt, Pseudomonas aeruginosa PA01
gccgcaaguggcggc

SEQ ID NO: 3502464 - RNA, 16 nt, Pseudomonas aeruginosa PA01
gccgcaaguggcggcu

SEQ ID NO: 3502465 - RNA, 16 nt, Pseudomonas aeruginosa PA01
gccgcaauccgccgcu

SEQ ID NO: 3502466 - RNA, 22 nt, Pseudomonas aeruginosa PA01
gccgcacaccgcgcgcgccugc

SEQ ID NO: 3502467 - RNA, 17 nt, Pseudomonas aeruginosa PA01
gccgcacaggcuggcca

SEQ ID NO: 3502468 - RNA, 18 nt, Pseudomonas aeruginosa PA01
gccgcacaggcuggccag

SEQ ID NO: 3502469 - RNA, 18 nt, Pseudomonas aeruginosa PA01
gccgcacaguugcgcgcc

SEQ ID NO: 3502470 - RNA, 22 nt, Pseudomonas aeruginosa PA01
gccgcacaguugcgcgccggcg

SEQ ID NO: 3502471 - RNA, 19 nt, Pseudomonas aeruginosa PA01
gccgcaccacguagccggc

SEQ ID NO: 3502472 - RNA, 11 nt, Pseudomonas aeruginosa PA01
gccgcaccagg

SEQ ID NO: 3502473 - RNA, 13 nt, Pseudomonas aeruginosa PA01
gccgcaccaggau

SEQ ID NO: 3502474 - RNA, 20 nt, Pseudomonas aeruginosa PA01
gccgcaccccauccucgccg

SEQ ID NO: 3502475 - RNA, 16 nt, Pseudomonas aeruginosa PA01
gccgcaccggcgaugg

SEQ ID NO: 3502476 - RNA, 23 nt, Pseudomonas aeruginosa PA01
gccgcaccggcgauggccggcac

SEQ ID NO: 3502477 - RNA, 13 nt, Pseudomonas aeruginosa PA01
gccgcacuuccag

SEQ ID NO: 3502478 - RNA, 14 nt, Pseudomonas aeruginosa PA01
gccgcacuuccagg

SEQ ID NO: 3502479 - RNA, 18 nt, Pseudomonas aeruginosa PA01
gccgcacuuccaggcgcc

SEQ ID NO: 3502480 - RNA, 19 nt, Pseudomonas aeruginosa PA01
gccgcacuuccaggcgcca

SEQ ID NO: 3502481 - RNA, 22 nt, Pseudomonas aeruginosa PA01
gccgcacuuccaggcgccaauc

SEQ ID NO: 3502482 - RNA, 17 nt, Pseudomonas aeruginosa PA01
gccgcagacaucgccga

SEQ ID NO: 3502483 - RNA, 19 nt, Pseudomonas aeruginosa PA01
gccgcagacaucgccgagg

SEQ ID NO: 3502484 - RNA, 20 nt, Pseudomonas aeruginosa PA01
gccgcagaccagcgaaccgc

SEQ ID NO: 3502485 - RNA, 22 nt, Pseudomonas aeruginosa PA01
gccgcagaccagcgaaccgccg

SEQ ID NO: 3502486 - RNA, 14 nt, Pseudomonas aeruginosa PA01
gccgcagacgcccu

SEQ ID NO: 3502487 - RNA, 15 nt, Pseudomonas aeruginosa PA01
gccgcagacguggca

SEQ ID NO: 3502488 - RNA, 20 nt, Pseudomonas aeruginosa PA01
gccgcagagcaucacccgcg

SEQ ID NO: 3502489 - RNA, 14 nt, Pseudomonas aeruginosa PA01
gccgcagagccagc

SEQ ID NO: 3502490 - RNA, 15 nt, Pseudomonas aeruginosa PA01
gccgcagagccagcc

SEQ ID NO: 3502491 - RNA, 18 nt, Pseudomonas aeruginosa PA01
gccgcagagccagccgca

SEQ ID NO: 3502492 - RNA, 19 nt, Pseudomonas aeruginosa PA01
gccgcagaucaucgcacgg

SEQ ID NO: 3502493 - RNA, 17 nt, Pseudomonas aeruginosa PA01
gccgcagaugcuccagg

SEQ ID NO: 3502494 - RNA, 19 nt, Pseudomonas aeruginosa PA01
gccgcagaugcuccaggga

SEQ ID NO: 3502495 - RNA, 21 nt, Pseudomonas aeruginosa PA01
gccgcagaugcuccagggagc

SEQ ID NO: 3502496 - RNA, 21 nt, Pseudomonas aeruginosa PA01
gccgcagcaagucgaacaggc

SEQ ID NO: 3502497 - RNA, 22 nt, Pseudomonas aeruginosa PA01
gccgcagcaagucgaacaggcc

SEQ ID NO: 3502498 - RNA, 15 nt, Pseudomonas aeruginosa PA01
gccgcagcagcggca

SEQ ID NO: 3502499 - RNA, 15 nt, Pseudomonas aeruginosa PA01
gccgcagcagcggcg

SEQ ID NO: 3502500 - RNA, 13 nt, Pseudomonas aeruginosa PA01
gccgcagcccggu

SEQ ID NO: 3502501 - RNA, 22 nt, Pseudomonas aeruginosa PA01
gccgcagcccuaggcgacccgg

SEQ ID NO: 3502502 - RNA, 12 nt, Pseudomonas aeruginosa PA01
gccgcagccgug

SEQ ID NO: 3502503 - RNA, 13 nt, Pseudomonas aeruginosa PA01
gccgcagcgcaag

SEQ ID NO: 3502504 - RNA, 15 nt, Pseudomonas aeruginosa PA01
gccgcagcgcagccg

SEQ ID NO: 3502505 - RNA, 16 nt, Pseudomonas aeruginosa PA01
gccgcagcgcagccga

SEQ ID NO: 3502506 - RNA, 13 nt, Pseudomonas aeruginosa PA01
gccgcagcgcccc

SEQ ID NO: 3502507 - RNA, 16 nt, Pseudomonas aeruginosa PA01
gccgcagcgccccucc

SEQ ID NO: 3502508 - RNA, 21 nt, Pseudomonas aeruginosa PA01
gccgcagcgccccucccagcc

SEQ ID NO: 3502509 - RNA, 22 nt, Pseudomonas aeruginosa PA01
gccgcagcgccccucccagcca

SEQ ID NO: 3502510 - RNA, 20 nt, Pseudomonas aeruginosa PA01
gccgcagcgccucccgggcc

SEQ ID NO: 3502511 - RNA, 14 nt, Pseudomonas aeruginosa PA01
gccgcagcggcaug

SEQ ID NO: 3502512 - RNA, 18 nt, Pseudomonas aeruginosa PA01
gccgcagcggcaugcccu

SEQ ID NO: 3502513 - RNA, 19 nt, Pseudomonas aeruginosa PA01
gccgcagcggcaugcccug

SEQ ID NO: 3502514 - RNA, 20 nt, Pseudomonas aeruginosa PA01
gccgcagcggcaugcccugc

SEQ ID NO: 3502515 - RNA, 15 nt, Pseudomonas aeruginosa PA01
gccgcagcggccagg

SEQ ID NO: 3502516 - RNA, 17 nt, Pseudomonas aeruginosa PA01
gccgcagcggccaggga

SEQ ID NO: 3502517 - RNA, 15 nt, Pseudomonas aeruginosa PA01
gccgcagcggcgucu

SEQ ID NO: 3502518 - RNA, 21 nt, Pseudomonas aeruginosa PA01
gccgcagcggcgucugccgcu

SEQ ID NO: 3502519 - RNA, 22 nt, Pseudomonas aeruginosa PA01
gccgcagcggcgucugccgcuc

SEQ ID NO: 3502520 - RNA, 23 nt, Pseudomonas aeruginosa PA01
gccgcagcggcgucugccgcucg

SEQ ID NO: 3502521 - RNA, 12 nt, Pseudomonas aeruginosa PA01
gccgcagcucgg

SEQ ID NO: 3502522 - RNA, 19 nt, Pseudomonas aeruginosa PA01
gccgcagcucggccucgau

SEQ ID NO: 3502523 - RNA, 20 nt, Pseudomonas aeruginosa PA01
gccgcagcucggccucgauc

SEQ ID NO: 3502524 - RNA, 19 nt, Pseudomonas aeruginosa PA01
gccgcaggaaccgacgcgc

SEQ ID NO: 3502525 - RNA, 22 nt, Pseudomonas aeruginosa PA01
gccgcaggaaccgacgcgcagg

SEQ ID NO: 3502526 - RNA, 18 nt, Pseudomonas aeruginosa PA01
gccgcaggaaguugaugg

SEQ ID NO: 3502527 - RNA, 17 nt, Pseudomonas aeruginosa PA01
gccgcaggaugccgccu

SEQ ID NO: 3502528 - RNA, 19 nt, Pseudomonas aeruginosa PA01
gccgcaggaugccgccugc

SEQ ID NO: 3502529 - RNA, 13 nt, Pseudomonas aeruginosa PA01
gccgcaggcagaa

SEQ ID NO: 3502530 - RNA, 19 nt, Pseudomonas aeruginosa PA01
gccgcaggcaguggcgcca

SEQ ID NO: 3502531 - RNA, 21 nt, Pseudomonas aeruginosa PA01
gccgcaggcaguggcgccagc

SEQ ID NO: 3502532 - RNA, 14 nt, Pseudomonas aeruginosa PA01
gccgcaggccgcgg

SEQ ID NO: 3502533 - RNA, 16 nt, Pseudomonas aeruginosa PA01
gccgcaggccgcggcc

SEQ ID NO: 3502534 - RNA, 17 nt, Pseudomonas aeruginosa PA01
gccgcaggccgcggccg

SEQ ID NO: 3502535 - RNA, 19 nt, Pseudomonas aeruginosa PA01
gccgcaggccgcggccgaa

SEQ ID NO: 3502536 - RNA, 12 nt, Pseudomonas aeruginosa PA01
gccgcaggcgcu

SEQ ID NO: 3502537 - RNA, 13 nt, Pseudomonas aeruginosa PA01
gccgcaggcgggc

SEQ ID NO: 3502538 - RNA, 14 nt, Pseudomonas aeruginosa PA01
gccgcaggcgggcg

SEQ ID NO: 3502539 - RNA, 16 nt, Pseudomonas aeruginosa PA01
gccgcaggcgggcgcc

SEQ ID NO: 3502540 - RNA, 17 nt, Pseudomonas aeruginosa PA01
gccgcaggcgggcgcca

SEQ ID NO: 3502541 - RNA, 23 nt, Pseudomonas aeruginosa PA01
gccgcaggcugccguccaggcgc

SEQ ID NO: 3502542 - RNA, 13 nt, Pseudomonas aeruginosa PA01
gccgcagggugaa

SEQ ID NO: 3502543 - RNA, 17 nt, Pseudomonas aeruginosa PA01
gccgcagggugaauaac

SEQ ID NO: 3502544 - RNA, 16 nt, Pseudomonas aeruginosa PA01
gccgcagggugcggcu

SEQ ID NO: 3502545 - RNA, 15 nt, Pseudomonas aeruginosa PA01
gccgcaggucuuguc

SEQ ID NO: 3502546 - RNA, 21 nt, Pseudomonas aeruginosa PA01
gccgcagguuggccccgccga

SEQ ID NO: 3502547 - RNA, 22 nt, Pseudomonas aeruginosa PA01
gccgcagguuggccccgccgag

SEQ ID NO: 3502548 - RNA, 17 nt, Pseudomonas aeruginosa PA01
gccgcaguacgaggggc

SEQ ID NO: 3502549 - RNA, 19 nt, Pseudomonas aeruginosa PA01
gccgcaguacgaggggccg

SEQ ID NO: 3502550 - RNA, 23 nt, Pseudomonas aeruginosa PA01
gccgcaguacgaggggccgccgu

SEQ ID NO: 3502551 - RNA, 14 nt, Pseudomonas aeruginosa PA01
gccgcaguagaugc

SEQ ID NO: 3502552 - RNA, 19 nt, Pseudomonas aeruginosa PA01
gccgcaguagaugccgcgu

SEQ ID NO: 3502553 - RNA, 22 nt, Pseudomonas aeruginosa PA01
gccgcaguagaugccgcgucgg

SEQ ID NO: 3502554 - RNA, 15 nt, Pseudomonas aeruginosa PA01
gccgcaguccagggc

SEQ ID NO: 3502555 - RNA, 16 nt, Pseudomonas aeruginosa PA01
gccgcaguccagggcg

SEQ ID NO: 3502556 - RNA, 14 nt, Pseudomonas aeruginosa PA01
gccgcaguccgggu

SEQ ID NO: 3502557 - RNA, 18 nt, Pseudomonas aeruginosa PA01
gccgcaguuguuccucgc

SEQ ID NO: 3502558 - RNA, 14 nt, Pseudomonas aeruginosa PA01
gccgcaucgaccuu

SEQ ID NO: 3502559 - RNA, 22 nt, Pseudomonas aeruginosa PA01
gccgcaucgaccuugcccucgg

SEQ ID NO: 3502560 - RNA, 23 nt, Pseudomonas aeruginosa PA01
gccgcaucgaccuugcccucggc

SEQ ID NO: 3502561 - RNA, 14 nt, Pseudomonas aeruginosa PA01
gccgcaucgcgggc

SEQ ID NO: 3502562 - RNA, 15 nt, Pseudomonas aeruginosa PA01
gccgcaucgcgggcg

SEQ ID NO: 3502563 - RNA, 11 nt, Pseudomonas aeruginosa PA01
gccgcaugccg

SEQ ID NO: 3502564 - RNA, 15 nt, Pseudomonas aeruginosa PA01
gccgcauuggccagg

SEQ ID NO: 3502565 - RNA, 16 nt, Pseudomonas aeruginosa PA01
gccgcauuggccaggc

SEQ ID NO: 3502566 - RNA, 20 nt, Pseudomonas aeruginosa PA01
gccgccaaccacuccgccac

SEQ ID NO: 3502567 - RNA, 20 nt, Pseudomonas aeruginosa PA01
gccgccaacuggcugucgag

SEQ ID NO: 3502568 - RNA, 15 nt, Pseudomonas aeruginosa PA01
gccgccaagcccuug

SEQ ID NO: 3502569 - RNA, 13 nt, Pseudomonas aeruginosa PA01
gccgccaccgcca

SEQ ID NO: 3502570 - RNA, 14 nt, Pseudomonas aeruginosa PA01
gccgccaccgccac

SEQ ID NO: 3502571 - RNA, 15 nt, Pseudomonas aeruginosa PA01
gccgccaccgccacc

SEQ ID NO: 3502572 - RNA, 19 nt, Pseudomonas aeruginosa PA01
gccgccaccgccaccgccg

SEQ ID NO: 3502573 - RNA, 13 nt, Pseudomonas aeruginosa PA01
gccgccacgccga

SEQ ID NO: 3502574 - RNA, 14 nt, Pseudomonas aeruginosa PA01
gccgccacgccgau

SEQ ID NO: 3502575 - RNA, 17 nt, Pseudomonas aeruginosa PA01
gccgccacgccgauacc

SEQ ID NO: 3502576 - RNA, 17 nt, Pseudomonas aeruginosa PA01
gccgccacgugcacgcc

SEQ ID NO: 3502577 - RNA, 23 nt, Pseudomonas aeruginosa PA01
gccgccagaaagccucaggcgcu

SEQ ID NO: 3502578 - RNA, 19 nt, Pseudomonas aeruginosa PA01
gccgccagaguucgagcug

SEQ ID NO: 3502579 - RNA, 14 nt, Pseudomonas aeruginosa PA01
gccgccagcaacag

SEQ ID NO: 3502580 - RNA, 19 nt, Pseudomonas aeruginosa PA01
gccgccagcaacggcuccu

SEQ ID NO: 3502581 - RNA, 17 nt, Pseudomonas aeruginosa PA01
gccgccagcaggaucga

SEQ ID NO: 3502582 - RNA, 22 nt, Pseudomonas aeruginosa PA01
gccgccagcaggaucgacagca

SEQ ID NO: 3502583 - RNA, 18 nt, Pseudomonas aeruginosa PA01
gccgccagcaggaucgga

SEQ ID NO: 3502584 - RNA, 14 nt, Pseudomonas aeruginosa PA01
gccgccagcaggcc

SEQ ID NO: 3502585 - RNA, 15 nt, Pseudomonas aeruginosa PA01
gccgccagcaggccg

SEQ ID NO: 3502586 - RNA, 22 nt, Pseudomonas aeruginosa PA01
gccgccagcaggccgaaggcca

SEQ ID NO: 3502587 - RNA, 13 nt, Pseudomonas aeruginosa PA01
gccgccagcaggu

SEQ ID NO: 3502588 - RNA, 16 nt, Pseudomonas aeruginosa PA01
gccgccagcaggucgg

SEQ ID NO: 3502589 - RNA, 18 nt, Pseudomonas aeruginosa PA01
gccgccagcaggucggcc

SEQ ID NO: 3502590 - RNA, 16 nt, Pseudomonas aeruginosa PA01
gccgccagccagagca

SEQ ID NO: 3502591 - RNA, 13 nt, Pseudomonas aeruginosa PA01
gccgccagccgcc

SEQ ID NO: 3502592 - RNA, 16 nt, Pseudomonas aeruginosa PA01
gccgccagccgccagg

SEQ ID NO: 3502593 - RNA, 17 nt, Pseudomonas aeruginosa PA01
gccgccagccgccagga

SEQ ID NO: 3502594 - RNA, 14 nt, Pseudomonas aeruginosa PA01
gccgccagcgcggc

SEQ ID NO: 3502595 - RNA, 23 nt, Pseudomonas aeruginosa PA01
gccgccagcgcggcgcuuggcga

SEQ ID NO: 3502596 - RNA, 21 nt, Pseudomonas aeruginosa PA01
gccgccagcuaccggcagggu

SEQ ID NO: 3502597 - RNA, 24 nt, Pseudomonas aeruginosa PA01
gccgccagcuaccggcagggucac

SEQ ID NO: 3502598 - RNA, 16 nt, Pseudomonas aeruginosa PA01
gccgccaggacggcag

SEQ ID NO: 3502599 - RNA, 17 nt, Pseudomonas aeruginosa PA01
gccgccaggacggcagg

SEQ ID NO: 3502600 - RNA, 19 nt, Pseudomonas aeruginosa PA01
gccgccaggacggcagggu

SEQ ID NO: 3502601 - RNA, 12 nt, Pseudomonas aeruginosa PA01
gccgccaggcag

SEQ ID NO: 3502602 - RNA, 14 nt, Pseudomonas aeruginosa PA01
gccgccaggcagac

SEQ ID NO: 3502603 - RNA, 18 nt, Pseudomonas aeruginosa PA01
gccgccaggcagaccagg

SEQ ID NO: 3502604 - RNA, 23 nt, Pseudomonas aeruginosa PA01
gccgccaggcagaccaggccgag

SEQ ID NO: 3502605 - RNA, 24 nt, Pseudomonas aeruginosa PA01
gccgccaggcagaccaggccgagc

SEQ ID NO: 3502606 - RNA, 19 nt, Pseudomonas aeruginosa PA01
gccgccaggcagaccugca

SEQ ID NO: 3502607 - RNA, 22 nt, Pseudomonas aeruginosa PA01
gccgccaggcagaccugcagca

SEQ ID NO: 3502608 - RNA, 18 nt, Pseudomonas aeruginosa PA01
gccgccaggcaggccggg

SEQ ID NO: 3502609 - RNA, 19 nt, Pseudomonas aeruginosa PA01
gccgccaggcaggccgggc

SEQ ID NO: 3502610 - RNA, 13 nt, Pseudomonas aeruginosa PA01
gccgccaggcccu

SEQ ID NO: 3502611 - RNA, 17 nt, Pseudomonas aeruginosa PA01
gccgccaggcccugggc

SEQ ID NO: 3502612 - RNA, 20 nt, Pseudomonas aeruginosa PA01
gccgccaggcccugggcggc

SEQ ID NO: 3502613 - RNA, 12 nt, Pseudomonas aeruginosa PA01
gccgccaggccu

SEQ ID NO: 3502614 - RNA, 16 nt, Pseudomonas aeruginosa PA01
gccgccaggccucggc

SEQ ID NO: 3502615 - RNA, 18 nt, Pseudomonas aeruginosa PA01
gccgccaggccucggcgc

SEQ ID NO: 3502616 - RNA, 20 nt, Pseudomonas aeruginosa PA01
gccgccaggccucggcgcgg

SEQ ID NO: 3502617 - RNA, 11 nt, Pseudomonas aeruginosa PA01
gccgccaggcg

SEQ ID NO: 3502618 - RNA, 14 nt, Pseudomonas aeruginosa PA01
gccgccaggcgcgu

SEQ ID NO: 3502619 - RNA, 19 nt, Pseudomonas aeruginosa PA01
gccgccaggcgcgucgcgg

SEQ ID NO: 3502620 - RNA, 22 nt, Pseudomonas aeruginosa PA01
gccgccaggcgcgucgcggccu

SEQ ID NO: 3502621 - RNA, 20 nt, Pseudomonas aeruginosa PA01
gccgccaggcgcgucuccag

SEQ ID NO: 3502622 - RNA, 16 nt, Pseudomonas aeruginosa PA01
gccgccaggcgcuggc

SEQ ID NO: 3502623 - RNA, 18 nt, Pseudomonas aeruginosa PA01
gccgccaggcgcuggcga

SEQ ID NO: 3502624 - RNA, 14 nt, Pseudomonas aeruginosa PA01
gccgccaggcggca

SEQ ID NO: 3502625 - RNA, 13 nt, Pseudomonas aeruginosa PA01
gccgccaggcugg

SEQ ID NO: 3502626 - RNA, 15 nt, Pseudomonas aeruginosa PA01
gccgccagggcgucg

SEQ ID NO: 3502627 - RNA, 13 nt, Pseudomonas aeruginosa PA01
gccgccaggguca

SEQ ID NO: 3502628 - RNA, 14 nt, Pseudomonas aeruginosa PA01
gccgccagggucag

SEQ ID NO: 3502629 - RNA, 16 nt, Pseudomonas aeruginosa PA01
gccgccagguccgccu

SEQ ID NO: 3502630 - RNA, 18 nt, Pseudomonas aeruginosa PA01
gccgccagguccgccugg

SEQ ID NO: 3502631 - RNA, 15 nt, Pseudomonas aeruginosa PA01
gccgccagucggccu

SEQ ID NO: 3502632 - RNA, 16 nt, Pseudomonas aeruginosa PA01
gccgccagucggccug

SEQ ID NO: 3502633 - RNA, 17 nt, Pseudomonas aeruginosa PA01
gccgccagucggccugg

SEQ ID NO: 3502634 - RNA, 18 nt, Pseudomonas aeruginosa PA01
gccgccagucggccuggc

SEQ ID NO: 3502635 - RNA, 19 nt, Pseudomonas aeruginosa PA01
gccgccagucggccuggcu

SEQ ID NO: 3502636 - RNA, 16 nt, Pseudomonas aeruginosa PA01
gccgccagugcaugcg

SEQ ID NO: 3502637 - RNA, 18 nt, Pseudomonas aeruginosa PA01
gccgccaguucgcgcagg

SEQ ID NO: 3502638 - RNA, 16 nt, Pseudomonas aeruginosa PA01
gccgccaguucggcca

SEQ ID NO: 3502639 - RNA, 22 nt, Pseudomonas aeruginosa PA01
gccgccaguucggccaucagca

SEQ ID NO: 3502640 - RNA, 20 nt, Pseudomonas aeruginosa PA01
gccgccauagagugcccagg

SEQ ID NO: 3502641 - RNA, 15 nt, Pseudomonas aeruginosa PA01
gccgccaucaccagc

SEQ ID NO: 3502642 - RNA, 18 nt, Pseudomonas aeruginosa PA01
gccgccaucaccagcggc

SEQ ID NO: 3502643 - RNA, 16 nt, Pseudomonas aeruginosa PA01
gccgccaucgaccagg

SEQ ID NO: 3502644 - RNA, 15 nt, Pseudomonas aeruginosa PA01
gccgccaucgcccgg

SEQ ID NO: 3502645 - RNA, 18 nt, Pseudomonas aeruginosa PA01
gccgccaucgcccgguug

SEQ ID NO: 3502646 - RNA, 17 nt, Pseudomonas aeruginosa PA01
gccgccaucgccucgcc

SEQ ID NO: 3502647 - RNA, 19 nt, Pseudomonas aeruginosa PA01
gccgccaucgccucgccgg

SEQ ID NO: 3502648 - RNA, 20 nt, Pseudomonas aeruginosa PA01
gccgccaucgccucgccggc

SEQ ID NO: 3502649 - RNA, 21 nt, Pseudomonas aeruginosa PA01
gccgccaucgccucgccggcc

SEQ ID NO: 3502650 - RNA, 22 nt, Pseudomonas aeruginosa PA01
gccgccaucgccucgccggcca

SEQ ID NO: 3502651 - RNA, 23 nt, Pseudomonas aeruginosa PA01
gccgccaucgccucgccggccag

SEQ ID NO: 3502652 - RNA, 15 nt, Pseudomonas aeruginosa PA01
gccgccaugcucggc

SEQ ID NO: 3502653 - RNA, 14 nt, Pseudomonas aeruginosa PA01
gccgccauugacga

SEQ ID NO: 3502654 - RNA, 22 nt, Pseudomonas aeruginosa PA01
gccgcccaccgcgggggucgga

SEQ ID NO: 3502655 - RNA, 17 nt, Pseudomonas aeruginosa PA01
gccgcccacgggcggcu

SEQ ID NO: 3502656 - RNA, 13 nt, Pseudomonas aeruginosa PA01
gccgcccagcacc

SEQ ID NO: 3502657 - RNA, 12 nt, Pseudomonas aeruginosa PA01
gccgcccagcag

SEQ ID NO: 3502658 - RNA, 13 nt, Pseudomonas aeruginosa PA01
gccgcccagcagc

SEQ ID NO: 3502659 - RNA, 14 nt, Pseudomonas aeruginosa PA01
gccgcccagcagca

SEQ ID NO: 3502660 - RNA, 13 nt, Pseudomonas aeruginosa PA01
gccgcccagcgca

SEQ ID NO: 3502661 - RNA, 14 nt, Pseudomonas aeruginosa PA01
gccgcccagcgcag

SEQ ID NO: 3502662 - RNA, 20 nt, Pseudomonas aeruginosa PA01
gccgcccagcgcagccugcu

SEQ ID NO: 3502663 - RNA, 20 nt, Pseudomonas aeruginosa PA01
gccgcccagcggaugcgcga

SEQ ID NO: 3502664 - RNA, 13 nt, Pseudomonas aeruginosa PA01
gccgcccaguccu

SEQ ID NO: 3502665 - RNA, 15 nt, Pseudomonas aeruginosa PA01
gccgcccaguucgcg

SEQ ID NO: 3502666 - RNA, 20 nt, Pseudomonas aeruginosa PA01
gccgcccaguucgcgcggag

SEQ ID NO: 3502667 - RNA, 14 nt, Pseudomonas aeruginosa PA01
gccgccccaccacc

SEQ ID NO: 3502668 - RNA, 18 nt, Pseudomonas aeruginosa PA01
gccgccccaccaccaucg

SEQ ID NO: 3502669 - RNA, 22 nt, Pseudomonas aeruginosa PA01
gccgccccaccaccaucgccgc

SEQ ID NO: 3502670 - RNA, 23 nt, Pseudomonas aeruginosa PA01
gccgccccaccaccaucgccgcg

SEQ ID NO: 3502671 - RNA, 22 nt, Pseudomonas aeruginosa PA01
gccgccccacgggucgucgccc

SEQ ID NO: 3502672 - RNA, 13 nt, Pseudomonas aeruginosa PA01
gccgccccagccu

SEQ ID NO: 3502673 - RNA, 16 nt, Pseudomonas aeruginosa PA01
gccgccccagccucgg

SEQ ID NO: 3502674 - RNA, 20 nt, Pseudomonas aeruginosa PA01
gccgccccagccucggcagg

SEQ ID NO: 3502675 - RNA, 15 nt, Pseudomonas aeruginosa PA01
gccgcccccagcgcg

SEQ ID NO: 3502676 - RNA, 16 nt, Pseudomonas aeruginosa PA01
gccgcccccagcgcgc

SEQ ID NO: 3502677 - RNA, 20 nt, Pseudomonas aeruginosa PA01
gccgcccccagcgcgccgcc

SEQ ID NO: 3502678 - RNA, 21 nt, Pseudomonas aeruginosa PA01
gccgcccccagcgcgccgccg

SEQ ID NO: 3502679 - RNA, 22 nt, Pseudomonas aeruginosa PA01
gccgcccccagcgcgccgccga

SEQ ID NO: 3502680 - RNA, 16 nt, Pseudomonas aeruginosa PA01
gccgcccccggcccgg

SEQ ID NO: 3502681 - RNA, 22 nt, Pseudomonas aeruginosa PA01
gccgccccguuggcgcgggcga

SEQ ID NO: 3502682 - RNA, 16 nt, Pseudomonas aeruginosa PA01
gccgcccgagccgcug

SEQ ID NO: 3502683 - RNA, 22 nt, Pseudomonas aeruginosa PA01
gccgcccgaggcgaccuuggcc

SEQ ID NO: 3502684 - RNA, 14 nt, Pseudomonas aeruginosa PA01
gccgcccgcgccuc

SEQ ID NO: 3502685 - RNA, 15 nt, Pseudomonas aeruginosa PA01
gccgcccgcgccucc

SEQ ID NO: 3502686 - RNA, 16 nt, Pseudomonas aeruginosa PA01
gccgcccgcgccucca

SEQ ID NO: 3502687 - RNA, 22 nt, Pseudomonas aeruginosa PA01
gccgcccgcggaccgggcggcg

SEQ ID NO: 3502688 - RNA, 19 nt, Pseudomonas aeruginosa PA01
gccgcccggcagcggcugg

SEQ ID NO: 3502689 - RNA, 13 nt, Pseudomonas aeruginosa PA01
gccgcccggccag

SEQ ID NO: 3502690 - RNA, 14 nt, Pseudomonas aeruginosa PA01
gccgcccggccagg

SEQ ID NO: 3502691 - RNA, 16 nt, Pseudomonas aeruginosa PA01
gccgcccggccaggcc

SEQ ID NO: 3502692 - RNA, 13 nt, Pseudomonas aeruginosa PA01
gccgcccggccgc

SEQ ID NO: 3502693 - RNA, 15 nt, Pseudomonas aeruginosa PA01
gccgcccggccgcug

SEQ ID NO: 3502694 - RNA, 14 nt, Pseudomonas aeruginosa PA01
gccgcccggcgcca

SEQ ID NO: 3502695 - RNA, 18 nt, Pseudomonas aeruginosa PA01
gccgcccggcucgccgcc

SEQ ID NO: 3502696 - RNA, 22 nt, Pseudomonas aeruginosa PA01
gccgcccggcucgccgccgggc

SEQ ID NO: 3502697 - RNA, 18 nt, Pseudomonas aeruginosa PA01
gccgcccggucuagcgcc

SEQ ID NO: 3502698 - RNA, 23 nt, Pseudomonas aeruginosa PA01
gccgcccggucuagcgccccggc

SEQ ID NO: 3502699 - RNA, 23 nt, Pseudomonas aeruginosa PA01
gccgcccgguucguagaguucgc

SEQ ID NO: 3502700 - RNA, 15 nt, Pseudomonas aeruginosa PA01
gccgcccgucgcgcc

SEQ ID NO: 3502701 - RNA, 17 nt, Pseudomonas aeruginosa PA01
gccgcccgucgcgccgg

SEQ ID NO: 3502702 - RNA, 14 nt, Pseudomonas aeruginosa PA01
gccgcccuccauca

SEQ ID NO: 3502703 - RNA, 18 nt, Pseudomonas aeruginosa PA01
gccgcccuccaucagcgc

SEQ ID NO: 3502704 - RNA, 23 nt, Pseudomonas aeruginosa PA01
gccgcccucgcaguacagcucgg

SEQ ID NO: 3502705 - RNA, 14 nt, Pseudomonas aeruginosa PA01
gccgcccucgggcc

SEQ ID NO: 3502706 - RNA, 16 nt, Pseudomonas aeruginosa PA01
gccgcccugcggcagg

SEQ ID NO: 3502707 - RNA, 17 nt, Pseudomonas aeruginosa PA01
gccgcccugcggcaggc

SEQ ID NO: 3502708 - RNA, 20 nt, Pseudomonas aeruginosa PA01
gccgcccugcggcaggcgcc

SEQ ID NO: 3502709 - RNA, 21 nt, Pseudomonas aeruginosa PA01
gccgcccugcggcaggcgcca

SEQ ID NO: 3502710 - RNA, 17 nt, Pseudomonas aeruginosa PA01
gccgcccuggccgagcg

SEQ ID NO: 3502711 - RNA, 23 nt, Pseudomonas aeruginosa PA01
gccgcccuggccgagcgggaagc

SEQ ID NO: 3502712 - RNA, 14 nt, Pseudomonas aeruginosa PA01
gccgcccuggcucu

SEQ ID NO: 3502713 - RNA, 18 nt, Pseudomonas aeruginosa PA01
gccgcccuguucgucugg

SEQ ID NO: 3502714 - RNA, 22 nt, Pseudomonas aeruginosa PA01
gccgcccuguucgucuggcgcc

SEQ ID NO: 3502715 - RNA, 18 nt, Pseudomonas aeruginosa PA01
gccgcccuugaccccacc

SEQ ID NO: 3502716 - RNA, 12 nt, Pseudomonas aeruginosa PA01
gccgcccuugcc

SEQ ID NO: 3502717 - RNA, 18 nt, Pseudomonas aeruginosa PA01
gccgccgaaaugcugcag

SEQ ID NO: 3502718 - RNA, 19 nt, Pseudomonas aeruginosa PA01
gccgccgaaaugcugcagg

SEQ ID NO: 3502719 - RNA, 22 nt, Pseudomonas aeruginosa PA01
gccgccgaaaugcugcaggccg

SEQ ID NO: 3502720 - RNA, 23 nt, Pseudomonas aeruginosa PA01
gccgccgaaaugcugcaggccga

SEQ ID NO: 3502721 - RNA, 15 nt, Pseudomonas aeruginosa PA01
gccgccgaacacgca

SEQ ID NO: 3502722 - RNA, 20 nt, Pseudomonas aeruginosa PA01
gccgccgaagaacucggcgc

SEQ ID NO: 3502723 - RNA, 23 nt, Pseudomonas aeruginosa PA01
gccgccgaagaacucggcgcugc

SEQ ID NO: 3502724 - RNA, 22 nt, Pseudomonas aeruginosa PA01
gccgccgaagccgacgccgagc

SEQ ID NO: 3502725 - RNA, 16 nt, Pseudomonas aeruginosa PA01
gccgccgaagggccgc

SEQ ID NO: 3502726 - RNA, 14 nt, Pseudomonas aeruginosa PA01
gccgccgacacccg

SEQ ID NO: 3502727 - RNA, 16 nt, Pseudomonas aeruginosa PA01
gccgccgacacccgcg

SEQ ID NO: 3502728 - RNA, 18 nt, Pseudomonas aeruginosa PA01
gccgccgacacccgcgcc

SEQ ID NO: 3502729 - RNA, 17 nt, Pseudomonas aeruginosa PA01
gccgccgacaggucgcu

SEQ ID NO: 3502730 - RNA, 12 nt, Pseudomonas aeruginosa PA01
gccgccgaccgg

SEQ ID NO: 3502731 - RNA, 23 nt, Pseudomonas aeruginosa PA01
gccgccgaccgggcgggucuggc

SEQ ID NO: 3502732 - RNA, 16 nt, Pseudomonas aeruginosa PA01
gccgccgaccucggcc

SEQ ID NO: 3502733 - RNA, 16 nt, Pseudomonas aeruginosa PA01
gccgccgacgccaugg

SEQ ID NO: 3502734 - RNA, 22 nt, Pseudomonas aeruginosa PA01
gccgccgagaacccggccaggc

SEQ ID NO: 3502735 - RNA, 23 nt, Pseudomonas aeruginosa PA01
gccgccgagaacccggccaggcc

SEQ ID NO: 3502736 - RNA, 17 nt, Pseudomonas aeruginosa PA01
gccgccgagcaacugca

SEQ ID NO: 3502737 - RNA, 13 nt, Pseudomonas aeruginosa PA01
gccgccgagcagg

SEQ ID NO: 3502738 - RNA, 15 nt, Pseudomonas aeruginosa PA01
gccgccgagcaggcc

SEQ ID NO: 3502739 - RNA, 18 nt, Pseudomonas aeruginosa PA01
gccgccgagcaugcgggc

SEQ ID NO: 3502740 - RNA, 21 nt, Pseudomonas aeruginosa PA01
gccgccgagcaugcgggcgau

SEQ ID NO: 3502741 - RNA, 23 nt, Pseudomonas aeruginosa PA01
gccgccgagcaugcgggcgaucu

SEQ ID NO: 3502742 - RNA, 15 nt, Pseudomonas aeruginosa PA01
gccgccgagcgccug

SEQ ID NO: 3502743 - RNA, 16 nt, Pseudomonas aeruginosa PA01
gccgccgagcgccugg

SEQ ID NO: 3502744 - RNA, 17 nt, Pseudomonas aeruginosa PA01
gccgccgagcgccuggc

SEQ ID NO: 3502745 - RNA, 14 nt, Pseudomonas aeruginosa PA01
gccgccgaggagga

SEQ ID NO: 3502746 - RNA, 23 nt, Pseudomonas aeruginosa PA01
gccgccgaggauagcguccagcu

SEQ ID NO: 3502747 - RNA, 13 nt, Pseudomonas aeruginosa PA01
gccgccgaggcgc

SEQ ID NO: 3502748 - RNA, 16 nt, Pseudomonas aeruginosa PA01
gccgccgaggcgcgcc

SEQ ID NO: 3502749 - RNA, 17 nt, Pseudomonas aeruginosa PA01
gccgccgaggcgcgcca

SEQ ID NO: 3502750 - RNA, 21 nt, Pseudomonas aeruginosa PA01
gccgccgaggcgcgccacgca

SEQ ID NO: 3502751 - RNA, 12 nt, Pseudomonas aeruginosa PA01
gccgccgagggc

SEQ ID NO: 3502752 - RNA, 14 nt, Pseudomonas aeruginosa PA01
gccgccgagggcac

SEQ ID NO: 3502753 - RNA, 15 nt, Pseudomonas aeruginosa PA01
gccgccgagggcacc

SEQ ID NO: 3502754 - RNA, 16 nt, Pseudomonas aeruginosa PA01
gccgccgagggcaccg

SEQ ID NO: 3502755 - RNA, 15 nt, Pseudomonas aeruginosa PA01
gccgccgaggugcgg

SEQ ID NO: 3502756 - RNA, 21 nt, Pseudomonas aeruginosa PA01
gccgccgaggugcggcuugcg

SEQ ID NO: 3502757 - RNA, 15 nt, Pseudomonas aeruginosa PA01
gccgccgagguugcg

SEQ ID NO: 3502758 - RNA, 19 nt, Pseudomonas aeruginosa PA01
gccgccgagguugcgcagg

SEQ ID NO: 3502759 - RNA, 18 nt, Pseudomonas aeruginosa PA01
gccgccgagugugccggc

SEQ ID NO: 3502760 - RNA, 19 nt, Pseudomonas aeruginosa PA01
gccgccgagugugccggcc

SEQ ID NO: 3502761 - RNA, 19 nt, Pseudomonas aeruginosa PA01
gccgccgauagggaaacac

SEQ ID NO: 3502762 - RNA, 15 nt, Pseudomonas aeruginosa PA01
gccgccgaucagcgc

SEQ ID NO: 3502763 - RNA, 19 nt, Pseudomonas aeruginosa PA01
gccgccgaucagcgcgccu

SEQ ID NO: 3502764 - RNA, 21 nt, Pseudomonas aeruginosa PA01
gccgccgaucagcgcgccuuc

SEQ ID NO: 3502765 - RNA, 23 nt, Pseudomonas aeruginosa PA01
gccgccgauccaggaaccggcca

SEQ ID NO: 3502766 - RNA, 17 nt, Pseudomonas aeruginosa PA01
gccgccgaucugcuggg

SEQ ID NO: 3502767 - RNA, 15 nt, Pseudomonas aeruginosa PA01
gccgccgaugccgac

SEQ ID NO: 3502768 - RNA, 20 nt, Pseudomonas aeruginosa PA01
gccgccgaugcuguucagca

SEQ ID NO: 3502769 - RNA, 17 nt, Pseudomonas aeruginosa PA01
gccgccgcagagccagc

SEQ ID NO: 3502770 - RNA, 20 nt, Pseudomonas aeruginosa PA01
gccgccgcagagccagccgc

SEQ ID NO: 3502771 - RNA, 13 nt, Pseudomonas aeruginosa PA01
gccgccgcagccg

SEQ ID NO: 3502772 - RNA, 18 nt, Pseudomonas aeruginosa PA01
gccgccgcagccguggcg

SEQ ID NO: 3502773 - RNA, 13 nt, Pseudomonas aeruginosa PA01
gccgccgcccagc

SEQ ID NO: 3502774 - RNA, 14 nt, Pseudomonas aeruginosa PA01
gccgccgcccagca

SEQ ID NO: 3502775 - RNA, 16 nt, Pseudomonas aeruginosa PA01
gccgccgcccagcagc

SEQ ID NO: 3502776 - RNA, 19 nt, Pseudomonas aeruginosa PA01
gccgccgcccagcagcacc

SEQ ID NO: 3502777 - RNA, 14 nt, Pseudomonas aeruginosa PA01
gccgccgccccagc

SEQ ID NO: 3502778 - RNA, 15 nt, Pseudomonas aeruginosa PA01
gccgccgccccagca

SEQ ID NO: 3502779 - RNA, 17 nt, Pseudomonas aeruginosa PA01
gccgccgccccagcaac

SEQ ID NO: 3502780 - RNA, 13 nt, Pseudomonas aeruginosa PA01
gccgccgccgaga

SEQ ID NO: 3502781 - RNA, 14 nt, Pseudomonas aeruginosa PA01
gccgccgccgcccc

SEQ ID NO: 3502782 - RNA, 15 nt, Pseudomonas aeruginosa PA01
gccgccgccgcccca

SEQ ID NO: 3502783 - RNA, 17 nt, Pseudomonas aeruginosa PA01
gccgccgccgccccagc

SEQ ID NO: 3502784 - RNA, 17 nt, Pseudomonas aeruginosa PA01
gccgccgccgccgucga

SEQ ID NO: 3502785 - RNA, 13 nt, Pseudomonas aeruginosa PA01
gccgccgccgcgg

SEQ ID NO: 3502786 - RNA, 14 nt, Pseudomonas aeruginosa PA01
gccgccgccgcggu

SEQ ID NO: 3502787 - RNA, 14 nt, Pseudomonas aeruginosa PA01
gccgccgccgucga

SEQ ID NO: 3502788 - RNA, 13 nt, Pseudomonas aeruginosa PA01
gccgccgcgcagc

SEQ ID NO: 3502789 - RNA, 14 nt, Pseudomonas aeruginosa PA01
gccgccgcgcaggc

SEQ ID NO: 3502790 - RNA, 16 nt, Pseudomonas aeruginosa PA01
gccgccgcgcaggcgg

SEQ ID NO: 3502791 - RNA, 14 nt, Pseudomonas aeruginosa PA01
gccgccgcgcccgg

SEQ ID NO: 3502792 - RNA, 12 nt, Pseudomonas aeruginosa PA01
gccgccgcgccg

SEQ ID NO: 3502793 - RNA, 13 nt, Pseudomonas aeruginosa PA01
gccgccgcgccgg

SEQ ID NO: 3502794 - RNA, 14 nt, Pseudomonas aeruginosa PA01
gccgccgcgccggc

SEQ ID NO: 3502795 - RNA, 15 nt, Pseudomonas aeruginosa PA01
gccgccgcgccggcg

SEQ ID NO: 3502796 - RNA, 16 nt, Pseudomonas aeruginosa PA01
gccgccgcgccggcga

SEQ ID NO: 3502797 - RNA, 11 nt, Pseudomonas aeruginosa PA01
gccgccgcgcg

SEQ ID NO: 3502798 - RNA, 13 nt, Pseudomonas aeruginosa PA01
gccgccgcgcgcg

SEQ ID NO: 3502799 - RNA, 13 nt, Pseudomonas aeruginosa PA01
gccgccgcgcugc

SEQ ID NO: 3502800 - RNA, 14 nt, Pseudomonas aeruginosa PA01
gccgccgcgcugca

SEQ ID NO: 3502801 - RNA, 15 nt, Pseudomonas aeruginosa PA01
gccgccgcgcugcag

SEQ ID NO: 3502802 - RNA, 20 nt, Pseudomonas aeruginosa PA01
gccgccgcgcugcaggcggu

SEQ ID NO: 3502803 - RNA, 14 nt, Pseudomonas aeruginosa PA01
gccgccgcggcacc

SEQ ID NO: 3502804 - RNA, 18 nt, Pseudomonas aeruginosa PA01
gccgccgcggcaccggcg

SEQ ID NO: 3502805 - RNA, 16 nt, Pseudomonas aeruginosa PA01
gccgccgcggccagcc

SEQ ID NO: 3502806 - RNA, 17 nt, Pseudomonas aeruginosa PA01
gccgccgcggccagccc

SEQ ID NO: 3502807 - RNA, 20 nt, Pseudomonas aeruginosa PA01
gccgccgcggccagcccccu

SEQ ID NO: 3502808 - RNA, 14 nt, Pseudomonas aeruginosa PA01
gccgccgcggcgcg

SEQ ID NO: 3502809 - RNA, 13 nt, Pseudomonas aeruginosa PA01
gccgccgcgggca

SEQ ID NO: 3502810 - RNA, 21 nt, Pseudomonas aeruginosa PA01
gccgccgcgggcgaacggcag

SEQ ID NO: 3502811 - RNA, 12 nt, Pseudomonas aeruginosa PA01
gccgccgcgguc

SEQ ID NO: 3502812 - RNA, 17 nt, Pseudomonas aeruginosa PA01
gccgccgcgucgucggc

SEQ ID NO: 3502813 - RNA, 14 nt, Pseudomonas aeruginosa PA01
gccgccgcgugccg

SEQ ID NO: 3502814 - RNA, 12 nt, Pseudomonas aeruginosa PA01
gccgccgcugca

SEQ ID NO: 3502815 - RNA, 13 nt, Pseudomonas aeruginosa PA01
gccgccgcuggcc

SEQ ID NO: 3502816 - RNA, 15 nt, Pseudomonas aeruginosa PA01
gccgccgcuggccug

SEQ ID NO: 3502817 - RNA, 21 nt, Pseudomonas aeruginosa PA01
gccgccgcuggccuggccacc

SEQ ID NO: 3502818 - RNA, 14 nt, Pseudomonas aeruginosa PA01
gccgccgcuggcga

SEQ ID NO: 3502819 - RNA, 21 nt, Pseudomonas aeruginosa PA01
gccgccggagagcgaauacac

SEQ ID NO: 3502820 - RNA, 13 nt, Pseudomonas aeruginosa PA01
gccgccggaggga

SEQ ID NO: 3502821 - RNA, 11 nt, Pseudomonas aeruginosa PA01
gccgccggcau

SEQ ID NO: 3502822 - RNA, 20 nt, Pseudomonas aeruginosa PA01
gccgccggccaccagcagca

SEQ ID NO: 3502823 - RNA, 12 nt, Pseudomonas aeruginosa PA01
gccgccggccag

SEQ ID NO: 3502824 - RNA, 13 nt, Pseudomonas aeruginosa PA01
gccgccggccagc

SEQ ID NO: 3502825 - RNA, 14 nt, Pseudomonas aeruginosa PA01
gccgccggccagcc

SEQ ID NO: 3502826 - RNA, 16 nt, Pseudomonas aeruginosa PA01
gccgccggccagccgc

SEQ ID NO: 3502827 - RNA, 19 nt, Pseudomonas aeruginosa PA01
gccgccggccagccgcgcc

SEQ ID NO: 3502828 - RNA, 13 nt, Pseudomonas aeruginosa PA01
gccgccggccugc

SEQ ID NO: 3502829 - RNA, 13 nt, Pseudomonas aeruginosa PA01
gccgccggcgacc

SEQ ID NO: 3502830 - RNA, 15 nt, Pseudomonas aeruginosa PA01
gccgccggcgaccgc

SEQ ID NO: 3502831 - RNA, 14 nt, Pseudomonas aeruginosa PA01
gccgccggcgcccu

SEQ ID NO: 3502832 - RNA, 18 nt, Pseudomonas aeruginosa PA01
gccgccggcgcccugcuc

SEQ ID NO: 3502833 - RNA, 14 nt, Pseudomonas aeruginosa PA01
gccgccggcgccgc

SEQ ID NO: 3502834 - RNA, 16 nt, Pseudomonas aeruginosa PA01
gccgccggcgccgccg

SEQ ID NO: 3502835 - RNA, 14 nt, Pseudomonas aeruginosa PA01
gccgccggcggcca

SEQ ID NO: 3502836 - RNA, 15 nt, Pseudomonas aeruginosa PA01
gccgccggcggccag

SEQ ID NO: 3502837 - RNA, 20 nt, Pseudomonas aeruginosa PA01
gccgccgggcaucaugccga

SEQ ID NO: 3502838 - RNA, 22 nt, Pseudomonas aeruginosa PA01
gccgccgggcaucaugccgagc

SEQ ID NO: 3502839 - RNA, 23 nt, Pseudomonas aeruginosa PA01
gccgccgggcaucaugccgagca

SEQ ID NO: 3502840 - RNA, 14 nt, Pseudomonas aeruginosa PA01
gccgccgggcgccc

SEQ ID NO: 3502841 - RNA, 15 nt, Pseudomonas aeruginosa PA01
gccgccgggcgcccg

SEQ ID NO: 3502842 - RNA, 16 nt, Pseudomonas aeruginosa PA01
gccgccgggcgcccgg

SEQ ID NO: 3502843 - RNA, 18 nt, Pseudomonas aeruginosa PA01
gccgccgggcgcccggcc

SEQ ID NO: 3502844 - RNA, 19 nt, Pseudomonas aeruginosa PA01
gccgccgggcgcccggccg

SEQ ID NO: 3502845 - RNA, 13 nt, Pseudomonas aeruginosa PA01
gccgccgggcgcg

SEQ ID NO: 3502846 - RNA, 19 nt, Pseudomonas aeruginosa PA01
gccgccgggcgcgcgccuc

SEQ ID NO: 3502847 - RNA, 17 nt, Pseudomonas aeruginosa PA01
gccgccgggcggcgucg

SEQ ID NO: 3502848 - RNA, 14 nt, Pseudomonas aeruginosa PA01
gccgccggggauca

SEQ ID NO: 3502849 - RNA, 18 nt, Pseudomonas aeruginosa PA01
gccgccggggaucagcga

SEQ ID NO: 3502850 - RNA, 15 nt, Pseudomonas aeruginosa PA01
gccgccggggcgcag

SEQ ID NO: 3502851 - RNA, 20 nt, Pseudomonas aeruginosa PA01
gccgccggggcgggccgcgc

SEQ ID NO: 3502852 - RNA, 21 nt, Pseudomonas aeruginosa PA01
gccgccggggcgggccgcgcc

SEQ ID NO: 3502853 - RNA, 13 nt, Pseudomonas aeruginosa PA01
gccgccgguagcc

SEQ ID NO: 3502854 - RNA, 19 nt, Pseudomonas aeruginosa PA01
gccgccggucuucacgccu

SEQ ID NO: 3502855 - RNA, 17 nt, Pseudomonas aeruginosa PA01
gccgccggugcaccagg

SEQ ID NO: 3502856 - RNA, 18 nt, Pseudomonas aeruginosa PA01
gccgccggugcaccaggc

SEQ ID NO: 3502857 - RNA, 20 nt, Pseudomonas aeruginosa PA01
gccgccggugcaccaggcga

SEQ ID NO: 3502858 - RNA, 23 nt, Pseudomonas aeruginosa PA01
gccgccggugcaccaggcgaugc

SEQ ID NO: 3502859 - RNA, 24 nt, Pseudomonas aeruginosa PA01
gccgccggugcaccaggcgaugcg

SEQ ID NO: 3502860 - RNA, 18 nt, Pseudomonas aeruginosa PA01
gccgccgguucgcaggcc

SEQ ID NO: 3502861 - RNA, 19 nt, Pseudomonas aeruginosa PA01
gccgccgguucgcaggcca

SEQ ID NO: 3502862 - RNA, 21 nt, Pseudomonas aeruginosa PA01
gccgccgguucgcaggccagg

SEQ ID NO: 3502863 - RNA, 23 nt, Pseudomonas aeruginosa PA01
gccgccgguucgcaggccaggcg

SEQ ID NO: 3502864 - RNA, 15 nt, Pseudomonas aeruginosa PA01
gccgccguacaggcc

SEQ ID NO: 3502865 - RNA, 16 nt, Pseudomonas aeruginosa PA01
gccgccguacaggcca

SEQ ID NO: 3502866 - RNA, 17 nt, Pseudomonas aeruginosa PA01
gccgccguacaggccac

SEQ ID NO: 3502867 - RNA, 12 nt, Pseudomonas aeruginosa PA01
gccgccguccug

SEQ ID NO: 3502868 - RNA, 21 nt, Pseudomonas aeruginosa PA01
gccgccgucgacuugccgauc

SEQ ID NO: 3502869 - RNA, 22 nt, Pseudomonas aeruginosa PA01
gccgccgucgacuugccgauca

SEQ ID NO: 3502870 - RNA, 14 nt, Pseudomonas aeruginosa PA01
gccgccgucgcggc

SEQ ID NO: 3502871 - RNA, 15 nt, Pseudomonas aeruginosa PA01
gccgccgucgcggcc

SEQ ID NO: 3502872 - RNA, 16 nt, Pseudomonas aeruginosa PA01
gccgccgucgcggcca

SEQ ID NO: 3502873 - RNA, 17 nt, Pseudomonas aeruginosa PA01
gccgccgucgcggccau

SEQ ID NO: 3502874 - RNA, 22 nt, Pseudomonas aeruginosa PA01
gccgccgucggacucgacguca

SEQ ID NO: 3502875 - RNA, 15 nt, Pseudomonas aeruginosa PA01
gccgccgucuccgcc

SEQ ID NO: 3502876 - RNA, 20 nt, Pseudomonas aeruginosa PA01
gccgccgucuccgccgcuau

SEQ ID NO: 3502877 - RNA, 17 nt, Pseudomonas aeruginosa PA01
gccgccgucuugccgcu

SEQ ID NO: 3502878 - RNA, 18 nt, Pseudomonas aeruginosa PA01
gccgccgucuugccgcug

SEQ ID NO: 3502879 - RNA, 19 nt, Pseudomonas aeruginosa PA01
gccgccgucuugccgcugc

SEQ ID NO: 3502880 - RNA, 16 nt, Pseudomonas aeruginosa PA01
gccgccgugaucucga

SEQ ID NO: 3502881 - RNA, 21 nt, Pseudomonas aeruginosa PA01
gccgccgugaucucgaacucg

SEQ ID NO: 3502882 - RNA, 18 nt, Pseudomonas aeruginosa PA01
gccgccguggcugugcug

SEQ ID NO: 3502883 - RNA, 23 nt, Pseudomonas aeruginosa PA01
gccgccguggcugugcuggccac

SEQ ID NO: 3502884 - RNA, 21 nt, Pseudomonas aeruginosa PA01
gccgccguguaaugacuccgg

SEQ ID NO: 3502885 - RNA, 21 nt, Pseudomonas aeruginosa PA01
gccgccguucucauugcgccg

SEQ ID NO: 3502886 - RNA, 22 nt, Pseudomonas aeruginosa PA01
gccgccguucucauugcgccgc

SEQ ID NO: 3502887 - RNA, 17 nt, Pseudomonas aeruginosa PA01
gccgccguugaggaagu

SEQ ID NO: 3502888 - RNA, 16 nt, Pseudomonas aeruginosa PA01
gccgccguugaugacg

SEQ ID NO: 3502889 - RNA, 18 nt, Pseudomonas aeruginosa PA01
gccgccguugaugacgaa

SEQ ID NO: 3502890 - RNA, 22 nt, Pseudomonas aeruginosa PA01
gccgccguugaugacgaacugc

SEQ ID NO: 3502891 - RNA, 22 nt, Pseudomonas aeruginosa PA01
gccgccuauccgugacgucggc

SEQ ID NO: 3502892 - RNA, 18 nt, Pseudomonas aeruginosa PA01
gccgccucgaaggccggc

SEQ ID NO: 3502893 - RNA, 16 nt, Pseudomonas aeruginosa PA01
gccgccucgcgcaacg

SEQ ID NO: 3502894 - RNA, 19 nt, Pseudomonas aeruginosa PA01
gccgccucgcgcaacgccu

SEQ ID NO: 3502895 - RNA, 23 nt, Pseudomonas aeruginosa PA01
gccgccucgcgcaacgccuugcc

SEQ ID NO: 3502896 - RNA, 15 nt, Pseudomonas aeruginosa PA01
gccgccucgcgccgc

SEQ ID NO: 3502897 - RNA, 18 nt, Pseudomonas aeruginosa PA01
gccgccucgcgccgcgcc

SEQ ID NO: 3502898 - RNA, 19 nt, Pseudomonas aeruginosa PA01
gccgccucgcgccgcgcca

SEQ ID NO: 3502899 - RNA, 24 nt, Pseudomonas aeruginosa PA01
gccgccucgcugggcgggcguccg

SEQ ID NO: 3502900 - RNA, 16 nt, Pseudomonas aeruginosa PA01
gccgccucgggcagcc

SEQ ID NO: 3502901 - RNA, 17 nt, Pseudomonas aeruginosa PA01
gccgccucgggcagccc

SEQ ID NO: 3502902 - RNA, 21 nt, Pseudomonas aeruginosa PA01
gccgccucuaugaaccggggc

SEQ ID NO: 3502903 - RNA, 22 nt, Pseudomonas aeruginosa PA01
gccgccucuaugaaccggggcg

SEQ ID NO: 3502904 - RNA, 16 nt, Pseudomonas aeruginosa PA01
gccgccugcgccucgg

SEQ ID NO: 3502905 - RNA, 18 nt, Pseudomonas aeruginosa PA01
gccgccugcgccucggcc

SEQ ID NO: 3502906 - RNA, 18 nt, Pseudomonas aeruginosa PA01
gccgccugcggcuugccc

SEQ ID NO: 3502907 - RNA, 19 nt, Pseudomonas aeruginosa PA01
gccgccugcggcuugcccu

SEQ ID NO: 3502908 - RNA, 23 nt, Pseudomonas aeruginosa PA01
gccgccugcggcuugcccugcuc

SEQ ID NO: 3502909 - RNA, 15 nt, Pseudomonas aeruginosa PA01
gccgccugcucgccg

SEQ ID NO: 3502910 - RNA, 21 nt, Pseudomonas aeruginosa PA01
gccgccugcucgccgcugaag

SEQ ID NO: 3502911 - RNA, 15 nt, Pseudomonas aeruginosa PA01
gccgccugcucggcc

SEQ ID NO: 3502912 - RNA, 17 nt, Pseudomonas aeruginosa PA01
gccgccugcucggccug

SEQ ID NO: 3502913 - RNA, 15 nt, Pseudomonas aeruginosa PA01
gccgccugcuggcug

SEQ ID NO: 3502914 - RNA, 19 nt, Pseudomonas aeruginosa PA01
gccgccugcuggcugccca

SEQ ID NO: 3502915 - RNA, 13 nt, Pseudomonas aeruginosa PA01
gccgccuggccgg

SEQ ID NO: 3502916 - RNA, 15 nt, Pseudomonas aeruginosa PA01
gccgccuggccggcc

SEQ ID NO: 3502917 - RNA, 16 nt, Pseudomonas aeruginosa PA01
gccgccuggccggcca

SEQ ID NO: 3502918 - RNA, 17 nt, Pseudomonas aeruginosa PA01
gccgccuggccggccag

SEQ ID NO: 3502919 - RNA, 21 nt, Pseudomonas aeruginosa PA01
gccgccuggccggccagccag

SEQ ID NO: 3502920 - RNA, 13 nt, Pseudomonas aeruginosa PA01
gccgccuggcgca

SEQ ID NO: 3502921 - RNA, 20 nt, Pseudomonas aeruginosa PA01
gccgccuggcgcauggcgcu

SEQ ID NO: 3502922 - RNA, 18 nt, Pseudomonas aeruginosa PA01
gccgccuggcgugccgcc

SEQ ID NO: 3502923 - RNA, 19 nt, Pseudomonas aeruginosa PA01
gccgccuggcgugccgcca

SEQ ID NO: 3502924 - RNA, 23 nt, Pseudomonas aeruginosa PA01
gccgccuggcgugccgccaggcc

SEQ ID NO: 3502925 - RNA, 13 nt, Pseudomonas aeruginosa PA01
gccgccugggccg

SEQ ID NO: 3502926 - RNA, 17 nt, Pseudomonas aeruginosa PA01
gccgccugggccgccuc

SEQ ID NO: 3502927 - RNA, 21 nt, Pseudomonas aeruginosa PA01
gccgccuggguggcgacgaag

SEQ ID NO: 3502928 - RNA, 16 nt, Pseudomonas aeruginosa PA01
gccgccuggucggggc

SEQ ID NO: 3502929 - RNA, 19 nt, Pseudomonas aeruginosa PA01
gccgccuggucggggccgg

SEQ ID NO: 3502930 - RNA, 22 nt, Pseudomonas aeruginosa PA01
gccgccuggucggggccggcga

SEQ ID NO: 3502931 - RNA, 15 nt, Pseudomonas aeruginosa PA01
gccgccuggugcccg

SEQ ID NO: 3502932 - RNA, 20 nt, Pseudomonas aeruginosa PA01
gccgccuggugcccgaugcc

SEQ ID NO: 3502933 - RNA, 21 nt, Pseudomonas aeruginosa PA01
gccgccuggugcccgaugccg

SEQ ID NO: 3502934 - RNA, 22 nt, Pseudomonas aeruginosa PA01
gccgccuggugcccgaugccgc

SEQ ID NO: 3502935 - RNA, 13 nt, Pseudomonas aeruginosa PA01
gccgccuuccucg

SEQ ID NO: 3502936 - RNA, 14 nt, Pseudomonas aeruginosa PA01
gccgccuuccucgg

SEQ ID NO: 3502937 - RNA, 16 nt, Pseudomonas aeruginosa PA01
gccgccuuccucggcc

SEQ ID NO: 3502938 - RNA, 17 nt, Pseudomonas aeruginosa PA01
gccgccuuccucggccg

SEQ ID NO: 3502939 - RNA, 18 nt, Pseudomonas aeruginosa PA01
gccgccuuccucggccgc

SEQ ID NO: 3502940 - RNA, 22 nt, Pseudomonas aeruginosa PA01
gccgccuuccucggccgccagg

SEQ ID NO: 3502941 - RNA, 13 nt, Pseudomonas aeruginosa PA01
gccgccuucggca

SEQ ID NO: 3502942 - RNA, 14 nt, Pseudomonas aeruginosa PA01
gccgccuucggcag

SEQ ID NO: 3502943 - RNA, 15 nt, Pseudomonas aeruginosa PA01
gccgccuucggcagg

SEQ ID NO: 3502944 - RNA, 19 nt, Pseudomonas aeruginosa PA01
gccgccuucggcaggaccu

SEQ ID NO: 3502945 - RNA, 21 nt, Pseudomonas aeruginosa PA01
gccgccuucggcaggaccucg

SEQ ID NO: 3502946 - RNA, 22 nt, Pseudomonas aeruginosa PA01
gccgccuucggcaggaccucgg

SEQ ID NO: 3502947 - RNA, 17 nt, Pseudomonas aeruginosa PA01
gccgccuucgggcggcu

SEQ ID NO: 3502948 - RNA, 20 nt, Pseudomonas aeruginosa PA01
gccgccuugaccugcugggc

SEQ ID NO: 3502949 - RNA, 20 nt, Pseudomonas aeruginosa PA01
gccgccuugagcggcgcccu

SEQ ID NO: 3502950 - RNA, 16 nt, Pseudomonas aeruginosa PA01
gccgccuugcgcagca

SEQ ID NO: 3502951 - RNA, 23 nt, Pseudomonas aeruginosa PA01
gccgccuugcguaccagcgcgca

SEQ ID NO: 3502952 - RNA, 16 nt, Pseudomonas aeruginosa PA01
gccgccuugcucgacc

SEQ ID NO: 3502953 - RNA, 18 nt, Pseudomonas aeruginosa PA01
gccgccuugcucgacccg

SEQ ID NO: 3502954 - RNA, 19 nt, Pseudomonas aeruginosa PA01
gccgccuugcucgacccgg

SEQ ID NO: 3502955 - RNA, 20 nt, Pseudomonas aeruginosa PA01
gccgccuugcucgacccggu

SEQ ID NO: 3502956 - RNA, 19 nt, Pseudomonas aeruginosa PA01
gccgcgaacacacccugcg

SEQ ID NO: 3502957 - RNA, 20 nt, Pseudomonas aeruginosa PA01
gccgcgaacacacccugcgc

SEQ ID NO: 3502958 - RNA, 15 nt, Pseudomonas aeruginosa PA01
gccgcgaagcccagc

SEQ ID NO: 3502959 - RNA, 19 nt, Pseudomonas aeruginosa PA01
gccgcgaagcccagcgccg

SEQ ID NO: 3502960 - RNA, 20 nt, Pseudomonas aeruginosa PA01
gccgcgaagcccagcgccgc

SEQ ID NO: 3502961 - RNA, 21 nt, Pseudomonas aeruginosa PA01
gccgcgacaggauggacagcu

SEQ ID NO: 3502962 - RNA, 22 nt, Pseudomonas aeruginosa PA01
gccgcgaccgaagccgcgcagc

SEQ ID NO: 3502963 - RNA, 13 nt, Pseudomonas aeruginosa PA01
gccgcgaccgggc

SEQ ID NO: 3502964 - RNA, 14 nt, Pseudomonas aeruginosa PA01
gccgcgaccgggca

SEQ ID NO: 3502965 - RNA, 22 nt, Pseudomonas aeruginosa PA01
gccgcgaccgggcaugccgugg

SEQ ID NO: 3502966 - RNA, 12 nt, Pseudomonas aeruginosa PA01
gccgcgaccucg

SEQ ID NO: 3502967 - RNA, 16 nt, Pseudomonas aeruginosa PA01
gccgcgaccucguugc

SEQ ID NO: 3502968 - RNA, 15 nt, Pseudomonas aeruginosa PA01
gccgcgaccugcucg

SEQ ID NO: 3502969 - RNA, 20 nt, Pseudomonas aeruginosa PA01
gccgcgaccugcucgucgau

SEQ ID NO: 3502970 - RNA, 14 nt, Pseudomonas aeruginosa PA01
gccgcgacgacugc

SEQ ID NO: 3502971 - RNA, 16 nt, Pseudomonas aeruginosa PA01
gccgcgacgacugcgg

SEQ ID NO: 3502972 - RNA, 14 nt, Pseudomonas aeruginosa PA01
gccgcgacgcgacc

SEQ ID NO: 3502973 - RNA, 16 nt, Pseudomonas aeruginosa PA01
gccgcgacgcuccagc

SEQ ID NO: 3502974 - RNA, 17 nt, Pseudomonas aeruginosa PA01
gccgcgacgcuccagcg

SEQ ID NO: 3502975 - RNA, 15 nt, Pseudomonas aeruginosa PA01
gccgcgacggcugcu

SEQ ID NO: 3502976 - RNA, 15 nt, Pseudomonas aeruginosa PA01
gccgcgacucggcug

SEQ ID NO: 3502977 - RNA, 16 nt, Pseudomonas aeruginosa PA01
gccgcgacucggcugc

SEQ ID NO: 3502978 - RNA, 18 nt, Pseudomonas aeruginosa PA01
gccgcgacucggcugcaa

SEQ ID NO: 3502979 - RNA, 13 nt, Pseudomonas aeruginosa PA01
gccgcgagccagc

SEQ ID NO: 3502980 - RNA, 15 nt, Pseudomonas aeruginosa PA01
gccgcgagccagccg

SEQ ID NO: 3502981 - RNA, 14 nt, Pseudomonas aeruginosa PA01
gccgcgagccuuca

SEQ ID NO: 3502982 - RNA, 20 nt, Pseudomonas aeruginosa PA01
gccgcgagcgaaacggcgcu

SEQ ID NO: 3502983 - RNA, 15 nt, Pseudomonas aeruginosa PA01
gccgcgagcgccgcc

SEQ ID NO: 3502984 - RNA, 17 nt, Pseudomonas aeruginosa PA01
gccgcgagcgccgccgg

SEQ ID NO: 3502985 - RNA, 13 nt, Pseudomonas aeruginosa PA01
gccgcgagcgcgg

SEQ ID NO: 3502986 - RNA, 17 nt, Pseudomonas aeruginosa PA01
gccgcgagcgcggccgg

SEQ ID NO: 3502987 - RNA, 19 nt, Pseudomonas aeruginosa PA01
gccgcgagcgcggccggcc

SEQ ID NO: 3502988 - RNA, 20 nt, Pseudomonas aeruginosa PA01
gccgcgagcgcggccggcca

SEQ ID NO: 3502989 - RNA, 21 nt, Pseudomonas aeruginosa PA01
gccgcgagcgcggccggccac

SEQ ID NO: 3502990 - RNA, 15 nt, Pseudomonas aeruginosa PA01
gccgcgagcuuggcc

SEQ ID NO: 3502991 - RNA, 18 nt, Pseudomonas aeruginosa PA01
gccgcgagcuuggcccug

SEQ ID NO: 3502992 - RNA, 20 nt, Pseudomonas aeruginosa PA01
gccgcgagcuuggcccuggc

SEQ ID NO: 3502993 - RNA, 22 nt, Pseudomonas aeruginosa PA01
gccgcgagcuuggcccuggccu

SEQ ID NO: 3502994 - RNA, 13 nt, Pseudomonas aeruginosa PA01
gccgcgaggacaa

SEQ ID NO: 3502995 - RNA, 16 nt, Pseudomonas aeruginosa PA01
gccgcgagguccggcu

SEQ ID NO: 3502996 - RNA, 20 nt, Pseudomonas aeruginosa PA01
gccgcgagguccggcuccgg

SEQ ID NO: 3502997 - RNA, 13 nt, Pseudomonas aeruginosa PA01
gccgcgaggugga

SEQ ID NO: 3502998 - RNA, 19 nt, Pseudomonas aeruginosa PA01
gccgcgaguccuucggcgc

SEQ ID NO: 3502999 - RNA, 20 nt, Pseudomonas aeruginosa PA01
gccgcgaguccuucggcgca

SEQ ID NO: 3503000 - RNA, 17 nt, Pseudomonas aeruginosa PA01
gccgcgauauucgcccu

SEQ ID NO: 3503001 - RNA, 12 nt, Pseudomonas aeruginosa PA01
gccgcgauggcu

SEQ ID NO: 3503002 - RNA, 13 nt, Pseudomonas aeruginosa PA01
gccgcgauggcuc

SEQ ID NO: 3503003 - RNA, 16 nt, Pseudomonas aeruginosa PA01
gccgcgauggcucgcg

SEQ ID NO: 3503004 - RNA, 20 nt, Pseudomonas aeruginosa PA01
gccgcgcaaccguuccagcg

SEQ ID NO: 3503005 - RNA, 18 nt, Pseudomonas aeruginosa PA01
gccgcgcaagcucgucac

SEQ ID NO: 3503006 - RNA, 22 nt, Pseudomonas aeruginosa PA01
gccgcgcaaggcagcguccgaa

SEQ ID NO: 3503007 - RNA, 21 nt, Pseudomonas aeruginosa PA01
gccgcgcacaaaaaagcccgc

SEQ ID NO: 3503008 - RNA, 22 nt, Pseudomonas aeruginosa PA01
gccgcgcacaaaaaagcccgcc

SEQ ID NO: 3503009 - RNA, 23 nt, Pseudomonas aeruginosa PA01
gccgcgcacaaaaaagcccgcca

SEQ ID NO: 3503010 - RNA, 15 nt, Pseudomonas aeruginosa PA01
gccgcgcaccaccga

SEQ ID NO: 3503011 - RNA, 14 nt, Pseudomonas aeruginosa PA01
gccgcgcaccagca

SEQ ID NO: 3503012 - RNA, 17 nt, Pseudomonas aeruginosa PA01
gccgcgcaccucgaccg

SEQ ID NO: 3503013 - RNA, 18 nt, Pseudomonas aeruginosa PA01
gccgcgcaccucgaccgc

SEQ ID NO: 3503014 - RNA, 20 nt, Pseudomonas aeruginosa PA01
gccgcgcaccucgaccgcgc

SEQ ID NO: 3503015 - RNA, 21 nt, Pseudomonas aeruginosa PA01
gccgcgcaccucgaccgcgcc

SEQ ID NO: 3503016 - RNA, 23 nt, Pseudomonas aeruginosa PA01
gccgcgcaccucgaccgcgccgg

SEQ ID NO: 3503017 - RNA, 13 nt, Pseudomonas aeruginosa PA01
gccgcgcaccugg

SEQ ID NO: 3503018 - RNA, 14 nt, Pseudomonas aeruginosa PA01
gccgcgcaccuggg

SEQ ID NO: 3503019 - RNA, 16 nt, Pseudomonas aeruginosa PA01
gccgcgcaccugggcg

SEQ ID NO: 3503020 - RNA, 22 nt, Pseudomonas aeruginosa PA01
gccgcgcacgucgagguagaac

SEQ ID NO: 3503021 - RNA, 19 nt, Pseudomonas aeruginosa PA01
gccgcgcacuuguagagga

SEQ ID NO: 3503022 - RNA, 14 nt, Pseudomonas aeruginosa PA01
gccgcgcagcacca

SEQ ID NO: 3503023 - RNA, 14 nt, Pseudomonas aeruginosa PA01
gccgcgcagcagua

SEQ ID NO: 3503024 - RNA, 22 nt, Pseudomonas aeruginosa PA01
gccgcgcagcaguaccuggcgg

SEQ ID NO: 3503025 - RNA, 14 nt, Pseudomonas aeruginosa PA01
gccgcgcagcgcgg

SEQ ID NO: 3503026 - RNA, 12 nt, Pseudomonas aeruginosa PA01
gccgcgcagcuu

SEQ ID NO: 3503027 - RNA, 22 nt, Pseudomonas aeruginosa PA01
gccgcgcagcuugccuuccagg

SEQ ID NO: 3503028 - RNA, 17 nt, Pseudomonas aeruginosa PA01
gccgcgcaggcggucgg

SEQ ID NO: 3503029 - RNA, 20 nt, Pseudomonas aeruginosa PA01
gccgcgcagguucaucgccg

SEQ ID NO: 3503030 - RNA, 23 nt, Pseudomonas aeruginosa PA01
gccgcgcagguucaucgccgcca

SEQ ID NO: 3503031 - RNA, 16 nt, Pseudomonas aeruginosa PA01
gccgcgcagucccgcg

SEQ ID NO: 3503032 - RNA, 17 nt, Pseudomonas aeruginosa PA01
gccgcgcagucccgcgc

SEQ ID NO: 3503033 - RNA, 19 nt, Pseudomonas aeruginosa PA01
gccgcgcauccucggcauc

SEQ ID NO: 3503034 - RNA, 22 nt, Pseudomonas aeruginosa PA01
gccgcgcaugaaaaagccgccc

SEQ ID NO: 3503035 - RNA, 17 nt, Pseudomonas aeruginosa PA01
gccgcgccaacuggcgc

SEQ ID NO: 3503036 - RNA, 21 nt, Pseudomonas aeruginosa PA01
gccgcgccacggggccccucg

SEQ ID NO: 3503037 - RNA, 12 nt, Pseudomonas aeruginosa PA01
gccgcgccagca

SEQ ID NO: 3503038 - RNA, 14 nt, Pseudomonas aeruginosa PA01
gccgcgccagcagg

SEQ ID NO: 3503039 - RNA, 16 nt, Pseudomonas aeruginosa PA01
gccgcgccagcaggcg

SEQ ID NO: 3503040 - RNA, 13 nt, Pseudomonas aeruginosa PA01
gccgcgccagcca

SEQ ID NO: 3503041 - RNA, 14 nt, Pseudomonas aeruginosa PA01
gccgcgccaggcgc

SEQ ID NO: 3503042 - RNA, 15 nt, Pseudomonas aeruginosa PA01
gccgcgccaggcgca

SEQ ID NO: 3503043 - RNA, 12 nt, Pseudomonas aeruginosa PA01
gccgcgccaggu

SEQ ID NO: 3503044 - RNA, 15 nt, Pseudomonas aeruginosa PA01
gccgcgccccacggc

SEQ ID NO: 3503045 - RNA, 17 nt, Pseudomonas aeruginosa PA01
gccgcgccccacggcgc

SEQ ID NO: 3503046 - RNA, 18 nt, Pseudomonas aeruginosa PA01
gccgcgccccacggcgcg

SEQ ID NO: 3503047 - RNA, 21 nt, Pseudomonas aeruginosa PA01
gccgcgccccacggcgcggcc

SEQ ID NO: 3503048 - RNA, 13 nt, Pseudomonas aeruginosa PA01
gccgcgccccagc

SEQ ID NO: 3503049 - RNA, 16 nt, Pseudomonas aeruginosa PA01
gccgcgccccagcggc

SEQ ID NO: 3503050 - RNA, 17 nt, Pseudomonas aeruginosa PA01
gccgcgccccagcggca

SEQ ID NO: 3503051 - RNA, 20 nt, Pseudomonas aeruginosa PA01
gccgcgccccagcggcaggc

SEQ ID NO: 3503052 - RNA, 21 nt, Pseudomonas aeruginosa PA01
gccgcgccccagcggcaggca

SEQ ID NO: 3503053 - RNA, 22 nt, Pseudomonas aeruginosa PA01
gccgcgccccagcggcaggcac

SEQ ID NO: 3503054 - RNA, 12 nt, Pseudomonas aeruginosa PA01
gccgcgcccggc

SEQ ID NO: 3503055 - RNA, 13 nt, Pseudomonas aeruginosa PA01
gccgcgcccggcc

SEQ ID NO: 3503056 - RNA, 14 nt, Pseudomonas aeruginosa PA01
gccgcgcccggcca

SEQ ID NO: 3503057 - RNA, 15 nt, Pseudomonas aeruginosa PA01
gccgcgcccggccag

SEQ ID NO: 3503058 - RNA, 14 nt, Pseudomonas aeruginosa PA01
gccgcgcccggccu

SEQ ID NO: 3503059 - RNA, 15 nt, Pseudomonas aeruginosa PA01
gccgcgcccggccuu

SEQ ID NO: 3503060 - RNA, 16 nt, Pseudomonas aeruginosa PA01
gccgcgcccggccuuc

SEQ ID NO: 3503061 - RNA, 14 nt, Pseudomonas aeruginosa PA01
gccgcgcccggcgc

SEQ ID NO: 3503062 - RNA, 15 nt, Pseudomonas aeruginosa PA01
gccgcgcccggcgcc

SEQ ID NO: 3503063 - RNA, 16 nt, Pseudomonas aeruginosa PA01
gccgcgcccggcgcca

SEQ ID NO: 3503064 - RNA, 14 nt, Pseudomonas aeruginosa PA01
gccgcgccgaaggc

SEQ ID NO: 3503065 - RNA, 12 nt, Pseudomonas aeruginosa PA01
gccgcgccgacc

SEQ ID NO: 3503066 - RNA, 14 nt, Pseudomonas aeruginosa PA01
gccgcgccgaccca

SEQ ID NO: 3503067 - RNA, 12 nt, Pseudomonas aeruginosa PA01
gccgcgccgaga

SEQ ID NO: 3503068 - RNA, 22 nt, Pseudomonas aeruginosa PA01
gccgcgccgagauagcggcaac

SEQ ID NO: 3503069 - RNA, 16 nt, Pseudomonas aeruginosa PA01
gccgcgccgagccggc

SEQ ID NO: 3503070 - RNA, 18 nt, Pseudomonas aeruginosa PA01
gccgcgccgagccggcug

SEQ ID NO: 3503071 - RNA, 19 nt, Pseudomonas aeruginosa PA01
gccgcgccgagccggcugc

SEQ ID NO: 3503072 - RNA, 21 nt, Pseudomonas aeruginosa PA01
gccgcgccgagccggcugccg

SEQ ID NO: 3503073 - RNA, 22 nt, Pseudomonas aeruginosa PA01
gccgcgccgagccggcugccga

SEQ ID NO: 3503074 - RNA, 23 nt, Pseudomonas aeruginosa PA01
gccgcgccgagccggcugccgaa

SEQ ID NO: 3503075 - RNA, 12 nt, Pseudomonas aeruginosa PA01
gccgcgccgaug

SEQ ID NO: 3503076 - RNA, 14 nt, Pseudomonas aeruginosa PA01
gccgcgccgaugcc

SEQ ID NO: 3503077 - RNA, 10 nt, Pseudomonas aeruginosa PA01
gccgcgccgc

SEQ ID NO: 3503078 - RNA, 20 nt, Pseudomonas aeruginosa PA01
gccgcgccgcaagggcgucg

SEQ ID NO: 3503079 - RNA, 13 nt, Pseudomonas aeruginosa PA01
gccgcgccgcccu

SEQ ID NO: 3503080 - RNA, 15 nt, Pseudomonas aeruginosa PA01
gccgcgccgcccugg

SEQ ID NO: 3503081 - RNA, 12 nt, Pseudomonas aeruginosa PA01
gccgcgccgccg

SEQ ID NO: 3503082 - RNA, 13 nt, Pseudomonas aeruginosa PA01
gccgcgccgcuca

SEQ ID NO: 3503083 - RNA, 23 nt, Pseudomonas aeruginosa PA01
gccgcgccgcucaggcgucccgc

SEQ ID NO: 3503084 - RNA, 12 nt, Pseudomonas aeruginosa PA01
gccgcgccggcc

SEQ ID NO: 3503085 - RNA, 13 nt, Pseudomonas aeruginosa PA01
gccgcgccggccg

SEQ ID NO: 3503086 - RNA, 13 nt, Pseudomonas aeruginosa PA01
gccgcgccggcga

SEQ ID NO: 3503087 - RNA, 15 nt, Pseudomonas aeruginosa PA01
gccgcgccggcgauc

SEQ ID NO: 3503088 - RNA, 16 nt, Pseudomonas aeruginosa PA01
gccgcgccggcgaucg

SEQ ID NO: 3503089 - RNA, 13 nt, Pseudomonas aeruginosa PA01
gccgcgccggggc

SEQ ID NO: 3503090 - RNA, 15 nt, Pseudomonas aeruginosa PA01
gccgcgccucgucgc

SEQ ID NO: 3503091 - RNA, 18 nt, Pseudomonas aeruginosa PA01
gccgcgccucgucgcgcc

SEQ ID NO: 3503092 - RNA, 22 nt, Pseudomonas aeruginosa PA01
gccgcgccucgucgcgccaggc

SEQ ID NO: 3503093 - RNA, 12 nt, Pseudomonas aeruginosa PA01
gccgcgccugcu

SEQ ID NO: 3503094 - RNA, 14 nt, Pseudomonas aeruginosa PA01
gccgcgccugcugc

SEQ ID NO: 3503095 - RNA, 17 nt, Pseudomonas aeruginosa PA01
gccgcgccuucagcgcc

SEQ ID NO: 3503096 - RNA, 18 nt, Pseudomonas aeruginosa PA01
gccgcgccuucagcgcca

SEQ ID NO: 3503097 - RNA, 21 nt, Pseudomonas aeruginosa PA01
gccgcgccuucagcgccagca

SEQ ID NO: 3503098 - RNA, 22 nt, Pseudomonas aeruginosa PA01
gccgcgccuucagcgccagcag

SEQ ID NO: 3503099 - RNA, 21 nt, Pseudomonas aeruginosa PA01
gccgcgccuucugcaccuugg

SEQ ID NO: 3503100 - RNA, 20 nt, Pseudomonas aeruginosa PA01
gccgcgccuugcucaggucg

SEQ ID NO: 3503101 - RNA, 20 nt, Pseudomonas aeruginosa PA01
gccgcgccuuucgcucaggc

SEQ ID NO: 3503102 - RNA, 15 nt, Pseudomonas aeruginosa PA01
gccgcgcgaccgcgg

SEQ ID NO: 3503103 - RNA, 18 nt, Pseudomonas aeruginosa PA01
gccgcgcgaccgcggcgc

SEQ ID NO: 3503104 - RNA, 13 nt, Pseudomonas aeruginosa PA01
gccgcgcgauggc

SEQ ID NO: 3503105 - RNA, 16 nt, Pseudomonas aeruginosa PA01
gccgcgcgauggccgg

SEQ ID NO: 3503106 - RNA, 19 nt, Pseudomonas aeruginosa PA01
gccgcgcgauggccggcgg

SEQ ID NO: 3503107 - RNA, 22 nt, Pseudomonas aeruginosa PA01
gccgcgcgauggccggcggaga

SEQ ID NO: 3503108 - RNA, 13 nt, Pseudomonas aeruginosa PA01
gccgcgcgccagc

SEQ ID NO: 3503109 - RNA, 13 nt, Pseudomonas aeruginosa PA01
gccgcgcgccgag

SEQ ID NO: 3503110 - RNA, 16 nt, Pseudomonas aeruginosa PA01
gccgcgcgccgcaucg

SEQ ID NO: 3503111 - RNA, 15 nt, Pseudomonas aeruginosa PA01
gccgcgcgccuggcu

SEQ ID NO: 3503112 - RNA, 20 nt, Pseudomonas aeruginosa PA01
gccgcgcgccuggcuggcca

SEQ ID NO: 3503113 - RNA, 23 nt, Pseudomonas aeruginosa PA01
gccgcgcgcgcggucgagcagcg

SEQ ID NO: 3503114 - RNA, 17 nt, Pseudomonas aeruginosa PA01
gccgcgcgcgucgagcg

SEQ ID NO: 3503115 - RNA, 14 nt, Pseudomonas aeruginosa PA01
gccgcgcgcuggau

SEQ ID NO: 3503116 - RNA, 22 nt, Pseudomonas aeruginosa PA01
gccgcgcgcuggauuucgccga

SEQ ID NO: 3503117 - RNA, 14 nt, Pseudomonas aeruginosa PA01
gccgcgcggcgccc

SEQ ID NO: 3503118 - RNA, 18 nt, Pseudomonas aeruginosa PA01
gccgcgcggcgccccguc

SEQ ID NO: 3503119 - RNA, 12 nt, Pseudomonas aeruginosa PA01
gccgcgcgggcc

SEQ ID NO: 3503120 - RNA, 14 nt, Pseudomonas aeruginosa PA01
gccgcgcgggccgg

SEQ ID NO: 3503121 - RNA, 16 nt, Pseudomonas aeruginosa PA01
gccgcgcgggccggcg

SEQ ID NO: 3503122 - RNA, 17 nt, Pseudomonas aeruginosa PA01
gccgcgcgggccggcga

SEQ ID NO: 3503123 - RNA, 18 nt, Pseudomonas aeruginosa PA01
gccgcgcgggccggcgau

SEQ ID NO: 3503124 - RNA, 21 nt, Pseudomonas aeruginosa PA01
gccgcgcgggccggcgauggc

SEQ ID NO: 3503125 - RNA, 22 nt, Pseudomonas aeruginosa PA01
gccgcgcgggccggcgauggcc

SEQ ID NO: 3503126 - RNA, 17 nt, Pseudomonas aeruginosa PA01
gccgcgcggucgagcuc

SEQ ID NO: 3503127 - RNA, 21 nt, Pseudomonas aeruginosa PA01
gccgcgcggucgagcucggcc

SEQ ID NO: 3503128 - RNA, 17 nt, Pseudomonas aeruginosa PA01
gccgcgcguaggcuugg

SEQ ID NO: 3503129 - RNA, 20 nt, Pseudomonas aeruginosa PA01
gccgcgcguaggcuuggucg

SEQ ID NO: 3503130 - RNA, 20 nt, Pseudomonas aeruginosa PA01
gccgcgcguggcuucgucca

SEQ ID NO: 3503131 - RNA, 21 nt, Pseudomonas aeruginosa PA01
gccgcgcguggcuucguccag

SEQ ID NO: 3503132 - RNA, 23 nt, Pseudomonas aeruginosa PA01
gccgcgcguggcuucguccagcg

SEQ ID NO: 3503133 - RNA, 17 nt, Pseudomonas aeruginosa PA01
gccgcgcguucgcgcga

SEQ ID NO: 3503134 - RNA, 18 nt, Pseudomonas aeruginosa PA01
gccgcgcguucgcgcgag

SEQ ID NO: 3503135 - RNA, 23 nt, Pseudomonas aeruginosa PA01
gccgcgcguucgcgcgaggcgcu

SEQ ID NO: 3503136 - RNA, 14 nt, Pseudomonas aeruginosa PA01
gccgcgcuccaaca

SEQ ID NO: 3503137 - RNA, 17 nt, Pseudomonas aeruginosa PA01
gccgcgcuccaacaggc

SEQ ID NO: 3503138 - RNA, 15 nt, Pseudomonas aeruginosa PA01
gccgcgcucgacggu

SEQ ID NO: 3503139 - RNA, 13 nt, Pseudomonas aeruginosa PA01
gccgcgcucgcgc

SEQ ID NO: 3503140 - RNA, 14 nt, Pseudomonas aeruginosa PA01
gccgcgcucgcgca

SEQ ID NO: 3503141 - RNA, 17 nt, Pseudomonas aeruginosa PA01
gccgcgcucgcgcauga

SEQ ID NO: 3503142 - RNA, 15 nt, Pseudomonas aeruginosa PA01
gccgcgcucgcggaa

SEQ ID NO: 3503143 - RNA, 19 nt, Pseudomonas aeruginosa PA01
gccgcgcucgcggaaccag

SEQ ID NO: 3503144 - RNA, 15 nt, Pseudomonas aeruginosa PA01
gccgcgcucggauca

SEQ ID NO: 3503145 - RNA, 13 nt, Pseudomonas aeruginosa PA01
gccgcgcucggcc

SEQ ID NO: 3503146 - RNA, 16 nt, Pseudomonas aeruginosa PA01
gccgcgcucggccagu

SEQ ID NO: 3503147 - RNA, 19 nt, Pseudomonas aeruginosa PA01
gccgcgcucggccaguucg

SEQ ID NO: 3503148 - RNA, 16 nt, Pseudomonas aeruginosa PA01
gccgcgcucgguccag

SEQ ID NO: 3503149 - RNA, 13 nt, Pseudomonas aeruginosa PA01
gccgcgcugcagg

SEQ ID NO: 3503150 - RNA, 14 nt, Pseudomonas aeruginosa PA01
gccgcgcugcaggc

SEQ ID NO: 3503151 - RNA, 18 nt, Pseudomonas aeruginosa PA01
gccgcgcugcgccaggcc

SEQ ID NO: 3503152 - RNA, 21 nt, Pseudomonas aeruginosa PA01
gccgcgcugcugccauccgcg

SEQ ID NO: 3503153 - RNA, 13 nt, Pseudomonas aeruginosa PA01
gccgcgcugcugg

SEQ ID NO: 3503154 - RNA, 14 nt, Pseudomonas aeruginosa PA01
gccgcgcugcuggu

SEQ ID NO: 3503155 - RNA, 14 nt, Pseudomonas aeruginosa PA01
gccgcgcugucggc

SEQ ID NO: 3503156 - RNA, 16 nt, Pseudomonas aeruginosa PA01
gccgcgcugucggccu

SEQ ID NO: 3503157 - RNA, 21 nt, Pseudomonas aeruginosa PA01
gccgcgcuucaggcaguccuu

SEQ ID NO: 3503158 - RNA, 13 nt, Pseudomonas aeruginosa PA01
gccgcgcuuggcc

SEQ ID NO: 3503159 - RNA, 17 nt, Pseudomonas aeruginosa PA01
gccgcggaaaacgccgc

SEQ ID NO: 3503160 - RNA, 19 nt, Pseudomonas aeruginosa PA01
gccgcggaaaacgccgcga

SEQ ID NO: 3503161 - RNA, 21 nt, Pseudomonas aeruginosa PA01
gccgcggaaaacgccgcgaag

SEQ ID NO: 3503162 - RNA, 18 nt, Pseudomonas aeruginosa PA01
gccgcggaaggcccgcga

SEQ ID NO: 3503163 - RNA, 18 nt, Pseudomonas aeruginosa PA01
gccgcggaagugcgccgg

SEQ ID NO: 3503164 - RNA, 20 nt, Pseudomonas aeruginosa PA01
gccgcggaagugcgccgguu

SEQ ID NO: 3503165 - RNA, 17 nt, Pseudomonas aeruginosa PA01
gccgcggacggccggcu

SEQ ID NO: 3503166 - RNA, 19 nt, Pseudomonas aeruginosa PA01
gccgcggagcaccgcgccu

SEQ ID NO: 3503167 - RNA, 23 nt, Pseudomonas aeruginosa PA01
gccgcggagcaccgcgccuucca

SEQ ID NO: 3503168 - RNA, 17 nt, Pseudomonas aeruginosa PA01
gccgcggauacggcagg

SEQ ID NO: 3503169 - RNA, 19 nt, Pseudomonas aeruginosa PA01
gccgcggauacggcagggg

SEQ ID NO: 3503170 - RNA, 12 nt, Pseudomonas aeruginosa PA01
gccgcggaucac

SEQ ID NO: 3503171 - RNA, 15 nt, Pseudomonas aeruginosa PA01
gccgcggaucaccug

SEQ ID NO: 3503172 - RNA, 17 nt, Pseudomonas aeruginosa PA01
gccgcggaucaccuggc

SEQ ID NO: 3503173 - RNA, 16 nt, Pseudomonas aeruginosa PA01
gccgcggcaaugcggc

SEQ ID NO: 3503174 - RNA, 21 nt, Pseudomonas aeruginosa PA01
gccgcggcaaugcggcgaugg

SEQ ID NO: 3503175 - RNA, 13 nt, Pseudomonas aeruginosa PA01
gccgcggccagcc

SEQ ID NO: 3503176 - RNA, 15 nt, Pseudomonas aeruginosa PA01
gccgcggccagcccc

SEQ ID NO: 3503177 - RNA, 16 nt, Pseudomonas aeruginosa PA01
gccgcggccagccccc

SEQ ID NO: 3503178 - RNA, 18 nt, Pseudomonas aeruginosa PA01
gccgcggcccugcgccgc

SEQ ID NO: 3503179 - RNA, 13 nt, Pseudomonas aeruginosa PA01
gccgcggccggcg

SEQ ID NO: 3503180 - RNA, 14 nt, Pseudomonas aeruginosa PA01
gccgcggccggcga

SEQ ID NO: 3503181 - RNA, 15 nt, Pseudomonas aeruginosa PA01
gccgcggccggcgac

SEQ ID NO: 3503182 - RNA, 16 nt, Pseudomonas aeruginosa PA01
gccgcggccggcgacc

SEQ ID NO: 3503183 - RNA, 13 nt, Pseudomonas aeruginosa PA01
gccgcggccgggg

SEQ ID NO: 3503184 - RNA, 15 nt, Pseudomonas aeruginosa PA01
gccgcggccggggaa

SEQ ID NO: 3503185 - RNA, 19 nt, Pseudomonas aeruginosa PA01
gccgcggccggggaacagg

SEQ ID NO: 3503186 - RNA, 20 nt, Pseudomonas aeruginosa PA01
gccgcggccggggaacaggu

SEQ ID NO: 3503187 - RNA, 16 nt, Pseudomonas aeruginosa PA01
gccgcggcgaacauca

SEQ ID NO: 3503188 - RNA, 12 nt, Pseudomonas aeruginosa PA01
gccgcggcgacc

SEQ ID NO: 3503189 - RNA, 13 nt, Pseudomonas aeruginosa PA01
gccgcggcgacca

SEQ ID NO: 3503190 - RNA, 22 nt, Pseudomonas aeruginosa PA01
gccgcggcgagcaucucggcca

SEQ ID NO: 3503191 - RNA, 20 nt, Pseudomonas aeruginosa PA01
gccgcggcgauaggcgcgca

SEQ ID NO: 3503192 - RNA, 21 nt, Pseudomonas aeruginosa PA01
gccgcggcgccacgcucaccg

SEQ ID NO: 3503193 - RNA, 15 nt, Pseudomonas aeruginosa PA01
gccgcggcgcggaga

SEQ ID NO: 3503194 - RNA, 12 nt, Pseudomonas aeruginosa PA01
gccgcggcggcg

SEQ ID NO: 3503195 - RNA, 13 nt, Pseudomonas aeruginosa PA01
gccgcggcggcgu

SEQ ID NO: 3503196 - RNA, 19 nt, Pseudomonas aeruginosa PA01
gccgcggcguuagccgccu

SEQ ID NO: 3503197 - RNA, 23 nt, Pseudomonas aeruginosa PA01
gccgcggcguuagccgccugcgg

SEQ ID NO: 3503198 - RNA, 24 nt, Pseudomonas aeruginosa PA01
gccgcggcguuagccgccugcggc

SEQ ID NO: 3503199 - RNA, 15 nt, Pseudomonas aeruginosa PA01
gccgcggcguugcgc

SEQ ID NO: 3503200 - RNA, 23 nt, Pseudomonas aeruginosa PA01
gccgcggcguugucggccagcag

SEQ ID NO: 3503201 - RNA, 16 nt, Pseudomonas aeruginosa PA01
gccgcggcugaugccg

SEQ ID NO: 3503202 - RNA, 20 nt, Pseudomonas aeruginosa PA01
gccgcggcugaugccgcggu

SEQ ID NO: 3503203 - RNA, 16 nt, Pseudomonas aeruginosa PA01
gccgcggcuggcaggu

SEQ ID NO: 3503204 - RNA, 22 nt, Pseudomonas aeruginosa PA01
gccgcggcuggcaggugccgcu

SEQ ID NO: 3503205 - RNA, 18 nt, Pseudomonas aeruginosa PA01
gccgcggcuggccauccg

SEQ ID NO: 3503206 - RNA, 14 nt, Pseudomonas aeruginosa PA01
gccgcggcuguagc

SEQ ID NO: 3503207 - RNA, 16 nt, Pseudomonas aeruginosa PA01
gccgcgggacgccgca

SEQ ID NO: 3503208 - RNA, 17 nt, Pseudomonas aeruginosa PA01
gccgcgggaggccgccu

SEQ ID NO: 3503209 - RNA, 18 nt, Pseudomonas aeruginosa PA01
gccgcgggaggccgccuc

SEQ ID NO: 3503210 - RNA, 19 nt, Pseudomonas aeruginosa PA01
gccgcgggaggccgccucg

SEQ ID NO: 3503211 - RNA, 13 nt, Pseudomonas aeruginosa PA01
gccgcgggcaacc

SEQ ID NO: 3503212 - RNA, 14 nt, Pseudomonas aeruginosa PA01
gccgcgggcaaccg

SEQ ID NO: 3503213 - RNA, 15 nt, Pseudomonas aeruginosa PA01
gccgcgggccagccg

SEQ ID NO: 3503214 - RNA, 19 nt, Pseudomonas aeruginosa PA01
gccgcgggccagccguucg

SEQ ID NO: 3503215 - RNA, 12 nt, Pseudomonas aeruginosa PA01
gccgcgggcgcu

SEQ ID NO: 3503216 - RNA, 21 nt, Pseudomonas aeruginosa PA01
gccgcgggcgcuaugcgccgu

SEQ ID NO: 3503217 - RNA, 15 nt, Pseudomonas aeruginosa PA01
gccgcgggcguugcg

SEQ ID NO: 3503218 - RNA, 23 nt, Pseudomonas aeruginosa PA01
gccgcgggcguugcgcgccucgc

SEQ ID NO: 3503219 - RNA, 22 nt, Pseudomonas aeruginosa PA01
gccgcgggcuauucccgccgcu

SEQ ID NO: 3503220 - RNA, 17 nt, Pseudomonas aeruginosa PA01
gccgcggggaggaagcu

SEQ ID NO: 3503221 - RNA, 14 nt, Pseudomonas aeruginosa PA01
gccgcgggucacca

SEQ ID NO: 3503222 - RNA, 17 nt, Pseudomonas aeruginosa PA01
gccgcgggucaccagcg

SEQ ID NO: 3503223 - RNA, 18 nt, Pseudomonas aeruginosa PA01
gccgcgggucaccagcgc

SEQ ID NO: 3503224 - RNA, 19 nt, Pseudomonas aeruginosa PA01
gccgcgggucucgaucagc

SEQ ID NO: 3503225 - RNA, 21 nt, Pseudomonas aeruginosa PA01
gccgcgggucucgaucagcgc

SEQ ID NO: 3503226 - RNA, 23 nt, Pseudomonas aeruginosa PA01
gccgcgggucucgaucagcgccg

SEQ ID NO: 3503227 - RNA, 20 nt, Pseudomonas aeruginosa PA01
gccgcgggucugcucggcgc

SEQ ID NO: 3503228 - RNA, 22 nt, Pseudomonas aeruginosa PA01
gccgcgggucugcucggcgccc

SEQ ID NO: 3503229 - RNA, 16 nt, Pseudomonas aeruginosa PA01
gccgcgguaggucagc

SEQ ID NO: 3503230 - RNA, 19 nt, Pseudomonas aeruginosa PA01
gccgcgguccaucccuucg

SEQ ID NO: 3503231 - RNA, 19 nt, Pseudomonas aeruginosa PA01
gccgcggugggcuccagcg

SEQ ID NO: 3503232 - RNA, 16 nt, Pseudomonas aeruginosa PA01
gccgcggugucggcga

SEQ ID NO: 3503233 - RNA, 14 nt, Pseudomonas aeruginosa PA01
gccgcguagcgcca

SEQ ID NO: 3503234 - RNA, 16 nt, Pseudomonas aeruginosa PA01
gccgcguagcgccagg

SEQ ID NO: 3503235 - RNA, 17 nt, Pseudomonas aeruginosa PA01
gccgcguagcgccaggc

SEQ ID NO: 3503236 - RNA, 19 nt, Pseudomonas aeruginosa PA01
gccgcguaguaggcacagg

SEQ ID NO: 3503237 - RNA, 21 nt, Pseudomonas aeruginosa PA01
gccgcguaguaggcacaggac

SEQ ID NO: 3503238 - RNA, 22 nt, Pseudomonas aeruginosa PA01
gccgcguaguaggcacaggacc

SEQ ID NO: 3503239 - RNA, 24 nt, Pseudomonas aeruginosa PA01
gccgcguaguaggcacaggacccu

SEQ ID NO: 3503240 - RNA, 14 nt, Pseudomonas aeruginosa PA01
gccgcguauggcuu

SEQ ID NO: 3503241 - RNA, 23 nt, Pseudomonas aeruginosa PA01
gccgcgucgaagcugucggcccg

SEQ ID NO: 3503242 - RNA, 19 nt, Pseudomonas aeruginosa PA01
gccgcgucgaagucgauca

SEQ ID NO: 3503243 - RNA, 20 nt, Pseudomonas aeruginosa PA01
gccgcgucgaagucgaucac

SEQ ID NO: 3503244 - RNA, 23 nt, Pseudomonas aeruginosa PA01
gccgcgucgaagucgaucaccgc

SEQ ID NO: 3503245 - RNA, 13 nt, Pseudomonas aeruginosa PA01
gccgcgucgccca

SEQ ID NO: 3503246 - RNA, 14 nt, Pseudomonas aeruginosa PA01
gccgcgucgcccag

SEQ ID NO: 3503247 - RNA, 16 nt, Pseudomonas aeruginosa PA01
gccgcgucgcccaggc

SEQ ID NO: 3503248 - RNA, 22 nt, Pseudomonas aeruginosa PA01
gccgcgucgcccaggccgcugg

SEQ ID NO: 3503249 - RNA, 13 nt, Pseudomonas aeruginosa PA01
gccgcgucgccgc

SEQ ID NO: 3503250 - RNA, 15 nt, Pseudomonas aeruginosa PA01
gccgcgucgccgcca

SEQ ID NO: 3503251 - RNA, 18 nt, Pseudomonas aeruginosa PA01
gccgcgucgccgccagcg

SEQ ID NO: 3503252 - RNA, 23 nt, Pseudomonas aeruginosa PA01
gccgcgucggcucgguuccagcu

SEQ ID NO: 3503253 - RNA, 20 nt, Pseudomonas aeruginosa PA01
gccgcgucguaguugccucu

SEQ ID NO: 3503254 - RNA, 22 nt, Pseudomonas aeruginosa PA01
gccgcgucguaguugccucucg

SEQ ID NO: 3503255 - RNA, 16 nt, Pseudomonas aeruginosa PA01
gccgcgucgucggcga

SEQ ID NO: 3503256 - RNA, 20 nt, Pseudomonas aeruginosa PA01
gccgcgucgucggcgacgcu

SEQ ID NO: 3503257 - RNA, 21 nt, Pseudomonas aeruginosa PA01
gccgcgucgucggcgacgcug

SEQ ID NO: 3503258 - RNA, 15 nt, Pseudomonas aeruginosa PA01
gccgcgugcccgaga

SEQ ID NO: 3503259 - RNA, 13 nt, Pseudomonas aeruginosa PA01
gccgcgugccgcc

SEQ ID NO: 3503260 - RNA, 16 nt, Pseudomonas aeruginosa PA01
gccgcgugccgccgga

SEQ ID NO: 3503261 - RNA, 14 nt, Pseudomonas aeruginosa PA01
gccgcgugcgcgcc

SEQ ID NO: 3503262 - RNA, 16 nt, Pseudomonas aeruginosa PA01
gccgcgugcgcgcccu

SEQ ID NO: 3503263 - RNA, 17 nt, Pseudomonas aeruginosa PA01
gccgcgugcgcgcccuc

SEQ ID NO: 3503264 - RNA, 19 nt, Pseudomonas aeruginosa PA01
gccgcgugcgcgcccucgg

SEQ ID NO: 3503265 - RNA, 15 nt, Pseudomonas aeruginosa PA01
gccgcgugcgcgccg

SEQ ID NO: 3503266 - RNA, 17 nt, Pseudomonas aeruginosa PA01
gccgcgugcgcgccgcc

SEQ ID NO: 3503267 - RNA, 18 nt, Pseudomonas aeruginosa PA01
gccgcgugcgcgccgccg

SEQ ID NO: 3503268 - RNA, 19 nt, Pseudomonas aeruginosa PA01
gccgcgugcgcgccgccgg

SEQ ID NO: 3503269 - RNA, 21 nt, Pseudomonas aeruginosa PA01
gccgcgugcgcgccgccgggc

SEQ ID NO: 3503270 - RNA, 22 nt, Pseudomonas aeruginosa PA01
gccgcgugcgcgccgccgggcg

SEQ ID NO: 3503271 - RNA, 18 nt, Pseudomonas aeruginosa PA01
gccgcgugggcuucgccg

SEQ ID NO: 3503272 - RNA, 20 nt, Pseudomonas aeruginosa PA01
gccgcgugggcuucgccgcc

SEQ ID NO: 3503273 - RNA, 18 nt, Pseudomonas aeruginosa PA01
gccgcguucagucccgcg

SEQ ID NO: 3503274 - RNA, 19 nt, Pseudomonas aeruginosa PA01
gccgcguucagucccgcgg

SEQ ID NO: 3503275 - RNA, 20 nt, Pseudomonas aeruginosa PA01
gccgcguucagucccgcggc

SEQ ID NO: 3503276 - RNA, 21 nt, Pseudomonas aeruginosa PA01
gccgcguucagucccgcggcg

SEQ ID NO: 3503277 - RNA, 16 nt, Pseudomonas aeruginosa PA01
gccgcguucgccgagg

SEQ ID NO: 3503278 - RNA, 17 nt, Pseudomonas aeruginosa PA01
gccgcguucgccgaggc

SEQ ID NO: 3503279 - RNA, 21 nt, Pseudomonas aeruginosa PA01
gccgcguucgccgaggcggcg

SEQ ID NO: 3503280 - RNA, 19 nt, Pseudomonas aeruginosa PA01
gccgcguugucccuguccc

SEQ ID NO: 3503281 - RNA, 22 nt, Pseudomonas aeruginosa PA01
gccgcguugucccugucccgcc

SEQ ID NO: 3503282 - RNA, 23 nt, Pseudomonas aeruginosa PA01
gccgcguugucccugucccgccg

SEQ ID NO: 3503283 - RNA, 23 nt, Pseudomonas aeruginosa PA01
gccgcuacccagguggucgacca

SEQ ID NO: 3503284 - RNA, 15 nt, Pseudomonas aeruginosa PA01
gccgcuacgcggcgg

SEQ ID NO: 3503285 - RNA, 14 nt, Pseudomonas aeruginosa PA01
gccgcuacugcgcg

SEQ ID NO: 3503286 - RNA, 15 nt, Pseudomonas aeruginosa PA01
gccgcuacugcgcgg

SEQ ID NO: 3503287 - RNA, 16 nt, Pseudomonas aeruginosa PA01
gccgcuacugcgcggg

SEQ ID NO: 3503288 - RNA, 18 nt, Pseudomonas aeruginosa PA01
gccgcuacugcgcgggca

SEQ ID NO: 3503289 - RNA, 15 nt, Pseudomonas aeruginosa PA01
gccgcuagcccugcu

SEQ ID NO: 3503290 - RNA, 18 nt, Pseudomonas aeruginosa PA01
gccgcuagcccugcugcu

SEQ ID NO: 3503291 - RNA, 20 nt, Pseudomonas aeruginosa PA01
gccgcuagcccugcugcucg

SEQ ID NO: 3503292 - RNA, 23 nt, Pseudomonas aeruginosa PA01
gccgcuagcccugcugcucgcca

SEQ ID NO: 3503293 - RNA, 17 nt, Pseudomonas aeruginosa PA01
gccgcuagcgguagccg

SEQ ID NO: 3503294 - RNA, 20 nt, Pseudomonas aeruginosa PA01
gccgcuagcgguagccguca

SEQ ID NO: 3503295 - RNA, 13 nt, Pseudomonas aeruginosa PA01
gccgcuagggcgc

SEQ ID NO: 3503296 - RNA, 23 nt, Pseudomonas aeruginosa PA01
gccgcuagggcgcccucgccaau

SEQ ID NO: 3503297 - RNA, 16 nt, Pseudomonas aeruginosa PA01
gccgcuaucgccgccg

SEQ ID NO: 3503298 - RNA, 18 nt, Pseudomonas aeruginosa PA01
gccgcuaucgccgccgca

SEQ ID NO: 3503299 - RNA, 22 nt, Pseudomonas aeruginosa PA01
gccgcuaucgccgccgcagccg

SEQ ID NO: 3503300 - RNA, 16 nt, Pseudomonas aeruginosa PA01
gccgcuaucgcuggcg

SEQ ID NO: 3503301 - RNA, 18 nt, Pseudomonas aeruginosa PA01
gccgcuaucgcuggcgca

SEQ ID NO: 3503302 - RNA, 19 nt, Pseudomonas aeruginosa PA01
gccgcuaucgcuggcgcag

SEQ ID NO: 3503303 - RNA, 20 nt, Pseudomonas aeruginosa PA01
gccgcuaucgcuggcgcagc

SEQ ID NO: 3503304 - RNA, 21 nt, Pseudomonas aeruginosa PA01
gccgcuaucgcuggcgcagcc

SEQ ID NO: 3503305 - RNA, 20 nt, Pseudomonas aeruginosa PA01
gccgcuaugggcaccgcgcc

SEQ ID NO: 3503306 - RNA, 22 nt, Pseudomonas aeruginosa PA01
gccgcuaugggcaccgcgccgg

SEQ ID NO: 3503307 - RNA, 14 nt, Pseudomonas aeruginosa PA01
gccgcucacccugu

SEQ ID NO: 3503308 - RNA, 13 nt, Pseudomonas aeruginosa PA01
gccgcucaccgcc

SEQ ID NO: 3503309 - RNA, 14 nt, Pseudomonas aeruginosa PA01
gccgcucaccgcca

SEQ ID NO: 3503310 - RNA, 13 nt, Pseudomonas aeruginosa PA01
gccgcucaggcgu

SEQ ID NO: 3503311 - RNA, 15 nt, Pseudomonas aeruginosa PA01
gccgcucaggcgucc

SEQ ID NO: 3503312 - RNA, 17 nt, Pseudomonas aeruginosa PA01
gccgcucaggcgucccg

SEQ ID NO: 3503313 - RNA, 23 nt, Pseudomonas aeruginosa PA01
gccgcucaggcgucccgcuccag

SEQ ID NO: 3503314 - RNA, 18 nt, Pseudomonas aeruginosa PA01
gccgcucaggcugugcag

SEQ ID NO: 3503315 - RNA, 16 nt, Pseudomonas aeruginosa PA01
gccgcucauccgcugg

SEQ ID NO: 3503316 - RNA, 16 nt, Pseudomonas aeruginosa PA01
gccgcuccacacccgg

SEQ ID NO: 3503317 - RNA, 23 nt, Pseudomonas aeruginosa PA01
gccgcuccacacccggucgcgcu

SEQ ID NO: 3503318 - RNA, 16 nt, Pseudomonas aeruginosa PA01
gccgcuccaggaucgc

SEQ ID NO: 3503319 - RNA, 17 nt, Pseudomonas aeruginosa PA01
gccgcuccaggaucgcc

SEQ ID NO: 3503320 - RNA, 16 nt, Pseudomonas aeruginosa PA01
gccgcucccaccgcuu

SEQ ID NO: 3503321 - RNA, 23 nt, Pseudomonas aeruginosa PA01
gccgcucccaccgcuuucagcgc

SEQ ID NO: 3503322 - RNA, 14 nt, Pseudomonas aeruginosa PA01
gccgcuccgcgcca

SEQ ID NO: 3503323 - RNA, 17 nt, Pseudomonas aeruginosa PA01
gccgcuccgcgccacgc

SEQ ID NO: 3503324 - RNA, 14 nt, Pseudomonas aeruginosa PA01
gccgcuccggcugc

SEQ ID NO: 3503325 - RNA, 20 nt, Pseudomonas aeruginosa PA01
gccgcuccggcugcgcggag

SEQ ID NO: 3503326 - RNA, 20 nt, Pseudomonas aeruginosa PA01
gccgcuccuggcaggcucac

SEQ ID NO: 3503327 - RNA, 17 nt, Pseudomonas aeruginosa PA01
gccgcucgagggcgacc

SEQ ID NO: 3503328 - RNA, 18 nt, Pseudomonas aeruginosa PA01
gccgcucgagggcgaccg

SEQ ID NO: 3503329 - RNA, 21 nt, Pseudomonas aeruginosa PA01
gccgcucgagggcgaccgcca

SEQ ID NO: 3503330 - RNA, 22 nt, Pseudomonas aeruginosa PA01
gccgcucgagggcgaccgccag

SEQ ID NO: 3503331 - RNA, 20 nt, Pseudomonas aeruginosa PA01
gccgcucgaugcccgccagc

SEQ ID NO: 3503332 - RNA, 22 nt, Pseudomonas aeruginosa PA01
gccgcucgaugcccgccagcag

SEQ ID NO: 3503333 - RNA, 13 nt, Pseudomonas aeruginosa PA01
gccgcucgcgcac

SEQ ID NO: 3503334 - RNA, 15 nt, Pseudomonas aeruginosa PA01
gccgcucgcgcacgg

SEQ ID NO: 3503335 - RNA, 18 nt, Pseudomonas aeruginosa PA01
gccgcucgcgcacggcga

SEQ ID NO: 3503336 - RNA, 20 nt, Pseudomonas aeruginosa PA01
gccgcucgcgcacggcgaag

SEQ ID NO: 3503337 - RNA, 12 nt, Pseudomonas aeruginosa PA01
gccgcucgcgcg

SEQ ID NO: 3503338 - RNA, 15 nt, Pseudomonas aeruginosa PA01
gccgcucgcguccgc

SEQ ID NO: 3503339 - RNA, 15 nt, Pseudomonas aeruginosa PA01
gccgcucggccgcca

SEQ ID NO: 3503340 - RNA, 17 nt, Pseudomonas aeruginosa PA01
gccgcucggccgccagc

SEQ ID NO: 3503341 - RNA, 18 nt, Pseudomonas aeruginosa PA01
gccgcucggccgccagca

SEQ ID NO: 3503342 - RNA, 22 nt, Pseudomonas aeruginosa PA01
gccgcucggccuugagcgccga

SEQ ID NO: 3503343 - RNA, 17 nt, Pseudomonas aeruginosa PA01
gccgcucggcgagccgc

SEQ ID NO: 3503344 - RNA, 19 nt, Pseudomonas aeruginosa PA01
gccgcucggcgagccgccg

SEQ ID NO: 3503345 - RNA, 20 nt, Pseudomonas aeruginosa PA01
gccgcucggcgagccgccgg

SEQ ID NO: 3503346 - RNA, 23 nt, Pseudomonas aeruginosa PA01
gccgcucggcgagccgccgggcg

SEQ ID NO: 3503347 - RNA, 13 nt, Pseudomonas aeruginosa PA01
gccgcucggcggg

SEQ ID NO: 3503348 - RNA, 12 nt, Pseudomonas aeruginosa PA01
gccgcucggcgu

SEQ ID NO: 3503349 - RNA, 19 nt, Pseudomonas aeruginosa PA01
gccgcucggcguagccggc

SEQ ID NO: 3503350 - RNA, 13 nt, Pseudomonas aeruginosa PA01
gccgcucguuggc

SEQ ID NO: 3503351 - RNA, 18 nt, Pseudomonas aeruginosa PA01
gccgcucguuggcggcca

SEQ ID NO: 3503352 - RNA, 23 nt, Pseudomonas aeruginosa PA01
gccgcucuaucagggucuucagg

SEQ ID NO: 3503353 - RNA, 23 nt, Pseudomonas aeruginosa PA01
gccgcucugccagaaggccugcg

SEQ ID NO: 3503354 - RNA, 15 nt, Pseudomonas aeruginosa PA01
gccgcucugcuggcc

SEQ ID NO: 3503355 - RNA, 18 nt, Pseudomonas aeruginosa PA01
gccgcucugcuggccgcc

SEQ ID NO: 3503356 - RNA, 13 nt, Pseudomonas aeruginosa PA01
gccgcucuggcug

SEQ ID NO: 3503357 - RNA, 14 nt, Pseudomonas aeruginosa PA01
gccgcucuggcugc

SEQ ID NO: 3503358 - RNA, 20 nt, Pseudomonas aeruginosa PA01
gccgcucuggcugcuggcga

SEQ ID NO: 3503359 - RNA, 23 nt, Pseudomonas aeruginosa PA01
gccgcucuucugguaggccagca

SEQ ID NO: 3503360 - RNA, 15 nt, Pseudomonas aeruginosa PA01
gccgcugaaguccug

SEQ ID NO: 3503361 - RNA, 19 nt, Pseudomonas aeruginosa PA01
gccgcugaaguccuggccg

SEQ ID NO: 3503362 - RNA, 22 nt, Pseudomonas aeruginosa PA01
gccgcugaaguccuggccgagc

SEQ ID NO: 3503363 - RNA, 23 nt, Pseudomonas aeruginosa PA01
gccgcugaaguccuggccgagca

SEQ ID NO: 3503364 - RNA, 22 nt, Pseudomonas aeruginosa PA01
gccgcugaauaccaccgggccg

SEQ ID NO: 3503365 - RNA, 14 nt, Pseudomonas aeruginosa PA01
gccgcugaccucgg

SEQ ID NO: 3503366 - RNA, 20 nt, Pseudomonas aeruginosa PA01
gccgcugacggucugccagc

SEQ ID NO: 3503367 - RNA, 23 nt, Pseudomonas aeruginosa PA01
gccgcugacggucugccagcucu

SEQ ID NO: 3503368 - RNA, 14 nt, Pseudomonas aeruginosa PA01
gccgcugagcagca

SEQ ID NO: 3503369 - RNA, 21 nt, Pseudomonas aeruginosa PA01
gccgcugaucaguaccggcag

SEQ ID NO: 3503370 - RNA, 23 nt, Pseudomonas aeruginosa PA01
gccgcugaucaguaccggcagcg

SEQ ID NO: 3503371 - RNA, 13 nt, Pseudomonas aeruginosa PA01
gccgcugaugcgc

SEQ ID NO: 3503372 - RNA, 16 nt, Pseudomonas aeruginosa PA01
gccgcugaugcgcugg

SEQ ID NO: 3503373 - RNA, 19 nt, Pseudomonas aeruginosa PA01
gccgcugaugcgcuggucg

SEQ ID NO: 3503374 - RNA, 15 nt, Pseudomonas aeruginosa PA01
gccgcugcacgccuu

SEQ ID NO: 3503375 - RNA, 18 nt, Pseudomonas aeruginosa PA01
gccgcugcacgccuuccg

SEQ ID NO: 3503376 - RNA, 17 nt, Pseudomonas aeruginosa PA01
gccgcugcagggcggcg

SEQ ID NO: 3503377 - RNA, 18 nt, Pseudomonas aeruginosa PA01
gccgcugcagggcggcgc

SEQ ID NO: 3503378 - RNA, 19 nt, Pseudomonas aeruginosa PA01
gccgcugcagggcggcgcu

SEQ ID NO: 3503379 - RNA, 13 nt, Pseudomonas aeruginosa PA01
gccgcugcccaga

SEQ ID NO: 3503380 - RNA, 16 nt, Pseudomonas aeruginosa PA01
gccgcugcccagaucc

SEQ ID NO: 3503381 - RNA, 16 nt, Pseudomonas aeruginosa PA01
gccgcugccgccgcgc

SEQ ID NO: 3503382 - RNA, 21 nt, Pseudomonas aeruginosa PA01
gccgcugccgcucuggcugcu

SEQ ID NO: 3503383 - RNA, 14 nt, Pseudomonas aeruginosa PA01
gccgcugccgggcu

SEQ ID NO: 3503384 - RNA, 19 nt, Pseudomonas aeruginosa PA01
gccgcugccguugcaggcc

SEQ ID NO: 3503385 - RNA, 15 nt, Pseudomonas aeruginosa PA01
gccgcugccugucgc

SEQ ID NO: 3503386 - RNA, 16 nt, Pseudomonas aeruginosa PA01
gccgcugccugucgca

SEQ ID NO: 3503387 - RNA, 18 nt, Pseudomonas aeruginosa PA01
gccgcugccugucgcagc

SEQ ID NO: 3503388 - RNA, 14 nt, Pseudomonas aeruginosa PA01
gccgcugcgcaggc

SEQ ID NO: 3503389 - RNA, 15 nt, Pseudomonas aeruginosa PA01
gccgcugcgcaggcc

SEQ ID NO: 3503390 - RNA, 16 nt, Pseudomonas aeruginosa PA01
gccgcugcgcaggccg

SEQ ID NO: 3503391 - RNA, 14 nt, Pseudomonas aeruginosa PA01
gccgcugcgcauca

SEQ ID NO: 3503392 - RNA, 19 nt, Pseudomonas aeruginosa PA01
gccgcugcgcaucaggucg

SEQ ID NO: 3503393 - RNA, 13 nt, Pseudomonas aeruginosa PA01
gccgcugcggcgg

SEQ ID NO: 3503394 - RNA, 14 nt, Pseudomonas aeruginosa PA01
gccgcugcggcucg

SEQ ID NO: 3503395 - RNA, 17 nt, Pseudomonas aeruginosa PA01
gccgcugcggcucgccg

SEQ ID NO: 3503396 - RNA, 20 nt, Pseudomonas aeruginosa PA01
gccgcugcggcucgccgauu

SEQ ID NO: 3503397 - RNA, 14 nt, Pseudomonas aeruginosa PA01
gccgcugcgucguc

SEQ ID NO: 3503398 - RNA, 20 nt, Pseudomonas aeruginosa PA01
gccgcugcgucgucgcggcg

SEQ ID NO: 3503399 - RNA, 21 nt, Pseudomonas aeruginosa PA01
gccgcugcgucgucgcggcgc

SEQ ID NO: 3503400 - RNA, 23 nt, Pseudomonas aeruginosa PA01
gccgcugcgucgucgcggcgccu

SEQ ID NO: 3503401 - RNA, 13 nt, Pseudomonas aeruginosa PA01
gccgcugcuggca

SEQ ID NO: 3503402 - RNA, 14 nt, Pseudomonas aeruginosa PA01
gccgcuggaaccgg

SEQ ID NO: 3503403 - RNA, 17 nt, Pseudomonas aeruginosa PA01
gccgcuggaaccggccg

SEQ ID NO: 3503404 - RNA, 20 nt, Pseudomonas aeruginosa PA01
gccgcuggacgaaccgauca

SEQ ID NO: 3503405 - RNA, 14 nt, Pseudomonas aeruginosa PA01
gccgcuggaugccg

SEQ ID NO: 3503406 - RNA, 21 nt, Pseudomonas aeruginosa PA01
gccgcuggcauaaccggaagc

SEQ ID NO: 3503407 - RNA, 16 nt, Pseudomonas aeruginosa PA01
gccgcuggcauuccag

SEQ ID NO: 3503408 - RNA, 12 nt, Pseudomonas aeruginosa PA01
gccgcuggccga

SEQ ID NO: 3503409 - RNA, 14 nt, Pseudomonas aeruginosa PA01
gccgcuggccgacc

SEQ ID NO: 3503410 - RNA, 15 nt, Pseudomonas aeruginosa PA01
gccgcuggccuggcc

SEQ ID NO: 3503411 - RNA, 17 nt, Pseudomonas aeruginosa PA01
gccgcuggccuggccac

SEQ ID NO: 3503412 - RNA, 22 nt, Pseudomonas aeruginosa PA01
gccgcuggccuggccacccuug

SEQ ID NO: 3503413 - RNA, 12 nt, Pseudomonas aeruginosa PA01
gccgcuggcgcu

SEQ ID NO: 3503414 - RNA, 12 nt, Pseudomonas aeruginosa PA01
gccgcuggcggc

SEQ ID NO: 3503415 - RNA, 15 nt, Pseudomonas aeruginosa PA01
gccgcuggcggcaug

SEQ ID NO: 3503416 - RNA, 13 nt, Pseudomonas aeruginosa PA01
gccgcuggcggcc

SEQ ID NO: 3503417 - RNA, 16 nt, Pseudomonas aeruginosa PA01
gccgcuggcggccuuc

SEQ ID NO: 3503418 - RNA, 20 nt, Pseudomonas aeruginosa PA01
gccgcuggcggccuucggcg

SEQ ID NO: 3503419 - RNA, 21 nt, Pseudomonas aeruginosa PA01
gccgcuggcggccuucggcgu

SEQ ID NO: 3503420 - RNA, 17 nt, Pseudomonas aeruginosa PA01
gccgcuggcggcgacga

SEQ ID NO: 3503421 - RNA, 15 nt, Pseudomonas aeruginosa PA01
gccgcuggcggcgcu

SEQ ID NO: 3503422 - RNA, 12 nt, Pseudomonas aeruginosa PA01
gccgcuggcgug

SEQ ID NO: 3503423 - RNA, 13 nt, Pseudomonas aeruginosa PA01
gccgcuggcgugg

SEQ ID NO: 3503424 - RNA, 22 nt, Pseudomonas aeruginosa PA01
gccgcuggcgugguggaugacc

SEQ ID NO: 3503425 - RNA, 22 nt, Pseudomonas aeruginosa PA01
gccgcuggcguuguugccgccg

SEQ ID NO: 3503426 - RNA, 23 nt, Pseudomonas aeruginosa PA01
gccgcuggcguuguugccgccga

SEQ ID NO: 3503427 - RNA, 13 nt, Pseudomonas aeruginosa PA01
gccgcugggcagc

SEQ ID NO: 3503428 - RNA, 14 nt, Pseudomonas aeruginosa PA01
gccgcuggggaccg

SEQ ID NO: 3503429 - RNA, 21 nt, Pseudomonas aeruginosa PA01
gccgcuggggaccgcaccugg

SEQ ID NO: 3503430 - RNA, 22 nt, Pseudomonas aeruginosa PA01
gccgcuggggaccgcaccuggu

SEQ ID NO: 3503431 - RNA, 17 nt, Pseudomonas aeruginosa PA01
gccgcuggguuuccugc

SEQ ID NO: 3503432 - RNA, 21 nt, Pseudomonas aeruginosa PA01
gccgcugguagcuaccgucgg

SEQ ID NO: 3503433 - RNA, 24 nt, Pseudomonas aeruginosa PA01
gccgcugguagcuaccgucggccu

SEQ ID NO: 3503434 - RNA, 16 nt, Pseudomonas aeruginosa PA01
gccgcugguccagcug

SEQ ID NO: 3503435 - RNA, 17 nt, Pseudomonas aeruginosa PA01
gccgcuguaggacaggu

SEQ ID NO: 3503436 - RNA, 14 nt, Pseudomonas aeruginosa PA01
gccgcugucgucca

SEQ ID NO: 3503437 - RNA, 20 nt, Pseudomonas aeruginosa PA01
gccgcugucguccagcgggu

SEQ ID NO: 3503438 - RNA, 22 nt, Pseudomonas aeruginosa PA01
gccgcugucguccagcggguag

SEQ ID NO: 3503439 - RNA, 20 nt, Pseudomonas aeruginosa PA01
gccgcugucgucuucggcca

SEQ ID NO: 3503440 - RNA, 18 nt, Pseudomonas aeruginosa PA01
gccgcugucuaucugcgc

SEQ ID NO: 3503441 - RNA, 22 nt, Pseudomonas aeruginosa PA01
gccgcugucuaucugcgccgaa

SEQ ID NO: 3503442 - RNA, 18 nt, Pseudomonas aeruginosa PA01
gccgcugugcagggucag

SEQ ID NO: 3503443 - RNA, 21 nt, Pseudomonas aeruginosa PA01
gccgcugugcagggucagucg

SEQ ID NO: 3503444 - RNA, 21 nt, Pseudomonas aeruginosa PA01
gccgcuguggaaguacggcgc

SEQ ID NO: 3503445 - RNA, 21 nt, Pseudomonas aeruginosa PA01
gccgcugugugccucugaccg

SEQ ID NO: 3503446 - RNA, 22 nt, Pseudomonas aeruginosa PA01
gccgcugugugccucugaccgc

SEQ ID NO: 3503447 - RNA, 19 nt, Pseudomonas aeruginosa PA01
gccgcuguuacugagcgug

SEQ ID NO: 3503448 - RNA, 15 nt, Pseudomonas aeruginosa PA01
gccgcuuacccaggu

SEQ ID NO: 3503449 - RNA, 14 nt, Pseudomonas aeruginosa PA01
gccgcuuacgcggc

SEQ ID NO: 3503450 - RNA, 16 nt, Pseudomonas aeruginosa PA01
gccgcuuacgcggccu

SEQ ID NO: 3503451 - RNA, 15 nt, Pseudomonas aeruginosa PA01
gccgcuucaagcggc

SEQ ID NO: 3503452 - RNA, 15 nt, Pseudomonas aeruginosa PA01
gccgcuuccgccagg

SEQ ID NO: 3503453 - RNA, 16 nt, Pseudomonas aeruginosa PA01
gccgcuuccgccaggc

SEQ ID NO: 3503454 - RNA, 19 nt, Pseudomonas aeruginosa PA01
gccgcuuccgccaggcgca

SEQ ID NO: 3503455 - RNA, 21 nt, Pseudomonas aeruginosa PA01
gccgcuuccgccaggcgcagc

SEQ ID NO: 3503456 - RNA, 22 nt, Pseudomonas aeruginosa PA01
gccgcuuccgccaggcgcagcc

SEQ ID NO: 3503457 - RNA, 14 nt, Pseudomonas aeruginosa PA01
gccgcuuccgccgg

SEQ ID NO: 3503458 - RNA, 16 nt, Pseudomonas aeruginosa PA01
gccgcuuccgccggcg

SEQ ID NO: 3503459 - RNA, 20 nt, Pseudomonas aeruginosa PA01
gccgcuuccgccggcgccgc

SEQ ID NO: 3503460 - RNA, 23 nt, Pseudomonas aeruginosa PA01
gccgcuuccgccggcgccgccuc

SEQ ID NO: 3503461 - RNA, 18 nt, Pseudomonas aeruginosa PA01
gccgcuuccggcccggcc

SEQ ID NO: 3503462 - RNA, 15 nt, Pseudomonas aeruginosa PA01
gccgcuucgccgccc

SEQ ID NO: 3503463 - RNA, 16 nt, Pseudomonas aeruginosa PA01
gccgcuucgcgguaga

SEQ ID NO: 3503464 - RNA, 19 nt, Pseudomonas aeruginosa PA01
gccgcuucgcgguagacgc

SEQ ID NO: 3503465 - RNA, 12 nt, Pseudomonas aeruginosa PA01
gccgcuucggcu

SEQ ID NO: 3503466 - RNA, 13 nt, Pseudomonas aeruginosa PA01
gccgcuucuuccc

SEQ ID NO: 3503467 - RNA, 16 nt, Pseudomonas aeruginosa PA01
gccgcuucuucccgcc

SEQ ID NO: 3503468 - RNA, 18 nt, Pseudomonas aeruginosa PA01
gccgcuucuucccgccca

SEQ ID NO: 3503469 - RNA, 20 nt, Pseudomonas aeruginosa PA01
gccgcuucuucccgcccauc

SEQ ID NO: 3503470 - RNA, 22 nt, Pseudomonas aeruginosa PA01
gccgcuugagaccuucgcgggu

SEQ ID NO: 3503471 - RNA, 18 nt, Pseudomonas aeruginosa PA01
gccgcuugaucuuguccu

SEQ ID NO: 3503472 - RNA, 19 nt, Pseudomonas aeruginosa PA01
gccgcuugaucuuguccug

SEQ ID NO: 3503473 - RNA, 19 nt, Pseudomonas aeruginosa PA01
gccgcuugcccucgcgccc

SEQ ID NO: 3503474 - RNA, 21 nt, Pseudomonas aeruginosa PA01
gccgcuugcccucgcgcccgg

SEQ ID NO: 3503475 - RNA, 16 nt, Pseudomonas aeruginosa PA01
gccgcuuggagcgggc

SEQ ID NO: 3503476 - RNA, 17 nt, Pseudomonas aeruginosa PA01
gccgcuuggccauggcg

SEQ ID NO: 3503477 - RNA, 16 nt, Pseudomonas aeruginosa PA01
gccgcuuucggugaac

SEQ ID NO: 3503478 - RNA, 22 nt, Pseudomonas aeruginosa PA01
gccggaaaacagcgagcccagg

SEQ ID NO: 3503479 - RNA, 14 nt, Pseudomonas aeruginosa PA01
gccggaaagcagaa

SEQ ID NO: 3503480 - RNA, 17 nt, Pseudomonas aeruginosa PA01
gccggaaagcaguucgc

SEQ ID NO: 3503481 - RNA, 18 nt, Pseudomonas aeruginosa PA01
gccggaaagcaguucgcc

SEQ ID NO: 3503482 - RNA, 15 nt, Pseudomonas aeruginosa PA01
gccggaaagccuggc

SEQ ID NO: 3503483 - RNA, 17 nt, Pseudomonas aeruginosa PA01
gccggaaagccuggccg

SEQ ID NO: 3503484 - RNA, 18 nt, Pseudomonas aeruginosa PA01
gccggaaagccuggccgg

SEQ ID NO: 3503485 - RNA, 19 nt, Pseudomonas aeruginosa PA01
gccggaaagccuggccggc

SEQ ID NO: 3503486 - RNA, 13 nt, Pseudomonas aeruginosa PA01
gccggaacggcuu

SEQ ID NO: 3503487 - RNA, 16 nt, Pseudomonas aeruginosa PA01
gccggaacggcuugcu

SEQ ID NO: 3503488 - RNA, 22 nt, Pseudomonas aeruginosa PA01
gccggaagacggaaacgcgcgc

SEQ ID NO: 3503489 - RNA, 14 nt, Pseudomonas aeruginosa PA01
gccggaagcgcucg

SEQ ID NO: 3503490 - RNA, 15 nt, Pseudomonas aeruginosa PA01
gccggaagcgcucgc

SEQ ID NO: 3503491 - RNA, 18 nt, Pseudomonas aeruginosa PA01
gccggaagcgcucgcgcu

SEQ ID NO: 3503492 - RNA, 16 nt, Pseudomonas aeruginosa PA01
gccggaagcuucaggc

SEQ ID NO: 3503493 - RNA, 23 nt, Pseudomonas aeruginosa PA01
gccggaagcuucaggcucggccu

SEQ ID NO: 3503494 - RNA, 21 nt, Pseudomonas aeruginosa PA01
gccggaaguggcagcgccguu

SEQ ID NO: 3503495 - RNA, 13 nt, Pseudomonas aeruginosa PA01
gccggaaucacgc

SEQ ID NO: 3503496 - RNA, 18 nt, Pseudomonas aeruginosa PA01
gccggaaucacgcugcuc

SEQ ID NO: 3503497 - RNA, 19 nt, Pseudomonas aeruginosa PA01
gccggaaucacgcugcucg

SEQ ID NO: 3503498 - RNA, 17 nt, Pseudomonas aeruginosa PA01
gccggaaugacgagccg

SEQ ID NO: 3503499 - RNA, 24 nt, Pseudomonas aeruginosa PA01
gccggaauguugcggcgguggccg

SEQ ID NO: 3503500 - RNA, 20 nt, Pseudomonas aeruginosa PA01
gccggacaacaggccgggcg

SEQ ID NO: 3503501 - RNA, 13 nt, Pseudomonas aeruginosa PA01
gccggacaggcca

SEQ ID NO: 3503502 - RNA, 14 nt, Pseudomonas aeruginosa PA01
gccggacaggccac

SEQ ID NO: 3503503 - RNA, 18 nt, Pseudomonas aeruginosa PA01
gccggacaggccacccgc

SEQ ID NO: 3503504 - RNA, 22 nt, Pseudomonas aeruginosa PA01
gccggacaggccacccgccucg

SEQ ID NO: 3503505 - RNA, 14 nt, Pseudomonas aeruginosa PA01
gccggaccaacugc

SEQ ID NO: 3503506 - RNA, 22 nt, Pseudomonas aeruginosa PA01
gccggaccucucucgcugcgcg

SEQ ID NO: 3503507 - RNA, 15 nt, Pseudomonas aeruginosa PA01
gccggacgcaccagc

SEQ ID NO: 3503508 - RNA, 16 nt, Pseudomonas aeruginosa PA01
gccggacgcaccagca

SEQ ID NO: 3503509 - RNA, 22 nt, Pseudomonas aeruginosa PA01
gccggacgcaccagcaggccga

SEQ ID NO: 3503510 - RNA, 17 nt, Pseudomonas aeruginosa PA01
gccggacgcgacugcug

SEQ ID NO: 3503511 - RNA, 19 nt, Pseudomonas aeruginosa PA01
gccggacgcgacugcugcu

SEQ ID NO: 3503512 - RNA, 15 nt, Pseudomonas aeruginosa PA01
gccggacggcggcgu

SEQ ID NO: 3503513 - RNA, 21 nt, Pseudomonas aeruginosa PA01
gccggacguuuccagcggcuc

SEQ ID NO: 3503514 - RNA, 22 nt, Pseudomonas aeruginosa PA01
gccggacuuggagaagaucgcc

SEQ ID NO: 3503515 - RNA, 15 nt, Pseudomonas aeruginosa PA01
gccggagaacgccgc

SEQ ID NO: 3503516 - RNA, 19 nt, Pseudomonas aeruginosa PA01
gccggagaacgccgccacg

SEQ ID NO: 3503517 - RNA, 18 nt, Pseudomonas aeruginosa PA01
gccggagacuucagcgca

SEQ ID NO: 3503518 - RNA, 15 nt, Pseudomonas aeruginosa PA01
gccggagagcagcac

SEQ ID NO: 3503519 - RNA, 18 nt, Pseudomonas aeruginosa PA01
gccggagagcagcacggc

SEQ ID NO: 3503520 - RNA, 23 nt, Pseudomonas aeruginosa PA01
gccggagagcagcacggccucgc

SEQ ID NO: 3503521 - RNA, 23 nt, Pseudomonas aeruginosa PA01
gccggagagcgaauacaccgagc

SEQ ID NO: 3503522 - RNA, 19 nt, Pseudomonas aeruginosa PA01
gccggagaugugcgcggug

SEQ ID NO: 3503523 - RNA, 20 nt, Pseudomonas aeruginosa PA01
gccggagaugugcgcgguga

SEQ ID NO: 3503524 - RNA, 14 nt, Pseudomonas aeruginosa PA01
gccggagcaggcca

SEQ ID NO: 3503525 - RNA, 13 nt, Pseudomonas aeruginosa PA01
gccggagccaccg

SEQ ID NO: 3503526 - RNA, 22 nt, Pseudomonas aeruginosa PA01
gccggagggaaugaagaagccc

SEQ ID NO: 3503527 - RNA, 16 nt, Pseudomonas aeruginosa PA01
gccggaggggcggccg

SEQ ID NO: 3503528 - RNA, 24 nt, Pseudomonas aeruginosa PA01
gccggaggggcggccgccgagcaa

SEQ ID NO: 3503529 - RNA, 14 nt, Pseudomonas aeruginosa PA01
gccggagugccgcg

SEQ ID NO: 3503530 - RNA, 19 nt, Pseudomonas aeruginosa PA01
gccggauagaucaggccgg

SEQ ID NO: 3503531 - RNA, 22 nt, Pseudomonas aeruginosa PA01
gccggauagaucaggccggcgu

SEQ ID NO: 3503532 - RNA, 14 nt, Pseudomonas aeruginosa PA01
gccggaucggccuu

SEQ ID NO: 3503533 - RNA, 21 nt, Pseudomonas aeruginosa PA01
gccggaucggccuuggcgaug

SEQ ID NO: 3503534 - RNA, 23 nt, Pseudomonas aeruginosa PA01
gccggaucgguaggcucugcucc

SEQ ID NO: 3503535 - RNA, 14 nt, Pseudomonas aeruginosa PA01
gccggaugccaccg

SEQ ID NO: 3503536 - RNA, 13 nt, Pseudomonas aeruginosa PA01
gccggauggccgc

SEQ ID NO: 3503537 - RNA, 13 nt, Pseudomonas aeruginosa PA01
gccggaugggcga

SEQ ID NO: 3503538 - RNA, 14 nt, Pseudomonas aeruginosa PA01
gccggauucgcgca

SEQ ID NO: 3503539 - RNA, 17 nt, Pseudomonas aeruginosa PA01
gccggauucgcgcagca

SEQ ID NO: 3503540 - RNA, 19 nt, Pseudomonas aeruginosa PA01
gccggauucgcgcagcagg

SEQ ID NO: 3503541 - RNA, 21 nt, Pseudomonas aeruginosa PA01
gccggauucgcgcagcaggcg

SEQ ID NO: 3503542 - RNA, 14 nt, Pseudomonas aeruginosa PA01
gccggauuggccga

SEQ ID NO: 3503543 - RNA, 22 nt, Pseudomonas aeruginosa PA01
gccggauuguaucggcuccucu

SEQ ID NO: 3503544 - RNA, 16 nt, Pseudomonas aeruginosa PA01
gccggcaaacgccgcc

SEQ ID NO: 3503545 - RNA, 16 nt, Pseudomonas aeruginosa PA01
gccggcaagcgugccc

SEQ ID NO: 3503546 - RNA, 17 nt, Pseudomonas aeruginosa PA01
gccggcaagcgugcccc

SEQ ID NO: 3503547 - RNA, 21 nt, Pseudomonas aeruginosa PA01
gccggcaagcgugccccgacu

SEQ ID NO: 3503548 - RNA, 12 nt, Pseudomonas aeruginosa PA01
gccggcaccagc

SEQ ID NO: 3503549 - RNA, 13 nt, Pseudomonas aeruginosa PA01
gccggcaccagca

SEQ ID NO: 3503550 - RNA, 16 nt, Pseudomonas aeruginosa PA01
gccggcacccggagga

SEQ ID NO: 3503551 - RNA, 21 nt, Pseudomonas aeruginosa PA01
gccggcaccgucgagcaccag

SEQ ID NO: 3503552 - RNA, 16 nt, Pseudomonas aeruginosa PA01
gccggcacgcucaggc

SEQ ID NO: 3503553 - RNA, 20 nt, Pseudomonas aeruginosa PA01
gccggcacgcucaggcgcag

SEQ ID NO: 3503554 - RNA, 18 nt, Pseudomonas aeruginosa PA01
gccggcacggcaucgauc

SEQ ID NO: 3503555 - RNA, 21 nt, Pseudomonas aeruginosa PA01
gccggcacggcaucgauccgc

SEQ ID NO: 3503556 - RNA, 17 nt, Pseudomonas aeruginosa PA01
gccggcacuguuccuca

SEQ ID NO: 3503557 - RNA, 12 nt, Pseudomonas aeruginosa PA01
gccggcagcagc

SEQ ID NO: 3503558 - RNA, 13 nt, Pseudomonas aeruginosa PA01
gccggcagcagcg

SEQ ID NO: 3503559 - RNA, 16 nt, Pseudomonas aeruginosa PA01
gccggcagcagcgcca

SEQ ID NO: 3503560 - RNA, 18 nt, Pseudomonas aeruginosa PA01
gccggcagcagcgccagg

SEQ ID NO: 3503561 - RNA, 16 nt, Pseudomonas aeruginosa PA01
gccggcagcgaccacc

SEQ ID NO: 3503562 - RNA, 20 nt, Pseudomonas aeruginosa PA01
gccggcagcgaccaccacca

SEQ ID NO: 3503563 - RNA, 22 nt, Pseudomonas aeruginosa PA01
gccggcagcgagcgggucagca

SEQ ID NO: 3503564 - RNA, 14 nt, Pseudomonas aeruginosa PA01
gccggcagcgccgc

SEQ ID NO: 3503565 - RNA, 13 nt, Pseudomonas aeruginosa PA01
gccggcagcucgg

SEQ ID NO: 3503566 - RNA, 15 nt, Pseudomonas aeruginosa PA01
gccggcagcucggcc

SEQ ID NO: 3503567 - RNA, 16 nt, Pseudomonas aeruginosa PA01
gccggcagcucggccg

SEQ ID NO: 3503568 - RNA, 18 nt, Pseudomonas aeruginosa PA01
gccggcagcucggccgag

SEQ ID NO: 3503569 - RNA, 19 nt, Pseudomonas aeruginosa PA01
gccggcagcucggccgagg

SEQ ID NO: 3503570 - RNA, 20 nt, Pseudomonas aeruginosa PA01
gccggcaggaggaucgcggc

SEQ ID NO: 3503571 - RNA, 22 nt, Pseudomonas aeruginosa PA01
gccggcaggaggaucgcggccu

SEQ ID NO: 3503572 - RNA, 12 nt, Pseudomonas aeruginosa PA01
gccggcaggccg

SEQ ID NO: 3503573 - RNA, 22 nt, Pseudomonas aeruginosa PA01
gccggcaggccgauggccccgg

SEQ ID NO: 3503574 - RNA, 12 nt, Pseudomonas aeruginosa PA01
gccggcaggccu

SEQ ID NO: 3503575 - RNA, 18 nt, Pseudomonas aeruginosa PA01
gccggcaggccuucggcg

SEQ ID NO: 3503576 - RNA, 19 nt, Pseudomonas aeruginosa PA01
gccggcagugugccgcccu

SEQ ID NO: 3503577 - RNA, 14 nt, Pseudomonas aeruginosa PA01
gccggcauagccga

SEQ ID NO: 3503578 - RNA, 13 nt, Pseudomonas aeruginosa PA01
gccggcauccagc

SEQ ID NO: 3503579 - RNA, 17 nt, Pseudomonas aeruginosa PA01
gccggcauccagcaucc

SEQ ID NO: 3503580 - RNA, 21 nt, Pseudomonas aeruginosa PA01
gccggcauccuguggcugcag

SEQ ID NO: 3503581 - RNA, 22 nt, Pseudomonas aeruginosa PA01
gccggcauccuguggcugcagg

SEQ ID NO: 3503582 - RNA, 15 nt, Pseudomonas aeruginosa PA01
gccggcaucgccaug

SEQ ID NO: 3503583 - RNA, 20 nt, Pseudomonas aeruginosa PA01
gccggcaucgccauggcgcu

SEQ ID NO: 3503584 - RNA, 21 nt, Pseudomonas aeruginosa PA01
gccggcaucgccauggcgcug

SEQ ID NO: 3503585 - RNA, 14 nt, Pseudomonas aeruginosa PA01
gccggcaucguggc

SEQ ID NO: 3503586 - RNA, 22 nt, Pseudomonas aeruginosa PA01
gccggcaugcucagccgcgccg

SEQ ID NO: 3503587 - RNA, 20 nt, Pseudomonas aeruginosa PA01
gccggcauggaucaacuggu

SEQ ID NO: 3503588 - RNA, 16 nt, Pseudomonas aeruginosa PA01
gccggcauugcacuuc

SEQ ID NO: 3503589 - RNA, 15 nt, Pseudomonas aeruginosa PA01
gccggcauugcccaa

SEQ ID NO: 3503590 - RNA, 22 nt, Pseudomonas aeruginosa PA01
gccggcauugcccaauacggcg

SEQ ID NO: 3503591 - RNA, 20 nt, Pseudomonas aeruginosa PA01
gccggcauuggcacccugga

SEQ ID NO: 3503592 - RNA, 17 nt, Pseudomonas aeruginosa PA01
gccggccaaccaccggc

SEQ ID NO: 3503593 - RNA, 18 nt, Pseudomonas aeruginosa PA01
gccggccaaccaccggcg

SEQ ID NO: 3503594 - RNA, 19 nt, Pseudomonas aeruginosa PA01
gccggccaaccaccggcgc

SEQ ID NO: 3503595 - RNA, 20 nt, Pseudomonas aeruginosa PA01
gccggccaaccaccggcgca

SEQ ID NO: 3503596 - RNA, 21 nt, Pseudomonas aeruginosa PA01
gccggccaaccaccggcgcac

SEQ ID NO: 3503597 - RNA, 17 nt, Pseudomonas aeruginosa PA01
gccggccaccagcagca

SEQ ID NO: 3503598 - RNA, 21 nt, Pseudomonas aeruginosa PA01
gccggccaccagcagcaacgg

SEQ ID NO: 3503599 - RNA, 21 nt, Pseudomonas aeruginosa PA01
gccggccaccaucacgucgcg

SEQ ID NO: 3503600 - RNA, 14 nt, Pseudomonas aeruginosa PA01
gccggccacgcgac

SEQ ID NO: 3503601 - RNA, 15 nt, Pseudomonas aeruginosa PA01
gccggccacgcgacc

SEQ ID NO: 3503602 - RNA, 19 nt, Pseudomonas aeruginosa PA01
gccggccacgcgaccagcg

SEQ ID NO: 3503603 - RNA, 13 nt, Pseudomonas aeruginosa PA01
gccggccagagcu

SEQ ID NO: 3503604 - RNA, 19 nt, Pseudomonas aeruginosa PA01
gccggccagcaccuucacc

SEQ ID NO: 3503605 - RNA, 22 nt, Pseudomonas aeruginosa PA01
gccggccagcaccuucaccgug

SEQ ID NO: 3503606 - RNA, 14 nt, Pseudomonas aeruginosa PA01
gccggccagccagg

SEQ ID NO: 3503607 - RNA, 15 nt, Pseudomonas aeruginosa PA01
gccggccagccaggc

SEQ ID NO: 3503608 - RNA, 13 nt, Pseudomonas aeruginosa PA01
gccggccagccgc

SEQ ID NO: 3503609 - RNA, 15 nt, Pseudomonas aeruginosa PA01
gccggccagccgcgc

SEQ ID NO: 3503610 - RNA, 18 nt, Pseudomonas aeruginosa PA01
gccggccagccgcgccag

SEQ ID NO: 3503611 - RNA, 19 nt, Pseudomonas aeruginosa PA01
gccggccagccuucccggc

SEQ ID NO: 3503612 - RNA, 22 nt, Pseudomonas aeruginosa PA01
gccggccagccuucccggcgcu

SEQ ID NO: 3503613 - RNA, 19 nt, Pseudomonas aeruginosa PA01
gccggccaggaaggccgcu

SEQ ID NO: 3503614 - RNA, 22 nt, Pseudomonas aeruginosa PA01
gccggccaggaaggccgcuucg

SEQ ID NO: 3503615 - RNA, 14 nt, Pseudomonas aeruginosa PA01
gccggccagggagc

SEQ ID NO: 3503616 - RNA, 23 nt, Pseudomonas aeruginosa PA01
gccggccagggcgaacagcgccg

SEQ ID NO: 3503617 - RNA, 14 nt, Pseudomonas aeruginosa PA01
gccggccaggggcu

SEQ ID NO: 3503618 - RNA, 19 nt, Pseudomonas aeruginosa PA01
gccggccaggggcugaaca

SEQ ID NO: 3503619 - RNA, 20 nt, Pseudomonas aeruginosa PA01
gccggccaggggcugaacag

SEQ ID NO: 3503620 - RNA, 14 nt, Pseudomonas aeruginosa PA01
gccggccagggucg

SEQ ID NO: 3503621 - RNA, 15 nt, Pseudomonas aeruginosa PA01
gccggccagggucgc

SEQ ID NO: 3503622 - RNA, 18 nt, Pseudomonas aeruginosa PA01
gccggccagggucgccag

SEQ ID NO: 3503623 - RNA, 19 nt, Pseudomonas aeruginosa PA01
gccggccagggucgccagc

SEQ ID NO: 3503624 - RNA, 21 nt, Pseudomonas aeruginosa PA01
gccggccagggucgccagcag

SEQ ID NO: 3503625 - RNA, 14 nt, Pseudomonas aeruginosa PA01
gccggccaggucgu

SEQ ID NO: 3503626 - RNA, 19 nt, Pseudomonas aeruginosa PA01
gccggccaggucguugcgc

SEQ ID NO: 3503627 - RNA, 22 nt, Pseudomonas aeruginosa PA01
gccggccaggucguugcgccgg

SEQ ID NO: 3503628 - RNA, 23 nt, Pseudomonas aeruginosa PA01
gccggccagguggucguagcagg

SEQ ID NO: 3503629 - RNA, 15 nt, Pseudomonas aeruginosa PA01
gccggccauccagcc

SEQ ID NO: 3503630 - RNA, 21 nt, Pseudomonas aeruginosa PA01
gccggccauccagccaggcgc

SEQ ID NO: 3503631 - RNA, 14 nt, Pseudomonas aeruginosa PA01
gccggccaugcagg

SEQ ID NO: 3503632 - RNA, 16 nt, Pseudomonas aeruginosa PA01
gccggccaugcaggcc

SEQ ID NO: 3503633 - RNA, 17 nt, Pseudomonas aeruginosa PA01
gccggccaugcaggcca

SEQ ID NO: 3503634 - RNA, 21 nt, Pseudomonas aeruginosa PA01
gccggccaugcaggccagggc

SEQ ID NO: 3503635 - RNA, 23 nt, Pseudomonas aeruginosa PA01
gccggccaugcaggccagggcgg

SEQ ID NO: 3503636 - RNA, 18 nt, Pseudomonas aeruginosa PA01
gccggccaugcuggcgcu

SEQ ID NO: 3503637 - RNA, 16 nt, Pseudomonas aeruginosa PA01
gccggccauucgcugu

SEQ ID NO: 3503638 - RNA, 22 nt, Pseudomonas aeruginosa PA01
gccggccauucgcugucgagca

SEQ ID NO: 3503639 - RNA, 19 nt, Pseudomonas aeruginosa PA01
gccggccauugccgccaga

SEQ ID NO: 3503640 - RNA, 12 nt, Pseudomonas aeruginosa PA01
gccggcccagca

SEQ ID NO: 3503641 - RNA, 14 nt, Pseudomonas aeruginosa PA01
gccggcccagcagg

SEQ ID NO: 3503642 - RNA, 16 nt, Pseudomonas aeruginosa PA01
gccggcccagcaggcc

SEQ ID NO: 3503643 - RNA, 18 nt, Pseudomonas aeruginosa PA01
gccggcccagcaggccgg

SEQ ID NO: 3503644 - RNA, 20 nt, Pseudomonas aeruginosa PA01
gccggcccauccgccgcagg

SEQ ID NO: 3503645 - RNA, 11 nt, Pseudomonas aeruginosa PA01
gccggccccug

SEQ ID NO: 3503646 - RNA, 18 nt, Pseudomonas aeruginosa PA01
gccggccccugggccggc

SEQ ID NO: 3503647 - RNA, 19 nt, Pseudomonas aeruginosa PA01
gccggccccugggccggcu

SEQ ID NO: 3503648 - RNA, 12 nt, Pseudomonas aeruginosa PA01
gccggcccgcgc

SEQ ID NO: 3503649 - RNA, 16 nt, Pseudomonas aeruginosa PA01
gccggcccgcgcggca

SEQ ID NO: 3503650 - RNA, 17 nt, Pseudomonas aeruginosa PA01
gccggcccgcgcggcaa

SEQ ID NO: 3503651 - RNA, 20 nt, Pseudomonas aeruginosa PA01
gccggcccgcgcggcaacgu

SEQ ID NO: 3503652 - RNA, 19 nt, Pseudomonas aeruginosa PA01
gccggcccgugcccguccu

SEQ ID NO: 3503653 - RNA, 12 nt, Pseudomonas aeruginosa PA01
gccggccgacga

SEQ ID NO: 3503654 - RNA, 22 nt, Pseudomonas aeruginosa PA01
gccggccgaucuucagcagcag

SEQ ID NO: 3503655 - RNA, 13 nt, Pseudomonas aeruginosa PA01
gccggccgccagc

SEQ ID NO: 3503656 - RNA, 15 nt, Pseudomonas aeruginosa PA01
gccggccgccagcag

SEQ ID NO: 3503657 - RNA, 17 nt, Pseudomonas aeruginosa PA01
gccggccgccagcaggu

SEQ ID NO: 3503658 - RNA, 16 nt, Pseudomonas aeruginosa PA01
gccggccgcgucgccc

SEQ ID NO: 3503659 - RNA, 17 nt, Pseudomonas aeruginosa PA01
gccggccgcgucgccca

SEQ ID NO: 3503660 - RNA, 19 nt, Pseudomonas aeruginosa PA01
gccggccgcgucgcccagg

SEQ ID NO: 3503661 - RNA, 21 nt, Pseudomonas aeruginosa PA01
gccggccgcgucgcccaggcc

SEQ ID NO: 3503662 - RNA, 17 nt, Pseudomonas aeruginosa PA01
gccggccggcagcgagc

SEQ ID NO: 3503663 - RNA, 18 nt, Pseudomonas aeruginosa PA01
gccggccggcucagcgcu

SEQ ID NO: 3503664 - RNA, 16 nt, Pseudomonas aeruginosa PA01
gccggccgggagcuac

SEQ ID NO: 3503665 - RNA, 13 nt, Pseudomonas aeruginosa PA01
gccggccggggcc

SEQ ID NO: 3503666 - RNA, 17 nt, Pseudomonas aeruginosa PA01
gccggccggggccggca

SEQ ID NO: 3503667 - RNA, 19 nt, Pseudomonas aeruginosa PA01
gccggccggggcgcgcccg

SEQ ID NO: 3503668 - RNA, 22 nt, Pseudomonas aeruginosa PA01
gccggccgucccagucggcguc

SEQ ID NO: 3503669 - RNA, 23 nt, Pseudomonas aeruginosa PA01
gccggccgucccagucggcgucc

SEQ ID NO: 3503670 - RNA, 13 nt, Pseudomonas aeruginosa PA01
gccggccgucgcg

SEQ ID NO: 3503671 - RNA, 14 nt, Pseudomonas aeruginosa PA01
gccggccgucgcgc

SEQ ID NO: 3503672 - RNA, 15 nt, Pseudomonas aeruginosa PA01
gccggccgucgcgca

SEQ ID NO: 3503673 - RNA, 16 nt, Pseudomonas aeruginosa PA01
gccggccgucgcgcac

SEQ ID NO: 3503674 - RNA, 22 nt, Pseudomonas aeruginosa PA01
gccggccgucgcgcaccaccca

SEQ ID NO: 3503675 - RNA, 20 nt, Pseudomonas aeruginosa PA01
gccggccgugcggaggguca

SEQ ID NO: 3503676 - RNA, 21 nt, Pseudomonas aeruginosa PA01
gccggccgugcggagggucag

SEQ ID NO: 3503677 - RNA, 20 nt, Pseudomonas aeruginosa PA01
gccggccuccagcacucgcu

SEQ ID NO: 3503678 - RNA, 23 nt, Pseudomonas aeruginosa PA01
gccggccuccagcacucgcuccu

SEQ ID NO: 3503679 - RNA, 16 nt, Pseudomonas aeruginosa PA01
gccggccuccagcgcc

SEQ ID NO: 3503680 - RNA, 17 nt, Pseudomonas aeruginosa PA01
gccggccuccagcgccu

SEQ ID NO: 3503681 - RNA, 21 nt, Pseudomonas aeruginosa PA01
gccggccuccagcgccucgcc

SEQ ID NO: 3503682 - RNA, 19 nt, Pseudomonas aeruginosa PA01
gccggccuccagcgccugg

SEQ ID NO: 3503683 - RNA, 20 nt, Pseudomonas aeruginosa PA01
gccggccuccagcgccuggc

SEQ ID NO: 3503684 - RNA, 11 nt, Pseudomonas aeruginosa PA01
gccggccucga

SEQ ID NO: 3503685 - RNA, 13 nt, Pseudomonas aeruginosa PA01
gccggccucgacg

SEQ ID NO: 3503686 - RNA, 16 nt, Pseudomonas aeruginosa PA01
gccggccucgacgcag

SEQ ID NO: 3503687 - RNA, 18 nt, Pseudomonas aeruginosa PA01
gccggccucgacgcagag

SEQ ID NO: 3503688 - RNA, 20 nt, Pseudomonas aeruginosa PA01
gccggccucgacgcagagcg

SEQ ID NO: 3503689 - RNA, 22 nt, Pseudomonas aeruginosa PA01
gccggccucgacgcagagcgcc

SEQ ID NO: 3503690 - RNA, 23 nt, Pseudomonas aeruginosa PA01
gccggccucgaggaacaggucga

SEQ ID NO: 3503691 - RNA, 12 nt, Pseudomonas aeruginosa PA01
gccggccucgca

SEQ ID NO: 3503692 - RNA, 13 nt, Pseudomonas aeruginosa PA01
gccggccucgcgc

SEQ ID NO: 3503693 - RNA, 14 nt, Pseudomonas aeruginosa PA01
gccggccucgcgca

SEQ ID NO: 3503694 - RNA, 22 nt, Pseudomonas aeruginosa PA01
gccggccucgcgcaacugcggg

SEQ ID NO: 3503695 - RNA, 15 nt, Pseudomonas aeruginosa PA01
gccggccucgcugcc

SEQ ID NO: 3503696 - RNA, 20 nt, Pseudomonas aeruginosa PA01
gccggccucgcugccgccgc

SEQ ID NO: 3503697 - RNA, 23 nt, Pseudomonas aeruginosa PA01
gccggccucgcugccgccgcaga

SEQ ID NO: 3503698 - RNA, 13 nt, Pseudomonas aeruginosa PA01
gccggccucggcg

SEQ ID NO: 3503699 - RNA, 14 nt, Pseudomonas aeruginosa PA01
gccggccucggcgg

SEQ ID NO: 3503700 - RNA, 15 nt, Pseudomonas aeruginosa PA01
gccggccucggcggc

SEQ ID NO: 3503701 - RNA, 16 nt, Pseudomonas aeruginosa PA01
gccggccucggcggcg

SEQ ID NO: 3503702 - RNA, 16 nt, Pseudomonas aeruginosa PA01
gccggccucuccgaga

SEQ ID NO: 3503703 - RNA, 15 nt, Pseudomonas aeruginosa PA01
gccggccugcgcgca

SEQ ID NO: 3503704 - RNA, 16 nt, Pseudomonas aeruginosa PA01
gccggccugcgcgcac

SEQ ID NO: 3503705 - RNA, 21 nt, Pseudomonas aeruginosa PA01
gccggccuggaucucggcggc

SEQ ID NO: 3503706 - RNA, 23 nt, Pseudomonas aeruginosa PA01
gccggccuggaucucggcggcca

SEQ ID NO: 3503707 - RNA, 17 nt, Pseudomonas aeruginosa PA01
gccggccuugcuuugcg

SEQ ID NO: 3503708 - RNA, 16 nt, Pseudomonas aeruginosa PA01
gccggcgaacagccag

SEQ ID NO: 3503709 - RNA, 17 nt, Pseudomonas aeruginosa PA01
gccggcgaacagccagc

SEQ ID NO: 3503710 - RNA, 18 nt, Pseudomonas aeruginosa PA01
gccggcgaacagccagcg

SEQ ID NO: 3503711 - RNA, 19 nt, Pseudomonas aeruginosa PA01
gccggcgaacagccagcgg

SEQ ID NO: 3503712 - RNA, 13 nt, Pseudomonas aeruginosa PA01
gccggcgaacagg

SEQ ID NO: 3503713 - RNA, 21 nt, Pseudomonas aeruginosa PA01
gccggcgaaccaggcggccga

SEQ ID NO: 3503714 - RNA, 22 nt, Pseudomonas aeruginosa PA01
gccggcgaaccaggcggccgaa

SEQ ID NO: 3503715 - RNA, 19 nt, Pseudomonas aeruginosa PA01
gccggcgaacggcaugcgu

SEQ ID NO: 3503716 - RNA, 12 nt, Pseudomonas aeruginosa PA01
gccggcgaacuc

SEQ ID NO: 3503717 - RNA, 17 nt, Pseudomonas aeruginosa PA01
gccggcgaacucguugu

SEQ ID NO: 3503718 - RNA, 20 nt, Pseudomonas aeruginosa PA01
gccggcgaagggcaggccga

SEQ ID NO: 3503719 - RNA, 21 nt, Pseudomonas aeruginosa PA01
gccggcgaagggcaggccgau

SEQ ID NO: 3503720 - RNA, 21 nt, Pseudomonas aeruginosa PA01
gccggcgaagucguagucgua

SEQ ID NO: 3503721 - RNA, 13 nt, Pseudomonas aeruginosa PA01
gccggcgaccagc

SEQ ID NO: 3503722 - RNA, 14 nt, Pseudomonas aeruginosa PA01
gccggcgaccagcg

SEQ ID NO: 3503723 - RNA, 19 nt, Pseudomonas aeruginosa PA01
gccggcgaccagcgucgcg

SEQ ID NO: 3503724 - RNA, 14 nt, Pseudomonas aeruginosa PA01
gccggcgaccagcu

SEQ ID NO: 3503725 - RNA, 20 nt, Pseudomonas aeruginosa PA01
gccggcgaccagcucgaagc

SEQ ID NO: 3503726 - RNA, 21 nt, Pseudomonas aeruginosa PA01
gccggcgaccgcgcgcauggu

SEQ ID NO: 3503727 - RNA, 13 nt, Pseudomonas aeruginosa PA01
gccggcgaccuug

SEQ ID NO: 3503728 - RNA, 17 nt, Pseudomonas aeruginosa PA01
gccggcgaccuugucca

SEQ ID NO: 3503729 - RNA, 19 nt, Pseudomonas aeruginosa PA01
gccggcgaccuuguccagg

SEQ ID NO: 3503730 - RNA, 20 nt, Pseudomonas aeruginosa PA01
gccggcgaccuuguccaggc

SEQ ID NO: 3503731 - RNA, 17 nt, Pseudomonas aeruginosa PA01
gccggcgaccuuguccu

SEQ ID NO: 3503732 - RNA, 18 nt, Pseudomonas aeruginosa PA01
gccggcgaccuuguccug

SEQ ID NO: 3503733 - RNA, 20 nt, Pseudomonas aeruginosa PA01
gccggcgaccuuguccugcg

SEQ ID NO: 3503734 - RNA, 17 nt, Pseudomonas aeruginosa PA01
gccggcgacgacgaucc

SEQ ID NO: 3503735 - RNA, 18 nt, Pseudomonas aeruginosa PA01
gccggcgacgacgauccc

SEQ ID NO: 3503736 - RNA, 15 nt, Pseudomonas aeruginosa PA01
gccggcgacgaggua

SEQ ID NO: 3503737 - RNA, 15 nt, Pseudomonas aeruginosa PA01
gccggcgacgcagga

SEQ ID NO: 3503738 - RNA, 13 nt, Pseudomonas aeruginosa PA01
gccggcgacgccg

SEQ ID NO: 3503739 - RNA, 16 nt, Pseudomonas aeruginosa PA01
gccggcgacgccgucc

SEQ ID NO: 3503740 - RNA, 15 nt, Pseudomonas aeruginosa PA01
gccggcgagccgcug

SEQ ID NO: 3503741 - RNA, 16 nt, Pseudomonas aeruginosa PA01
gccggcgagccgcugg

SEQ ID NO: 3503742 - RNA, 16 nt, Pseudomonas aeruginosa PA01
gccggcgagcgccugg

SEQ ID NO: 3503743 - RNA, 15 nt, Pseudomonas aeruginosa PA01
gccggcgaggaucgc

SEQ ID NO: 3503744 - RNA, 20 nt, Pseudomonas aeruginosa PA01
gccggcgaggaucgcgcugg

SEQ ID NO: 3503745 - RNA, 22 nt, Pseudomonas aeruginosa PA01
gccggcgaggaucgcgcuggcc

SEQ ID NO: 3503746 - RNA, 23 nt, Pseudomonas aeruginosa PA01
gccggcgaggaucgcgcuggcca

SEQ ID NO: 3503747 - RNA, 16 nt, Pseudomonas aeruginosa PA01
gccggcgaggcggaaa

SEQ ID NO: 3503748 - RNA, 16 nt, Pseudomonas aeruginosa PA01
gccggcgaggcguucc

SEQ ID NO: 3503749 - RNA, 14 nt, Pseudomonas aeruginosa PA01
gccggcgaucagcg

SEQ ID NO: 3503750 - RNA, 20 nt, Pseudomonas aeruginosa PA01
gccggcgaucagcucgcggu

SEQ ID NO: 3503751 - RNA, 23 nt, Pseudomonas aeruginosa PA01
gccggcgaucagcucgcgguagg

SEQ ID NO: 3503752 - RNA, 17 nt, Pseudomonas aeruginosa PA01
gccggcgaucauccagc

SEQ ID NO: 3503753 - RNA, 18 nt, Pseudomonas aeruginosa PA01
gccggcgaucauccagcc

SEQ ID NO: 3503754 - RNA, 12 nt, Pseudomonas aeruginosa PA01
gccggcgaucgc

SEQ ID NO: 3503755 - RNA, 15 nt, Pseudomonas aeruginosa PA01
gccggcgaucgccag

SEQ ID NO: 3503756 - RNA, 17 nt, Pseudomonas aeruginosa PA01
gccggcgaucgccaggc

SEQ ID NO: 3503757 - RNA, 19 nt, Pseudomonas aeruginosa PA01
gccggcgaucgccaggcga

SEQ ID NO: 3503758 - RNA, 23 nt, Pseudomonas aeruginosa PA01
gccggcgaucgccaggcgaucca

SEQ ID NO: 3503759 - RNA, 15 nt, Pseudomonas aeruginosa PA01
gccggcgaucgccgg

SEQ ID NO: 3503760 - RNA, 16 nt, Pseudomonas aeruginosa PA01
gccggcgaucuccgcc

SEQ ID NO: 3503761 - RNA, 20 nt, Pseudomonas aeruginosa PA01
gccggcgaucuccgccaggc

SEQ ID NO: 3503762 - RNA, 22 nt, Pseudomonas aeruginosa PA01
gccggcgaucuccgccaggcgg

SEQ ID NO: 3503763 - RNA, 23 nt, Pseudomonas aeruginosa PA01
gccggcgaucuccgccaggcggc

SEQ ID NO: 3503764 - RNA, 16 nt, Pseudomonas aeruginosa PA01
gccggcgaugcccagg

SEQ ID NO: 3503765 - RNA, 17 nt, Pseudomonas aeruginosa PA01
gccggcgaugcccaggc

SEQ ID NO: 3503766 - RNA, 18 nt, Pseudomonas aeruginosa PA01
gccggcgaugcccaggcc

SEQ ID NO: 3503767 - RNA, 21 nt, Pseudomonas aeruginosa PA01
gccggcgaugcccaggccgcc

SEQ ID NO: 3503768 - RNA, 22 nt, Pseudomonas aeruginosa PA01
gccggcgaugcccaggccgccg

SEQ ID NO: 3503769 - RNA, 16 nt, Pseudomonas aeruginosa PA01
gccggcgaugccgccc

SEQ ID NO: 3503770 - RNA, 17 nt, Pseudomonas aeruginosa PA01
gccggcgaugccgccca

SEQ ID NO: 3503771 - RNA, 20 nt, Pseudomonas aeruginosa PA01
gccggcgaugccgcccagca

SEQ ID NO: 3503772 - RNA, 16 nt, Pseudomonas aeruginosa PA01
gccggcgaugcgcagg

SEQ ID NO: 3503773 - RNA, 23 nt, Pseudomonas aeruginosa PA01
gccggcgauggcccagaugauca

SEQ ID NO: 3503774 - RNA, 20 nt, Pseudomonas aeruginosa PA01
gccggcgauggccgccugca

SEQ ID NO: 3503775 - RNA, 22 nt, Pseudomonas aeruginosa PA01
gccggcgauggccgccugcagg

SEQ ID NO: 3503776 - RNA, 21 nt, Pseudomonas aeruginosa PA01
gccggcgaugugcggcguggc

SEQ ID NO: 3503777 - RNA, 22 nt, Pseudomonas aeruginosa PA01
gccggcgaugugcggcguggcg

SEQ ID NO: 3503778 - RNA, 17 nt, Pseudomonas aeruginosa PA01
gccggcgcagaucgcgg

SEQ ID NO: 3503779 - RNA, 20 nt, Pseudomonas aeruginosa PA01
gccggcgcagaucgcggcgc

SEQ ID NO: 3503780 - RNA, 22 nt, Pseudomonas aeruginosa PA01
gccggcgcagaucgcggcgcag

SEQ ID NO: 3503781 - RNA, 22 nt, Pseudomonas aeruginosa PA01
gccggcgcaucgucgaaacgcu

SEQ ID NO: 3503782 - RNA, 17 nt, Pseudomonas aeruginosa PA01
gccggcgcaugcgccgg

SEQ ID NO: 3503783 - RNA, 19 nt, Pseudomonas aeruginosa PA01
gccggcgcaugcgccggcu

SEQ ID NO: 3503784 - RNA, 14 nt, Pseudomonas aeruginosa PA01
gccggcgccagcag

SEQ ID NO: 3503785 - RNA, 16 nt, Pseudomonas aeruginosa PA01
gccggcgccagcaggc

SEQ ID NO: 3503786 - RNA, 21 nt, Pseudomonas aeruginosa PA01
gccggcgccaucgaucagcag

SEQ ID NO: 3503787 - RNA, 22 nt, Pseudomonas aeruginosa PA01
gccggcgccaucgaucagcagc

SEQ ID NO: 3503788 - RNA, 23 nt, Pseudomonas aeruginosa PA01
gccggcgccaucgaucagcagcg

SEQ ID NO: 3503789 - RNA, 14 nt, Pseudomonas aeruginosa PA01
gccggcgcccugcu

SEQ ID NO: 3503790 - RNA, 13 nt, Pseudomonas aeruginosa PA01
gccggcgcccugg

SEQ ID NO: 3503791 - RNA, 15 nt, Pseudomonas aeruginosa PA01
gccggcgcccugggc

SEQ ID NO: 3503792 - RNA, 13 nt, Pseudomonas aeruginosa PA01
gccggcgcccuuc

SEQ ID NO: 3503793 - RNA, 23 nt, Pseudomonas aeruginosa PA01
gccggcgccgauauugaacgacu

SEQ ID NO: 3503794 - RNA, 14 nt, Pseudomonas aeruginosa PA01
gccggcgccgaugc

SEQ ID NO: 3503795 - RNA, 14 nt, Pseudomonas aeruginosa PA01
gccggcgccgcagg

SEQ ID NO: 3503796 - RNA, 21 nt, Pseudomonas aeruginosa PA01
gccggcgccgcagggugcggc

SEQ ID NO: 3503797 - RNA, 12 nt, Pseudomonas aeruginosa PA01
gccggcgccgcc

SEQ ID NO: 3503798 - RNA, 15 nt, Pseudomonas aeruginosa PA01
gccggcgccgccgaa

SEQ ID NO: 3503799 - RNA, 20 nt, Pseudomonas aeruginosa PA01
gccggcgccgccgaacaugc

SEQ ID NO: 3503800 - RNA, 15 nt, Pseudomonas aeruginosa PA01
gccggcgccgccucg

SEQ ID NO: 3503801 - RNA, 16 nt, Pseudomonas aeruginosa PA01
gccggcgccgcggucg

SEQ ID NO: 3503802 - RNA, 13 nt, Pseudomonas aeruginosa PA01
gccggcgccgucg

SEQ ID NO: 3503803 - RNA, 19 nt, Pseudomonas aeruginosa PA01
gccggcgccuucaucgcca

SEQ ID NO: 3503804 - RNA, 13 nt, Pseudomonas aeruginosa PA01
gccggcgccuugc

SEQ ID NO: 3503805 - RNA, 18 nt, Pseudomonas aeruginosa PA01
gccggcgcgauccuggcg

SEQ ID NO: 3503806 - RNA, 19 nt, Pseudomonas aeruginosa PA01
gccggcgcgauccuggcgg

SEQ ID NO: 3503807 - RNA, 21 nt, Pseudomonas aeruginosa PA01
gccggcgcgauccuggcggca

SEQ ID NO: 3503808 - RNA, 16 nt, Pseudomonas aeruginosa PA01
gccggcgcgcacggag

SEQ ID NO: 3503809 - RNA, 12 nt, Pseudomonas aeruginosa PA01
gccggcgcgccc

SEQ ID NO: 3503810 - RNA, 17 nt, Pseudomonas aeruginosa PA01
gccggcgcgcccaggcc

SEQ ID NO: 3503811 - RNA, 19 nt, Pseudomonas aeruginosa PA01
gccggcgcgcccaggccca

SEQ ID NO: 3503812 - RNA, 20 nt, Pseudomonas aeruginosa PA01
gccggcgcgccccugcgccc

SEQ ID NO: 3503813 - RNA, 15 nt, Pseudomonas aeruginosa PA01
gccggcgcgcccggc

SEQ ID NO: 3503814 - RNA, 14 nt, Pseudomonas aeruginosa PA01
gccggcgcgcggcg

SEQ ID NO: 3503815 - RNA, 13 nt, Pseudomonas aeruginosa PA01
gccggcgcgcggu

SEQ ID NO: 3503816 - RNA, 17 nt, Pseudomonas aeruginosa PA01
gccggcgcggacggccu

SEQ ID NO: 3503817 - RNA, 19 nt, Pseudomonas aeruginosa PA01
gccggcgcggacggccugc

SEQ ID NO: 3503818 - RNA, 13 nt, Pseudomonas aeruginosa PA01
gccggcgcggcgc

SEQ ID NO: 3503819 - RNA, 16 nt, Pseudomonas aeruginosa PA01
gccggcgcgggcggcc

SEQ ID NO: 3503820 - RNA, 17 nt, Pseudomonas aeruginosa PA01
gccggcgcgggcggccu

SEQ ID NO: 3503821 - RNA, 21 nt, Pseudomonas aeruginosa PA01
gccggcgcggucucgcguuca

SEQ ID NO: 3503822 - RNA, 15 nt, Pseudomonas aeruginosa PA01
gccggcgcguaggug

SEQ ID NO: 3503823 - RNA, 21 nt, Pseudomonas aeruginosa PA01
gccggcgcgucccugggcgca

SEQ ID NO: 3503824 - RNA, 18 nt, Pseudomonas aeruginosa PA01
gccggcgcgucgcugcgc

SEQ ID NO: 3503825 - RNA, 19 nt, Pseudomonas aeruginosa PA01
gccggcgcgucgcugcgca

SEQ ID NO: 3503826 - RNA, 24 nt, Pseudomonas aeruginosa PA01
gccggcgcgucgcugcgcaacugc

SEQ ID NO: 3503827 - RNA, 24 nt, Pseudomonas aeruginosa PA01
gccggcgcguucacuccacgagga

SEQ ID NO: 3503828 - RNA, 20 nt, Pseudomonas aeruginosa PA01
gccggcgcguucucugucgg

SEQ ID NO: 3503829 - RNA, 15 nt, Pseudomonas aeruginosa PA01
gccggcgcuccuccu

SEQ ID NO: 3503830 - RNA, 14 nt, Pseudomonas aeruginosa PA01
gccggcgcucggcc

SEQ ID NO: 3503831 - RNA, 15 nt, Pseudomonas aeruginosa PA01
gccggcgcucggcca

SEQ ID NO: 3503832 - RNA, 17 nt, Pseudomonas aeruginosa PA01
gccggcgcucggccagg

SEQ ID NO: 3503833 - RNA, 21 nt, Pseudomonas aeruginosa PA01
gccggcgcucggccaggucgc

SEQ ID NO: 3503834 - RNA, 16 nt, Pseudomonas aeruginosa PA01
gccggcgcugcgagcg

SEQ ID NO: 3503835 - RNA, 13 nt, Pseudomonas aeruginosa PA01
gccggcgcugguu

SEQ ID NO: 3503836 - RNA, 18 nt, Pseudomonas aeruginosa PA01
gccggcgcugucucgcca

SEQ ID NO: 3503837 - RNA, 20 nt, Pseudomonas aeruginosa PA01
gccggcgcugucucgccagc

SEQ ID NO: 3503838 - RNA, 17 nt, Pseudomonas aeruginosa PA01
gccggcggaucacaggc

SEQ ID NO: 3503839 - RNA, 19 nt, Pseudomonas aeruginosa PA01
gccggcggaucagcccgcu

SEQ ID NO: 3503840 - RNA, 20 nt, Pseudomonas aeruginosa PA01
gccggcggaucagcccgcug

SEQ ID NO: 3503841 - RNA, 23 nt, Pseudomonas aeruginosa PA01
gccggcggaucagcccgcugacc

SEQ ID NO: 3503842 - RNA, 15 nt, Pseudomonas aeruginosa PA01
gccggcggccggcgc

SEQ ID NO: 3503843 - RNA, 18 nt, Pseudomonas aeruginosa PA01
gccggcggccugagccgg

SEQ ID NO: 3503844 - RNA, 21 nt, Pseudomonas aeruginosa PA01
gccggcggccugagccggccg

SEQ ID NO: 3503845 - RNA, 15 nt, Pseudomonas aeruginosa PA01
gccggcggccugccc

SEQ ID NO: 3503846 - RNA, 15 nt, Pseudomonas aeruginosa PA01
gccggcggcgaugau

SEQ ID NO: 3503847 - RNA, 22 nt, Pseudomonas aeruginosa PA01
gccggcggcgaugaucggcagc

SEQ ID NO: 3503848 - RNA, 14 nt, Pseudomonas aeruginosa PA01
gccggcggcgcggc

SEQ ID NO: 3503849 - RNA, 15 nt, Pseudomonas aeruginosa PA01
gccggcggcgcggca

SEQ ID NO: 3503850 - RNA, 16 nt, Pseudomonas aeruginosa PA01
gccggcggcgcggcag

SEQ ID NO: 3503851 - RNA, 13 nt, Pseudomonas aeruginosa PA01
gccggcggcgcgu

SEQ ID NO: 3503852 - RNA, 15 nt, Pseudomonas aeruginosa PA01
gccggcggcgcgucc

SEQ ID NO: 3503853 - RNA, 23 nt, Pseudomonas aeruginosa PA01
gccggcggcgcguccaccuggcg

SEQ ID NO: 3503854 - RNA, 15 nt, Pseudomonas aeruginosa PA01
gccggcggcgcugag

SEQ ID NO: 3503855 - RNA, 12 nt, Pseudomonas aeruginosa PA01
gccggcggcgga

SEQ ID NO: 3503856 - RNA, 18 nt, Pseudomonas aeruginosa PA01
gccggcggcggacgcagg

SEQ ID NO: 3503857 - RNA, 21 nt, Pseudomonas aeruginosa PA01
gccggcggcggacgcaggccg

SEQ ID NO: 3503858 - RNA, 22 nt, Pseudomonas aeruginosa PA01
gccggcggcggacgcaggccga

SEQ ID NO: 3503859 - RNA, 12 nt, Pseudomonas aeruginosa PA01
gccggcgggcgc

SEQ ID NO: 3503860 - RNA, 14 nt, Pseudomonas aeruginosa PA01
gccggcgggcgcga

SEQ ID NO: 3503861 - RNA, 16 nt, Pseudomonas aeruginosa PA01
gccggcgggcgcgagg

SEQ ID NO: 3503862 - RNA, 17 nt, Pseudomonas aeruginosa PA01
gccggcgggcgcgaggc

SEQ ID NO: 3503863 - RNA, 20 nt, Pseudomonas aeruginosa PA01
gccggcgggcgcgaggcgcc

SEQ ID NO: 3503864 - RNA, 23 nt, Pseudomonas aeruginosa PA01
gccggcgggcgcgaggcgcccgc

SEQ ID NO: 3503865 - RNA, 18 nt, Pseudomonas aeruginosa PA01
gccggcggguguggggaa

SEQ ID NO: 3503866 - RNA, 23 nt, Pseudomonas aeruginosa PA01
gccggcggugagggcgacggcgg

SEQ ID NO: 3503867 - RNA, 17 nt, Pseudomonas aeruginosa PA01
gccggcggugcggaaga

SEQ ID NO: 3503868 - RNA, 18 nt, Pseudomonas aeruginosa PA01
gccggcgguggacgucgg

SEQ ID NO: 3503869 - RNA, 19 nt, Pseudomonas aeruginosa PA01
gccggcgguggacgucggc

SEQ ID NO: 3503870 - RNA, 14 nt, Pseudomonas aeruginosa PA01
gccggcguccgccg

SEQ ID NO: 3503871 - RNA, 17 nt, Pseudomonas aeruginosa PA01
gccggcguccuccucca

SEQ ID NO: 3503872 - RNA, 20 nt, Pseudomonas aeruginosa PA01
gccggcguccuugccgagga

SEQ ID NO: 3503873 - RNA, 17 nt, Pseudomonas aeruginosa PA01
gccggcgucguccugcg

SEQ ID NO: 3503874 - RNA, 22 nt, Pseudomonas aeruginosa PA01
gccggcgucguccugcgcggcg

SEQ ID NO: 3503875 - RNA, 19 nt, Pseudomonas aeruginosa PA01
gccggcgugaacgcggcga

SEQ ID NO: 3503876 - RNA, 15 nt, Pseudomonas aeruginosa PA01
gccggcgugcccauc

SEQ ID NO: 3503877 - RNA, 18 nt, Pseudomonas aeruginosa PA01
gccggcgugcccauccgc

SEQ ID NO: 3503878 - RNA, 22 nt, Pseudomonas aeruginosa PA01
gccggcgugcccuuuuccucca

SEQ ID NO: 3503879 - RNA, 12 nt, Pseudomonas aeruginosa PA01
gccggcgugccg

SEQ ID NO: 3503880 - RNA, 17 nt, Pseudomonas aeruginosa PA01
gccggcguuauccgccg

SEQ ID NO: 3503881 - RNA, 18 nt, Pseudomonas aeruginosa PA01
gccggcguuauccgccga

SEQ ID NO: 3503882 - RNA, 20 nt, Pseudomonas aeruginosa PA01
gccggcguuauccgccgaua

SEQ ID NO: 3503883 - RNA, 18 nt, Pseudomonas aeruginosa PA01
gccggcguucgacgccuu

SEQ ID NO: 3503884 - RNA, 22 nt, Pseudomonas aeruginosa PA01
gccggcguuggaauaguggauc

SEQ ID NO: 3503885 - RNA, 19 nt, Pseudomonas aeruginosa PA01
gccggcguuggcgucgcug

SEQ ID NO: 3503886 - RNA, 15 nt, Pseudomonas aeruginosa PA01
gccggcuaaccgcga

SEQ ID NO: 3503887 - RNA, 15 nt, Pseudomonas aeruginosa PA01
gccggcuacucgugg

SEQ ID NO: 3503888 - RNA, 20 nt, Pseudomonas aeruginosa PA01
gccggcucagaaauccaccu

SEQ ID NO: 3503889 - RNA, 21 nt, Pseudomonas aeruginosa PA01
gccggcucagaaauccaccuu

SEQ ID NO: 3503890 - RNA, 14 nt, Pseudomonas aeruginosa PA01
gccggcucagcgcu

SEQ ID NO: 3503891 - RNA, 23 nt, Pseudomonas aeruginosa PA01
gccggcuccccuggaaugccggc

SEQ ID NO: 3503892 - RNA, 14 nt, Pseudomonas aeruginosa PA01
gccggcuccuugcg

SEQ ID NO: 3503893 - RNA, 15 nt, Pseudomonas aeruginosa PA01
gccggcuccuugcgc

SEQ ID NO: 3503894 - RNA, 17 nt, Pseudomonas aeruginosa PA01
gccggcuccuugcgccg

SEQ ID NO: 3503895 - RNA, 19 nt, Pseudomonas aeruginosa PA01
gccggcuccuugcgccguu

SEQ ID NO: 3503896 - RNA, 22 nt, Pseudomonas aeruginosa PA01
gccggcuccuugcgccguugcc

SEQ ID NO: 3503897 - RNA, 13 nt, Pseudomonas aeruginosa PA01
gccggcucgccca

SEQ ID NO: 3503898 - RNA, 18 nt, Pseudomonas aeruginosa PA01
gccggcucgguguaggcg

SEQ ID NO: 3503899 - RNA, 18 nt, Pseudomonas aeruginosa PA01
gccggcugacgcuggcga

SEQ ID NO: 3503900 - RNA, 14 nt, Pseudomonas aeruginosa PA01
gccggcugaugccc

SEQ ID NO: 3503901 - RNA, 14 nt, Pseudomonas aeruginosa PA01
gccggcugccgaag

SEQ ID NO: 3503902 - RNA, 14 nt, Pseudomonas aeruginosa PA01
gccggcugcgccgc

SEQ ID NO: 3503903 - RNA, 17 nt, Pseudomonas aeruginosa PA01
gccggcugugcagggca

SEQ ID NO: 3503904 - RNA, 18 nt, Pseudomonas aeruginosa PA01
gccggcugugcagggcag

SEQ ID NO: 3503905 - RNA, 19 nt, Pseudomonas aeruginosa PA01
gccggcugugcagggcagc

SEQ ID NO: 3503906 - RNA, 21 nt, Pseudomonas aeruginosa PA01
gccggcugugcagggcagcgg

SEQ ID NO: 3503907 - RNA, 16 nt, Pseudomonas aeruginosa PA01
gccggcuuccucgccc

SEQ ID NO: 3503908 - RNA, 17 nt, Pseudomonas aeruginosa PA01
gccggcuucuacgccuu

SEQ ID NO: 3503909 - RNA, 23 nt, Pseudomonas aeruginosa PA01
gccggcuucuacgccuugcggcg

SEQ ID NO: 3503910 - RNA, 16 nt, Pseudomonas aeruginosa PA01
gccggcuugcugcagg

SEQ ID NO: 3503911 - RNA, 12 nt, Pseudomonas aeruginosa PA01
gccgggaaccag

SEQ ID NO: 3503912 - RNA, 16 nt, Pseudomonas aeruginosa PA01
gccgggaaccagcaug

SEQ ID NO: 3503913 - RNA, 23 nt, Pseudomonas aeruginosa PA01
gccgggaagcaccgacucgcccu

SEQ ID NO: 3503914 - RNA, 15 nt, Pseudomonas aeruginosa PA01
gccgggaagccgcuc

SEQ ID NO: 3503915 - RNA, 16 nt, Pseudomonas aeruginosa PA01
gccgggaagccgcucg

SEQ ID NO: 3503916 - RNA, 20 nt, Pseudomonas aeruginosa PA01
gccgggaagccgcucggcgu

SEQ ID NO: 3503917 - RNA, 23 nt, Pseudomonas aeruginosa PA01
gccgggaagccgcucggcguagc

SEQ ID NO: 3503918 - RNA, 15 nt, Pseudomonas aeruginosa PA01
gccgggaagcgcagg

SEQ ID NO: 3503919 - RNA, 16 nt, Pseudomonas aeruginosa PA01
gccgggaagcgcaggc

SEQ ID NO: 3503920 - RNA, 18 nt, Pseudomonas aeruginosa PA01
gccgggaagcgcaggccg

SEQ ID NO: 3503921 - RNA, 21 nt, Pseudomonas aeruginosa PA01
gccgggaagcgcaggccgccg

SEQ ID NO: 3503922 - RNA, 22 nt, Pseudomonas aeruginosa PA01
gccgggaagcgcaggccgccgg

SEQ ID NO: 3503923 - RNA, 14 nt, Pseudomonas aeruginosa PA01
gccgggaaucccca

SEQ ID NO: 3503924 - RNA, 16 nt, Pseudomonas aeruginosa PA01
gccgggaaucgccagc

SEQ ID NO: 3503925 - RNA, 17 nt, Pseudomonas aeruginosa PA01
gccgggaaucuggccga

SEQ ID NO: 3503926 - RNA, 20 nt, Pseudomonas aeruginosa PA01
gccgggaauggagaugccga

SEQ ID NO: 3503927 - RNA, 19 nt, Pseudomonas aeruginosa PA01
gccgggagcuacagcgauu

SEQ ID NO: 3503928 - RNA, 17 nt, Pseudomonas aeruginosa PA01
gccgggauacagcagcc

SEQ ID NO: 3503929 - RNA, 18 nt, Pseudomonas aeruginosa PA01
gccgggauacagcagcca

SEQ ID NO: 3503930 - RNA, 13 nt, Pseudomonas aeruginosa PA01
gccgggaucaccu

SEQ ID NO: 3503931 - RNA, 14 nt, Pseudomonas aeruginosa PA01
gccgggaucaccuc

SEQ ID NO: 3503932 - RNA, 20 nt, Pseudomonas aeruginosa PA01
gccgggaucuccucgacggc

SEQ ID NO: 3503933 - RNA, 23 nt, Pseudomonas aeruginosa PA01
gccgggaucuccucgacggcggg

SEQ ID NO: 3503934 - RNA, 16 nt, Pseudomonas aeruginosa PA01
gccgggaugaacccgg

SEQ ID NO: 3503935 - RNA, 17 nt, Pseudomonas aeruginosa PA01
gccgggaugaacccggc

SEQ ID NO: 3503936 - RNA, 23 nt, Pseudomonas aeruginosa PA01
gccgggauuguugcggcggguca

SEQ ID NO: 3503937 - RNA, 12 nt, Pseudomonas aeruginosa PA01
gccgggcaacgc

SEQ ID NO: 3503938 - RNA, 17 nt, Pseudomonas aeruginosa PA01
gccgggcaacgccaggc

SEQ ID NO: 3503939 - RNA, 23 nt, Pseudomonas aeruginosa PA01
gccgggcaacgcgcagaggcgcu

SEQ ID NO: 3503940 - RNA, 17 nt, Pseudomonas aeruginosa PA01
gccgggcaagcucgacg

SEQ ID NO: 3503941 - RNA, 24 nt, Pseudomonas aeruginosa PA01
gccgggcaccccgagcggcgcgaa

SEQ ID NO: 3503942 - RNA, 13 nt, Pseudomonas aeruginosa PA01
gccgggcagccgu

SEQ ID NO: 3503943 - RNA, 18 nt, Pseudomonas aeruginosa PA01
gccgggcaggccgaggcc

SEQ ID NO: 3503944 - RNA, 20 nt, Pseudomonas aeruginosa PA01
gccgggcaggccgaggccgg

SEQ ID NO: 3503945 - RNA, 21 nt, Pseudomonas aeruginosa PA01
gccgggcaggccgaggccggc

SEQ ID NO: 3503946 - RNA, 14 nt, Pseudomonas aeruginosa PA01
gccgggcagugcgc

SEQ ID NO: 3503947 - RNA, 15 nt, Pseudomonas aeruginosa PA01
gccgggcagugcgcc

SEQ ID NO: 3503948 - RNA, 18 nt, Pseudomonas aeruginosa PA01
gccgggcagugcgcccuc

SEQ ID NO: 3503949 - RNA, 23 nt, Pseudomonas aeruginosa PA01
gccgggcagugcgcccucgaacg

SEQ ID NO: 3503950 - RNA, 21 nt, Pseudomonas aeruginosa PA01
gccgggcaucaugccgagcau

SEQ ID NO: 3503951 - RNA, 16 nt, Pseudomonas aeruginosa PA01
gccgggcauucgcagc

SEQ ID NO: 3503952 - RNA, 17 nt, Pseudomonas aeruginosa PA01
gccgggcauucgcagcg

SEQ ID NO: 3503953 - RNA, 13 nt, Pseudomonas aeruginosa PA01
gccgggccagcuc

SEQ ID NO: 3503954 - RNA, 15 nt, Pseudomonas aeruginosa PA01
gccgggccagcucca

SEQ ID NO: 3503955 - RNA, 17 nt, Pseudomonas aeruginosa PA01
gccgggccagcuccagc

SEQ ID NO: 3503956 - RNA, 18 nt, Pseudomonas aeruginosa PA01
gccgggccagcuccagca

SEQ ID NO: 3503957 - RNA, 14 nt, Pseudomonas aeruginosa PA01
gccgggcccugggc

SEQ ID NO: 3503958 - RNA, 15 nt, Pseudomonas aeruginosa PA01
gccgggcccugggcc

SEQ ID NO: 3503959 - RNA, 16 nt, Pseudomonas aeruginosa PA01
gccgggcccugggccc

SEQ ID NO: 3503960 - RNA, 18 nt, Pseudomonas aeruginosa PA01
gccgggcccugggccccg

SEQ ID NO: 3503961 - RNA, 20 nt, Pseudomonas aeruginosa PA01
gccgggcccugggccccggc

SEQ ID NO: 3503962 - RNA, 22 nt, Pseudomonas aeruginosa PA01
gccgggccgaucaccaccugga

SEQ ID NO: 3503963 - RNA, 14 nt, Pseudomonas aeruginosa PA01
gccgggccgcagcg

SEQ ID NO: 3503964 - RNA, 13 nt, Pseudomonas aeruginosa PA01
gccgggccggcca

SEQ ID NO: 3503965 - RNA, 17 nt, Pseudomonas aeruginosa PA01
gccgggcgagucgauca

SEQ ID NO: 3503966 - RNA, 18 nt, Pseudomonas aeruginosa PA01
gccgggcgagucgaucag

SEQ ID NO: 3503967 - RNA, 20 nt, Pseudomonas aeruginosa PA01
gccgggcgagucgaucaggu

SEQ ID NO: 3503968 - RNA, 23 nt, Pseudomonas aeruginosa PA01
gccgggcgagucgaucaggucgc

SEQ ID NO: 3503969 - RNA, 14 nt, Pseudomonas aeruginosa PA01
gccgggcgcccggc

SEQ ID NO: 3503970 - RNA, 15 nt, Pseudomonas aeruginosa PA01
gccgggcgcccggcc

SEQ ID NO: 3503971 - RNA, 21 nt, Pseudomonas aeruginosa PA01
gccgggcgcgaugccgaugcc

SEQ ID NO: 3503972 - RNA, 13 nt, Pseudomonas aeruginosa PA01
gccgggcgcgcgc

SEQ ID NO: 3503973 - RNA, 15 nt, Pseudomonas aeruginosa PA01
gccgggcgcgcgccu

SEQ ID NO: 3503974 - RNA, 13 nt, Pseudomonas aeruginosa PA01
gccgggcgcgcug

SEQ ID NO: 3503975 - RNA, 14 nt, Pseudomonas aeruginosa PA01
gccgggcgcgcugg

SEQ ID NO: 3503976 - RNA, 17 nt, Pseudomonas aeruginosa PA01
gccgggcgcgcuggucg

SEQ ID NO: 3503977 - RNA, 16 nt, Pseudomonas aeruginosa PA01
gccgggcggacgcugg

SEQ ID NO: 3503978 - RNA, 12 nt, Pseudomonas aeruginosa PA01
gccgggcggcgg

SEQ ID NO: 3503979 - RNA, 15 nt, Pseudomonas aeruginosa PA01
gccgggcggcgucgc

SEQ ID NO: 3503980 - RNA, 21 nt, Pseudomonas aeruginosa PA01
gccgggcggcgucgcggagaa

SEQ ID NO: 3503981 - RNA, 18 nt, Pseudomonas aeruginosa PA01
gccgggcgucugcccggu

SEQ ID NO: 3503982 - RNA, 17 nt, Pseudomonas aeruginosa PA01
gccgggcgugucgagga

SEQ ID NO: 3503983 - RNA, 23 nt, Pseudomonas aeruginosa PA01
gccgggcgugucgaggaaggcca

SEQ ID NO: 3503984 - RNA, 23 nt, Pseudomonas aeruginosa PA01
gccgggcguuuucguugccgcgc

SEQ ID NO: 3503985 - RNA, 24 nt, Pseudomonas aeruginosa PA01
gccgggcguuuucguugccgcgcu

SEQ ID NO: 3503986 - RNA, 20 nt, Pseudomonas aeruginosa PA01
gccgggcuagguuuccccgu

SEQ ID NO: 3503987 - RNA, 16 nt, Pseudomonas aeruginosa PA01
gccgggcucagcgcgc

SEQ ID NO: 3503988 - RNA, 22 nt, Pseudomonas aeruginosa PA01
gccgggcucagcgcgcguagcg

SEQ ID NO: 3503989 - RNA, 21 nt, Pseudomonas aeruginosa PA01
gccgggcuccagcaucaccuu

SEQ ID NO: 3503990 - RNA, 22 nt, Pseudomonas aeruginosa PA01
gccgggcuccagcaucaccuug

SEQ ID NO: 3503991 - RNA, 23 nt, Pseudomonas aeruginosa PA01
gccgggcuccagcaucaccuugc

SEQ ID NO: 3503992 - RNA, 22 nt, Pseudomonas aeruginosa PA01
gccgggcucugguagccgcagu

SEQ ID NO: 3503993 - RNA, 14 nt, Pseudomonas aeruginosa PA01
gccgggcuggccac

SEQ ID NO: 3503994 - RNA, 17 nt, Pseudomonas aeruginosa PA01
gccgggcuggccaccgc

SEQ ID NO: 3503995 - RNA, 17 nt, Pseudomonas aeruginosa PA01
gccgggcuggccgucga

SEQ ID NO: 3503996 - RNA, 21 nt, Pseudomonas aeruginosa PA01
gccgggcugguucagcggguu

SEQ ID NO: 3503997 - RNA, 20 nt, Pseudomonas aeruginosa PA01
gccgggcuguagugcuccgg

SEQ ID NO: 3503998 - RNA, 16 nt, Pseudomonas aeruginosa PA01
gccgggcuuccuggcc

SEQ ID NO: 3503999 - RNA, 19 nt, Pseudomonas aeruginosa PA01
gccgggcuuccuggccggg

SEQ ID NO: 3504000 - RNA, 14 nt, Pseudomonas aeruginosa PA01
gccgggcuucggug

SEQ ID NO: 3504001 - RNA, 16 nt, Pseudomonas aeruginosa PA01
gccgggcuucggugua

SEQ ID NO: 3504002 - RNA, 23 nt, Pseudomonas aeruginosa PA01
gccgggcuucgguguaucggcgg

SEQ ID NO: 3504003 - RNA, 17 nt, Pseudomonas aeruginosa PA01
gccgggcuucuucaggc

SEQ ID NO: 3504004 - RNA, 21 nt, Pseudomonas aeruginosa PA01
gccgggcuuuuucauggcugg

SEQ ID NO: 3504005 - RNA, 22 nt, Pseudomonas aeruginosa PA01
gccgggcuuuuucauggcuggc

SEQ ID NO: 3504006 - RNA, 23 nt, Pseudomonas aeruginosa PA01
gccgggcuuuuucaugggcgcgc

SEQ ID NO: 3504007 - RNA, 14 nt, Pseudomonas aeruginosa PA01
gccggggaacaggu

SEQ ID NO: 3504008 - RNA, 15 nt, Pseudomonas aeruginosa PA01
gccggggaacagguu

SEQ ID NO: 3504009 - RNA, 19 nt, Pseudomonas aeruginosa PA01
gccggggaaccacaccugc

SEQ ID NO: 3504010 - RNA, 19 nt, Pseudomonas aeruginosa PA01
gccggggaagauguucgcc

SEQ ID NO: 3504011 - RNA, 14 nt, Pseudomonas aeruginosa PA01
gccggggaucaggu

SEQ ID NO: 3504012 - RNA, 17 nt, Pseudomonas aeruginosa PA01
gccggggaucaggucgc

SEQ ID NO: 3504013 - RNA, 19 nt, Pseudomonas aeruginosa PA01
gccggggaucaggucgccg

SEQ ID NO: 3504014 - RNA, 21 nt, Pseudomonas aeruginosa PA01
gccggggaucaggucgccgcu

SEQ ID NO: 3504015 - RNA, 22 nt, Pseudomonas aeruginosa PA01
gccggggaucaggucgccgcug

SEQ ID NO: 3504016 - RNA, 23 nt, Pseudomonas aeruginosa PA01
gccggggaucaggucgccgcuga

SEQ ID NO: 3504017 - RNA, 12 nt, Pseudomonas aeruginosa PA01
gccggggaucgg

SEQ ID NO: 3504018 - RNA, 16 nt, Pseudomonas aeruginosa PA01
gccggggaucggcauc

SEQ ID NO: 3504019 - RNA, 15 nt, Pseudomonas aeruginosa PA01
gccggggcagcaggg

SEQ ID NO: 3504020 - RNA, 15 nt, Pseudomonas aeruginosa PA01
gccggggcaggcaug

SEQ ID NO: 3504021 - RNA, 16 nt, Pseudomonas aeruginosa PA01
gccggggccggcaccc

SEQ ID NO: 3504022 - RNA, 14 nt, Pseudomonas aeruginosa PA01
gccggggccguuca

SEQ ID NO: 3504023 - RNA, 23 nt, Pseudomonas aeruginosa PA01
gccggggccuacugcuggacggc

SEQ ID NO: 3504024 - RNA, 14 nt, Pseudomonas aeruginosa PA01
gccggggcgcaggu

SEQ ID NO: 3504025 - RNA, 12 nt, Pseudomonas aeruginosa PA01
gccggggcgcgc

SEQ ID NO: 3504026 - RNA, 16 nt, Pseudomonas aeruginosa PA01
gccggggcgcgcccgc

SEQ ID NO: 3504027 - RNA, 19 nt, Pseudomonas aeruginosa PA01
gccggggcgcgcccgccag

SEQ ID NO: 3504028 - RNA, 21 nt, Pseudomonas aeruginosa PA01
gccggggcgcgcccgccaggu

SEQ ID NO: 3504029 - RNA, 20 nt, Pseudomonas aeruginosa PA01
gccggggcggauucaggcgc

SEQ ID NO: 3504030 - RNA, 23 nt, Pseudomonas aeruginosa PA01
gccggggcggauucaggcgcgcu

SEQ ID NO: 3504031 - RNA, 13 nt, Pseudomonas aeruginosa PA01
gccggggcgugca

SEQ ID NO: 3504032 - RNA, 20 nt, Pseudomonas aeruginosa PA01
gccggggcucaggccuuggc

SEQ ID NO: 3504033 - RNA, 16 nt, Pseudomonas aeruginosa PA01
gccggggcugagcgca

SEQ ID NO: 3504034 - RNA, 15 nt, Pseudomonas aeruginosa PA01
gccgggggcggcgaa

SEQ ID NO: 3504035 - RNA, 23 nt, Pseudomonas aeruginosa PA01
gccgggggcggcgaacggaccga

SEQ ID NO: 3504036 - RNA, 19 nt, Pseudomonas aeruginosa PA01
gccgggggcggcgccuggu

SEQ ID NO: 3504037 - RNA, 17 nt, Pseudomonas aeruginosa PA01
gccgggggucgcggcga

SEQ ID NO: 3504038 - RNA, 17 nt, Pseudomonas aeruginosa PA01
gccgggggucgcggguu

SEQ ID NO: 3504039 - RNA, 21 nt, Pseudomonas aeruginosa PA01
gccgggggucucguagcagcc

SEQ ID NO: 3504040 - RNA, 16 nt, Pseudomonas aeruginosa PA01
gccggggguguugaaa

SEQ ID NO: 3504041 - RNA, 19 nt, Pseudomonas aeruginosa PA01
gccggggguguugaaagcc

SEQ ID NO: 3504042 - RNA, 16 nt, Pseudomonas aeruginosa PA01
gccggggucaggccga

SEQ ID NO: 3504043 - RNA, 19 nt, Pseudomonas aeruginosa PA01
gccggggucaggccgaggc

SEQ ID NO: 3504044 - RNA, 15 nt, Pseudomonas aeruginosa PA01
gccgggguccgccgg

SEQ ID NO: 3504045 - RNA, 22 nt, Pseudomonas aeruginosa PA01
gccgggguggaguaccaggcca

SEQ ID NO: 3504046 - RNA, 16 nt, Pseudomonas aeruginosa PA01
gccgggguugaguugc

SEQ ID NO: 3504047 - RNA, 15 nt, Pseudomonas aeruginosa PA01
gccggguacagcgcc

SEQ ID NO: 3504048 - RNA, 21 nt, Pseudomonas aeruginosa PA01
gccggguacagcgccacggcc

SEQ ID NO: 3504049 - RNA, 20 nt, Pseudomonas aeruginosa PA01
gccggguagcguuaucgccg

SEQ ID NO: 3504050 - RNA, 13 nt, Pseudomonas aeruginosa PA01
gccggguagggcg

SEQ ID NO: 3504051 - RNA, 14 nt, Pseudomonas aeruginosa PA01
gccggguauccagc

SEQ ID NO: 3504052 - RNA, 19 nt, Pseudomonas aeruginosa PA01
gccggguccaccgcggccu

SEQ ID NO: 3504053 - RNA, 23 nt, Pseudomonas aeruginosa PA01
gccgggucgacaugcaggccggc

SEQ ID NO: 3504054 - RNA, 12 nt, Pseudomonas aeruginosa PA01
gccgggucgacc

SEQ ID NO: 3504055 - RNA, 15 nt, Pseudomonas aeruginosa PA01
gccgggucgaccuug

SEQ ID NO: 3504056 - RNA, 22 nt, Pseudomonas aeruginosa PA01
gccgggucgaccuugccgacgc

SEQ ID NO: 3504057 - RNA, 23 nt, Pseudomonas aeruginosa PA01
gccgggucgacuucgcaccagcc

SEQ ID NO: 3504058 - RNA, 16 nt, Pseudomonas aeruginosa PA01
gccgggucgcagccgg

SEQ ID NO: 3504059 - RNA, 16 nt, Pseudomonas aeruginosa PA01
gccgggucgccgcagc

SEQ ID NO: 3504060 - RNA, 23 nt, Pseudomonas aeruginosa PA01
gccgggucgccgcagcccuaggc

SEQ ID NO: 3504061 - RNA, 18 nt, Pseudomonas aeruginosa PA01
gccgggucguacaccaga

SEQ ID NO: 3504062 - RNA, 16 nt, Pseudomonas aeruginosa PA01
gccgggugaccgugcg

SEQ ID NO: 3504063 - RNA, 12 nt, Pseudomonas aeruginosa PA01
gccgggugccgg

SEQ ID NO: 3504064 - RNA, 17 nt, Pseudomonas aeruginosa PA01
gccgggugcuaugcgcc

SEQ ID NO: 3504065 - RNA, 19 nt, Pseudomonas aeruginosa PA01
gccgggugcuaugcgccgg

SEQ ID NO: 3504066 - RNA, 21 nt, Pseudomonas aeruginosa PA01
gccgggugcuaugcgccgggc

SEQ ID NO: 3504067 - RNA, 16 nt, Pseudomonas aeruginosa PA01
gccggguucccaguug

SEQ ID NO: 3504068 - RNA, 16 nt, Pseudomonas aeruginosa PA01
gccggguuucgucggu

SEQ ID NO: 3504069 - RNA, 23 nt, Pseudomonas aeruginosa PA01
gccggguuucgucggucaucacg

SEQ ID NO: 3504070 - RNA, 22 nt, Pseudomonas aeruginosa PA01
gccggguuuuucuuugccugga

SEQ ID NO: 3504071 - RNA, 14 nt, Pseudomonas aeruginosa PA01
gccgguaauaggcu

SEQ ID NO: 3504072 - RNA, 21 nt, Pseudomonas aeruginosa PA01
gccgguaaugaaaagccccgc

SEQ ID NO: 3504073 - RNA, 23 nt, Pseudomonas aeruginosa PA01
gccgguaaugaaaagccccgcga

SEQ ID NO: 3504074 - RNA, 23 nt, Pseudomonas aeruginosa PA01
gccgguaaugacgaucucgauga

SEQ ID NO: 3504075 - RNA, 22 nt, Pseudomonas aeruginosa PA01
gccgguaauuggccaggcucgc

SEQ ID NO: 3504076 - RNA, 17 nt, Pseudomonas aeruginosa PA01
gccgguacucgccgggc

SEQ ID NO: 3504077 - RNA, 14 nt, Pseudomonas aeruginosa PA01
gccgguagcggcgc

SEQ ID NO: 3504078 - RNA, 16 nt, Pseudomonas aeruginosa PA01
gccgguagcggcgcac

SEQ ID NO: 3504079 - RNA, 19 nt, Pseudomonas aeruginosa PA01
gccgguagcuggccaugcg

SEQ ID NO: 3504080 - RNA, 15 nt, Pseudomonas aeruginosa PA01
gccgguaggggccga

SEQ ID NO: 3504081 - RNA, 17 nt, Pseudomonas aeruginosa PA01
gccgguaggggccgacg

SEQ ID NO: 3504082 - RNA, 18 nt, Pseudomonas aeruginosa PA01
gccgguaggucaccaggu

SEQ ID NO: 3504083 - RNA, 12 nt, Pseudomonas aeruginosa PA01
gccgguagugcu

SEQ ID NO: 3504084 - RNA, 19 nt, Pseudomonas aeruginosa PA01
gccgguaguucgcugaccg

SEQ ID NO: 3504085 - RNA, 14 nt, Pseudomonas aeruginosa PA01
gccgguaucgcgcu

SEQ ID NO: 3504086 - RNA, 18 nt, Pseudomonas aeruginosa PA01
gccggucaaccgcgggcg

SEQ ID NO: 3504087 - RNA, 20 nt, Pseudomonas aeruginosa PA01
gccggucaaccgcgggcgag

SEQ ID NO: 3504088 - RNA, 17 nt, Pseudomonas aeruginosa PA01
gccggucaauucgcgga

SEQ ID NO: 3504089 - RNA, 16 nt, Pseudomonas aeruginosa PA01
gccggucaccacugga

SEQ ID NO: 3504090 - RNA, 17 nt, Pseudomonas aeruginosa PA01
gccggucagagacaggu

SEQ ID NO: 3504091 - RNA, 14 nt, Pseudomonas aeruginosa PA01
gccggucaggcgcc

SEQ ID NO: 3504092 - RNA, 15 nt, Pseudomonas aeruginosa PA01
gccggucaggcgccc

SEQ ID NO: 3504093 - RNA, 12 nt, Pseudomonas aeruginosa PA01
gccggucaggcu

SEQ ID NO: 3504094 - RNA, 18 nt, Pseudomonas aeruginosa PA01
gccggucaggcugcggcg

SEQ ID NO: 3504095 - RNA, 19 nt, Pseudomonas aeruginosa PA01
gccggucaggcugcggcgg

SEQ ID NO: 3504096 - RNA, 14 nt, Pseudomonas aeruginosa PA01
gccggucaggcugg

SEQ ID NO: 3504097 - RNA, 16 nt, Pseudomonas aeruginosa PA01
gccggucccgggcucc

SEQ ID NO: 3504098 - RNA, 21 nt, Pseudomonas aeruginosa PA01
gccggucccgggcuccggguu

SEQ ID NO: 3504099 - RNA, 23 nt, Pseudomonas aeruginosa PA01
gccgguccgacaaucagcggcgg

SEQ ID NO: 3504100 - RNA, 13 nt, Pseudomonas aeruginosa PA01
gccggucgcgcag

SEQ ID NO: 3504101 - RNA, 17 nt, Pseudomonas aeruginosa PA01
gccggucgcgcucaggc

SEQ ID NO: 3504102 - RNA, 20 nt, Pseudomonas aeruginosa PA01
gccggucgcgcucaggcgca

SEQ ID NO: 3504103 - RNA, 21 nt, Pseudomonas aeruginosa PA01
gccggucgcgcucaggcgcag

SEQ ID NO: 3504104 - RNA, 22 nt, Pseudomonas aeruginosa PA01
gccggucgcgcucaggcgcagc

SEQ ID NO: 3504105 - RNA, 12 nt, Pseudomonas aeruginosa PA01
gccggucgggca

SEQ ID NO: 3504106 - RNA, 18 nt, Pseudomonas aeruginosa PA01
gccggucguucgcccuuc

SEQ ID NO: 3504107 - RNA, 19 nt, Pseudomonas aeruginosa PA01
gccggucguucgcccuuca

SEQ ID NO: 3504108 - RNA, 18 nt, Pseudomonas aeruginosa PA01
gccggucucgauggcagc

SEQ ID NO: 3504109 - RNA, 12 nt, Pseudomonas aeruginosa PA01
gccggucucggc

SEQ ID NO: 3504110 - RNA, 13 nt, Pseudomonas aeruginosa PA01
gccggucucggcg

SEQ ID NO: 3504111 - RNA, 14 nt, Pseudomonas aeruginosa PA01
gccggucugcugcg

SEQ ID NO: 3504112 - RNA, 16 nt, Pseudomonas aeruginosa PA01
gccggucugcugcgcg

SEQ ID NO: 3504113 - RNA, 22 nt, Pseudomonas aeruginosa PA01
gccggucugguagcgaaucugc

SEQ ID NO: 3504114 - RNA, 20 nt, Pseudomonas aeruginosa PA01
gccggucuucacgccuugcu

SEQ ID NO: 3504115 - RNA, 18 nt, Pseudomonas aeruginosa PA01
gccggucuugccggcugc

SEQ ID NO: 3504116 - RNA, 13 nt, Pseudomonas aeruginosa PA01
gccggugaacagg

SEQ ID NO: 3504117 - RNA, 17 nt, Pseudomonas aeruginosa PA01
gccggugaacagguagc

SEQ ID NO: 3504118 - RNA, 19 nt, Pseudomonas aeruginosa PA01
gccggugaacagguagcug

SEQ ID NO: 3504119 - RNA, 17 nt, Pseudomonas aeruginosa PA01
gccggugacauucgaca

SEQ ID NO: 3504120 - RNA, 23 nt, Pseudomonas aeruginosa PA01
gccggugacauucgacagcaggu

SEQ ID NO: 3504121 - RNA, 20 nt, Pseudomonas aeruginosa PA01
gccggugacccacuccggca

SEQ ID NO: 3504122 - RNA, 21 nt, Pseudomonas aeruginosa PA01
gccggugacccacuccggcag

SEQ ID NO: 3504123 - RNA, 21 nt, Pseudomonas aeruginosa PA01
gccggugacgaacgaagcgcc

SEQ ID NO: 3504124 - RNA, 20 nt, Pseudomonas aeruginosa PA01
gccggugacgcugcucacca

SEQ ID NO: 3504125 - RNA, 21 nt, Pseudomonas aeruginosa PA01
gccggugaggcgcagcagcgc

SEQ ID NO: 3504126 - RNA, 23 nt, Pseudomonas aeruginosa PA01
gccggugaggcgcagcagcgcca

SEQ ID NO: 3504127 - RNA, 20 nt, Pseudomonas aeruginosa PA01
gccggugaucgagccgccgg

SEQ ID NO: 3504128 - RNA, 15 nt, Pseudomonas aeruginosa PA01
gccggugaugucggc

SEQ ID NO: 3504129 - RNA, 14 nt, Pseudomonas aeruginosa PA01
gccggugcaccagg

SEQ ID NO: 3504130 - RNA, 15 nt, Pseudomonas aeruginosa PA01
gccggugcaccaggc

SEQ ID NO: 3504131 - RNA, 23 nt, Pseudomonas aeruginosa PA01
gccggugcagaagacgcccagca

SEQ ID NO: 3504132 - RNA, 22 nt, Pseudomonas aeruginosa PA01
gccggugcaugaaggcgcugag

SEQ ID NO: 3504133 - RNA, 19 nt, Pseudomonas aeruginosa PA01
gccggugccaggaccagcc

SEQ ID NO: 3504134 - RNA, 19 nt, Pseudomonas aeruginosa PA01
gccggugccauacagcgcc

SEQ ID NO: 3504135 - RNA, 20 nt, Pseudomonas aeruginosa PA01
gccggugccauacagcgccc

SEQ ID NO: 3504136 - RNA, 21 nt, Pseudomonas aeruginosa PA01
gccggugccgaucucguaggc

SEQ ID NO: 3504137 - RNA, 16 nt, Pseudomonas aeruginosa PA01
gccggugccgcccugg

SEQ ID NO: 3504138 - RNA, 15 nt, Pseudomonas aeruginosa PA01
gccggugccgccggc

SEQ ID NO: 3504139 - RNA, 16 nt, Pseudomonas aeruginosa PA01
gccggugccgccggcc

SEQ ID NO: 3504140 - RNA, 13 nt, Pseudomonas aeruginosa PA01
gccggugccggcg

SEQ ID NO: 3504141 - RNA, 15 nt, Pseudomonas aeruginosa PA01
gccggugccggcggc

SEQ ID NO: 3504142 - RNA, 17 nt, Pseudomonas aeruginosa PA01
gccggugccggcggcgg

SEQ ID NO: 3504143 - RNA, 20 nt, Pseudomonas aeruginosa PA01
gccggugccuucggcggcgc

SEQ ID NO: 3504144 - RNA, 21 nt, Pseudomonas aeruginosa PA01
gccggugccuucggcggcgcc

SEQ ID NO: 3504145 - RNA, 15 nt, Pseudomonas aeruginosa PA01
gccggugcgaaccgg

SEQ ID NO: 3504146 - RNA, 18 nt, Pseudomonas aeruginosa PA01
gccggugcgaaccggccu

SEQ ID NO: 3504147 - RNA, 19 nt, Pseudomonas aeruginosa PA01
gccggugcgaaccggccuu

SEQ ID NO: 3504148 - RNA, 14 nt, Pseudomonas aeruginosa PA01
gccggugcgcgauc

SEQ ID NO: 3504149 - RNA, 22 nt, Pseudomonas aeruginosa PA01
gccggugcggguggucgccgcc

SEQ ID NO: 3504150 - RNA, 13 nt, Pseudomonas aeruginosa PA01
gccggugcggucg

SEQ ID NO: 3504151 - RNA, 16 nt, Pseudomonas aeruginosa PA01
gccggugcucggccug

SEQ ID NO: 3504152 - RNA, 18 nt, Pseudomonas aeruginosa PA01
gccggugcucggccugau

SEQ ID NO: 3504153 - RNA, 13 nt, Pseudomonas aeruginosa PA01
gccggugcuggcg

SEQ ID NO: 3504154 - RNA, 14 nt, Pseudomonas aeruginosa PA01
gccggugcuggcga

SEQ ID NO: 3504155 - RNA, 12 nt, Pseudomonas aeruginosa PA01
gccggugcuggu

SEQ ID NO: 3504156 - RNA, 15 nt, Pseudomonas aeruginosa PA01
gccggugcuggugcg

SEQ ID NO: 3504157 - RNA, 21 nt, Pseudomonas aeruginosa PA01
gccggugcuggugcggccgau

SEQ ID NO: 3504158 - RNA, 22 nt, Pseudomonas aeruginosa PA01
gccggugcuggugcggccgaug

SEQ ID NO: 3504159 - RNA, 23 nt, Pseudomonas aeruginosa PA01
gccggugcuggugcggccgauga

SEQ ID NO: 3504160 - RNA, 13 nt, Pseudomonas aeruginosa PA01
gccgguggccagg

SEQ ID NO: 3504161 - RNA, 14 nt, Pseudomonas aeruginosa PA01
gccgguggccagga

SEQ ID NO: 3504162 - RNA, 16 nt, Pseudomonas aeruginosa PA01
gccgguggccaggacg

SEQ ID NO: 3504163 - RNA, 19 nt, Pseudomonas aeruginosa PA01
gccgguggccaggacgcug

SEQ ID NO: 3504164 - RNA, 13 nt, Pseudomonas aeruginosa PA01
gccgguggcgccc

SEQ ID NO: 3504165 - RNA, 14 nt, Pseudomonas aeruginosa PA01
gccgguggcgccca

SEQ ID NO: 3504166 - RNA, 16 nt, Pseudomonas aeruginosa PA01
gccgguggcgcccagc

SEQ ID NO: 3504167 - RNA, 19 nt, Pseudomonas aeruginosa PA01
gccgguggcgcccagccag

SEQ ID NO: 3504168 - RNA, 21 nt, Pseudomonas aeruginosa PA01
gccgguggcgcccagccagag

SEQ ID NO: 3504169 - RNA, 19 nt, Pseudomonas aeruginosa PA01
gccgguggcguuauccgcc

SEQ ID NO: 3504170 - RNA, 17 nt, Pseudomonas aeruginosa PA01
gccgguggucuucagca

SEQ ID NO: 3504171 - RNA, 16 nt, Pseudomonas aeruginosa PA01
gccgguguagcgacgg

SEQ ID NO: 3504172 - RNA, 15 nt, Pseudomonas aeruginosa PA01
gccggugugacggcc

SEQ ID NO: 3504173 - RNA, 17 nt, Pseudomonas aeruginosa PA01
gccggugugacggccgg

SEQ ID NO: 3504174 - RNA, 15 nt, Pseudomonas aeruginosa PA01
gccggugugccguca

SEQ ID NO: 3504175 - RNA, 22 nt, Pseudomonas aeruginosa PA01
gccgguuaucgaggcgucggcg

SEQ ID NO: 3504176 - RNA, 16 nt, Pseudomonas aeruginosa PA01
gccgguucccgcagcg

SEQ ID NO: 3504177 - RNA, 19 nt, Pseudomonas aeruginosa PA01
gccgguucccgcagcgauc

SEQ ID NO: 3504178 - RNA, 18 nt, Pseudomonas aeruginosa PA01
gccgguuccgaaucgccu

SEQ ID NO: 3504179 - RNA, 22 nt, Pseudomonas aeruginosa PA01
gccgguuccgaaucgccuacca

SEQ ID NO: 3504180 - RNA, 19 nt, Pseudomonas aeruginosa PA01
gccgguugcggcgccgguu

SEQ ID NO: 3504181 - RNA, 19 nt, Pseudomonas aeruginosa PA01
gccgguugcgucucagcgg

SEQ ID NO: 3504182 - RNA, 20 nt, Pseudomonas aeruginosa PA01
gccgguugcugcugcggggc

SEQ ID NO: 3504183 - RNA, 19 nt, Pseudomonas aeruginosa PA01
gccgguugcugcuggguga

SEQ ID NO: 3504184 - RNA, 22 nt, Pseudomonas aeruginosa PA01
gccgguugcugcuugcgcgcgg

SEQ ID NO: 3504185 - RNA, 24 nt, Pseudomonas aeruginosa PA01
gccgguugcugcuugcgcgcggcg

SEQ ID NO: 3504186 - RNA, 14 nt, Pseudomonas aeruginosa PA01
gccgguuucgaccg

SEQ ID NO: 3504187 - RNA, 17 nt, Pseudomonas aeruginosa PA01
gccgguuucgaccggcg

SEQ ID NO: 3504188 - RNA, 15 nt, Pseudomonas aeruginosa PA01
gccguaaccaacagc

SEQ ID NO: 3504189 - RNA, 15 nt, Pseudomonas aeruginosa PA01
gccguacagcaggca

SEQ ID NO: 3504190 - RNA, 17 nt, Pseudomonas aeruginosa PA01
gccguacagcaggcagg

SEQ ID NO: 3504191 - RNA, 18 nt, Pseudomonas aeruginosa PA01
gccguacagcaggcaggc

SEQ ID NO: 3504192 - RNA, 20 nt, Pseudomonas aeruginosa PA01
gccguacagcccccgccggc

SEQ ID NO: 3504193 - RNA, 20 nt, Pseudomonas aeruginosa PA01
gccguacaggccaccgcgca

SEQ ID NO: 3504194 - RNA, 16 nt, Pseudomonas aeruginosa PA01
gccguacaggucggcg

SEQ ID NO: 3504195 - RNA, 19 nt, Pseudomonas aeruginosa PA01
gccguacaggucggcgccg

SEQ ID NO: 3504196 - RNA, 20 nt, Pseudomonas aeruginosa PA01
gccguacaggucggcgccgg

SEQ ID NO: 3504197 - RNA, 20 nt, Pseudomonas aeruginosa PA01
gccguacucauggccgcagc

SEQ ID NO: 3504198 - RNA, 21 nt, Pseudomonas aeruginosa PA01
gccguacucauggccgcagcg

SEQ ID NO: 3504199 - RNA, 13 nt, Pseudomonas aeruginosa PA01
gccguagaacagc

SEQ ID NO: 3504200 - RNA, 20 nt, Pseudomonas aeruginosa PA01
gccguagaacagcacgucga

SEQ ID NO: 3504201 - RNA, 20 nt, Pseudomonas aeruginosa PA01
gccguagaacgccaggaucg

SEQ ID NO: 3504202 - RNA, 14 nt, Pseudomonas aeruginosa PA01
gccguagaccacca

SEQ ID NO: 3504203 - RNA, 19 nt, Pseudomonas aeruginosa PA01
gccguagaccaccagcagc

SEQ ID NO: 3504204 - RNA, 21 nt, Pseudomonas aeruginosa PA01
gccguagaccaccagcagcag

SEQ ID NO: 3504205 - RNA, 17 nt, Pseudomonas aeruginosa PA01
gccguagaucaggacga

SEQ ID NO: 3504206 - RNA, 13 nt, Pseudomonas aeruginosa PA01
gccguagaugguc

SEQ ID NO: 3504207 - RNA, 17 nt, Pseudomonas aeruginosa PA01
gccguagcaaguugucc

SEQ ID NO: 3504208 - RNA, 14 nt, Pseudomonas aeruginosa PA01
gccguagccgaacg

SEQ ID NO: 3504209 - RNA, 18 nt, Pseudomonas aeruginosa PA01
gccguagccggugccgau

SEQ ID NO: 3504210 - RNA, 14 nt, Pseudomonas aeruginosa PA01
gccguagccgucga

SEQ ID NO: 3504211 - RNA, 19 nt, Pseudomonas aeruginosa PA01
gccguagccgucgaacagc

SEQ ID NO: 3504212 - RNA, 21 nt, Pseudomonas aeruginosa PA01
gccguagccgucgaacagcag

SEQ ID NO: 3504213 - RNA, 18 nt, Pseudomonas aeruginosa PA01
gccguagcgcaguucgcc

SEQ ID NO: 3504214 - RNA, 16 nt, Pseudomonas aeruginosa PA01
gccguagcugcgcgcc

SEQ ID NO: 3504215 - RNA, 23 nt, Pseudomonas aeruginosa PA01
gccguaggccacuucccggcgca

SEQ ID NO: 3504216 - RNA, 18 nt, Pseudomonas aeruginosa PA01
gccguaggcgauggccug

SEQ ID NO: 3504217 - RNA, 20 nt, Pseudomonas aeruginosa PA01
gccguaggcgauggccuggu

SEQ ID NO: 3504218 - RNA, 17 nt, Pseudomonas aeruginosa PA01
gccguagggcgaauaac

SEQ ID NO: 3504219 - RNA, 20 nt, Pseudomonas aeruginosa PA01
gccguagggcgaauaacgcc

SEQ ID NO: 3504220 - RNA, 17 nt, Pseudomonas aeruginosa PA01
gccguaggugaccgccc

SEQ ID NO: 3504221 - RNA, 20 nt, Pseudomonas aeruginosa PA01
gccguaggugaccgcccagg

SEQ ID NO: 3504222 - RNA, 22 nt, Pseudomonas aeruginosa PA01
gccguaguucgaaccguggcgg

SEQ ID NO: 3504223 - RNA, 20 nt, Pseudomonas aeruginosa PA01
gccguauccgcggcaggggc

SEQ ID NO: 3504224 - RNA, 21 nt, Pseudomonas aeruginosa PA01
gccguauccgcggcaggggcu

SEQ ID NO: 3504225 - RNA, 16 nt, Pseudomonas aeruginosa PA01
gccgucaagcaacggc

SEQ ID NO: 3504226 - RNA, 13 nt, Pseudomonas aeruginosa PA01
gccgucaccagca

SEQ ID NO: 3504227 - RNA, 14 nt, Pseudomonas aeruginosa PA01
gccgucaccagcag

SEQ ID NO: 3504228 - RNA, 17 nt, Pseudomonas aeruginosa PA01
gccgucaccagcagccc

SEQ ID NO: 3504229 - RNA, 22 nt, Pseudomonas aeruginosa PA01
gccgucaccgcguucugcggac

SEQ ID NO: 3504230 - RNA, 15 nt, Pseudomonas aeruginosa PA01
gccgucacggccucc

SEQ ID NO: 3504231 - RNA, 23 nt, Pseudomonas aeruginosa PA01
gccgucacuugaagucccauugc

SEQ ID NO: 3504232 - RNA, 14 nt, Pseudomonas aeruginosa PA01
gccgucagacgcgg

SEQ ID NO: 3504233 - RNA, 14 nt, Pseudomonas aeruginosa PA01
gccgucaggcaccu

SEQ ID NO: 3504234 - RNA, 15 nt, Pseudomonas aeruginosa PA01
gccgucaggcaccuc

SEQ ID NO: 3504235 - RNA, 20 nt, Pseudomonas aeruginosa PA01
gccgucaggcaccucgucca

SEQ ID NO: 3504236 - RNA, 21 nt, Pseudomonas aeruginosa PA01
gccgucaggcaccucguccag

SEQ ID NO: 3504237 - RNA, 20 nt, Pseudomonas aeruginosa PA01
gccgucaucgagcaguucca

SEQ ID NO: 3504238 - RNA, 15 nt, Pseudomonas aeruginosa PA01
gccgucaucgcugac

SEQ ID NO: 3504239 - RNA, 17 nt, Pseudomonas aeruginosa PA01
gccgucaucgcugaccu

SEQ ID NO: 3504240 - RNA, 20 nt, Pseudomonas aeruginosa PA01
gccgucaucgcugaccugga

SEQ ID NO: 3504241 - RNA, 21 nt, Pseudomonas aeruginosa PA01
gccgucaugcacuucgaccag

SEQ ID NO: 3504242 - RNA, 17 nt, Pseudomonas aeruginosa PA01
gccgucauggcgggcgu

SEQ ID NO: 3504243 - RNA, 13 nt, Pseudomonas aeruginosa PA01
gccguccaccagc

SEQ ID NO: 3504244 - RNA, 18 nt, Pseudomonas aeruginosa PA01
gccguccaccagccagcu

SEQ ID NO: 3504245 - RNA, 24 nt, Pseudomonas aeruginosa PA01
gccguccaccagccagcucggcga

SEQ ID NO: 3504246 - RNA, 13 nt, Pseudomonas aeruginosa PA01
gccguccagccgg

SEQ ID NO: 3504247 - RNA, 19 nt, Pseudomonas aeruginosa PA01
gccguccagccggcgcuuc

SEQ ID NO: 3504248 - RNA, 22 nt, Pseudomonas aeruginosa PA01
gccguccagcuugagguaggcc

SEQ ID NO: 3504249 - RNA, 14 nt, Pseudomonas aeruginosa PA01
gccguccaggcgcg

SEQ ID NO: 3504250 - RNA, 19 nt, Pseudomonas aeruginosa PA01
gccguccaggcgcgaacgc

SEQ ID NO: 3504251 - RNA, 19 nt, Pseudomonas aeruginosa PA01
gccguccaucaggcguucg

SEQ ID NO: 3504252 - RNA, 19 nt, Pseudomonas aeruginosa PA01
gccgucccagucggcgucc

SEQ ID NO: 3504253 - RNA, 21 nt, Pseudomonas aeruginosa PA01
gccgucccagucggcguccgc

SEQ ID NO: 3504254 - RNA, 16 nt, Pseudomonas aeruginosa PA01
gccgucccauuccucg

SEQ ID NO: 3504255 - RNA, 20 nt, Pseudomonas aeruginosa PA01
gccgucccggaguuccagcg

SEQ ID NO: 3504256 - RNA, 15 nt, Pseudomonas aeruginosa PA01
gccgucccugaccag

SEQ ID NO: 3504257 - RNA, 18 nt, Pseudomonas aeruginosa PA01
gccgucccugaccagcag

SEQ ID NO: 3504258 - RNA, 13 nt, Pseudomonas aeruginosa PA01
gccguccgccagg

SEQ ID NO: 3504259 - RNA, 21 nt, Pseudomonas aeruginosa PA01
gccguccgcccaguucgccgg

SEQ ID NO: 3504260 - RNA, 14 nt, Pseudomonas aeruginosa PA01
gccguccuccagca

SEQ ID NO: 3504261 - RNA, 15 nt, Pseudomonas aeruginosa PA01
gccguccugcggccg

SEQ ID NO: 3504262 - RNA, 16 nt, Pseudomonas aeruginosa PA01
gccguccugcggccgc

SEQ ID NO: 3504263 - RNA, 18 nt, Pseudomonas aeruginosa PA01
gccguccugcggccgcaa

SEQ ID NO: 3504264 - RNA, 20 nt, Pseudomonas aeruginosa PA01
gccguccugcuugaccuugc

SEQ ID NO: 3504265 - RNA, 13 nt, Pseudomonas aeruginosa PA01
gccguccugugga

SEQ ID NO: 3504266 - RNA, 23 nt, Pseudomonas aeruginosa PA01
gccguccuguuucugcuguggag

SEQ ID NO: 3504267 - RNA, 14 nt, Pseudomonas aeruginosa PA01
gccguccuucagga

SEQ ID NO: 3504268 - RNA, 21 nt, Pseudomonas aeruginosa PA01
gccguccuugaguagcuggcg

SEQ ID NO: 3504269 - RNA, 17 nt, Pseudomonas aeruginosa PA01
gccguccuugucgcagc

SEQ ID NO: 3504270 - RNA, 20 nt, Pseudomonas aeruginosa PA01
gccguccuugucgcagcggc

SEQ ID NO: 3504271 - RNA, 15 nt, Pseudomonas aeruginosa PA01
gccgucgaacagcag

SEQ ID NO: 3504272 - RNA, 20 nt, Pseudomonas aeruginosa PA01
gccgucgaacagcagcucgc

SEQ ID NO: 3504273 - RNA, 23 nt, Pseudomonas aeruginosa PA01
gccgucgaacagcagcucgccgc

SEQ ID NO: 3504274 - RNA, 18 nt, Pseudomonas aeruginosa PA01
gccgucgaagggcacgcc

SEQ ID NO: 3504275 - RNA, 19 nt, Pseudomonas aeruginosa PA01
gccgucgaagggcacgccg

SEQ ID NO: 3504276 - RNA, 20 nt, Pseudomonas aeruginosa PA01
gccgucgaagggcacgccgc

SEQ ID NO: 3504277 - RNA, 22 nt, Pseudomonas aeruginosa PA01
gccgucgacccgccucacccca

SEQ ID NO: 3504278 - RNA, 14 nt, Pseudomonas aeruginosa PA01
gccgucgaccugcg

SEQ ID NO: 3504279 - RNA, 16 nt, Pseudomonas aeruginosa PA01
gccgucgacuugccga

SEQ ID NO: 3504280 - RNA, 17 nt, Pseudomonas aeruginosa PA01
gccgucgacuugccgau

SEQ ID NO: 3504281 - RNA, 19 nt, Pseudomonas aeruginosa PA01
gccgucgacuugccgauca

SEQ ID NO: 3504282 - RNA, 12 nt, Pseudomonas aeruginosa PA01
gccgucgagcac

SEQ ID NO: 3504283 - RNA, 14 nt, Pseudomonas aeruginosa PA01
gccgucgagccagc

SEQ ID NO: 3504284 - RNA, 17 nt, Pseudomonas aeruginosa PA01
gccgucgagccagccca

SEQ ID NO: 3504285 - RNA, 20 nt, Pseudomonas aeruginosa PA01
gccgucgagccagcccagcg

SEQ ID NO: 3504286 - RNA, 14 nt, Pseudomonas aeruginosa PA01
gccgucgagggcaa

SEQ ID NO: 3504287 - RNA, 18 nt, Pseudomonas aeruginosa PA01
gccgucgagggcaaaggc

SEQ ID NO: 3504288 - RNA, 20 nt, Pseudomonas aeruginosa PA01
gccgucgagggcaaaggcgc

SEQ ID NO: 3504289 - RNA, 18 nt, Pseudomonas aeruginosa PA01
gccgucgaggucggcgau

SEQ ID NO: 3504290 - RNA, 17 nt, Pseudomonas aeruginosa PA01
gccgucgcacucuuccu

SEQ ID NO: 3504291 - RNA, 14 nt, Pseudomonas aeruginosa PA01
gccgucgccggcga

SEQ ID NO: 3504292 - RNA, 16 nt, Pseudomonas aeruginosa PA01
gccgucgcgcaccacc

SEQ ID NO: 3504293 - RNA, 17 nt, Pseudomonas aeruginosa PA01
gccgucgcgcaccaccc

SEQ ID NO: 3504294 - RNA, 13 nt, Pseudomonas aeruginosa PA01
gccgucgcgccgc

SEQ ID NO: 3504295 - RNA, 15 nt, Pseudomonas aeruginosa PA01
gccgucgcgccgcgg

SEQ ID NO: 3504296 - RNA, 16 nt, Pseudomonas aeruginosa PA01
gccgucgcgccgcgga

SEQ ID NO: 3504297 - RNA, 13 nt, Pseudomonas aeruginosa PA01
gccgucgcggaag

SEQ ID NO: 3504298 - RNA, 19 nt, Pseudomonas aeruginosa PA01
gccgucgcggaagccgugc

SEQ ID NO: 3504299 - RNA, 15 nt, Pseudomonas aeruginosa PA01
gccgucgcggccauc

SEQ ID NO: 3504300 - RNA, 16 nt, Pseudomonas aeruginosa PA01
gccgucgcugccgagc

SEQ ID NO: 3504301 - RNA, 18 nt, Pseudomonas aeruginosa PA01
gccgucggccuggcgguu

SEQ ID NO: 3504302 - RNA, 13 nt, Pseudomonas aeruginosa PA01
gccgucggcgauc

SEQ ID NO: 3504303 - RNA, 17 nt, Pseudomonas aeruginosa PA01
gccgucggcgaucgcca

SEQ ID NO: 3504304 - RNA, 14 nt, Pseudomonas aeruginosa PA01
gccgucggcgcggg

SEQ ID NO: 3504305 - RNA, 17 nt, Pseudomonas aeruginosa PA01
gccgucggcgcggggcg

SEQ ID NO: 3504306 - RNA, 14 nt, Pseudomonas aeruginosa PA01
gccgucgggcuucg

SEQ ID NO: 3504307 - RNA, 20 nt, Pseudomonas aeruginosa PA01
gccgucgggcuucgguguau

SEQ ID NO: 3504308 - RNA, 23 nt, Pseudomonas aeruginosa PA01
gccgucggugaucgagacgccgu

SEQ ID NO: 3504309 - RNA, 15 nt, Pseudomonas aeruginosa PA01
gccgucguagcgcag

SEQ ID NO: 3504310 - RNA, 16 nt, Pseudomonas aeruginosa PA01
gccgucguagcgcagc

SEQ ID NO: 3504311 - RNA, 21 nt, Pseudomonas aeruginosa PA01
gccgucguagcgcagcggcag

SEQ ID NO: 3504312 - RNA, 23 nt, Pseudomonas aeruginosa PA01
gccgucguagcgcagcggcaggc

SEQ ID NO: 3504313 - RNA, 14 nt, Pseudomonas aeruginosa PA01
gccgucguccgggu

SEQ ID NO: 3504314 - RNA, 20 nt, Pseudomonas aeruginosa PA01
gccgucguuuuguccggcgg

SEQ ID NO: 3504315 - RNA, 16 nt, Pseudomonas aeruginosa PA01
gccgucuccaggcgcg

SEQ ID NO: 3504316 - RNA, 18 nt, Pseudomonas aeruginosa PA01
gccgucuccaggcgcgcc

SEQ ID NO: 3504317 - RNA, 19 nt, Pseudomonas aeruginosa PA01
gccgucuccaggcgcgccg

SEQ ID NO: 3504318 - RNA, 20 nt, Pseudomonas aeruginosa PA01
gccgucuccaggcgcgccgu

SEQ ID NO: 3504319 - RNA, 21 nt, Pseudomonas aeruginosa PA01
gccgucuccaggcgcgccgug

SEQ ID NO: 3504320 - RNA, 19 nt, Pseudomonas aeruginosa PA01
gccgucuuccagggcggcg

SEQ ID NO: 3504321 - RNA, 13 nt, Pseudomonas aeruginosa PA01
gccgucuuccucg

SEQ ID NO: 3504322 - RNA, 19 nt, Pseudomonas aeruginosa PA01
gccgucuuccucgaagguc

SEQ ID NO: 3504323 - RNA, 22 nt, Pseudomonas aeruginosa PA01
gccgucuuccucgaaggucgcg

SEQ ID NO: 3504324 - RNA, 16 nt, Pseudomonas aeruginosa PA01
gccgucuugccgcugc

SEQ ID NO: 3504325 - RNA, 17 nt, Pseudomonas aeruginosa PA01
gccgucuugccgcugcg

SEQ ID NO: 3504326 - RNA, 19 nt, Pseudomonas aeruginosa PA01
gccgucuugccgcugcgcg

SEQ ID NO: 3504327 - RNA, 20 nt, Pseudomonas aeruginosa PA01
gccgucuugccgcugcgcgc

SEQ ID NO: 3504328 - RNA, 17 nt, Pseudomonas aeruginosa PA01
gccgugaaaagcggcgu

SEQ ID NO: 3504329 - RNA, 12 nt, Pseudomonas aeruginosa PA01
gccgugaagcac

SEQ ID NO: 3504330 - RNA, 19 nt, Pseudomonas aeruginosa PA01
gccgugacgaggggcugcg

SEQ ID NO: 3504331 - RNA, 17 nt, Pseudomonas aeruginosa PA01
gccgugaggcgcgcgcc

SEQ ID NO: 3504332 - RNA, 22 nt, Pseudomonas aeruginosa PA01
gccgugaucaccuggaucgcca

SEQ ID NO: 3504333 - RNA, 16 nt, Pseudomonas aeruginosa PA01
gccgugcagcagcgac

SEQ ID NO: 3504334 - RNA, 17 nt, Pseudomonas aeruginosa PA01
gccgugcagcuuggcga

SEQ ID NO: 3504335 - RNA, 18 nt, Pseudomonas aeruginosa PA01
gccgugcagggucagguc

SEQ ID NO: 3504336 - RNA, 19 nt, Pseudomonas aeruginosa PA01
gccgugcaucaccggcagc

SEQ ID NO: 3504337 - RNA, 20 nt, Pseudomonas aeruginosa PA01
gccgugcaucaccggcagca

SEQ ID NO: 3504338 - RNA, 16 nt, Pseudomonas aeruginosa PA01
gccgugcaugccgacg

SEQ ID NO: 3504339 - RNA, 20 nt, Pseudomonas aeruginosa PA01
gccgugcaugccgacgagca

SEQ ID NO: 3504340 - RNA, 19 nt, Pseudomonas aeruginosa PA01
gccgugccagagcuugagg

SEQ ID NO: 3504341 - RNA, 14 nt, Pseudomonas aeruginosa PA01
gccgugccggucgc

SEQ ID NO: 3504342 - RNA, 13 nt, Pseudomonas aeruginosa PA01
gccgugccgugga

SEQ ID NO: 3504343 - RNA, 15 nt, Pseudomonas aeruginosa PA01
gccgugcgcuccgcc

SEQ ID NO: 3504344 - RNA, 19 nt, Pseudomonas aeruginosa PA01
gccgugcgcuccgccaggc

SEQ ID NO: 3504345 - RNA, 20 nt, Pseudomonas aeruginosa PA01
gccgugcgcuccgccaggcc

SEQ ID NO: 3504346 - RNA, 21 nt, Pseudomonas aeruginosa PA01
gccgugcgcuccgccaggccg

SEQ ID NO: 3504347 - RNA, 19 nt, Pseudomonas aeruginosa PA01
gccgugcggagggucaggc

SEQ ID NO: 3504348 - RNA, 12 nt, Pseudomonas aeruginosa PA01
gccgugcggcgu

SEQ ID NO: 3504349 - RNA, 19 nt, Pseudomonas aeruginosa PA01
gccgugcggcguucgccgc

SEQ ID NO: 3504350 - RNA, 20 nt, Pseudomonas aeruginosa PA01
gccgugcggcguucgccgcg

SEQ ID NO: 3504351 - RNA, 22 nt, Pseudomonas aeruginosa PA01
gccgugcuccucauggaacugc

SEQ ID NO: 3504352 - RNA, 22 nt, Pseudomonas aeruginosa PA01
gccguggaccaacagccggcgg

SEQ ID NO: 3504353 - RNA, 17 nt, Pseudomonas aeruginosa PA01
gccguggaccaggauca

SEQ ID NO: 3504354 - RNA, 13 nt, Pseudomonas aeruginosa PA01
gccguggaucgcc

SEQ ID NO: 3504355 - RNA, 14 nt, Pseudomonas aeruginosa PA01
gccguggaucgccc

SEQ ID NO: 3504356 - RNA, 17 nt, Pseudomonas aeruginosa PA01
gccguggaucgcccggc

SEQ ID NO: 3504357 - RNA, 19 nt, Pseudomonas aeruginosa PA01
gccguggaucgcccggcug

SEQ ID NO: 3504358 - RNA, 23 nt, Pseudomonas aeruginosa PA01
gccguggaugucgaggaacaggu

SEQ ID NO: 3504359 - RNA, 15 nt, Pseudomonas aeruginosa PA01
gccguggcaccaggu

SEQ ID NO: 3504360 - RNA, 14 nt, Pseudomonas aeruginosa PA01
gccguggcacccag

SEQ ID NO: 3504361 - RNA, 18 nt, Pseudomonas aeruginosa PA01
gccguggcacccaggcca

SEQ ID NO: 3504362 - RNA, 15 nt, Pseudomonas aeruginosa PA01
gccguggcaggcgcc

SEQ ID NO: 3504363 - RNA, 13 nt, Pseudomonas aeruginosa PA01
gccguggcgcccc

SEQ ID NO: 3504364 - RNA, 12 nt, Pseudomonas aeruginosa PA01
gccguggcggcg

SEQ ID NO: 3504365 - RNA, 16 nt, Pseudomonas aeruginosa PA01
gccguggcggcgcgcg

SEQ ID NO: 3504366 - RNA, 15 nt, Pseudomonas aeruginosa PA01
gccguggcuccugga

SEQ ID NO: 3504367 - RNA, 14 nt, Pseudomonas aeruginosa PA01
gccguggcucggcg

SEQ ID NO: 3504368 - RNA, 16 nt, Pseudomonas aeruginosa PA01
gccguggcucggcggc

SEQ ID NO: 3504369 - RNA, 17 nt, Pseudomonas aeruginosa PA01
gccguggcucggcggca

SEQ ID NO: 3504370 - RNA, 22 nt, Pseudomonas aeruginosa PA01
gccguggcucggcggcaggcug

SEQ ID NO: 3504371 - RNA, 23 nt, Pseudomonas aeruginosa PA01
gccgugggaacgcgaggagaucg

SEQ ID NO: 3504372 - RNA, 15 nt, Pseudomonas aeruginosa PA01
gccgugggccgccga

SEQ ID NO: 3504373 - RNA, 17 nt, Pseudomonas aeruginosa PA01
gccgugggccgccgaac

SEQ ID NO: 3504374 - RNA, 14 nt, Pseudomonas aeruginosa PA01
gccgugggccggcg

SEQ ID NO: 3504375 - RNA, 17 nt, Pseudomonas aeruginosa PA01
gccgugggccggcgcgc

SEQ ID NO: 3504376 - RNA, 20 nt, Pseudomonas aeruginosa PA01
gccgugggccggcgcgccgu

SEQ ID NO: 3504377 - RNA, 19 nt, Pseudomonas aeruginosa PA01
gccgugggcgccgccggug

SEQ ID NO: 3504378 - RNA, 20 nt, Pseudomonas aeruginosa PA01
gccgugggcgccgccgguga

SEQ ID NO: 3504379 - RNA, 21 nt, Pseudomonas aeruginosa PA01
gccgugggcguagagccugga

SEQ ID NO: 3504380 - RNA, 22 nt, Pseudomonas aeruginosa PA01
gccgugggcguagagccuggag

SEQ ID NO: 3504381 - RNA, 14 nt, Pseudomonas aeruginosa PA01
gccgugggucgccu

SEQ ID NO: 3504382 - RNA, 14 nt, Pseudomonas aeruginosa PA01
gccguggucgcgca

SEQ ID NO: 3504383 - RNA, 15 nt, Pseudomonas aeruginosa PA01
gccguggucgcgcag

SEQ ID NO: 3504384 - RNA, 16 nt, Pseudomonas aeruginosa PA01
gccguggucgcgcagg

SEQ ID NO: 3504385 - RNA, 17 nt, Pseudomonas aeruginosa PA01
gccguggucgcgcaggc

SEQ ID NO: 3504386 - RNA, 18 nt, Pseudomonas aeruginosa PA01
gccgugguggccguggcg

SEQ ID NO: 3504387 - RNA, 15 nt, Pseudomonas aeruginosa PA01
gccgugugccugagc

SEQ ID NO: 3504388 - RNA, 17 nt, Pseudomonas aeruginosa PA01
gccguguugaugccgau

SEQ ID NO: 3504389 - RNA, 15 nt, Pseudomonas aeruginosa PA01
gccguuacgccgggu

SEQ ID NO: 3504390 - RNA, 17 nt, Pseudomonas aeruginosa PA01
gccguucacguugaccu

SEQ ID NO: 3504391 - RNA, 17 nt, Pseudomonas aeruginosa PA01
gccguucagcucccagg

SEQ ID NO: 3504392 - RNA, 19 nt, Pseudomonas aeruginosa PA01
gccguucagcucccaggcg

SEQ ID NO: 3504393 - RNA, 13 nt, Pseudomonas aeruginosa PA01
gccguucaggccg

SEQ ID NO: 3504394 - RNA, 17 nt, Pseudomonas aeruginosa PA01
gccguucaggccggcgc

SEQ ID NO: 3504395 - RNA, 23 nt, Pseudomonas aeruginosa PA01
gccguucaggccggcgccgccga

SEQ ID NO: 3504396 - RNA, 15 nt, Pseudomonas aeruginosa PA01
gccguucaggcgcgg

SEQ ID NO: 3504397 - RNA, 22 nt, Pseudomonas aeruginosa PA01
gccguucagggacaugucgagg

SEQ ID NO: 3504398 - RNA, 14 nt, Pseudomonas aeruginosa PA01
gccguucaggguca

SEQ ID NO: 3504399 - RNA, 19 nt, Pseudomonas aeruginosa PA01
gccguucagggucagguug

SEQ ID NO: 3504400 - RNA, 13 nt, Pseudomonas aeruginosa PA01
gccguuccagcgg

SEQ ID NO: 3504401 - RNA, 15 nt, Pseudomonas aeruginosa PA01
gccguuccaggcggg

SEQ ID NO: 3504402 - RNA, 20 nt, Pseudomonas aeruginosa PA01
gccguuccuccucgccgccg

SEQ ID NO: 3504403 - RNA, 21 nt, Pseudomonas aeruginosa PA01
gccguuccuccucgccgccga

SEQ ID NO: 3504404 - RNA, 22 nt, Pseudomonas aeruginosa PA01
gccguuccuccucgccgccgac

SEQ ID NO: 3504405 - RNA, 15 nt, Pseudomonas aeruginosa PA01
gccguucgcccgcca

SEQ ID NO: 3504406 - RNA, 15 nt, Pseudomonas aeruginosa PA01
gccguucgcccgcgg

SEQ ID NO: 3504407 - RNA, 12 nt, Pseudomonas aeruginosa PA01
gccguucgcccu

SEQ ID NO: 3504408 - RNA, 16 nt, Pseudomonas aeruginosa PA01
gccguucgucaccggc

SEQ ID NO: 3504409 - RNA, 20 nt, Pseudomonas aeruginosa PA01
gccguucgucaccggcgcca

SEQ ID NO: 3504410 - RNA, 19 nt, Pseudomonas aeruginosa PA01
gccguucucauugcgccgc

SEQ ID NO: 3504411 - RNA, 22 nt, Pseudomonas aeruginosa PA01
gccguucucauugcgccgccgg

SEQ ID NO: 3504412 - RNA, 20 nt, Pseudomonas aeruginosa PA01
gccguucuccgggucgggcu

SEQ ID NO: 3504413 - RNA, 13 nt, Pseudomonas aeruginosa PA01
gccguucugugcg

SEQ ID NO: 3504414 - RNA, 19 nt, Pseudomonas aeruginosa PA01
gccguucugugcggcgaug

SEQ ID NO: 3504415 - RNA, 14 nt, Pseudomonas aeruginosa PA01
gccguugaaacgcu

SEQ ID NO: 3504416 - RNA, 17 nt, Pseudomonas aeruginosa PA01
gccguugaaacgcucgg

SEQ ID NO: 3504417 - RNA, 15 nt, Pseudomonas aeruginosa PA01
gccguugaccagcgc

SEQ ID NO: 3504418 - RNA, 20 nt, Pseudomonas aeruginosa PA01
gccguugaccagcgcgucga

SEQ ID NO: 3504419 - RNA, 14 nt, Pseudomonas aeruginosa PA01
gccguugaggaagu

SEQ ID NO: 3504420 - RNA, 19 nt, Pseudomonas aeruginosa PA01
gccguugaugacgaacugc

SEQ ID NO: 3504421 - RNA, 20 nt, Pseudomonas aeruginosa PA01
gccguugaugucgaccacga

SEQ ID NO: 3504422 - RNA, 14 nt, Pseudomonas aeruginosa PA01
gccguugcaggccc

SEQ ID NO: 3504423 - RNA, 14 nt, Pseudomonas aeruginosa PA01
gccguugccagcau

SEQ ID NO: 3504424 - RNA, 18 nt, Pseudomonas aeruginosa PA01
gccguugccgaugccgga

SEQ ID NO: 3504425 - RNA, 23 nt, Pseudomonas aeruginosa PA01
gccguugccgguacucgccgggc

SEQ ID NO: 3504426 - RNA, 17 nt, Pseudomonas aeruginosa PA01
gccguugccuucgccgu

SEQ ID NO: 3504427 - RNA, 14 nt, Pseudomonas aeruginosa PA01
gccguugcgcaggc

SEQ ID NO: 3504428 - RNA, 15 nt, Pseudomonas aeruginosa PA01
gccguugcgcaggcg

SEQ ID NO: 3504429 - RNA, 15 nt, Pseudomonas aeruginosa PA01
gccguugcggcagca

SEQ ID NO: 3504430 - RNA, 18 nt, Pseudomonas aeruginosa PA01
gccguugcuaccggcgga

SEQ ID NO: 3504431 - RNA, 19 nt, Pseudomonas aeruginosa PA01
gccguugcucacgccgaac

SEQ ID NO: 3504432 - RNA, 23 nt, Pseudomonas aeruginosa PA01
gccguuggcgaacuucaggccgg

SEQ ID NO: 3504433 - RNA, 16 nt, Pseudomonas aeruginosa PA01
gccguuggcgaggacu

SEQ ID NO: 3504434 - RNA, 17 nt, Pseudomonas aeruginosa PA01
gccguugggccagggcc

SEQ ID NO: 3504435 - RNA, 18 nt, Pseudomonas aeruginosa PA01
gccguuguagaucggcag

SEQ ID NO: 3504436 - RNA, 20 nt, Pseudomonas aeruginosa PA01
gccguuguagaucggcagca

SEQ ID NO: 3504437 - RNA, 19 nt, Pseudomonas aeruginosa PA01
gccguuguagcugaccacg

SEQ ID NO: 3504438 - RNA, 14 nt, Pseudomonas aeruginosa PA01
gccguuguggcagg

SEQ ID NO: 3504439 - RNA, 19 nt, Pseudomonas aeruginosa PA01
gccguuguucaggcgcgcg

SEQ ID NO: 3504440 - RNA, 19 nt, Pseudomonas aeruginosa PA01
gccguuguugaccgcagga

SEQ ID NO: 3504441 - RNA, 22 nt, Pseudomonas aeruginosa PA01
gccguuucgacgaugcucgguu

SEQ ID NO: 3504442 - RNA, 21 nt, Pseudomonas aeruginosa PA01
gccguuucguuuccguugucu

SEQ ID NO: 3504443 - RNA, 19 nt, Pseudomonas aeruginosa PA01
gccguuuuacucgucgcca

SEQ ID NO: 3504444 - RNA, 19 nt, Pseudomonas aeruginosa PA01
gccguuuuuuaugccgagg

SEQ ID NO: 3504445 - RNA, 19 nt, Pseudomonas aeruginosa PA01
gccuaccagaccgcagccg

SEQ ID NO: 3504446 - RNA, 21 nt, Pseudomonas aeruginosa PA01
gccuaccagaccgcagccggc

SEQ ID NO: 3504447 - RNA, 21 nt, Pseudomonas aeruginosa PA01
gccuaccauuagaggaaccca

SEQ ID NO: 3504448 - RNA, 12 nt, Pseudomonas aeruginosa PA01
gccuacccgcgc

SEQ ID NO: 3504449 - RNA, 20 nt, Pseudomonas aeruginosa PA01
gccuaccggcgccgccccgu

SEQ ID NO: 3504450 - RNA, 22 nt, Pseudomonas aeruginosa PA01
gccuacgguacaguucaggcug

SEQ ID NO: 3504451 - RNA, 23 nt, Pseudomonas aeruginosa PA01
gccuacgguacaguucaggcugg

SEQ ID NO: 3504452 - RNA, 16 nt, Pseudomonas aeruginosa PA01
gccuacugggcguggc

SEQ ID NO: 3504453 - RNA, 16 nt, Pseudomonas aeruginosa PA01
gccuacuugaucagcc

SEQ ID NO: 3504454 - RNA, 17 nt, Pseudomonas aeruginosa PA01
gccuacuugaucagccg

SEQ ID NO: 3504455 - RNA, 18 nt, Pseudomonas aeruginosa PA01
gccuacuugaucagccgc

SEQ ID NO: 3504456 - RNA, 19 nt, Pseudomonas aeruginosa PA01
gccuacuugaucagccgca

SEQ ID NO: 3504457 - RNA, 21 nt, Pseudomonas aeruginosa PA01
gccuacuugaucagccgcagg

SEQ ID NO: 3504458 - RNA, 22 nt, Pseudomonas aeruginosa PA01
gccuacuugaucagccgcaggc

SEQ ID NO: 3504459 - RNA, 17 nt, Pseudomonas aeruginosa PA01
gccuagacccugggcca

SEQ ID NO: 3504460 - RNA, 17 nt, Pseudomonas aeruginosa PA01
gccuagcacccggguau

SEQ ID NO: 3504461 - RNA, 18 nt, Pseudomonas aeruginosa PA01
gccuauccacgacgucgg

SEQ ID NO: 3504462 - RNA, 18 nt, Pseudomonas aeruginosa PA01
gccuauccgugacgucgg

SEQ ID NO: 3504463 - RNA, 22 nt, Pseudomonas aeruginosa PA01
gccuauccgugacgucggcggc

SEQ ID NO: 3504464 - RNA, 16 nt, Pseudomonas aeruginosa PA01
gccucaacgaccgccc

SEQ ID NO: 3504465 - RNA, 19 nt, Pseudomonas aeruginosa PA01
gccucaacgaccgcccagg

SEQ ID NO: 3504466 - RNA, 12 nt, Pseudomonas aeruginosa PA01
gccucacccugc

SEQ ID NO: 3504467 - RNA, 16 nt, Pseudomonas aeruginosa PA01
gccucacccugcuggg

SEQ ID NO: 3504468 - RNA, 18 nt, Pseudomonas aeruginosa PA01
gccucacccugcugggcg

SEQ ID NO: 3504469 - RNA, 19 nt, Pseudomonas aeruginosa PA01
gccucacccugcugggcgg

SEQ ID NO: 3504470 - RNA, 15 nt, Pseudomonas aeruginosa PA01
gccucagaacugcuc

SEQ ID NO: 3504471 - RNA, 16 nt, Pseudomonas aeruginosa PA01
gccucagaacugcucg

SEQ ID NO: 3504472 - RNA, 20 nt, Pseudomonas aeruginosa PA01
gccucagaacugcucggcgu

SEQ ID NO: 3504473 - RNA, 23 nt, Pseudomonas aeruginosa PA01
gccucagaacugcucggcgucca

SEQ ID NO: 3504474 - RNA, 23 nt, Pseudomonas aeruginosa PA01
gccucagaaguauuucaaccagg

SEQ ID NO: 3504475 - RNA, 21 nt, Pseudomonas aeruginosa PA01
gccucagcgaaacucgugcuc

SEQ ID NO: 3504476 - RNA, 17 nt, Pseudomonas aeruginosa PA01
gccucagcgacaucccg

SEQ ID NO: 3504477 - RNA, 23 nt, Pseudomonas aeruginosa PA01
gccucagcggaacuugcgccgac

SEQ ID NO: 3504478 - RNA, 15 nt, Pseudomonas aeruginosa PA01
gccucagcggccuuc

SEQ ID NO: 3504479 - RNA, 14 nt, Pseudomonas aeruginosa PA01
gccucagcggcugg

SEQ ID NO: 3504480 - RNA, 15 nt, Pseudomonas aeruginosa PA01
gccucagcggcuggc

SEQ ID NO: 3504481 - RNA, 17 nt, Pseudomonas aeruginosa PA01
gccucagcggcuggcga

SEQ ID NO: 3504482 - RNA, 13 nt, Pseudomonas aeruginosa PA01
gccucaggccggg

SEQ ID NO: 3504483 - RNA, 14 nt, Pseudomonas aeruginosa PA01
gccucaggccggga

SEQ ID NO: 3504484 - RNA, 19 nt, Pseudomonas aeruginosa PA01
gccucaggccuggcgcaac

SEQ ID NO: 3504485 - RNA, 19 nt, Pseudomonas aeruginosa PA01
gccucaggcgcugcgcggc

SEQ ID NO: 3504486 - RNA, 14 nt, Pseudomonas aeruginosa PA01
gccucaguaccugc

SEQ ID NO: 3504487 - RNA, 14 nt, Pseudomonas aeruginosa PA01
gccucauacgaaaa

SEQ ID NO: 3504488 - RNA, 22 nt, Pseudomonas aeruginosa PA01
gccucauucgcucugcgccagg

SEQ ID NO: 3504489 - RNA, 23 nt, Pseudomonas aeruginosa PA01
gccucauucgcucugcgccaggc

SEQ ID NO: 3504490 - RNA, 16 nt, Pseudomonas aeruginosa PA01
gccuccaccagcgccg

SEQ ID NO: 3504491 - RNA, 19 nt, Pseudomonas aeruginosa PA01
gccuccaccagcgccggcg

SEQ ID NO: 3504492 - RNA, 20 nt, Pseudomonas aeruginosa PA01
gccuccaccagcgccggcgg

SEQ ID NO: 3504493 - RNA, 13 nt, Pseudomonas aeruginosa PA01
gccuccacccgcg

SEQ ID NO: 3504494 - RNA, 14 nt, Pseudomonas aeruginosa PA01
gccuccacggcggc

SEQ ID NO: 3504495 - RNA, 16 nt, Pseudomonas aeruginosa PA01
gccuccacggcggccu

SEQ ID NO: 3504496 - RNA, 19 nt, Pseudomonas aeruginosa PA01
gccuccagcaacgccgccc

SEQ ID NO: 3504497 - RNA, 20 nt, Pseudomonas aeruginosa PA01
gccuccagcaacgccgcccc

SEQ ID NO: 3504498 - RNA, 14 nt, Pseudomonas aeruginosa PA01
gccuccagcacucg

SEQ ID NO: 3504499 - RNA, 19 nt, Pseudomonas aeruginosa PA01
gccuccagcacucgcuccu

SEQ ID NO: 3504500 - RNA, 13 nt, Pseudomonas aeruginosa PA01
gccuccagcagcu

SEQ ID NO: 3504501 - RNA, 12 nt, Pseudomonas aeruginosa PA01
gccuccagcgcc

SEQ ID NO: 3504502 - RNA, 14 nt, Pseudomonas aeruginosa PA01
gccuccagcgccgc

SEQ ID NO: 3504503 - RNA, 19 nt, Pseudomonas aeruginosa PA01
gccuccagcgccgccucga

SEQ ID NO: 3504504 - RNA, 19 nt, Pseudomonas aeruginosa PA01
gccuccagcgccucgccga

SEQ ID NO: 3504505 - RNA, 13 nt, Pseudomonas aeruginosa PA01
gccuccagcgggc

SEQ ID NO: 3504506 - RNA, 21 nt, Pseudomonas aeruginosa PA01
gccuccagcgggccuucgcca

SEQ ID NO: 3504507 - RNA, 20 nt, Pseudomonas aeruginosa PA01
gccuccagcgucugccgcug

SEQ ID NO: 3504508 - RNA, 21 nt, Pseudomonas aeruginosa PA01
gccuccagcgucugccgcugg

SEQ ID NO: 3504509 - RNA, 19 nt, Pseudomonas aeruginosa PA01
gccuccaggaauccuccgc

SEQ ID NO: 3504510 - RNA, 21 nt, Pseudomonas aeruginosa PA01
gccuccaggaauccuccgcca

SEQ ID NO: 3504511 - RNA, 22 nt, Pseudomonas aeruginosa PA01
gccuccaggaauccuccgccag

SEQ ID NO: 3504512 - RNA, 23 nt, Pseudomonas aeruginosa PA01
gccuccaggaauccuccgccagc

SEQ ID NO: 3504513 - RNA, 14 nt, Pseudomonas aeruginosa PA01
gccuccaggaccuu

SEQ ID NO: 3504514 - RNA, 14 nt, Pseudomonas aeruginosa PA01
gccuccaggcgcgc

SEQ ID NO: 3504515 - RNA, 19 nt, Pseudomonas aeruginosa PA01
gccuccaggcgcgccugga

SEQ ID NO: 3504516 - RNA, 14 nt, Pseudomonas aeruginosa PA01
gccuccaggcuggc

SEQ ID NO: 3504517 - RNA, 16 nt, Pseudomonas aeruginosa PA01
gccuccaggcuggccu

SEQ ID NO: 3504518 - RNA, 19 nt, Pseudomonas aeruginosa PA01
gccucccaccgcgcggcac

SEQ ID NO: 3504519 - RNA, 19 nt, Pseudomonas aeruginosa PA01
gccucccagccgugggcgu

SEQ ID NO: 3504520 - RNA, 22 nt, Pseudomonas aeruginosa PA01
gccuccccggcccgcgccgccu

SEQ ID NO: 3504521 - RNA, 22 nt, Pseudomonas aeruginosa PA01
gccucccgccaaauggcucgcu

SEQ ID NO: 3504522 - RNA, 12 nt, Pseudomonas aeruginosa PA01
gccucccgccgc

SEQ ID NO: 3504523 - RNA, 17 nt, Pseudomonas aeruginosa PA01
gccucccggcucgccga

SEQ ID NO: 3504524 - RNA, 17 nt, Pseudomonas aeruginosa PA01
gccucccgggccucucg

SEQ ID NO: 3504525 - RNA, 17 nt, Pseudomonas aeruginosa PA01
gccuccgcucugcuggc

SEQ ID NO: 3504526 - RNA, 18 nt, Pseudomonas aeruginosa PA01
gccuccgcucugcuggcc

SEQ ID NO: 3504527 - RNA, 21 nt, Pseudomonas aeruginosa PA01
gccuccgcucugcuggccacc

SEQ ID NO: 3504528 - RNA, 22 nt, Pseudomonas aeruginosa PA01
gccuccgcucugcuggccaccc

SEQ ID NO: 3504529 - RNA, 13 nt, Pseudomonas aeruginosa PA01
gccuccggcacgc

SEQ ID NO: 3504530 - RNA, 13 nt, Pseudomonas aeruginosa PA01
gccauggcgcugc

SEQ ID NO: 3504531 - RNA, 20 nt, Pseudomonas aeruginosa PA01
gccauggcgcuugcgcagca

SEQ ID NO: 3504532 - RNA, 23 nt, Pseudomonas aeruginosa PA01
gccauggcggaucuggaauucgc

SEQ ID NO: 3504533 - RNA, 20 nt, Pseudomonas aeruginosa PA01
gccauggcgggucacgccga

SEQ ID NO: 3504534 - RNA, 23 nt, Pseudomonas aeruginosa PA01
gccauggcgggucacgccgaagu

SEQ ID NO: 3504535 - RNA, 15 nt, Pseudomonas aeruginosa PA01
gccauggcuggugcg

SEQ ID NO: 3504536 - RNA, 18 nt, Pseudomonas aeruginosa PA01
gccaugggccggccgacg

SEQ ID NO: 3504537 - RNA, 15 nt, Pseudomonas aeruginosa PA01
gccauggggaucacc

SEQ ID NO: 3504538 - RNA, 20 nt, Pseudomonas aeruginosa PA01
gccaugggugucggcgauca

SEQ ID NO: 3504539 - RNA, 19 nt, Pseudomonas aeruginosa PA01
gccauggucguucagcggc

SEQ ID NO: 3504540 - RNA, 14 nt, Pseudomonas aeruginosa PA01
gccauggucucgcu

SEQ ID NO: 3504541 - RNA, 16 nt, Pseudomonas aeruginosa PA01
gccauggucucgcuga

SEQ ID NO: 3504542 - RNA, 22 nt, Pseudomonas aeruginosa PA01
gccauguacguaucccagcgcg

SEQ ID NO: 3504543 - RNA, 13 nt, Pseudomonas aeruginosa PA01
gccauguccacca

SEQ ID NO: 3504544 - RNA, 14 nt, Pseudomonas aeruginosa PA01
gccaugucccgggu

SEQ ID NO: 3504545 - RNA, 21 nt, Pseudomonas aeruginosa PA01
gccauucacuuccccucccga

SEQ ID NO: 3504546 - RNA, 22 nt, Pseudomonas aeruginosa PA01
gccauucaggcggaucaccacg

SEQ ID NO: 3504547 - RNA, 14 nt, Pseudomonas aeruginosa PA01
gccauuccgcggca

SEQ ID NO: 3504548 - RNA, 12 nt, Pseudomonas aeruginosa PA01
gccauuccuggg

SEQ ID NO: 3504549 - RNA, 14 nt, Pseudomonas aeruginosa PA01
gccauuccuuccag

SEQ ID NO: 3504550 - RNA, 14 nt, Pseudomonas aeruginosa PA01
gccauucgaauggc

SEQ ID NO: 3504551 - RNA, 21 nt, Pseudomonas aeruginosa PA01
gccauucgaauggcgccggcc

SEQ ID NO: 3504552 - RNA, 13 nt, Pseudomonas aeruginosa PA01
gccauucgccgcg

SEQ ID NO: 3504553 - RNA, 19 nt, Pseudomonas aeruginosa PA01
gccauucgccgcgacgcuc

SEQ ID NO: 3504554 - RNA, 22 nt, Pseudomonas aeruginosa PA01
gccauucgcugucgagcaggga

SEQ ID NO: 3504555 - RNA, 15 nt, Pseudomonas aeruginosa PA01
gccauucgcuucggc

SEQ ID NO: 3504556 - RNA, 17 nt, Pseudomonas aeruginosa PA01
gccauucgcuucggcca

SEQ ID NO: 3504557 - RNA, 17 nt, Pseudomonas aeruginosa PA01
gccauucggccuggcag

SEQ ID NO: 3504558 - RNA, 14 nt, Pseudomonas aeruginosa PA01
gccauucggcgacg

SEQ ID NO: 3504559 - RNA, 22 nt, Pseudomonas aeruginosa PA01
gccauucggcgacgggcuucgc

SEQ ID NO: 3504560 - RNA, 23 nt, Pseudomonas aeruginosa PA01
gccauucggcgacgggcuucgcg

SEQ ID NO: 3504561 - RNA, 16 nt, Pseudomonas aeruginosa PA01
gccauucggcuuccug

SEQ ID NO: 3504562 - RNA, 19 nt, Pseudomonas aeruginosa PA01
gccauucggcuuccugggc

SEQ ID NO: 3504563 - RNA, 21 nt, Pseudomonas aeruginosa PA01
gccauucggcuuccugggcga

SEQ ID NO: 3504564 - RNA, 13 nt, Pseudomonas aeruginosa PA01
gccauucucgcca

SEQ ID NO: 3504565 - RNA, 17 nt, Pseudomonas aeruginosa PA01
gccauugaaggccgaca

SEQ ID NO: 3504566 - RNA, 23 nt, Pseudomonas aeruginosa PA01
gccauugacgaaauacucgucga

SEQ ID NO: 3504567 - RNA, 17 nt, Pseudomonas aeruginosa PA01
gccauugagcgcgccca

SEQ ID NO: 3504568 - RNA, 20 nt, Pseudomonas aeruginosa PA01
gccauugagcgcgcccaggc

SEQ ID NO: 3504569 - RNA, 15 nt, Pseudomonas aeruginosa PA01
gccauugcagguagu

SEQ ID NO: 3504570 - RNA, 22 nt, Pseudomonas aeruginosa PA01
gccauugcagguaguccagcca

SEQ ID NO: 3504571 - RNA, 14 nt, Pseudomonas aeruginosa PA01
gccauugcccggug

SEQ ID NO: 3504572 - RNA, 16 nt, Pseudomonas aeruginosa PA01
gccauugccgccaggu

SEQ ID NO: 3504573 - RNA, 17 nt, Pseudomonas aeruginosa PA01
gccauugcgccaggacc

SEQ ID NO: 3504574 - RNA, 14 nt, Pseudomonas aeruginosa PA01
gccauuggccaggg

SEQ ID NO: 3504575 - RNA, 17 nt, Pseudomonas aeruginosa PA01
gccauuggccaggguca

SEQ ID NO: 3504576 - RNA, 15 nt, Pseudomonas aeruginosa PA01
gccauuggccgacgc

SEQ ID NO: 3504577 - RNA, 17 nt, Pseudomonas aeruginosa PA01
gccauuggccgacgccg

SEQ ID NO: 3504578 - RNA, 20 nt, Pseudomonas aeruginosa PA01
gccauuggccgacgccgcug

SEQ ID NO: 3504579 - RNA, 17 nt, Pseudomonas aeruginosa PA01
gccauugucggccucga

SEQ ID NO: 3504580 - RNA, 19 nt, Pseudomonas aeruginosa PA01
gccauugugcgcgcgcaga

SEQ ID NO: 3504581 - RNA, 20 nt, Pseudomonas aeruginosa PA01
gccauuguucuuuggccaau

SEQ ID NO: 3504582 - RNA, 14 nt, Pseudomonas aeruginosa PA01
gcccaacagcggug

SEQ ID NO: 3504583 - RNA, 20 nt, Pseudomonas aeruginosa PA01
gcccaacagcggugugcuca

SEQ ID NO: 3504584 - RNA, 14 nt, Pseudomonas aeruginosa PA01
gcccaacuccagcu

SEQ ID NO: 3504585 - RNA, 18 nt, Pseudomonas aeruginosa PA01
gcccaacuccagcucgac

SEQ ID NO: 3504586 - RNA, 15 nt, Pseudomonas aeruginosa PA01
gcccaagccgagcgg

SEQ ID NO: 3504587 - RNA, 17 nt, Pseudomonas aeruginosa PA01
gcccaagccgagcggca

SEQ ID NO: 3504588 - RNA, 23 nt, Pseudomonas aeruginosa PA01
gcccaagccgagcggcaaggcca

SEQ ID NO: 3504589 - RNA, 17 nt, Pseudomonas aeruginosa PA01
gcccaaggccaggucga

SEQ ID NO: 3504590 - RNA, 15 nt, Pseudomonas aeruginosa PA01
gcccaagggccuggg

SEQ ID NO: 3504591 - RNA, 16 nt, Pseudomonas aeruginosa PA01
gcccaagggccugggc

SEQ ID NO: 3504592 - RNA, 23 nt, Pseudomonas aeruginosa PA01
gcccaagggccugggcgccgcca

SEQ ID NO: 3504593 - RNA, 20 nt, Pseudomonas aeruginosa PA01
gcccaauccgcgccgguggc

SEQ ID NO: 3504594 - RNA, 15 nt, Pseudomonas aeruginosa PA01
gcccacaaagucacu

SEQ ID NO: 3504595 - RNA, 23 nt, Pseudomonas aeruginosa PA01
gcccacaaagucacugcgggccg

SEQ ID NO: 3504596 - RNA, 13 nt, Pseudomonas aeruginosa PA01
gcccacagugcca

SEQ ID NO: 3504597 - RNA, 18 nt, Pseudomonas aeruginosa PA01
gcccacagugccaggcuc

SEQ ID NO: 3504598 - RNA, 23 nt, Pseudomonas aeruginosa PA01
gcccacagugccaggcucgccgc

SEQ ID NO: 3504599 - RNA, 14 nt, Pseudomonas aeruginosa PA01
gcccaccaccaccg

SEQ ID NO: 3504600 - RNA, 13 nt, Pseudomonas aeruginosa PA01
gcccaccaccagg

SEQ ID NO: 3504601 - RNA, 14 nt, Pseudomonas aeruginosa PA01
gcccaccaccagga

SEQ ID NO: 3504602 - RNA, 20 nt, Pseudomonas aeruginosa PA01
gcccaccaccaggaccaugu

SEQ ID NO: 3504603 - RNA, 19 nt, Pseudomonas aeruginosa PA01
gcccaccagaggcugaccu

SEQ ID NO: 3504604 - RNA, 11 nt, Pseudomonas aeruginosa PA01
gcccaccagcg

SEQ ID NO: 3504605 - RNA, 17 nt, Pseudomonas aeruginosa PA01
gcccacccccagcccgg

SEQ ID NO: 3504606 - RNA, 19 nt, Pseudomonas aeruginosa PA01
gcccacccccagcccggcc

SEQ ID NO: 3504607 - RNA, 21 nt, Pseudomonas aeruginosa PA01
gcccacccccggcccggccau

SEQ ID NO: 3504608 - RNA, 23 nt, Pseudomonas aeruginosa PA01
gcccacccccggcccggccaucc

SEQ ID NO: 3504609 - RNA, 16 nt, Pseudomonas aeruginosa PA01
gcccacccugcgcgag

SEQ ID NO: 3504610 - RNA, 17 nt, Pseudomonas aeruginosa PA01
gcccacccugcgcgagg

SEQ ID NO: 3504611 - RNA, 13 nt, Pseudomonas aeruginosa PA01
gcccaccugaacg

SEQ ID NO: 3504612 - RNA, 18 nt, Pseudomonas aeruginosa PA01
gcccaccugaacgcgccc

SEQ ID NO: 3504613 - RNA, 16 nt, Pseudomonas aeruginosa PA01
gcccaccuugcgggug

SEQ ID NO: 3504614 - RNA, 15 nt, Pseudomonas aeruginosa PA01
gcccacgcgccuggc

SEQ ID NO: 3504615 - RNA, 18 nt, Pseudomonas aeruginosa PA01
gcccacgcgccuggccgu

SEQ ID NO: 3504616 - RNA, 20 nt, Pseudomonas aeruginosa PA01
gcccacgcucagugcgccgg

SEQ ID NO: 3504617 - RNA, 21 nt, Pseudomonas aeruginosa PA01
gcccacgcucagugcgccggg

SEQ ID NO: 3504618 - RNA, 24 nt, Pseudomonas aeruginosa PA01
gcccacgcucagugcgccgggugc

SEQ ID NO: 3504619 - RNA, 14 nt, Pseudomonas aeruginosa PA01
gcccacggccaggc

SEQ ID NO: 3504620 - RNA, 17 nt, Pseudomonas aeruginosa PA01
gcccacggccaggccca

SEQ ID NO: 3504621 - RNA, 12 nt, Pseudomonas aeruginosa PA01
gcccacggcgag

SEQ ID NO: 3504622 - RNA, 14 nt, Pseudomonas aeruginosa PA01
gcccacggcgccuu

SEQ ID NO: 3504623 - RNA, 15 nt, Pseudomonas aeruginosa PA01
gcccacgggcggccg

SEQ ID NO: 3504624 - RNA, 13 nt, Pseudomonas aeruginosa PA01
gcccacuccagau

SEQ ID NO: 3504625 - RNA, 23 nt, Pseudomonas aeruginosa PA01
gcccacuccagauagugcggcca

SEQ ID NO: 3504626 - RNA, 17 nt, Pseudomonas aeruginosa PA01
gcccacuccuccgccug

SEQ ID NO: 3504627 - RNA, 18 nt, Pseudomonas aeruginosa PA01
gcccacuccuccgccugc

SEQ ID NO: 3504628 - RNA, 14 nt, Pseudomonas aeruginosa PA01
gcccacucuucagu

SEQ ID NO: 3504629 - RNA, 12 nt, Pseudomonas aeruginosa PA01
gcccagaaaaaa

SEQ ID NO: 3504630 - RNA, 17 nt, Pseudomonas aeruginosa PA01
gcccagaaaaaagcccc

SEQ ID NO: 3504631 - RNA, 19 nt, Pseudomonas aeruginosa PA01
gcccagaaaaaagccccgc

SEQ ID NO: 3504632 - RNA, 17 nt, Pseudomonas aeruginosa PA01
gcccagacacgccucaa

SEQ ID NO: 3504633 - RNA, 22 nt, Pseudomonas aeruginosa PA01
gcccagacacgccucaaggcau

SEQ ID NO: 3504634 - RNA, 18 nt, Pseudomonas aeruginosa PA01
gcccagaccccauccgca

SEQ ID NO: 3504635 - RNA, 14 nt, Pseudomonas aeruginosa PA01
gcccagacgccgcu

SEQ ID NO: 3504636 - RNA, 18 nt, Pseudomonas aeruginosa PA01
gcccagagcagcaccagc

SEQ ID NO: 3504637 - RNA, 19 nt, Pseudomonas aeruginosa PA01
gcccagagcagcaccagca

SEQ ID NO: 3504638 - RNA, 16 nt, Pseudomonas aeruginosa PA01
gcccagauauccaggg

SEQ ID NO: 3504639 - RNA, 19 nt, Pseudomonas aeruginosa PA01
gcccagauauccagggcca

SEQ ID NO: 3504640 - RNA, 20 nt, Pseudomonas aeruginosa PA01
gcccagauauccagggccag

SEQ ID NO: 3504641 - RNA, 22 nt, Pseudomonas aeruginosa PA01
gcccagauauccagggccagga

SEQ ID NO: 3504642 - RNA, 22 nt, Pseudomonas aeruginosa PA01
gcccagaucauguagagcaggc

SEQ ID NO: 3504643 - RNA, 19 nt, Pseudomonas aeruginosa PA01
gcccagauccccugcagga

SEQ ID NO: 3504644 - RNA, 22 nt, Pseudomonas aeruginosa PA01
gcccagauccccugcaggaccc

SEQ ID NO: 3504645 - RNA, 16 nt, Pseudomonas aeruginosa PA01
gcccagaugaucaggc

SEQ ID NO: 3504646 - RNA, 17 nt, Pseudomonas aeruginosa PA01
gcccagaugaucaggcc

SEQ ID NO: 3504647 - RNA, 19 nt, Pseudomonas aeruginosa PA01
gcccagaugaucaggccga

SEQ ID NO: 3504648 - RNA, 21 nt, Pseudomonas aeruginosa PA01
gcccagaugaucaggccgagc

SEQ ID NO: 3504649 - RNA, 17 nt, Pseudomonas aeruginosa PA01
gcccagcaacgcgugau

SEQ ID NO: 3504650 - RNA, 17 nt, Pseudomonas aeruginosa PA01
gcccagcaccgagcuga

SEQ ID NO: 3504651 - RNA, 16 nt, Pseudomonas aeruginosa PA01
gcccagcagcaccauc

SEQ ID NO: 3504652 - RNA, 13 nt, Pseudomonas aeruginosa PA01
gcccagcagcagg

SEQ ID NO: 3504653 - RNA, 14 nt, Pseudomonas aeruginosa PA01
gcccagcagcaggc

SEQ ID NO: 3504654 - RNA, 16 nt, Pseudomonas aeruginosa PA01
gcccagcagcaggccg

SEQ ID NO: 3504655 - RNA, 17 nt, Pseudomonas aeruginosa PA01
gcccagcagcaggccgg

SEQ ID NO: 3504656 - RNA, 18 nt, Pseudomonas aeruginosa PA01
gcccagcagcaggccggc

SEQ ID NO: 3504657 - RNA, 20 nt, Pseudomonas aeruginosa PA01
gcccagcagcaggccggcga

SEQ ID NO: 3504658 - RNA, 22 nt, Pseudomonas aeruginosa PA01
gcccagcagcaggccggcgacc

SEQ ID NO: 3504659 - RNA, 15 nt, Pseudomonas aeruginosa PA01
gcccagcagcggcag

SEQ ID NO: 3504660 - RNA, 12 nt, Pseudomonas aeruginosa PA01
gcccagcaggcc

SEQ ID NO: 3504661 - RNA, 13 nt, Pseudomonas aeruginosa PA01
gcccagcaggccg

SEQ ID NO: 3504662 - RNA, 14 nt, Pseudomonas aeruginosa PA01
gcccagcaggccgg

SEQ ID NO: 3504663 - RNA, 16 nt, Pseudomonas aeruginosa PA01
gcccagcaggcgcgcc

SEQ ID NO: 3504664 - RNA, 17 nt, Pseudomonas aeruginosa PA01
gcccagcaggcgcgccc

SEQ ID NO: 3504665 - RNA, 12 nt, Pseudomonas aeruginosa PA01
gcccagcaggcu

SEQ ID NO: 3504666 - RNA, 13 nt, Pseudomonas aeruginosa PA01
gcccagcaggcug

SEQ ID NO: 3504667 - RNA, 14 nt, Pseudomonas aeruginosa PA01
gcccagcaggcugc

SEQ ID NO: 3504668 - RNA, 15 nt, Pseudomonas aeruginosa PA01
gcccagcaggcugcu

SEQ ID NO: 3504669 - RNA, 22 nt, Pseudomonas aeruginosa PA01
gcccagcaggcugcugcugcgg

SEQ ID NO: 3504670 - RNA, 17 nt, Pseudomonas aeruginosa PA01
gcccagcagggccagcc

SEQ ID NO: 3504671 - RNA, 19 nt, Pseudomonas aeruginosa PA01
gcccagcagggccagccag

SEQ ID NO: 3504672 - RNA, 23 nt, Pseudomonas aeruginosa PA01
gcccagcagggccagccagagcc

SEQ ID NO: 3504673 - RNA, 14 nt, Pseudomonas aeruginosa PA01
gcccagcaggucga

SEQ ID NO: 3504674 - RNA, 15 nt, Pseudomonas aeruginosa PA01
gcccagcaggucgau

SEQ ID NO: 3504675 - RNA, 13 nt, Pseudomonas aeruginosa PA01
gcccagccagagc

SEQ ID NO: 3504676 - RNA, 14 nt, Pseudomonas aeruginosa PA01
gcccagccagagcg

SEQ ID NO: 3504677 - RNA, 14 nt, Pseudomonas aeruginosa PA01
gcccagccagggcc

SEQ ID NO: 3504678 - RNA, 17 nt, Pseudomonas aeruginosa PA01
gcccagccccaccgcca

SEQ ID NO: 3504679 - RNA, 11 nt, Pseudomonas aeruginosa PA01
gcccagcccgc

SEQ ID NO: 3504680 - RNA, 13 nt, Pseudomonas aeruginosa PA01
gcccagccgcggc

SEQ ID NO: 3504681 - RNA, 22 nt, Pseudomonas aeruginosa PA01
gcccagccggugaaacggauca

SEQ ID NO: 3504682 - RNA, 18 nt, Pseudomonas aeruginosa PA01
gcccagcgacuccgccag

SEQ ID NO: 3504683 - RNA, 13 nt, Pseudomonas aeruginosa PA01
gcccagcgcagcc

SEQ ID NO: 3504684 - RNA, 15 nt, Pseudomonas aeruginosa PA01
gcccagcgcagccug

SEQ ID NO: 3504685 - RNA, 19 nt, Pseudomonas aeruginosa PA01
gcccagcgcagccugcugg

SEQ ID NO: 3504686 - RNA, 23 nt, Pseudomonas aeruginosa PA01
gcccagcgcagccugcuggccug

SEQ ID NO: 3504687 - RNA, 13 nt, Pseudomonas aeruginosa PA01
gcccagcgcaggc

SEQ ID NO: 3504688 - RNA, 15 nt, Pseudomonas aeruginosa PA01
gcccagcgcaggccg

SEQ ID NO: 3504689 - RNA, 16 nt, Pseudomonas aeruginosa PA01
gcccagcgcaggccga

SEQ ID NO: 3504690 - RNA, 20 nt, Pseudomonas aeruginosa PA01
gcccagcgccccgccuaccg

SEQ ID NO: 3504691 - RNA, 13 nt, Pseudomonas aeruginosa PA01
gcccagcgccgcc

SEQ ID NO: 3504692 - RNA, 14 nt, Pseudomonas aeruginosa PA01
gcccagcgccgcca

SEQ ID NO: 3504693 - RNA, 16 nt, Pseudomonas aeruginosa PA01
gcccagcgccgccagc

SEQ ID NO: 3504694 - RNA, 17 nt, Pseudomonas aeruginosa PA01
gcccagcgccgccagca

SEQ ID NO: 3504695 - RNA, 18 nt, Pseudomonas aeruginosa PA01
gcccagcgccgccagcag

SEQ ID NO: 3504696 - RNA, 22 nt, Pseudomonas aeruginosa PA01
gcccagcgccgccagcaggucg

SEQ ID NO: 3504697 - RNA, 14 nt, Pseudomonas aeruginosa PA01
gcccagcgccgccu

SEQ ID NO: 3504698 - RNA, 20 nt, Pseudomonas aeruginosa PA01
gcccagcgccgccugcuggc

SEQ ID NO: 3504699 - RNA, 23 nt, Pseudomonas aeruginosa PA01
gcccagcgccgccugcuggcugc

SEQ ID NO: 3504700 - RNA, 13 nt, Pseudomonas aeruginosa PA01
gcccagcgccugc

SEQ ID NO: 3504701 - RNA, 14 nt, Pseudomonas aeruginosa PA01
gcccagcgccugua

SEQ ID NO: 3504702 - RNA, 14 nt, Pseudomonas aeruginosa PA01
gcccagcggcaggg

SEQ ID NO: 3504703 - RNA, 13 nt, Pseudomonas aeruginosa PA01
gcccagcggcgcc

SEQ ID NO: 3504704 - RNA, 15 nt, Pseudomonas aeruginosa PA01
gcccagcggcgccag

SEQ ID NO: 3504705 - RNA, 14 nt, Pseudomonas aeruginosa PA01
gcccagcggcgccu

SEQ ID NO: 3504706 - RNA, 16 nt, Pseudomonas aeruginosa PA01
gcccagcggcgccucg

SEQ ID NO: 3504707 - RNA, 17 nt, Pseudomonas aeruginosa PA01
gcccagcggcgccucga

SEQ ID NO: 3504708 - RNA, 20 nt, Pseudomonas aeruginosa PA01
gcccagcggcgccucgaagc

SEQ ID NO: 3504709 - RNA, 15 nt, Pseudomonas aeruginosa PA01
gcccagcggcgcggc

SEQ ID NO: 3504710 - RNA, 16 nt, Pseudomonas aeruginosa PA01
gcccagcggcgcggcg

SEQ ID NO: 3504711 - RNA, 18 nt, Pseudomonas aeruginosa PA01
gcccagcggcuggcgggc

SEQ ID NO: 3504712 - RNA, 19 nt, Pseudomonas aeruginosa PA01
gcccagcggcuggcgggcg

SEQ ID NO: 3504713 - RNA, 21 nt, Pseudomonas aeruginosa PA01
gcccagcggcuggcgggcgac

SEQ ID NO: 3504714 - RNA, 18 nt, Pseudomonas aeruginosa PA01
gcccagcguggccagcga

SEQ ID NO: 3504715 - RNA, 20 nt, Pseudomonas aeruginosa PA01
gcccagcguggccagcgaac

SEQ ID NO: 3504716 - RNA, 15 nt, Pseudomonas aeruginosa PA01
gcccagcguucggcg

SEQ ID NO: 3504717 - RNA, 20 nt, Pseudomonas aeruginosa PA01
gcccagcguucggcgcuggc

SEQ ID NO: 3504718 - RNA, 24 nt, Pseudomonas aeruginosa PA01
gcccagcguucggcgcuggcgcgg

SEQ ID NO: 3504719 - RNA, 13 nt, Pseudomonas aeruginosa PA01
gcccagcucgccg

SEQ ID NO: 3504720 - RNA, 14 nt, Pseudomonas aeruginosa PA01
gcccagcucgccgc

SEQ ID NO: 3504721 - RNA, 16 nt, Pseudomonas aeruginosa PA01
gcccagcucgccgcuc

SEQ ID NO: 3504722 - RNA, 18 nt, Pseudomonas aeruginosa PA01
gcccagcucguccaggca

SEQ ID NO: 3504723 - RNA, 19 nt, Pseudomonas aeruginosa PA01
gcccagcucguccaggcaa

SEQ ID NO: 3504724 - RNA, 21 nt, Pseudomonas aeruginosa PA01
gcccagcucguccaggcaagc

SEQ ID NO: 3504725 - RNA, 15 nt, Pseudomonas aeruginosa PA01
gcccagcuucuuggc

SEQ ID NO: 3504726 - RNA, 17 nt, Pseudomonas aeruginosa PA01
gcccagcuugauguagg

SEQ ID NO: 3504727 - RNA, 15 nt, Pseudomonas aeruginosa PA01
gcccagcuuggccac

SEQ ID NO: 3504728 - RNA, 15 nt, Pseudomonas aeruginosa PA01
gcccaggcagaucgc

SEQ ID NO: 3504729 - RNA, 19 nt, Pseudomonas aeruginosa PA01
gcccaggcagaucgcgccg

SEQ ID NO: 3504730 - RNA, 20 nt, Pseudomonas aeruginosa PA01
gcccaggcagaucgcgccga

SEQ ID NO: 3504731 - RNA, 22 nt, Pseudomonas aeruginosa PA01
gcccaggcagaucgcgccgagc

SEQ ID NO: 3504732 - RNA, 14 nt, Pseudomonas aeruginosa PA01
gcccaggcagcaga

SEQ ID NO: 3504733 - RNA, 16 nt, Pseudomonas aeruginosa PA01
gcccaggcagcagagc

SEQ ID NO: 3504734 - RNA, 12 nt, Pseudomonas aeruginosa PA01
gcccaggccgaa

SEQ ID NO: 3504735 - RNA, 14 nt, Pseudomonas aeruginosa PA01
gcccaggccgccga

SEQ ID NO: 3504736 - RNA, 21 nt, Pseudomonas aeruginosa PA01
gcccaggccgccgauccagga

SEQ ID NO: 3504737 - RNA, 13 nt, Pseudomonas aeruginosa PA01
gcccaggccgcug

SEQ ID NO: 3504738 - RNA, 20 nt, Pseudomonas aeruginosa PA01
gcccaggccgcuggcggcga

SEQ ID NO: 3504739 - RNA, 14 nt, Pseudomonas aeruginosa PA01
gcccaggccggguc

SEQ ID NO: 3504740 - RNA, 19 nt, Pseudomonas aeruginosa PA01
gcccaggccgggucgcagc

SEQ ID NO: 3504741 - RNA, 20 nt, Pseudomonas aeruginosa PA01
gcccaggccgggucgcagcc

SEQ ID NO: 3504742 - RNA, 22 nt, Pseudomonas aeruginosa PA01
gcccaggccgggucgcagccgg

SEQ ID NO: 3504743 - RNA, 23 nt, Pseudomonas aeruginosa PA01
gcccaggccgggucgcagccggg

SEQ ID NO: 3504744 - RNA, 14 nt, Pseudomonas aeruginosa PA01
gcccaggccggguu

SEQ ID NO: 3504745 - RNA, 13 nt, Pseudomonas aeruginosa PA01
gcccaggcgcacc

SEQ ID NO: 3504746 - RNA, 20 nt, Pseudomonas aeruginosa PA01
gcccaggcgcaccuccucgg

SEQ ID NO: 3504747 - RNA, 14 nt, Pseudomonas aeruginosa PA01
gcccaggcgccgcu

SEQ ID NO: 3504748 - RNA, 15 nt, Pseudomonas aeruginosa PA01
gcccaggcgccgcuc

SEQ ID NO: 3504749 - RNA, 15 nt, Pseudomonas aeruginosa PA01
gcccaggcgcucggc

SEQ ID NO: 3504750 - RNA, 18 nt, Pseudomonas aeruginosa PA01
gcccaggcgcucggcggc

SEQ ID NO: 3504751 - RNA, 19 nt, Pseudomonas aeruginosa PA01
gcccaggcgcucggcggcg

SEQ ID NO: 3504752 - RNA, 16 nt, Pseudomonas aeruginosa PA01
gcccaggcgcuggcgc

SEQ ID NO: 3504753 - RNA, 17 nt, Pseudomonas aeruginosa PA01
gcccaggcgcuggcgcc

SEQ ID NO: 3504754 - RNA, 19 nt, Pseudomonas aeruginosa PA01
gcccaggcgcuggcgccga

SEQ ID NO: 3504755 - RNA, 20 nt, Pseudomonas aeruginosa PA01
gcccaggcgcuggcgccgau

SEQ ID NO: 3504756 - RNA, 19 nt, Pseudomonas aeruginosa PA01
gcccaggcgucgcgccagc

SEQ ID NO: 3504757 - RNA, 23 nt, Pseudomonas aeruginosa PA01
gcccaggcgucgcgccagcaccg

SEQ ID NO: 3504758 - RNA, 18 nt, Pseudomonas aeruginosa PA01
gcccaggcugaggucgcg

SEQ ID NO: 3504759 - RNA, 23 nt, Pseudomonas aeruginosa PA01
gcccaggcugaggucgcgggcga

SEQ ID NO: 3504760 - RNA, 11 nt, Pseudomonas aeruginosa PA01
gcccaggcugc

SEQ ID NO: 3504761 - RNA, 13 nt, Pseudomonas aeruginosa PA01
gcccaggcugccg

SEQ ID NO: 3504762 - RNA, 16 nt, Pseudomonas aeruginosa PA01
gcccaggcugccgccg

SEQ ID NO: 3504763 - RNA, 18 nt, Pseudomonas aeruginosa PA01
gcccaggcugccgccgcc

SEQ ID NO: 3504764 - RNA, 15 nt, Pseudomonas aeruginosa PA01
gcccaggcugccggc

SEQ ID NO: 3504765 - RNA, 16 nt, Pseudomonas aeruginosa PA01
gcccaggcugccggcc

SEQ ID NO: 3504766 - RNA, 14 nt, Pseudomonas aeruginosa PA01
gcccaggcuggcgg

SEQ ID NO: 3504767 - RNA, 17 nt, Pseudomonas aeruginosa PA01
gcccaggcuggcggcca

SEQ ID NO: 3504768 - RNA, 21 nt, Pseudomonas aeruginosa PA01
gcccaggcuggcggccagggc

SEQ ID NO: 3504769 - RNA, 16 nt, Pseudomonas aeruginosa PA01
gcccagggacgcgccg

SEQ ID NO: 3504770 - RNA, 16 nt, Pseudomonas aeruginosa PA01
gcccagggccagcagc

SEQ ID NO: 3504771 - RNA, 20 nt, Pseudomonas aeruginosa PA01
gcccagggccagcggguuga

SEQ ID NO: 3504772 - RNA, 14 nt, Pseudomonas aeruginosa PA01
gcccagggcccaga

SEQ ID NO: 3504773 - RNA, 15 nt, Pseudomonas aeruginosa PA01
gcccagggcccagag

SEQ ID NO: 3504774 - RNA, 17 nt, Pseudomonas aeruginosa PA01
gcccagggcccagagca

SEQ ID NO: 3504775 - RNA, 20 nt, Pseudomonas aeruginosa PA01
gcccagggcgaucgucgaga

SEQ ID NO: 3504776 - RNA, 11 nt, Pseudomonas aeruginosa PA01
gcccagggcgg

SEQ ID NO: 3504777 - RNA, 18 nt, Pseudomonas aeruginosa PA01
gcccagggcguggucggc

SEQ ID NO: 3504778 - RNA, 21 nt, Pseudomonas aeruginosa PA01
gcccagggcguggucggcggc

SEQ ID NO: 3504779 - RNA, 22 nt, Pseudomonas aeruginosa PA01
gcccagggcguggucggcggcc

SEQ ID NO: 3504780 - RNA, 16 nt, Pseudomonas aeruginosa PA01
gcccagggggccgggc

SEQ ID NO: 3504781 - RNA, 20 nt, Pseudomonas aeruginosa PA01
gcccaggguggcguucucga

SEQ ID NO: 3504782 - RNA, 18 nt, Pseudomonas aeruginosa PA01
gcccagguacugggcgau

SEQ ID NO: 3504783 - RNA, 17 nt, Pseudomonas aeruginosa PA01
gcccagguagccggcga

SEQ ID NO: 3504784 - RNA, 19 nt, Pseudomonas aeruginosa PA01
gcccagguagccggcgagc

SEQ ID NO: 3504785 - RNA, 21 nt, Pseudomonas aeruginosa PA01
gcccagguagccggcgagcgc

SEQ ID NO: 3504786 - RNA, 16 nt, Pseudomonas aeruginosa PA01
gcccagguaggcgaug

SEQ ID NO: 3504787 - RNA, 17 nt, Pseudomonas aeruginosa PA01
gcccagguaggcgaugc

SEQ ID NO: 3504788 - RNA, 16 nt, Pseudomonas aeruginosa PA01
gcccagguagucgccc

SEQ ID NO: 3504789 - RNA, 20 nt, Pseudomonas aeruginosa PA01
gcccagguagucgcccagcg

SEQ ID NO: 3504790 - RNA, 21 nt, Pseudomonas aeruginosa PA01
gcccagguagucgcccagcgc

SEQ ID NO: 3504791 - RNA, 22 nt, Pseudomonas aeruginosa PA01
gcccagguagucgcccagcgcc

SEQ ID NO: 3504792 - RNA, 24 nt, Pseudomonas aeruginosa PA01
gcccagguagucgcccagcgccug

SEQ ID NO: 3504793 - RNA, 23 nt, Pseudomonas aeruginosa PA01
gcccaggugcgagucaccccgac

SEQ ID NO: 3504794 - RNA, 12 nt, Pseudomonas aeruginosa PA01
gcccagguggca

SEQ ID NO: 3504795 - RNA, 15 nt, Pseudomonas aeruginosa PA01
gcccagguggcaggc

SEQ ID NO: 3504796 - RNA, 19 nt, Pseudomonas aeruginosa PA01
gcccagguugaugccguug

SEQ ID NO: 3504797 - RNA, 17 nt, Pseudomonas aeruginosa PA01
gcccaguaccacgcagc

SEQ ID NO: 3504798 - RNA, 15 nt, Pseudomonas aeruginosa PA01
gcccaguaccgccac

SEQ ID NO: 3504799 - RNA, 17 nt, Pseudomonas aeruginosa PA01
gcccaguaccgccacgu

SEQ ID NO: 3504800 - RNA, 18 nt, Pseudomonas aeruginosa PA01
gcccaguccugggugucg

SEQ ID NO: 3504801 - RNA, 16 nt, Pseudomonas aeruginosa PA01
gcccagugcccggcag

SEQ ID NO: 3504802 - RNA, 14 nt, Pseudomonas aeruginosa PA01
gcccagugcuggcg

SEQ ID NO: 3504803 - RNA, 19 nt, Pseudomonas aeruginosa PA01
gcccagugguuccaggagg

SEQ ID NO: 3504804 - RNA, 15 nt, Pseudomonas aeruginosa PA01
gcccaguucgccggc

SEQ ID NO: 3504805 - RNA, 16 nt, Pseudomonas aeruginosa PA01
gcccaguucgcgcagg

SEQ ID NO: 3504806 - RNA, 15 nt, Pseudomonas aeruginosa PA01
gcccaguucgcugcc

SEQ ID NO: 3504807 - RNA, 19 nt, Pseudomonas aeruginosa PA01
gcccaguucgcugccgccg

SEQ ID NO: 3504808 - RNA, 20 nt, Pseudomonas aeruginosa PA01
gcccaguucgcugccgccgc

SEQ ID NO: 3504809 - RNA, 22 nt, Pseudomonas aeruginosa PA01
gcccaguucgcugccgccgcgc

SEQ ID NO: 3504810 - RNA, 19 nt, Pseudomonas aeruginosa PA01
gcccaguucuucgccgccc

SEQ ID NO: 3504811 - RNA, 21 nt, Pseudomonas aeruginosa PA01
gcccaguucuucgccgcccgc

SEQ ID NO: 3504812 - RNA, 15 nt, Pseudomonas aeruginosa PA01
gcccaguugcccggc

SEQ ID NO: 3504813 - RNA, 16 nt, Pseudomonas aeruginosa PA01
gcccaguugcccggcc

SEQ ID NO: 3504814 - RNA, 20 nt, Pseudomonas aeruginosa PA01
gcccaguugcccggccuggu

SEQ ID NO: 3504815 - RNA, 16 nt, Pseudomonas aeruginosa PA01
gcccaguugcgccgcc

SEQ ID NO: 3504816 - RNA, 17 nt, Pseudomonas aeruginosa PA01
gcccaguugcgccgccu

SEQ ID NO: 3504817 - RNA, 18 nt, Pseudomonas aeruginosa PA01
gcccaguugcgccgccug

SEQ ID NO: 3504818 - RNA, 19 nt, Pseudomonas aeruginosa PA01
gcccaguugcgccgccugc

SEQ ID NO: 3504819 - RNA, 15 nt, Pseudomonas aeruginosa PA01
gcccaguugcgcggc

SEQ ID NO: 3504820 - RNA, 14 nt, Pseudomonas aeruginosa PA01
gcccauacaccagg

SEQ ID NO: 3504821 - RNA, 22 nt, Pseudomonas aeruginosa PA01
gcccauacaccaggccggcggc

SEQ ID NO: 3504822 - RNA, 23 nt, Pseudomonas aeruginosa PA01
gcccauagcgaguaggcgaagcc

SEQ ID NO: 3504823 - RNA, 14 nt, Pseudomonas aeruginosa PA01
gcccaucaacgagc

SEQ ID NO: 3504824 - RNA, 17 nt, Pseudomonas aeruginosa PA01
gcccaucaacgagccga

SEQ ID NO: 3504825 - RNA, 20 nt, Pseudomonas aeruginosa PA01
gcccaucaacgagccgagca

SEQ ID NO: 3504826 - RNA, 14 nt, Pseudomonas aeruginosa PA01
gcccaucaggcuca

SEQ ID NO: 3504827 - RNA, 17 nt, Pseudomonas aeruginosa PA01
gcccauccgccgcagga

SEQ ID NO: 3504828 - RNA, 17 nt, Pseudomonas aeruginosa PA01
gcccauccgcucggcga

SEQ ID NO: 3504829 - RNA, 14 nt, Pseudomonas aeruginosa PA01
gcccauccuggcga

SEQ ID NO: 3504830 - RNA, 18 nt, Pseudomonas aeruginosa PA01
gcccaucgacugcaacag

SEQ ID NO: 3504831 - RNA, 19 nt, Pseudomonas aeruginosa PA01
gcccaucgacugcaacaga

SEQ ID NO: 3504832 - RNA, 23 nt, Pseudomonas aeruginosa PA01
gcccaucgagguauugcgcgugg

SEQ ID NO: 3504833 - RNA, 14 nt, Pseudomonas aeruginosa PA01
gcccaucgccacca

SEQ ID NO: 3504834 - RNA, 17 nt, Pseudomonas aeruginosa PA01
gcccaucgccaccagca

SEQ ID NO: 3504835 - RNA, 18 nt, Pseudomonas aeruginosa PA01
gcccaucgccaccagcag

SEQ ID NO: 3504836 - RNA, 19 nt, Pseudomonas aeruginosa PA01
gcccaucgccaccagcagg

SEQ ID NO: 3504837 - RNA, 21 nt, Pseudomonas aeruginosa PA01
gcccaucgccaccagcaggaa

SEQ ID NO: 3504838 - RNA, 17 nt, Pseudomonas aeruginosa PA01
gcccaucgccagggucu

SEQ ID NO: 3504839 - RNA, 18 nt, Pseudomonas aeruginosa PA01
gcccaucggcgucggcug

SEQ ID NO: 3504840 - RNA, 23 nt, Pseudomonas aeruginosa PA01
gcccaucucgguguccaccacca

SEQ ID NO: 3504841 - RNA, 16 nt, Pseudomonas aeruginosa PA01
gcccaucuucaggccg

SEQ ID NO: 3504842 - RNA, 23 nt, Pseudomonas aeruginosa PA01
gcccaugaaaaagcccggccugg

SEQ ID NO: 3504843 - RNA, 20 nt, Pseudomonas aeruginosa PA01
gcccaugaaaaauggccgcu

SEQ ID NO: 3504844 - RNA, 19 nt, Pseudomonas aeruginosa PA01
gcccaugauggucggcacg

SEQ ID NO: 3504845 - RNA, 20 nt, Pseudomonas aeruginosa PA01
gcccaugccgcccggccgcu

SEQ ID NO: 3504846 - RNA, 17 nt, Pseudomonas aeruginosa PA01
gcccaugccuugcagcg

SEQ ID NO: 3504847 - RNA, 16 nt, Pseudomonas aeruginosa PA01
gcccaugcgcggcgag

SEQ ID NO: 3504848 - RNA, 17 nt, Pseudomonas aeruginosa PA01
gcccauggcacgcaggg

SEQ ID NO: 3504849 - RNA, 14 nt, Pseudomonas aeruginosa PA01
gcccauggucagcg

SEQ ID NO: 3504850 - RNA, 19 nt, Pseudomonas aeruginosa PA01
gcccauguagaccaccagc

SEQ ID NO: 3504851 - RNA, 22 nt, Pseudomonas aeruginosa PA01
gcccauguagaccaccagcgug

SEQ ID NO: 3504852 - RNA, 23 nt, Pseudomonas aeruginosa PA01
gcccaugugcagcuucuccaggg

SEQ ID NO: 3504853 - RNA, 18 nt, Pseudomonas aeruginosa PA01
gcccaugugcuugaccgc

SEQ ID NO: 3504854 - RNA, 20 nt, Pseudomonas aeruginosa PA01
gcccaugugcuugaccgccg

SEQ ID NO: 3504855 - RNA, 23 nt, Pseudomonas aeruginosa PA01
gcccaugugcuugaccgccgccu

SEQ ID NO: 3504856 - RNA, 20 nt, Pseudomonas aeruginosa PA01
gcccauugcccggccaggcg

SEQ ID NO: 3504857 - RNA, 15 nt, Pseudomonas aeruginosa PA01
gcccauugccgggcu

SEQ ID NO: 3504858 - RNA, 16 nt, Pseudomonas aeruginosa PA01
gcccauugccgggcuu

SEQ ID NO: 3504859 - RNA, 17 nt, Pseudomonas aeruginosa PA01
gccccaaggggccgcgc

SEQ ID NO: 3504860 - RNA, 12 nt, Pseudomonas aeruginosa PA01
gccccacaggcc

SEQ ID NO: 3504861 - RNA, 20 nt, Pseudomonas aeruginosa PA01
gccccaccaccaucgccgcg

SEQ ID NO: 3504862 - RNA, 14 nt, Pseudomonas aeruginosa PA01
gccccaccccaggg

SEQ ID NO: 3504863 - RNA, 21 nt, Pseudomonas aeruginosa PA01
gccccaccccaggguuggcgg

SEQ ID NO: 3504864 - RNA, 17 nt, Pseudomonas aeruginosa PA01
gccccaccgcacuggug

SEQ ID NO: 3504865 - RNA, 20 nt, Pseudomonas aeruginosa PA01
gccccaccgcacugguggcg

SEQ ID NO: 3504866 - RNA, 15 nt, Pseudomonas aeruginosa PA01
gccccaccgccaggu

SEQ ID NO: 3504867 - RNA, 18 nt, Pseudomonas aeruginosa PA01
gccccaccuggcgacagg

SEQ ID NO: 3504868 - RNA, 21 nt, Pseudomonas aeruginosa PA01
gccccaccuggcgacaggcga

SEQ ID NO: 3504869 - RNA, 12 nt, Pseudomonas aeruginosa PA01
gccccacggcgc

SEQ ID NO: 3504870 - RNA, 15 nt, Pseudomonas aeruginosa PA01
gccccacggcgcggc

SEQ ID NO: 3504871 - RNA, 21 nt, Pseudomonas aeruginosa PA01
gccccacgggucgucgcccug

SEQ ID NO: 3504872 - RNA, 19 nt, Pseudomonas aeruginosa PA01
gccccacuggaagaaggcg

SEQ ID NO: 3504873 - RNA, 21 nt, Pseudomonas aeruginosa PA01
gccccacuggaagaaggcgau

SEQ ID NO: 3504874 - RNA, 23 nt, Pseudomonas aeruginosa PA01
gccccacuggaagaaggcgauca

SEQ ID NO: 3504875 - RNA, 16 nt, Pseudomonas aeruginosa PA01
gccccacuuccggccc

SEQ ID NO: 3504876 - RNA, 18 nt, Pseudomonas aeruginosa PA01
gccccacuuccggcccgg

SEQ ID NO: 3504877 - RNA, 19 nt, Pseudomonas aeruginosa PA01
gccccacuuccggcccggc

SEQ ID NO: 3504878 - RNA, 22 nt, Pseudomonas aeruginosa PA01
gccccacuuccggcccggccag

SEQ ID NO: 3504879 - RNA, 14 nt, Pseudomonas aeruginosa PA01
gccccagaagcccc

SEQ ID NO: 3504880 - RNA, 15 nt, Pseudomonas aeruginosa PA01
gccccagaagcccca

SEQ ID NO: 3504881 - RNA, 19 nt, Pseudomonas aeruginosa PA01
gccccagaagccccagagc

SEQ ID NO: 3504882 - RNA, 21 nt, Pseudomonas aeruginosa PA01
gccccagaagccccagagccc

SEQ ID NO: 3504883 - RNA, 14 nt, Pseudomonas aeruginosa PA01
gccccagacccagg

SEQ ID NO: 3504884 - RNA, 21 nt, Pseudomonas aeruginosa PA01
gccccagacccaggugcgcag

SEQ ID NO: 3504885 - RNA, 14 nt, Pseudomonas aeruginosa PA01
gccccagagcccgc

SEQ ID NO: 3504886 - RNA, 15 nt, Pseudomonas aeruginosa PA01
gccccagagcccgcc

SEQ ID NO: 3504887 - RNA, 22 nt, Pseudomonas aeruginosa PA01
gccccagauggguaagguugcc

SEQ ID NO: 3504888 - RNA, 23 nt, Pseudomonas aeruginosa PA01
gccccagauggguaagguugccg

SEQ ID NO: 3504889 - RNA, 13 nt, Pseudomonas aeruginosa PA01
gccccagcaacug

SEQ ID NO: 3504890 - RNA, 15 nt, Pseudomonas aeruginosa PA01
gccccagcacgccga

SEQ ID NO: 3504891 - RNA, 21 nt, Pseudomonas aeruginosa PA01
gccccagcacgccgagcaacg

SEQ ID NO: 3504892 - RNA, 15 nt, Pseudomonas aeruginosa PA01
gccccagcaucgccg

SEQ ID NO: 3504893 - RNA, 16 nt, Pseudomonas aeruginosa PA01
gccccagcaucgccgg

SEQ ID NO: 3504894 - RNA, 17 nt, Pseudomonas aeruginosa PA01
gccccagcaucgccggc

SEQ ID NO: 3504895 - RNA, 18 nt, Pseudomonas aeruginosa PA01
gccccagcaucgccggca

SEQ ID NO: 3504896 - RNA, 20 nt, Pseudomonas aeruginosa PA01
gccccagcaucgccggcagc

SEQ ID NO: 3504897 - RNA, 16 nt, Pseudomonas aeruginosa PA01
gccccagccuccaccc

SEQ ID NO: 3504898 - RNA, 16 nt, Pseudomonas aeruginosa PA01
gccccagccucggcag

SEQ ID NO: 3504899 - RNA, 19 nt, Pseudomonas aeruginosa PA01
gccccagccucggcagggc

SEQ ID NO: 3504900 - RNA, 13 nt, Pseudomonas aeruginosa PA01
gccccagccuugc

SEQ ID NO: 3504901 - RNA, 14 nt, Pseudomonas aeruginosa PA01
gccccagcgccugg

SEQ ID NO: 3504902 - RNA, 16 nt, Pseudomonas aeruginosa PA01
gccccagcgccugggc

SEQ ID NO: 3504903 - RNA, 17 nt, Pseudomonas aeruginosa PA01
gccccagcgccugggcc

SEQ ID NO: 3504904 - RNA, 23 nt, Pseudomonas aeruginosa PA01
gccccagcgcgagcguuccauga

SEQ ID NO: 3504905 - RNA, 15 nt, Pseudomonas aeruginosa PA01
gccccagcggcaggc

SEQ ID NO: 3504906 - RNA, 18 nt, Pseudomonas aeruginosa PA01
gccccagcggcaggcacg

SEQ ID NO: 3504907 - RNA, 13 nt, Pseudomonas aeruginosa PA01
gccccagcggucg

SEQ ID NO: 3504908 - RNA, 14 nt, Pseudomonas aeruginosa PA01
gccccaggcacggc

SEQ ID NO: 3504909 - RNA, 12 nt, Pseudomonas aeruginosa PA01
gccccaggccgc

SEQ ID NO: 3504910 - RNA, 14 nt, Pseudomonas aeruginosa PA01
gccccaggccgccg

SEQ ID NO: 3504911 - RNA, 12 nt, Pseudomonas aeruginosa PA01
gccccaggcgag

SEQ ID NO: 3504912 - RNA, 13 nt, Pseudomonas aeruginosa PA01
gccccaggcgagu

SEQ ID NO: 3504913 - RNA, 20 nt, Pseudomonas aeruginosa PA01
gccccaggcgauccacagca

SEQ ID NO: 3504914 - RNA, 14 nt, Pseudomonas aeruginosa PA01
gccccaggcgccca

SEQ ID NO: 3504915 - RNA, 16 nt, Pseudomonas aeruginosa PA01
gccccaggcgcccagg

SEQ ID NO: 3504916 - RNA, 20 nt, Pseudomonas aeruginosa PA01
gccccaggcgcccaggcagc

SEQ ID NO: 3504917 - RNA, 21 nt, Pseudomonas aeruginosa PA01
gccccaggcgcccaggcagca

SEQ ID NO: 3504918 - RNA, 15 nt, Pseudomonas aeruginosa PA01
gccccaggcgcggcg

SEQ ID NO: 3504919 - RNA, 15 nt, Pseudomonas aeruginosa PA01
gccccaggcgggcac

SEQ ID NO: 3504920 - RNA, 21 nt, Pseudomonas aeruginosa PA01
gccccaggcgggcacgucgcg

SEQ ID NO: 3504921 - RNA, 19 nt, Pseudomonas aeruginosa PA01
gccccagggaaucgucacg

SEQ ID NO: 3504922 - RNA, 21 nt, Pseudomonas aeruginosa PA01
gccccagggaaucgucacggc

SEQ ID NO: 3504923 - RNA, 13 nt, Pseudomonas aeruginosa PA01
gccccagggccgg

SEQ ID NO: 3504924 - RNA, 16 nt, Pseudomonas aeruginosa PA01
gccccagggccggcgc

SEQ ID NO: 3504925 - RNA, 20 nt, Pseudomonas aeruginosa PA01
gccccagguaggcgaaggcg

SEQ ID NO: 3504926 - RNA, 22 nt, Pseudomonas aeruginosa PA01
gccccagguaggcgaaggcgau

SEQ ID NO: 3504927 - RNA, 14 nt, Pseudomonas aeruginosa PA01
gccccaggugcagc

SEQ ID NO: 3504928 - RNA, 17 nt, Pseudomonas aeruginosa PA01
gccccaggugcagcgag

SEQ ID NO: 3504929 - RNA, 18 nt, Pseudomonas aeruginosa PA01
gccccaggugcagcgagg

SEQ ID NO: 3504930 - RNA, 15 nt, Pseudomonas aeruginosa PA01
gccccagucccuuca

SEQ ID NO: 3504931 - RNA, 21 nt, Pseudomonas aeruginosa PA01
gccccagucccuucagcgcac

SEQ ID NO: 3504932 - RNA, 15 nt, Pseudomonas aeruginosa PA01
gccccaguccucgua

SEQ ID NO: 3504933 - RNA, 16 nt, Pseudomonas aeruginosa PA01
gccccauccgggcggc

SEQ ID NO: 3504934 - RNA, 19 nt, Pseudomonas aeruginosa PA01
gccccauccgggcggcggg

SEQ ID NO: 3504935 - RNA, 20 nt, Pseudomonas aeruginosa PA01
gccccauccgggcggcgggc

SEQ ID NO: 3504936 - RNA, 17 nt, Pseudomonas aeruginosa PA01
gcccccaccgcccccgc

SEQ ID NO: 3504937 - RNA, 18 nt, Pseudomonas aeruginosa PA01
gcccccacgacgcacuca

SEQ ID NO: 3504938 - RNA, 13 nt, Pseudomonas aeruginosa PA01
gcccccagcgccc

SEQ ID NO: 3504939 - RNA, 12 nt, Pseudomonas aeruginosa PA01
gcccccagcgcg

SEQ ID NO: 3504940 - RNA, 12 nt, Pseudomonas aeruginosa PA01
gcccccaggcac

SEQ ID NO: 3504941 - RNA, 23 nt, Pseudomonas aeruginosa PA01
gcccccaggcaccguaggccagg

SEQ ID NO: 3504942 - RNA, 20 nt, Pseudomonas aeruginosa PA01
gcccccaugaaaaaggcgcc

SEQ ID NO: 3504943 - RNA, 13 nt, Pseudomonas aeruginosa PA01
gcccccgccgcug

SEQ ID NO: 3504944 - RNA, 23 nt, Pseudomonas aeruginosa PA01
gcccccgccgcugaggcucgccg

SEQ ID NO: 3504945 - RNA, 14 nt, Pseudomonas aeruginosa PA01
gcccccgccggccg

SEQ ID NO: 3504946 - RNA, 17 nt, Pseudomonas aeruginosa PA01
gcccccgccggccggga

SEQ ID NO: 3504947 - RNA, 15 nt, Pseudomonas aeruginosa PA01
gcccccggcccgggc

SEQ ID NO: 3504948 - RNA, 15 nt, Pseudomonas aeruginosa PA01
gcccccggcgccacc

SEQ ID NO: 3504949 - RNA, 20 nt, Pseudomonas aeruginosa PA01
gcccccggcgcccagaaaaa

SEQ ID NO: 3504950 - RNA, 14 nt, Pseudomonas aeruginosa PA01
gcccccucgcccuc

SEQ ID NO: 3504951 - RNA, 12 nt, Pseudomonas aeruginosa PA01
gcccccuggccg

SEQ ID NO: 3504952 - RNA, 13 nt, Pseudomonas aeruginosa PA01
gcccccuggccgu

SEQ ID NO: 3504953 - RNA, 18 nt, Pseudomonas aeruginosa PA01
gccccgaaaaaaaaggcc

SEQ ID NO: 3504954 - RNA, 20 nt, Pseudomonas aeruginosa PA01
gccccgaaaaaaaaggccgc

SEQ ID NO: 3504955 - RNA, 14 nt, Pseudomonas aeruginosa PA01
gccccgagaaaacc

SEQ ID NO: 3504956 - RNA, 15 nt, Pseudomonas aeruginosa PA01
gccccgagcgggccg

SEQ ID NO: 3504957 - RNA, 16 nt, Pseudomonas aeruginosa PA01
gccccgagcgggccga

SEQ ID NO: 3504958 - RNA, 14 nt, Pseudomonas aeruginosa PA01
gccccgaggccagc

SEQ ID NO: 3504959 - RNA, 17 nt, Pseudomonas aeruginosa PA01
gccccgaggccagcagg

SEQ ID NO: 3504960 - RNA, 21 nt, Pseudomonas aeruginosa PA01
gccccgaggccagcaggccgu

SEQ ID NO: 3504961 - RNA, 17 nt, Pseudomonas aeruginosa PA01
gccccgaggggcggcuu

SEQ ID NO: 3504962 - RNA, 18 nt, Pseudomonas aeruginosa PA01
gccccgaucgccucggcc

SEQ ID NO: 3504963 - RNA, 19 nt, Pseudomonas aeruginosa PA01
gccccgaucgccucggcca

SEQ ID NO: 3504964 - RNA, 19 nt, Pseudomonas aeruginosa PA01
gccccgcaaggugcgggcc

SEQ ID NO: 3504965 - RNA, 15 nt, Pseudomonas aeruginosa PA01
gccccgcaccagcca

SEQ ID NO: 3504966 - RNA, 16 nt, Pseudomonas aeruginosa PA01
gccccgcaccagccag

SEQ ID NO: 3504967 - RNA, 14 nt, Pseudomonas aeruginosa PA01
gccccgcagccgcg

SEQ ID NO: 3504968 - RNA, 18 nt, Pseudomonas aeruginosa PA01
gccccgcauugcggggcg

SEQ ID NO: 3504969 - RNA, 23 nt, Pseudomonas aeruginosa PA01
gccccgcauugcggggcguucuu

SEQ ID NO: 3504970 - RNA, 16 nt, Pseudomonas aeruginosa PA01
gccccgccaaggcggg

SEQ ID NO: 3504971 - RNA, 12 nt, Pseudomonas aeruginosa PA01
gccccgccagga

SEQ ID NO: 3504972 - RNA, 14 nt, Pseudomonas aeruginosa PA01
gccccgccgacugg

SEQ ID NO: 3504973 - RNA, 18 nt, Pseudomonas aeruginosa PA01
gccccgccgaggaagccg

SEQ ID NO: 3504974 - RNA, 21 nt, Pseudomonas aeruginosa PA01
gccccgccgaggaagccgacc

SEQ ID NO: 3504975 - RNA, 12 nt, Pseudomonas aeruginosa PA01
gccccgccgcca

SEQ ID NO: 3504976 - RNA, 15 nt, Pseudomonas aeruginosa PA01
gccccgccgccaggc

SEQ ID NO: 3504977 - RNA, 14 nt, Pseudomonas aeruginosa PA01
gccccgccggcgcu

SEQ ID NO: 3504978 - RNA, 23 nt, Pseudomonas aeruginosa PA01
gccccgccgggagcggccgugca

SEQ ID NO: 3504979 - RNA, 18 nt, Pseudomonas aeruginosa PA01
gccccgccuaccggggcg

SEQ ID NO: 3504980 - RNA, 23 nt, Pseudomonas aeruginosa PA01
gccccgccuaccggggcgcgggc

SEQ ID NO: 3504981 - RNA, 23 nt, Pseudomonas aeruginosa PA01
gccccgcgauugcagcuccuggu

SEQ ID NO: 3504982 - RNA, 18 nt, Pseudomonas aeruginosa PA01
gccccgcgguacccggca

SEQ ID NO: 3504983 - RNA, 21 nt, Pseudomonas aeruginosa PA01
gccccgcgguacccggcaggg

SEQ ID NO: 3504984 - RNA, 22 nt, Pseudomonas aeruginosa PA01
gccccgcgguacccggcagggc

SEQ ID NO: 3504985 - RNA, 12 nt, Pseudomonas aeruginosa PA01
gccccgcuggcc

SEQ ID NO: 3504986 - RNA, 13 nt, Pseudomonas aeruginosa PA01
gccccgcuggccc

SEQ ID NO: 3504987 - RNA, 14 nt, Pseudomonas aeruginosa PA01
gccccgcuggccca

SEQ ID NO: 3504988 - RNA, 19 nt, Pseudomonas aeruginosa PA01
gccccgcuggcccaacagc

SEQ ID NO: 3504989 - RNA, 14 nt, Pseudomonas aeruginosa PA01
gccccgcuucggcg

SEQ ID NO: 3504990 - RNA, 16 nt, Pseudomonas aeruginosa PA01
gccccgcuucggcggg

SEQ ID NO: 3504991 - RNA, 20 nt, Pseudomonas aeruginosa PA01
gccccgcuugccgucgaccu

SEQ ID NO: 3504992 - RNA, 23 nt, Pseudomonas aeruginosa PA01
gccccgcuugccgucgaccugcg

SEQ ID NO: 3504993 - RNA, 15 nt, Pseudomonas aeruginosa PA01
gccccggcaagggcc

SEQ ID NO: 3504994 - RNA, 22 nt, Pseudomonas aeruginosa PA01
gccccggcaagggccugcucag

SEQ ID NO: 3504995 - RNA, 12 nt, Pseudomonas aeruginosa PA01
gccccggcagcc

SEQ ID NO: 3504996 - RNA, 15 nt, Pseudomonas aeruginosa PA01
gccccggcagccacc

SEQ ID NO: 3504997 - RNA, 18 nt, Pseudomonas aeruginosa PA01
gccccggcaggcaggccu

SEQ ID NO: 3504998 - RNA, 19 nt, Pseudomonas aeruginosa PA01
gccccggcaucgccggggc

SEQ ID NO: 3504999 - RNA, 21 nt, Pseudomonas aeruginosa PA01
gccccggccagguacuggcga

SEQ ID NO: 3505000 - RNA, 13 nt, Pseudomonas aeruginosa PA01
gccccggcccagc

SEQ ID NO: 3505001 - RNA, 16 nt, Pseudomonas aeruginosa PA01
gccccggcccagccgc

SEQ ID NO: 3505002 - RNA, 19 nt, Pseudomonas aeruginosa PA01
gccccggcccagccgcggc

SEQ ID NO: 3505003 - RNA, 12 nt, Pseudomonas aeruginosa PA01
gccccggcccgg

SEQ ID NO: 3505004 - RNA, 13 nt, Pseudomonas aeruginosa PA01
gccccggcccggc

SEQ ID NO: 3505005 - RNA, 12 nt, Pseudomonas aeruginosa PA01
gccccggccgcg

SEQ ID NO: 3505006 - RNA, 13 nt, Pseudomonas aeruginosa PA01
gccccggccgcgc

SEQ ID NO: 3505007 - RNA, 20 nt, Pseudomonas aeruginosa PA01
gccccggccgcgccagccac

SEQ ID NO: 3505008 - RNA, 12 nt, Pseudomonas aeruginosa PA01
gccccggccggc

SEQ ID NO: 3505009 - RNA, 13 nt, Pseudomonas aeruginosa PA01
gccccggccggca

SEQ ID NO: 3505010 - RNA, 22 nt, Pseudomonas aeruginosa PA01
gccccggccucaacgaccgccc

SEQ ID NO: 3505011 - RNA, 12 nt, Pseudomonas aeruginosa PA01
gccccggcgagc

SEQ ID NO: 3505012 - RNA, 17 nt, Pseudomonas aeruginosa PA01
gccccggcgauccgcgc

SEQ ID NO: 3505013 - RNA, 21 nt, Pseudomonas aeruginosa PA01
gccccggcgccgaccguggcg

SEQ ID NO: 3505014 - RNA, 13 nt, Pseudomonas aeruginosa PA01
gccccggcggcga

SEQ ID NO: 3505015 - RNA, 15 nt, Pseudomonas aeruginosa PA01
gccccggcggcgauc

SEQ ID NO: 3505016 - RNA, 16 nt, Pseudomonas aeruginosa PA01
gccccggcggcgaucu

SEQ ID NO: 3505017 - RNA, 17 nt, Pseudomonas aeruginosa PA01
gccccggcggcgaucuu

SEQ ID NO: 3505018 - RNA, 16 nt, Pseudomonas aeruginosa PA01
gccccggcgucggcgc

SEQ ID NO: 3505019 - RNA, 17 nt, Pseudomonas aeruginosa PA01
gccccggcgucggcgcg

SEQ ID NO: 3505020 - RNA, 21 nt, Pseudomonas aeruginosa PA01
gccccggcgucggcgcgggcg

SEQ ID NO: 3505021 - RNA, 17 nt, Pseudomonas aeruginosa PA01
gccccgggaccaucacc

SEQ ID NO: 3505022 - RNA, 16 nt, Pseudomonas aeruginosa PA01
gccccgggcgccgggu

SEQ ID NO: 3505023 - RNA, 17 nt, Pseudomonas aeruginosa PA01
gccccgggcgccggguc

SEQ ID NO: 3505024 - RNA, 16 nt, Pseudomonas aeruginosa PA01
gccccgggucgcugcu

SEQ ID NO: 3505025 - RNA, 23 nt, Pseudomonas aeruginosa PA01
gccccgggucgcugcucagggcc

SEQ ID NO: 3505026 - RNA, 16 nt, Pseudomonas aeruginosa PA01
gccccgggucggcacg

SEQ ID NO: 3505027 - RNA, 20 nt, Pseudomonas aeruginosa PA01
gccccgggucggcacggcca

SEQ ID NO: 3505028 - RNA, 14 nt, Pseudomonas aeruginosa PA01
gccccggucucgcg

SEQ ID NO: 3505029 - RNA, 17 nt, Pseudomonas aeruginosa PA01
gccccggucucgcgcag

SEQ ID NO: 3505030 - RNA, 19 nt, Pseudomonas aeruginosa PA01
gccccggucucgcgcagcg

SEQ ID NO: 3505031 - RNA, 21 nt, Pseudomonas aeruginosa PA01
gccccggucucgcgcagcggc

SEQ ID NO: 3505032 - RNA, 22 nt, Pseudomonas aeruginosa PA01
gccccggucucgcgcagcggcg

SEQ ID NO: 3505033 - RNA, 18 nt, Pseudomonas aeruginosa PA01
gccccgguuacucgccgg

SEQ ID NO: 3505034 - RNA, 18 nt, Pseudomonas aeruginosa PA01
gccccgguuggcgcccca

SEQ ID NO: 3505035 - RNA, 15 nt, Pseudomonas aeruginosa PA01
gccccgucccuacca

SEQ ID NO: 3505036 - RNA, 22 nt, Pseudomonas aeruginosa PA01
gccccgucccuaccagcgcaac

SEQ ID NO: 3505037 - RNA, 19 nt, Pseudomonas aeruginosa PA01
gccccgucuucacgacgaa

SEQ ID NO: 3505038 - RNA, 17 nt, Pseudomonas aeruginosa PA01
gccccgugcaccgaggc

SEQ ID NO: 3505039 - RNA, 15 nt, Pseudomonas aeruginosa PA01
gccccguggcgggcc

SEQ ID NO: 3505040 - RNA, 18 nt, Pseudomonas aeruginosa PA01
gccccguggcgggccagc

SEQ ID NO: 3505041 - RNA, 20 nt, Pseudomonas aeruginosa PA01
gccccguggcgggccagcag

SEQ ID NO: 3505042 - RNA, 21 nt, Pseudomonas aeruginosa PA01
gccccguggcgggccagcagg

SEQ ID NO: 3505043 - RNA, 22 nt, Pseudomonas aeruginosa PA01
gccccguggcgggccagcaggc

SEQ ID NO: 3505044 - RNA, 18 nt, Pseudomonas aeruginosa PA01
gccccguuaaugccggug

SEQ ID NO: 3505045 - RNA, 19 nt, Pseudomonas aeruginosa PA01
gccccguuaaugccggugg

SEQ ID NO: 3505046 - RNA, 16 nt, Pseudomonas aeruginosa PA01
gccccguuugccgucg

SEQ ID NO: 3505047 - RNA, 21 nt, Pseudomonas aeruginosa PA01
gccccguuugccgucggcgcg

SEQ ID NO: 3505048 - RNA, 21 nt, Pseudomonas aeruginosa PA01
gccccguuuuuccuuguggcg

SEQ ID NO: 3505049 - RNA, 21 nt, Pseudomonas aeruginosa PA01
gccccuagaccaacugcgccc

SEQ ID NO: 3505050 - RNA, 19 nt, Pseudomonas aeruginosa PA01
gccccucacaccaccagca

SEQ ID NO: 3505051 - RNA, 20 nt, Pseudomonas aeruginosa PA01
gccccucacaccaccagcau

SEQ ID NO: 3505052 - RNA, 15 nt, Pseudomonas aeruginosa PA01
gccccucacuccguc

SEQ ID NO: 3505053 - RNA, 21 nt, Pseudomonas aeruginosa PA01
gccccucacuccgucuccagc

SEQ ID NO: 3505054 - RNA, 13 nt, Pseudomonas aeruginosa PA01
gccccucagaagu

SEQ ID NO: 3505055 - RNA, 14 nt, Pseudomonas aeruginosa PA01
gccccuccaguucc

SEQ ID NO: 3505056 - RNA, 16 nt, Pseudomonas aeruginosa PA01
gccccuccaguuccug

SEQ ID NO: 3505057 - RNA, 14 nt, Pseudomonas aeruginosa PA01
gccccucccagcca

SEQ ID NO: 3505058 - RNA, 20 nt, Pseudomonas aeruginosa PA01
gccccuccuggaaagaccgg

SEQ ID NO: 3505059 - RNA, 19 nt, Pseudomonas aeruginosa PA01
gccccuccuucgagccugg

SEQ ID NO: 3505060 - RNA, 20 nt, Pseudomonas aeruginosa PA01
gccccuccuucgagccuggc

SEQ ID NO: 3505061 - RNA, 21 nt, Pseudomonas aeruginosa PA01
gccccuccuucgagccuggcc

SEQ ID NO: 3505062 - RNA, 23 nt, Pseudomonas aeruginosa PA01
gccccuccuucgagccuggccag

SEQ ID NO: 3505063 - RNA, 13 nt, Pseudomonas aeruginosa PA01
gccccucgccgug

SEQ ID NO: 3505064 - RNA, 14 nt, Pseudomonas aeruginosa PA01
gccccucgccguga

SEQ ID NO: 3505065 - RNA, 19 nt, Pseudomonas aeruginosa PA01
gccccucgcgcaucuggcu

SEQ ID NO: 3505066 - RNA, 13 nt, Pseudomonas aeruginosa PA01
gccccucggccag

SEQ ID NO: 3505067 - RNA, 18 nt, Pseudomonas aeruginosa PA01
gccccucguggcgcgauc

SEQ ID NO: 3505068 - RNA, 20 nt, Pseudomonas aeruginosa PA01
gccccucuuccacgcgccga

SEQ ID NO: 3505069 - RNA, 12 nt, Pseudomonas aeruginosa PA01
gccccugccgcg

SEQ ID NO: 3505070 - RNA, 13 nt, Pseudomonas aeruginosa PA01
gccccugccgcgg

SEQ ID NO: 3505071 - RNA, 20 nt, Pseudomonas aeruginosa PA01
gccccugccguauccgcggc

SEQ ID NO: 3505072 - RNA, 21 nt, Pseudomonas aeruginosa PA01
gccccugccguauccgcggca

SEQ ID NO: 3505073 - RNA, 17 nt, Pseudomonas aeruginosa PA01
gccccugcgcccaggga

SEQ ID NO: 3505074 - RNA, 21 nt, Pseudomonas aeruginosa PA01
gccccugcgcccagggacgcg

SEQ ID NO: 3505075 - RNA, 18 nt, Pseudomonas aeruginosa PA01
gccccugcggaccgcaga

SEQ ID NO: 3505076 - RNA, 20 nt, Pseudomonas aeruginosa PA01
gccccugcggaccgcagaac

SEQ ID NO: 3505077 - RNA, 19 nt, Pseudomonas aeruginosa PA01
gccccugcggcgccgguug

SEQ ID NO: 3505078 - RNA, 14 nt, Pseudomonas aeruginosa PA01
gccccugcuccucg

SEQ ID NO: 3505079 - RNA, 17 nt, Pseudomonas aeruginosa PA01
gccccugcuccucgccg

SEQ ID NO: 3505080 - RNA, 16 nt, Pseudomonas aeruginosa PA01
gccccuggcgcugggc

SEQ ID NO: 3505081 - RNA, 17 nt, Pseudomonas aeruginosa PA01
gccccuggcgcugggcc

SEQ ID NO: 3505082 - RNA, 14 nt, Pseudomonas aeruginosa PA01
gccccugggccggc

SEQ ID NO: 3505083 - RNA, 18 nt, Pseudomonas aeruginosa PA01
gccccuucagcuccagca

SEQ ID NO: 3505084 - RNA, 19 nt, Pseudomonas aeruginosa PA01
gccccuucagcuccagcag

SEQ ID NO: 3505085 - RNA, 22 nt, Pseudomonas aeruginosa PA01
gccccuugcgcuguuccgccgu

SEQ ID NO: 3505086 - RNA, 14 nt, Pseudomonas aeruginosa PA01
gccccuuggccagc

SEQ ID NO: 3505087 - RNA, 18 nt, Pseudomonas aeruginosa PA01
gccccuuggccagcacca

SEQ ID NO: 3505088 - RNA, 20 nt, Pseudomonas aeruginosa PA01
gccccuuuuuuuugccugcc

SEQ ID NO: 3505089 - RNA, 13 nt, Pseudomonas aeruginosa PA01
gcccgaacgccga

SEQ ID NO: 3505090 - RNA, 23 nt, Pseudomonas aeruginosa PA01
gcccgaauguuccaaggugcugc

SEQ ID NO: 3505091 - RNA, 19 nt, Pseudomonas aeruginosa PA01
gcccgaccccacgccggcc

SEQ ID NO: 3505092 - RNA, 20 nt, Pseudomonas aeruginosa PA01
gcccgaccccacgccggccg

SEQ ID NO: 3505093 - RNA, 22 nt, Pseudomonas aeruginosa PA01
gcccgaccccacgccggccggc

SEQ ID NO: 3505094 - RNA, 21 nt, Pseudomonas aeruginosa PA01
gcccgaccggguugaugccga

SEQ ID NO: 3505095 - RNA, 15 nt, Pseudomonas aeruginosa PA01
gcccgaccgguucca

SEQ ID NO: 3505096 - RNA, 21 nt, Pseudomonas aeruginosa PA01
gcccgacgaaguugcaggcca

SEQ ID NO: 3505097 - RNA, 16 nt, Pseudomonas aeruginosa PA01
gcccgacgccgcccgg

SEQ ID NO: 3505098 - RNA, 18 nt, Pseudomonas aeruginosa PA01
gcccgacgccgcccggca

SEQ ID NO: 3505099 - RNA, 15 nt, Pseudomonas aeruginosa PA01
gcccgacggcucgaa

SEQ ID NO: 3505100 - RNA, 23 nt, Pseudomonas aeruginosa PA01
gcccgacugcgaaaaagaacgcc

SEQ ID NO: 3505101 - RNA, 19 nt, Pseudomonas aeruginosa PA01
gcccgagaagccggggcag

SEQ ID NO: 3505102 - RNA, 16 nt, Pseudomonas aeruginosa PA01
gcccgagagggugguc

SEQ ID NO: 3505103 - RNA, 13 nt, Pseudomonas aeruginosa PA01
gcccgagcaggcu

SEQ ID NO: 3505104 - RNA, 14 nt, Pseudomonas aeruginosa PA01
gcccgagcaggcug

SEQ ID NO: 3505105 - RNA, 15 nt, Pseudomonas aeruginosa PA01
gcccgagccgcugca

SEQ ID NO: 3505106 - RNA, 15 nt, Pseudomonas aeruginosa PA01
gcccgagccggacga

SEQ ID NO: 3505107 - RNA, 15 nt, Pseudomonas aeruginosa PA01
gcccgagcgacugga

SEQ ID NO: 3505108 - RNA, 14 nt, Pseudomonas aeruginosa PA01
gcccgagcuuugcg

SEQ ID NO: 3505109 - RNA, 18 nt, Pseudomonas aeruginosa PA01
gcccgagcuuugcgcagc

SEQ ID NO: 3505110 - RNA, 20 nt, Pseudomonas aeruginosa PA01
gcccgaggcguuauccgccg

SEQ ID NO: 3505111 - RNA, 14 nt, Pseudomonas aeruginosa PA01
gcccgagggcgccg

SEQ ID NO: 3505112 - RNA, 15 nt, Pseudomonas aeruginosa PA01
gcccgaggugucgcc

SEQ ID NO: 3505113 - RNA, 17 nt, Pseudomonas aeruginosa PA01
gcccgaggugucgccgc

SEQ ID NO: 3505114 - RNA, 18 nt, Pseudomonas aeruginosa PA01
gcccgaggugucgccgcg

SEQ ID NO: 3505115 - RNA, 20 nt, Pseudomonas aeruginosa PA01
gcccgagucccuugcggcag

SEQ ID NO: 3505116 - RNA, 22 nt, Pseudomonas aeruginosa PA01
gcccgagucccuugcggcagac

SEQ ID NO: 3505117 - RNA, 16 nt, Pseudomonas aeruginosa PA01
gcccgagugccggcgc

SEQ ID NO: 3505118 - RNA, 17 nt, Pseudomonas aeruginosa PA01
gcccgagugccggcgcg

SEQ ID NO: 3505119 - RNA, 20 nt, Pseudomonas aeruginosa PA01
gcccgagugccggcgcgucg

SEQ ID NO: 3505120 - RNA, 14 nt, Pseudomonas aeruginosa PA01
gcccgaucgccucg

SEQ ID NO: 3505121 - RNA, 20 nt, Pseudomonas aeruginosa PA01
gcccgaucgccucgucgagc

SEQ ID NO: 3505122 - RNA, 19 nt, Pseudomonas aeruginosa PA01
gcccgaugaucgagcgcac

SEQ ID NO: 3505123 - RNA, 12 nt, Pseudomonas aeruginosa PA01
gcccgaugccgc

SEQ ID NO: 3505124 - RNA, 13 nt, Pseudomonas aeruginosa PA01
gcccgaugccgcg

SEQ ID NO: 3505125 - RNA, 23 nt, Pseudomonas aeruginosa PA01
gcccgcacagguagaggucgaaa

SEQ ID NO: 3505126 - RNA, 10 nt, Pseudomonas aeruginosa PA01
gcccgcacca

SEQ ID NO: 3505127 - RNA, 17 nt, Pseudomonas aeruginosa PA01
gcccgcagaucuucccc

SEQ ID NO: 3505128 - RNA, 20 nt, Pseudomonas aeruginosa PA01
gcccgcagaucuuccccguu

SEQ ID NO: 3505129 - RNA, 16 nt, Pseudomonas aeruginosa PA01
gcccgcagccacaggc

SEQ ID NO: 3505130 - RNA, 20 nt, Pseudomonas aeruginosa PA01
gcccgcagccacaggcgcca

SEQ ID NO: 3505131 - RNA, 21 nt, Pseudomonas aeruginosa PA01
gcccgcagccacaggcgccag

SEQ ID NO: 3505132 - RNA, 19 nt, Pseudomonas aeruginosa PA01
gcccgcaguuccucgccgc

SEQ ID NO: 3505133 - RNA, 13 nt, Pseudomonas aeruginosa PA01
gcccgccaaggcc

SEQ ID NO: 3505134 - RNA, 17 nt, Pseudomonas aeruginosa PA01
gcccgccaaggcccugc

SEQ ID NO: 3505135 - RNA, 21 nt, Pseudomonas aeruginosa PA01
gcccgccaaggcccugcugca

SEQ ID NO: 3505136 - RNA, 16 nt, Pseudomonas aeruginosa PA01
gcccgccaagggcgcc

SEQ ID NO: 3505137 - RNA, 20 nt, Pseudomonas aeruginosa PA01
gcccgccaagggcgccgccg

SEQ ID NO: 3505138 - RNA, 21 nt, Pseudomonas aeruginosa PA01
gcccgccaagggcgccgccga

SEQ ID NO: 3505139 - RNA, 23 nt, Pseudomonas aeruginosa PA01
gcccgccacagaucgccagcucg

SEQ ID NO: 3505140 - RNA, 13 nt, Pseudomonas aeruginosa PA01
gcccgccaccugg

SEQ ID NO: 3505141 - RNA, 15 nt, Pseudomonas aeruginosa PA01
gcccgccaccuggcg

SEQ ID NO: 3505142 - RNA, 19 nt, Pseudomonas aeruginosa PA01
gcccgccaccuggcgggcu

SEQ ID NO: 3505143 - RNA, 17 nt, Pseudomonas aeruginosa PA01
gcccgccacgcuugucg

SEQ ID NO: 3505144 - RNA, 16 nt, Pseudomonas aeruginosa PA01
gcccgccacggcgcgc

SEQ ID NO: 3505145 - RNA, 22 nt, Pseudomonas aeruginosa PA01
gcccgccacggcgcgcuccggc

SEQ ID NO: 3505146 - RNA, 13 nt, Pseudomonas aeruginosa PA01
gcccgccagcagg

SEQ ID NO: 3505147 - RNA, 14 nt, Pseudomonas aeruginosa PA01
gcccgccagcaggc

SEQ ID NO: 3505148 - RNA, 15 nt, Pseudomonas aeruginosa PA01
gcccgccagcaggcg

SEQ ID NO: 3505149 - RNA, 16 nt, Pseudomonas aeruginosa PA01
gcccgccagcaggcgc

SEQ ID NO: 3505150 - RNA, 17 nt, Pseudomonas aeruginosa PA01
gcccgccagcaggcgcc

SEQ ID NO: 3505151 - RNA, 22 nt, Pseudomonas aeruginosa PA01
gcccgccagcaggcgccggcgg

SEQ ID NO: 3505152 - RNA, 14 nt, Pseudomonas aeruginosa PA01
gcccgccaggucga

SEQ ID NO: 3505153 - RNA, 17 nt, Pseudomonas aeruginosa PA01
gcccgccauguuggccu

SEQ ID NO: 3505154 - RNA, 20 nt, Pseudomonas aeruginosa PA01
gcccgcccaguugcgggccu

SEQ ID NO: 3505155 - RNA, 12 nt, Pseudomonas aeruginosa PA01
gcccgccccgca

SEQ ID NO: 3505156 - RNA, 14 nt, Pseudomonas aeruginosa PA01
gcccgccccgcaag

SEQ ID NO: 3505157 - RNA, 19 nt, Pseudomonas aeruginosa PA01
gcccgccccgcaccagcca

SEQ ID NO: 3505158 - RNA, 21 nt, Pseudomonas aeruginosa PA01
gcccgccccgcaccagccagc

SEQ ID NO: 3505159 - RNA, 19 nt, Pseudomonas aeruginosa PA01
gcccgcccggaaccaccgg

SEQ ID NO: 3505160 - RNA, 23 nt, Pseudomonas aeruginosa PA01
gcccgcccggaaccaccggucaa

SEQ ID NO: 3505161 - RNA, 15 nt, Pseudomonas aeruginosa PA01
gcccgcccggcacca

SEQ ID NO: 3505162 - RNA, 15 nt, Pseudomonas aeruginosa PA01
gcccgcccucgucgc

SEQ ID NO: 3505163 - RNA, 15 nt, Pseudomonas aeruginosa PA01
gcccgccgaacagca

SEQ ID NO: 3505164 - RNA, 22 nt, Pseudomonas aeruginosa PA01
gcccgccgaacagcaacaccgc

SEQ ID NO: 3505165 - RNA, 16 nt, Pseudomonas aeruginosa PA01
gcccgccgccuggugc

SEQ ID NO: 3505166 - RNA, 13 nt, Pseudomonas aeruginosa PA01
gcccgccgcgagc

SEQ ID NO: 3505167 - RNA, 14 nt, Pseudomonas aeruginosa PA01
gcccgccgcgagcg

SEQ ID NO: 3505168 - RNA, 16 nt, Pseudomonas aeruginosa PA01
gcccgccgcgagcgcc

SEQ ID NO: 3505169 - RNA, 14 nt, Pseudomonas aeruginosa PA01
gcccgccgcggcga

SEQ ID NO: 3505170 - RNA, 12 nt, Pseudomonas aeruginosa PA01
gcccgccggcga

SEQ ID NO: 3505171 - RNA, 14 nt, Pseudomonas aeruginosa PA01
gcccgccggcgaug

SEQ ID NO: 3505172 - RNA, 17 nt, Pseudomonas aeruginosa PA01
gcccgccggcgaugcgc

SEQ ID NO: 3505173 - RNA, 22 nt, Pseudomonas aeruginosa PA01
gcccgccggcgaugcgcaggcc

SEQ ID NO: 3505174 - RNA, 15 nt, Pseudomonas aeruginosa PA01
gcccgccggcgcccu

SEQ ID NO: 3505175 - RNA, 14 nt, Pseudomonas aeruginosa PA01
gcccgccggcgcgc

SEQ ID NO: 3505176 - RNA, 15 nt, Pseudomonas aeruginosa PA01
gcccgccggcgcgcc

SEQ ID NO: 3505177 - RNA, 21 nt, Pseudomonas aeruginosa PA01
gcccgccggcgcgcccaggcc

SEQ ID NO: 3505178 - RNA, 23 nt, Pseudomonas aeruginosa PA01
gcccgccggcgcgcccaggccca

SEQ ID NO: 3505179 - RNA, 15 nt, Pseudomonas aeruginosa PA01
gcccgccggcgugcc

SEQ ID NO: 3505180 - RNA, 22 nt, Pseudomonas aeruginosa PA01
gcccgccggucaaccgcgggcg

SEQ ID NO: 3505181 - RNA, 20 nt, Pseudomonas aeruginosa PA01
gcccgccgucauggcgggcg

SEQ ID NO: 3505182 - RNA, 15 nt, Pseudomonas aeruginosa PA01
gcccgccguccucca

SEQ ID NO: 3505183 - RNA, 16 nt, Pseudomonas aeruginosa PA01
gcccgccguccuccag

SEQ ID NO: 3505184 - RNA, 18 nt, Pseudomonas aeruginosa PA01
gcccgccguccuccagca

SEQ ID NO: 3505185 - RNA, 20 nt, Pseudomonas aeruginosa PA01
gcccgccguccuccagcaag

SEQ ID NO: 3505186 - RNA, 14 nt, Pseudomonas aeruginosa PA01
gcccgccgucgccc

SEQ ID NO: 3505187 - RNA, 18 nt, Pseudomonas aeruginosa PA01
gcccgccgugcgcuccgc

SEQ ID NO: 3505188 - RNA, 14 nt, Pseudomonas aeruginosa PA01
gcccgccucaggcc

SEQ ID NO: 3505189 - RNA, 19 nt, Pseudomonas aeruginosa PA01
gcccgccucaggccgggau

SEQ ID NO: 3505190 - RNA, 13 nt, Pseudomonas aeruginosa PA01
gcccgccucgcgc

SEQ ID NO: 3505191 - RNA, 21 nt, Pseudomonas aeruginosa PA01
gcccgccucggaaucggcgau

SEQ ID NO: 3505192 - RNA, 15 nt, Pseudomonas aeruginosa PA01
gcccgccugauggcg

SEQ ID NO: 3505193 - RNA, 19 nt, Pseudomonas aeruginosa PA01
gcccgccuggaaggcgcug

SEQ ID NO: 3505194 - RNA, 17 nt, Pseudomonas aeruginosa PA01
gcccgccuuccagcuug

SEQ ID NO: 3505195 - RNA, 16 nt, Pseudomonas aeruginosa PA01
gcccgccuugauggcg

SEQ ID NO: 3505196 - RNA, 19 nt, Pseudomonas aeruginosa PA01
gcccgccuugauggcgggc

SEQ ID NO: 3505197 - RNA, 20 nt, Pseudomonas aeruginosa PA01
gcccgccuuguucgccagca

SEQ ID NO: 3505198 - RNA, 23 nt, Pseudomonas aeruginosa PA01
gcccgccuuguucgccagcaccu

SEQ ID NO: 3505199 - RNA, 16 nt, Pseudomonas aeruginosa PA01
gcccgcgagccgcgca

SEQ ID NO: 3505200 - RNA, 20 nt, Pseudomonas aeruginosa PA01
gcccgcgagccgcgcagcag

SEQ ID NO: 3505201 - RNA, 15 nt, Pseudomonas aeruginosa PA01
gcccgcgagccgucc

SEQ ID NO: 3505202 - RNA, 23 nt, Pseudomonas aeruginosa PA01
gcccgcgagccguccugcggccg

SEQ ID NO: 3505203 - RNA, 13 nt, Pseudomonas aeruginosa PA01
gcccgcgcaugga

SEQ ID NO: 3505204 - RNA, 11 nt, Pseudomonas aeruginosa PA01
gcccgcgccgc

SEQ ID NO: 3505205 - RNA, 14 nt, Pseudomonas aeruginosa PA01
gcccgcgccgccuc

SEQ ID NO: 3505206 - RNA, 15 nt, Pseudomonas aeruginosa PA01
gcccgcgccgccucg

SEQ ID NO: 3505207 - RNA, 23 nt, Pseudomonas aeruginosa PA01
gcccgcgccgccucgauggcggc

SEQ ID NO: 3505208 - RNA, 18 nt, Pseudomonas aeruginosa PA01
gcccgcgccuccaggcgc

SEQ ID NO: 3505209 - RNA, 20 nt, Pseudomonas aeruginosa PA01
gcccgcgccuccaggcgcgc

SEQ ID NO: 3505210 - RNA, 22 nt, Pseudomonas aeruginosa PA01
gcccgcgccuccaggcgcgccu

SEQ ID NO: 3505211 - RNA, 19 nt, Pseudomonas aeruginosa PA01
gcccgcgccugggccgcga

SEQ ID NO: 3505212 - RNA, 19 nt, Pseudomonas aeruginosa PA01
gcccgcgcgacagcucugg

SEQ ID NO: 3505213 - RNA, 20 nt, Pseudomonas aeruginosa PA01
gcccgcgcggcaacgucagg

SEQ ID NO: 3505214 - RNA, 12 nt, Pseudomonas aeruginosa PA01
gcccgcgcucgg

SEQ ID NO: 3505215 - RNA, 13 nt, Pseudomonas aeruginosa PA01
gcccgcgcucggc

SEQ ID NO: 3505216 - RNA, 20 nt, Pseudomonas aeruginosa PA01
gcccgcgcucggccgccugg

SEQ ID NO: 3505217 - RNA, 13 nt, Pseudomonas aeruginosa PA01
gcccgcggaucgc

SEQ ID NO: 3505218 - RNA, 15 nt, Pseudomonas aeruginosa PA01
gcccgcggaucgcgc

SEQ ID NO: 3505219 - RNA, 16 nt, Pseudomonas aeruginosa PA01
gcccgcggaucgcgcc

SEQ ID NO: 3505220 - RNA, 17 nt, Pseudomonas aeruginosa PA01
gcccgcggaucgcgccg

SEQ ID NO: 3505221 - RNA, 21 nt, Pseudomonas aeruginosa PA01
gcccgcggaucgcgccgucgc

SEQ ID NO: 3505222 - RNA, 13 nt, Pseudomonas aeruginosa PA01
gcccgcggcagca

SEQ ID NO: 3505223 - RNA, 14 nt, Pseudomonas aeruginosa PA01
gcccgcggcagcag

SEQ ID NO: 3505224 - RNA, 15 nt, Pseudomonas aeruginosa PA01
gcccgcggcagcagc

SEQ ID NO: 3505225 - RNA, 17 nt, Pseudomonas aeruginosa PA01
gcccgcggcagcagcca

SEQ ID NO: 3505226 - RNA, 23 nt, Pseudomonas aeruginosa PA01
gcccgcggcguuauccgcccuac

SEQ ID NO: 3505227 - RNA, 13 nt, Pseudomonas aeruginosa PA01
gcccgcgggcagc

SEQ ID NO: 3505228 - RNA, 16 nt, Pseudomonas aeruginosa PA01
gcccgcgggcagcucg

SEQ ID NO: 3505229 - RNA, 21 nt, Pseudomonas aeruginosa PA01
gcccgcgguauucuccagcag

SEQ ID NO: 3505230 - RNA, 22 nt, Pseudomonas aeruginosa PA01
gcccgcgguauucuccagcagg

SEQ ID NO: 3505231 - RNA, 23 nt, Pseudomonas aeruginosa PA01
gcccgcgguauucuccagcaggc

SEQ ID NO: 3505232 - RNA, 19 nt, Pseudomonas aeruginosa PA01
gcccgcggucacucggccu

SEQ ID NO: 3505233 - RNA, 20 nt, Pseudomonas aeruginosa PA01
gcccgcggucacucggccuc

SEQ ID NO: 3505234 - RNA, 14 nt, Pseudomonas aeruginosa PA01
gcccgcguccuccu

SEQ ID NO: 3505235 - RNA, 16 nt, Pseudomonas aeruginosa PA01
gcccgcguccuccugg

SEQ ID NO: 3505236 - RNA, 13 nt, Pseudomonas aeruginosa PA01
gcccgcgucgcgc

SEQ ID NO: 3505237 - RNA, 17 nt, Pseudomonas aeruginosa PA01
gcccgcucaagggcugg

SEQ ID NO: 3505238 - RNA, 20 nt, Pseudomonas aeruginosa PA01
gcccgcucaagggcuggcag

SEQ ID NO: 3505239 - RNA, 21 nt, Pseudomonas aeruginosa PA01
gcccgcucaagggcuggcagg

SEQ ID NO: 3505240 - RNA, 24 nt, Pseudomonas aeruginosa PA01
gcccgcucaugagauccgccagca

SEQ ID NO: 3505241 - RNA, 13 nt, Pseudomonas aeruginosa PA01
gcccgcuccgcau

SEQ ID NO: 3505242 - RNA, 16 nt, Pseudomonas aeruginosa PA01
gcccgcucgacccggu

SEQ ID NO: 3505243 - RNA, 22 nt, Pseudomonas aeruginosa PA01
gcccgcucuugauacccaccgg

SEQ ID NO: 3505244 - RNA, 12 nt, Pseudomonas aeruginosa PA01
gcccgcugaccg

SEQ ID NO: 3505245 - RNA, 16 nt, Pseudomonas aeruginosa PA01
gcccgcugaccgggcg

SEQ ID NO: 3505246 - RNA, 21 nt, Pseudomonas aeruginosa PA01
gcccgcugaccgggcggaucg

SEQ ID NO: 3505247 - RNA, 23 nt, Pseudomonas aeruginosa PA01
gcccgcugaccgggcggaucgcc

SEQ ID NO: 3505248 - RNA, 24 nt, Pseudomonas aeruginosa PA01
gcccgcugauugcgggccuuggcg

SEQ ID NO: 3505249 - RNA, 22 nt, Pseudomonas aeruginosa PA01
gcccgcugcaugugccaggccu

SEQ ID NO: 3505250 - RNA, 13 nt, Pseudomonas aeruginosa PA01
gcccgcugcgcug

SEQ ID NO: 3505251 - RNA, 15 nt, Pseudomonas aeruginosa PA01
gcccgcugcgcugcc

SEQ ID NO: 3505252 - RNA, 21 nt, Pseudomonas aeruginosa PA01
gcccgcugcgcugccagcgcc

SEQ ID NO: 3505253 - RNA, 14 nt, Pseudomonas aeruginosa PA01
gcccgcugggcagg

SEQ ID NO: 3505254 - RNA, 20 nt, Pseudomonas aeruginosa PA01
gcccgcugggcagguggugg

SEQ ID NO: 3505255 - RNA, 16 nt, Pseudomonas aeruginosa PA01
gcccgcugugcgggga

SEQ ID NO: 3505256 - RNA, 18 nt, Pseudomonas aeruginosa PA01
gcccgcuucgagcgggcu

SEQ ID NO: 3505257 - RNA, 15 nt, Pseudomonas aeruginosa PA01
gcccgcuugcgccgc

SEQ ID NO: 3505258 - RNA, 17 nt, Pseudomonas aeruginosa PA01
gcccgcuugcgccgccu

SEQ ID NO: 3505259 - RNA, 23 nt, Pseudomonas aeruginosa PA01
gcccgcuugcgccgccucgcgca

SEQ ID NO: 3505260 - RNA, 20 nt, Pseudomonas aeruginosa PA01
gcccgcuuuccccggcggca

SEQ ID NO: 3505261 - RNA, 16 nt, Pseudomonas aeruginosa PA01
gcccggaaccaccggu

SEQ ID NO: 3505262 - RNA, 18 nt, Pseudomonas aeruginosa PA01
gcccggagaccgugccgc

SEQ ID NO: 3505263 - RNA, 21 nt, Pseudomonas aeruginosa PA01
gcccggagaccgugccgccgg

SEQ ID NO: 3505264 - RNA, 22 nt, Pseudomonas aeruginosa PA01
gcccggagaccgugccgccggg

SEQ ID NO: 3505265 - RNA, 17 nt, Pseudomonas aeruginosa PA01
gcccggagaucgccgcg

SEQ ID NO: 3505266 - RNA, 20 nt, Pseudomonas aeruginosa PA01
gcccggagaucgccgcgccg

SEQ ID NO: 3505267 - RNA, 13 nt, Pseudomonas aeruginosa PA01
gcccggagcgcga

SEQ ID NO: 3505268 - RNA, 16 nt, Pseudomonas aeruginosa PA01
gcccggagcggcugcc

SEQ ID NO: 3505269 - RNA, 19 nt, Pseudomonas aeruginosa PA01
gcccggagcggcugccgag

SEQ ID NO: 3505270 - RNA, 18 nt, Pseudomonas aeruginosa PA01
gcccggagcuuugcaggg

SEQ ID NO: 3505271 - RNA, 21 nt, Pseudomonas aeruginosa PA01
gcccggagcuuugcagggcga

SEQ ID NO: 3505272 - RNA, 22 nt, Pseudomonas aeruginosa PA01
gcccggagcuuugcagggcgau

SEQ ID NO: 3505273 - RNA, 21 nt, Pseudomonas aeruginosa PA01
gcccggagugugucggggccg

SEQ ID NO: 3505274 - RNA, 20 nt, Pseudomonas aeruginosa PA01
gcccggauagacgccgucca

SEQ ID NO: 3505275 - RNA, 22 nt, Pseudomonas aeruginosa PA01
gcccggauagacgccguccacc

SEQ ID NO: 3505276 - RNA, 18 nt, Pseudomonas aeruginosa PA01
gcccggauuuugggcagc

SEQ ID NO: 3505277 - RNA, 18 nt, Pseudomonas aeruginosa PA01
gcccggcaauagccgggc

SEQ ID NO: 3505278 - RNA, 19 nt, Pseudomonas aeruginosa PA01
gcccggcaauagccgggcu

SEQ ID NO: 3505279 - RNA, 15 nt, Pseudomonas aeruginosa PA01
gcccggcaaucaggc

SEQ ID NO: 3505280 - RNA, 17 nt, Pseudomonas aeruginosa PA01
gcccggcaaucaggcgc

SEQ ID NO: 3505281 - RNA, 14 nt, Pseudomonas aeruginosa PA01
gcccggcaccaccg

SEQ ID NO: 3505282 - RNA, 19 nt, Pseudomonas aeruginosa PA01
gcccggcaccaccggucaa

SEQ ID NO: 3505283 - RNA, 17 nt, Pseudomonas aeruginosa PA01
gcccggcaccaggccga

SEQ ID NO: 3505284 - RNA, 14 nt, Pseudomonas aeruginosa PA01
gcccggcaccgggg

SEQ ID NO: 3505285 - RNA, 17 nt, Pseudomonas aeruginosa PA01
gcccggcacgcuccagg

SEQ ID NO: 3505286 - RNA, 16 nt, Pseudomonas aeruginosa PA01
gcccggcacucgccgg

SEQ ID NO: 3505287 - RNA, 18 nt, Pseudomonas aeruginosa PA01
gcccggcacucgccgggc

SEQ ID NO: 3505288 - RNA, 16 nt, Pseudomonas aeruginosa PA01
gcccggcagaucuccc

SEQ ID NO: 3505289 - RNA, 18 nt, Pseudomonas aeruginosa PA01
gcccggcagaucucccug

SEQ ID NO: 3505290 - RNA, 17 nt, Pseudomonas aeruginosa PA01
gcccggcagaugccggg

SEQ ID NO: 3505291 - RNA, 19 nt, Pseudomonas aeruginosa PA01
gcccggcagcaggccgccg

SEQ ID NO: 3505292 - RNA, 17 nt, Pseudomonas aeruginosa PA01
gcccggcagcgccgggc

SEQ ID NO: 3505293 - RNA, 14 nt, Pseudomonas aeruginosa PA01
gcccggcagcggcu

SEQ ID NO: 3505294 - RNA, 17 nt, Pseudomonas aeruginosa PA01
gcccggcagcggcuggc

SEQ ID NO: 3505295 - RNA, 21 nt, Pseudomonas aeruginosa PA01
gcccggcaggcagugccgggc

SEQ ID NO: 3505296 - RNA, 22 nt, Pseudomonas aeruginosa PA01
gcccggcaggcagugccgggcg

SEQ ID NO: 3505297 - RNA, 15 nt, Pseudomonas aeruginosa PA01
gcccggcaggcgcac

SEQ ID NO: 3505298 - RNA, 17 nt, Pseudomonas aeruginosa PA01
gcccggcaggcgcacgc

SEQ ID NO: 3505299 - RNA, 20 nt, Pseudomonas aeruginosa PA01
gcccggcaggucgaggacga

SEQ ID NO: 3505300 - RNA, 19 nt, Pseudomonas aeruginosa PA01
gcccggcauaggcgccagc

SEQ ID NO: 3505301 - RNA, 20 nt, Pseudomonas aeruginosa PA01
gcccggcauaggcgccagcc

SEQ ID NO: 3505302 - RNA, 20 nt, Pseudomonas aeruginosa PA01
gcccggcaucgugccgcgga

SEQ ID NO: 3505303 - RNA, 16 nt, Pseudomonas aeruginosa PA01
gcccggcauucgccgg

SEQ ID NO: 3505304 - RNA, 17 nt, Pseudomonas aeruginosa PA01
gcccggcauucgccggg

SEQ ID NO: 3505305 - RNA, 18 nt, Pseudomonas aeruginosa PA01
gcccggcauucgccgggc

SEQ ID NO: 3505306 - RNA, 13 nt, Pseudomonas aeruginosa PA01
gcccggccaggcc

SEQ ID NO: 3505307 - RNA, 14 nt, Pseudomonas aeruginosa PA01
gcccggccaggcca

SEQ ID NO: 3505308 - RNA, 14 nt, Pseudomonas aeruginosa PA01
gcccggccaggccg

SEQ ID NO: 3505309 - RNA, 15 nt, Pseudomonas aeruginosa PA01
gcccggccaggccgc

SEQ ID NO: 3505310 - RNA, 16 nt, Pseudomonas aeruginosa PA01
gcccggccaggccgcc

SEQ ID NO: 3505311 - RNA, 18 nt, Pseudomonas aeruginosa PA01
gcccggccaggccgccca

SEQ ID NO: 3505312 - RNA, 15 nt, Pseudomonas aeruginosa PA01
gcccggccaggcgau

SEQ ID NO: 3505313 - RNA, 14 nt, Pseudomonas aeruginosa PA01
gcccggccaggcgc

SEQ ID NO: 3505314 - RNA, 12 nt, Pseudomonas aeruginosa PA01
gcccggccaucc

SEQ ID NO: 3505315 - RNA, 17 nt, Pseudomonas aeruginosa PA01
gcccggccauccuggcc

SEQ ID NO: 3505316 - RNA, 19 nt, Pseudomonas aeruginosa PA01
gcccggccauccuggccgg

SEQ ID NO: 3505317 - RNA, 22 nt, Pseudomonas aeruginosa PA01
gcccggccauccuggccggucg

SEQ ID NO: 3505318 - RNA, 15 nt, Pseudomonas aeruginosa PA01
gcccggccaugccgc

SEQ ID NO: 3505319 - RNA, 16 nt, Pseudomonas aeruginosa PA01
gcccggccaugccgcc

SEQ ID NO: 3505320 - RNA, 14 nt, Pseudomonas aeruginosa PA01
gcccggccgcaggc

SEQ ID NO: 3505321 - RNA, 12 nt, Pseudomonas aeruginosa PA01
gcccggccgccu

SEQ ID NO: 3505322 - RNA, 15 nt, Pseudomonas aeruginosa PA01
gcccggccgccugcc

SEQ ID NO: 3505323 - RNA, 16 nt, Pseudomonas aeruginosa PA01
gcccggccgccugccu

SEQ ID NO: 3505324 - RNA, 18 nt, Pseudomonas aeruginosa PA01
gcccggccgccugccuuc

SEQ ID NO: 3505325 - RNA, 14 nt, Pseudomonas aeruginosa PA01
gcccggccgcugcc

SEQ ID NO: 3505326 - RNA, 16 nt, Pseudomonas aeruginosa PA01
gcccggccgcugccgg

SEQ ID NO: 3505327 - RNA, 16 nt, Pseudomonas aeruginosa PA01
gcccggccgcuggaug

SEQ ID NO: 3505328 - RNA, 17 nt, Pseudomonas aeruginosa PA01
gcccggccgcuggaugc

SEQ ID NO: 3505329 - RNA, 20 nt, Pseudomonas aeruginosa PA01
gcccggccgcuggaugccga

SEQ ID NO: 3505330 - RNA, 17 nt, Pseudomonas aeruginosa PA01
gcccggccggauuggcc

SEQ ID NO: 3505331 - RNA, 21 nt, Pseudomonas aeruginosa PA01
gcccggccggauuggccgagg

SEQ ID NO: 3505332 - RNA, 16 nt, Pseudomonas aeruginosa PA01
gcccggccuccccggc

SEQ ID NO: 3505333 - RNA, 19 nt, Pseudomonas aeruginosa PA01
gcccggccuccccggcccg

SEQ ID NO: 3505334 - RNA, 15 nt, Pseudomonas aeruginosa PA01
gcccggccucgccgg

SEQ ID NO: 3505335 - RNA, 12 nt, Pseudomonas aeruginosa PA01
gcccggccuggc

SEQ ID NO: 3505336 - RNA, 14 nt, Pseudomonas aeruginosa PA01
gcccggccuggcgu

SEQ ID NO: 3505337 - RNA, 17 nt, Pseudomonas aeruginosa PA01
gcccggccuggcguccc

SEQ ID NO: 3505338 - RNA, 14 nt, Pseudomonas aeruginosa PA01
gcccggccugguag

SEQ ID NO: 3505339 - RNA, 14 nt, Pseudomonas aeruginosa PA01
gcccggccuggugc

SEQ ID NO: 3505340 - RNA, 16 nt, Pseudomonas aeruginosa PA01
gcccggcgaacagcgc

SEQ ID NO: 3505341 - RNA, 19 nt, Pseudomonas aeruginosa PA01
gcccggcgaaugccgggcu

SEQ ID NO: 3505342 - RNA, 22 nt, Pseudomonas aeruginosa PA01
gcccggcgagagcguccggcag

SEQ ID NO: 3505343 - RNA, 23 nt, Pseudomonas aeruginosa PA01
gcccggcgagagcguccggcagg

SEQ ID NO: 3505344 - RNA, 12 nt, Pseudomonas aeruginosa PA01
gcccggcgaggu

SEQ ID NO: 3505345 - RNA, 15 nt, Pseudomonas aeruginosa PA01
gcccggcgaggucgg

SEQ ID NO: 3505346 - RNA, 18 nt, Pseudomonas aeruginosa PA01
gcccggcgaggucggggu

SEQ ID NO: 3505347 - RNA, 14 nt, Pseudomonas aeruginosa PA01
gcccggcgccaccg

SEQ ID NO: 3505348 - RNA, 15 nt, Pseudomonas aeruginosa PA01
gcccggcgccaccgc

SEQ ID NO: 3505349 - RNA, 13 nt, Pseudomonas aeruginosa PA01
gcccggcgccagu

SEQ ID NO: 3505350 - RNA, 23 nt, Pseudomonas aeruginosa PA01
gcccggcgccaguucgccgguga

SEQ ID NO: 3505351 - RNA, 13 nt, Pseudomonas aeruginosa PA01
gcccggcgcgacc

SEQ ID NO: 3505352 - RNA, 14 nt, Pseudomonas aeruginosa PA01
gcccggcgcgaccg

SEQ ID NO: 3505353 - RNA, 19 nt, Pseudomonas aeruginosa PA01
gcccggcgcgacgcuccag

SEQ ID NO: 3505354 - RNA, 13 nt, Pseudomonas aeruginosa PA01
gcccggcgcggcg

SEQ ID NO: 3505355 - RNA, 14 nt, Pseudomonas aeruginosa PA01
gcccggcgcggcgg

SEQ ID NO: 3505356 - RNA, 15 nt, Pseudomonas aeruginosa PA01
gcccggcgcggcggc

SEQ ID NO: 3505357 - RNA, 18 nt, Pseudomonas aeruginosa PA01
gcccggcgcggcggccgc

SEQ ID NO: 3505358 - RNA, 20 nt, Pseudomonas aeruginosa PA01
gcccggcgcggcggccgccu

SEQ ID NO: 3505359 - RNA, 19 nt, Pseudomonas aeruginosa PA01
gcccggcgcuccaacagca

SEQ ID NO: 3505360 - RNA, 13 nt, Pseudomonas aeruginosa PA01
gcccggcgcugcu

SEQ ID NO: 3505361 - RNA, 14 nt, Pseudomonas aeruginosa PA01
gccagcaggccgag

SEQ ID NO: 3505362 - RNA, 16 nt, Pseudomonas aeruginosa PA01
gccagcaggccgagcc

SEQ ID NO: 3505363 - RNA, 20 nt, Pseudomonas aeruginosa PA01
gccagcaggccgaucagcgg

SEQ ID NO: 3505364 - RNA, 21 nt, Pseudomonas aeruginosa PA01
gccagcaggcgauacaccgca

SEQ ID NO: 3505365 - RNA, 12 nt, Pseudomonas aeruginosa PA01
gccagcaggcgc

SEQ ID NO: 3505366 - RNA, 15 nt, Pseudomonas aeruginosa PA01
gccagcaggcgcagc

SEQ ID NO: 3505367 - RNA, 16 nt, Pseudomonas aeruginosa PA01
gccagcaggcgcagca

SEQ ID NO: 3505368 - RNA, 18 nt, Pseudomonas aeruginosa PA01
gccagcaggcgcagcagc

SEQ ID NO: 3505369 - RNA, 19 nt, Pseudomonas aeruginosa PA01
gccagcaggcgcaggucgg

SEQ ID NO: 3505370 - RNA, 13 nt, Pseudomonas aeruginosa PA01
gccagcaggcgcc

SEQ ID NO: 3505371 - RNA, 16 nt, Pseudomonas aeruginosa PA01
gccagcaggcgccgcg

SEQ ID NO: 3505372 - RNA, 18 nt, Pseudomonas aeruginosa PA01
gccagcaggcgccgcgca

SEQ ID NO: 3505373 - RNA, 15 nt, Pseudomonas aeruginosa PA01
gccagcaggcgccgg

SEQ ID NO: 3505374 - RNA, 17 nt, Pseudomonas aeruginosa PA01
gccagcaggcgcgggcu

SEQ ID NO: 3505375 - RNA, 22 nt, Pseudomonas aeruginosa PA01
gccagcaggcgcgggcuggcca

SEQ ID NO: 3505376 - RNA, 13 nt, Pseudomonas aeruginosa PA01
gccagcaggcgcu

SEQ ID NO: 3505377 - RNA, 19 nt, Pseudomonas aeruginosa PA01
gccagcaggcgcucggcga

SEQ ID NO: 3505378 - RNA, 16 nt, Pseudomonas aeruginosa PA01
gccagcaggcguugca

SEQ ID NO: 3505379 - RNA, 21 nt, Pseudomonas aeruginosa PA01
gccagcaggcucaugcccagc

SEQ ID NO: 3505380 - RNA, 22 nt, Pseudomonas aeruginosa PA01
gccagcaggcucaugcccagcu

SEQ ID NO: 3505381 - RNA, 13 nt, Pseudomonas aeruginosa PA01
gccagcaggcugg

SEQ ID NO: 3505382 - RNA, 15 nt, Pseudomonas aeruginosa PA01
gccagcaggcuggcg

SEQ ID NO: 3505383 - RNA, 18 nt, Pseudomonas aeruginosa PA01
gccagcaggcuggcggca

SEQ ID NO: 3505384 - RNA, 19 nt, Pseudomonas aeruginosa PA01
gccagcagggccgccgagg

SEQ ID NO: 3505385 - RNA, 13 nt, Pseudomonas aeruginosa PA01
gccagcagggugg

SEQ ID NO: 3505386 - RNA, 22 nt, Pseudomonas aeruginosa PA01
gccagcaggguggccagggucc

SEQ ID NO: 3505387 - RNA, 19 nt, Pseudomonas aeruginosa PA01
gccagcagguacagcagcu

SEQ ID NO: 3505388 - RNA, 13 nt, Pseudomonas aeruginosa PA01
gccagcagguagc

SEQ ID NO: 3505389 - RNA, 14 nt, Pseudomonas aeruginosa PA01
gccagcagguagcc

SEQ ID NO: 3505390 - RNA, 17 nt, Pseudomonas aeruginosa PA01
gccagcagguagccugc

SEQ ID NO: 3505391 - RNA, 22 nt, Pseudomonas aeruginosa PA01
gccagcagguagccugcggcca

SEQ ID NO: 3505392 - RNA, 14 nt, Pseudomonas aeruginosa PA01
gccagcaggucgcg

SEQ ID NO: 3505393 - RNA, 16 nt, Pseudomonas aeruginosa PA01
gccagcaggucgcgcu

SEQ ID NO: 3505394 - RNA, 21 nt, Pseudomonas aeruginosa PA01
gccagcaggucgcgcugggcg

SEQ ID NO: 3505395 - RNA, 22 nt, Pseudomonas aeruginosa PA01
gccagcagucguugacggugcu

SEQ ID NO: 3505396 - RNA, 19 nt, Pseudomonas aeruginosa PA01
gccagcaguugcaacagcg

SEQ ID NO: 3505397 - RNA, 19 nt, Pseudomonas aeruginosa PA01
gccagcaucgcaucggcga

SEQ ID NO: 3505398 - RNA, 21 nt, Pseudomonas aeruginosa PA01
gccagcaucgcaucggcgacc

SEQ ID NO: 3505399 - RNA, 16 nt, Pseudomonas aeruginosa PA01
gccagccacucccggc

SEQ ID NO: 3505400 - RNA, 13 nt, Pseudomonas aeruginosa PA01
gccagccagagcc

SEQ ID NO: 3505401 - RNA, 14 nt, Pseudomonas aeruginosa PA01
gccagccagagcca

SEQ ID NO: 3505402 - RNA, 16 nt, Pseudomonas aeruginosa PA01
gccagccagcccggcg

SEQ ID NO: 3505403 - RNA, 14 nt, Pseudomonas aeruginosa PA01
gccagccagcgcgg

SEQ ID NO: 3505404 - RNA, 18 nt, Pseudomonas aeruginosa PA01
gccagccagcgcggcucg

SEQ ID NO: 3505405 - RNA, 21 nt, Pseudomonas aeruginosa PA01
gccagccagcgcggcucgggc

SEQ ID NO: 3505406 - RNA, 12 nt, Pseudomonas aeruginosa PA01
gccagccaggac

SEQ ID NO: 3505407 - RNA, 21 nt, Pseudomonas aeruginosa PA01
gccagccagggcagcaggucg

SEQ ID NO: 3505408 - RNA, 14 nt, Pseudomonas aeruginosa PA01
gccagccaggguac

SEQ ID NO: 3505409 - RNA, 14 nt, Pseudomonas aeruginosa PA01
gccagccaggucgg

SEQ ID NO: 3505410 - RNA, 22 nt, Pseudomonas aeruginosa PA01
gccagccaugugcuccuugacc

SEQ ID NO: 3505411 - RNA, 14 nt, Pseudomonas aeruginosa PA01
gccagcccagaaca

SEQ ID NO: 3505412 - RNA, 16 nt, Pseudomonas aeruginosa PA01
gccagcccagaacagc

SEQ ID NO: 3505413 - RNA, 19 nt, Pseudomonas aeruginosa PA01
gccagcccagcggcgcggc

SEQ ID NO: 3505414 - RNA, 21 nt, Pseudomonas aeruginosa PA01
gccagcccagcggcgcggcgu

SEQ ID NO: 3505415 - RNA, 14 nt, Pseudomonas aeruginosa PA01
gccagcccagugcu

SEQ ID NO: 3505416 - RNA, 13 nt, Pseudomonas aeruginosa PA01
gccagccccaggc

SEQ ID NO: 3505417 - RNA, 14 nt, Pseudomonas aeruginosa PA01
gccagccccaggcg

SEQ ID NO: 3505418 - RNA, 16 nt, Pseudomonas aeruginosa PA01
gccagcccccucgccc

SEQ ID NO: 3505419 - RNA, 20 nt, Pseudomonas aeruginosa PA01
gccagcccccucgcccucga

SEQ ID NO: 3505420 - RNA, 22 nt, Pseudomonas aeruginosa PA01
gccagccccugcggaccgcaga

SEQ ID NO: 3505421 - RNA, 15 nt, Pseudomonas aeruginosa PA01
gccagcccgcaaucc

SEQ ID NO: 3505422 - RNA, 12 nt, Pseudomonas aeruginosa PA01
gccagcccgcca

SEQ ID NO: 3505423 - RNA, 14 nt, Pseudomonas aeruginosa PA01
gccagcccggagcc

SEQ ID NO: 3505424 - RNA, 22 nt, Pseudomonas aeruginosa PA01
gccagcccggcaggucgaggac

SEQ ID NO: 3505425 - RNA, 14 nt, Pseudomonas aeruginosa PA01
gccagcccggccuc

SEQ ID NO: 3505426 - RNA, 18 nt, Pseudomonas aeruginosa PA01
gccagcccggccucgccg

SEQ ID NO: 3505427 - RNA, 12 nt, Pseudomonas aeruginosa PA01
gccagcccggcg

SEQ ID NO: 3505428 - RNA, 14 nt, Pseudomonas aeruginosa PA01
gccagcccggcggu

SEQ ID NO: 3505429 - RNA, 17 nt, Pseudomonas aeruginosa PA01
gccagcccgguucagcg

SEQ ID NO: 3505430 - RNA, 17 nt, Pseudomonas aeruginosa PA01
gccagcccucgcccagg

SEQ ID NO: 3505431 - RNA, 18 nt, Pseudomonas aeruginosa PA01
gccagcccucgcccaggu

SEQ ID NO: 3505432 - RNA, 22 nt, Pseudomonas aeruginosa PA01
gccagcccucgcccaggugcgc

SEQ ID NO: 3505433 - RNA, 23 nt, Pseudomonas aeruginosa PA01
gccagcccucggggaaggucacc

SEQ ID NO: 3505434 - RNA, 11 nt, Pseudomonas aeruginosa PA01
gccagcccugg

SEQ ID NO: 3505435 - RNA, 18 nt, Pseudomonas aeruginosa PA01
gccagcccuuucagcggc

SEQ ID NO: 3505436 - RNA, 12 nt, Pseudomonas aeruginosa PA01
gccagccgagca

SEQ ID NO: 3505437 - RNA, 19 nt, Pseudomonas aeruginosa PA01
gccagccgagcaacucggc

SEQ ID NO: 3505438 - RNA, 22 nt, Pseudomonas aeruginosa PA01
gccagccgagcaacucggcggc

SEQ ID NO: 3505439 - RNA, 14 nt, Pseudomonas aeruginosa PA01
gccagccgccagga

SEQ ID NO: 3505440 - RNA, 14 nt, Pseudomonas aeruginosa PA01
gccagccgcccugg

SEQ ID NO: 3505441 - RNA, 17 nt, Pseudomonas aeruginosa PA01
gccagccgcccuggcuc

SEQ ID NO: 3505442 - RNA, 19 nt, Pseudomonas aeruginosa PA01
gccagccgcccuggcucug

SEQ ID NO: 3505443 - RNA, 12 nt, Pseudomonas aeruginosa PA01
gccagccgccga

SEQ ID NO: 3505444 - RNA, 17 nt, Pseudomonas aeruginosa PA01
gccagccgccgaagggc

SEQ ID NO: 3505445 - RNA, 21 nt, Pseudomonas aeruginosa PA01
gccagccgccuugcucgaccc

SEQ ID NO: 3505446 - RNA, 23 nt, Pseudomonas aeruginosa PA01
gccagccgccuugcucgacccgg

SEQ ID NO: 3505447 - RNA, 14 nt, Pseudomonas aeruginosa PA01
gccagccgcgaguc

SEQ ID NO: 3505448 - RNA, 11 nt, Pseudomonas aeruginosa PA01
gccagccgcgc

SEQ ID NO: 3505449 - RNA, 16 nt, Pseudomonas aeruginosa PA01
gccagccgcgcgccgc

SEQ ID NO: 3505450 - RNA, 17 nt, Pseudomonas aeruginosa PA01
gccagccgcgcgccgca

SEQ ID NO: 3505451 - RNA, 20 nt, Pseudomonas aeruginosa PA01
gccagccgcgcgccgcaucg

SEQ ID NO: 3505452 - RNA, 15 nt, Pseudomonas aeruginosa PA01
gccagccgcgcggca

SEQ ID NO: 3505453 - RNA, 16 nt, Pseudomonas aeruginosa PA01
gccagccgcggaucac

SEQ ID NO: 3505454 - RNA, 16 nt, Pseudomonas aeruginosa PA01
gccagccggccuugcu

SEQ ID NO: 3505455 - RNA, 13 nt, Pseudomonas aeruginosa PA01
gccagccggcgaa

SEQ ID NO: 3505456 - RNA, 14 nt, Pseudomonas aeruginosa PA01
gccagccggcgaag

SEQ ID NO: 3505457 - RNA, 22 nt, Pseudomonas aeruginosa PA01
gccagccggcgaagggcaggcc

SEQ ID NO: 3505458 - RNA, 23 nt, Pseudomonas aeruginosa PA01
gccagccggcgaagggcaggccg

SEQ ID NO: 3505459 - RNA, 12 nt, Pseudomonas aeruginosa PA01
gccagccggcgc

SEQ ID NO: 3505460 - RNA, 15 nt, Pseudomonas aeruginosa PA01
gccagccggcgccgc

SEQ ID NO: 3505461 - RNA, 15 nt, Pseudomonas aeruginosa PA01
gccagccgucgucgu

SEQ ID NO: 3505462 - RNA, 21 nt, Pseudomonas aeruginosa PA01
gccagccgucgucguccaccg

SEQ ID NO: 3505463 - RNA, 20 nt, Pseudomonas aeruginosa PA01
gccagccguucgcuggacag

SEQ ID NO: 3505464 - RNA, 17 nt, Pseudomonas aeruginosa PA01
gccagccuacugggcgu

SEQ ID NO: 3505465 - RNA, 18 nt, Pseudomonas aeruginosa PA01
gccagccucggcgaaguc

SEQ ID NO: 3505466 - RNA, 16 nt, Pseudomonas aeruginosa PA01
gccagccugcagccag

SEQ ID NO: 3505467 - RNA, 18 nt, Pseudomonas aeruginosa PA01
gccagccugcagccagcu

SEQ ID NO: 3505468 - RNA, 13 nt, Pseudomonas aeruginosa PA01
gccagccuggcca

SEQ ID NO: 3505469 - RNA, 18 nt, Pseudomonas aeruginosa PA01
gccagccuggccagcgcu

SEQ ID NO: 3505470 - RNA, 20 nt, Pseudomonas aeruginosa PA01
gccagccuucccggcgcuuc

SEQ ID NO: 3505471 - RNA, 14 nt, Pseudomonas aeruginosa PA01
gccagccuuccucg

SEQ ID NO: 3505472 - RNA, 15 nt, Pseudomonas aeruginosa PA01
gccagccuuccucgg

SEQ ID NO: 3505473 - RNA, 16 nt, Pseudomonas aeruginosa PA01
gccagccuuccucggg

SEQ ID NO: 3505474 - RNA, 19 nt, Pseudomonas aeruginosa PA01
gccagcgaacccaggccgc

SEQ ID NO: 3505475 - RNA, 22 nt, Pseudomonas aeruginosa PA01
gccagcgaacccaggccgcgca

SEQ ID NO: 3505476 - RNA, 21 nt, Pseudomonas aeruginosa PA01
gccagcgaccgucgaaccagg

SEQ ID NO: 3505477 - RNA, 16 nt, Pseudomonas aeruginosa PA01
gccagcgagacgggcg

SEQ ID NO: 3505478 - RNA, 17 nt, Pseudomonas aeruginosa PA01
gccagcgagacgggcga

SEQ ID NO: 3505479 - RNA, 18 nt, Pseudomonas aeruginosa PA01
gccagcgagacgggcgag

SEQ ID NO: 3505480 - RNA, 20 nt, Pseudomonas aeruginosa PA01
gccagcgagacgggcgaggc

SEQ ID NO: 3505481 - RNA, 22 nt, Pseudomonas aeruginosa PA01
gccagcgcaccuacuaccgcug

SEQ ID NO: 3505482 - RNA, 14 nt, Pseudomonas aeruginosa PA01
gccagcgcaucgag

SEQ ID NO: 3505483 - RNA, 18 nt, Pseudomonas aeruginosa PA01
gccagcgcaucgaggccg

SEQ ID NO: 3505484 - RNA, 14 nt, Pseudomonas aeruginosa PA01
gccagcgccaccag

SEQ ID NO: 3505485 - RNA, 15 nt, Pseudomonas aeruginosa PA01
gccagcgccaccagc

SEQ ID NO: 3505486 - RNA, 17 nt, Pseudomonas aeruginosa PA01
gccagcgccaccagcag

SEQ ID NO: 3505487 - RNA, 21 nt, Pseudomonas aeruginosa PA01
gccagcgccaccagcagggcc

SEQ ID NO: 3505488 - RNA, 19 nt, Pseudomonas aeruginosa PA01
gccagcgccacgccgcugu

SEQ ID NO: 3505489 - RNA, 15 nt, Pseudomonas aeruginosa PA01
gccagcgccacggcg

SEQ ID NO: 3505490 - RNA, 20 nt, Pseudomonas aeruginosa PA01
gccagcgccacggcgaucgc

SEQ ID NO: 3505491 - RNA, 14 nt, Pseudomonas aeruginosa PA01
gccagcgccagcag

SEQ ID NO: 3505492 - RNA, 21 nt, Pseudomonas aeruginosa PA01
gccagcgccaggagcagggcg

SEQ ID NO: 3505493 - RNA, 13 nt, Pseudomonas aeruginosa PA01
gccagcgccaggg

SEQ ID NO: 3505494 - RNA, 14 nt, Pseudomonas aeruginosa PA01
gccagcgccagguu

SEQ ID NO: 3505495 - RNA, 13 nt, Pseudomonas aeruginosa PA01
gccagcgcccagg

SEQ ID NO: 3505496 - RNA, 17 nt, Pseudomonas aeruginosa PA01
gccagcgcccaggccgg

SEQ ID NO: 3505497 - RNA, 21 nt, Pseudomonas aeruginosa PA01
gccagcgcccaggccgggucg

SEQ ID NO: 3505498 - RNA, 23 nt, Pseudomonas aeruginosa PA01
gccagcgcccaggccgggucgca

SEQ ID NO: 3505499 - RNA, 15 nt, Pseudomonas aeruginosa PA01
gccagcgccccacca

SEQ ID NO: 3505500 - RNA, 21 nt, Pseudomonas aeruginosa PA01
gccagcgccccaccaggcucg

SEQ ID NO: 3505501 - RNA, 12 nt, Pseudomonas aeruginosa PA01
gccagcgccgcc

SEQ ID NO: 3505502 - RNA, 13 nt, Pseudomonas aeruginosa PA01
gccagcgccgcca

SEQ ID NO: 3505503 - RNA, 19 nt, Pseudomonas aeruginosa PA01
gccagcgccgccaguucgc

SEQ ID NO: 3505504 - RNA, 13 nt, Pseudomonas aeruginosa PA01
gccagcgccgccg

SEQ ID NO: 3505505 - RNA, 14 nt, Pseudomonas aeruginosa PA01
gccagcgccgccgc

SEQ ID NO: 3505506 - RNA, 20 nt, Pseudomonas aeruginosa PA01
gccagcgccgccgcgugggc

SEQ ID NO: 3505507 - RNA, 15 nt, Pseudomonas aeruginosa PA01
gccagcgccgccgcu

SEQ ID NO: 3505508 - RNA, 17 nt, Pseudomonas aeruginosa PA01
gccagcgccgccgcugc

SEQ ID NO: 3505509 - RNA, 14 nt, Pseudomonas aeruginosa PA01
gccagcgccuggcg

SEQ ID NO: 3505510 - RNA, 16 nt, Pseudomonas aeruginosa PA01
gccagcgcggccgccg

SEQ ID NO: 3505511 - RNA, 17 nt, Pseudomonas aeruginosa PA01
gccagcgcggccgccgc

SEQ ID NO: 3505512 - RNA, 19 nt, Pseudomonas aeruginosa PA01
gccagcgcggccgccgccg

SEQ ID NO: 3505513 - RNA, 20 nt, Pseudomonas aeruginosa PA01
gccagcgcggccgccgccga

SEQ ID NO: 3505514 - RNA, 22 nt, Pseudomonas aeruginosa PA01
gccagcgcggccgccgccgaca

SEQ ID NO: 3505515 - RNA, 12 nt, Pseudomonas aeruginosa PA01
gccagcgcggcg

SEQ ID NO: 3505516 - RNA, 13 nt, Pseudomonas aeruginosa PA01
gccagcgcggcgc

SEQ ID NO: 3505517 - RNA, 15 nt, Pseudomonas aeruginosa PA01
gccagcgcggcggac

SEQ ID NO: 3505518 - RNA, 12 nt, Pseudomonas aeruginosa PA01
gccagcgcggcu

SEQ ID NO: 3505519 - RNA, 17 nt, Pseudomonas aeruginosa PA01
gccagcgcggcucgggc

SEQ ID NO: 3505520 - RNA, 18 nt, Pseudomonas aeruginosa PA01
gccagcgcggcucgggcg

SEQ ID NO: 3505521 - RNA, 21 nt, Pseudomonas aeruginosa PA01
gccagcgcggcucgggcggca

SEQ ID NO: 3505522 - RNA, 15 nt, Pseudomonas aeruginosa PA01
gccagcgcggugcgc

SEQ ID NO: 3505523 - RNA, 16 nt, Pseudomonas aeruginosa PA01
gccagcgcggugcgcg

SEQ ID NO: 3505524 - RNA, 18 nt, Pseudomonas aeruginosa PA01
gccagcgcggugcgcgcc

SEQ ID NO: 3505525 - RNA, 19 nt, Pseudomonas aeruginosa PA01
gccagcgcggugcgcgcca

SEQ ID NO: 3505526 - RNA, 14 nt, Pseudomonas aeruginosa PA01
gccagcgcgucggc

SEQ ID NO: 3505527 - RNA, 21 nt, Pseudomonas aeruginosa PA01
gccagcgcgucggcacgccga

SEQ ID NO: 3505528 - RNA, 17 nt, Pseudomonas aeruginosa PA01
gccagcgcucgaacgcc

SEQ ID NO: 3505529 - RNA, 21 nt, Pseudomonas aeruginosa PA01
gccagcgcucgaacgccgccc

SEQ ID NO: 3505530 - RNA, 18 nt, Pseudomonas aeruginosa PA01
gccagcgcuucgcgaucg

SEQ ID NO: 3505531 - RNA, 20 nt, Pseudomonas aeruginosa PA01
gccagcgcuucgcgaucggc

SEQ ID NO: 3505532 - RNA, 21 nt, Pseudomonas aeruginosa PA01
gccagcgcuucgcgaucggcg

SEQ ID NO: 3505533 - RNA, 17 nt, Pseudomonas aeruginosa PA01
gccagcggaugcuggcg

SEQ ID NO: 3505534 - RNA, 18 nt, Pseudomonas aeruginosa PA01
gccagcggaugcuggcgg

SEQ ID NO: 3505535 - RNA, 15 nt, Pseudomonas aeruginosa PA01
gccagcggcagaucg

SEQ ID NO: 3505536 - RNA, 14 nt, Pseudomonas aeruginosa PA01
gccagcggcagcgg

SEQ ID NO: 3505537 - RNA, 15 nt, Pseudomonas aeruginosa PA01
gccagcggcagcggu

SEQ ID NO: 3505538 - RNA, 13 nt, Pseudomonas aeruginosa PA01
gccagcggcaucc

SEQ ID NO: 3505539 - RNA, 20 nt, Pseudomonas aeruginosa PA01
gccagcggcauccgccgcug

SEQ ID NO: 3505540 - RNA, 21 nt, Pseudomonas aeruginosa PA01
gccagcggcauccgccgcugg

SEQ ID NO: 3505541 - RNA, 13 nt, Pseudomonas aeruginosa PA01
gccagcggcauuc

SEQ ID NO: 3505542 - RNA, 20 nt, Pseudomonas aeruginosa PA01
gccagcggcauucgaacggc

SEQ ID NO: 3505543 - RNA, 16 nt, Pseudomonas aeruginosa PA01
gccagcggccagggcg

SEQ ID NO: 3505544 - RNA, 18 nt, Pseudomonas aeruginosa PA01
gccagcggcccggcaggc

SEQ ID NO: 3505545 - RNA, 14 nt, Pseudomonas aeruginosa PA01
gccagcggcgaucg

SEQ ID NO: 3505546 - RNA, 19 nt, Pseudomonas aeruginosa PA01
gccagcggcguauccucgg

SEQ ID NO: 3505547 - RNA, 22 nt, Pseudomonas aeruginosa PA01
gccagcggcguauccucggcca

SEQ ID NO: 3505548 - RNA, 23 nt, Pseudomonas aeruginosa PA01
gccagcggcuccucggccugggc

SEQ ID NO: 3505549 - RNA, 24 nt, Pseudomonas aeruginosa PA01
gccagcggcuccucggccugggcg

SEQ ID NO: 3505550 - RNA, 17 nt, Pseudomonas aeruginosa PA01
gccagcgggacgaugcc

SEQ ID NO: 3505551 - RNA, 14 nt, Pseudomonas aeruginosa PA01
gccagcgggcgccg

SEQ ID NO: 3505552 - RNA, 21 nt, Pseudomonas aeruginosa PA01
gccagcgggcgccgccgccga

SEQ ID NO: 3505553 - RNA, 14 nt, Pseudomonas aeruginosa PA01
gccagcgguacccg

SEQ ID NO: 3505554 - RNA, 17 nt, Pseudomonas aeruginosa PA01
gccagcgguacccgccg

SEQ ID NO: 3505555 - RNA, 18 nt, Pseudomonas aeruginosa PA01
gccagcgguacccgccgg

SEQ ID NO: 3505556 - RNA, 19 nt, Pseudomonas aeruginosa PA01
gccagcgguacccgccggc

SEQ ID NO: 3505557 - RNA, 18 nt, Pseudomonas aeruginosa PA01
gccagcgguucaggucga

SEQ ID NO: 3505558 - RNA, 19 nt, Pseudomonas aeruginosa PA01
gccagcgguucaggucgag

SEQ ID NO: 3505559 - RNA, 20 nt, Pseudomonas aeruginosa PA01
gccagcgguucaggucgagg

SEQ ID NO: 3505560 - RNA, 19 nt, Pseudomonas aeruginosa PA01
gccagcgguugagcagggc

SEQ ID NO: 3505561 - RNA, 20 nt, Pseudomonas aeruginosa PA01
gccagcgguugagcagggcg

SEQ ID NO: 3505562 - RNA, 21 nt, Pseudomonas aeruginosa PA01
gccagcgguugagcagggcgu

SEQ ID NO: 3505563 - RNA, 22 nt, Pseudomonas aeruginosa PA01
gccagcgguugagcagggcguc

SEQ ID NO: 3505564 - RNA, 17 nt, Pseudomonas aeruginosa PA01
gccagcguccuucggcg

SEQ ID NO: 3505565 - RNA, 20 nt, Pseudomonas aeruginosa PA01
gccagcguccuucggcgcuc

SEQ ID NO: 3505566 - RNA, 21 nt, Pseudomonas aeruginosa PA01
gccagcguccuucggcgcucu

SEQ ID NO: 3505567 - RNA, 14 nt, Pseudomonas aeruginosa PA01
gccagcgucgccgc

SEQ ID NO: 3505568 - RNA, 19 nt, Pseudomonas aeruginosa PA01
gccagcgucgccgccgcgg

SEQ ID NO: 3505569 - RNA, 22 nt, Pseudomonas aeruginosa PA01
gccagcgucgccugccaggcgg

SEQ ID NO: 3505570 - RNA, 21 nt, Pseudomonas aeruginosa PA01
gccagcguuucgaagccgccg

SEQ ID NO: 3505571 - RNA, 20 nt, Pseudomonas aeruginosa PA01
gccagcucauggagcaacag

SEQ ID NO: 3505572 - RNA, 21 nt, Pseudomonas aeruginosa PA01
gccagcucauggagcaacagc

SEQ ID NO: 3505573 - RNA, 17 nt, Pseudomonas aeruginosa PA01
gccagcuccagcaccgg

SEQ ID NO: 3505574 - RNA, 21 nt, Pseudomonas aeruginosa PA01
gccagcuccagcaccggcggc

SEQ ID NO: 3505575 - RNA, 17 nt, Pseudomonas aeruginosa PA01
gccagcuccagcgccca

SEQ ID NO: 3505576 - RNA, 15 nt, Pseudomonas aeruginosa PA01
gccagcuccgccuga

SEQ ID NO: 3505577 - RNA, 15 nt, Pseudomonas aeruginosa PA01
gccagcucgaacagc

SEQ ID NO: 3505578 - RNA, 13 nt, Pseudomonas aeruginosa PA01
gccagcucgcccg

SEQ ID NO: 3505579 - RNA, 14 nt, Pseudomonas aeruginosa PA01
gccagcucgcccgc

SEQ ID NO: 3505580 - RNA, 14 nt, Pseudomonas aeruginosa PA01
gccagcucgccgaa

SEQ ID NO: 3505581 - RNA, 13 nt, Pseudomonas aeruginosa PA01
gccagcucgccgc

SEQ ID NO: 3505582 - RNA, 15 nt, Pseudomonas aeruginosa PA01
gccagcucgccgcgc

SEQ ID NO: 3505583 - RNA, 16 nt, Pseudomonas aeruginosa PA01
gccagcucgcugucca

SEQ ID NO: 3505584 - RNA, 17 nt, Pseudomonas aeruginosa PA01
gccagcucgcuguccag

SEQ ID NO: 3505585 - RNA, 23 nt, Pseudomonas aeruginosa PA01
gccagcucggacaagggccagag

SEQ ID NO: 3505586 - RNA, 19 nt, Pseudomonas aeruginosa PA01
gccagcucggccggcaggc

SEQ ID NO: 3505587 - RNA, 13 nt, Pseudomonas aeruginosa PA01
gccagcucggccu

SEQ ID NO: 3505588 - RNA, 13 nt, Pseudomonas aeruginosa PA01
gccagcucgucgc

SEQ ID NO: 3505589 - RNA, 14 nt, Pseudomonas aeruginosa PA01
gccagcucgucgcc

SEQ ID NO: 3505590 - RNA, 15 nt, Pseudomonas aeruginosa PA01
gccagcucgucgccc

SEQ ID NO: 3505591 - RNA, 17 nt, Pseudomonas aeruginosa PA01
gccagcucgucgcccuu

SEQ ID NO: 3505592 - RNA, 18 nt, Pseudomonas aeruginosa PA01
gccagcucgucgcccuuc

SEQ ID NO: 3505593 - RNA, 19 nt, Pseudomonas aeruginosa PA01
gccagcucgucgcccuuca

SEQ ID NO: 3505594 - RNA, 20 nt, Pseudomonas aeruginosa PA01
gccagcucuggccguccugc

SEQ ID NO: 3505595 - RNA, 16 nt, Pseudomonas aeruginosa PA01
gccagcucuugcccug

SEQ ID NO: 3505596 - RNA, 18 nt, Pseudomonas aeruginosa PA01
gccagcucuugcccugcc

SEQ ID NO: 3505597 - RNA, 19 nt, Pseudomonas aeruginosa PA01
gccagcucuugcccugcca

SEQ ID NO: 3505598 - RNA, 16 nt, Pseudomonas aeruginosa PA01
gccagcuggcgacggc

SEQ ID NO: 3505599 - RNA, 18 nt, Pseudomonas aeruginosa PA01
gccagcuuccaggcgcgc

SEQ ID NO: 3505600 - RNA, 19 nt, Pseudomonas aeruginosa PA01
gccagcuuccaggcgcgcu

SEQ ID NO: 3505601 - RNA, 20 nt, Pseudomonas aeruginosa PA01
gccagcuuccaggcgcgcug

SEQ ID NO: 3505602 - RNA, 21 nt, Pseudomonas aeruginosa PA01
gccagcuuccaggcgcgcugg

SEQ ID NO: 3505603 - RNA, 22 nt, Pseudomonas aeruginosa PA01
gccagcuuccaggcgcgcugga

SEQ ID NO: 3505604 - RNA, 14 nt, Pseudomonas aeruginosa PA01
gccagcuucuccag

SEQ ID NO: 3505605 - RNA, 15 nt, Pseudomonas aeruginosa PA01
gccagcuuggucggg

SEQ ID NO: 3505606 - RNA, 21 nt, Pseudomonas aeruginosa PA01
gccagcuuguaguagcgcccg

SEQ ID NO: 3505607 - RNA, 15 nt, Pseudomonas aeruginosa PA01
gccagcuuguccgcc

SEQ ID NO: 3505608 - RNA, 16 nt, Pseudomonas aeruginosa PA01
gccagcuuguccgccg

SEQ ID NO: 3505609 - RNA, 19 nt, Pseudomonas aeruginosa PA01
gccagcuugucggccuugg

SEQ ID NO: 3505610 - RNA, 14 nt, Pseudomonas aeruginosa PA01
gccaggaaaucgag

SEQ ID NO: 3505611 - RNA, 13 nt, Pseudomonas aeruginosa PA01
gccaggaagagcc

SEQ ID NO: 3505612 - RNA, 16 nt, Pseudomonas aeruginosa PA01
gccaggaagagcccgc

SEQ ID NO: 3505613 - RNA, 20 nt, Pseudomonas aeruginosa PA01
gccaggaagagcccgccacg

SEQ ID NO: 3505614 - RNA, 23 nt, Pseudomonas aeruginosa PA01
gccaggaagagcccgccacgcuu

SEQ ID NO: 3505615 - RNA, 13 nt, Pseudomonas aeruginosa PA01
gccaggaagccgc

SEQ ID NO: 3505616 - RNA, 17 nt, Pseudomonas aeruginosa PA01
gccaggaagccgcgccc

SEQ ID NO: 3505617 - RNA, 18 nt, Pseudomonas aeruginosa PA01
gccaggaagccgcgcccc

SEQ ID NO: 3505618 - RNA, 22 nt, Pseudomonas aeruginosa PA01
gccaggaagccgcgccccagcg

SEQ ID NO: 3505619 - RNA, 18 nt, Pseudomonas aeruginosa PA01
gccaggaagcggcgguac

SEQ ID NO: 3505620 - RNA, 14 nt, Pseudomonas aeruginosa PA01
gccaggaagcgggc

SEQ ID NO: 3505621 - RNA, 18 nt, Pseudomonas aeruginosa PA01
gccaggaaggccgcuucg

SEQ ID NO: 3505622 - RNA, 12 nt, Pseudomonas aeruginosa PA01
gccaggaccagg

SEQ ID NO: 3505623 - RNA, 16 nt, Pseudomonas aeruginosa PA01
gccaggaccagggcgg

SEQ ID NO: 3505624 - RNA, 17 nt, Pseudomonas aeruginosa PA01
gccaggaccaucggcac

SEQ ID NO: 3505625 - RNA, 17 nt, Pseudomonas aeruginosa PA01
gccaggaccgcgauggu

SEQ ID NO: 3505626 - RNA, 18 nt, Pseudomonas aeruginosa PA01
gccaggaccuccugcaca

SEQ ID NO: 3505627 - RNA, 18 nt, Pseudomonas aeruginosa PA01
gccaggaccucgaagcug

SEQ ID NO: 3505628 - RNA, 19 nt, Pseudomonas aeruginosa PA01
gccaggacgccaccaggcc

SEQ ID NO: 3505629 - RNA, 13 nt, Pseudomonas aeruginosa PA01
gccaggacgcucg

SEQ ID NO: 3505630 - RNA, 17 nt, Pseudomonas aeruginosa PA01
gccaggacgcucgggua

SEQ ID NO: 3505631 - RNA, 15 nt, Pseudomonas aeruginosa PA01
gccaggacgcuggcg

SEQ ID NO: 3505632 - RNA, 16 nt, Pseudomonas aeruginosa PA01
gccaggacggcagggu

SEQ ID NO: 3505633 - RNA, 20 nt, Pseudomonas aeruginosa PA01
gccaggacguuauccguccu

SEQ ID NO: 3505634 - RNA, 14 nt, Pseudomonas aeruginosa PA01
gccaggacucgcca

SEQ ID NO: 3505635 - RNA, 14 nt, Pseudomonas aeruginosa PA01
gccaggagcacgcc

SEQ ID NO: 3505636 - RNA, 19 nt, Pseudomonas aeruginosa PA01
gccaggagcacgccgugca

SEQ ID NO: 3505637 - RNA, 17 nt, Pseudomonas aeruginosa PA01
gccaggagcagggcgcc

SEQ ID NO: 3505638 - RNA, 20 nt, Pseudomonas aeruginosa PA01
gccaggagcaucggcgcggc

SEQ ID NO: 3505639 - RNA, 23 nt, Pseudomonas aeruginosa PA01
gccaggagcaucggcgcggccuu

SEQ ID NO: 3505640 - RNA, 19 nt, Pseudomonas aeruginosa PA01
gccaggagcuugccgaaga

SEQ ID NO: 3505641 - RNA, 18 nt, Pseudomonas aeruginosa PA01
gccaggaggauucgccag

SEQ ID NO: 3505642 - RNA, 22 nt, Pseudomonas aeruginosa PA01
gccaggaggauucgccagccuc

SEQ ID NO: 3505643 - RNA, 16 nt, Pseudomonas aeruginosa PA01
gccaggaggcccacgg

SEQ ID NO: 3505644 - RNA, 22 nt, Pseudomonas aeruginosa PA01
gccaggaggcccacgggcggcc

SEQ ID NO: 3505645 - RNA, 14 nt, Pseudomonas aeruginosa PA01
gccaggaucagucc

SEQ ID NO: 3505646 - RNA, 17 nt, Pseudomonas aeruginosa PA01
gccaggaucggcauggc

SEQ ID NO: 3505647 - RNA, 15 nt, Pseudomonas aeruginosa PA01
gccaggaucgucggc

SEQ ID NO: 3505648 - RNA, 15 nt, Pseudomonas aeruginosa PA01
gccaggaugaccagg

SEQ ID NO: 3505649 - RNA, 19 nt, Pseudomonas aeruginosa PA01
gccaggaugaccaggcuga

SEQ ID NO: 3505650 - RNA, 17 nt, Pseudomonas aeruginosa PA01
gccaggauguucgccga

SEQ ID NO: 3505651 - RNA, 13 nt, Pseudomonas aeruginosa PA01
gccaggcagacca

SEQ ID NO: 3505652 - RNA, 20 nt, Pseudomonas aeruginosa PA01
gccaggcagaccagcgcaag

SEQ ID NO: 3505653 - RNA, 15 nt, Pseudomonas aeruginosa PA01
gccaggcagaccagg

SEQ ID NO: 3505654 - RNA, 19 nt, Pseudomonas aeruginosa PA01
gccaggcagaccaggccga

SEQ ID NO: 3505655 - RNA, 21 nt, Pseudomonas aeruginosa PA01
gccaggcagaccaggccgagc

SEQ ID NO: 3505656 - RNA, 13 nt, Pseudomonas aeruginosa PA01
gccaggcagaccu

SEQ ID NO: 3505657 - RNA, 15 nt, Pseudomonas aeruginosa PA01
gccaggcagaccugc

SEQ ID NO: 3505658 - RNA, 12 nt, Pseudomonas aeruginosa PA01
gccaggcaggcc

SEQ ID NO: 3505659 - RNA, 14 nt, Pseudomonas aeruginosa PA01
gccaggcaggccgg

SEQ ID NO: 3505660 - RNA, 15 nt, Pseudomonas aeruginosa PA01
gccaggcaggccggg

SEQ ID NO: 3505661 - RNA, 16 nt, Pseudomonas aeruginosa PA01
gccaggcaggccgggc

SEQ ID NO: 3505662 - RNA, 22 nt, Pseudomonas aeruginosa PA01
gccaggcaggccgggcuggcca

SEQ ID NO: 3505663 - RNA, 13 nt, Pseudomonas aeruginosa PA01
gccaggcaggcgg

SEQ ID NO: 3505664 - RNA, 17 nt, Pseudomonas aeruginosa PA01
gccaggcagucguaggu

SEQ ID NO: 3505665 - RNA, 13 nt, Pseudomonas aeruginosa PA01
gccaggcauccag

SEQ ID NO: 3505666 - RNA, 14 nt, Pseudomonas aeruginosa PA01
gccaggcauccagc

SEQ ID NO: 3505667 - RNA, 16 nt, Pseudomonas aeruginosa PA01
gccaggcauccagcac

SEQ ID NO: 3505668 - RNA, 17 nt, Pseudomonas aeruginosa PA01
gccaggcauccagcacc

SEQ ID NO: 3505669 - RNA, 18 nt, Pseudomonas aeruginosa PA01
gccaggcauccagcaccg

SEQ ID NO: 3505670 - RNA, 17 nt, Pseudomonas aeruginosa PA01
gccaggcauuccuccag

SEQ ID NO: 3505671 - RNA, 18 nt, Pseudomonas aeruginosa PA01
gccaggcauuccuccagg

SEQ ID NO: 3505672 - RNA, 21 nt, Pseudomonas aeruginosa PA01
gccaggcauuccuccaggguc

SEQ ID NO: 3505673 - RNA, 22 nt, Pseudomonas aeruginosa PA01
gccaggcauuccuccagggucg

SEQ ID NO: 3505674 - RNA, 17 nt, Pseudomonas aeruginosa PA01
gccaggccacggccggc

SEQ ID NO: 3505675 - RNA, 18 nt, Pseudomonas aeruginosa PA01
gccaggccacggccggcg

SEQ ID NO: 3505676 - RNA, 18 nt, Pseudomonas aeruginosa PA01
gccaggcccacgcccauc

SEQ ID NO: 3505677 - RNA, 16 nt, Pseudomonas aeruginosa PA01
gccaggcccacgccga

SEQ ID NO: 3505678 - RNA, 13 nt, Pseudomonas aeruginosa PA01
gccaggccccagg

SEQ ID NO: 3505679 - RNA, 18 nt, Pseudomonas aeruginosa PA01
gccaggccccaggccgcc

SEQ ID NO: 3505680 - RNA, 20 nt, Pseudomonas aeruginosa PA01
gccaggccccaggccgccgc

SEQ ID NO: 3505681 - RNA, 19 nt, Pseudomonas aeruginosa PA01
gccaggccccagggccggc

SEQ ID NO: 3505682 - RNA, 20 nt, Pseudomonas aeruginosa PA01
gccaggccccagggccggcg

SEQ ID NO: 3505683 - RNA, 21 nt, Pseudomonas aeruginosa PA01
gccaggccccagggccggcgc

SEQ ID NO: 3505684 - RNA, 15 nt, Pseudomonas aeruginosa PA01
gccaggcccggcgcu

SEQ ID NO: 3505685 - RNA, 18 nt, Pseudomonas aeruginosa PA01
gccaggcccggcgcugcu

SEQ ID NO: 3505686 - RNA, 17 nt, Pseudomonas aeruginosa PA01
gccaggcccucagcggc

SEQ ID NO: 3505687 - RNA, 22 nt, Pseudomonas aeruginosa PA01
gccaggcccucagcggcggugc

SEQ ID NO: 3505688 - RNA, 15 nt, Pseudomonas aeruginosa PA01
gccaggcccucggcg

SEQ ID NO: 3505689 - RNA, 18 nt, Pseudomonas aeruginosa PA01
gccaggcccucggcgacc

SEQ ID NO: 3505690 - RNA, 19 nt, Pseudomonas aeruginosa PA01
gccaggcccucggcgacca

SEQ ID NO: 3505691 - RNA, 14 nt, Pseudomonas aeruginosa PA01
gccaggcccugggc

SEQ ID NO: 3505692 - RNA, 20 nt, Pseudomonas aeruginosa PA01
gccaggcccugggcggcggg

SEQ ID NO: 3505693 - RNA, 17 nt, Pseudomonas aeruginosa PA01
gccaggcccuuggucag

SEQ ID NO: 3505694 - RNA, 19 nt, Pseudomonas aeruginosa PA01
gccaggcccuuggucaggc

SEQ ID NO: 3505695 - RNA, 19 nt, Pseudomonas aeruginosa PA01
gccaggccgacccgcaggc

SEQ ID NO: 3505696 - RNA, 12 nt, Pseudomonas aeruginosa PA01
gccaggccgagc

SEQ ID NO: 3505697 - RNA, 14 nt, Pseudomonas aeruginosa PA01
gccaggccgagcgc

SEQ ID NO: 3505698 - RNA, 16 nt, Pseudomonas aeruginosa PA01
gccaggccgagcgcca

SEQ ID NO: 3505699 - RNA, 18 nt, Pseudomonas aeruginosa PA01
gccaggccgagcgccagg

SEQ ID NO: 3505700 - RNA, 16 nt, Pseudomonas aeruginosa PA01
gccaggccgagcgcgc

SEQ ID NO: 3505701 - RNA, 17 nt, Pseudomonas aeruginosa PA01
gccaggccgagcgcgcc

SEQ ID NO: 3505702 - RNA, 18 nt, Pseudomonas aeruginosa PA01
gccaggccgagcgcgccg

SEQ ID NO: 3505703 - RNA, 17 nt, Pseudomonas aeruginosa PA01
gccaggccgaucagcgc

SEQ ID NO: 3505704 - RNA, 23 nt, Pseudomonas aeruginosa PA01
gccaggccgaucagcgccucggc

SEQ ID NO: 3505705 - RNA, 15 nt, Pseudomonas aeruginosa PA01
gccaggccgcccagg

SEQ ID NO: 3505706 - RNA, 17 nt, Pseudomonas aeruginosa PA01
gccaggccgcccaggac

SEQ ID NO: 3505707 - RNA, 12 nt, Pseudomonas aeruginosa PA01
gccaggccgccg

SEQ ID NO: 3505708 - RNA, 13 nt, Pseudomonas aeruginosa PA01
gccaggccgccga

SEQ ID NO: 3505709 - RNA, 14 nt, Pseudomonas aeruginosa PA01
gccaggccgccgaa

SEQ ID NO: 3505710 - RNA, 17 nt, Pseudomonas aeruginosa PA01
gccaggccgcgcagucc

SEQ ID NO: 3505711 - RNA, 22 nt, Pseudomonas aeruginosa PA01
gccaggccgcgcagucccgcgc

SEQ ID NO: 3505712 - RNA, 15 nt, Pseudomonas aeruginosa PA01
gccaggccggagccg

SEQ ID NO: 3505713 - RNA, 18 nt, Pseudomonas aeruginosa PA01
gccaggccggagccgcgu

SEQ ID NO: 3505714 - RNA, 14 nt, Pseudomonas aeruginosa PA01
gccaggccggcgag

SEQ ID NO: 3505715 - RNA, 13 nt, Pseudomonas aeruginosa PA01
gccaggccggcgc

SEQ ID NO: 3505716 - RNA, 16 nt, Pseudomonas aeruginosa PA01
gccaggccggcgcauc

SEQ ID NO: 3505717 - RNA, 15 nt, Pseudomonas aeruginosa PA01
gccaggccggcgccu

SEQ ID NO: 3505718 - RNA, 23 nt, Pseudomonas aeruginosa PA01
gccaggccggcgccuugcgccag

SEQ ID NO: 3505719 - RNA, 19 nt, Pseudomonas aeruginosa PA01
gccaggccguagaccacca

SEQ ID NO: 3505720 - RNA, 21 nt, Pseudomonas aeruginosa PA01
gccaggccguagaccaccagc

SEQ ID NO: 3505721 - RNA, 12 nt, Pseudomonas aeruginosa PA01
gccaggccucag

SEQ ID NO: 3505722 - RNA, 12 nt, Pseudomonas aeruginosa PA01
gccaggccucgg

SEQ ID NO: 3505723 - RNA, 15 nt, Pseudomonas aeruginosa PA01
gccaggccucggcgc

SEQ ID NO: 3505724 - RNA, 16 nt, Pseudomonas aeruginosa PA01
gccaggccucggcgcg

SEQ ID NO: 3505725 - RNA, 18 nt, Pseudomonas aeruginosa PA01
gccaggccucggcgcggg

SEQ ID NO: 3505726 - RNA, 20 nt, Pseudomonas aeruginosa PA01
gccaggccuuccagaacgcc

SEQ ID NO: 3505727 - RNA, 22 nt, Pseudomonas aeruginosa PA01
gccaggccuuccagaacgccgc

SEQ ID NO: 3505728 - RNA, 13 nt, Pseudomonas aeruginosa PA01
gccaggccuugca

SEQ ID NO: 3505729 - RNA, 20 nt, Pseudomonas aeruginosa PA01
gccaggccuugugcgccagc

SEQ ID NO: 3505730 - RNA, 22 nt, Pseudomonas aeruginosa PA01
gccaggcgaagcggcuggccgc

SEQ ID NO: 3505731 - RNA, 22 nt, Pseudomonas aeruginosa PA01
gccaggcgaauggagggaucgc

SEQ ID NO: 3505732 - RNA, 15 nt, Pseudomonas aeruginosa PA01
gccaggcgauccagc

SEQ ID NO: 3505733 - RNA, 20 nt, Pseudomonas aeruginosa PA01
gccaggcgauggugcgcucg

SEQ ID NO: 3505734 - RNA, 15 nt, Pseudomonas aeruginosa PA01
gccaggcgcaccagc

SEQ ID NO: 3505735 - RNA, 16 nt, Pseudomonas aeruginosa PA01
gccaggcgcagccagc

SEQ ID NO: 3505736 - RNA, 23 nt, Pseudomonas aeruginosa PA01
gccaggcgcaguaggccugguag

SEQ ID NO: 3505737 - RNA, 15 nt, Pseudomonas aeruginosa PA01
gccaggcgcagugcc

SEQ ID NO: 3505738 - RNA, 16 nt, Pseudomonas aeruginosa PA01
gccaggcgcagugccu

SEQ ID NO: 3505739 - RNA, 13 nt, Pseudomonas aeruginosa PA01
gccaggcgccagg

SEQ ID NO: 3505740 - RNA, 14 nt, Pseudomonas aeruginosa PA01
gccaggcgccaggu

SEQ ID NO: 3505741 - RNA, 12 nt, Pseudomonas aeruginosa PA01
gccaggcgccga

SEQ ID NO: 3505742 - RNA, 18 nt, Pseudomonas aeruginosa PA01
gccaggcgcgacagcucg

SEQ ID NO: 3505743 - RNA, 14 nt, Pseudomonas aeruginosa PA01
gccaggcgcggcgc

SEQ ID NO: 3505744 - RNA, 15 nt, Pseudomonas aeruginosa PA01
gccaggcgcgggucu

SEQ ID NO: 3505745 - RNA, 22 nt, Pseudomonas aeruginosa PA01
gccaggcgcgguugccgcugcg

SEQ ID NO: 3505746 - RNA, 13 nt, Pseudomonas aeruginosa PA01
gccaggcgcgucu

SEQ ID NO: 3505747 - RNA, 23 nt, Pseudomonas aeruginosa PA01
gccaggcgcgucuccagcucggc

SEQ ID NO: 3505748 - RNA, 16 nt, Pseudomonas aeruginosa PA01
gccaggcgcuccucca

SEQ ID NO: 3505749 - RNA, 15 nt, Pseudomonas aeruginosa PA01
gccaggcgcucgcgc

SEQ ID NO: 3505750 - RNA, 19 nt, Pseudomonas aeruginosa PA01
gccaggcgcucgcgcugca

SEQ ID NO: 3505751 - RNA, 20 nt, Pseudomonas aeruginosa PA01
gccaggcgcucgcgcugcaa

SEQ ID NO: 3505752 - RNA, 17 nt, Pseudomonas aeruginosa PA01
gccaggcgcucucgccg

SEQ ID NO: 3505753 - RNA, 18 nt, Pseudomonas aeruginosa PA01
gccaggcgcucucgccgc

SEQ ID NO: 3505754 - RNA, 19 nt, Pseudomonas aeruginosa PA01
gccaggcgcucucgccgcc

SEQ ID NO: 3505755 - RNA, 20 nt, Pseudomonas aeruginosa PA01
gccaggcgcucucgccgccu

SEQ ID NO: 3505756 - RNA, 16 nt, Pseudomonas aeruginosa PA01
gccaggcgcuuguccg

SEQ ID NO: 3505757 - RNA, 21 nt, Pseudomonas aeruginosa PA01
gccaggcggaacggcucgcga

SEQ ID NO: 3505758 - RNA, 20 nt, Pseudomonas aeruginosa PA01
gccaggcggcagccgcggcu

SEQ ID NO: 3505759 - RNA, 12 nt, Pseudomonas aeruginosa PA01
gccaggcggccg

SEQ ID NO: 3505760 - RNA, 13 nt, Pseudomonas aeruginosa PA01
gccaggcggccga

SEQ ID NO: 3505761 - RNA, 16 nt, Pseudomonas aeruginosa PA01
gccaggcggccgaaga

SEQ ID NO: 3505762 - RNA, 14 nt, Pseudomonas aeruginosa PA01
gccaggcggccgac

SEQ ID NO: 3505763 - RNA, 15 nt, Pseudomonas aeruginosa PA01
gccaggcggccgcug

SEQ ID NO: 3505764 - RNA, 18 nt, Pseudomonas aeruginosa PA01
gccaggcggccgcuggcg

SEQ ID NO: 3505765 - RNA, 16 nt, Pseudomonas aeruginosa PA01
gccaggcggcucccuu

SEQ ID NO: 3505766 - RNA, 16 nt, Pseudomonas aeruginosa PA01
gccaggcggggauggc

SEQ ID NO: 3505767 - RNA, 17 nt, Pseudomonas aeruginosa PA01
gccaggcggggauggcg

SEQ ID NO: 3505768 - RNA, 21 nt, Pseudomonas aeruginosa PA01
gccaggcggggauggcgggcu

SEQ ID NO: 3505769 - RNA, 16 nt, Pseudomonas aeruginosa PA01
gccaggcgguccagcc

SEQ ID NO: 3505770 - RNA, 21 nt, Pseudomonas aeruginosa PA01
gccaggcgguuccagacaucc

SEQ ID NO: 3505771 - RNA, 23 nt, Pseudomonas aeruginosa PA01
gccaggcguauucggcgaccagc

SEQ ID NO: 3505772 - RNA, 19 nt, Pseudomonas aeruginosa PA01
gccaggcguuccagcucgg

SEQ ID NO: 3505773 - RNA, 14 nt, Pseudomonas aeruginosa PA01
gccaggcucgccgc

SEQ ID NO: 3505774 - RNA, 16 nt, Pseudomonas aeruginosa PA01
gccaggcucgccgcca

SEQ ID NO: 3505775 - RNA, 18 nt, Pseudomonas aeruginosa PA01
gccaggcucgccgccagc

SEQ ID NO: 3505776 - RNA, 20 nt, Pseudomonas aeruginosa PA01
gccaggcucgccgccagcag

SEQ ID NO: 3505777 - RNA, 23 nt, Pseudomonas aeruginosa PA01
gccaggcucgccgccagcaggau

SEQ ID NO: 3505778 - RNA, 20 nt, Pseudomonas aeruginosa PA01
gccaggcucgguucugcgca

SEQ ID NO: 3505779 - RNA, 22 nt, Pseudomonas aeruginosa PA01
gccaggcucuucuucgaaccgc

SEQ ID NO: 3505780 - RNA, 15 nt, Pseudomonas aeruginosa PA01
gccaggcugauccgc

SEQ ID NO: 3505781 - RNA, 15 nt, Pseudomonas aeruginosa PA01
gccaggcugcgcuug

SEQ ID NO: 3505782 - RNA, 14 nt, Pseudomonas aeruginosa PA01
gccaggcuggccac

SEQ ID NO: 3505783 - RNA, 15 nt, Pseudomonas aeruginosa PA01
gccaggcuggccacg

SEQ ID NO: 3505784 - RNA, 16 nt, Pseudomonas aeruginosa PA01
gccaggcuggccacga

SEQ ID NO: 3505785 - RNA, 19 nt, Pseudomonas aeruginosa PA01
gccaggcuggcugguaacg

SEQ ID NO: 3505786 - RNA, 23 nt, Pseudomonas aeruginosa PA01
gccaggcuggcugguaacgggcg

SEQ ID NO: 3505787 - RNA, 22 nt, Pseudomonas aeruginosa PA01
gccaggcuggguuggcgcgaga

SEQ ID NO: 3505788 - RNA, 14 nt, Pseudomonas aeruginosa PA01
gccaggcugucagg

SEQ ID NO: 3505789 - RNA, 20 nt, Pseudomonas aeruginosa PA01
gccaggcuuuccgccgagcg

SEQ ID NO: 3505790 - RNA, 13 nt, Pseudomonas aeruginosa PA01
gccagggaaauca

SEQ ID NO: 3505791 - RNA, 12 nt, Pseudomonas aeruginosa PA01
gccagggacgcg

SEQ ID NO: 3505792 - RNA, 16 nt, Pseudomonas aeruginosa PA01
gccagggacgcgcagc

SEQ ID NO: 3505793 - RNA, 18 nt, Pseudomonas aeruginosa PA01
gccagggacgcgcagcgg

SEQ ID NO: 3505794 - RNA, 19 nt, Pseudomonas aeruginosa PA01
gccagggacgcgcagcggc

SEQ ID NO: 3505795 - RNA, 14 nt, Pseudomonas aeruginosa PA01
gccagggagcagga

SEQ ID NO: 3505796 - RNA, 20 nt, Pseudomonas aeruginosa PA01
gccagggagcaggacgccga

SEQ ID NO: 3505797 - RNA, 14 nt, Pseudomonas aeruginosa PA01
gccagggaggcgcu

SEQ ID NO: 3505798 - RNA, 18 nt, Pseudomonas aeruginosa PA01
gccagggaggcgcuggcc

SEQ ID NO: 3505799 - RNA, 19 nt, Pseudomonas aeruginosa PA01
gccagggaggcgcuggcca

SEQ ID NO: 3505800 - RNA, 20 nt, Pseudomonas aeruginosa PA01
gccagggaggcgcuggccag

SEQ ID NO: 3505801 - RNA, 19 nt, Pseudomonas aeruginosa PA01
gccagggagucgcuggcca

SEQ ID NO: 3505802 - RNA, 21 nt, Pseudomonas aeruginosa PA01
gccagggauacucaugcaggc

SEQ ID NO: 3505803 - RNA, 21 nt, Pseudomonas aeruginosa PA01
gccagggauuccuuggucagg

SEQ ID NO: 3505804 - RNA, 15 nt, Pseudomonas aeruginosa PA01
gccagggcaacgcca

SEQ ID NO: 3505805 - RNA, 20 nt, Pseudomonas aeruginosa PA01
gccagggcaacgccaggcug

SEQ ID NO: 3505806 - RNA, 18 nt, Pseudomonas aeruginosa PA01
gccagggcagcaggucgc

SEQ ID NO: 3505807 - RNA, 21 nt, Pseudomonas aeruginosa PA01
gccagggcagggaguccgcca

SEQ ID NO: 3505808 - RNA, 23 nt, Pseudomonas aeruginosa PA01
gccagggcagggaguccgccagc

SEQ ID NO: 3505809 - RNA, 21 nt, Pseudomonas aeruginosa PA01
gccagggcaugggucagcgcc

SEQ ID NO: 3505810 - RNA, 23 nt, Pseudomonas aeruginosa PA01
gccagggcaugggucagcgccag

SEQ ID NO: 3505811 - RNA, 19 nt, Pseudomonas aeruginosa PA01
gccagggcauguuccucca

SEQ ID NO: 3505812 - RNA, 18 nt, Pseudomonas aeruginosa PA01
gccagggcauugaccuug

SEQ ID NO: 3505813 - RNA, 14 nt, Pseudomonas aeruginosa PA01
gccagggcccacag

SEQ ID NO: 3505814 - RNA, 13 nt, Pseudomonas aeruginosa PA01
gccagggccgcga

SEQ ID NO: 3505815 - RNA, 14 nt, Pseudomonas aeruginosa PA01
gccagggccgcucg

SEQ ID NO: 3505816 - RNA, 13 nt, Pseudomonas aeruginosa PA01
gccagggccuugc

SEQ ID NO: 3505817 - RNA, 18 nt, Pseudomonas aeruginosa PA01
gccagggcgaacagcgcc

SEQ ID NO: 3505818 - RNA, 16 nt, Pseudomonas aeruginosa PA01
gccagggcgaggauca

SEQ ID NO: 3505819 - RNA, 19 nt, Pseudomonas aeruginosa PA01
gccagggcgaggaucacgc

SEQ ID NO: 3505820 - RNA, 16 nt, Pseudomonas aeruginosa PA01
gccagggcgcucaccg

SEQ ID NO: 3505821 - RNA, 15 nt, Pseudomonas aeruginosa PA01
gccagggcggcgccg

SEQ ID NO: 3505822 - RNA, 16 nt, Pseudomonas aeruginosa PA01
gccagggcggcgccga

SEQ ID NO: 3505823 - RNA, 13 nt, Pseudomonas aeruginosa PA01
gccagggcggcgg

SEQ ID NO: 3505824 - RNA, 16 nt, Pseudomonas aeruginosa PA01
gccagggcggucggcc

SEQ ID NO: 3505825 - RNA, 17 nt, Pseudomonas aeruginosa PA01
gccagggcguugcucga

SEQ ID NO: 3505826 - RNA, 18 nt, Pseudomonas aeruginosa PA01
gccagggcuucccaggcc

SEQ ID NO: 3505827 - RNA, 23 nt, Pseudomonas aeruginosa PA01
gccagggcuucccaggccagcgg

SEQ ID NO: 3505828 - RNA, 16 nt, Pseudomonas aeruginosa PA01
gccaggggagcgccgg

SEQ ID NO: 3505829 - RNA, 17 nt, Pseudomonas aeruginosa PA01
gccaggggagcgccggc

SEQ ID NO: 3505830 - RNA, 18 nt, Pseudomonas aeruginosa PA01
gccaggggagcgccggcg

SEQ ID NO: 3505831 - RNA, 16 nt, Pseudomonas aeruginosa PA01
gccaggggcacgcugg

SEQ ID NO: 3505832 - RNA, 18 nt, Pseudomonas aeruginosa PA01
gccaggggcuagucgcgc

SEQ ID NO: 3505833 - RNA, 22 nt, Pseudomonas aeruginosa PA01
gccaggggcuagucgcgcagcg

SEQ ID NO: 3505834 - RNA, 23 nt, Pseudomonas aeruginosa PA01
gccaggggcuagucgcgcagcgc

SEQ ID NO: 3505835 - RNA, 17 nt, Pseudomonas aeruginosa PA01
gccaggggcugaacagc

SEQ ID NO: 3505836 - RNA, 21 nt, Pseudomonas aeruginosa PA01
gccaggggcugaacagcgcca

SEQ ID NO: 3505837 - RNA, 23 nt, Pseudomonas aeruginosa PA01
gccaggggcugaacagcgccacc

SEQ ID NO: 3505838 - RNA, 15 nt, Pseudomonas aeruginosa PA01
gccagggggccuggc

SEQ ID NO: 3505839 - RNA, 13 nt, Pseudomonas aeruginosa PA01
gccaggggucagg

SEQ ID NO: 3505840 - RNA, 18 nt, Pseudomonas aeruginosa PA01
gccaggggucaggccgau

SEQ ID NO: 3505841 - RNA, 22 nt, Pseudomonas aeruginosa PA01
gccaggguaccguugcgcaggc

SEQ ID NO: 3505842 - RNA, 23 nt, Pseudomonas aeruginosa PA01
gccaggguaccguugcgcaggcg

SEQ ID NO: 3505843 - RNA, 13 nt, Pseudomonas aeruginosa PA01
gccagggucgcca

SEQ ID NO: 3505844 - RNA, 14 nt, Pseudomonas aeruginosa PA01
gccagggucgccag

SEQ ID NO: 3505845 - RNA, 16 nt, Pseudomonas aeruginosa PA01
gccagggucgccagca

SEQ ID NO: 3505846 - RNA, 19 nt, Pseudomonas aeruginosa PA01
gccagggucgccagcaggu

SEQ ID NO: 3505847 - RNA, 16 nt, Pseudomonas aeruginosa PA01
gccagggucuugccga

SEQ ID NO: 3505848 - RNA, 19 nt, Pseudomonas aeruginosa PA01
gccagggucuugccgaccu

SEQ ID NO: 3505849 - RNA, 20 nt, Pseudomonas aeruginosa PA01
gccaggguguuguucgccag

SEQ ID NO: 3505850 - RNA, 16 nt, Pseudomonas aeruginosa PA01
gccagguaauagccgu

SEQ ID NO: 3505851 - RNA, 24 nt, Pseudomonas aeruginosa PA01
gccagguaccggccaggcggucca

SEQ ID NO: 3505852 - RNA, 20 nt, Pseudomonas aeruginosa PA01
gccagguacggaugccgcga

SEQ ID NO: 3505853 - RNA, 22 nt, Pseudomonas aeruginosa PA01
gccagguacggaugccgcgagc

SEQ ID NO: 3505854 - RNA, 15 nt, Pseudomonas aeruginosa PA01
gccagguacuggcga

SEQ ID NO: 3505855 - RNA, 19 nt, Pseudomonas aeruginosa PA01
gccagguacuggcgaugga

SEQ ID NO: 3505856 - RNA, 22 nt, Pseudomonas aeruginosa PA01
gccagguacuggcgauggauga

SEQ ID NO: 3505857 - RNA, 16 nt, Pseudomonas aeruginosa PA01
gccagguagccuggau

SEQ ID NO: 3505858 - RNA, 22 nt, Pseudomonas aeruginosa PA01
gccagguagcggaccccggccu

SEQ ID NO: 3505859 - RNA, 21 nt, Pseudomonas aeruginosa PA01
gccagguagcggcguucgccg

SEQ ID NO: 3505860 - RNA, 16 nt, Pseudomonas aeruginosa PA01
gccagguaggcgacga

SEQ ID NO: 3505861 - RNA, 15 nt, Pseudomonas aeruginosa PA01
gccagguaggggucg

SEQ ID NO: 3505862 - RNA, 21 nt, Pseudomonas aeruginosa PA01
gccagguaggggucguugccg

SEQ ID NO: 3505863 - RNA, 18 nt, Pseudomonas aeruginosa PA01
gccagguaguccagcggu

SEQ ID NO: 3505864 - RNA, 18 nt, Pseudomonas aeruginosa PA01
gccagguagugccgcccu

SEQ ID NO: 3505865 - RNA, 20 nt, Pseudomonas aeruginosa PA01
gccagguauuccgcccauug

SEQ ID NO: 3505866 - RNA, 18 nt, Pseudomonas aeruginosa PA01
gccagguauucgcgcucg

SEQ ID NO: 3505867 - RNA, 13 nt, Pseudomonas aeruginosa PA01
gccaggucagcca

SEQ ID NO: 3505868 - RNA, 17 nt, Pseudomonas aeruginosa PA01
gccagguccgccugguc

SEQ ID NO: 3505869 - RNA, 21 nt, Pseudomonas aeruginosa PA01
gccaggucgacgaccuugccc

SEQ ID NO: 3505870 - RNA, 14 nt, Pseudomonas aeruginosa PA01
gccaggucgauccc

SEQ ID NO: 3505871 - RNA, 19 nt, Pseudomonas aeruginosa PA01
gccaggucgcgacugacca

SEQ ID NO: 3505872 - RNA, 15 nt, Pseudomonas aeruginosa PA01
gccaggucgcgcagg

SEQ ID NO: 3505873 - RNA, 18 nt, Pseudomonas aeruginosa PA01
gccaggucgcgcagggcc

SEQ ID NO: 3505874 - RNA, 14 nt, Pseudomonas aeruginosa PA01
gccaggucgcgggu

SEQ ID NO: 3505875 - RNA, 15 nt, Pseudomonas aeruginosa PA01
gccaggucgcgggug

SEQ ID NO: 3505876 - RNA, 19 nt, Pseudomonas aeruginosa PA01
gccaggucggagugcucga

SEQ ID NO: 3505877 - RNA, 11 nt, Pseudomonas aeruginosa PA01
gccaggucggu

SEQ ID NO: 3505878 - RNA, 18 nt, Pseudomonas aeruginosa PA01
gccaggucgguccgccga

SEQ ID NO: 3505879 - RNA, 19 nt, Pseudomonas aeruginosa PA01
gccaggucgguccgccgau

SEQ ID NO: 3505880 - RNA, 20 nt, Pseudomonas aeruginosa PA01
gccaggucgguccgccgaug

SEQ ID NO: 3505881 - RNA, 14 nt, Pseudomonas aeruginosa PA01
gccaggucgucgcg

SEQ ID NO: 3505882 - RNA, 15 nt, Pseudomonas aeruginosa PA01
gccaggucgucgcgc

SEQ ID NO: 3505883 - RNA, 16 nt, Pseudomonas aeruginosa PA01
gccaggucgucgcgcu

SEQ ID NO: 3505884 - RNA, 17 nt, Pseudomonas aeruginosa PA01
gccaggucgucgcgcuu

SEQ ID NO: 3505885 - RNA, 15 nt, Pseudomonas aeruginosa PA01
gccaggucguugcgc

SEQ ID NO: 3505886 - RNA, 17 nt, Pseudomonas aeruginosa PA01
gccaggucguugcgccg

SEQ ID NO: 3505887 - RNA, 19 nt, Pseudomonas aeruginosa PA01
gccaggucguugcgccggc

SEQ ID NO: 3505888 - RNA, 20 nt, Pseudomonas aeruginosa PA01
gccaggucguugcgccggcc

SEQ ID NO: 3505889 - RNA, 22 nt, Pseudomonas aeruginosa PA01
gccaggucguugcgccggccca

SEQ ID NO: 3505890 - RNA, 17 nt, Pseudomonas aeruginosa PA01
gccaggucuucuggaaa

SEQ ID NO: 3505891 - RNA, 15 nt, Pseudomonas aeruginosa PA01
gccaggugcaggaag

SEQ ID NO: 3505892 - RNA, 18 nt, Pseudomonas aeruginosa PA01
gccagguggcgggcaagg

SEQ ID NO: 3505893 - RNA, 23 nt, Pseudomonas aeruginosa PA01
gccagguggucgaucuccuccuc

SEQ ID NO: 3505894 - RNA, 14 nt, Pseudomonas aeruginosa PA01
gccagguggucgua

SEQ ID NO: 3505895 - RNA, 22 nt, Pseudomonas aeruginosa PA01
gccagguggucguagcaggucc

SEQ ID NO: 3505896 - RNA, 18 nt, Pseudomonas aeruginosa PA01
gccagguguucggccccg

SEQ ID NO: 3505897 - RNA, 21 nt, Pseudomonas aeruginosa PA01
gccagguucuugaugucagcg

SEQ ID NO: 3505898 - RNA, 19 nt, Pseudomonas aeruginosa PA01
gccagguugcgcaaccagc

SEQ ID NO: 3505899 - RNA, 20 nt, Pseudomonas aeruginosa PA01
gccagguugcgcaaccagcg

SEQ ID NO: 3505900 - RNA, 21 nt, Pseudomonas aeruginosa PA01
gccagguugcgcaaccagcgc

SEQ ID NO: 3505901 - RNA, 22 nt, Pseudomonas aeruginosa PA01
gccagguugcgcaaccagcgcu

SEQ ID NO: 3505902 - RNA, 22 nt, Pseudomonas aeruginosa PA01
gccagguugcguuccaacuggc

SEQ ID NO: 3505903 - RNA, 17 nt, Pseudomonas aeruginosa PA01
gccagguuggcaacugc

SEQ ID NO: 3505904 - RNA, 21 nt, Pseudomonas aeruginosa PA01
gccagguuuccggcagcacgu

SEQ ID NO: 3505905 - RNA, 18 nt, Pseudomonas aeruginosa PA01
gccaguaauggggaucgc

SEQ ID NO: 3505906 - RNA, 21 nt, Pseudomonas aeruginosa PA01
gccaguacuccgagggccgcg

SEQ ID NO: 3505907 - RNA, 17 nt, Pseudomonas aeruginosa PA01
gccaguaguccuccgcg

SEQ ID NO: 3505908 - RNA, 18 nt, Pseudomonas aeruginosa PA01
gccaguaguccuccgcgc

SEQ ID NO: 3505909 - RNA, 22 nt, Pseudomonas aeruginosa PA01
gccaguagucuuccugggagaa

SEQ ID NO: 3505910 - RNA, 19 nt, Pseudomonas aeruginosa PA01
gccagucauugcgcuccga

SEQ ID NO: 3505911 - RNA, 15 nt, Pseudomonas aeruginosa PA01
gccaguccacgacga

SEQ ID NO: 3505912 - RNA, 23 nt, Pseudomonas aeruginosa PA01
gccaguccacgacgaacggcgcu

SEQ ID NO: 3505913 - RNA, 20 nt, Pseudomonas aeruginosa PA01
gccagucccgcaaagcccgc

SEQ ID NO: 3505914 - RNA, 14 nt, Pseudomonas aeruginosa PA01
gccaguccggcagc

SEQ ID NO: 3505915 - RNA, 19 nt, Pseudomonas aeruginosa PA01
gccaguccggucagcagca

SEQ ID NO: 3505916 - RNA, 21 nt, Pseudomonas aeruginosa PA01
gccaguccggucagcagcagg

SEQ ID NO: 3505917 - RNA, 15 nt, Pseudomonas aeruginosa PA01
gccagucgagacgcc

SEQ ID NO: 3505918 - RNA, 19 nt, Pseudomonas aeruginosa PA01
gccagucgagacgccagcc

SEQ ID NO: 3505919 - RNA, 21 nt, Pseudomonas aeruginosa PA01
gccagucgagacgccagccgc

SEQ ID NO: 3505920 - RNA, 22 nt, Pseudomonas aeruginosa PA01
gccagucgagacgccagccgcc

SEQ ID NO: 3505921 - RNA, 23 nt, Pseudomonas aeruginosa PA01
gccagucggcggucuugaucacg

SEQ ID NO: 3505922 - RNA, 23 nt, Pseudomonas aeruginosa PA01
gccagugcagccguugccccaga

SEQ ID NO: 3505923 - RNA, 13 nt, Pseudomonas aeruginosa PA01
gccagugcaugcg

SEQ ID NO: 3505924 - RNA, 20 nt, Pseudomonas aeruginosa PA01
gccagugcaugcguucgccg

SEQ ID NO: 3505925 - RNA, 22 nt, Pseudomonas aeruginosa PA01
gccagugccucgcgcguggccg

SEQ ID NO: 3505926 - RNA, 23 nt, Pseudomonas aeruginosa PA01
gccagugccugcaccacgcaggc

SEQ ID NO: 3505927 - RNA, 20 nt, Pseudomonas aeruginosa PA01
gccaguuccggggucagcgc

SEQ ID NO: 3505928 - RNA, 16 nt, Pseudomonas aeruginosa PA01
gccaguuccuucgccg

SEQ ID NO: 3505929 - RNA, 18 nt, Pseudomonas aeruginosa PA01
gccaguucgagcagucgc

SEQ ID NO: 3505930 - RNA, 22 nt, Pseudomonas aeruginosa PA01
gccaguucgccggugacgcugc

SEQ ID NO: 3505931 - RNA, 15 nt, Pseudomonas aeruginosa PA01
gccaguucgcgcagg

SEQ ID NO: 3505932 - RNA, 16 nt, Pseudomonas aeruginosa PA01
gccaguucgcgcaggu

SEQ ID NO: 3505933 - RNA, 15 nt, Pseudomonas aeruginosa PA01
gccaguucgcggcgc

SEQ ID NO: 3505934 - RNA, 16 nt, Pseudomonas aeruginosa PA01
gccaguucgcggcgca

SEQ ID NO: 3505935 - RNA, 19 nt, Pseudomonas aeruginosa PA01
gccaguucgcggcgcaguu

SEQ ID NO: 3505936 - RNA, 14 nt, Pseudomonas aeruginosa PA01
gccaguucggccau

SEQ ID NO: 3505937 - RNA, 17 nt, Pseudomonas aeruginosa PA01
gccaguucggggucggc

SEQ ID NO: 3505938 - RNA, 16 nt, Pseudomonas aeruginosa PA01
gccaguucucgcagca

SEQ ID NO: 3505939 - RNA, 18 nt, Pseudomonas aeruginosa PA01
gccaguucucgcagcagg

SEQ ID NO: 3505940 - RNA, 21 nt, Pseudomonas aeruginosa PA01
gccaguuggaaguugccgcca

SEQ ID NO: 3505941 - RNA, 17 nt, Pseudomonas aeruginosa PA01
gccaguuggacgcggcc

SEQ ID NO: 3505942 - RNA, 18 nt, Pseudomonas aeruginosa PA01
gccaguuggacgcggccu

SEQ ID NO: 3505943 - RNA, 20 nt, Pseudomonas aeruginosa PA01
gccaguuggacgcggccugg

SEQ ID NO: 3505944 - RNA, 13 nt, Pseudomonas aeruginosa PA01
gccaguuggcccu

SEQ ID NO: 3505945 - RNA, 18 nt, Pseudomonas aeruginosa PA01
gccaguuggugcacgcgc

SEQ ID NO: 3505946 - RNA, 20 nt, Pseudomonas aeruginosa PA01
gccaguuggugcacgcgccg

SEQ ID NO: 3505947 - RNA, 22 nt, Pseudomonas aeruginosa PA01
gccaguuggugcacgcgccggg

SEQ ID NO: 3505948 - RNA, 13 nt, Pseudomonas aeruginosa PA01
gccaguuguuccg

SEQ ID NO: 3505949 - RNA, 18 nt, Pseudomonas aeruginosa PA01
gccaguuguuccggcugg

SEQ ID NO: 3505950 - RNA, 19 nt, Pseudomonas aeruginosa PA01
gccaguuguuccggcugga

SEQ ID NO: 3505951 - RNA, 22 nt, Pseudomonas aeruginosa PA01
gccauaauggccgcuacgcggc

SEQ ID NO: 3505952 - RNA, 14 nt, Pseudomonas aeruginosa PA01
gccauacagcgccc

SEQ ID NO: 3505953 - RNA, 16 nt, Pseudomonas aeruginosa PA01
gccauacucggacggc

SEQ ID NO: 3505954 - RNA, 21 nt, Pseudomonas aeruginosa PA01
gccauacucggacggcucgcg

SEQ ID NO: 3505955 - RNA, 22 nt, Pseudomonas aeruginosa PA01
gccauacucggacggcucgcgc

SEQ ID NO: 3505956 - RNA, 20 nt, Pseudomonas aeruginosa PA01
gccauagagugcccaggcgc

SEQ ID NO: 3505957 - RNA, 15 nt, Pseudomonas aeruginosa PA01
gccauagcgccggca

SEQ ID NO: 3505958 - RNA, 15 nt, Pseudomonas aeruginosa PA01
gccauagcgcgccgg

SEQ ID NO: 3505959 - RNA, 15 nt, Pseudomonas aeruginosa PA01
gccauaggccagcac

SEQ ID NO: 3505960 - RNA, 14 nt, Pseudomonas aeruginosa PA01
gccauaggcggcgc

SEQ ID NO: 3505961 - RNA, 21 nt, Pseudomonas aeruginosa PA01
gccauaggcuggaucgaucuc

SEQ ID NO: 3505962 - RNA, 16 nt, Pseudomonas aeruginosa PA01
gccauagugcugggcg

SEQ ID NO: 3505963 - RNA, 17 nt, Pseudomonas aeruginosa PA01
gccauagugcugggcga

SEQ ID NO: 3505964 - RNA, 20 nt, Pseudomonas aeruginosa PA01
gccauagugcugggcgaccu

SEQ ID NO: 3505965 - RNA, 22 nt, Pseudomonas aeruginosa PA01
gccauagugcugggcgaccuuc

SEQ ID NO: 3505966 - RNA, 16 nt, Pseudomonas aeruginosa PA01
gccaucaccagcggcg

SEQ ID NO: 3505967 - RNA, 21 nt, Pseudomonas aeruginosa PA01
gccaucaccagcggcgagcag

SEQ ID NO: 3505968 - RNA, 17 nt, Pseudomonas aeruginosa PA01
gccaucagcaccaggaa

SEQ ID NO: 3505969 - RNA, 20 nt, Pseudomonas aeruginosa PA01
gccaucagcaccaggaagcc

SEQ ID NO: 3505970 - RNA, 22 nt, Pseudomonas aeruginosa PA01
gccaucagcaccaggaagcccc

SEQ ID NO: 3505971 - RNA, 12 nt, Pseudomonas aeruginosa PA01
gccaucagcacg

SEQ ID NO: 3505972 - RNA, 17 nt, Pseudomonas aeruginosa PA01
gccaucagcacgaaagc

SEQ ID NO: 3505973 - RNA, 24 nt, Pseudomonas aeruginosa PA01
gccaucagcacgaaagccaugccc

SEQ ID NO: 3505974 - RNA, 22 nt, Pseudomonas aeruginosa PA01
gccaucagcacgucguccagcg

SEQ ID NO: 3505975 - RNA, 13 nt, Pseudomonas aeruginosa PA01
gccaucagcgcca

SEQ ID NO: 3505976 - RNA, 14 nt, Pseudomonas aeruginosa PA01
gccaucagcgccag

SEQ ID NO: 3505977 - RNA, 13 nt, Pseudomonas aeruginosa PA01
gccaucagcgccg

SEQ ID NO: 3505978 - RNA, 14 nt, Pseudomonas aeruginosa PA01
gccaucagcgccgc

SEQ ID NO: 3505979 - RNA, 16 nt, Pseudomonas aeruginosa PA01
gccaucagcgccgccu

SEQ ID NO: 3505980 - RNA, 18 nt, Pseudomonas aeruginosa PA01
gccaucagcgccgccucg

SEQ ID NO: 3505981 - RNA, 13 nt, Pseudomonas aeruginosa PA01
gccaucaggcccu

SEQ ID NO: 3505982 - RNA, 12 nt, Pseudomonas aeruginosa PA01
gccaucaggccg

SEQ ID NO: 3505983 - RNA, 18 nt, Pseudomonas aeruginosa PA01
gccaucaggccgcggccc

SEQ ID NO: 3505984 - RNA, 20 nt, Pseudomonas aeruginosa PA01
gccaucaggccgcggcccug

SEQ ID NO: 3505985 - RNA, 13 nt, Pseudomonas aeruginosa PA01
gccaucagggcga

SEQ ID NO: 3505986 - RNA, 16 nt, Pseudomonas aeruginosa PA01
gccaucagggucggcc

SEQ ID NO: 3505987 - RNA, 19 nt, Pseudomonas aeruginosa PA01
gccaucagggucggcccgg

SEQ ID NO: 3505988 - RNA, 13 nt, Pseudomonas aeruginosa PA01
gccauccagccag

SEQ ID NO: 3505989 - RNA, 16 nt, Pseudomonas aeruginosa PA01
gccauccagccaggcg

SEQ ID NO: 3505990 - RNA, 19 nt, Pseudomonas aeruginosa PA01
gccauccagccaggcgcuc

SEQ ID NO: 3505991 - RNA, 16 nt, Pseudomonas aeruginosa PA01
gccauccagcgccugg

SEQ ID NO: 3505992 - RNA, 21 nt, Pseudomonas aeruginosa PA01
gccauccauaucggccaccga

SEQ ID NO: 3505993 - RNA, 18 nt, Pseudomonas aeruginosa PA01
gccauccgcagucuucuc

SEQ ID NO: 3505994 - RNA, 14 nt, Pseudomonas aeruginosa PA01
gccauccgcccugc

SEQ ID NO: 3505995 - RNA, 23 nt, Pseudomonas aeruginosa PA01
gccauccgccuucuuuucuuccg

SEQ ID NO: 3505996 - RNA, 22 nt, Pseudomonas aeruginosa PA01
gccauccgcgccgaccagccgc

SEQ ID NO: 3505997 - RNA, 12 nt, Pseudomonas aeruginosa PA01
gccauccuccag

SEQ ID NO: 3505998 - RNA, 17 nt, Pseudomonas aeruginosa PA01
gccauccuccagcgccg

SEQ ID NO: 3505999 - RNA, 13 nt, Pseudomonas aeruginosa PA01
gccauccuccgag

SEQ ID NO: 3506000 - RNA, 17 nt, Pseudomonas aeruginosa PA01
gccauccuccgaggcca

SEQ ID NO: 3506001 - RNA, 18 nt, Pseudomonas aeruginosa PA01
gccauccuggccggucgu

SEQ ID NO: 3506002 - RNA, 16 nt, Pseudomonas aeruginosa PA01
gccauccuucggcgug

SEQ ID NO: 3506003 - RNA, 14 nt, Pseudomonas aeruginosa PA01
gccauccuugaguu

SEQ ID NO: 3506004 - RNA, 17 nt, Pseudomonas aeruginosa PA01
gccaucgaaaucgccca

SEQ ID NO: 3506005 - RNA, 20 nt, Pseudomonas aeruginosa PA01
gccaucgaaaucgcccacca

SEQ ID NO: 3506006 - RNA, 22 nt, Pseudomonas aeruginosa PA01
gccaucgaaaucgcccaccagg

SEQ ID NO: 3506007 - RNA, 13 nt, Pseudomonas aeruginosa PA01
gccaucgaccagg

SEQ ID NO: 3506008 - RNA, 14 nt, Pseudomonas aeruginosa PA01
gccaucgaccagga

SEQ ID NO: 3506009 - RNA, 22 nt, Pseudomonas aeruginosa PA01
gccaucgaccaggaauuccugg

SEQ ID NO: 3506010 - RNA, 15 nt, Pseudomonas aeruginosa PA01
gccaucgagcgcucc

SEQ ID NO: 3506011 - RNA, 23 nt, Pseudomonas aeruginosa PA01
gccaucgagcgcuccaccgcgcu

SEQ ID NO: 3506012 - RNA, 17 nt, Pseudomonas aeruginosa PA01
gccaucgaggccaggcc

SEQ ID NO: 3506013 - RNA, 18 nt, Pseudomonas aeruginosa PA01
gccaucgaggccaggccg

SEQ ID NO: 3506014 - RNA, 16 nt, Pseudomonas aeruginosa PA01
gccaucgaucagcagc

SEQ ID NO: 3506015 - RNA, 23 nt, Pseudomonas aeruginosa PA01
gccaucgaucagcagcgccacgc

SEQ ID NO: 3506016 - RNA, 21 nt, Pseudomonas aeruginosa PA01
gccaucgauggucacuggcga

SEQ ID NO: 3506017 - RNA, 17 nt, Pseudomonas aeruginosa PA01
gccaucgcauagccggc

SEQ ID NO: 3506018 - RNA, 18 nt, Pseudomonas aeruginosa PA01
gccaucgcauagccggcg

SEQ ID NO: 3506019 - RNA, 19 nt, Pseudomonas aeruginosa PA01
gccaucgcauagccggcgc

SEQ ID NO: 3506020 - RNA, 14 nt, Pseudomonas aeruginosa PA01
gccaucgccggccc

SEQ ID NO: 3506021 - RNA, 20 nt, Pseudomonas aeruginosa PA01
gccaucgccggcccgcgcgg

SEQ ID NO: 3506022 - RNA, 17 nt, Pseudomonas aeruginosa PA01
gccaucgccucgccggc

SEQ ID NO: 3506023 - RNA, 19 nt, Pseudomonas aeruginosa PA01
gccaucgccucgccggcca

SEQ ID NO: 3506024 - RNA, 16 nt, Pseudomonas aeruginosa PA01
gccaucgcuuuccugg

SEQ ID NO: 3506025 - RNA, 19 nt, Pseudomonas aeruginosa PA01
gccaucgcuuuccuggccg

SEQ ID NO: 3506026 - RNA, 21 nt, Pseudomonas aeruginosa PA01
gccaucgcuuuccuggccgac

SEQ ID NO: 3506027 - RNA, 22 nt, Pseudomonas aeruginosa PA01
gccaucgcuuuccuggccgacc

SEQ ID NO: 3506028 - RNA, 22 nt, Pseudomonas aeruginosa PA01
gccaucggcgguacgcccucca

SEQ ID NO: 3506029 - RNA, 16 nt, Pseudomonas aeruginosa PA01
gccaucggucgcgccc

SEQ ID NO: 3506030 - RNA, 18 nt, Pseudomonas aeruginosa PA01
gccaucggucgcgccccc

SEQ ID NO: 3506031 - RNA, 16 nt, Pseudomonas aeruginosa PA01
gccaucuggcugccga

SEQ ID NO: 3506032 - RNA, 17 nt, Pseudomonas aeruginosa PA01
gccaucuggcugccgag

SEQ ID NO: 3506033 - RNA, 14 nt, Pseudomonas aeruginosa PA01
gccaucuuccugug

SEQ ID NO: 3506034 - RNA, 23 nt, Pseudomonas aeruginosa PA01
gccaucuuccugugcgaggcugg

SEQ ID NO: 3506035 - RNA, 12 nt, Pseudomonas aeruginosa PA01
gccaucuucucg

SEQ ID NO: 3506036 - RNA, 18 nt, Pseudomonas aeruginosa PA01
gccaucuucucgaagcgc

SEQ ID NO: 3506037 - RNA, 16 nt, Pseudomonas aeruginosa PA01
gccaugaaaaagccgg

SEQ ID NO: 3506038 - RNA, 19 nt, Pseudomonas aeruginosa PA01
gccaugaaaaagccgggau

SEQ ID NO: 3506039 - RNA, 17 nt, Pseudomonas aeruginosa PA01
gccaugacacaccacgc

SEQ ID NO: 3506040 - RNA, 15 nt, Pseudomonas aeruginosa PA01
gccaugacccgcggc

SEQ ID NO: 3506041 - RNA, 16 nt, Pseudomonas aeruginosa PA01
gccaugacccgcggca

SEQ ID NO: 3506042 - RNA, 17 nt, Pseudomonas aeruginosa PA01
gccaugaccucggccag

SEQ ID NO: 3506043 - RNA, 18 nt, Pseudomonas aeruginosa PA01
gccaugaccucggccagc

SEQ ID NO: 3506044 - RNA, 14 nt, Pseudomonas aeruginosa PA01
gccaugagccgggg

SEQ ID NO: 3506045 - RNA, 11 nt, Pseudomonas aeruginosa PA01
gccaugagguu

SEQ ID NO: 3506046 - RNA, 18 nt, Pseudomonas aeruginosa PA01
gccaugagguuggccacg

SEQ ID NO: 3506047 - RNA, 19 nt, Pseudomonas aeruginosa PA01
gccaugagguuggccacgu

SEQ ID NO: 3506048 - RNA, 14 nt, Pseudomonas aeruginosa PA01
gccaugaucaucgc

SEQ ID NO: 3506049 - RNA, 19 nt, Pseudomonas aeruginosa PA01
gccaugaucaucgccugcu

SEQ ID NO: 3506050 - RNA, 18 nt, Pseudomonas aeruginosa PA01
gccaugaugugcgcaggc

SEQ ID NO: 3506051 - RNA, 19 nt, Pseudomonas aeruginosa PA01
gccaugaugugcgcaggcu

SEQ ID NO: 3506052 - RNA, 21 nt, Pseudomonas aeruginosa PA01
gccaugaugugcgcaggcugg

SEQ ID NO: 3506053 - RNA, 18 nt, Pseudomonas aeruginosa PA01
gccaugcaagaacgccga

SEQ ID NO: 3506054 - RNA, 21 nt, Pseudomonas aeruginosa PA01
gccaugcacacgcucccaaca

SEQ ID NO: 3506055 - RNA, 13 nt, Pseudomonas aeruginosa PA01
gccaugcaggcca

SEQ ID NO: 3506056 - RNA, 14 nt, Pseudomonas aeruginosa PA01
gccaugcaggccag

SEQ ID NO: 3506057 - RNA, 15 nt, Pseudomonas aeruginosa PA01
gccaugcaggccagg

SEQ ID NO: 3506058 - RNA, 16 nt, Pseudomonas aeruginosa PA01
gccaugcaggccaggg

SEQ ID NO: 3506059 - RNA, 15 nt, Pseudomonas aeruginosa PA01
gccaugcaggcugcc

SEQ ID NO: 3506060 - RNA, 16 nt, Pseudomonas aeruginosa PA01
gccaugcaggcugccg

SEQ ID NO: 3506061 - RNA, 16 nt, Pseudomonas aeruginosa PA01
gccaugcccagacgcc

SEQ ID NO: 3506062 - RNA, 19 nt, Pseudomonas aeruginosa PA01
gccaugcccagacgccgcu

SEQ ID NO: 3506063 - RNA, 20 nt, Pseudomonas aeruginosa PA01
gccaugcccagacgccgcuc

SEQ ID NO: 3506064 - RNA, 15 nt, Pseudomonas aeruginosa PA01
gccaugcccggcugg

SEQ ID NO: 3506065 - RNA, 18 nt, Pseudomonas aeruginosa PA01
gccaugcccggcuggcgu

SEQ ID NO: 3506066 - RNA, 18 nt, Pseudomonas aeruginosa PA01
gccaugccgccgacgccg

SEQ ID NO: 3506067 - RNA, 17 nt, Pseudomonas aeruginosa PA01
gccaugccggccaggaa

SEQ ID NO: 3506068 - RNA, 15 nt, Pseudomonas aeruginosa PA01
gccaugccggcgccg

SEQ ID NO: 3506069 - RNA, 17 nt, Pseudomonas aeruginosa PA01
gccaugccguucaggcc

SEQ ID NO: 3506070 - RNA, 20 nt, Pseudomonas aeruginosa PA01
gccaugccguucaggccggc

SEQ ID NO: 3506071 - RNA, 22 nt, Pseudomonas aeruginosa PA01
gccaugccguucaggccggcgc

SEQ ID NO: 3506072 - RNA, 13 nt, Pseudomonas aeruginosa PA01
gccaugcgcccgc

SEQ ID NO: 3506073 - RNA, 14 nt, Pseudomonas aeruginosa PA01
gccaugcgcccgcu

SEQ ID NO: 3506074 - RNA, 19 nt, Pseudomonas aeruginosa PA01
gccaugcgcucggggucgu

SEQ ID NO: 3506075 - RNA, 16 nt, Pseudomonas aeruginosa PA01
gccaugcggcaggccu

SEQ ID NO: 3506076 - RNA, 13 nt, Pseudomonas aeruginosa PA01
gccaugcucggcc

SEQ ID NO: 3506077 - RNA, 14 nt, Pseudomonas aeruginosa PA01
gccaugcucggcca

SEQ ID NO: 3506078 - RNA, 15 nt, Pseudomonas aeruginosa PA01
gccaugcucggccag

SEQ ID NO: 3506079 - RNA, 14 nt, Pseudomonas aeruginosa PA01
gccaugcucuucag

SEQ ID NO: 3506080 - RNA, 19 nt, Pseudomonas aeruginosa PA01
gccaugcucuucaggcugu

SEQ ID NO: 3506081 - RNA, 22 nt, Pseudomonas aeruginosa PA01
gccaugcucuucaggcugucgg

SEQ ID NO: 3506082 - RNA, 13 nt, Pseudomonas aeruginosa PA01
gccaugcuggcgc

SEQ ID NO: 3506083 - RNA, 16 nt, Pseudomonas aeruginosa PA01
gccaugcuggcgcucu

SEQ ID NO: 3506084 - RNA, 21 nt, Pseudomonas aeruginosa PA01
gccauggaucaccagggucgg

SEQ ID NO: 3506085 - RNA, 14 nt, Pseudomonas aeruginosa PA01
gccauggcaucccc

SEQ ID NO: 3506086 - RNA, 14 nt, Pseudomonas aeruginosa PA01
gccauggccgcuga

SEQ ID NO: 3506087 - RNA, 15 nt, Pseudomonas aeruginosa PA01
gcagucgccgccagu

SEQ ID NO: 3506088 - RNA, 16 nt, Pseudomonas aeruginosa PA01
gcagucgccuggcccu

SEQ ID NO: 3506089 - RNA, 14 nt, Pseudomonas aeruginosa PA01
gcagucgcggcccu

SEQ ID NO: 3506090 - RNA, 21 nt, Pseudomonas aeruginosa PA01
gcagucgguagaaauccuccg

SEQ ID NO: 3506091 - RNA, 17 nt, Pseudomonas aeruginosa PA01
gcagucgucgcagccga

SEQ ID NO: 3506092 - RNA, 13 nt, Pseudomonas aeruginosa PA01
gcagugccgggcg

SEQ ID NO: 3506093 - RNA, 17 nt, Pseudomonas aeruginosa PA01
gcagugcgcccucgaac

SEQ ID NO: 3506094 - RNA, 20 nt, Pseudomonas aeruginosa PA01
gcagugcgcccucgaacggc

SEQ ID NO: 3506095 - RNA, 14 nt, Pseudomonas aeruginosa PA01
gcagugcgccggca

SEQ ID NO: 3506096 - RNA, 14 nt, Pseudomonas aeruginosa PA01
gcagugcggggcgc

SEQ ID NO: 3506097 - RNA, 16 nt, Pseudomonas aeruginosa PA01
gcagugcggggcgcuc

SEQ ID NO: 3506098 - RNA, 20 nt, Pseudomonas aeruginosa PA01
gcagugcggggcgcucgccc

SEQ ID NO: 3506099 - RNA, 19 nt, Pseudomonas aeruginosa PA01
gcaguggcgccagccagcc

SEQ ID NO: 3506100 - RNA, 20 nt, Pseudomonas aeruginosa PA01
gcaguggcgccagccagccc

SEQ ID NO: 3506101 - RNA, 13 nt, Pseudomonas aeruginosa PA01
gcagugggaagcu

SEQ ID NO: 3506102 - RNA, 15 nt, Pseudomonas aeruginosa PA01
gcagugugcaccgag

SEQ ID NO: 3506103 - RNA, 16 nt, Pseudomonas aeruginosa PA01
gcagugugcaccgagu

SEQ ID NO: 3506104 - RNA, 16 nt, Pseudomonas aeruginosa PA01
gcagugugccgcccug

SEQ ID NO: 3506105 - RNA, 18 nt, Pseudomonas aeruginosa PA01
gcagugugccgcccugcu

SEQ ID NO: 3506106 - RNA, 13 nt, Pseudomonas aeruginosa PA01
gcaguuccaggcg

SEQ ID NO: 3506107 - RNA, 15 nt, Pseudomonas aeruginosa PA01
gcaguuccaggcguc

SEQ ID NO: 3506108 - RNA, 17 nt, Pseudomonas aeruginosa PA01
gcaguuccaggcgugcu

SEQ ID NO: 3506109 - RNA, 20 nt, Pseudomonas aeruginosa PA01
gcaguuccucgccgcugcug

SEQ ID NO: 3506110 - RNA, 16 nt, Pseudomonas aeruginosa PA01
gcaguucgaccuccag

SEQ ID NO: 3506111 - RNA, 15 nt, Pseudomonas aeruginosa PA01
gcaguucgccccgcc

SEQ ID NO: 3506112 - RNA, 16 nt, Pseudomonas aeruginosa PA01
gcaguucgccccgccg

SEQ ID NO: 3506113 - RNA, 13 nt, Pseudomonas aeruginosa PA01
gcaguucgcccgg

SEQ ID NO: 3506114 - RNA, 14 nt, Pseudomonas aeruginosa PA01
gcaguucgccgccg

SEQ ID NO: 3506115 - RNA, 17 nt, Pseudomonas aeruginosa PA01
gcaguucgccgccgagc

SEQ ID NO: 3506116 - RNA, 18 nt, Pseudomonas aeruginosa PA01
gcaguucgccgccgagcg

SEQ ID NO: 3506117 - RNA, 17 nt, Pseudomonas aeruginosa PA01
gcaguucgcgggccgcg

SEQ ID NO: 3506118 - RNA, 23 nt, Pseudomonas aeruginosa PA01
gcaguucguccaucgccaggcca

SEQ ID NO: 3506119 - RNA, 12 nt, Pseudomonas aeruginosa PA01
gcaguucgucgc

SEQ ID NO: 3506120 - RNA, 14 nt, Pseudomonas aeruginosa PA01
gcaguucgucgcca

SEQ ID NO: 3506121 - RNA, 23 nt, Pseudomonas aeruginosa PA01
gcaguucgucgccacgcccgccg

SEQ ID NO: 3506122 - RNA, 13 nt, Pseudomonas aeruginosa PA01
gcaguugcaacag

SEQ ID NO: 3506123 - RNA, 14 nt, Pseudomonas aeruginosa PA01
gcaguugcaacagc

SEQ ID NO: 3506124 - RNA, 14 nt, Pseudomonas aeruginosa PA01
gcaguugccaggag

SEQ ID NO: 3506125 - RNA, 16 nt, Pseudomonas aeruginosa PA01
gcauaaccgcucgcgg

SEQ ID NO: 3506126 - RNA, 12 nt, Pseudomonas aeruginosa PA01
gcauaaccgcuu

SEQ ID NO: 3506127 - RNA, 16 nt, Pseudomonas aeruginosa PA01
gcauaaccgcuugcgg

SEQ ID NO: 3506128 - RNA, 18 nt, Pseudomonas aeruginosa PA01
gcauaaccgucgcuggag

SEQ ID NO: 3506129 - RNA, 19 nt, Pseudomonas aeruginosa PA01
gcauacgaaaacggcccuc

SEQ ID NO: 3506130 - RNA, 17 nt, Pseudomonas aeruginosa PA01
gcauagaugucgaaguc

SEQ ID NO: 3506131 - RNA, 23 nt, Pseudomonas aeruginosa PA01
gcauagcagaugucguucuugcg

SEQ ID NO: 3506132 - RNA, 19 nt, Pseudomonas aeruginosa PA01
gcauagcaggccuggagcg

SEQ ID NO: 3506133 - RNA, 16 nt, Pseudomonas aeruginosa PA01
gcauagccaccgccga

SEQ ID NO: 3506134 - RNA, 15 nt, Pseudomonas aeruginosa PA01
gcauagccggcgcgc

SEQ ID NO: 3506135 - RNA, 16 nt, Pseudomonas aeruginosa PA01
gcauagccggcgcgcc

SEQ ID NO: 3506136 - RNA, 19 nt, Pseudomonas aeruginosa PA01
gcauagccggcgcgcccgg

SEQ ID NO: 3506137 - RNA, 16 nt, Pseudomonas aeruginosa PA01
gcauagcgcagccgcu

SEQ ID NO: 3506138 - RNA, 22 nt, Pseudomonas aeruginosa PA01
gcauagcgcgcuguagccggcg

SEQ ID NO: 3506139 - RNA, 14 nt, Pseudomonas aeruginosa PA01
gcauagcugaucuc

SEQ ID NO: 3506140 - RNA, 19 nt, Pseudomonas aeruginosa PA01
gcauagcugaucucggcga

SEQ ID NO: 3506141 - RNA, 18 nt, Pseudomonas aeruginosa PA01
gcauaggaggcgcuuucc

SEQ ID NO: 3506142 - RNA, 14 nt, Pseudomonas aeruginosa PA01
gcauaggcccggcg

SEQ ID NO: 3506143 - RNA, 15 nt, Pseudomonas aeruginosa PA01
gcauaggccugggcg

SEQ ID NO: 3506144 - RNA, 16 nt, Pseudomonas aeruginosa PA01
gcauaggccugggcgu

SEQ ID NO: 3506145 - RNA, 22 nt, Pseudomonas aeruginosa PA01
gcauaggguccaguucagggcg

SEQ ID NO: 3506146 - RNA, 16 nt, Pseudomonas aeruginosa PA01
gcauaggucaugccca

SEQ ID NO: 3506147 - RNA, 18 nt, Pseudomonas aeruginosa PA01
gcauaggucaugcccagg

SEQ ID NO: 3506148 - RNA, 19 nt, Pseudomonas aeruginosa PA01
gcauaggucaugcccaggc

SEQ ID NO: 3506149 - RNA, 21 nt, Pseudomonas aeruginosa PA01
gcauauccccucucaacaccc

SEQ ID NO: 3506150 - RNA, 19 nt, Pseudomonas aeruginosa PA01
gcauauucuucaacagcgu

SEQ ID NO: 3506151 - RNA, 12 nt, Pseudomonas aeruginosa PA01
gcaucaccaccg

SEQ ID NO: 3506152 - RNA, 13 nt, Pseudomonas aeruginosa PA01
gcaucaccaggcu

SEQ ID NO: 3506153 - RNA, 17 nt, Pseudomonas aeruginosa PA01
gcaucaccccgcaaccg

SEQ ID NO: 3506154 - RNA, 20 nt, Pseudomonas aeruginosa PA01
gcaucaccccgcaaccgcag

SEQ ID NO: 3506155 - RNA, 13 nt, Pseudomonas aeruginosa PA01
gcaucaccgcggu

SEQ ID NO: 3506156 - RNA, 21 nt, Pseudomonas aeruginosa PA01
gcaucaccgcgguggaggcgg

SEQ ID NO: 3506157 - RNA, 23 nt, Pseudomonas aeruginosa PA01
gcaucaccgcgguggaggcggcg

SEQ ID NO: 3506158 - RNA, 22 nt, Pseudomonas aeruginosa PA01
gcaucaccggcagcagcggauc

SEQ ID NO: 3506159 - RNA, 23 nt, Pseudomonas aeruginosa PA01
gcaucaccggcgggauguacgcc

SEQ ID NO: 3506160 - RNA, 23 nt, Pseudomonas aeruginosa PA01
gcaucaccuugcggaacccgcgc

SEQ ID NO: 3506161 - RNA, 22 nt, Pseudomonas aeruginosa PA01
gcaucagcaauuccgcagccuu

SEQ ID NO: 3506162 - RNA, 13 nt, Pseudomonas aeruginosa PA01
gcaucagcaggaa

SEQ ID NO: 3506163 - RNA, 21 nt, Pseudomonas aeruginosa PA01
gcaucagccgcgacgacugcg

SEQ ID NO: 3506164 - RNA, 22 nt, Pseudomonas aeruginosa PA01
gcaucagccuggccagcgucgc

SEQ ID NO: 3506165 - RNA, 16 nt, Pseudomonas aeruginosa PA01
gcaucagcgccgguuc

SEQ ID NO: 3506166 - RNA, 15 nt, Pseudomonas aeruginosa PA01
gcaucaggccaaagc

SEQ ID NO: 3506167 - RNA, 13 nt, Pseudomonas aeruginosa PA01
gcaucaggcgcuc

SEQ ID NO: 3506168 - RNA, 12 nt, Pseudomonas aeruginosa PA01
gcaucaggucgg

SEQ ID NO: 3506169 - RNA, 17 nt, Pseudomonas aeruginosa PA01
gcaucaggucggcgcgc

SEQ ID NO: 3506170 - RNA, 20 nt, Pseudomonas aeruginosa PA01
gcaucaggucggcgcgcacc

SEQ ID NO: 3506171 - RNA, 23 nt, Pseudomonas aeruginosa PA01
gcaucaggucggcgcgcaccugu

SEQ ID NO: 3506172 - RNA, 23 nt, Pseudomonas aeruginosa PA01
gcaucaggucggucuggcggccc

SEQ ID NO: 3506173 - RNA, 22 nt, Pseudomonas aeruginosa PA01
gcaucaguagcgggcauccagc

SEQ ID NO: 3506174 - RNA, 15 nt, Pseudomonas aeruginosa PA01
gcauccacagggucg

SEQ ID NO: 3506175 - RNA, 19 nt, Pseudomonas aeruginosa PA01
gcauccacagggucggcag

SEQ ID NO: 3506176 - RNA, 20 nt, Pseudomonas aeruginosa PA01
gcauccacagggucggcagg

SEQ ID NO: 3506177 - RNA, 23 nt, Pseudomonas aeruginosa PA01
gcauccagcgauacaccugcaac

SEQ ID NO: 3506178 - RNA, 14 nt, Pseudomonas aeruginosa PA01
gcauccagggucgc

SEQ ID NO: 3506179 - RNA, 18 nt, Pseudomonas aeruginosa PA01
gcauccaguuccugcacc

SEQ ID NO: 3506180 - RNA, 15 nt, Pseudomonas aeruginosa PA01
gcauccaucgccagu

SEQ ID NO: 3506181 - RNA, 17 nt, Pseudomonas aeruginosa PA01
gcauccaucgccaguug

SEQ ID NO: 3506182 - RNA, 15 nt, Pseudomonas aeruginosa PA01
gcaucccaguagccg

SEQ ID NO: 3506183 - RNA, 23 nt, Pseudomonas aeruginosa PA01
gcaucccaguagccggucaggcg

SEQ ID NO: 3506184 - RNA, 20 nt, Pseudomonas aeruginosa PA01
gcauccccuuuuuucagccu

SEQ ID NO: 3506185 - RNA, 20 nt, Pseudomonas aeruginosa PA01
gcaucccuuuuucauucucc

SEQ ID NO: 3506186 - RNA, 20 nt, Pseudomonas aeruginosa PA01
gcauccggcucgacgccgac

SEQ ID NO: 3506187 - RNA, 23 nt, Pseudomonas aeruginosa PA01
gcauccgugcgaacacaccgacc

SEQ ID NO: 3506188 - RNA, 14 nt, Pseudomonas aeruginosa PA01
gcauccucgccccg

SEQ ID NO: 3506189 - RNA, 20 nt, Pseudomonas aeruginosa PA01
gcauccucgccccgccggga

SEQ ID NO: 3506190 - RNA, 21 nt, Pseudomonas aeruginosa PA01
gcauccucgcgguucugcucc

SEQ ID NO: 3506191 - RNA, 16 nt, Pseudomonas aeruginosa PA01
gcauccucggcaucca

SEQ ID NO: 3506192 - RNA, 22 nt, Pseudomonas aeruginosa PA01
gcauccucguuccacgggucgc

SEQ ID NO: 3506193 - RNA, 13 nt, Pseudomonas aeruginosa PA01
gcauccugccgcc

SEQ ID NO: 3506194 - RNA, 18 nt, Pseudomonas aeruginosa PA01
gcauccuguggcugcagg

SEQ ID NO: 3506195 - RNA, 19 nt, Pseudomonas aeruginosa PA01
gcauccuguggcugcaggu

SEQ ID NO: 3506196 - RNA, 13 nt, Pseudomonas aeruginosa PA01
gcauccuucuucu

SEQ ID NO: 3506197 - RNA, 19 nt, Pseudomonas aeruginosa PA01
gcauccuuuuuccgaccuu

SEQ ID NO: 3506198 - RNA, 13 nt, Pseudomonas aeruginosa PA01
gcaucgaaggcgc

SEQ ID NO: 3506199 - RNA, 15 nt, Pseudomonas aeruginosa PA01
gcaucgaaggcgccg

SEQ ID NO: 3506200 - RNA, 18 nt, Pseudomonas aeruginosa PA01
gcaucgaaggcgccggca

SEQ ID NO: 3506201 - RNA, 13 nt, Pseudomonas aeruginosa PA01
gcaucgaccaggg

SEQ ID NO: 3506202 - RNA, 15 nt, Pseudomonas aeruginosa PA01
gcaucgaccagggcc

SEQ ID NO: 3506203 - RNA, 21 nt, Pseudomonas aeruginosa PA01
gcaucgaccagggccgggucg

SEQ ID NO: 3506204 - RNA, 22 nt, Pseudomonas aeruginosa PA01
gcaucgacgauguacugcucgg

SEQ ID NO: 3506205 - RNA, 13 nt, Pseudomonas aeruginosa PA01
gcaucgacgccag

SEQ ID NO: 3506206 - RNA, 17 nt, Pseudomonas aeruginosa PA01
gcaucgacgccagcggc

SEQ ID NO: 3506207 - RNA, 19 nt, Pseudomonas aeruginosa PA01
gcaucgacgccagcggcga

SEQ ID NO: 3506208 - RNA, 20 nt, Pseudomonas aeruginosa PA01
gcaucgacgccagcggcgau

SEQ ID NO: 3506209 - RNA, 15 nt, Pseudomonas aeruginosa PA01
gcaucgacggggcgu

SEQ ID NO: 3506210 - RNA, 20 nt, Pseudomonas aeruginosa PA01
gcaucgaggccgcccagcgc

SEQ ID NO: 3506211 - RNA, 21 nt, Pseudomonas aeruginosa PA01
gcaucgaggccgcccagcgca

SEQ ID NO: 3506212 - RNA, 22 nt, Pseudomonas aeruginosa PA01
gcaucgaggccggcaugcaggu

SEQ ID NO: 3506213 - RNA, 15 nt, Pseudomonas aeruginosa PA01
gcaucgauccgcacc

SEQ ID NO: 3506214 - RNA, 21 nt, Pseudomonas aeruginosa PA01
gcaucgauccgcacccgggca

SEQ ID NO: 3506215 - RNA, 17 nt, Pseudomonas aeruginosa PA01
gcaucgcaucggcgacc

SEQ ID NO: 3506216 - RNA, 22 nt, Pseudomonas aeruginosa PA01
gcaucgccgaccacuuccaggu

SEQ ID NO: 3506217 - RNA, 17 nt, Pseudomonas aeruginosa PA01
gcaucgccgcccaguug

SEQ ID NO: 3506218 - RNA, 17 nt, Pseudomonas aeruginosa PA01
gcaucgccggcagcgcc

SEQ ID NO: 3506219 - RNA, 13 nt, Pseudomonas aeruginosa PA01
gcaucgccggggc

SEQ ID NO: 3506220 - RNA, 14 nt, Pseudomonas aeruginosa PA01
gcaucgccggggcu

SEQ ID NO: 3506221 - RNA, 19 nt, Pseudomonas aeruginosa PA01
gcaucgccugggccggcgu

SEQ ID NO: 3506222 - RNA, 21 nt, Pseudomonas aeruginosa PA01
gcaucgcgcacaugccgagcg

SEQ ID NO: 3506223 - RNA, 20 nt, Pseudomonas aeruginosa PA01
gcaucgcgggcgugcuccag

SEQ ID NO: 3506224 - RNA, 22 nt, Pseudomonas aeruginosa PA01
gcaucgcgggcgugcuccagca

SEQ ID NO: 3506225 - RNA, 14 nt, Pseudomonas aeruginosa PA01
gcaucgcucgcaac

SEQ ID NO: 3506226 - RNA, 15 nt, Pseudomonas aeruginosa PA01
gcaucgcucgcaacg

SEQ ID NO: 3506227 - RNA, 14 nt, Pseudomonas aeruginosa PA01
gcaucgcugaccuc

SEQ ID NO: 3506228 - RNA, 16 nt, Pseudomonas aeruginosa PA01
gcaucggagaccacgg

SEQ ID NO: 3506229 - RNA, 11 nt, Pseudomonas aeruginosa PA01
gcaucggccac

SEQ ID NO: 3506230 - RNA, 14 nt, Pseudomonas aeruginosa PA01
gcaucggccaccuu

SEQ ID NO: 3506231 - RNA, 23 nt, Pseudomonas aeruginosa PA01
gcaucggccaccuucgcccgcug

SEQ ID NO: 3506232 - RNA, 22 nt, Pseudomonas aeruginosa PA01
gcaucggccauucggccuggca

SEQ ID NO: 3506233 - RNA, 23 nt, Pseudomonas aeruginosa PA01
gcaucggccgacagagcggccgg

SEQ ID NO: 3506234 - RNA, 15 nt, Pseudomonas aeruginosa PA01
gcaucggccgccagg

SEQ ID NO: 3506235 - RNA, 16 nt, Pseudomonas aeruginosa PA01
gcaucggccgccaggc

SEQ ID NO: 3506236 - RNA, 12 nt, Pseudomonas aeruginosa PA01
gcaucggccggg

SEQ ID NO: 3506237 - RNA, 13 nt, Pseudomonas aeruginosa PA01
gcaucggccuggu

SEQ ID NO: 3506238 - RNA, 14 nt, Pseudomonas aeruginosa PA01
gcaucggcgaccuu

SEQ ID NO: 3506239 - RNA, 16 nt, Pseudomonas aeruginosa PA01
gcaucggcgccgcgca

SEQ ID NO: 3506240 - RNA, 12 nt, Pseudomonas aeruginosa PA01
gcaucggcgccu

SEQ ID NO: 3506241 - RNA, 14 nt, Pseudomonas aeruginosa PA01
gcaucggcgccucc

SEQ ID NO: 3506242 - RNA, 21 nt, Pseudomonas aeruginosa PA01
gcaucggcgccucccaggguc

SEQ ID NO: 3506243 - RNA, 16 nt, Pseudomonas aeruginosa PA01
gcaucggcgcgccgaa

SEQ ID NO: 3506244 - RNA, 15 nt, Pseudomonas aeruginosa PA01
gcaucggcgcggccu

SEQ ID NO: 3506245 - RNA, 16 nt, Pseudomonas aeruginosa PA01
gcaucggcgcggccuu

SEQ ID NO: 3506246 - RNA, 17 nt, Pseudomonas aeruginosa PA01
gcaucggcgcggccuuc

SEQ ID NO: 3506247 - RNA, 16 nt, Pseudomonas aeruginosa PA01
gcaucggugaccuggu

SEQ ID NO: 3506248 - RNA, 15 nt, Pseudomonas aeruginosa PA01
gcaucggugccggca

SEQ ID NO: 3506249 - RNA, 17 nt, Pseudomonas aeruginosa PA01
gcaucggugccggcagg

SEQ ID NO: 3506250 - RNA, 20 nt, Pseudomonas aeruginosa PA01
gcaucggugccggcaggccu

SEQ ID NO: 3506251 - RNA, 19 nt, Pseudomonas aeruginosa PA01
gcaucgucgaaacgcuggc

SEQ ID NO: 3506252 - RNA, 21 nt, Pseudomonas aeruginosa PA01
gcaucgucgaaacgcuggcgg

SEQ ID NO: 3506253 - RNA, 15 nt, Pseudomonas aeruginosa PA01
gcaucgucgaagggc

SEQ ID NO: 3506254 - RNA, 14 nt, Pseudomonas aeruginosa PA01
gcaucgugcagcca

SEQ ID NO: 3506255 - RNA, 13 nt, Pseudomonas aeruginosa PA01
gcaucgugccgcg

SEQ ID NO: 3506256 - RNA, 15 nt, Pseudomonas aeruginosa PA01
gcaucgugccgcgga

SEQ ID NO: 3506257 - RNA, 19 nt, Pseudomonas aeruginosa PA01
gcaucgugcuucucaccga

SEQ ID NO: 3506258 - RNA, 18 nt, Pseudomonas aeruginosa PA01
gcaucguuguaggccaug

SEQ ID NO: 3506259 - RNA, 13 nt, Pseudomonas aeruginosa PA01
gcaucuccccacc

SEQ ID NO: 3506260 - RNA, 21 nt, Pseudomonas aeruginosa PA01
gcaucuccccaccaacucagu

SEQ ID NO: 3506261 - RNA, 17 nt, Pseudomonas aeruginosa PA01
gcaucuccggcaccgug

SEQ ID NO: 3506262 - RNA, 13 nt, Pseudomonas aeruginosa PA01
gcaucucgauggu

SEQ ID NO: 3506263 - RNA, 12 nt, Pseudomonas aeruginosa PA01
gcaucucgccgg

SEQ ID NO: 3506264 - RNA, 15 nt, Pseudomonas aeruginosa PA01
gcaucucgccggcac

SEQ ID NO: 3506265 - RNA, 12 nt, Pseudomonas aeruginosa PA01
gcaucucggcca

SEQ ID NO: 3506266 - RNA, 19 nt, Pseudomonas aeruginosa PA01
gcaucucggccaccugcuc

SEQ ID NO: 3506267 - RNA, 16 nt, Pseudomonas aeruginosa PA01
gcaucucggccaggcc

SEQ ID NO: 3506268 - RNA, 17 nt, Pseudomonas aeruginosa PA01
gcaucucggccaggccc

SEQ ID NO: 3506269 - RNA, 19 nt, Pseudomonas aeruginosa PA01
gcaucucuuccucgcugcc

SEQ ID NO: 3506270 - RNA, 14 nt, Pseudomonas aeruginosa PA01
gcaucugccgggcg

SEQ ID NO: 3506271 - RNA, 21 nt, Pseudomonas aeruginosa PA01
gcaucugccgggcgcgcuggu

SEQ ID NO: 3506272 - RNA, 22 nt, Pseudomonas aeruginosa PA01
gcaucugccgggcgcgcugguc

SEQ ID NO: 3506273 - RNA, 21 nt, Pseudomonas aeruginosa PA01
gcaucugcgacaugccgguuc

SEQ ID NO: 3506274 - RNA, 12 nt, Pseudomonas aeruginosa PA01
gcaucugcgccg

SEQ ID NO: 3506275 - RNA, 14 nt, Pseudomonas aeruginosa PA01
gcaucugcgccggg

SEQ ID NO: 3506276 - RNA, 21 nt, Pseudomonas aeruginosa PA01
gcaucugcucgaggauggcac

SEQ ID NO: 3506277 - RNA, 23 nt, Pseudomonas aeruginosa PA01
gcaucugcucgaggauggcacgg

SEQ ID NO: 3506278 - RNA, 18 nt, Pseudomonas aeruginosa PA01
gcaucugcugguccuggc

SEQ ID NO: 3506279 - RNA, 19 nt, Pseudomonas aeruginosa PA01
gcaucugcugguccuggcg

SEQ ID NO: 3506280 - RNA, 15 nt, Pseudomonas aeruginosa PA01
gcaucuggcugcgcg

SEQ ID NO: 3506281 - RNA, 16 nt, Pseudomonas aeruginosa PA01
gcaucuggcugcgcgc

SEQ ID NO: 3506282 - RNA, 18 nt, Pseudomonas aeruginosa PA01
gcaucuggcugcgcgcca

SEQ ID NO: 3506283 - RNA, 12 nt, Pseudomonas aeruginosa PA01
gcaucuucugcg

SEQ ID NO: 3506284 - RNA, 16 nt, Pseudomonas aeruginosa PA01
gcaucuucuucaaccg

SEQ ID NO: 3506285 - RNA, 18 nt, Pseudomonas aeruginosa PA01
gcaugaaaaagcccggca

SEQ ID NO: 3506286 - RNA, 18 nt, Pseudomonas aeruginosa PA01
gcaugaaaaagcccggcc

SEQ ID NO: 3506287 - RNA, 16 nt, Pseudomonas aeruginosa PA01
gcaugaaaaagccgcc

SEQ ID NO: 3506288 - RNA, 21 nt, Pseudomonas aeruginosa PA01
gcaugaagcuuuuccagcgca

SEQ ID NO: 3506289 - RNA, 17 nt, Pseudomonas aeruginosa PA01
gcaugaccgauggcgcc

SEQ ID NO: 3506290 - RNA, 19 nt, Pseudomonas aeruginosa PA01
gcaugaccgauggcgccgc

SEQ ID NO: 3506291 - RNA, 23 nt, Pseudomonas aeruginosa PA01
gcaugaccgauggcgccgcgaug

SEQ ID NO: 3506292 - RNA, 18 nt, Pseudomonas aeruginosa PA01
gcaugaccuucagcaccu

SEQ ID NO: 3506293 - RNA, 20 nt, Pseudomonas aeruginosa PA01
gcaugacgauaucggcgccg

SEQ ID NO: 3506294 - RNA, 21 nt, Pseudomonas aeruginosa PA01
gcaugacgauaucggcgccgg

SEQ ID NO: 3506295 - RNA, 22 nt, Pseudomonas aeruginosa PA01
gcaugacgauaucggcgccggc

SEQ ID NO: 3506296 - RNA, 16 nt, Pseudomonas aeruginosa PA01
gcaugaggccuggucc

SEQ ID NO: 3506297 - RNA, 16 nt, Pseudomonas aeruginosa PA01
gcaugaggcuggccag

SEQ ID NO: 3506298 - RNA, 17 nt, Pseudomonas aeruginosa PA01
gcaugaggggaaucgcc

SEQ ID NO: 3506299 - RNA, 19 nt, Pseudomonas aeruginosa PA01
gcaugaggggaaucgccgu

SEQ ID NO: 3506300 - RNA, 18 nt, Pseudomonas aeruginosa PA01
gcaugaucgccucggcgc

SEQ ID NO: 3506301 - RNA, 20 nt, Pseudomonas aeruginosa PA01
gcaugaucgccucggcgcgc

SEQ ID NO: 3506302 - RNA, 16 nt, Pseudomonas aeruginosa PA01
gcaugaugcaggcagu

SEQ ID NO: 3506303 - RNA, 15 nt, Pseudomonas aeruginosa PA01
gcaugaugccgaggc

SEQ ID NO: 3506304 - RNA, 17 nt, Pseudomonas aeruginosa PA01
gcaugauggugccgccg

SEQ ID NO: 3506305 - RNA, 21 nt, Pseudomonas aeruginosa PA01
gcaugauuucguuggcccaga

SEQ ID NO: 3506306 - RNA, 22 nt, Pseudomonas aeruginosa PA01
gcaugauuucguuggcccagac

SEQ ID NO: 3506307 - RNA, 17 nt, Pseudomonas aeruginosa PA01
gcaugcagguggcgcuc

SEQ ID NO: 3506308 - RNA, 15 nt, Pseudomonas aeruginosa PA01
gcaugcccagcgugg

SEQ ID NO: 3506309 - RNA, 18 nt, Pseudomonas aeruginosa PA01
gcaugcccagcguggcca

SEQ ID NO: 3506310 - RNA, 12 nt, Pseudomonas aeruginosa PA01
gcaugcccaggc

SEQ ID NO: 3506311 - RNA, 14 nt, Pseudomonas aeruginosa PA01
gcaugcccagggcc

SEQ ID NO: 3506312 - RNA, 17 nt, Pseudomonas aeruginosa PA01
gcaugcccagggccagc

SEQ ID NO: 3506313 - RNA, 14 nt, Pseudomonas aeruginosa PA01
gcaugcccugccgg

SEQ ID NO: 3506314 - RNA, 16 nt, Pseudomonas aeruginosa PA01
gcaugcccugccggcg

SEQ ID NO: 3506315 - RNA, 18 nt, Pseudomonas aeruginosa PA01
gcaugcccugccggcgca

SEQ ID NO: 3506316 - RNA, 18 nt, Pseudomonas aeruginosa PA01
gcaugccgacgagcagcu

SEQ ID NO: 3506317 - RNA, 12 nt, Pseudomonas aeruginosa PA01
gcaugccgcucu

SEQ ID NO: 3506318 - RNA, 12 nt, Pseudomonas aeruginosa PA01
gcaugccggccg

SEQ ID NO: 3506319 - RNA, 21 nt, Pseudomonas aeruginosa PA01
gcaugccggccgucgcgcacc

SEQ ID NO: 3506320 - RNA, 13 nt, Pseudomonas aeruginosa PA01
gcaugccgggguc

SEQ ID NO: 3506321 - RNA, 18 nt, Pseudomonas aeruginosa PA01
gcaugccgugggcgccgc

SEQ ID NO: 3506322 - RNA, 21 nt, Pseudomonas aeruginosa PA01
gcaugccgugggcgccgccgg

SEQ ID NO: 3506323 - RNA, 17 nt, Pseudomonas aeruginosa PA01
gcaugccugcuuucccu

SEQ ID NO: 3506324 - RNA, 22 nt, Pseudomonas aeruginosa PA01
gcaugcgcacggucuccgggga

SEQ ID NO: 3506325 - RNA, 14 nt, Pseudomonas aeruginosa PA01
gcaugcgcggcgua

SEQ ID NO: 3506326 - RNA, 20 nt, Pseudomonas aeruginosa PA01
gcaugcggaaggcuuccugg

SEQ ID NO: 3506327 - RNA, 19 nt, Pseudomonas aeruginosa PA01
gcaugcggccccggcgcuc

SEQ ID NO: 3506328 - RNA, 21 nt, Pseudomonas aeruginosa PA01
gcaugcggccccggcgcucgc

SEQ ID NO: 3506329 - RNA, 17 nt, Pseudomonas aeruginosa PA01
gcaugcguucgccgaaa

SEQ ID NO: 3506330 - RNA, 22 nt, Pseudomonas aeruginosa PA01
gcaugcguucgccgaaauagcg

SEQ ID NO: 3506331 - RNA, 21 nt, Pseudomonas aeruginosa PA01
gcaugcucacugcgagcacca

SEQ ID NO: 3506332 - RNA, 23 nt, Pseudomonas aeruginosa PA01
gcaugcucacugcgagcaccaug

SEQ ID NO: 3506333 - RNA, 16 nt, Pseudomonas aeruginosa PA01
gcaugcucagccgcgc

SEQ ID NO: 3506334 - RNA, 16 nt, Pseudomonas aeruginosa PA01
gcaugcuuuugaacac

SEQ ID NO: 3506335 - RNA, 20 nt, Pseudomonas aeruginosa PA01
gcaugcuuuugaacaccagc

SEQ ID NO: 3506336 - RNA, 18 nt, Pseudomonas aeruginosa PA01
gcauggagacggcccgcc

SEQ ID NO: 3506337 - RNA, 12 nt, Pseudomonas aeruginosa PA01
gcauggccacgc

SEQ ID NO: 3506338 - RNA, 23 nt, Pseudomonas aeruginosa PA01
gcauggccauggcagagcuggaa

SEQ ID NO: 3506339 - RNA, 15 nt, Pseudomonas aeruginosa PA01
gcauggccuugccgg

SEQ ID NO: 3506340 - RNA, 20 nt, Pseudomonas aeruginosa PA01
gcauggccuugccggcaucg

SEQ ID NO: 3506341 - RNA, 24 nt, Pseudomonas aeruginosa PA01
gcauggcgaagcucggccgcucga

SEQ ID NO: 3506342 - RNA, 16 nt, Pseudomonas aeruginosa PA01
gcauggcgaccuggug

SEQ ID NO: 3506343 - RNA, 22 nt, Pseudomonas aeruginosa PA01
gcauggcgaccugguggcgccg

SEQ ID NO: 3506344 - RNA, 21 nt, Pseudomonas aeruginosa PA01
gcauggcgaucuccgggagca

SEQ ID NO: 3506345 - RNA, 15 nt, Pseudomonas aeruginosa PA01
gcauggcgcucuuca

SEQ ID NO: 3506346 - RNA, 16 nt, Pseudomonas aeruginosa PA01
gcauggcggcgaccgc

SEQ ID NO: 3506347 - RNA, 15 nt, Pseudomonas aeruginosa PA01
gcauggcuggcgcua

SEQ ID NO: 3506348 - RNA, 22 nt, Pseudomonas aeruginosa PA01
gcauggcuggcgcuaccgcgca

SEQ ID NO: 3506349 - RNA, 19 nt, Pseudomonas aeruginosa PA01
gcauggcuuuccaggcgcc

SEQ ID NO: 3506350 - RNA, 22 nt, Pseudomonas aeruginosa PA01
gcaugggauggcgcgguccgcg

SEQ ID NO: 3506351 - RNA, 23 nt, Pseudomonas aeruginosa PA01
gcaugggauggcgcgguccgcgg

SEQ ID NO: 3506352 - RNA, 16 nt, Pseudomonas aeruginosa PA01
gcaugggcucgcgcgg

SEQ ID NO: 3506353 - RNA, 19 nt, Pseudomonas aeruginosa PA01
gcaugggcucgcgcggggc

SEQ ID NO: 3506354 - RNA, 13 nt, Pseudomonas aeruginosa PA01
gcaugggucagcg

SEQ ID NO: 3506355 - RNA, 20 nt, Pseudomonas aeruginosa PA01
gcaugggucagcgccagcaa

SEQ ID NO: 3506356 - RNA, 21 nt, Pseudomonas aeruginosa PA01
gcaugguccguucggcgccca

SEQ ID NO: 3506357 - RNA, 22 nt, Pseudomonas aeruginosa PA01
gcaugguccguucggcgcccag

SEQ ID NO: 3506358 - RNA, 15 nt, Pseudomonas aeruginosa PA01
gcaugguggaucgac

SEQ ID NO: 3506359 - RNA, 17 nt, Pseudomonas aeruginosa PA01
gcaugguguccggcggc

SEQ ID NO: 3506360 - RNA, 16 nt, Pseudomonas aeruginosa PA01
gcauguagcgcgccga

SEQ ID NO: 3506361 - RNA, 15 nt, Pseudomonas aeruginosa PA01
gcauguagcgcuccu

SEQ ID NO: 3506362 - RNA, 20 nt, Pseudomonas aeruginosa PA01
gcauguaggggagcacggca

SEQ ID NO: 3506363 - RNA, 14 nt, Pseudomonas aeruginosa PA01
gcauguccaccgcc

SEQ ID NO: 3506364 - RNA, 18 nt, Pseudomonas aeruginosa PA01
gcauguccaccgccgcca

SEQ ID NO: 3506365 - RNA, 16 nt, Pseudomonas aeruginosa PA01
gcauguccgcaggcag

SEQ ID NO: 3506366 - RNA, 13 nt, Pseudomonas aeruginosa PA01
gcauguccucggc

SEQ ID NO: 3506367 - RNA, 23 nt, Pseudomonas aeruginosa PA01
gcauguccucggcgccgucgauc

SEQ ID NO: 3506368 - RNA, 21 nt, Pseudomonas aeruginosa PA01
gcaugucgagguugcgcucca

SEQ ID NO: 3506369 - RNA, 15 nt, Pseudomonas aeruginosa PA01
gcaugucguccaggc

SEQ ID NO: 3506370 - RNA, 16 nt, Pseudomonas aeruginosa PA01
gcaugucuucgucgcg

SEQ ID NO: 3506371 - RNA, 17 nt, Pseudomonas aeruginosa PA01
gcaugucuucgucgcgc

SEQ ID NO: 3506372 - RNA, 15 nt, Pseudomonas aeruginosa PA01
gcaugugccaggccu

SEQ ID NO: 3506373 - RNA, 18 nt, Pseudomonas aeruginosa PA01
gcauguucaugcgcuggu

SEQ ID NO: 3506374 - RNA, 22 nt, Pseudomonas aeruginosa PA01
gcauguuggcgccuucggcgac

SEQ ID NO: 3506375 - RNA, 15 nt, Pseudomonas aeruginosa PA01
gcauguugugcuuga

SEQ ID NO: 3506376 - RNA, 22 nt, Pseudomonas aeruginosa PA01
gcauuaccccgaccaggucgcu

SEQ ID NO: 3506377 - RNA, 15 nt, Pseudomonas aeruginosa PA01
gcauucaccagcgac

SEQ ID NO: 3506378 - RNA, 23 nt, Pseudomonas aeruginosa PA01
gcauucagcgcgccccggcgagc

SEQ ID NO: 3506379 - RNA, 18 nt, Pseudomonas aeruginosa PA01
gcauuccagaaacggcug

SEQ ID NO: 3506380 - RNA, 19 nt, Pseudomonas aeruginosa PA01
gcauuccagaaacggcugc

SEQ ID NO: 3506381 - RNA, 15 nt, Pseudomonas aeruginosa PA01
gcauuccucagcgcc

SEQ ID NO: 3506382 - RNA, 16 nt, Pseudomonas aeruginosa PA01
gcauuccucagcgccg

SEQ ID NO: 3506383 - RNA, 16 nt, Pseudomonas aeruginosa PA01
gcauucgacccgccga

SEQ ID NO: 3506384 - RNA, 19 nt, Pseudomonas aeruginosa PA01
gcauucgacccgccgacca

SEQ ID NO: 3506385 - RNA, 14 nt, Pseudomonas aeruginosa PA01
gcauucgccgggcu

SEQ ID NO: 3506386 - RNA, 18 nt, Pseudomonas aeruginosa PA01
gcauucguccagccgccg

SEQ ID NO: 3506387 - RNA, 19 nt, Pseudomonas aeruginosa PA01
gcauucguccagccgccgc

SEQ ID NO: 3506388 - RNA, 17 nt, Pseudomonas aeruginosa PA01
gcauucgucgccgcugg

SEQ ID NO: 3506389 - RNA, 23 nt, Pseudomonas aeruginosa PA01
gcauucucucuucagcaggggga

SEQ ID NO: 3506390 - RNA, 20 nt, Pseudomonas aeruginosa PA01
gcauucuggaugcagccggg

SEQ ID NO: 3506391 - RNA, 21 nt, Pseudomonas aeruginosa PA01
gcauucuggaugcagccgggg

SEQ ID NO: 3506392 - RNA, 23 nt, Pseudomonas aeruginosa PA01
gcauugacacggauauccgggcc

SEQ ID NO: 3506393 - RNA, 20 nt, Pseudomonas aeruginosa PA01
gcauugacccgggugccuuc

SEQ ID NO: 3506394 - RNA, 19 nt, Pseudomonas aeruginosa PA01
gcauugcgcuugcgaucga

SEQ ID NO: 3506395 - RNA, 14 nt, Pseudomonas aeruginosa PA01
gcauuggugcugcc

SEQ ID NO: 3506396 - RNA, 16 nt, Pseudomonas aeruginosa PA01
gcauuggugcugccga

SEQ ID NO: 3506397 - RNA, 14 nt, Pseudomonas aeruginosa PA01
gcauugucgggcgu

SEQ ID NO: 3506398 - RNA, 16 nt, Pseudomonas aeruginosa PA01
gcauuucagcggaagc

SEQ ID NO: 3506399 - RNA, 14 nt, Pseudomonas aeruginosa PA01
gcauuuccuggacg

SEQ ID NO: 3506400 - RNA, 12 nt, Pseudomonas aeruginosa PA01
gcauuuccuggg

SEQ ID NO: 3506401 - RNA, 15 nt, Pseudomonas aeruginosa PA01
gcauuuccugggugc

SEQ ID NO: 3506402 - RNA, 20 nt, Pseudomonas aeruginosa PA01
gcauuuccugggugccgcga

SEQ ID NO: 3506403 - RNA, 13 nt, Pseudomonas aeruginosa PA01
gccaaaaaaagcc

SEQ ID NO: 3506404 - RNA, 18 nt, Pseudomonas aeruginosa PA01
gccaaaaaaagccccggc

SEQ ID NO: 3506405 - RNA, 22 nt, Pseudomonas aeruginosa PA01
gccaaaccgggaaagucuguga

SEQ ID NO: 3506406 - RNA, 14 nt, Pseudomonas aeruginosa PA01
gccaaacgccgucu

SEQ ID NO: 3506407 - RNA, 22 nt, Pseudomonas aeruginosa PA01
gccaaagccgcaauccgccgcu

SEQ ID NO: 3506408 - RNA, 22 nt, Pseudomonas aeruginosa PA01
gccaaaguucaguagcggcagg

SEQ ID NO: 3506409 - RNA, 15 nt, Pseudomonas aeruginosa PA01
gccaaccaccggcgc

SEQ ID NO: 3506410 - RNA, 14 nt, Pseudomonas aeruginosa PA01
gccaaccacuccgc

SEQ ID NO: 3506411 - RNA, 16 nt, Pseudomonas aeruginosa PA01
gccaaccacuccgcca

SEQ ID NO: 3506412 - RNA, 16 nt, Pseudomonas aeruginosa PA01
gccaaccagauccggg

SEQ ID NO: 3506413 - RNA, 12 nt, Pseudomonas aeruginosa PA01
gccaaccaggaa

SEQ ID NO: 3506414 - RNA, 16 nt, Pseudomonas aeruginosa PA01
gccaacccucggaugc

SEQ ID NO: 3506415 - RNA, 22 nt, Pseudomonas aeruginosa PA01
gccaacccucggaugccgcaca

SEQ ID NO: 3506416 - RNA, 14 nt, Pseudomonas aeruginosa PA01
gccaaccgcgcucg

SEQ ID NO: 3506417 - RNA, 18 nt, Pseudomonas aeruginosa PA01
gccaaccgcgcucggcgg

SEQ ID NO: 3506418 - RNA, 19 nt, Pseudomonas aeruginosa PA01
gccaaccgcgcucggcggu

SEQ ID NO: 3506419 - RNA, 16 nt, Pseudomonas aeruginosa PA01
gccaaccgggcagcag

SEQ ID NO: 3506420 - RNA, 18 nt, Pseudomonas aeruginosa PA01
gccaaccgggcagcagcc

SEQ ID NO: 3506421 - RNA, 17 nt, Pseudomonas aeruginosa PA01
gccaaccgucgcccugg

SEQ ID NO: 3506422 - RNA, 21 nt, Pseudomonas aeruginosa PA01
gccaaccgucgcccuggugca

SEQ ID NO: 3506423 - RNA, 15 nt, Pseudomonas aeruginosa PA01
gccaaccucucccca

SEQ ID NO: 3506424 - RNA, 15 nt, Pseudomonas aeruginosa PA01
gccaacgcccgggcc

SEQ ID NO: 3506425 - RNA, 19 nt, Pseudomonas aeruginosa PA01
gccaacgcccgggccgggg

SEQ ID NO: 3506426 - RNA, 21 nt, Pseudomonas aeruginosa PA01
gccaacgcccgggccgggggc

SEQ ID NO: 3506427 - RNA, 16 nt, Pseudomonas aeruginosa PA01
gccaacgcgccgucgc

SEQ ID NO: 3506428 - RNA, 19 nt, Pseudomonas aeruginosa PA01
gccaacggcguuauccgcc

SEQ ID NO: 3506429 - RNA, 17 nt, Pseudomonas aeruginosa PA01
gccaacguccucgaugc

SEQ ID NO: 3506430 - RNA, 22 nt, Pseudomonas aeruginosa PA01
gccaacguccucgaugcccgcc

SEQ ID NO: 3506431 - RNA, 23 nt, Pseudomonas aeruginosa PA01
gccaacguccucgaugcccgccu

SEQ ID NO: 3506432 - RNA, 18 nt, Pseudomonas aeruginosa PA01
gccaacugagcggcggca

SEQ ID NO: 3506433 - RNA, 20 nt, Pseudomonas aeruginosa PA01
gccaacugcuucaggcgcgc

SEQ ID NO: 3506434 - RNA, 19 nt, Pseudomonas aeruginosa PA01
gccaacugcuugccgagcu

SEQ ID NO: 3506435 - RNA, 16 nt, Pseudomonas aeruginosa PA01
gccaacuggcgcaacu

SEQ ID NO: 3506436 - RNA, 14 nt, Pseudomonas aeruginosa PA01
gccaacuggcgucc

SEQ ID NO: 3506437 - RNA, 22 nt, Pseudomonas aeruginosa PA01
gccaacuggcguccccaugccc

SEQ ID NO: 3506438 - RNA, 16 nt, Pseudomonas aeruginosa PA01
gccaacugggccuuga

SEQ ID NO: 3506439 - RNA, 15 nt, Pseudomonas aeruginosa PA01
gccaagcuggcgauc

SEQ ID NO: 3506440 - RNA, 16 nt, Pseudomonas aeruginosa PA01
gccaagcuggcgaucg

SEQ ID NO: 3506441 - RNA, 20 nt, Pseudomonas aeruginosa PA01
gccaagcuuguugcgcaggc

SEQ ID NO: 3506442 - RNA, 23 nt, Pseudomonas aeruginosa PA01
gccaagcuuguugcgcaggcgau

SEQ ID NO: 3506443 - RNA, 20 nt, Pseudomonas aeruginosa PA01
gccaaggaugcgccagcggc

SEQ ID NO: 3506444 - RNA, 14 nt, Pseudomonas aeruginosa PA01
gccaaggcccugcu

SEQ ID NO: 3506445 - RNA, 17 nt, Pseudomonas aeruginosa PA01
gccaaggcccugcugca

SEQ ID NO: 3506446 - RNA, 17 nt, Pseudomonas aeruginosa PA01
gccaaggccgccaggcc

SEQ ID NO: 3506447 - RNA, 21 nt, Pseudomonas aeruginosa PA01
gccaaggccgccaggccucgg

SEQ ID NO: 3506448 - RNA, 11 nt, Pseudomonas aeruginosa PA01
gccaaggcggg

SEQ ID NO: 3506449 - RNA, 15 nt, Pseudomonas aeruginosa PA01
gccaaggcggggcuu

SEQ ID NO: 3506450 - RNA, 18 nt, Pseudomonas aeruginosa PA01
gccaagggcgccgccgag

SEQ ID NO: 3506451 - RNA, 21 nt, Pseudomonas aeruginosa PA01
gccaagggcgccgccgaggau

SEQ ID NO: 3506452 - RNA, 20 nt, Pseudomonas aeruginosa PA01
gccaagguacggggcugcgg

SEQ ID NO: 3506453 - RNA, 19 nt, Pseudomonas aeruginosa PA01
gccaagguuccagccccgc

SEQ ID NO: 3506454 - RNA, 21 nt, Pseudomonas aeruginosa PA01
gccaagguuccagccccgccg

SEQ ID NO: 3506455 - RNA, 17 nt, Pseudomonas aeruginosa PA01
gccaauccacaaacacu

SEQ ID NO: 3506456 - RNA, 16 nt, Pseudomonas aeruginosa PA01
gccaauccaugauccc

SEQ ID NO: 3506457 - RNA, 19 nt, Pseudomonas aeruginosa PA01
gccaauccgggcguagggc

SEQ ID NO: 3506458 - RNA, 22 nt, Pseudomonas aeruginosa PA01
gccaauccgggcguggggcgaa

SEQ ID NO: 3506459 - RNA, 18 nt, Pseudomonas aeruginosa PA01
gccaaugcccggaccugg

SEQ ID NO: 3506460 - RNA, 20 nt, Pseudomonas aeruginosa PA01
gccaaugccuuccgacgccg

SEQ ID NO: 3506461 - RNA, 21 nt, Pseudomonas aeruginosa PA01
gccaaugccuuccgacgccgc

SEQ ID NO: 3506462 - RNA, 22 nt, Pseudomonas aeruginosa PA01
gccaaugccuuccgacgccgcg

SEQ ID NO: 3506463 - RNA, 22 nt, Pseudomonas aeruginosa PA01
gccaaugcguggguccacgccg

SEQ ID NO: 3506464 - RNA, 23 nt, Pseudomonas aeruginosa PA01
gccaaugcguggguccacgccgg

SEQ ID NO: 3506465 - RNA, 15 nt, Pseudomonas aeruginosa PA01
gccaauugcuccggu

SEQ ID NO: 3506466 - RNA, 13 nt, Pseudomonas aeruginosa PA01
gccacacauccag

SEQ ID NO: 3506467 - RNA, 14 nt, Pseudomonas aeruginosa PA01
gccacacauccagu

SEQ ID NO: 3506468 - RNA, 18 nt, Pseudomonas aeruginosa PA01
gccacacauccagugugg

SEQ ID NO: 3506469 - RNA, 15 nt, Pseudomonas aeruginosa PA01
gccacagaggucgcu

SEQ ID NO: 3506470 - RNA, 16 nt, Pseudomonas aeruginosa PA01
gccacagaucgccagc

SEQ ID NO: 3506471 - RNA, 22 nt, Pseudomonas aeruginosa PA01
gccacagaucgccagcucgccg

SEQ ID NO: 3506472 - RNA, 23 nt, Pseudomonas aeruginosa PA01
gccacagaucgccagcucgccgc

SEQ ID NO: 3506473 - RNA, 14 nt, Pseudomonas aeruginosa PA01
gccacaggcccugg

SEQ ID NO: 3506474 - RNA, 15 nt, Pseudomonas aeruginosa PA01
gccacaggcccugga

SEQ ID NO: 3506475 - RNA, 19 nt, Pseudomonas aeruginosa PA01
gccacaggcccuggaucac

SEQ ID NO: 3506476 - RNA, 15 nt, Pseudomonas aeruginosa PA01
gccacaggcgccagu

SEQ ID NO: 3506477 - RNA, 21 nt, Pseudomonas aeruginosa PA01
gccacaggcguuauccgccga

SEQ ID NO: 3506478 - RNA, 21 nt, Pseudomonas aeruginosa PA01
gccacaggcguuauccgccgc

SEQ ID NO: 3506479 - RNA, 22 nt, Pseudomonas aeruginosa PA01
gccacaggcguuauccgccgcc

SEQ ID NO: 3506480 - RNA, 23 nt, Pseudomonas aeruginosa PA01
gccacaggcguuauccgccgccg

SEQ ID NO: 3506481 - RNA, 19 nt, Pseudomonas aeruginosa PA01
gccacagguggaucgcggc

SEQ ID NO: 3506482 - RNA, 21 nt, Pseudomonas aeruginosa PA01
gccacagguggaucgcggcgu

SEQ ID NO: 3506483 - RNA, 22 nt, Pseudomonas aeruginosa PA01
gccaccaaccacaaccagccau

SEQ ID NO: 3506484 - RNA, 13 nt, Pseudomonas aeruginosa PA01
gccaccaccacga

SEQ ID NO: 3506485 - RNA, 14 nt, Pseudomonas aeruginosa PA01
gccaccaccaugcc

SEQ ID NO: 3506486 - RNA, 23 nt, Pseudomonas aeruginosa PA01
gccaccaccaugccuuccaccgg

SEQ ID NO: 3506487 - RNA, 14 nt, Pseudomonas aeruginosa PA01
gccaccaccgugac

SEQ ID NO: 3506488 - RNA, 16 nt, Pseudomonas aeruginosa PA01
gccaccacgaucaggc

SEQ ID NO: 3506489 - RNA, 17 nt, Pseudomonas aeruginosa PA01
gccaccacgaucaggcc

SEQ ID NO: 3506490 - RNA, 23 nt, Pseudomonas aeruginosa PA01
gccaccacggcgaagccgcgccc

SEQ ID NO: 3506491 - RNA, 13 nt, Pseudomonas aeruginosa PA01
gccaccagagcca

SEQ ID NO: 3506492 - RNA, 16 nt, Pseudomonas aeruginosa PA01
gccaccagagccagcc

SEQ ID NO: 3506493 - RNA, 18 nt, Pseudomonas aeruginosa PA01
gccaccagagccagccgc

SEQ ID NO: 3506494 - RNA, 20 nt, Pseudomonas aeruginosa PA01
gccaccagagccagccgcga

SEQ ID NO: 3506495 - RNA, 12 nt, Pseudomonas aeruginosa PA01
gccaccagcagg

SEQ ID NO: 3506496 - RNA, 14 nt, Pseudomonas aeruginosa PA01
gccaccagcaggaa

SEQ ID NO: 3506497 - RNA, 22 nt, Pseudomonas aeruginosa PA01
gccaccagcaggaagccgacca

SEQ ID NO: 3506498 - RNA, 14 nt, Pseudomonas aeruginosa PA01
gccaccagcagggc

SEQ ID NO: 3506499 - RNA, 16 nt, Pseudomonas aeruginosa PA01
gccaccagcagggcca

SEQ ID NO: 3506500 - RNA, 17 nt, Pseudomonas aeruginosa PA01
gccaccagcaugcccag

SEQ ID NO: 3506501 - RNA, 19 nt, Pseudomonas aeruginosa PA01
gccaccagcaugcccagcg

SEQ ID NO: 3506502 - RNA, 14 nt, Pseudomonas aeruginosa PA01
gccaccagccaggc

SEQ ID NO: 3506503 - RNA, 16 nt, Pseudomonas aeruginosa PA01
gccaccagccaggcgg

SEQ ID NO: 3506504 - RNA, 12 nt, Pseudomonas aeruginosa PA01
gccaccagcgag

SEQ ID NO: 3506505 - RNA, 15 nt, Pseudomonas aeruginosa PA01
gccaccagcgagucg

SEQ ID NO: 3506506 - RNA, 22 nt, Pseudomonas aeruginosa PA01
gccaccagcgagucgacccagg

SEQ ID NO: 3506507 - RNA, 13 nt, Pseudomonas aeruginosa PA01
gccaccagcgugg

SEQ ID NO: 3506508 - RNA, 16 nt, Pseudomonas aeruginosa PA01
gccaccagcguggcgc

SEQ ID NO: 3506509 - RNA, 17 nt, Pseudomonas aeruginosa PA01
gccaccaggccgcugcc

SEQ ID NO: 3506510 - RNA, 22 nt, Pseudomonas aeruginosa PA01
gccaccaggccgcugccgccgc

SEQ ID NO: 3506511 - RNA, 21 nt, Pseudomonas aeruginosa PA01
gccaccagggccuugccgcga

SEQ ID NO: 3506512 - RNA, 13 nt, Pseudomonas aeruginosa PA01
gccaccagggugc

SEQ ID NO: 3506513 - RNA, 15 nt, Pseudomonas aeruginosa PA01
gccaccaucacgucg

SEQ ID NO: 3506514 - RNA, 21 nt, Pseudomonas aeruginosa PA01
gccaccaucacgucgcgcacc

SEQ ID NO: 3506515 - RNA, 16 nt, Pseudomonas aeruginosa PA01
gccaccaucgcggcga

SEQ ID NO: 3506516 - RNA, 13 nt, Pseudomonas aeruginosa PA01
gccaccccgccgc

SEQ ID NO: 3506517 - RNA, 17 nt, Pseudomonas aeruginosa PA01
gccaccccgccgcgcau

SEQ ID NO: 3506518 - RNA, 18 nt, Pseudomonas aeruginosa PA01
gccaccccgccgcuggcg

SEQ ID NO: 3506519 - RNA, 19 nt, Pseudomonas aeruginosa PA01
gccaccccgccgcuggcgg

SEQ ID NO: 3506520 - RNA, 21 nt, Pseudomonas aeruginosa PA01
gccaccccgccgcuggcggca

SEQ ID NO: 3506521 - RNA, 22 nt, Pseudomonas aeruginosa PA01
gccaccccgccgcuggcggcau

SEQ ID NO: 3506522 - RNA, 14 nt, Pseudomonas aeruginosa PA01
gccaccccgccggc

SEQ ID NO: 3506523 - RNA, 15 nt, Pseudomonas aeruginosa PA01
gccaccccgccggcg

SEQ ID NO: 3506524 - RNA, 22 nt, Pseudomonas aeruginosa PA01
gccaccccgcuccgcucagucg

SEQ ID NO: 3506525 - RNA, 23 nt, Pseudomonas aeruginosa PA01
gccacccgcaucgaggccgccca

SEQ ID NO: 3506526 - RNA, 17 nt, Pseudomonas aeruginosa PA01
gccacccgccucgucgc

SEQ ID NO: 3506527 - RNA, 21 nt, Pseudomonas aeruginosa PA01
gccacccgccucgucgccaug

SEQ ID NO: 3506528 - RNA, 22 nt, Pseudomonas aeruginosa PA01
gccacccgccucgucgccaugc

SEQ ID NO: 3506529 - RNA, 16 nt, Pseudomonas aeruginosa PA01
gccacccgcgggcagc

SEQ ID NO: 3506530 - RNA, 17 nt, Pseudomonas aeruginosa PA01
gccacccgcgggcagca

SEQ ID NO: 3506531 - RNA, 15 nt, Pseudomonas aeruginosa PA01
gccacccgcucgacc

SEQ ID NO: 3506532 - RNA, 17 nt, Pseudomonas aeruginosa PA01
gccacccgcucgaccuu

SEQ ID NO: 3506533 - RNA, 16 nt, Pseudomonas aeruginosa PA01
gccacccggcgcccgg

SEQ ID NO: 3506534 - RNA, 18 nt, Pseudomonas aeruginosa PA01
gccacccggcgcccggcg

SEQ ID NO: 3506535 - RNA, 20 nt, Pseudomonas aeruginosa PA01
gccacccggcgcccggcgca

SEQ ID NO: 3506536 - RNA, 17 nt, Pseudomonas aeruginosa PA01
gccacccguuccuugcg

SEQ ID NO: 3506537 - RNA, 18 nt, Pseudomonas aeruginosa PA01
gccacccguuccuugcgc

SEQ ID NO: 3506538 - RNA, 22 nt, Pseudomonas aeruginosa PA01
gccacccguuccuugcgcggca

SEQ ID NO: 3506539 - RNA, 13 nt, Pseudomonas aeruginosa PA01
gccacccuugcgc

SEQ ID NO: 3506540 - RNA, 19 nt, Pseudomonas aeruginosa PA01
gccacccuugcguccugcc

SEQ ID NO: 3506541 - RNA, 16 nt, Pseudomonas aeruginosa PA01
gccacccuuggagccg

SEQ ID NO: 3506542 - RNA, 19 nt, Pseudomonas aeruginosa PA01
gccacccuuggagccgccc

SEQ ID NO: 3506543 - RNA, 20 nt, Pseudomonas aeruginosa PA01
gccacccuuguggccgaucu

SEQ ID NO: 3506544 - RNA, 21 nt, Pseudomonas aeruginosa PA01
gccaccgaaucgaugcuguag

SEQ ID NO: 3506545 - RNA, 23 nt, Pseudomonas aeruginosa PA01
gccaccgaaucggacagguuggc

SEQ ID NO: 3506546 - RNA, 14 nt, Pseudomonas aeruginosa PA01
gccaccgacccucg

SEQ ID NO: 3506547 - RNA, 19 nt, Pseudomonas aeruginosa PA01
gccaccgacgcgcgcgcau

SEQ ID NO: 3506548 - RNA, 14 nt, Pseudomonas aeruginosa PA01
gccaccgauagcgg

SEQ ID NO: 3506549 - RNA, 17 nt, Pseudomonas aeruginosa PA01
gccaccgauagcggcgc

SEQ ID NO: 3506550 - RNA, 18 nt, Pseudomonas aeruginosa PA01
gccaccgauagcggcgcg

SEQ ID NO: 3506551 - RNA, 20 nt, Pseudomonas aeruginosa PA01
gccaccgauagcggcgcgag

SEQ ID NO: 3506552 - RNA, 21 nt, Pseudomonas aeruginosa PA01
gccaccgauagcggcgcgagg

SEQ ID NO: 3506553 - RNA, 22 nt, Pseudomonas aeruginosa PA01
gccaccgauagcggcgcgaggc

SEQ ID NO: 3506554 - RNA, 23 nt, Pseudomonas aeruginosa PA01
gccaccgauagcggcgcgaggcc

SEQ ID NO: 3506555 - RNA, 18 nt, Pseudomonas aeruginosa PA01
gccaccgauucgccggcc

SEQ ID NO: 3506556 - RNA, 14 nt, Pseudomonas aeruginosa PA01
gccaccgccaccgc

SEQ ID NO: 3506557 - RNA, 17 nt, Pseudomonas aeruginosa PA01
gccaccgccaccgccgg

SEQ ID NO: 3506558 - RNA, 12 nt, Pseudomonas aeruginosa PA01
gccaccgccagg

SEQ ID NO: 3506559 - RNA, 13 nt, Pseudomonas aeruginosa PA01
gccaccgccagga

SEQ ID NO: 3506560 - RNA, 14 nt, Pseudomonas aeruginosa PA01
gccaccgccaggac

SEQ ID NO: 3506561 - RNA, 16 nt, Pseudomonas aeruginosa PA01
gccaccgccaggaccu

SEQ ID NO: 3506562 - RNA, 12 nt, Pseudomonas aeruginosa PA01
gccaccgccgac

SEQ ID NO: 3506563 - RNA, 12 nt, Pseudomonas aeruginosa PA01
gccaccgccugg

SEQ ID NO: 3506564 - RNA, 16 nt, Pseudomonas aeruginosa PA01
gccaccgccuggucgc

SEQ ID NO: 3506565 - RNA, 22 nt, Pseudomonas aeruginosa PA01
gccaccgccuggucgccgggau

SEQ ID NO: 3506566 - RNA, 19 nt, Pseudomonas aeruginosa PA01
gccaccgcgacgcgcugga

SEQ ID NO: 3506567 - RNA, 21 nt, Pseudomonas aeruginosa PA01
gccaccgcgacgcgcuggacc

SEQ ID NO: 3506568 - RNA, 22 nt, Pseudomonas aeruginosa PA01
gccaccgcgacgcgcuggacca

SEQ ID NO: 3506569 - RNA, 24 nt, Pseudomonas aeruginosa PA01
gccaccgcggauccacgccuggcc

SEQ ID NO: 3506570 - RNA, 19 nt, Pseudomonas aeruginosa PA01
gccaccgcguugaccguga

SEQ ID NO: 3506571 - RNA, 20 nt, Pseudomonas aeruginosa PA01
gccaccggcguuauccgccg

SEQ ID NO: 3506572 - RNA, 13 nt, Pseudomonas aeruginosa PA01
gccaccggcugca

SEQ ID NO: 3506573 - RNA, 16 nt, Pseudomonas aeruginosa PA01
gccaccgggaucagcg

SEQ ID NO: 3506574 - RNA, 20 nt, Pseudomonas aeruginosa PA01
gccaccgggaucagcggcgg

SEQ ID NO: 3506575 - RNA, 21 nt, Pseudomonas aeruginosa PA01
gccaccgguacgcucaccacc

SEQ ID NO: 3506576 - RNA, 22 nt, Pseudomonas aeruginosa PA01
gccaccgguacgcucaccacca

SEQ ID NO: 3506577 - RNA, 13 nt, Pseudomonas aeruginosa PA01
gccaccgguggac

SEQ ID NO: 3506578 - RNA, 20 nt, Pseudomonas aeruginosa PA01
gccaccucguauuccacguc

SEQ ID NO: 3506579 - RNA, 13 nt, Pseudomonas aeruginosa PA01
gccaccugcauca

SEQ ID NO: 3506580 - RNA, 15 nt, Pseudomonas aeruginosa PA01
gccaccugcaucacg

SEQ ID NO: 3506581 - RNA, 14 nt, Pseudomonas aeruginosa PA01
gccaccugcgggug

SEQ ID NO: 3506582 - RNA, 16 nt, Pseudomonas aeruginosa PA01
gccaccugcuccggcg

SEQ ID NO: 3506583 - RNA, 16 nt, Pseudomonas aeruginosa PA01
gccaccugcucgcuga

SEQ ID NO: 3506584 - RNA, 20 nt, Pseudomonas aeruginosa PA01
gccaccugcucgcugaaccg

SEQ ID NO: 3506585 - RNA, 24 nt, Pseudomonas aeruginosa PA01
gccaccugcucgcugaaccgcguc

SEQ ID NO: 3506586 - RNA, 22 nt, Pseudomonas aeruginosa PA01
gccaccugguucaucgagcggc

SEQ ID NO: 3506587 - RNA, 13 nt, Pseudomonas aeruginosa PA01
gccaccuucgccc

SEQ ID NO: 3506588 - RNA, 16 nt, Pseudomonas aeruginosa PA01
gccaccuucgcccgcu

SEQ ID NO: 3506589 - RNA, 21 nt, Pseudomonas aeruginosa PA01
gccaccuucgcccgcugcgcu

SEQ ID NO: 3506590 - RNA, 20 nt, Pseudomonas aeruginosa PA01
gccaccuugcgucccugggc

SEQ ID NO: 3506591 - RNA, 21 nt, Pseudomonas aeruginosa PA01
gccaccuugcgucccugggcc

SEQ ID NO: 3506592 - RNA, 13 nt, Pseudomonas aeruginosa PA01
gccacgaacaggc

SEQ ID NO: 3506593 - RNA, 14 nt, Pseudomonas aeruginosa PA01
gccacgacccugcu

SEQ ID NO: 3506594 - RNA, 21 nt, Pseudomonas aeruginosa PA01
gccacgacccugcuggccggu

SEQ ID NO: 3506595 - RNA, 24 nt, Pseudomonas aeruginosa PA01
gccacgacccugcuggccggugcc

SEQ ID NO: 3506596 - RNA, 23 nt, Pseudomonas aeruginosa PA01
gccacgacguaauucgcugacga

SEQ ID NO: 3506597 - RNA, 20 nt, Pseudomonas aeruginosa PA01
gccacgaucauggugaagcc

SEQ ID NO: 3506598 - RNA, 18 nt, Pseudomonas aeruginosa PA01
gccacgcaaacccauuuc

SEQ ID NO: 3506599 - RNA, 17 nt, Pseudomonas aeruginosa PA01
gccacgcaauccucggu

SEQ ID NO: 3506600 - RNA, 15 nt, Pseudomonas aeruginosa PA01
gccacgcaccaccag

SEQ ID NO: 3506601 - RNA, 17 nt, Pseudomonas aeruginosa PA01
gccacgcaccaccaggu

SEQ ID NO: 3506602 - RNA, 17 nt, Pseudomonas aeruginosa PA01
gccacgcaguucgcggg

SEQ ID NO: 3506603 - RNA, 21 nt, Pseudomonas aeruginosa PA01
gccacgccauucgaauggcgc

SEQ ID NO: 3506604 - RNA, 22 nt, Pseudomonas aeruginosa PA01
gccacgccauucgaauggcgcc

SEQ ID NO: 3506605 - RNA, 23 nt, Pseudomonas aeruginosa PA01
gccacgccauucgaauggcgccg

SEQ ID NO: 3506606 - RNA, 12 nt, Pseudomonas aeruginosa PA01
gccacgcccgcc

SEQ ID NO: 3506607 - RNA, 13 nt, Pseudomonas aeruginosa PA01
gccacgcccggug

SEQ ID NO: 3506608 - RNA, 13 nt, Pseudomonas aeruginosa PA01
gccacgccgacgc

SEQ ID NO: 3506609 - RNA, 19 nt, Pseudomonas aeruginosa PA01
gccacgccgacgccgaguu

SEQ ID NO: 3506610 - RNA, 13 nt, Pseudomonas aeruginosa PA01
gccacgccgcugu

SEQ ID NO: 3506611 - RNA, 20 nt, Pseudomonas aeruginosa PA01
gccacgccgcugucguccag

SEQ ID NO: 3506612 - RNA, 12 nt, Pseudomonas aeruginosa PA01
gccacgccggcg

SEQ ID NO: 3506613 - RNA, 21 nt, Pseudomonas aeruginosa PA01
gccacgccggucucgauggca

SEQ ID NO: 3506614 - RNA, 20 nt, Pseudomonas aeruginosa PA01
gccacgccuucgggcgaugc

SEQ ID NO: 3506615 - RNA, 17 nt, Pseudomonas aeruginosa PA01
gccacgcgaccagcgcc

SEQ ID NO: 3506616 - RNA, 18 nt, Pseudomonas aeruginosa PA01
gccacgcgaccagcgcca

SEQ ID NO: 3506617 - RNA, 23 nt, Pseudomonas aeruginosa PA01
gccacgcgaccagcgccaggcgc

SEQ ID NO: 3506618 - RNA, 15 nt, Pseudomonas aeruginosa PA01
gccacgcgagaagcc

SEQ ID NO: 3506619 - RNA, 19 nt, Pseudomonas aeruginosa PA01
gccacgcgagaagccgccc

SEQ ID NO: 3506620 - RNA, 20 nt, Pseudomonas aeruginosa PA01
gccacgcgcaucgugcagcc

SEQ ID NO: 3506621 - RNA, 17 nt, Pseudomonas aeruginosa PA01
gccacgcucuccaaccg

SEQ ID NO: 3506622 - RNA, 18 nt, Pseudomonas aeruginosa PA01
gccacgcucucgaacagc

SEQ ID NO: 3506623 - RNA, 19 nt, Pseudomonas aeruginosa PA01
gccacgcucucgaacagca

SEQ ID NO: 3506624 - RNA, 19 nt, Pseudomonas aeruginosa PA01
gccacgcugaucaucagca

SEQ ID NO: 3506625 - RNA, 20 nt, Pseudomonas aeruginosa PA01
gccacgcugaucaucagcag

SEQ ID NO: 3506626 - RNA, 22 nt, Pseudomonas aeruginosa PA01
gccacgcugaucaucagcaggg

SEQ ID NO: 3506627 - RNA, 14 nt, Pseudomonas aeruginosa PA01
gccacgcugcugcc

SEQ ID NO: 3506628 - RNA, 15 nt, Pseudomonas aeruginosa PA01
gccacgcugcugccg

SEQ ID NO: 3506629 - RNA, 18 nt, Pseudomonas aeruginosa PA01
gccacgcugcugccggcc

SEQ ID NO: 3506630 - RNA, 20 nt, Pseudomonas aeruginosa PA01
gccacgcuucugcgccuccu

SEQ ID NO: 3506631 - RNA, 18 nt, Pseudomonas aeruginosa PA01
gccacgcuugucguggcg

SEQ ID NO: 3506632 - RNA, 19 nt, Pseudomonas aeruginosa PA01
gccacgcuugucguggcgg

SEQ ID NO: 3506633 - RNA, 21 nt, Pseudomonas aeruginosa PA01
gccacgcuugucguggcgggc

SEQ ID NO: 3506634 - RNA, 22 nt, Pseudomonas aeruginosa PA01
gccacgcuugucguggcgggcu

SEQ ID NO: 3506635 - RNA, 23 nt, Pseudomonas aeruginosa PA01
gccacgcuugucguggcgggcuc

SEQ ID NO: 3506636 - RNA, 17 nt, Pseudomonas aeruginosa PA01
gccacggaaggccacgc

SEQ ID NO: 3506637 - RNA, 23 nt, Pseudomonas aeruginosa PA01
gccacggaaggccacgccgccgu

SEQ ID NO: 3506638 - RNA, 19 nt, Pseudomonas aeruginosa PA01
gccacggauaugcgccgcc

SEQ ID NO: 3506639 - RNA, 22 nt, Pseudomonas aeruginosa PA01
gccacggauaugcgccgccacg

SEQ ID NO: 3506640 - RNA, 21 nt, Pseudomonas aeruginosa PA01
gccacggaugcagucccgcca

SEQ ID NO: 3506641 - RNA, 14 nt, Pseudomonas aeruginosa PA01
gccacggcaucgga

SEQ ID NO: 3506642 - RNA, 13 nt, Pseudomonas aeruginosa PA01
gccacggccgcug

SEQ ID NO: 3506643 - RNA, 16 nt, Pseudomonas aeruginosa PA01
gccacggccgcugcgc

SEQ ID NO: 3506644 - RNA, 17 nt, Pseudomonas aeruginosa PA01
gccacggccgcugcgca

SEQ ID NO: 3506645 - RNA, 14 nt, Pseudomonas aeruginosa PA01
gccacggccggcga

SEQ ID NO: 3506646 - RNA, 15 nt, Pseudomonas aeruginosa PA01
gccacggccggcgag

SEQ ID NO: 3506647 - RNA, 17 nt, Pseudomonas aeruginosa PA01
gccacggccggcgaggc

SEQ ID NO: 3506648 - RNA, 13 nt, Pseudomonas aeruginosa PA01
gccacggcgagag

SEQ ID NO: 3506649 - RNA, 22 nt, Pseudomonas aeruginosa PA01
gccacggcgagagcgccgacca

SEQ ID NO: 3506650 - RNA, 16 nt, Pseudomonas aeruginosa PA01
gccacggcgaucgccg

SEQ ID NO: 3506651 - RNA, 17 nt, Pseudomonas aeruginosa PA01
gccacggcgaucgccgg

SEQ ID NO: 3506652 - RNA, 12 nt, Pseudomonas aeruginosa PA01
gccacggcgcgg

SEQ ID NO: 3506653 - RNA, 18 nt, Pseudomonas aeruginosa PA01
gccacgggcagaccuucg

SEQ ID NO: 3506654 - RNA, 15 nt, Pseudomonas aeruginosa PA01
gccacgggcgccagc

SEQ ID NO: 3506655 - RNA, 17 nt, Pseudomonas aeruginosa PA01
gccacgggcgccagcgg

SEQ ID NO: 3506656 - RNA, 20 nt, Pseudomonas aeruginosa PA01
gccacggggccccucgccgu

SEQ ID NO: 3506657 - RNA, 16 nt, Pseudomonas aeruginosa PA01
gccacguacagcgcga

SEQ ID NO: 3506658 - RNA, 17 nt, Pseudomonas aeruginosa PA01
gccacguccagcggcau

SEQ ID NO: 3506659 - RNA, 21 nt, Pseudomonas aeruginosa PA01
gccacguccuugguguagccg

SEQ ID NO: 3506660 - RNA, 12 nt, Pseudomonas aeruginosa PA01
gccacgucgccc

SEQ ID NO: 3506661 - RNA, 17 nt, Pseudomonas aeruginosa PA01
gccacgucgccccaggg

SEQ ID NO: 3506662 - RNA, 18 nt, Pseudomonas aeruginosa PA01
gccacgucgccccaggga

SEQ ID NO: 3506663 - RNA, 22 nt, Pseudomonas aeruginosa PA01
gccacgucugugccgaggccgc

SEQ ID NO: 3506664 - RNA, 19 nt, Pseudomonas aeruginosa PA01
gccacgugcacgccgugca

SEQ ID NO: 3506665 - RNA, 20 nt, Pseudomonas aeruginosa PA01
gccacgugcacgccgugcau

SEQ ID NO: 3506666 - RNA, 20 nt, Pseudomonas aeruginosa PA01
gccacgugcggggugcgcug

SEQ ID NO: 3506667 - RNA, 15 nt, Pseudomonas aeruginosa PA01
gccacguucugcagg

SEQ ID NO: 3506668 - RNA, 16 nt, Pseudomonas aeruginosa PA01
gccacguucugcagga

SEQ ID NO: 3506669 - RNA, 19 nt, Pseudomonas aeruginosa PA01
gccacguucugcaggacga

SEQ ID NO: 3506670 - RNA, 22 nt, Pseudomonas aeruginosa PA01
gccacuauuccuugcgccaugc

SEQ ID NO: 3506671 - RNA, 23 nt, Pseudomonas aeruginosa PA01
gccacuauuccuugcgccaugcg

SEQ ID NO: 3506672 - RNA, 16 nt, Pseudomonas aeruginosa PA01
gccacuccagccccgc

SEQ ID NO: 3506673 - RNA, 18 nt, Pseudomonas aeruginosa PA01
gccacuccgggcuggucg

SEQ ID NO: 3506674 - RNA, 17 nt, Pseudomonas aeruginosa PA01
gccacucgcagccgcgc

SEQ ID NO: 3506675 - RNA, 18 nt, Pseudomonas aeruginosa PA01
gccacucgcagccgcgcu

SEQ ID NO: 3506676 - RNA, 19 nt, Pseudomonas aeruginosa PA01
gccacucgcagccgcgcuc

SEQ ID NO: 3506677 - RNA, 13 nt, Pseudomonas aeruginosa PA01
gccacucgcgacg

SEQ ID NO: 3506678 - RNA, 15 nt, Pseudomonas aeruginosa PA01
gccacucggccaggc

SEQ ID NO: 3506679 - RNA, 16 nt, Pseudomonas aeruginosa PA01
gccacucggccaggcg

SEQ ID NO: 3506680 - RNA, 17 nt, Pseudomonas aeruginosa PA01
gccacucggccaggcgc

SEQ ID NO: 3506681 - RNA, 24 nt, Pseudomonas aeruginosa PA01
gccacucggccaggcgccagggcc

SEQ ID NO: 3506682 - RNA, 14 nt, Pseudomonas aeruginosa PA01
gccacucggcgugc

SEQ ID NO: 3506683 - RNA, 19 nt, Pseudomonas aeruginosa PA01
gccacucggcgugccgggc

SEQ ID NO: 3506684 - RNA, 20 nt, Pseudomonas aeruginosa PA01
gccacucggcgugccgggcc

SEQ ID NO: 3506685 - RNA, 21 nt, Pseudomonas aeruginosa PA01
gccacucggcgugccgggccg

SEQ ID NO: 3506686 - RNA, 20 nt, Pseudomonas aeruginosa PA01
gccacugaacuggaucggcc

SEQ ID NO: 3506687 - RNA, 23 nt, Pseudomonas aeruginosa PA01
gccacugaacuggaucggcccca

SEQ ID NO: 3506688 - RNA, 20 nt, Pseudomonas aeruginosa PA01
gccacugacgcgcagcgccg

SEQ ID NO: 3506689 - RNA, 21 nt, Pseudomonas aeruginosa PA01
gccacugacgcgcagcgccgc

SEQ ID NO: 3506690 - RNA, 23 nt, Pseudomonas aeruginosa PA01
gccacugacgcgcagcgccgccg

SEQ ID NO: 3506691 - RNA, 18 nt, Pseudomonas aeruginosa PA01
gccacugauaccgcuggc

SEQ ID NO: 3506692 - RNA, 22 nt, Pseudomonas aeruginosa PA01
gccacugauaccgcuggccagg

SEQ ID NO: 3506693 - RNA, 19 nt, Pseudomonas aeruginosa PA01
gccacugccgccucagcga

SEQ ID NO: 3506694 - RNA, 15 nt, Pseudomonas aeruginosa PA01
gccacugcuuggcga

SEQ ID NO: 3506695 - RNA, 15 nt, Pseudomonas aeruginosa PA01
gccacuggcggaccg

SEQ ID NO: 3506696 - RNA, 19 nt, Pseudomonas aeruginosa PA01
gccacuggcggaccgccuc

SEQ ID NO: 3506697 - RNA, 17 nt, Pseudomonas aeruginosa PA01
gccacuucaagcuggcg

SEQ ID NO: 3506698 - RNA, 13 nt, Pseudomonas aeruginosa PA01
gccacuuccagca

SEQ ID NO: 3506699 - RNA, 17 nt, Pseudomonas aeruginosa PA01
gccacuuccagcacgcc

SEQ ID NO: 3506700 - RNA, 21 nt, Pseudomonas aeruginosa PA01
gccacuuccagcacgccgauc

SEQ ID NO: 3506701 - RNA, 22 nt, Pseudomonas aeruginosa PA01
gccacuuccagcacgccgaucc

SEQ ID NO: 3506702 - RNA, 14 nt, Pseudomonas aeruginosa PA01
gccacuuccagcuu

SEQ ID NO: 3506703 - RNA, 19 nt, Pseudomonas aeruginosa PA01
gccacuuccagcuugcgcu

SEQ ID NO: 3506704 - RNA, 20 nt, Pseudomonas aeruginosa PA01
gccacuuccagcuugcgcuc

SEQ ID NO: 3506705 - RNA, 14 nt, Pseudomonas aeruginosa PA01
gccacuucccggcg

SEQ ID NO: 3506706 - RNA, 15 nt, Pseudomonas aeruginosa PA01
gccacuucccggcgc

SEQ ID NO: 3506707 - RNA, 16 nt, Pseudomonas aeruginosa PA01
gccacuucccggcgca

SEQ ID NO: 3506708 - RNA, 17 nt, Pseudomonas aeruginosa PA01
gccacuucccggcgcag

SEQ ID NO: 3506709 - RNA, 16 nt, Pseudomonas aeruginosa PA01
gccacuucguccggcc

SEQ ID NO: 3506710 - RNA, 17 nt, Pseudomonas aeruginosa PA01
gccacuucguccggccg

SEQ ID NO: 3506711 - RNA, 20 nt, Pseudomonas aeruginosa PA01
gccacuucguccggccgccc

SEQ ID NO: 3506712 - RNA, 22 nt, Pseudomonas aeruginosa PA01
gccacuucguccggccgcccga

SEQ ID NO: 3506713 - RNA, 15 nt, Pseudomonas aeruginosa PA01
gccagaaaacccagc

SEQ ID NO: 3506714 - RNA, 16 nt, Pseudomonas aeruginosa PA01
gccagaaaacccagcg

SEQ ID NO: 3506715 - RNA, 15 nt, Pseudomonas aeruginosa PA01
gccagaagcgcucgu

SEQ ID NO: 3506716 - RNA, 17 nt, Pseudomonas aeruginosa PA01
gccagaagcggccgacc

SEQ ID NO: 3506717 - RNA, 18 nt, Pseudomonas aeruginosa PA01
gccagaagcggccgacca

SEQ ID NO: 3506718 - RNA, 17 nt, Pseudomonas aeruginosa PA01
gccagaaugugccggua

SEQ ID NO: 3506719 - RNA, 22 nt, Pseudomonas aeruginosa PA01
gccagaaugugccgguagcugg

SEQ ID NO: 3506720 - RNA, 17 nt, Pseudomonas aeruginosa PA01
gccagaauuccagcagg

SEQ ID NO: 3506721 - RNA, 22 nt, Pseudomonas aeruginosa PA01
gccagaauuccagcaggucggc

SEQ ID NO: 3506722 - RNA, 17 nt, Pseudomonas aeruginosa PA01
gccagaccagccccagu

SEQ ID NO: 3506723 - RNA, 24 nt, Pseudomonas aeruginosa PA01
gccagaccgagauuggccgccugc

SEQ ID NO: 3506724 - RNA, 16 nt, Pseudomonas aeruginosa PA01
gccagaccggcagcgc

SEQ ID NO: 3506725 - RNA, 18 nt, Pseudomonas aeruginosa PA01
gccagaccggcagcgccg

SEQ ID NO: 3506726 - RNA, 20 nt, Pseudomonas aeruginosa PA01
gccagaccggcagcgccgcc

SEQ ID NO: 3506727 - RNA, 21 nt, Pseudomonas aeruginosa PA01
gccagaccggcagcgccgcca

SEQ ID NO: 3506728 - RNA, 15 nt, Pseudomonas aeruginosa PA01
gccagaccguggcgc

SEQ ID NO: 3506729 - RNA, 16 nt, Pseudomonas aeruginosa PA01
gccagaccguggcgcu

SEQ ID NO: 3506730 - RNA, 16 nt, Pseudomonas aeruginosa PA01
gccagacgaucagcgg

SEQ ID NO: 3506731 - RNA, 18 nt, Pseudomonas aeruginosa PA01
gccagacgaucagcggcc

SEQ ID NO: 3506732 - RNA, 19 nt, Pseudomonas aeruginosa PA01
gccagacgaucagcggccc

SEQ ID NO: 3506733 - RNA, 17 nt, Pseudomonas aeruginosa PA01
gccagacguccggcagg

SEQ ID NO: 3506734 - RNA, 13 nt, Pseudomonas aeruginosa PA01
gccagagaucgcc

SEQ ID NO: 3506735 - RNA, 14 nt, Pseudomonas aeruginosa PA01
gccagagaucgccc

SEQ ID NO: 3506736 - RNA, 16 nt, Pseudomonas aeruginosa PA01
gccagagcacgaaagc

SEQ ID NO: 3506737 - RNA, 14 nt, Pseudomonas aeruginosa PA01
gccagagcagcguc

SEQ ID NO: 3506738 - RNA, 12 nt, Pseudomonas aeruginosa PA01
gccagagccagu

SEQ ID NO: 3506739 - RNA, 22 nt, Pseudomonas aeruginosa PA01
gccagagccagucgagagcggg

SEQ ID NO: 3506740 - RNA, 23 nt, Pseudomonas aeruginosa PA01
gccagagcccgucgaagccaggc

SEQ ID NO: 3506741 - RNA, 13 nt, Pseudomonas aeruginosa PA01
gccagagcgcgcu

SEQ ID NO: 3506742 - RNA, 21 nt, Pseudomonas aeruginosa PA01
gccagagcgcgcuacucaggu

SEQ ID NO: 3506743 - RNA, 21 nt, Pseudomonas aeruginosa PA01
gccagagcgcugccugcaccg

SEQ ID NO: 3506744 - RNA, 19 nt, Pseudomonas aeruginosa PA01
gccagagcguaucgaugcg

SEQ ID NO: 3506745 - RNA, 17 nt, Pseudomonas aeruginosa PA01
gccagaggaucggccaa

SEQ ID NO: 3506746 - RNA, 19 nt, Pseudomonas aeruginosa PA01
gccagaggaucggccaacu

SEQ ID NO: 3506747 - RNA, 16 nt, Pseudomonas aeruginosa PA01
gccagaugacgauggc

SEQ ID NO: 3506748 - RNA, 21 nt, Pseudomonas aeruginosa PA01
gccagaugacgauggccgccg

SEQ ID NO: 3506749 - RNA, 18 nt, Pseudomonas aeruginosa PA01
gccagaugcgcgucgccg

SEQ ID NO: 3506750 - RNA, 19 nt, Pseudomonas aeruginosa PA01
gccagaugcgcgucgccga

SEQ ID NO: 3506751 - RNA, 18 nt, Pseudomonas aeruginosa PA01
gccagcaaacccgggccc

SEQ ID NO: 3506752 - RNA, 19 nt, Pseudomonas aeruginosa PA01
gccagcaaacccgggccca

SEQ ID NO: 3506753 - RNA, 16 nt, Pseudomonas aeruginosa PA01
gccagcaacaguugcc

SEQ ID NO: 3506754 - RNA, 19 nt, Pseudomonas aeruginosa PA01
gccagcaacaguugccgca

SEQ ID NO: 3506755 - RNA, 22 nt, Pseudomonas aeruginosa PA01
gccagcaacaguugccgcagca

SEQ ID NO: 3506756 - RNA, 16 nt, Pseudomonas aeruginosa PA01
gccagcaacccgcccu

SEQ ID NO: 3506757 - RNA, 15 nt, Pseudomonas aeruginosa PA01
gccagcaacggcucc

SEQ ID NO: 3506758 - RNA, 17 nt, Pseudomonas aeruginosa PA01
gccagcaauacccgccg

SEQ ID NO: 3506759 - RNA, 19 nt, Pseudomonas aeruginosa PA01
gccagcaauacccgccgcu

SEQ ID NO: 3506760 - RNA, 15 nt, Pseudomonas aeruginosa PA01
gccagcaaugcccgc

SEQ ID NO: 3506761 - RNA, 18 nt, Pseudomonas aeruginosa PA01
gccagcaauugccgcugc

SEQ ID NO: 3506762 - RNA, 19 nt, Pseudomonas aeruginosa PA01
gccagcaauugccgcugca

SEQ ID NO: 3506763 - RNA, 13 nt, Pseudomonas aeruginosa PA01
gccagcaccaccc

SEQ ID NO: 3506764 - RNA, 17 nt, Pseudomonas aeruginosa PA01
gccagcaccacccggcc

SEQ ID NO: 3506765 - RNA, 21 nt, Pseudomonas aeruginosa PA01
gccagcaccacccggccgcgc

SEQ ID NO: 3506766 - RNA, 22 nt, Pseudomonas aeruginosa PA01
gccagcaccacccggccgcgcu

SEQ ID NO: 3506767 - RNA, 12 nt, Pseudomonas aeruginosa PA01
gccagcaccagc

SEQ ID NO: 3506768 - RNA, 13 nt, Pseudomonas aeruginosa PA01
gccagcaccagca

SEQ ID NO: 3506769 - RNA, 14 nt, Pseudomonas aeruginosa PA01
gccagcaccagucc

SEQ ID NO: 3506770 - RNA, 15 nt, Pseudomonas aeruginosa PA01
gccagcaccaguccc

SEQ ID NO: 3506771 - RNA, 16 nt, Pseudomonas aeruginosa PA01
gccagcaccagucccu

SEQ ID NO: 3506772 - RNA, 13 nt, Pseudomonas aeruginosa PA01
gccagcaccaugc

SEQ ID NO: 3506773 - RNA, 14 nt, Pseudomonas aeruginosa PA01
gccagcaccaugcg

SEQ ID NO: 3506774 - RNA, 19 nt, Pseudomonas aeruginosa PA01
gccagcaccaugcgcggca

SEQ ID NO: 3506775 - RNA, 18 nt, Pseudomonas aeruginosa PA01
gccagcaccguggucagc

SEQ ID NO: 3506776 - RNA, 22 nt, Pseudomonas aeruginosa PA01
gccagcaccguggucagcacca

SEQ ID NO: 3506777 - RNA, 14 nt, Pseudomonas aeruginosa PA01
gccagcaccucgac

SEQ ID NO: 3506778 - RNA, 15 nt, Pseudomonas aeruginosa PA01
gccagcaccucgacg

SEQ ID NO: 3506779 - RNA, 17 nt, Pseudomonas aeruginosa PA01
gccagcaccucgacgcc

SEQ ID NO: 3506780 - RNA, 19 nt, Pseudomonas aeruginosa PA01
gccagcaccucgacgcccg

SEQ ID NO: 3506781 - RNA, 16 nt, Pseudomonas aeruginosa PA01
gccagcaccuggcagu

SEQ ID NO: 3506782 - RNA, 17 nt, Pseudomonas aeruginosa PA01
gccagcaccuggcagug

SEQ ID NO: 3506783 - RNA, 18 nt, Pseudomonas aeruginosa PA01
gccagcaccuucaucacc

SEQ ID NO: 3506784 - RNA, 18 nt, Pseudomonas aeruginosa PA01
gccagcacggcgcagggc

SEQ ID NO: 3506785 - RNA, 16 nt, Pseudomonas aeruginosa PA01
gccagcacgguacacg

SEQ ID NO: 3506786 - RNA, 22 nt, Pseudomonas aeruginosa PA01
gccagcacgguacacgccguug

SEQ ID NO: 3506787 - RNA, 15 nt, Pseudomonas aeruginosa PA01
gccagcagacggcac

SEQ ID NO: 3506788 - RNA, 12 nt, Pseudomonas aeruginosa PA01
gccagcagcacg

SEQ ID NO: 3506789 - RNA, 17 nt, Pseudomonas aeruginosa PA01
gccagcagcagaagggc

SEQ ID NO: 3506790 - RNA, 13 nt, Pseudomonas aeruginosa PA01
gccagcagcaucg

SEQ ID NO: 3506791 - RNA, 12 nt, Pseudomonas aeruginosa PA01
gccagcagcaug

SEQ ID NO: 3506792 - RNA, 16 nt, Pseudomonas aeruginosa PA01
gccagcagccaggccu

SEQ ID NO: 3506793 - RNA, 15 nt, Pseudomonas aeruginosa PA01
gccagcagcccggcc

SEQ ID NO: 3506794 - RNA, 19 nt, Pseudomonas aeruginosa PA01
gccagcagcccggccugga

SEQ ID NO: 3506795 - RNA, 20 nt, Pseudomonas aeruginosa PA01
gccagcagcccggccuggau

SEQ ID NO: 3506796 - RNA, 13 nt, Pseudomonas aeruginosa PA01
gccagcagcgccu

SEQ ID NO: 3506797 - RNA, 16 nt, Pseudomonas aeruginosa PA01
gccagcagcgccuccu

SEQ ID NO: 3506798 - RNA, 20 nt, Pseudomonas aeruginosa PA01
gccagcagcgccuccucuac

SEQ ID NO: 3506799 - RNA, 13 nt, Pseudomonas aeruginosa PA01
gccagcagcgcug

SEQ ID NO: 3506800 - RNA, 19 nt, Pseudomonas aeruginosa PA01
gccagcagcgcugaucacg

SEQ ID NO: 3506801 - RNA, 20 nt, Pseudomonas aeruginosa PA01
gccagcagcgcugaucacga

SEQ ID NO: 3506802 - RNA, 13 nt, Pseudomonas aeruginosa PA01
gccagcagcggcg

SEQ ID NO: 3506803 - RNA, 15 nt, Pseudomonas aeruginosa PA01
gccagcagcggcggc

SEQ ID NO: 3506804 - RNA, 19 nt, Pseudomonas aeruginosa PA01
gccagcagcggcggcgccg

SEQ ID NO: 3506805 - RNA, 13 nt, Pseudomonas aeruginosa PA01
gccagcaggaucg

SEQ ID NO: 3506806 - RNA, 21 nt, Pseudomonas aeruginosa PA01
gccagcaggaucgacagcagc

SEQ ID NO: 3506807 - RNA, 22 nt, Pseudomonas aeruginosa PA01
gccagcaggaugcugcacagcc

SEQ ID NO: 3506808 - RNA, 12 nt, Pseudomonas aeruginosa PA01
gccagcaggccg

SEQ ID NO: 3506809 - RNA, 15 nt, Pseudomonas aeruginosa PA01
gccagcaggccgaag

SEQ ID NO: 3506810 - RNA, 17 nt, Pseudomonas aeruginosa PA01
gccagcaggccgaaggc

SEQ ID NO: 3506811 - RNA, 15 nt, Pseudomonas aeruginosa PA01
gcagggcgccgauca

SEQ ID NO: 3506812 - RNA, 21 nt, Pseudomonas aeruginosa PA01
gcagggcgccgaucaggcgua

SEQ ID NO: 3506813 - RNA, 21 nt, Pseudomonas aeruginosa PA01
gcagggcgcugagcgcgguca

SEQ ID NO: 3506814 - RNA, 16 nt, Pseudomonas aeruginosa PA01
gcagggcggcgagcug

SEQ ID NO: 3506815 - RNA, 18 nt, Pseudomonas aeruginosa PA01
gcagggcggcgaugacca

SEQ ID NO: 3506816 - RNA, 14 nt, Pseudomonas aeruginosa PA01
gcagggcggcgccu

SEQ ID NO: 3506817 - RNA, 15 nt, Pseudomonas aeruginosa PA01
gcagggcggcgccug

SEQ ID NO: 3506818 - RNA, 19 nt, Pseudomonas aeruginosa PA01
gcagggcggcgccuggagc

SEQ ID NO: 3506819 - RNA, 18 nt, Pseudomonas aeruginosa PA01
gcagggcggcuuccaggu

SEQ ID NO: 3506820 - RNA, 19 nt, Pseudomonas aeruginosa PA01
gcagggcgguacgccgcgc

SEQ ID NO: 3506821 - RNA, 18 nt, Pseudomonas aeruginosa PA01
gcagggcguaggcgucgc

SEQ ID NO: 3506822 - RNA, 22 nt, Pseudomonas aeruginosa PA01
gcagggcguaggcgucgcgaac

SEQ ID NO: 3506823 - RNA, 17 nt, Pseudomonas aeruginosa PA01
gcagggcguagugcucc

SEQ ID NO: 3506824 - RNA, 23 nt, Pseudomonas aeruginosa PA01
gcagggcgucccguuccggcgca

SEQ ID NO: 3506825 - RNA, 15 nt, Pseudomonas aeruginosa PA01
gcagggcgucgccgg

SEQ ID NO: 3506826 - RNA, 17 nt, Pseudomonas aeruginosa PA01
gcagggcgucgccggga

SEQ ID NO: 3506827 - RNA, 22 nt, Pseudomonas aeruginosa PA01
gcagggcugcuguugccaggga

SEQ ID NO: 3506828 - RNA, 17 nt, Pseudomonas aeruginosa PA01
gcagggcuuccuuggcg

SEQ ID NO: 3506829 - RNA, 16 nt, Pseudomonas aeruginosa PA01
gcaggggcaccggcgg

SEQ ID NO: 3506830 - RNA, 13 nt, Pseudomonas aeruginosa PA01
gcaggggcgcgcc

SEQ ID NO: 3506831 - RNA, 18 nt, Pseudomonas aeruginosa PA01
gcaggggcgcgccggcuu

SEQ ID NO: 3506832 - RNA, 22 nt, Pseudomonas aeruginosa PA01
gcaggggcuuucuucgccuggc

SEQ ID NO: 3506833 - RNA, 22 nt, Pseudomonas aeruginosa PA01
gcagggggaagugaagagcucc

SEQ ID NO: 3506834 - RNA, 13 nt, Pseudomonas aeruginosa PA01
gcaggguaccgcu

SEQ ID NO: 3506835 - RNA, 22 nt, Pseudomonas aeruginosa PA01
gcaggguaccgcuggcgcuggg

SEQ ID NO: 3506836 - RNA, 17 nt, Pseudomonas aeruginosa PA01
gcaggguagccacgccg

SEQ ID NO: 3506837 - RNA, 18 nt, Pseudomonas aeruginosa PA01
gcaggguauuuuccagca

SEQ ID NO: 3506838 - RNA, 18 nt, Pseudomonas aeruginosa PA01
gcagggucacgccgauca

SEQ ID NO: 3506839 - RNA, 20 nt, Pseudomonas aeruginosa PA01
gcagggucacgccgaucacc

SEQ ID NO: 3506840 - RNA, 22 nt, Pseudomonas aeruginosa PA01
gcagggucacgccgaucacccc

SEQ ID NO: 3506841 - RNA, 16 nt, Pseudomonas aeruginosa PA01
gcagggucacgccggu

SEQ ID NO: 3506842 - RNA, 17 nt, Pseudomonas aeruginosa PA01
gcagggucacgccggug

SEQ ID NO: 3506843 - RNA, 18 nt, Pseudomonas aeruginosa PA01
gcagggucacgccgguga

SEQ ID NO: 3506844 - RNA, 19 nt, Pseudomonas aeruginosa PA01
gcagggucacgcugggcag

SEQ ID NO: 3506845 - RNA, 14 nt, Pseudomonas aeruginosa PA01
gcagggucagcagc

SEQ ID NO: 3506846 - RNA, 16 nt, Pseudomonas aeruginosa PA01
gcagggucagcagcgc

SEQ ID NO: 3506847 - RNA, 19 nt, Pseudomonas aeruginosa PA01
gcagggucagcagcgccag

SEQ ID NO: 3506848 - RNA, 18 nt, Pseudomonas aeruginosa PA01
gcagggucaggcccuuga

SEQ ID NO: 3506849 - RNA, 12 nt, Pseudomonas aeruginosa PA01
gcagggucaggg

SEQ ID NO: 3506850 - RNA, 15 nt, Pseudomonas aeruginosa PA01
gcagggucaggguga

SEQ ID NO: 3506851 - RNA, 18 nt, Pseudomonas aeruginosa PA01
gcagggucagucgagcag

SEQ ID NO: 3506852 - RNA, 15 nt, Pseudomonas aeruginosa PA01
gcagggucgccgggu

SEQ ID NO: 3506853 - RNA, 17 nt, Pseudomonas aeruginosa PA01
gcagggucgcgagcagg

SEQ ID NO: 3506854 - RNA, 18 nt, Pseudomonas aeruginosa PA01
gcagggucgcgagcaggg

SEQ ID NO: 3506855 - RNA, 19 nt, Pseudomonas aeruginosa PA01
gcagggucgcgagcagggc

SEQ ID NO: 3506856 - RNA, 20 nt, Pseudomonas aeruginosa PA01
gcagggucgcgagcagggcg

SEQ ID NO: 3506857 - RNA, 22 nt, Pseudomonas aeruginosa PA01
gcagggucgcgagcagggcgau

SEQ ID NO: 3506858 - RNA, 22 nt, Pseudomonas aeruginosa PA01
gcagggucgcguuggcgugcuc

SEQ ID NO: 3506859 - RNA, 21 nt, Pseudomonas aeruginosa PA01
gcagggucuucaggcgccguu

SEQ ID NO: 3506860 - RNA, 17 nt, Pseudomonas aeruginosa PA01
gcagggugaagcugcgg

SEQ ID NO: 3506861 - RNA, 19 nt, Pseudomonas aeruginosa PA01
gcagggugcggauggcgau

SEQ ID NO: 3506862 - RNA, 14 nt, Pseudomonas aeruginosa PA01
gcagggugcgggcg

SEQ ID NO: 3506863 - RNA, 16 nt, Pseudomonas aeruginosa PA01
gcagggugcgggcgcg

SEQ ID NO: 3506864 - RNA, 14 nt, Pseudomonas aeruginosa PA01
gcaggguggccagg

SEQ ID NO: 3506865 - RNA, 14 nt, Pseudomonas aeruginosa PA01
gcaggguggcgacg

SEQ ID NO: 3506866 - RNA, 12 nt, Pseudomonas aeruginosa PA01
gcagggugucga

SEQ ID NO: 3506867 - RNA, 23 nt, Pseudomonas aeruginosa PA01
gcaggguguugaucaccgcggug

SEQ ID NO: 3506868 - RNA, 22 nt, Pseudomonas aeruginosa PA01
gcaggguucggggaacagcgcc

SEQ ID NO: 3506869 - RNA, 13 nt, Pseudomonas aeruginosa PA01
gcagguaacccgc

SEQ ID NO: 3506870 - RNA, 16 nt, Pseudomonas aeruginosa PA01
gcagguaacccgcggc

SEQ ID NO: 3506871 - RNA, 18 nt, Pseudomonas aeruginosa PA01
gcagguaacccgcggcga

SEQ ID NO: 3506872 - RNA, 14 nt, Pseudomonas aeruginosa PA01
gcagguacagcagc

SEQ ID NO: 3506873 - RNA, 21 nt, Pseudomonas aeruginosa PA01
gcagguacagcgacucgcugc

SEQ ID NO: 3506874 - RNA, 16 nt, Pseudomonas aeruginosa PA01
gcagguacggcgccgc

SEQ ID NO: 3506875 - RNA, 17 nt, Pseudomonas aeruginosa PA01
gcagguacggcgccgcu

SEQ ID NO: 3506876 - RNA, 16 nt, Pseudomonas aeruginosa PA01
gcagguacucgccggc

SEQ ID NO: 3506877 - RNA, 18 nt, Pseudomonas aeruginosa PA01
gcagguacucgccggcga

SEQ ID NO: 3506878 - RNA, 19 nt, Pseudomonas aeruginosa PA01
gcagguagaaggugcccag

SEQ ID NO: 3506879 - RNA, 21 nt, Pseudomonas aeruginosa PA01
gcagguagaaggugcccagcg

SEQ ID NO: 3506880 - RNA, 17 nt, Pseudomonas aeruginosa PA01
gcagguagaccacgcag

SEQ ID NO: 3506881 - RNA, 19 nt, Pseudomonas aeruginosa PA01
gcagguagaccacgcaggc

SEQ ID NO: 3506882 - RNA, 20 nt, Pseudomonas aeruginosa PA01
gcagguagaccacgcaggcc

SEQ ID NO: 3506883 - RNA, 22 nt, Pseudomonas aeruginosa PA01
gcagguagaccacgcaggccag

SEQ ID NO: 3506884 - RNA, 14 nt, Pseudomonas aeruginosa PA01
gcagguagaccgcc

SEQ ID NO: 3506885 - RNA, 18 nt, Pseudomonas aeruginosa PA01
gcagguagaccgccucgg

SEQ ID NO: 3506886 - RNA, 14 nt, Pseudomonas aeruginosa PA01
gcagguagacgcag

SEQ ID NO: 3506887 - RNA, 21 nt, Pseudomonas aeruginosa PA01
gcagguagcagccguccagcu

SEQ ID NO: 3506888 - RNA, 13 nt, Pseudomonas aeruginosa PA01
gcagguagccagg

SEQ ID NO: 3506889 - RNA, 13 nt, Pseudomonas aeruginosa PA01
gcagguagccgcg

SEQ ID NO: 3506890 - RNA, 20 nt, Pseudomonas aeruginosa PA01
gcagguagccgcgccggccg

SEQ ID NO: 3506891 - RNA, 18 nt, Pseudomonas aeruginosa PA01
gcagguagccugcggcca

SEQ ID NO: 3506892 - RNA, 19 nt, Pseudomonas aeruginosa PA01
gcagguagccugcggccag

SEQ ID NO: 3506893 - RNA, 13 nt, Pseudomonas aeruginosa PA01
gcagguagcgcug

SEQ ID NO: 3506894 - RNA, 19 nt, Pseudomonas aeruginosa PA01
gcagguagcgcugcgcccg

SEQ ID NO: 3506895 - RNA, 20 nt, Pseudomonas aeruginosa PA01
gcagguagcgcugcgcccgc

SEQ ID NO: 3506896 - RNA, 22 nt, Pseudomonas aeruginosa PA01
gcagguagcgcugcgcccgcuc

SEQ ID NO: 3506897 - RNA, 23 nt, Pseudomonas aeruginosa PA01
gcagguagcgcugcgcccgcucg

SEQ ID NO: 3506898 - RNA, 17 nt, Pseudomonas aeruginosa PA01
gcagguagcugagcagg

SEQ ID NO: 3506899 - RNA, 18 nt, Pseudomonas aeruginosa PA01
gcagguagcugagcaggc

SEQ ID NO: 3506900 - RNA, 22 nt, Pseudomonas aeruginosa PA01
gcagguagcugcuccagcccgg

SEQ ID NO: 3506901 - RNA, 14 nt, Pseudomonas aeruginosa PA01
gcagguaguccagc

SEQ ID NO: 3506902 - RNA, 21 nt, Pseudomonas aeruginosa PA01
gcagguaguccagccagugca

SEQ ID NO: 3506903 - RNA, 11 nt, Pseudomonas aeruginosa PA01
gcagguagugc

SEQ ID NO: 3506904 - RNA, 17 nt, Pseudomonas aeruginosa PA01
gcagguagugcggcggg

SEQ ID NO: 3506905 - RNA, 20 nt, Pseudomonas aeruginosa PA01
gcagguagugcucggccagu

SEQ ID NO: 3506906 - RNA, 20 nt, Pseudomonas aeruginosa PA01
gcagguaguucuccaggccc

SEQ ID NO: 3506907 - RNA, 16 nt, Pseudomonas aeruginosa PA01
gcagguaucgcugggc

SEQ ID NO: 3506908 - RNA, 16 nt, Pseudomonas aeruginosa PA01
gcaggucacgcccugc

SEQ ID NO: 3506909 - RNA, 19 nt, Pseudomonas aeruginosa PA01
gcaggucaucaggaucagg

SEQ ID NO: 3506910 - RNA, 20 nt, Pseudomonas aeruginosa PA01
gcaggucaucaggaucaggu

SEQ ID NO: 3506911 - RNA, 20 nt, Pseudomonas aeruginosa PA01
gcagguccgacggaaauagg

SEQ ID NO: 3506912 - RNA, 17 nt, Pseudomonas aeruginosa PA01
gcagguccgcgccucgc

SEQ ID NO: 3506913 - RNA, 18 nt, Pseudomonas aeruginosa PA01
gcagguccgcgccucgcg

SEQ ID NO: 3506914 - RNA, 19 nt, Pseudomonas aeruginosa PA01
gcagguccgcgccucgcgc

SEQ ID NO: 3506915 - RNA, 20 nt, Pseudomonas aeruginosa PA01
gcagguccgcgccucgcgca

SEQ ID NO: 3506916 - RNA, 17 nt, Pseudomonas aeruginosa PA01
gcagguccggguugucg

SEQ ID NO: 3506917 - RNA, 22 nt, Pseudomonas aeruginosa PA01
gcagguccggguugucguugcg

SEQ ID NO: 3506918 - RNA, 23 nt, Pseudomonas aeruginosa PA01
gcagguccuggguauagaccagc

SEQ ID NO: 3506919 - RNA, 14 nt, Pseudomonas aeruginosa PA01
gcagguccuguccc

SEQ ID NO: 3506920 - RNA, 21 nt, Pseudomonas aeruginosa PA01
gcaggucgagcaguuccggca

SEQ ID NO: 3506921 - RNA, 16 nt, Pseudomonas aeruginosa PA01
gcaggucgaggcgcuc

SEQ ID NO: 3506922 - RNA, 18 nt, Pseudomonas aeruginosa PA01
gcaggucgagggcguccu

SEQ ID NO: 3506923 - RNA, 17 nt, Pseudomonas aeruginosa PA01
gcaggucgcgcaguucg

SEQ ID NO: 3506924 - RNA, 17 nt, Pseudomonas aeruginosa PA01
gcaggucgcgcggcgcc

SEQ ID NO: 3506925 - RNA, 15 nt, Pseudomonas aeruginosa PA01
gcaggucgcgcuggg

SEQ ID NO: 3506926 - RNA, 17 nt, Pseudomonas aeruginosa PA01
gcaggucgcgcugggcg

SEQ ID NO: 3506927 - RNA, 14 nt, Pseudomonas aeruginosa PA01
gcaggucgcggccc

SEQ ID NO: 3506928 - RNA, 22 nt, Pseudomonas aeruginosa PA01
gcaggucgcggccccagcacug

SEQ ID NO: 3506929 - RNA, 16 nt, Pseudomonas aeruginosa PA01
gcaggucgcugucgcg

SEQ ID NO: 3506930 - RNA, 13 nt, Pseudomonas aeruginosa PA01
gcaggucggccuc

SEQ ID NO: 3506931 - RNA, 15 nt, Pseudomonas aeruginosa PA01
gcaggucggccucgg

SEQ ID NO: 3506932 - RNA, 18 nt, Pseudomonas aeruginosa PA01
gcaggucgggcaacggcu

SEQ ID NO: 3506933 - RNA, 15 nt, Pseudomonas aeruginosa PA01
gcaggucgucggcga

SEQ ID NO: 3506934 - RNA, 16 nt, Pseudomonas aeruginosa PA01
gcaggucgugcagccc

SEQ ID NO: 3506935 - RNA, 17 nt, Pseudomonas aeruginosa PA01
gcaggucgugcagcccg

SEQ ID NO: 3506936 - RNA, 13 nt, Pseudomonas aeruginosa PA01
gcaggucgugcug

SEQ ID NO: 3506937 - RNA, 19 nt, Pseudomonas aeruginosa PA01
gcaggucgugcuggacuuc

SEQ ID NO: 3506938 - RNA, 13 nt, Pseudomonas aeruginosa PA01
gcaggucguuacg

SEQ ID NO: 3506939 - RNA, 14 nt, Pseudomonas aeruginosa PA01
gcaggucguugacg

SEQ ID NO: 3506940 - RNA, 18 nt, Pseudomonas aeruginosa PA01
gcaggucucaccgcccug

SEQ ID NO: 3506941 - RNA, 17 nt, Pseudomonas aeruginosa PA01
gcaggugcaccgcgcug

SEQ ID NO: 3506942 - RNA, 18 nt, Pseudomonas aeruginosa PA01
gcaggugcaccgcgcugg

SEQ ID NO: 3506943 - RNA, 14 nt, Pseudomonas aeruginosa PA01
gcaggugcccuggc

SEQ ID NO: 3506944 - RNA, 20 nt, Pseudomonas aeruginosa PA01
gcaggugcccuggcagacgc

SEQ ID NO: 3506945 - RNA, 17 nt, Pseudomonas aeruginosa PA01
gcaggugcuuggcaccg

SEQ ID NO: 3506946 - RNA, 17 nt, Pseudomonas aeruginosa PA01
gcagguggacggcauug

SEQ ID NO: 3506947 - RNA, 13 nt, Pseudomonas aeruginosa PA01
gcagguggccgga

SEQ ID NO: 3506948 - RNA, 16 nt, Pseudomonas aeruginosa PA01
gcagguggcgcacugc

SEQ ID NO: 3506949 - RNA, 20 nt, Pseudomonas aeruginosa PA01
gcagguggcgcacugccagg

SEQ ID NO: 3506950 - RNA, 24 nt, Pseudomonas aeruginosa PA01
gcagguggcgcacugccaggagca

SEQ ID NO: 3506951 - RNA, 12 nt, Pseudomonas aeruginosa PA01
gcagguggcggg

SEQ ID NO: 3506952 - RNA, 16 nt, Pseudomonas aeruginosa PA01
gcagguggcuggccau

SEQ ID NO: 3506953 - RNA, 20 nt, Pseudomonas aeruginosa PA01
gcaggugguaagcgagcaga

SEQ ID NO: 3506954 - RNA, 16 nt, Pseudomonas aeruginosa PA01
gcagguggucguugcg

SEQ ID NO: 3506955 - RNA, 20 nt, Pseudomonas aeruginosa PA01
gcagguggucguugcgcgcc

SEQ ID NO: 3506956 - RNA, 21 nt, Pseudomonas aeruginosa PA01
gcagguggucguugcgcgcca

SEQ ID NO: 3506957 - RNA, 23 nt, Pseudomonas aeruginosa PA01
gcagguggucguugcgcgccagc

SEQ ID NO: 3506958 - RNA, 21 nt, Pseudomonas aeruginosa PA01
gcagguggugguagagcggca

SEQ ID NO: 3506959 - RNA, 17 nt, Pseudomonas aeruginosa PA01
gcagguguucggcggcg

SEQ ID NO: 3506960 - RNA, 15 nt, Pseudomonas aeruginosa PA01
gcagguucagcaggu

SEQ ID NO: 3506961 - RNA, 21 nt, Pseudomonas aeruginosa PA01
gcagguucagcaggucgcggc

SEQ ID NO: 3506962 - RNA, 21 nt, Pseudomonas aeruginosa PA01
gcagguucgaaugcugcccgg

SEQ ID NO: 3506963 - RNA, 13 nt, Pseudomonas aeruginosa PA01
gcagguugacccc

SEQ ID NO: 3506964 - RNA, 18 nt, Pseudomonas aeruginosa PA01
gcagguugagggccgcgc

SEQ ID NO: 3506965 - RNA, 22 nt, Pseudomonas aeruginosa PA01
gcagguugagggccgcgcugcu

SEQ ID NO: 3506966 - RNA, 19 nt, Pseudomonas aeruginosa PA01
gcagguugauccugggcgc

SEQ ID NO: 3506967 - RNA, 21 nt, Pseudomonas aeruginosa PA01
gcagguugauccugggcgcca

SEQ ID NO: 3506968 - RNA, 16 nt, Pseudomonas aeruginosa PA01
gcagguugcgcuggcg

SEQ ID NO: 3506969 - RNA, 23 nt, Pseudomonas aeruginosa PA01
gcagguugcgcuggcgcagcagc

SEQ ID NO: 3506970 - RNA, 16 nt, Pseudomonas aeruginosa PA01
gcagguugcucgccuu

SEQ ID NO: 3506971 - RNA, 18 nt, Pseudomonas aeruginosa PA01
gcagguugcucgccuugg

SEQ ID NO: 3506972 - RNA, 15 nt, Pseudomonas aeruginosa PA01
gcagguugcuggcga

SEQ ID NO: 3506973 - RNA, 16 nt, Pseudomonas aeruginosa PA01
gcagguugcuggcgag

SEQ ID NO: 3506974 - RNA, 18 nt, Pseudomonas aeruginosa PA01
gcagguugcuggcgagga

SEQ ID NO: 3506975 - RNA, 16 nt, Pseudomonas aeruginosa PA01
gcagguuggccccgcc

SEQ ID NO: 3506976 - RNA, 20 nt, Pseudomonas aeruginosa PA01
gcagguuggccccgccgagg

SEQ ID NO: 3506977 - RNA, 13 nt, Pseudomonas aeruginosa PA01
gcagguuggucug

SEQ ID NO: 3506978 - RNA, 13 nt, Pseudomonas aeruginosa PA01
gcagguuucgcga

SEQ ID NO: 3506979 - RNA, 13 nt, Pseudomonas aeruginosa PA01
gcaguaacgccug

SEQ ID NO: 3506980 - RNA, 22 nt, Pseudomonas aeruginosa PA01
gcaguaacgccugucgcuccgg

SEQ ID NO: 3506981 - RNA, 16 nt, Pseudomonas aeruginosa PA01
gcaguacagcucggcg

SEQ ID NO: 3506982 - RNA, 17 nt, Pseudomonas aeruginosa PA01
gcaguacagcucggcgc

SEQ ID NO: 3506983 - RNA, 14 nt, Pseudomonas aeruginosa PA01
gcaguacagcugca

SEQ ID NO: 3506984 - RNA, 17 nt, Pseudomonas aeruginosa PA01
gcaguacagcugcaccg

SEQ ID NO: 3506985 - RNA, 22 nt, Pseudomonas aeruginosa PA01
gcaguacagcugcaccgcgcgg

SEQ ID NO: 3506986 - RNA, 13 nt, Pseudomonas aeruginosa PA01
gcaguacccggcc

SEQ ID NO: 3506987 - RNA, 21 nt, Pseudomonas aeruginosa PA01
gcaguacccggccgccuuccu

SEQ ID NO: 3506988 - RNA, 20 nt, Pseudomonas aeruginosa PA01
gcaguacgaggggccgccgu

SEQ ID NO: 3506989 - RNA, 18 nt, Pseudomonas aeruginosa PA01
gcaguacgaucagccagg

SEQ ID NO: 3506990 - RNA, 20 nt, Pseudomonas aeruginosa PA01
gcaguacgaucagccagggc

SEQ ID NO: 3506991 - RNA, 21 nt, Pseudomonas aeruginosa PA01
gcaguacgaucagccagggca

SEQ ID NO: 3506992 - RNA, 21 nt, Pseudomonas aeruginosa PA01
gcaguacguggcgcuugagca

SEQ ID NO: 3506993 - RNA, 23 nt, Pseudomonas aeruginosa PA01
gcaguacucaugaccgccgcuca

SEQ ID NO: 3506994 - RNA, 16 nt, Pseudomonas aeruginosa PA01
gcaguacuuggccagc

SEQ ID NO: 3506995 - RNA, 18 nt, Pseudomonas aeruginosa PA01
gcaguacuuggccagcag

SEQ ID NO: 3506996 - RNA, 20 nt, Pseudomonas aeruginosa PA01
gcaguacuuggccagcagca

SEQ ID NO: 3506997 - RNA, 16 nt, Pseudomonas aeruginosa PA01
gcaguagcucgccgag

SEQ ID NO: 3506998 - RNA, 18 nt, Pseudomonas aeruginosa PA01
gcaguagcucgccgaggu

SEQ ID NO: 3506999 - RNA, 14 nt, Pseudomonas aeruginosa PA01
gcaguaggccuggu

SEQ ID NO: 3507000 - RNA, 14 nt, Pseudomonas aeruginosa PA01
gcaguaggcgcugc

SEQ ID NO: 3507001 - RNA, 15 nt, Pseudomonas aeruginosa PA01
gcaguaggcgcugcc

SEQ ID NO: 3507002 - RNA, 12 nt, Pseudomonas aeruginosa PA01
gcaguccaggcc

SEQ ID NO: 3507003 - RNA, 14 nt, Pseudomonas aeruginosa PA01
gcagucccgccagg

SEQ ID NO: 3507004 - RNA, 15 nt, Pseudomonas aeruginosa PA01
gcagucccgccaggc

SEQ ID NO: 3507005 - RNA, 16 nt, Pseudomonas aeruginosa PA01
gcagucccgccaggcg

SEQ ID NO: 3507006 - RNA, 16 nt, Pseudomonas aeruginosa PA01
gcagucccgcgcggcc

SEQ ID NO: 3507007 - RNA, 17 nt, Pseudomonas aeruginosa PA01
gcagucccgcgcggccc

SEQ ID NO: 3507008 - RNA, 18 nt, Pseudomonas aeruginosa PA01
gcagucccgcgcggcccu

SEQ ID NO: 3507009 - RNA, 21 nt, Pseudomonas aeruginosa PA01
gcagucccugccaggggcuag

SEQ ID NO: 3507010 - RNA, 23 nt, Pseudomonas aeruginosa PA01
gcaguccuggcgguagcccggca

SEQ ID NO: 3507011 - RNA, 18 nt, Pseudomonas aeruginosa PA01
gcaguccuugagcgccag

SEQ ID NO: 3507012 - RNA, 20 nt, Pseudomonas aeruginosa PA01
gcaguccuugagcgccagca

SEQ ID NO: 3507013 - RNA, 23 nt, Pseudomonas aeruginosa PA01
gcaguccuugagcgccagcaggu

SEQ ID NO: 3507014 - RNA, 19 nt, Pseudomonas aeruginosa PA01
gcagucgaaaaccggcggg

SEQ ID NO: 3507015 - RNA, 22 nt, Pseudomonas aeruginosa PA01
gcagucgaaaaccggcgggcuc

SEQ ID NO: 3507016 - RNA, 15 nt, Pseudomonas aeruginosa PA01
gcagucgccgcaccg

SEQ ID NO: 3507017 - RNA, 18 nt, Pseudomonas aeruginosa PA01
gcaggcggaucgccgccu

SEQ ID NO: 3507018 - RNA, 19 nt, Pseudomonas aeruginosa PA01
gcaggcggaucgccgccuu

SEQ ID NO: 3507019 - RNA, 15 nt, Pseudomonas aeruginosa PA01
gcaggcggcccaugc

SEQ ID NO: 3507020 - RNA, 16 nt, Pseudomonas aeruginosa PA01
gcaggcggccguccuc

SEQ ID NO: 3507021 - RNA, 14 nt, Pseudomonas aeruginosa PA01
gcaggcggcuggcg

SEQ ID NO: 3507022 - RNA, 16 nt, Pseudomonas aeruginosa PA01
gcaggcggcuggcgcg

SEQ ID NO: 3507023 - RNA, 19 nt, Pseudomonas aeruginosa PA01
gcaggcggcuggcgcgauc

SEQ ID NO: 3507024 - RNA, 17 nt, Pseudomonas aeruginosa PA01
gcaggcgggaguccagg

SEQ ID NO: 3507025 - RNA, 24 nt, Pseudomonas aeruginosa PA01
gcaggcgguaggugagcgacccgc

SEQ ID NO: 3507026 - RNA, 19 nt, Pseudomonas aeruginosa PA01
gcaggcggucagcgcguuc

SEQ ID NO: 3507027 - RNA, 15 nt, Pseudomonas aeruginosa PA01
gcaggcggucgccga

SEQ ID NO: 3507028 - RNA, 16 nt, Pseudomonas aeruginosa PA01
gcaggcggucgccgaa

SEQ ID NO: 3507029 - RNA, 21 nt, Pseudomonas aeruginosa PA01
gcaggcggucgccgaacagcc

SEQ ID NO: 3507030 - RNA, 14 nt, Pseudomonas aeruginosa PA01
gcaggcggucggaa

SEQ ID NO: 3507031 - RNA, 15 nt, Pseudomonas aeruginosa PA01
gcaggcggucggcca

SEQ ID NO: 3507032 - RNA, 15 nt, Pseudomonas aeruginosa PA01
gcaggcgguggagca

SEQ ID NO: 3507033 - RNA, 16 nt, Pseudomonas aeruginosa PA01
gcaggcgucgguccag

SEQ ID NO: 3507034 - RNA, 20 nt, Pseudomonas aeruginosa PA01
gcaggcguuauccgccgaga

SEQ ID NO: 3507035 - RNA, 17 nt, Pseudomonas aeruginosa PA01
gcaggcguucggcgaug

SEQ ID NO: 3507036 - RNA, 20 nt, Pseudomonas aeruginosa PA01
gcaggcguugcagugcgccg

SEQ ID NO: 3507037 - RNA, 21 nt, Pseudomonas aeruginosa PA01
gcaggcguugcagugcgccgc

SEQ ID NO: 3507038 - RNA, 14 nt, Pseudomonas aeruginosa PA01
gcaggcucagcacc

SEQ ID NO: 3507039 - RNA, 15 nt, Pseudomonas aeruginosa PA01
gcaggcucagcaccu

SEQ ID NO: 3507040 - RNA, 23 nt, Pseudomonas aeruginosa PA01
gcaggcucagcaccuugugcugc

SEQ ID NO: 3507041 - RNA, 16 nt, Pseudomonas aeruginosa PA01
gcaggcucagcgcaug

SEQ ID NO: 3507042 - RNA, 23 nt, Pseudomonas aeruginosa PA01
gcaggcucagcgcaugcggaagg

SEQ ID NO: 3507043 - RNA, 16 nt, Pseudomonas aeruginosa PA01
gcaggcucaguucggc

SEQ ID NO: 3507044 - RNA, 16 nt, Pseudomonas aeruginosa PA01
gcaggcucaucgcccg

SEQ ID NO: 3507045 - RNA, 17 nt, Pseudomonas aeruginosa PA01
gcaggcucaucgcccgc

SEQ ID NO: 3507046 - RNA, 19 nt, Pseudomonas aeruginosa PA01
gcaggcucaucgcccgccc

SEQ ID NO: 3507047 - RNA, 19 nt, Pseudomonas aeruginosa PA01
gcaggcucaugcccagcuu

SEQ ID NO: 3507048 - RNA, 15 nt, Pseudomonas aeruginosa PA01
gcaggcucgacaggu

SEQ ID NO: 3507049 - RNA, 20 nt, Pseudomonas aeruginosa PA01
gcaggcucucgcgcagcagg

SEQ ID NO: 3507050 - RNA, 21 nt, Pseudomonas aeruginosa PA01
gcaggcucucgcgcagcagga

SEQ ID NO: 3507051 - RNA, 22 nt, Pseudomonas aeruginosa PA01
gcaggcucuuggucgcggucug

SEQ ID NO: 3507052 - RNA, 14 nt, Pseudomonas aeruginosa PA01
gcaggcugccgaga

SEQ ID NO: 3507053 - RNA, 12 nt, Pseudomonas aeruginosa PA01
gcaggcugccgg

SEQ ID NO: 3507054 - RNA, 15 nt, Pseudomonas aeruginosa PA01
gcaggcugccggacg

SEQ ID NO: 3507055 - RNA, 16 nt, Pseudomonas aeruginosa PA01
gcaggcugccguugcg

SEQ ID NO: 3507056 - RNA, 19 nt, Pseudomonas aeruginosa PA01
gcaggcugccguugcggcc

SEQ ID NO: 3507057 - RNA, 15 nt, Pseudomonas aeruginosa PA01
gcaggcugccuucga

SEQ ID NO: 3507058 - RNA, 13 nt, Pseudomonas aeruginosa PA01
gcaggcugcgccg

SEQ ID NO: 3507059 - RNA, 14 nt, Pseudomonas aeruginosa PA01
gcaggcugcgccgc

SEQ ID NO: 3507060 - RNA, 17 nt, Pseudomonas aeruginosa PA01
gcaggcugcugcugcgg

SEQ ID NO: 3507061 - RNA, 20 nt, Pseudomonas aeruginosa PA01
gcaggcugcugcugcggcgg

SEQ ID NO: 3507062 - RNA, 23 nt, Pseudomonas aeruginosa PA01
gcaggcugcugcugcggcgguug

SEQ ID NO: 3507063 - RNA, 15 nt, Pseudomonas aeruginosa PA01
gcaggcuggccgagc

SEQ ID NO: 3507064 - RNA, 16 nt, Pseudomonas aeruginosa PA01
gcaggcuggccgagcg

SEQ ID NO: 3507065 - RNA, 13 nt, Pseudomonas aeruginosa PA01
gcaggcuggcggc

SEQ ID NO: 3507066 - RNA, 14 nt, Pseudomonas aeruginosa PA01
gcaggcuggcggca

SEQ ID NO: 3507067 - RNA, 15 nt, Pseudomonas aeruginosa PA01
gcaggcuguacagca

SEQ ID NO: 3507068 - RNA, 20 nt, Pseudomonas aeruginosa PA01
gcaggcuguacagcaggagc

SEQ ID NO: 3507069 - RNA, 15 nt, Pseudomonas aeruginosa PA01
gcaggcugucggcca

SEQ ID NO: 3507070 - RNA, 17 nt, Pseudomonas aeruginosa PA01
gcaggcugucggccagc

SEQ ID NO: 3507071 - RNA, 13 nt, Pseudomonas aeruginosa PA01
gcaggcugugcca

SEQ ID NO: 3507072 - RNA, 23 nt, Pseudomonas aeruginosa PA01
gcaggcugugccauuccugggcc

SEQ ID NO: 3507073 - RNA, 15 nt, Pseudomonas aeruginosa PA01
gcaggcuuggucagg

SEQ ID NO: 3507074 - RNA, 20 nt, Pseudomonas aeruginosa PA01
gcaggcuuuccagcccggcg

SEQ ID NO: 3507075 - RNA, 16 nt, Pseudomonas aeruginosa PA01
gcaggcuuucguaggc

SEQ ID NO: 3507076 - RNA, 22 nt, Pseudomonas aeruginosa PA01
gcaggcuuucguaggcaggcgc

SEQ ID NO: 3507077 - RNA, 23 nt, Pseudomonas aeruginosa PA01
gcaggcuuucguaggcaggcgcg

SEQ ID NO: 3507078 - RNA, 14 nt, Pseudomonas aeruginosa PA01
gcagggaaggcgcg

SEQ ID NO: 3507079 - RNA, 20 nt, Pseudomonas aeruginosa PA01
gcagggaggcgcacaucacc

SEQ ID NO: 3507080 - RNA, 17 nt, Pseudomonas aeruginosa PA01
gcagggaguccgccagc

SEQ ID NO: 3507081 - RNA, 18 nt, Pseudomonas aeruginosa PA01
gcagggaguccgccagcc

SEQ ID NO: 3507082 - RNA, 21 nt, Pseudomonas aeruginosa PA01
gcagggaguccgccagccggc

SEQ ID NO: 3507083 - RNA, 22 nt, Pseudomonas aeruginosa PA01
gcagggaguccgccagccggcu

SEQ ID NO: 3507084 - RNA, 16 nt, Pseudomonas aeruginosa PA01
gcagggauuccggguc

SEQ ID NO: 3507085 - RNA, 18 nt, Pseudomonas aeruginosa PA01
gcagggauuccgggucga

SEQ ID NO: 3507086 - RNA, 22 nt, Pseudomonas aeruginosa PA01
gcagggcacagccauagugcug

SEQ ID NO: 3507087 - RNA, 15 nt, Pseudomonas aeruginosa PA01
gcagggcagccgccg

SEQ ID NO: 3507088 - RNA, 16 nt, Pseudomonas aeruginosa PA01
gcagggcagccgccgc

SEQ ID NO: 3507089 - RNA, 18 nt, Pseudomonas aeruginosa PA01
gcagggcagccgccgcgg

SEQ ID NO: 3507090 - RNA, 14 nt, Pseudomonas aeruginosa PA01
gcagggcagcggcc

SEQ ID NO: 3507091 - RNA, 15 nt, Pseudomonas aeruginosa PA01
gcagggcagcggccc

SEQ ID NO: 3507092 - RNA, 20 nt, Pseudomonas aeruginosa PA01
gcagggcaucgaugaccuuc

SEQ ID NO: 3507093 - RNA, 22 nt, Pseudomonas aeruginosa PA01
gcagggcaucgaugaccuucga

SEQ ID NO: 3507094 - RNA, 14 nt, Pseudomonas aeruginosa PA01
gcagggccagcagc

SEQ ID NO: 3507095 - RNA, 16 nt, Pseudomonas aeruginosa PA01
gcagggccagcagcgc

SEQ ID NO: 3507096 - RNA, 18 nt, Pseudomonas aeruginosa PA01
gcagggccagccagagcc

SEQ ID NO: 3507097 - RNA, 14 nt, Pseudomonas aeruginosa PA01
gcagggccagcgga

SEQ ID NO: 3507098 - RNA, 15 nt, Pseudomonas aeruginosa PA01
gcagggccagcggaa

SEQ ID NO: 3507099 - RNA, 14 nt, Pseudomonas aeruginosa PA01
gcagggccaggccg

SEQ ID NO: 3507100 - RNA, 15 nt, Pseudomonas aeruginosa PA01
gcagggccaggccga

SEQ ID NO: 3507101 - RNA, 16 nt, Pseudomonas aeruginosa PA01
gcagggccaggccgag

SEQ ID NO: 3507102 - RNA, 17 nt, Pseudomonas aeruginosa PA01
gcagggccaggccgagc

SEQ ID NO: 3507103 - RNA, 22 nt, Pseudomonas aeruginosa PA01
gcagggccaggccgagcgcgcc

SEQ ID NO: 3507104 - RNA, 21 nt, Pseudomonas aeruginosa PA01
gcagggccagggcggcggcga

SEQ ID NO: 3507105 - RNA, 12 nt, Pseudomonas aeruginosa PA01
gcagggccgagc

SEQ ID NO: 3507106 - RNA, 13 nt, Pseudomonas aeruginosa PA01
gcagggccgagcg

SEQ ID NO: 3507107 - RNA, 14 nt, Pseudomonas aeruginosa PA01
gcagggccgccagc

SEQ ID NO: 3507108 - RNA, 15 nt, Pseudomonas aeruginosa PA01
gcagggccgccagcc

SEQ ID NO: 3507109 - RNA, 13 nt, Pseudomonas aeruginosa PA01
gcagggccgcggc

SEQ ID NO: 3507110 - RNA, 14 nt, Pseudomonas aeruginosa PA01
gcagggccggaugc

SEQ ID NO: 3507111 - RNA, 13 nt, Pseudomonas aeruginosa PA01
gcagggccuggcc

SEQ ID NO: 3507112 - RNA, 11 nt, Pseudomonas aeruginosa PA01
gcagggcgauc

SEQ ID NO: 3507113 - RNA, 17 nt, Pseudomonas aeruginosa PA01
gcagggcgauccagaag

SEQ ID NO: 3507114 - RNA, 15 nt, Pseudomonas aeruginosa PA01
gcagggcgauccgcc

SEQ ID NO: 3507115 - RNA, 19 nt, Pseudomonas aeruginosa PA01
gcagggcgaugccgauggc

SEQ ID NO: 3507116 - RNA, 21 nt, Pseudomonas aeruginosa PA01
gcagggcgaugccgauggcgc

SEQ ID NO: 3507117 - RNA, 16 nt, Pseudomonas aeruginosa PA01
gcagggcgauggccag

SEQ ID NO: 3507118 - RNA, 21 nt, Pseudomonas aeruginosa PA01
gcagggcgauggccagcgcgu

SEQ ID NO: 3507119 - RNA, 15 nt, Pseudomonas aeruginosa PA01
gcagggcgcaaccug

SEQ ID NO: 3507120 - RNA, 12 nt, Pseudomonas aeruginosa PA01
gcagggcgcccg

SEQ ID NO: 3507121 - RNA, 17 nt, Pseudomonas aeruginosa PA01
gcaggccgaucagcggc

SEQ ID NO: 3507122 - RNA, 22 nt, Pseudomonas aeruginosa PA01
gcaggccgaucucgugggccag

SEQ ID NO: 3507123 - RNA, 23 nt, Pseudomonas aeruginosa PA01
gcaggccgaucucgugggccagc

SEQ ID NO: 3507124 - RNA, 12 nt, Pseudomonas aeruginosa PA01
gcaggccgccga

SEQ ID NO: 3507125 - RNA, 14 nt, Pseudomonas aeruginosa PA01
gcaggccgccgagu

SEQ ID NO: 3507126 - RNA, 23 nt, Pseudomonas aeruginosa PA01
gcaggccgccgagugugccggcc

SEQ ID NO: 3507127 - RNA, 15 nt, Pseudomonas aeruginosa PA01
gcaggccgccgaucc

SEQ ID NO: 3507128 - RNA, 21 nt, Pseudomonas aeruginosa PA01
gcaggccgccgaucccgacgc

SEQ ID NO: 3507129 - RNA, 18 nt, Pseudomonas aeruginosa PA01
gcaggccgccggcggcca

SEQ ID NO: 3507130 - RNA, 12 nt, Pseudomonas aeruginosa PA01
gcaggccgcggc

SEQ ID NO: 3507131 - RNA, 14 nt, Pseudomonas aeruginosa PA01
gcaggccgcggccg

SEQ ID NO: 3507132 - RNA, 15 nt, Pseudomonas aeruginosa PA01
gcaggccgcggccga

SEQ ID NO: 3507133 - RNA, 15 nt, Pseudomonas aeruginosa PA01
gcaggccgcugccug

SEQ ID NO: 3507134 - RNA, 14 nt, Pseudomonas aeruginosa PA01
gcaggccgcuggcg

SEQ ID NO: 3507135 - RNA, 15 nt, Pseudomonas aeruginosa PA01
gcaggccgcuggcga

SEQ ID NO: 3507136 - RNA, 16 nt, Pseudomonas aeruginosa PA01
gcaggccggccagccu

SEQ ID NO: 3507137 - RNA, 15 nt, Pseudomonas aeruginosa PA01
gcaggccggccaggg

SEQ ID NO: 3507138 - RNA, 19 nt, Pseudomonas aeruginosa PA01
gcaggccggccuccagcgc

SEQ ID NO: 3507139 - RNA, 14 nt, Pseudomonas aeruginosa PA01
gcaggccggcgacc

SEQ ID NO: 3507140 - RNA, 15 nt, Pseudomonas aeruginosa PA01
gcaggccggcgagcc

SEQ ID NO: 3507141 - RNA, 17 nt, Pseudomonas aeruginosa PA01
gcaggccggcgagccag

SEQ ID NO: 3507142 - RNA, 19 nt, Pseudomonas aeruginosa PA01
gcaggccggcgagccaggu

SEQ ID NO: 3507143 - RNA, 21 nt, Pseudomonas aeruginosa PA01
gcaggccgggaauggagaugc

SEQ ID NO: 3507144 - RNA, 12 nt, Pseudomonas aeruginosa PA01
gcaggccgggcg

SEQ ID NO: 3507145 - RNA, 14 nt, Pseudomonas aeruginosa PA01
gcaggccgggcgga

SEQ ID NO: 3507146 - RNA, 16 nt, Pseudomonas aeruginosa PA01
gcaggccgggcggacg

SEQ ID NO: 3507147 - RNA, 21 nt, Pseudomonas aeruginosa PA01
gcaggccggugaucucgcggc

SEQ ID NO: 3507148 - RNA, 12 nt, Pseudomonas aeruginosa PA01
gcaggccggugg

SEQ ID NO: 3507149 - RNA, 13 nt, Pseudomonas aeruginosa PA01
gcaggccguccuu

SEQ ID NO: 3507150 - RNA, 16 nt, Pseudomonas aeruginosa PA01
gcaggccgugccagag

SEQ ID NO: 3507151 - RNA, 18 nt, Pseudomonas aeruginosa PA01
gcaggccgugccagagcu

SEQ ID NO: 3507152 - RNA, 19 nt, Pseudomonas aeruginosa PA01
gcaggccuggaauaccccg

SEQ ID NO: 3507153 - RNA, 23 nt, Pseudomonas aeruginosa PA01
gcaggccuggaauaccccgcgga

SEQ ID NO: 3507154 - RNA, 13 nt, Pseudomonas aeruginosa PA01
gcaggccuggagc

SEQ ID NO: 3507155 - RNA, 11 nt, Pseudomonas aeruginosa PA01
gcaggccuggg

SEQ ID NO: 3507156 - RNA, 18 nt, Pseudomonas aeruginosa PA01
gcaggccugggcaagcug

SEQ ID NO: 3507157 - RNA, 23 nt, Pseudomonas aeruginosa PA01
gcaggccugggcaagcugcacgg

SEQ ID NO: 3507158 - RNA, 15 nt, Pseudomonas aeruginosa PA01
gcaggccuuccacgc

SEQ ID NO: 3507159 - RNA, 20 nt, Pseudomonas aeruginosa PA01
gcaggccuuccacgccuucg

SEQ ID NO: 3507160 - RNA, 16 nt, Pseudomonas aeruginosa PA01
gcaggccuucccacuc

SEQ ID NO: 3507161 - RNA, 22 nt, Pseudomonas aeruginosa PA01
gcaggccuucccacuccgucca

SEQ ID NO: 3507162 - RNA, 12 nt, Pseudomonas aeruginosa PA01
gcaggccuucga

SEQ ID NO: 3507163 - RNA, 16 nt, Pseudomonas aeruginosa PA01
gcaggccuucgacuuc

SEQ ID NO: 3507164 - RNA, 12 nt, Pseudomonas aeruginosa PA01
gcaggccuucgg

SEQ ID NO: 3507165 - RNA, 17 nt, Pseudomonas aeruginosa PA01
gcaggccuucggcgccg

SEQ ID NO: 3507166 - RNA, 19 nt, Pseudomonas aeruginosa PA01
gcaggccuucggcgccgga

SEQ ID NO: 3507167 - RNA, 22 nt, Pseudomonas aeruginosa PA01
gcaggccuugcagggccgccag

SEQ ID NO: 3507168 - RNA, 22 nt, Pseudomonas aeruginosa PA01
gcaggcgaaaaaaagccccgcc

SEQ ID NO: 3507169 - RNA, 15 nt, Pseudomonas aeruginosa PA01
gcaggcgaacagggc

SEQ ID NO: 3507170 - RNA, 16 nt, Pseudomonas aeruginosa PA01
gcaggcgaacagggcc

SEQ ID NO: 3507171 - RNA, 19 nt, Pseudomonas aeruginosa PA01
gcaggcgaacugccgacgg

SEQ ID NO: 3507172 - RNA, 14 nt, Pseudomonas aeruginosa PA01
gcaggcgacgguca

SEQ ID NO: 3507173 - RNA, 21 nt, Pseudomonas aeruginosa PA01
gcaggcgaggauggccguccu

SEQ ID NO: 3507174 - RNA, 22 nt, Pseudomonas aeruginosa PA01
gcaggcgaggauggccguccuc

SEQ ID NO: 3507175 - RNA, 16 nt, Pseudomonas aeruginosa PA01
gcaggcgauagaugug

SEQ ID NO: 3507176 - RNA, 16 nt, Pseudomonas aeruginosa PA01
gcaggcgaugaccgcc

SEQ ID NO: 3507177 - RNA, 22 nt, Pseudomonas aeruginosa PA01
gcaggcgaugaucagcccuucg

SEQ ID NO: 3507178 - RNA, 15 nt, Pseudomonas aeruginosa PA01
gcaggcgaugccgac

SEQ ID NO: 3507179 - RNA, 16 nt, Pseudomonas aeruginosa PA01
gcaggcgaugccgacg

SEQ ID NO: 3507180 - RNA, 19 nt, Pseudomonas aeruginosa PA01
gcaggcgauucaagugucg

SEQ ID NO: 3507181 - RNA, 18 nt, Pseudomonas aeruginosa PA01
gcaggcgcaaccagacca

SEQ ID NO: 3507182 - RNA, 16 nt, Pseudomonas aeruginosa PA01
gcaggcgcagcagcga

SEQ ID NO: 3507183 - RNA, 19 nt, Pseudomonas aeruginosa PA01
gcaggcgcaggcgaacugc

SEQ ID NO: 3507184 - RNA, 14 nt, Pseudomonas aeruginosa PA01
gcaggcgcaggucg

SEQ ID NO: 3507185 - RNA, 15 nt, Pseudomonas aeruginosa PA01
gcaggcgcaggucgg

SEQ ID NO: 3507186 - RNA, 16 nt, Pseudomonas aeruginosa PA01
gcaggcgcaucaggcc

SEQ ID NO: 3507187 - RNA, 17 nt, Pseudomonas aeruginosa PA01
gcaggcgcauguccagc

SEQ ID NO: 3507188 - RNA, 18 nt, Pseudomonas aeruginosa PA01
gcaggcgccaaccgggca

SEQ ID NO: 3507189 - RNA, 19 nt, Pseudomonas aeruginosa PA01
gcaggcgccaaccgggcag

SEQ ID NO: 3507190 - RNA, 22 nt, Pseudomonas aeruginosa PA01
gcaggcgccaaccgggcagcag

SEQ ID NO: 3507191 - RNA, 14 nt, Pseudomonas aeruginosa PA01
gcaggcgcccgguc

SEQ ID NO: 3507192 - RNA, 14 nt, Pseudomonas aeruginosa PA01
gcaggcgcccuggc

SEQ ID NO: 3507193 - RNA, 21 nt, Pseudomonas aeruginosa PA01
gcaggcgcccuggccgucggc

SEQ ID NO: 3507194 - RNA, 23 nt, Pseudomonas aeruginosa PA01
gcaggcgcccuggccgucggccu

SEQ ID NO: 3507195 - RNA, 18 nt, Pseudomonas aeruginosa PA01
gcaggcgccgauggcugu

SEQ ID NO: 3507196 - RNA, 13 nt, Pseudomonas aeruginosa PA01
gcaggcgccgcgc

SEQ ID NO: 3507197 - RNA, 15 nt, Pseudomonas aeruginosa PA01
gcaggcgccggacca

SEQ ID NO: 3507198 - RNA, 13 nt, Pseudomonas aeruginosa PA01
gcaggcgccggcc

SEQ ID NO: 3507199 - RNA, 14 nt, Pseudomonas aeruginosa PA01
gcaggcgccggccg

SEQ ID NO: 3507200 - RNA, 14 nt, Pseudomonas aeruginosa PA01
gcaggcgccggcgg

SEQ ID NO: 3507201 - RNA, 15 nt, Pseudomonas aeruginosa PA01
gcaggcgccggcgga

SEQ ID NO: 3507202 - RNA, 18 nt, Pseudomonas aeruginosa PA01
gcaggcgccggcggauca

SEQ ID NO: 3507203 - RNA, 14 nt, Pseudomonas aeruginosa PA01
gcaggcgcgccagg

SEQ ID NO: 3507204 - RNA, 22 nt, Pseudomonas aeruginosa PA01
gcaggcgcggcauagaugccgg

SEQ ID NO: 3507205 - RNA, 18 nt, Pseudomonas aeruginosa PA01
gcaggcgcgggcuggcca

SEQ ID NO: 3507206 - RNA, 19 nt, Pseudomonas aeruginosa PA01
gcaggcgcgggcuggccac

SEQ ID NO: 3507207 - RNA, 22 nt, Pseudomonas aeruginosa PA01
gcaggcgcguugcuuccaggca

SEQ ID NO: 3507208 - RNA, 18 nt, Pseudomonas aeruginosa PA01
gcaggcgcuauccgccgu

SEQ ID NO: 3507209 - RNA, 21 nt, Pseudomonas aeruginosa PA01
gcaggcgcucgcgggccgccu

SEQ ID NO: 3507210 - RNA, 15 nt, Pseudomonas aeruginosa PA01
gcaggcgcucgcugc

SEQ ID NO: 3507211 - RNA, 12 nt, Pseudomonas aeruginosa PA01
gcaggcgcucgg

SEQ ID NO: 3507212 - RNA, 17 nt, Pseudomonas aeruginosa PA01
gcaggcgcucggcgacg

SEQ ID NO: 3507213 - RNA, 18 nt, Pseudomonas aeruginosa PA01
gcaggcgcucggcgacgc

SEQ ID NO: 3507214 - RNA, 15 nt, Pseudomonas aeruginosa PA01
gcaggcgcugcagcc

SEQ ID NO: 3507215 - RNA, 12 nt, Pseudomonas aeruginosa PA01
gcaggcgcuggc

SEQ ID NO: 3507216 - RNA, 15 nt, Pseudomonas aeruginosa PA01
gcaggcgcuggcggg

SEQ ID NO: 3507217 - RNA, 16 nt, Pseudomonas aeruginosa PA01
gcaggcgcuggcgggc

SEQ ID NO: 3507218 - RNA, 21 nt, Pseudomonas aeruginosa PA01
gcaggcggaaaaagcgcggag

SEQ ID NO: 3507219 - RNA, 22 nt, Pseudomonas aeruginosa PA01
gcaggcggaaauacggcuccgg

SEQ ID NO: 3507220 - RNA, 21 nt, Pseudomonas aeruginosa PA01
gcaggcggacacgcaggcgcc

SEQ ID NO: 3507221 - RNA, 14 nt, Pseudomonas aeruginosa PA01
gcaggcggaguagc

SEQ ID NO: 3507222 - RNA, 14 nt, Pseudomonas aeruginosa PA01
gcaggcggaucgcc

SEQ ID NO: 3507223 - RNA, 19 nt, Pseudomonas aeruginosa PA01
gcaggcggaucgcccggcg

SEQ ID NO: 3507224 - RNA, 17 nt, Pseudomonas aeruginosa PA01
gcaggcggaucgccgcc

SEQ ID NO: 3507225 - RNA, 16 nt, Pseudomonas aeruginosa PA01
gacgcggauuggccgg

SEQ ID NO: 3507226 - RNA, 18 nt, Pseudomonas aeruginosa PA01
gacgcggauuggccgggc

SEQ ID NO: 3507227 - RNA, 19 nt, Pseudomonas aeruginosa PA01
gacgcggauuggccgggcc

SEQ ID NO: 3507228 - RNA, 23 nt, Pseudomonas aeruginosa PA01
gacgcggauuggccgggccgaug

SEQ ID NO: 3507229 - RNA, 14 nt, Pseudomonas aeruginosa PA01
gacgcggccugggc

SEQ ID NO: 3507230 - RNA, 19 nt, Pseudomonas aeruginosa PA01
gacgcggccugggccgaag

SEQ ID NO: 3507231 - RNA, 21 nt, Pseudomonas aeruginosa PA01
gacgcggcggcuccggcgcca

SEQ ID NO: 3507232 - RNA, 17 nt, Pseudomonas aeruginosa PA01
gacgcggcuggcgcagg

SEQ ID NO: 3507233 - RNA, 23 nt, Pseudomonas aeruginosa PA01
gacgcgggacuuguacucgccgg

SEQ ID NO: 3507234 - RNA, 19 nt, Pseudomonas aeruginosa PA01
gacgcuacguuccagggcc

SEQ ID NO: 3507235 - RNA, 20 nt, Pseudomonas aeruginosa PA01
gacgcuacguuccagggccu

SEQ ID NO: 3507236 - RNA, 22 nt, Pseudomonas aeruginosa PA01
gacgcuacguuccagggccugg

SEQ ID NO: 3507237 - RNA, 14 nt, Pseudomonas aeruginosa PA01
gacgcucagcaccc

SEQ ID NO: 3507238 - RNA, 17 nt, Pseudomonas aeruginosa PA01
gacgcucagcacccugg

SEQ ID NO: 3507239 - RNA, 18 nt, Pseudomonas aeruginosa PA01
gacgcucagcacccuggc

SEQ ID NO: 3507240 - RNA, 16 nt, Pseudomonas aeruginosa PA01
gacgcuccagcggcag

SEQ ID NO: 3507241 - RNA, 13 nt, Pseudomonas aeruginosa PA01
gacgcuccaggug

SEQ ID NO: 3507242 - RNA, 21 nt, Pseudomonas aeruginosa PA01
gacgcuccaggugcacggcca

SEQ ID NO: 3507243 - RNA, 15 nt, Pseudomonas aeruginosa PA01
gacgcuccugcgccg

SEQ ID NO: 3507244 - RNA, 16 nt, Pseudomonas aeruginosa PA01
gacgcuccugcgccgg

SEQ ID NO: 3507245 - RNA, 13 nt, Pseudomonas aeruginosa PA01
gacgcucggccag

SEQ ID NO: 3507246 - RNA, 15 nt, Pseudomonas aeruginosa PA01
gacgcucggccagcg

SEQ ID NO: 3507247 - RNA, 18 nt, Pseudomonas aeruginosa PA01
gacgcucggcuucgcguu

SEQ ID NO: 3507248 - RNA, 19 nt, Pseudomonas aeruginosa PA01
gacgcucuccgucagggcg

SEQ ID NO: 3507249 - RNA, 17 nt, Pseudomonas aeruginosa PA01
gacgcucugcucggcca

SEQ ID NO: 3507250 - RNA, 21 nt, Pseudomonas aeruginosa PA01
gacgcucugcucggccagcgc

SEQ ID NO: 3507251 - RNA, 14 nt, Pseudomonas aeruginosa PA01
gacgcugaggauca

SEQ ID NO: 3507252 - RNA, 16 nt, Pseudomonas aeruginosa PA01
gacgcugcaccgcggc

SEQ ID NO: 3507253 - RNA, 17 nt, Pseudomonas aeruginosa PA01
gacgcugcaccgcggcg

SEQ ID NO: 3507254 - RNA, 18 nt, Pseudomonas aeruginosa PA01
gacgcugcaccgcggcgc

SEQ ID NO: 3507255 - RNA, 19 nt, Pseudomonas aeruginosa PA01
gacgcugcaccgcggcgcg

SEQ ID NO: 3507256 - RNA, 21 nt, Pseudomonas aeruginosa PA01
gacgcugcaccgcggcgcgga

SEQ ID NO: 3507257 - RNA, 14 nt, Pseudomonas aeruginosa PA01
gacgcugcaugcgg

SEQ ID NO: 3507258 - RNA, 18 nt, Pseudomonas aeruginosa PA01
gacgcugcaugcggaaca

SEQ ID NO: 3507259 - RNA, 15 nt, Pseudomonas aeruginosa PA01
gacgcugcgaccugg

SEQ ID NO: 3507260 - RNA, 16 nt, Pseudomonas aeruginosa PA01
gacgcugcgaccuggc

SEQ ID NO: 3507261 - RNA, 19 nt, Pseudomonas aeruginosa PA01
gacgcugcgaccuggcgcc

SEQ ID NO: 3507262 - RNA, 17 nt, Pseudomonas aeruginosa PA01
gacgcugcucaccaggu

SEQ ID NO: 3507263 - RNA, 13 nt, Pseudomonas aeruginosa PA01
gacgcuggcgaag

SEQ ID NO: 3507264 - RNA, 18 nt, Pseudomonas aeruginosa PA01
gacgcugggacggcugcc

SEQ ID NO: 3507265 - RNA, 13 nt, Pseudomonas aeruginosa PA01
gacgcugggcugg

SEQ ID NO: 3507266 - RNA, 17 nt, Pseudomonas aeruginosa PA01
gacgcuggucaggcuga

SEQ ID NO: 3507267 - RNA, 19 nt, Pseudomonas aeruginosa PA01
gacgcugucguggacgccg

SEQ ID NO: 3507268 - RNA, 13 nt, Pseudomonas aeruginosa PA01
gacgcuuguccuu

SEQ ID NO: 3507269 - RNA, 15 nt, Pseudomonas aeruginosa PA01
gacggaacaggagcc

SEQ ID NO: 3507270 - RNA, 15 nt, Pseudomonas aeruginosa PA01
gacggaacgucggcc

SEQ ID NO: 3507271 - RNA, 18 nt, Pseudomonas aeruginosa PA01
gacggaacgucggccugg

SEQ ID NO: 3507272 - RNA, 21 nt, Pseudomonas aeruginosa PA01
gacggaccgcgacaacccugu

SEQ ID NO: 3507273 - RNA, 16 nt, Pseudomonas aeruginosa PA01
gacggagagcagcagc

SEQ ID NO: 3507274 - RNA, 16 nt, Pseudomonas aeruginosa PA01
gacggauacgccaggu

SEQ ID NO: 3507275 - RNA, 19 nt, Pseudomonas aeruginosa PA01
gacggauacgccagguugc

SEQ ID NO: 3507276 - RNA, 16 nt, Pseudomonas aeruginosa PA01
gacggcaaggaccugc

SEQ ID NO: 3507277 - RNA, 19 nt, Pseudomonas aeruginosa PA01
gacggcaccagcgcgucga

SEQ ID NO: 3507278 - RNA, 16 nt, Pseudomonas aeruginosa PA01
gacggcacgacgccgg

SEQ ID NO: 3507279 - RNA, 15 nt, Pseudomonas aeruginosa PA01
gacggcacggggcgc

SEQ ID NO: 3507280 - RNA, 13 nt, Pseudomonas aeruginosa PA01
gacggcagccugg

SEQ ID NO: 3507281 - RNA, 12 nt, Pseudomonas aeruginosa PA01
gacggcaggccc

SEQ ID NO: 3507282 - RNA, 19 nt, Pseudomonas aeruginosa PA01
gacggcagggucagccgau

SEQ ID NO: 3507283 - RNA, 21 nt, Pseudomonas aeruginosa PA01
gacggcagggucagccgaugc

SEQ ID NO: 3507284 - RNA, 15 nt, Pseudomonas aeruginosa PA01
gacggcagguggcgg

SEQ ID NO: 3507285 - RNA, 19 nt, Pseudomonas aeruginosa PA01
gacggcauuccugguccag

SEQ ID NO: 3507286 - RNA, 20 nt, Pseudomonas aeruginosa PA01
gacggcauuccugguccagc

SEQ ID NO: 3507287 - RNA, 19 nt, Pseudomonas aeruginosa PA01
gacggccgcgccggcuccc

SEQ ID NO: 3507288 - RNA, 14 nt, Pseudomonas aeruginosa PA01
gacggccugcgccc

SEQ ID NO: 3507289 - RNA, 18 nt, Pseudomonas aeruginosa PA01
gacggcgcaagggcgccg

SEQ ID NO: 3507290 - RNA, 18 nt, Pseudomonas aeruginosa PA01
gacggcgcauauccacca

SEQ ID NO: 3507291 - RNA, 15 nt, Pseudomonas aeruginosa PA01
gacggcgccgaugcc

SEQ ID NO: 3507292 - RNA, 14 nt, Pseudomonas aeruginosa PA01
gacggcgcgcugcg

SEQ ID NO: 3507293 - RNA, 15 nt, Pseudomonas aeruginosa PA01
gacggcggaaggcgg

SEQ ID NO: 3507294 - RNA, 17 nt, Pseudomonas aeruginosa PA01
gacggcggaaggcggcg

SEQ ID NO: 3507295 - RNA, 18 nt, Pseudomonas aeruginosa PA01
gacggcggaaggcggcga

SEQ ID NO: 3507296 - RNA, 21 nt, Pseudomonas aeruginosa PA01
gacggcggacugcucgccgcc

SEQ ID NO: 3507297 - RNA, 23 nt, Pseudomonas aeruginosa PA01
gacggcggacugcucgccgccgg

SEQ ID NO: 3507298 - RNA, 14 nt, Pseudomonas aeruginosa PA01
gacggcggccgcca

SEQ ID NO: 3507299 - RNA, 21 nt, Pseudomonas aeruginosa PA01
gacggcggccgccaucgcccg

SEQ ID NO: 3507300 - RNA, 13 nt, Pseudomonas aeruginosa PA01
gacggcggcgacc

SEQ ID NO: 3507301 - RNA, 18 nt, Pseudomonas aeruginosa PA01
gacggcggcggcggaccu

SEQ ID NO: 3507302 - RNA, 19 nt, Pseudomonas aeruginosa PA01
gacggcggcgucaucccgu

SEQ ID NO: 3507303 - RNA, 17 nt, Pseudomonas aeruginosa PA01
gacggcgugcagguagc

SEQ ID NO: 3507304 - RNA, 23 nt, Pseudomonas aeruginosa PA01
gacggcguggucgaugcccaccu

SEQ ID NO: 3507305 - RNA, 17 nt, Pseudomonas aeruginosa PA01
gacggcucgcgcagcgg

SEQ ID NO: 3507306 - RNA, 22 nt, Pseudomonas aeruginosa PA01
gacggcucgcgcagcggcgcgu

SEQ ID NO: 3507307 - RNA, 18 nt, Pseudomonas aeruginosa PA01
gacggcucuggaugcggc

SEQ ID NO: 3507308 - RNA, 14 nt, Pseudomonas aeruginosa PA01
gacggcucuucccc

SEQ ID NO: 3507309 - RNA, 14 nt, Pseudomonas aeruginosa PA01
gacggcugaggcug

SEQ ID NO: 3507310 - RNA, 15 nt, Pseudomonas aeruginosa PA01
gacggcugaggcugg

SEQ ID NO: 3507311 - RNA, 23 nt, Pseudomonas aeruginosa PA01
gacggcugaggcuggcgaccggg

SEQ ID NO: 3507312 - RNA, 13 nt, Pseudomonas aeruginosa PA01
gacggcuuccagg

SEQ ID NO: 3507313 - RNA, 18 nt, Pseudomonas aeruginosa PA01
gacggcuugaucacgccg

SEQ ID NO: 3507314 - RNA, 20 nt, Pseudomonas aeruginosa PA01
gacggcuugaucacgccgaa

SEQ ID NO: 3507315 - RNA, 20 nt, Pseudomonas aeruginosa PA01
gacgggagcgcgaggcgcag

SEQ ID NO: 3507316 - RNA, 19 nt, Pseudomonas aeruginosa PA01
gacgggcauugucccugcg

SEQ ID NO: 3507317 - RNA, 12 nt, Pseudomonas aeruginosa PA01
gacgggccgcgc

SEQ ID NO: 3507318 - RNA, 13 nt, Pseudomonas aeruginosa PA01
gacgggccgcgcc

SEQ ID NO: 3507319 - RNA, 15 nt, Pseudomonas aeruginosa PA01
gacgggccgcgccgc

SEQ ID NO: 3507320 - RNA, 19 nt, Pseudomonas aeruginosa PA01
gacgggcgguaugccggag

SEQ ID NO: 3507321 - RNA, 22 nt, Pseudomonas aeruginosa PA01
gacggggaucacucgccgccgu

SEQ ID NO: 3507322 - RNA, 16 nt, Pseudomonas aeruginosa PA01
gacgggugcguccauc

SEQ ID NO: 3507323 - RNA, 15 nt, Pseudomonas aeruginosa PA01
gacggucagcaggcc

SEQ ID NO: 3507324 - RNA, 21 nt, Pseudomonas aeruginosa PA01
gacggucagcggacaaccgcc

SEQ ID NO: 3507325 - RNA, 19 nt, Pseudomonas aeruginosa PA01
gacgguccgcgccacgcag

SEQ ID NO: 3507326 - RNA, 14 nt, Pseudomonas aeruginosa PA01
gacggucggcaggu

SEQ ID NO: 3507327 - RNA, 13 nt, Pseudomonas aeruginosa PA01
gacggucucgccg

SEQ ID NO: 3507328 - RNA, 15 nt, Pseudomonas aeruginosa PA01
gacggucucgccgcc

SEQ ID NO: 3507329 - RNA, 17 nt, Pseudomonas aeruginosa PA01
gacggucucgccgccga

SEQ ID NO: 3507330 - RNA, 19 nt, Pseudomonas aeruginosa PA01
gacggucucgccgccgagc

SEQ ID NO: 3507331 - RNA, 15 nt, Pseudomonas aeruginosa PA01
gacggucugccagcu

SEQ ID NO: 3507332 - RNA, 20 nt, Pseudomonas aeruginosa PA01
gacggucugccagcucuggc

SEQ ID NO: 3507333 - RNA, 21 nt, Pseudomonas aeruginosa PA01
gacggugaaguagaucgcccg

SEQ ID NO: 3507334 - RNA, 15 nt, Pseudomonas aeruginosa PA01
gacggugaucgccgc

SEQ ID NO: 3507335 - RNA, 16 nt, Pseudomonas aeruginosa PA01
gacggugaucgccgcg

SEQ ID NO: 3507336 - RNA, 23 nt, Pseudomonas aeruginosa PA01
gacggugaucgccgcgaggugga

SEQ ID NO: 3507337 - RNA, 22 nt, Pseudomonas aeruginosa PA01
gacggugauucguccggagccg

SEQ ID NO: 3507338 - RNA, 21 nt, Pseudomonas aeruginosa PA01
gacggugcagccacccagcag

SEQ ID NO: 3507339 - RNA, 22 nt, Pseudomonas aeruginosa PA01
gacggugcagccacccagcagc

SEQ ID NO: 3507340 - RNA, 23 nt, Pseudomonas aeruginosa PA01
gacggugcagccacccagcagca

SEQ ID NO: 3507341 - RNA, 17 nt, Pseudomonas aeruginosa PA01
gacggugcaggccgacg

SEQ ID NO: 3507342 - RNA, 18 nt, Pseudomonas aeruginosa PA01
gacggugcaggccgacgu

SEQ ID NO: 3507343 - RNA, 13 nt, Pseudomonas aeruginosa PA01
gacggugcggccg

SEQ ID NO: 3507344 - RNA, 17 nt, Pseudomonas aeruginosa PA01
gacggugcggccguuca

SEQ ID NO: 3507345 - RNA, 19 nt, Pseudomonas aeruginosa PA01
gacggugcuguuguugccg

SEQ ID NO: 3507346 - RNA, 16 nt, Pseudomonas aeruginosa PA01
gacgguggaggcgggc

SEQ ID NO: 3507347 - RNA, 15 nt, Pseudomonas aeruginosa PA01
gacgguucagcagcg

SEQ ID NO: 3507348 - RNA, 17 nt, Pseudomonas aeruginosa PA01
gacgguucagcagcggc

SEQ ID NO: 3507349 - RNA, 22 nt, Pseudomonas aeruginosa PA01
gacgguucagcagcggcacccg

SEQ ID NO: 3507350 - RNA, 14 nt, Pseudomonas aeruginosa PA01
gacgguuucaggcc

SEQ ID NO: 3507351 - RNA, 21 nt, Pseudomonas aeruginosa PA01
gacgguuucaggccuugcuga

SEQ ID NO: 3507352 - RNA, 19 nt, Pseudomonas aeruginosa PA01
gacguagaggaucucgcca

SEQ ID NO: 3507353 - RNA, 17 nt, Pseudomonas aeruginosa PA01
gacguagggcaucgccg

SEQ ID NO: 3507354 - RNA, 23 nt, Pseudomonas aeruginosa PA01
gacgucacggauaggcggcggau

SEQ ID NO: 3507355 - RNA, 19 nt, Pseudomonas aeruginosa PA01
gacgucauaggccuuggcg

SEQ ID NO: 3507356 - RNA, 17 nt, Pseudomonas aeruginosa PA01
gacguccacugcguccu

SEQ ID NO: 3507357 - RNA, 19 nt, Pseudomonas aeruginosa PA01
gacguccacugcguccugg

SEQ ID NO: 3507358 - RNA, 14 nt, Pseudomonas aeruginosa PA01
gacguccagcgcca

SEQ ID NO: 3507359 - RNA, 16 nt, Pseudomonas aeruginosa PA01
gacguccagcgccacu

SEQ ID NO: 3507360 - RNA, 15 nt, Pseudomonas aeruginosa PA01
gacguccaucagcgu

SEQ ID NO: 3507361 - RNA, 17 nt, Pseudomonas aeruginosa PA01
gacguccaucagcgucu

SEQ ID NO: 3507362 - RNA, 23 nt, Pseudomonas aeruginosa PA01
gacguccaucagcgucugcagcu

SEQ ID NO: 3507363 - RNA, 12 nt, Pseudomonas aeruginosa PA01
gacgucccuucc

SEQ ID NO: 3507364 - RNA, 13 nt, Pseudomonas aeruginosa PA01
gacgucccuuccc

SEQ ID NO: 3507365 - RNA, 16 nt, Pseudomonas aeruginosa PA01
gacguccugcggguca

SEQ ID NO: 3507366 - RNA, 13 nt, Pseudomonas aeruginosa PA01
gacguccuggccg

SEQ ID NO: 3507367 - RNA, 14 nt, Pseudomonas aeruginosa PA01
gacguccuggccga

SEQ ID NO: 3507368 - RNA, 19 nt, Pseudomonas aeruginosa PA01
gacgucgaaaccgaacggc

SEQ ID NO: 3507369 - RNA, 12 nt, Pseudomonas aeruginosa PA01
gacgucgacgca

SEQ ID NO: 3507370 - RNA, 16 nt, Pseudomonas aeruginosa PA01
gacgucgacuucgucg

SEQ ID NO: 3507371 - RNA, 17 nt, Pseudomonas aeruginosa PA01
gacgucgacuucgucga

SEQ ID NO: 3507372 - RNA, 17 nt, Pseudomonas aeruginosa PA01
gacgucgaggaaggcca

SEQ ID NO: 3507373 - RNA, 22 nt, Pseudomonas aeruginosa PA01
gacgucgaggucgacggcggcc

SEQ ID NO: 3507374 - RNA, 13 nt, Pseudomonas aeruginosa PA01
gacgucgccccag

SEQ ID NO: 3507375 - RNA, 15 nt, Pseudomonas aeruginosa PA01
gacgucgccgaugcg

SEQ ID NO: 3507376 - RNA, 14 nt, Pseudomonas aeruginosa PA01
gacgucggcggcgg

SEQ ID NO: 3507377 - RNA, 22 nt, Pseudomonas aeruginosa PA01
gacgucgucggcgaccuugucg

SEQ ID NO: 3507378 - RNA, 13 nt, Pseudomonas aeruginosa PA01
gacgugaagcccc

SEQ ID NO: 3507379 - RNA, 16 nt, Pseudomonas aeruginosa PA01
gacgugaagccccugg

SEQ ID NO: 3507380 - RNA, 23 nt, Pseudomonas aeruginosa PA01
gacgugaagccccuggcgcuggg

SEQ ID NO: 3507381 - RNA, 14 nt, Pseudomonas aeruginosa PA01
gacgugcacccgcu

SEQ ID NO: 3507382 - RNA, 18 nt, Pseudomonas aeruginosa PA01
gacgugcugguagagccg

SEQ ID NO: 3507383 - RNA, 19 nt, Pseudomonas aeruginosa PA01
gacgugcugguagagccgg

SEQ ID NO: 3507384 - RNA, 20 nt, Pseudomonas aeruginosa PA01
gacgugcugguagagccggg

SEQ ID NO: 3507385 - RNA, 21 nt, Pseudomonas aeruginosa PA01
gacgugcugguagagccgggu

SEQ ID NO: 3507386 - RNA, 21 nt, Pseudomonas aeruginosa PA01
gacguggcauucgucgccgcu

SEQ ID NO: 3507387 - RNA, 22 nt, Pseudomonas aeruginosa PA01
gacguggcauucgucgccgcug

SEQ ID NO: 3507388 - RNA, 23 nt, Pseudomonas aeruginosa PA01
gacguggcauucgucgccgcugg

SEQ ID NO: 3507389 - RNA, 14 nt, Pseudomonas aeruginosa PA01
gacgugggaaauca

SEQ ID NO: 3507390 - RNA, 19 nt, Pseudomonas aeruginosa PA01
gacgugggaaaucaccgcc

SEQ ID NO: 3507391 - RNA, 20 nt, Pseudomonas aeruginosa PA01
gacgugggaaaucaccgcca

SEQ ID NO: 3507392 - RNA, 23 nt, Pseudomonas aeruginosa PA01
gacgugggaaaucaccgccaccu

SEQ ID NO: 3507393 - RNA, 16 nt, Pseudomonas aeruginosa PA01
gacguuccaccuggcg

SEQ ID NO: 3507394 - RNA, 20 nt, Pseudomonas aeruginosa PA01
gacguuccaccuggcgcagg

SEQ ID NO: 3507395 - RNA, 18 nt, Pseudomonas aeruginosa PA01
gacguuccgcgauagcuc

SEQ ID NO: 3507396 - RNA, 23 nt, Pseudomonas aeruginosa PA01
gacguuccgcgauagcucagucg

SEQ ID NO: 3507397 - RNA, 16 nt, Pseudomonas aeruginosa PA01
gacguucugcccgccg

SEQ ID NO: 3507398 - RNA, 22 nt, Pseudomonas aeruginosa PA01
gacguucugcccgccggcgccc

SEQ ID NO: 3507399 - RNA, 18 nt, Pseudomonas aeruginosa PA01
gacguucugcucgcugcc

SEQ ID NO: 3507400 - RNA, 19 nt, Pseudomonas aeruginosa PA01
gacguugccgcgcgggccg

SEQ ID NO: 3507401 - RNA, 18 nt, Pseudomonas aeruginosa PA01
gacguugcgcaggggcgc

SEQ ID NO: 3507402 - RNA, 12 nt, Pseudomonas aeruginosa PA01
gacguugcgccg

SEQ ID NO: 3507403 - RNA, 20 nt, Pseudomonas aeruginosa PA01
gacguugcugcccuggcgcg

SEQ ID NO: 3507404 - RNA, 21 nt, Pseudomonas aeruginosa PA01
gacguugcugcccuggcgcgc

SEQ ID NO: 3507405 - RNA, 14 nt, Pseudomonas aeruginosa PA01
gacuaacaggucaa

SEQ ID NO: 3507406 - RNA, 18 nt, Pseudomonas aeruginosa PA01
gacuaccgaucggcugcc

SEQ ID NO: 3507407 - RNA, 15 nt, Pseudomonas aeruginosa PA01
gacucacccgcugcg

SEQ ID NO: 3507408 - RNA, 22 nt, Pseudomonas aeruginosa PA01
gacucagaagaacggacgcgac

SEQ ID NO: 3507409 - RNA, 16 nt, Pseudomonas aeruginosa PA01
gacucagcgcgacagg

SEQ ID NO: 3507410 - RNA, 20 nt, Pseudomonas aeruginosa PA01
gacucagcgcgacaggcugg

SEQ ID NO: 3507411 - RNA, 14 nt, Pseudomonas aeruginosa PA01
gacuccagccaggc

SEQ ID NO: 3507412 - RNA, 23 nt, Pseudomonas aeruginosa PA01
gacucccgcagauagggcaucag

SEQ ID NO: 3507413 - RNA, 16 nt, Pseudomonas aeruginosa PA01
gacuccgcccaguucu

SEQ ID NO: 3507414 - RNA, 15 nt, Pseudomonas aeruginosa PA01
gacuccggaggcgca

SEQ ID NO: 3507415 - RNA, 17 nt, Pseudomonas aeruginosa PA01
gacuccggaggcgcaca

SEQ ID NO: 3507416 - RNA, 20 nt, Pseudomonas aeruginosa PA01
gacuccggaggcgcacaggc

SEQ ID NO: 3507417 - RNA, 23 nt, Pseudomonas aeruginosa PA01
gacuccggaggcgcacaggcgga

SEQ ID NO: 3507418 - RNA, 17 nt, Pseudomonas aeruginosa PA01
gacuccggcgcagccca

SEQ ID NO: 3507419 - RNA, 22 nt, Pseudomonas aeruginosa PA01
gacuccggcgcagcccagccgc

SEQ ID NO: 3507420 - RNA, 19 nt, Pseudomonas aeruginosa PA01
gacuccgggaacagcccgu

SEQ ID NO: 3507421 - RNA, 17 nt, Pseudomonas aeruginosa PA01
gacucgccaucggccug

SEQ ID NO: 3507422 - RNA, 21 nt, Pseudomonas aeruginosa PA01
gacucgcucgcuucagcgagc

SEQ ID NO: 3507423 - RNA, 22 nt, Pseudomonas aeruginosa PA01
gacucgcucgcuucagcgagcg

SEQ ID NO: 3507424 - RNA, 19 nt, Pseudomonas aeruginosa PA01
gacucgcugccggcgcgca

SEQ ID NO: 3507425 - RNA, 15 nt, Pseudomonas aeruginosa PA01
gacucgcugggcgcc

SEQ ID NO: 3507426 - RNA, 18 nt, Pseudomonas aeruginosa PA01
gacucgcugggcgccggc

SEQ ID NO: 3507427 - RNA, 21 nt, Pseudomonas aeruginosa PA01
gacucggcugcaacgccgcgg

SEQ ID NO: 3507428 - RNA, 19 nt, Pseudomonas aeruginosa PA01
gacucgguaaagcccaggu

SEQ ID NO: 3507429 - RNA, 20 nt, Pseudomonas aeruginosa PA01
gacucguugcacgcaggccg

SEQ ID NO: 3507430 - RNA, 22 nt, Pseudomonas aeruginosa PA01
gacucuccgcgccgcggcggcg

SEQ ID NO: 3507431 - RNA, 16 nt, Pseudomonas aeruginosa PA01
gacugacgguggaggc

SEQ ID NO: 3507432 - RNA, 13 nt, Pseudomonas aeruginosa PA01
gacugagccgcug

SEQ ID NO: 3507433 - RNA, 15 nt, Pseudomonas aeruginosa PA01
gacugagccgcuggu

SEQ ID NO: 3507434 - RNA, 22 nt, Pseudomonas aeruginosa PA01
gacugagcuaauccggcggcgc

SEQ ID NO: 3507435 - RNA, 16 nt, Pseudomonas aeruginosa PA01
gacugcaacuggccga

SEQ ID NO: 3507436 - RNA, 16 nt, Pseudomonas aeruginosa PA01
gacugccaacuggcgu

SEQ ID NO: 3507437 - RNA, 22 nt, Pseudomonas aeruginosa PA01
gacugccaggguaccguugcgc

SEQ ID NO: 3507438 - RNA, 21 nt, Pseudomonas aeruginosa PA01
gacugcccagcgccgccagca

SEQ ID NO: 3507439 - RNA, 22 nt, Pseudomonas aeruginosa PA01
gacugcccagcgccgccagcag

SEQ ID NO: 3507440 - RNA, 13 nt, Pseudomonas aeruginosa PA01
gacugccugcagg

SEQ ID NO: 3507441 - RNA, 14 nt, Pseudomonas aeruginosa PA01
gacugccugcaggu

SEQ ID NO: 3507442 - RNA, 22 nt, Pseudomonas aeruginosa PA01
gacugccugcagguagcgcugc

SEQ ID NO: 3507443 - RNA, 15 nt, Pseudomonas aeruginosa PA01
gacugcgagccgacu

SEQ ID NO: 3507444 - RNA, 14 nt, Pseudomonas aeruginosa PA01
gacugcgcuggccg

SEQ ID NO: 3507445 - RNA, 21 nt, Pseudomonas aeruginosa PA01
gacugcggcagcuuggcgacg

SEQ ID NO: 3507446 - RNA, 16 nt, Pseudomonas aeruginosa PA01
gacugcucgccgccgg

SEQ ID NO: 3507447 - RNA, 18 nt, Pseudomonas aeruginosa PA01
gacugcucgccgccggcg

SEQ ID NO: 3507448 - RNA, 19 nt, Pseudomonas aeruginosa PA01
gacugcucgccgccggcga

SEQ ID NO: 3507449 - RNA, 14 nt, Pseudomonas aeruginosa PA01
gacugcugcugcgg

SEQ ID NO: 3507450 - RNA, 18 nt, Pseudomonas aeruginosa PA01
gacugcugcugcggggcc

SEQ ID NO: 3507451 - RNA, 19 nt, Pseudomonas aeruginosa PA01
gacugcugcugcggggccu

SEQ ID NO: 3507452 - RNA, 22 nt, Pseudomonas aeruginosa PA01
gacugcugcugcggggccugcu

SEQ ID NO: 3507453 - RNA, 17 nt, Pseudomonas aeruginosa PA01
gacuggaaacgcaucca

SEQ ID NO: 3507454 - RNA, 18 nt, Pseudomonas aeruginosa PA01
gacuggauucggccugcc

SEQ ID NO: 3507455 - RNA, 20 nt, Pseudomonas aeruginosa PA01
gacuggcagcgauaaccgcg

SEQ ID NO: 3507456 - RNA, 16 nt, Pseudomonas aeruginosa PA01
gacuggcaguccaggg

SEQ ID NO: 3507457 - RNA, 14 nt, Pseudomonas aeruginosa PA01
gacuggcccuggua

SEQ ID NO: 3507458 - RNA, 22 nt, Pseudomonas aeruginosa PA01
gacugguaggacagggccaggc

SEQ ID NO: 3507459 - RNA, 21 nt, Pseudomonas aeruginosa PA01
gacuggugccggauagaggaa

SEQ ID NO: 3507460 - RNA, 18 nt, Pseudomonas aeruginosa PA01
gacugguugaccugcagc

SEQ ID NO: 3507461 - RNA, 20 nt, Pseudomonas aeruginosa PA01
gacugguugaccugcagcgc

SEQ ID NO: 3507462 - RNA, 21 nt, Pseudomonas aeruginosa PA01
gacugguugaccugcagcgcc

SEQ ID NO: 3507463 - RNA, 23 nt, Pseudomonas aeruginosa PA01
gacugguugaccugcagcgccuc

SEQ ID NO: 3507464 - RNA, 19 nt, Pseudomonas aeruginosa PA01
gacugucgcggggcuugcg

SEQ ID NO: 3507465 - RNA, 17 nt, Pseudomonas aeruginosa PA01
gacugucgugccuccag

SEQ ID NO: 3507466 - RNA, 18 nt, Pseudomonas aeruginosa PA01
gacugucgugccuccagc

SEQ ID NO: 3507467 - RNA, 24 nt, Pseudomonas aeruginosa PA01
gacugugcuuaauacggcgcaggc

SEQ ID NO: 3507468 - RNA, 23 nt, Pseudomonas aeruginosa PA01
gacugugguguagcgcagguugc

SEQ ID NO: 3507469 - RNA, 12 nt, Pseudomonas aeruginosa PA01
gacuucagcgca

SEQ ID NO: 3507470 - RNA, 17 nt, Pseudomonas aeruginosa PA01
gacuuccaggcgcaggc

SEQ ID NO: 3507471 - RNA, 16 nt, Pseudomonas aeruginosa PA01
gacuuccgccuugucc

SEQ ID NO: 3507472 - RNA, 21 nt, Pseudomonas aeruginosa PA01
gacuucgacgaacucgacgcg

SEQ ID NO: 3507473 - RNA, 18 nt, Pseudomonas aeruginosa PA01
gacuucgcaccagccggc

SEQ ID NO: 3507474 - RNA, 19 nt, Pseudomonas aeruginosa PA01
gacuucgcaccagccggcc

SEQ ID NO: 3507475 - RNA, 21 nt, Pseudomonas aeruginosa PA01
gacuucgcaccagccggccgc

SEQ ID NO: 3507476 - RNA, 22 nt, Pseudomonas aeruginosa PA01
gacuucgcaccagccggccgcg

SEQ ID NO: 3507477 - RNA, 15 nt, Pseudomonas aeruginosa PA01
gacuucgcauuccac

SEQ ID NO: 3507478 - RNA, 22 nt, Pseudomonas aeruginosa PA01
gacuucgcauuccaccuuggca

SEQ ID NO: 3507479 - RNA, 20 nt, Pseudomonas aeruginosa PA01
gacuucggcgacagccgggc

SEQ ID NO: 3507480 - RNA, 18 nt, Pseudomonas aeruginosa PA01
gacuugaugucgaugggc

SEQ ID NO: 3507481 - RNA, 14 nt, Pseudomonas aeruginosa PA01
gacuuggcagucgc

SEQ ID NO: 3507482 - RNA, 23 nt, Pseudomonas aeruginosa PA01
gagaaaaaccacgggaauggcgg

SEQ ID NO: 3507483 - RNA, 20 nt, Pseudomonas aeruginosa PA01
gagaaaacccugggaauggc

SEQ ID NO: 3507484 - RNA, 16 nt, Pseudomonas aeruginosa PA01
gagaaaccgaaguagu

SEQ ID NO: 3507485 - RNA, 22 nt, Pseudomonas aeruginosa PA01
gagaaagucgaucagcgcgcgg

SEQ ID NO: 3507486 - RNA, 12 nt, Pseudomonas aeruginosa PA01
gagaacagcagc

SEQ ID NO: 3507487 - RNA, 13 nt, Pseudomonas aeruginosa PA01
gagaacagcagcg

SEQ ID NO: 3507488 - RNA, 22 nt, Pseudomonas aeruginosa PA01
gagaacagcagcggcaccagca

SEQ ID NO: 3507489 - RNA, 19 nt, Pseudomonas aeruginosa PA01
gagaacagcagggucaggg

SEQ ID NO: 3507490 - RNA, 14 nt, Pseudomonas aeruginosa PA01
gagaaccaguacuu

SEQ ID NO: 3507491 - RNA, 16 nt, Pseudomonas aeruginosa PA01
gagaacccggccaggc

SEQ ID NO: 3507492 - RNA, 17 nt, Pseudomonas aeruginosa PA01
gagaacccggccaggcc

SEQ ID NO: 3507493 - RNA, 18 nt, Pseudomonas aeruginosa PA01
gagaacccggccaggccc

SEQ ID NO: 3507494 - RNA, 21 nt, Pseudomonas aeruginosa PA01
gagaacgacaugcucaucuuc

SEQ ID NO: 3507495 - RNA, 13 nt, Pseudomonas aeruginosa PA01
gagaacgccgcca

SEQ ID NO: 3507496 - RNA, 19 nt, Pseudomonas aeruginosa PA01
gagaacuugccggcgccau

SEQ ID NO: 3507497 - RNA, 21 nt, Pseudomonas aeruginosa PA01
gagaacuugccggcgccaucg

SEQ ID NO: 3507498 - RNA, 22 nt, Pseudomonas aeruginosa PA01
gagaacuuuucccagcggcugc

SEQ ID NO: 3507499 - RNA, 15 nt, Pseudomonas aeruginosa PA01
gagaagcagaacgcc

SEQ ID NO: 3507500 - RNA, 16 nt, Pseudomonas aeruginosa PA01
gagaagcagaacgccc

SEQ ID NO: 3507501 - RNA, 16 nt, Pseudomonas aeruginosa PA01
gagaagccagccaggu

SEQ ID NO: 3507502 - RNA, 22 nt, Pseudomonas aeruginosa PA01
gagaagccgcccacgggcggcu

SEQ ID NO: 3507503 - RNA, 17 nt, Pseudomonas aeruginosa PA01
gagaagccggggcaggc

SEQ ID NO: 3507504 - RNA, 18 nt, Pseudomonas aeruginosa PA01
gagaagccggggcaggca

SEQ ID NO: 3507505 - RNA, 16 nt, Pseudomonas aeruginosa PA01
gagaagcgccucgccu

SEQ ID NO: 3507506 - RNA, 15 nt, Pseudomonas aeruginosa PA01
gagaagcguucgccg

SEQ ID NO: 3507507 - RNA, 22 nt, Pseudomonas aeruginosa PA01
gagaaggcguagaaacgcgccu

SEQ ID NO: 3507508 - RNA, 16 nt, Pseudomonas aeruginosa PA01
gagaaggcugccgggc

SEQ ID NO: 3507509 - RNA, 13 nt, Pseudomonas aeruginosa PA01
gagaagggcgcgc

SEQ ID NO: 3507510 - RNA, 18 nt, Pseudomonas aeruginosa PA01
gagaaucugcccggccau

SEQ ID NO: 3507511 - RNA, 20 nt, Pseudomonas aeruginosa PA01
gagaaucugcccggccaugc

SEQ ID NO: 3507512 - RNA, 23 nt, Pseudomonas aeruginosa PA01
gagacaggaaucgacccagccgc

SEQ ID NO: 3507513 - RNA, 14 nt, Pseudomonas aeruginosa PA01
gagacauccggcca

SEQ ID NO: 3507514 - RNA, 13 nt, Pseudomonas aeruginosa PA01
gagacccccggga

SEQ ID NO: 3507515 - RNA, 22 nt, Pseudomonas aeruginosa PA01
gagacccccgggaugcccggcc

SEQ ID NO: 3507516 - RNA, 15 nt, Pseudomonas aeruginosa PA01
gagaccccggcggcg

SEQ ID NO: 3507517 - RNA, 13 nt, Pseudomonas aeruginosa PA01
gagacccgccagc

SEQ ID NO: 3507518 - RNA, 16 nt, Pseudomonas aeruginosa PA01
gagacccgccagcggc

SEQ ID NO: 3507519 - RNA, 17 nt, Pseudomonas aeruginosa PA01
gagacccgccagcggca

SEQ ID NO: 3507520 - RNA, 22 nt, Pseudomonas aeruginosa PA01
gagacccuggcgcugucgcccg

SEQ ID NO: 3507521 - RNA, 23 nt, Pseudomonas aeruginosa PA01
gagacccuggcgcugucgcccgg

SEQ ID NO: 3507522 - RNA, 18 nt, Pseudomonas aeruginosa PA01
gagaccgacgcucgcggc

SEQ ID NO: 3507523 - RNA, 19 nt, Pseudomonas aeruginosa PA01
gagaccgacgcucgcggca

SEQ ID NO: 3507524 - RNA, 19 nt, Pseudomonas aeruginosa PA01
gagaccgauccagcagucg

SEQ ID NO: 3507525 - RNA, 14 nt, Pseudomonas aeruginosa PA01
gagaccggcagccg

SEQ ID NO: 3507526 - RNA, 17 nt, Pseudomonas aeruginosa PA01
gagaccggcagccgggu

SEQ ID NO: 3507527 - RNA, 15 nt, Pseudomonas aeruginosa PA01
gagaccgugccgccg

SEQ ID NO: 3507528 - RNA, 18 nt, Pseudomonas aeruginosa PA01
gagaccgugccgccgggg

SEQ ID NO: 3507529 - RNA, 19 nt, Pseudomonas aeruginosa PA01
gagaccucgcccaucgcca

SEQ ID NO: 3507530 - RNA, 21 nt, Pseudomonas aeruginosa PA01
gagaccucgcccaucgccagg

SEQ ID NO: 3507531 - RNA, 22 nt, Pseudomonas aeruginosa PA01
gagaccucgcccaucgccaggg

SEQ ID NO: 3507532 - RNA, 23 nt, Pseudomonas aeruginosa PA01
gagaccucgcccaucgccagggu

SEQ ID NO: 3507533 - RNA, 18 nt, Pseudomonas aeruginosa PA01
gagaccuuccugccagcg

SEQ ID NO: 3507534 - RNA, 13 nt, Pseudomonas aeruginosa PA01
gagacgaucagca

SEQ ID NO: 3507535 - RNA, 16 nt, Pseudomonas aeruginosa PA01
gagacgauggcgacgu

SEQ ID NO: 3507536 - RNA, 13 nt, Pseudomonas aeruginosa PA01
gagacgccagccg

SEQ ID NO: 3507537 - RNA, 17 nt, Pseudomonas aeruginosa PA01
gagacgccagccgcccu

SEQ ID NO: 3507538 - RNA, 13 nt, Pseudomonas aeruginosa PA01
gagacgcccugga

SEQ ID NO: 3507539 - RNA, 16 nt, Pseudomonas aeruginosa PA01
gagacgccgccccagc

SEQ ID NO: 3507540 - RNA, 18 nt, Pseudomonas aeruginosa PA01
gagacgcgggcccagcgg

SEQ ID NO: 3507541 - RNA, 19 nt, Pseudomonas aeruginosa PA01
gagacgcgggcccagcggu

SEQ ID NO: 3507542 - RNA, 13 nt, Pseudomonas aeruginosa PA01
gagacgcugccgu

SEQ ID NO: 3507543 - RNA, 16 nt, Pseudomonas aeruginosa PA01
gagacgcugccguucg

SEQ ID NO: 3507544 - RNA, 21 nt, Pseudomonas aeruginosa PA01
gagacgcugccguucgcccgc

SEQ ID NO: 3507545 - RNA, 14 nt, Pseudomonas aeruginosa PA01
gagacggcccgccc

SEQ ID NO: 3507546 - RNA, 13 nt, Pseudomonas aeruginosa PA01
gagacggcggcga

SEQ ID NO: 3507547 - RNA, 20 nt, Pseudomonas aeruginosa PA01
gagacgggcgacgcccaugu

SEQ ID NO: 3507548 - RNA, 13 nt, Pseudomonas aeruginosa PA01
gagacgggcgagg

SEQ ID NO: 3507549 - RNA, 23 nt, Pseudomonas aeruginosa PA01
gagacguuggugauguugcgguc

SEQ ID NO: 3507550 - RNA, 20 nt, Pseudomonas aeruginosa PA01
gagacuaccgaucggcugcc

SEQ ID NO: 3507551 - RNA, 18 nt, Pseudomonas aeruginosa PA01
gagacuccggagaaccgg

SEQ ID NO: 3507552 - RNA, 22 nt, Pseudomonas aeruginosa PA01
gagacuugaugucgaugggcga

SEQ ID NO: 3507553 - RNA, 14 nt, Pseudomonas aeruginosa PA01
gagagaauccgccg

SEQ ID NO: 3507554 - RNA, 14 nt, Pseudomonas aeruginosa PA01
gagagacccgccag

SEQ ID NO: 3507555 - RNA, 19 nt, Pseudomonas aeruginosa PA01
gagagacccgccagcggca

SEQ ID NO: 3507556 - RNA, 21 nt, Pseudomonas aeruginosa PA01
gagagacccgccagcggcauu

SEQ ID NO: 3507557 - RNA, 16 nt, Pseudomonas aeruginosa PA01
gagagacugaacucgg

SEQ ID NO: 3507558 - RNA, 16 nt, Pseudomonas aeruginosa PA01
gagagauagucgccgu

SEQ ID NO: 3507559 - RNA, 17 nt, Pseudomonas aeruginosa PA01
gagagcagggccuggcc

SEQ ID NO: 3507560 - RNA, 13 nt, Pseudomonas aeruginosa PA01
gagagcgccagcg

SEQ ID NO: 3507561 - RNA, 12 nt, Pseudomonas aeruginosa PA01
gagagcggcgcc

SEQ ID NO: 3507562 - RNA, 16 nt, Pseudomonas aeruginosa PA01
gagagcguccggcagg

SEQ ID NO: 3507563 - RNA, 15 nt, Pseudomonas aeruginosa PA01
gagagcugcaaggcu

SEQ ID NO: 3507564 - RNA, 22 nt, Pseudomonas aeruginosa PA01
gagagcugcaaggcuucggcgg

SEQ ID NO: 3507565 - RNA, 23 nt, Pseudomonas aeruginosa PA01
gagagcuucucgguagggccgag

SEQ ID NO: 3507566 - RNA, 13 nt, Pseudomonas aeruginosa PA01
gagagggagcgcc

SEQ ID NO: 3507567 - RNA, 14 nt, Pseudomonas aeruginosa PA01
gagaggggcgcucg

SEQ ID NO: 3507568 - RNA, 22 nt, Pseudomonas aeruginosa PA01
gagaggggcgcucguugcgccg

SEQ ID NO: 3507569 - RNA, 21 nt, Pseudomonas aeruginosa PA01
gagaggggcucuuucauugcg

SEQ ID NO: 3507570 - RNA, 16 nt, Pseudomonas aeruginosa PA01
gagagggucagcaggc

SEQ ID NO: 3507571 - RNA, 21 nt, Pseudomonas aeruginosa PA01
gagagggucagcaggcugccg

SEQ ID NO: 3507572 - RNA, 18 nt, Pseudomonas aeruginosa PA01
gagagucggaagcuucag

SEQ ID NO: 3507573 - RNA, 16 nt, Pseudomonas aeruginosa PA01
gagauagccuccuccg

SEQ ID NO: 3507574 - RNA, 18 nt, Pseudomonas aeruginosa PA01
gagaucaccuugucguug

SEQ ID NO: 3507575 - RNA, 16 nt, Pseudomonas aeruginosa PA01
gagauccgccagcaga

SEQ ID NO: 3507576 - RNA, 14 nt, Pseudomonas aeruginosa PA01
gagauccugcagca

SEQ ID NO: 3507577 - RNA, 15 nt, Pseudomonas aeruginosa PA01
gagauccuggccggc

SEQ ID NO: 3507578 - RNA, 16 nt, Pseudomonas aeruginosa PA01
gagauccuggccggcg

SEQ ID NO: 3507579 - RNA, 19 nt, Pseudomonas aeruginosa PA01
gagauccuggccggcggcg

SEQ ID NO: 3507580 - RNA, 19 nt, Pseudomonas aeruginosa PA01
gagaucgcccagcggcugg

SEQ ID NO: 3507581 - RNA, 16 nt, Pseudomonas aeruginosa PA01
gagaucgccgcgccgu

SEQ ID NO: 3507582 - RNA, 13 nt, Pseudomonas aeruginosa PA01
gagaucggcggcg

SEQ ID NO: 3507583 - RNA, 14 nt, Pseudomonas aeruginosa PA01
gagaucggcggcgc

SEQ ID NO: 3507584 - RNA, 19 nt, Pseudomonas aeruginosa PA01
gagaucuucaggccgaagc

SEQ ID NO: 3507585 - RNA, 14 nt, Pseudomonas aeruginosa PA01
gagaugcaccggcc

SEQ ID NO: 3507586 - RNA, 14 nt, Pseudomonas aeruginosa PA01
gagaugcagcaggu

SEQ ID NO: 3507587 - RNA, 16 nt, Pseudomonas aeruginosa PA01
gagaugcucaggcgcu

SEQ ID NO: 3507588 - RNA, 19 nt, Pseudomonas aeruginosa PA01
gagaugcucaggcgcugcu

SEQ ID NO: 3507589 - RNA, 19 nt, Pseudomonas aeruginosa PA01
gagaugcugcgggcgccgc

SEQ ID NO: 3507590 - RNA, 20 nt, Pseudomonas aeruginosa PA01
gagauguacaggaugggcga

SEQ ID NO: 3507591 - RNA, 14 nt, Pseudomonas aeruginosa PA01
gagaugugcgcggu

SEQ ID NO: 3507592 - RNA, 17 nt, Pseudomonas aeruginosa PA01
gagauucugcaggcgcu

SEQ ID NO: 3507593 - RNA, 14 nt, Pseudomonas aeruginosa PA01
gagauucuuccggu

SEQ ID NO: 3507594 - RNA, 17 nt, Pseudomonas aeruginosa PA01
gagauugaugaagcgcu

SEQ ID NO: 3507595 - RNA, 13 nt, Pseudomonas aeruginosa PA01
gagcaacacaugc

SEQ ID NO: 3507596 - RNA, 14 nt, Pseudomonas aeruginosa PA01
gagcaacagcagga

SEQ ID NO: 3507597 - RNA, 23 nt, Pseudomonas aeruginosa PA01
gagcaacagcaggagaagcgccu

SEQ ID NO: 3507598 - RNA, 14 nt, Pseudomonas aeruginosa PA01
gagcaacucggcgg

SEQ ID NO: 3507599 - RNA, 15 nt, Pseudomonas aeruginosa PA01
gagcaacucggcggc

SEQ ID NO: 3507600 - RNA, 17 nt, Pseudomonas aeruginosa PA01
gagcaacucggcggcga

SEQ ID NO: 3507601 - RNA, 19 nt, Pseudomonas aeruginosa PA01
gagcaacucggcggcgagc

SEQ ID NO: 3507602 - RNA, 20 nt, Pseudomonas aeruginosa PA01
gagcaauccggcgcugccga

SEQ ID NO: 3507603 - RNA, 20 nt, Pseudomonas aeruginosa PA01
gagcaccaccacucgcgagc

SEQ ID NO: 3507604 - RNA, 21 nt, Pseudomonas aeruginosa PA01
gagcaccaccacucgcgagcu

SEQ ID NO: 3507605 - RNA, 23 nt, Pseudomonas aeruginosa PA01
gagcaccaccacucgcgagcugg

SEQ ID NO: 3507606 - RNA, 19 nt, Pseudomonas aeruginosa PA01
gagcaccagcaggucggcg

SEQ ID NO: 3507607 - RNA, 13 nt, Pseudomonas aeruginosa PA01
gagcaccaugccg

SEQ ID NO: 3507608 - RNA, 15 nt, Pseudomonas aeruginosa PA01
gagcaccaugccgau

SEQ ID NO: 3507609 - RNA, 16 nt, Pseudomonas aeruginosa PA01
gagcaccaugccgaug

SEQ ID NO: 3507610 - RNA, 21 nt, Pseudomonas aeruginosa PA01
gagcaccccgagcccggccgg

SEQ ID NO: 3507611 - RNA, 17 nt, Pseudomonas aeruginosa PA01
gagcacccgggcgaccu

SEQ ID NO: 3507612 - RNA, 19 nt, Pseudomonas aeruginosa PA01
gagcacccgggcgaccugc

SEQ ID NO: 3507613 - RNA, 14 nt, Pseudomonas aeruginosa PA01
gagcaccgcgccuu

SEQ ID NO: 3507614 - RNA, 15 nt, Pseudomonas aeruginosa PA01
gagcaccgcgccuuc

SEQ ID NO: 3507615 - RNA, 16 nt, Pseudomonas aeruginosa PA01
gagcaccgcgccuucc

SEQ ID NO: 3507616 - RNA, 17 nt, Pseudomonas aeruginosa PA01
gagcaccgcgccuucca

SEQ ID NO: 3507617 - RNA, 18 nt, Pseudomonas aeruginosa PA01
gagcaccgcgccuuccag

SEQ ID NO: 3507618 - RNA, 22 nt, Pseudomonas aeruginosa PA01
gagcaccgcgccuuccagcccu

SEQ ID NO: 3507619 - RNA, 20 nt, Pseudomonas aeruginosa PA01
gagcaccggaaaggcgucgu

SEQ ID NO: 3507620 - RNA, 22 nt, Pseudomonas aeruginosa PA01
gagcaccggcaggacgaugauc

SEQ ID NO: 3507621 - RNA, 15 nt, Pseudomonas aeruginosa PA01
gagcaccucgaccug

SEQ ID NO: 3507622 - RNA, 20 nt, Pseudomonas aeruginosa PA01
gagcaccucgaccugguagc

SEQ ID NO: 3507623 - RNA, 12 nt, Pseudomonas aeruginosa PA01
gagcacgaaagc

SEQ ID NO: 3507624 - RNA, 17 nt, Pseudomonas aeruginosa PA01
gagcacgccgcgaccga

SEQ ID NO: 3507625 - RNA, 17 nt, Pseudomonas aeruginosa PA01
gagcacgccguccgagg

SEQ ID NO: 3507626 - RNA, 13 nt, Pseudomonas aeruginosa PA01
gagcacgccgugc

SEQ ID NO: 3507627 - RNA, 16 nt, Pseudomonas aeruginosa PA01
gagcacgccgugcagg

SEQ ID NO: 3507628 - RNA, 23 nt, Pseudomonas aeruginosa PA01
gagcacggccguccugcggccgu

SEQ ID NO: 3507629 - RNA, 19 nt, Pseudomonas aeruginosa PA01
gagcacgguccgcgaaccg

SEQ ID NO: 3507630 - RNA, 14 nt, Pseudomonas aeruginosa PA01
gagcacgucgccuu

SEQ ID NO: 3507631 - RNA, 20 nt, Pseudomonas aeruginosa PA01
gagcacgucgccuucgcuga

SEQ ID NO: 3507632 - RNA, 13 nt, Pseudomonas aeruginosa PA01
gagcacuucccag

SEQ ID NO: 3507633 - RNA, 14 nt, Pseudomonas aeruginosa PA01
gagcacuucccagg

SEQ ID NO: 3507634 - RNA, 23 nt, Pseudomonas aeruginosa PA01
gagcacuucccaggugcccugga

SEQ ID NO: 3507635 - RNA, 14 nt, Pseudomonas aeruginosa PA01
gagcagaaccgcca

SEQ ID NO: 3507636 - RNA, 17 nt, Pseudomonas aeruginosa PA01
gagcagaaccgccagca

SEQ ID NO: 3507637 - RNA, 17 nt, Pseudomonas aeruginosa PA01
gagcagacacaaaaaac

SEQ ID NO: 3507638 - RNA, 15 nt, Pseudomonas aeruginosa PA01
gagcagagucgccgg

SEQ ID NO: 3507639 - RNA, 18 nt, Pseudomonas aeruginosa PA01
gagcagaguuuagccgcc

SEQ ID NO: 3507640 - RNA, 19 nt, Pseudomonas aeruginosa PA01
gagcagaguuuagccgcca

SEQ ID NO: 3507641 - RNA, 22 nt, Pseudomonas aeruginosa PA01
gagcagaguuuagccgccagug

SEQ ID NO: 3507642 - RNA, 15 nt, Pseudomonas aeruginosa PA01
gagcagcaccagcac

SEQ ID NO: 3507643 - RNA, 23 nt, Pseudomonas aeruginosa PA01
gagcagcaccagcaccagcggga

SEQ ID NO: 3507644 - RNA, 16 nt, Pseudomonas aeruginosa PA01
gagcagcaccaggcug

SEQ ID NO: 3507645 - RNA, 16 nt, Pseudomonas aeruginosa PA01
gagcagcacggccucg

SEQ ID NO: 3507646 - RNA, 15 nt, Pseudomonas aeruginosa PA01
gagcagcagcgccgc

SEQ ID NO: 3507647 - RNA, 17 nt, Pseudomonas aeruginosa PA01
gagcagcagcgccgcga

SEQ ID NO: 3507648 - RNA, 13 nt, Pseudomonas aeruginosa PA01
gagcagcaggugg

SEQ ID NO: 3507649 - RNA, 14 nt, Pseudomonas aeruginosa PA01
gagcagccaggcga

SEQ ID NO: 3507650 - RNA, 22 nt, Pseudomonas aeruginosa PA01
gagcagccaggcgaagcggcug

SEQ ID NO: 3507651 - RNA, 21 nt, Pseudomonas aeruginosa PA01
gagcagcccgggcaacugccg

SEQ ID NO: 3507652 - RNA, 14 nt, Pseudomonas aeruginosa PA01
gagcagcgccagcc

SEQ ID NO: 3507653 - RNA, 19 nt, Pseudomonas aeruginosa PA01
gagcagcgccagccagggu

SEQ ID NO: 3507654 - RNA, 15 nt, Pseudomonas aeruginosa PA01
gagcagcgccgcggu

SEQ ID NO: 3507655 - RNA, 14 nt, Pseudomonas aeruginosa PA01
gagcagcgcgcggc

SEQ ID NO: 3507656 - RNA, 15 nt, Pseudomonas aeruginosa PA01
gagcagcgcgcggcu

SEQ ID NO: 3507657 - RNA, 17 nt, Pseudomonas aeruginosa PA01
gagcagcgcgcggcucg

SEQ ID NO: 3507658 - RNA, 18 nt, Pseudomonas aeruginosa PA01
gagcagcgcgcggcucgg

SEQ ID NO: 3507659 - RNA, 15 nt, Pseudomonas aeruginosa PA01
gagcagcgcggcggc

SEQ ID NO: 3507660 - RNA, 13 nt, Pseudomonas aeruginosa PA01
gagcagcggacgc

SEQ ID NO: 3507661 - RNA, 18 nt, Pseudomonas aeruginosa PA01
gagcagcggacgcagcgg

SEQ ID NO: 3507662 - RNA, 19 nt, Pseudomonas aeruginosa PA01
gagcagcggacgcagcggg

SEQ ID NO: 3507663 - RNA, 22 nt, Pseudomonas aeruginosa PA01
gagcagcggacgcagcgggucg

SEQ ID NO: 3507664 - RNA, 13 nt, Pseudomonas aeruginosa PA01
gagcagcggcgcg

SEQ ID NO: 3507665 - RNA, 22 nt, Pseudomonas aeruginosa PA01
gagcagcggcgcgccaugcaug

SEQ ID NO: 3507666 - RNA, 18 nt, Pseudomonas aeruginosa PA01
gagcagcggcgcuuucca

SEQ ID NO: 3507667 - RNA, 22 nt, Pseudomonas aeruginosa PA01
gagcagcucauucguaaugaga

SEQ ID NO: 3507668 - RNA, 18 nt, Pseudomonas aeruginosa PA01
gagcagcucguucgccca

SEQ ID NO: 3507669 - RNA, 15 nt, Pseudomonas aeruginosa PA01
gagcaggacagcagg

SEQ ID NO: 3507670 - RNA, 24 nt, Pseudomonas aeruginosa PA01
gagcaggacagcagggucgcgccg

SEQ ID NO: 3507671 - RNA, 21 nt, Pseudomonas aeruginosa PA01
gagcaggacugcccgcguccc

SEQ ID NO: 3507672 - RNA, 21 nt, Pseudomonas aeruginosa PA01
gagcaggaggauacggcgcag

SEQ ID NO: 3507673 - RNA, 15 nt, Pseudomonas aeruginosa PA01
gagcaggcccaugau

SEQ ID NO: 3507674 - RNA, 24 nt, Pseudomonas aeruginosa PA01
gagcaggcccaugauggucggcac

SEQ ID NO: 3507675 - RNA, 17 nt, Pseudomonas aeruginosa PA01
gagcaggccgacggcgc

SEQ ID NO: 3507676 - RNA, 20 nt, Pseudomonas aeruginosa PA01
gagcaggccgacggcgcgcu

SEQ ID NO: 3507677 - RNA, 19 nt, Pseudomonas aeruginosa PA01
gagcaggccuugcagggcc

SEQ ID NO: 3507678 - RNA, 13 nt, Pseudomonas aeruginosa PA01
gagcaggcgccgg

SEQ ID NO: 3507679 - RNA, 17 nt, Pseudomonas aeruginosa PA01
gagcaggcgccggacca

SEQ ID NO: 3507680 - RNA, 13 nt, Pseudomonas aeruginosa PA01
gagcaggcgcgcc

SEQ ID NO: 3507681 - RNA, 21 nt, Pseudomonas aeruginosa PA01
gagcaggcggaaaaagcgcgg

SEQ ID NO: 3507682 - RNA, 16 nt, Pseudomonas aeruginosa PA01
gagcaggcggaucgcc

SEQ ID NO: 3507683 - RNA, 17 nt, Pseudomonas aeruginosa PA01
gagcaggcggaucgccg

SEQ ID NO: 3507684 - RNA, 19 nt, Pseudomonas aeruginosa PA01
gagcaggcggaucgccgcc

SEQ ID NO: 3507685 - RNA, 15 nt, Pseudomonas aeruginosa PA01
gagcaggcggccguc

SEQ ID NO: 3507686 - RNA, 16 nt, Pseudomonas aeruginosa PA01
gagcaggcggccgucc

SEQ ID NO: 3507687 - RNA, 12 nt, Pseudomonas aeruginosa PA01
gagcaggcggga

SEQ ID NO: 3507688 - RNA, 14 nt, Pseudomonas aeruginosa PA01
gagcaggcgggagu

SEQ ID NO: 3507689 - RNA, 19 nt, Pseudomonas aeruginosa PA01
gagcaggcguuccggggug

SEQ ID NO: 3507690 - RNA, 14 nt, Pseudomonas aeruginosa PA01
gagcaggcugccga

SEQ ID NO: 3507691 - RNA, 16 nt, Pseudomonas aeruginosa PA01
gagcaggcugccgaag

SEQ ID NO: 3507692 - RNA, 12 nt, Pseudomonas aeruginosa PA01
gagcaggcugcu

SEQ ID NO: 3507693 - RNA, 23 nt, Pseudomonas aeruginosa PA01
gagcaggcugcuagguucuaucg

SEQ ID NO: 3507694 - RNA, 14 nt, Pseudomonas aeruginosa PA01
gagcagggcacagc

SEQ ID NO: 3507695 - RNA, 14 nt, Pseudomonas aeruginosa PA01
gagcagggccgagc

SEQ ID NO: 3507696 - RNA, 22 nt, Pseudomonas aeruginosa PA01
gagcagggccgagcgcagcgcc

SEQ ID NO: 3507697 - RNA, 23 nt, Pseudomonas aeruginosa PA01
gagcagggccgagcgcagcgcca

SEQ ID NO: 3507698 - RNA, 15 nt, Pseudomonas aeruginosa PA01
gagcagggcgaugcc

SEQ ID NO: 3507699 - RNA, 23 nt, Pseudomonas aeruginosa PA01
gagcagggcgaugccgauggcgc

SEQ ID NO: 3507700 - RNA, 14 nt, Pseudomonas aeruginosa PA01
gagcagggcgccga

SEQ ID NO: 3507701 - RNA, 19 nt, Pseudomonas aeruginosa PA01
gagcagggcgccgaucagg

SEQ ID NO: 3507702 - RNA, 22 nt, Pseudomonas aeruginosa PA01
gagcagggcggauaaucgcagc

SEQ ID NO: 3507703 - RNA, 19 nt, Pseudomonas aeruginosa PA01
gagcagggcgucgcccucg

SEQ ID NO: 3507704 - RNA, 21 nt, Pseudomonas aeruginosa PA01
gagcagggcguucuuggccgc

SEQ ID NO: 3507705 - RNA, 16 nt, Pseudomonas aeruginosa PA01
gagcagggugaagcug

SEQ ID NO: 3507706 - RNA, 14 nt, Pseudomonas aeruginosa PA01
gagcagggugacgg

SEQ ID NO: 3507707 - RNA, 22 nt, Pseudomonas aeruginosa PA01
gagcagggugacggugaucgcc

SEQ ID NO: 3507708 - RNA, 22 nt, Pseudomonas aeruginosa PA01
gagcagguccugucccagcgag

SEQ ID NO: 3507709 - RNA, 14 nt, Pseudomonas aeruginosa PA01
gagcaggucgcgga

SEQ ID NO: 3507710 - RNA, 17 nt, Pseudomonas aeruginosa PA01
gagcaguucccccagca

SEQ ID NO: 3507711 - RNA, 15 nt, Pseudomonas aeruginosa PA01
gagcaguuccggcac

SEQ ID NO: 3507712 - RNA, 14 nt, Pseudomonas aeruginosa PA01
gagcaguucgucga

SEQ ID NO: 3507713 - RNA, 17 nt, Pseudomonas aeruginosa PA01
gagcaguugcagauaac

SEQ ID NO: 3507714 - RNA, 15 nt, Pseudomonas aeruginosa PA01
gagcaguugcgggcg

SEQ ID NO: 3507715 - RNA, 23 nt, Pseudomonas aeruginosa PA01
gagcaguuucggaucgacgccuu

SEQ ID NO: 3507716 - RNA, 15 nt, Pseudomonas aeruginosa PA01
gagcaucacccgcga

SEQ ID NO: 3507717 - RNA, 22 nt, Pseudomonas aeruginosa PA01
gagcauccacagggucggcagg

SEQ ID NO: 3507718 - RNA, 14 nt, Pseudomonas aeruginosa PA01
gagcaucucgccgg

SEQ ID NO: 3507719 - RNA, 17 nt, Pseudomonas aeruginosa PA01
gagcaucucgccggcac

SEQ ID NO: 3507720 - RNA, 16 nt, Pseudomonas aeruginosa PA01
gagcaucucggccagg

SEQ ID NO: 3507721 - RNA, 19 nt, Pseudomonas aeruginosa PA01
gagcaucucggccaggccc

SEQ ID NO: 3507722 - RNA, 13 nt, Pseudomonas aeruginosa PA01
gagcaucugccgg

SEQ ID NO: 3507723 - RNA, 15 nt, Pseudomonas aeruginosa PA01
gagcaugaugcaggc

SEQ ID NO: 3507724 - RNA, 17 nt, Pseudomonas aeruginosa PA01
gagcaugaugcaggcag

SEQ ID NO: 3507725 - RNA, 19 nt, Pseudomonas aeruginosa PA01
gagcaugauggugccgccg

SEQ ID NO: 3507726 - RNA, 20 nt, Pseudomonas aeruginosa PA01
gagcaugauggugccgccgg

SEQ ID NO: 3507727 - RNA, 14 nt, Pseudomonas aeruginosa PA01
gagcaugccgcaga

SEQ ID NO: 3507728 - RNA, 23 nt, Pseudomonas aeruginosa PA01
gagcaugccugcuuucccugcug

SEQ ID NO: 3507729 - RNA, 17 nt, Pseudomonas aeruginosa PA01
gagcaugcgcggcagga

SEQ ID NO: 3507730 - RNA, 20 nt, Pseudomonas aeruginosa PA01
gagcaugcucacugcgagca

SEQ ID NO: 3507731 - RNA, 22 nt, Pseudomonas aeruginosa PA01
gagcauggcguugagguugcga

SEQ ID NO: 3507732 - RNA, 20 nt, Pseudomonas aeruginosa PA01
gagcaugucggcgguuucca

SEQ ID NO: 3507733 - RNA, 19 nt, Pseudomonas aeruginosa PA01
gagcaugucuucgucgcgc

SEQ ID NO: 3507734 - RNA, 21 nt, Pseudomonas aeruginosa PA01
gagcaugucuucgucgcgcuu

SEQ ID NO: 3507735 - RNA, 17 nt, Pseudomonas aeruginosa PA01
gagcauuccucagcgcc

SEQ ID NO: 3507736 - RNA, 18 nt, Pseudomonas aeruginosa PA01
gagcauuccucagcgccg

SEQ ID NO: 3507737 - RNA, 21 nt, Pseudomonas aeruginosa PA01
gagccacggauaugcgccgcc

SEQ ID NO: 3507738 - RNA, 22 nt, Pseudomonas aeruginosa PA01
gagccacggauaugcgccgcca

SEQ ID NO: 3507739 - RNA, 15 nt, Pseudomonas aeruginosa PA01
gagccagcccagcgg

SEQ ID NO: 3507740 - RNA, 17 nt, Pseudomonas aeruginosa PA01
gagccagcccagcggcg

SEQ ID NO: 3507741 - RNA, 20 nt, Pseudomonas aeruginosa PA01
gagccagcccagcggcgcgg

SEQ ID NO: 3507742 - RNA, 14 nt, Pseudomonas aeruginosa PA01
gagccagccgcagc

SEQ ID NO: 3507743 - RNA, 15 nt, Pseudomonas aeruginosa PA01
gagccagccgcagcc

SEQ ID NO: 3507744 - RNA, 18 nt, Pseudomonas aeruginosa PA01
gagccagccgcagcccgg

SEQ ID NO: 3507745 - RNA, 15 nt, Pseudomonas aeruginosa PA01
gagccagccgcgagu

SEQ ID NO: 3507746 - RNA, 21 nt, Pseudomonas aeruginosa PA01
gagccagccgcggaucaccug

SEQ ID NO: 3507747 - RNA, 21 nt, Pseudomonas aeruginosa PA01
gagccagccguggcaggcgcc

SEQ ID NO: 3507748 - RNA, 14 nt, Pseudomonas aeruginosa PA01
gagccagcgcucga

SEQ ID NO: 3507749 - RNA, 22 nt, Pseudomonas aeruginosa PA01
gagccagcgcucgaacgccgcc

SEQ ID NO: 3507750 - RNA, 23 nt, Pseudomonas aeruginosa PA01
gagccagcgcucgaacgccgccc

SEQ ID NO: 3507751 - RNA, 11 nt, Pseudomonas aeruginosa PA01
gagccaggcgg

SEQ ID NO: 3507752 - RNA, 13 nt, Pseudomonas aeruginosa PA01
gagccaggcggcu

SEQ ID NO: 3507753 - RNA, 16 nt, Pseudomonas aeruginosa PA01
gagccaggcggcuccc

SEQ ID NO: 3507754 - RNA, 12 nt, Pseudomonas aeruginosa PA01
gagccaggcgua

SEQ ID NO: 3507755 - RNA, 20 nt, Pseudomonas aeruginosa PA01
gagccagguacggaugccgc

SEQ ID NO: 3507756 - RNA, 19 nt, Pseudomonas aeruginosa PA01
gagccagguuuccggcagc

SEQ ID NO: 3507757 - RNA, 22 nt, Pseudomonas aeruginosa PA01
gagccagguuuccggcagcacg

SEQ ID NO: 3507758 - RNA, 19 nt, Pseudomonas aeruginosa PA01
gagccagucgagagcgggu

SEQ ID NO: 3507759 - RNA, 15 nt, Pseudomonas aeruginosa PA01
gagccaugggccggc

SEQ ID NO: 3507760 - RNA, 19 nt, Pseudomonas aeruginosa PA01
gagccaugggccggccgac

SEQ ID NO: 3507761 - RNA, 19 nt, Pseudomonas aeruginosa PA01
gagcccagcggcagggcgg

SEQ ID NO: 3507762 - RNA, 21 nt, Pseudomonas aeruginosa PA01
gagcccagcggcagggcggcg

SEQ ID NO: 3507763 - RNA, 13 nt, Pseudomonas aeruginosa PA01
gagcccaggcaga

SEQ ID NO: 3507764 - RNA, 17 nt, Pseudomonas aeruginosa PA01
gagccccaugccguuca

SEQ ID NO: 3507765 - RNA, 13 nt, Pseudomonas aeruginosa PA01
gagcccccggcgc

SEQ ID NO: 3507766 - RNA, 13 nt, Pseudomonas aeruginosa PA01
gagccccggcagg

SEQ ID NO: 3507767 - RNA, 19 nt, Pseudomonas aeruginosa PA01
gagccccggcaggcaggcc

SEQ ID NO: 3507768 - RNA, 19 nt, Pseudomonas aeruginosa PA01
gagcccgagugcgcccagc

SEQ ID NO: 3507769 - RNA, 13 nt, Pseudomonas aeruginosa PA01
gagcccgccgaac

SEQ ID NO: 3507770 - RNA, 17 nt, Pseudomonas aeruginosa PA01
gagcccgccgaacagca

SEQ ID NO: 3507771 - RNA, 18 nt, Pseudomonas aeruginosa PA01
gagcccgccgaacagcaa

SEQ ID NO: 3507772 - RNA, 12 nt, Pseudomonas aeruginosa PA01
gagcccgccuga

SEQ ID NO: 3507773 - RNA, 14 nt, Pseudomonas aeruginosa PA01
gagcccgccugaag

SEQ ID NO: 3507774 - RNA, 16 nt, Pseudomonas aeruginosa PA01
gagcccgucgaagcca

SEQ ID NO: 3507775 - RNA, 20 nt, Pseudomonas aeruginosa PA01
gagcccgucgaagccaggca

SEQ ID NO: 3507776 - RNA, 21 nt, Pseudomonas aeruginosa PA01
gagcccgucgaagccaggcac

SEQ ID NO: 3507777 - RNA, 16 nt, Pseudomonas aeruginosa PA01
gagcccuugcgcggcg

SEQ ID NO: 3507778 - RNA, 22 nt, Pseudomonas aeruginosa PA01
gagccgaacuccggugucaggc

SEQ ID NO: 3507779 - RNA, 20 nt, Pseudomonas aeruginosa PA01
gagccgacauccugucgagg

SEQ ID NO: 3507780 - RNA, 22 nt, Pseudomonas aeruginosa PA01
gagccgacauccugucgaggcc

SEQ ID NO: 3507781 - RNA, 17 nt, Pseudomonas aeruginosa PA01
gagccgacuuccagcuu

SEQ ID NO: 3507782 - RNA, 15 nt, Pseudomonas aeruginosa PA01
gagccgagcaggcca

SEQ ID NO: 3507783 - RNA, 20 nt, Pseudomonas aeruginosa PA01
gagccgagcaggccacgcac

SEQ ID NO: 3507784 - RNA, 21 nt, Pseudomonas aeruginosa PA01
gagccgagcaggccacgcacc

SEQ ID NO: 3507785 - RNA, 22 nt, Pseudomonas aeruginosa PA01
gagccgagcaggccacgcacca

SEQ ID NO: 3507786 - RNA, 13 nt, Pseudomonas aeruginosa PA01
gagccgaucacca

SEQ ID NO: 3507787 - RNA, 14 nt, Pseudomonas aeruginosa PA01
gagccgaucaccag

SEQ ID NO: 3507788 - RNA, 17 nt, Pseudomonas aeruginosa PA01
gagccgaucaccagcaa

SEQ ID NO: 3507789 - RNA, 14 nt, Pseudomonas aeruginosa PA01
gagccgcaggguga

SEQ ID NO: 3507790 - RNA, 17 nt, Pseudomonas aeruginosa PA01
gagccgcccucggggcc

SEQ ID NO: 3507791 - RNA, 13 nt, Pseudomonas aeruginosa PA01
gagccgccggacu

SEQ ID NO: 3507792 - RNA, 16 nt, Pseudomonas aeruginosa PA01
gagccgccggggaagc

SEQ ID NO: 3507793 - RNA, 20 nt, Pseudomonas aeruginosa PA01
gagccgccggggaagcugcc

SEQ ID NO: 3507794 - RNA, 14 nt, Pseudomonas aeruginosa PA01
gagccgcgcagcag

SEQ ID NO: 3507795 - RNA, 12 nt, Pseudomonas aeruginosa PA01
gagccgcgcugc

SEQ ID NO: 3507796 - RNA, 21 nt, Pseudomonas aeruginosa PA01
gagccgcguucagucccgcgg

SEQ ID NO: 3507797 - RNA, 14 nt, Pseudomonas aeruginosa PA01
gagccgcugcaugg

SEQ ID NO: 3507798 - RNA, 20 nt, Pseudomonas aeruginosa PA01
gagccgcugcggcucgccga

SEQ ID NO: 3507799 - RNA, 13 nt, Pseudomonas aeruginosa PA01
gagccgcuggguu

SEQ ID NO: 3507800 - RNA, 19 nt, Pseudomonas aeruginosa PA01
gagccgcuggguuuccugc

SEQ ID NO: 3507801 - RNA, 14 nt, Pseudomonas aeruginosa PA01
gagccgcugguagc

SEQ ID NO: 3507802 - RNA, 13 nt, Pseudomonas aeruginosa PA01
gagccgcuggucc

SEQ ID NO: 3507803 - RNA, 19 nt, Pseudomonas aeruginosa PA01
gagccgcugguccagcugg

SEQ ID NO: 3507804 - RNA, 20 nt, Pseudomonas aeruginosa PA01
gagccggcauccuguggcug

SEQ ID NO: 3507805 - RNA, 11 nt, Pseudomonas aeruginosa PA01
gagccggccag

SEQ ID NO: 3507806 - RNA, 14 nt, Pseudomonas aeruginosa PA01
gagccggccaggcg

SEQ ID NO: 3507807 - RNA, 21 nt, Pseudomonas aeruginosa PA01
gagccggcgcaucagcgccgg

SEQ ID NO: 3507808 - RNA, 19 nt, Pseudomonas aeruginosa PA01
gagccggcugaugcccggg

SEQ ID NO: 3507809 - RNA, 13 nt, Pseudomonas aeruginosa PA01
gagccggcugccg

SEQ ID NO: 3507810 - RNA, 13 nt, Pseudomonas aeruginosa PA01
gagccgguagugc

SEQ ID NO: 3507811 - RNA, 23 nt, Pseudomonas aeruginosa PA01
gagccgguagugcuucagguagc

SEQ ID NO: 3507812 - RNA, 12 nt, Pseudomonas aeruginosa PA01
gagccggugccg

SEQ ID NO: 3507813 - RNA, 14 nt, Pseudomonas aeruginosa PA01
gagccggugccggc

SEQ ID NO: 3507814 - RNA, 16 nt, Pseudomonas aeruginosa PA01
gagccggugccggcgg

SEQ ID NO: 3507815 - RNA, 18 nt, Pseudomonas aeruginosa PA01
gagccggugccggcggcg

SEQ ID NO: 3507816 - RNA, 22 nt, Pseudomonas aeruginosa PA01
gagccguccugcggccgcaacc

SEQ ID NO: 3507817 - RNA, 16 nt, Pseudomonas aeruginosa PA01
gagccgucgccggcga

SEQ ID NO: 3507818 - RNA, 15 nt, Pseudomonas aeruginosa PA01
gagccguuccaggcg

SEQ ID NO: 3507819 - RNA, 16 nt, Pseudomonas aeruginosa PA01
gagccguuccaggcgg

SEQ ID NO: 3507820 - RNA, 23 nt, Pseudomonas aeruginosa PA01
gagccuacggaggaaacccaugc

SEQ ID NO: 3507821 - RNA, 14 nt, Pseudomonas aeruginosa PA01
gagccugcgugagc

SEQ ID NO: 3507822 - RNA, 14 nt, Pseudomonas aeruginosa PA01
gagccuggccaggc

SEQ ID NO: 3507823 - RNA, 15 nt, Pseudomonas aeruginosa PA01
gagccuggccaggcg

SEQ ID NO: 3507824 - RNA, 17 nt, Pseudomonas aeruginosa PA01
gagccuggccaggcgcu

SEQ ID NO: 3507825 - RNA, 21 nt, Pseudomonas aeruginosa PA01
gagccuggccaggcgcuccuc

SEQ ID NO: 3507826 - RNA, 19 nt, Pseudomonas aeruginosa PA01
gagccuucagcacggcgcg

SEQ ID NO: 3507827 - RNA, 22 nt, Pseudomonas aeruginosa PA01
gagccuucagcacggcgcgggu

SEQ ID NO: 3507828 - RNA, 18 nt, Pseudomonas aeruginosa PA01
gagccuucuagcgaaggc

SEQ ID NO: 3507829 - RNA, 20 nt, Pseudomonas aeruginosa PA01
gagccuugcggcgcucggga

SEQ ID NO: 3507830 - RNA, 16 nt, Pseudomonas aeruginosa PA01
gagcgaaacgccccgu

SEQ ID NO: 3507831 - RNA, 22 nt, Pseudomonas aeruginosa PA01
gagcgaaacgccccgucgacgc

SEQ ID NO: 3507832 - RNA, 17 nt, Pseudomonas aeruginosa PA01
gagcgaaaucggcaggc

SEQ ID NO: 3507833 - RNA, 18 nt, Pseudomonas aeruginosa PA01
gagcgaaaucggcaggcu

SEQ ID NO: 3507834 - RNA, 13 nt, Pseudomonas aeruginosa PA01
gagcgaagcgucg

SEQ ID NO: 3507835 - RNA, 14 nt, Pseudomonas aeruginosa PA01
gagcgaagcgucga

SEQ ID NO: 3507836 - RNA, 22 nt, Pseudomonas aeruginosa PA01
gagcgaauacaccgagcgcagu

SEQ ID NO: 3507837 - RNA, 23 nt, Pseudomonas aeruginosa PA01
gagcgacaccaugcuccgccugg

SEQ ID NO: 3507838 - RNA, 20 nt, Pseudomonas aeruginosa PA01
gagcgacccaacggggccuu

SEQ ID NO: 3507839 - RNA, 15 nt, Pseudomonas aeruginosa PA01
gagcgacguggcagg

SEQ ID NO: 3507840 - RNA, 22 nt, Pseudomonas aeruginosa PA01
gagcgacuccgggaacagcccg

SEQ ID NO: 3507841 - RNA, 22 nt, Pseudomonas aeruginosa PA01
gagcgagaccaucuggaucagg

SEQ ID NO: 3507842 - RNA, 15 nt, Pseudomonas aeruginosa PA01
gagcgagggcgucga

SEQ ID NO: 3507843 - RNA, 22 nt, Pseudomonas aeruginosa PA01
gagcgaucccaggucggcgggc

SEQ ID NO: 3507844 - RNA, 23 nt, Pseudomonas aeruginosa PA01
gagcgauguccaggccgaucucg

SEQ ID NO: 3507845 - RNA, 13 nt, Pseudomonas aeruginosa PA01
gagcgcacgugga

SEQ ID NO: 3507846 - RNA, 13 nt, Pseudomonas aeruginosa PA01
gagcgcagcgcca

SEQ ID NO: 3507847 - RNA, 19 nt, Pseudomonas aeruginosa PA01
gagcgcaguucgucgccca

SEQ ID NO: 3507848 - RNA, 22 nt, Pseudomonas aeruginosa PA01
gagcgccacgcgagaagccgcc

SEQ ID NO: 3507849 - RNA, 13 nt, Pseudomonas aeruginosa PA01
gagcgccacgggu

SEQ ID NO: 3507850 - RNA, 13 nt, Pseudomonas aeruginosa PA01
gagcgccagcacc

SEQ ID NO: 3507851 - RNA, 14 nt, Pseudomonas aeruginosa PA01
gagcgccagcaggu

SEQ ID NO: 3507852 - RNA, 16 nt, Pseudomonas aeruginosa PA01
gagcgccagcaggugg

SEQ ID NO: 3507853 - RNA, 16 nt, Pseudomonas aeruginosa PA01
gagcgccagccagcgc

SEQ ID NO: 3507854 - RNA, 17 nt, Pseudomonas aeruginosa PA01
gagcgccagccagcgcg

SEQ ID NO: 3507855 - RNA, 22 nt, Pseudomonas aeruginosa PA01
gagcgccagccagcgcggcucg

SEQ ID NO: 3507856 - RNA, 12 nt, Pseudomonas aeruginosa PA01
gagcgccagcga

SEQ ID NO: 3507857 - RNA, 13 nt, Pseudomonas aeruginosa PA01
gagcgccagcgag

SEQ ID NO: 3507858 - RNA, 14 nt, Pseudomonas aeruginosa PA01
gagcgccagcgaga

SEQ ID NO: 3507859 - RNA, 21 nt, Pseudomonas aeruginosa PA01
gagcgccaggaacgccucugc

SEQ ID NO: 3507860 - RNA, 13 nt, Pseudomonas aeruginosa PA01
gagcgccaggcgc

SEQ ID NO: 3507861 - RNA, 18 nt, Pseudomonas aeruginosa PA01
gagcgccagggccaggga

SEQ ID NO: 3507862 - RNA, 18 nt, Pseudomonas aeruginosa PA01
gagcgccaucagcgacca

SEQ ID NO: 3507863 - RNA, 12 nt, Pseudomonas aeruginosa PA01
gagcgcccggca

SEQ ID NO: 3507864 - RNA, 21 nt, Pseudomonas aeruginosa PA01
gagcgcccggcaaucaggcgc

SEQ ID NO: 3507865 - RNA, 14 nt, Pseudomonas aeruginosa PA01
gagcgccgccaggc

SEQ ID NO: 3507866 - RNA, 15 nt, Pseudomonas aeruginosa PA01
gagcgccgccaggca

SEQ ID NO: 3507867 - RNA, 19 nt, Pseudomonas aeruginosa PA01
gagcgccgccaggcaggcc

SEQ ID NO: 3507868 - RNA, 20 nt, Pseudomonas aeruginosa PA01
gagcgccgccaggcaggccg

SEQ ID NO: 3507869 - RNA, 13 nt, Pseudomonas aeruginosa PA01
gagcgccgccggu

SEQ ID NO: 3507870 - RNA, 13 nt, Pseudomonas aeruginosa PA01
gagcgccgccugg

SEQ ID NO: 3507871 - RNA, 20 nt, Pseudomonas aeruginosa PA01
gagcgccgcgcagcgcggcg

SEQ ID NO: 3507872 - RNA, 24 nt, Pseudomonas aeruginosa PA01
gagcgccgcgcagcgcggcgcugg

SEQ ID NO: 3507873 - RNA, 16 nt, Pseudomonas aeruginosa PA01
gagcgccgcggcggcg

SEQ ID NO: 3507874 - RNA, 13 nt, Pseudomonas aeruginosa PA01
gagcgccggcgcg

SEQ ID NO: 3507875 - RNA, 15 nt, Pseudomonas aeruginosa PA01
gagcgccggcgcggu

SEQ ID NO: 3507876 - RNA, 22 nt, Pseudomonas aeruginosa PA01
gagcgcgacuuggacagcgucu

SEQ ID NO: 3507877 - RNA, 14 nt, Pseudomonas aeruginosa PA01
gagcgcgagcggca

SEQ ID NO: 3507878 - RNA, 21 nt, Pseudomonas aeruginosa PA01
gagcgcgagcggcagauccgc

SEQ ID NO: 3507879 - RNA, 15 nt, Pseudomonas aeruginosa PA01
gagcgcgagugcagc

SEQ ID NO: 3507880 - RNA, 14 nt, Pseudomonas aeruginosa PA01
gagcgcgcccaggc

SEQ ID NO: 3507881 - RNA, 16 nt, Pseudomonas aeruginosa PA01
gagcgcgcccaggcag

SEQ ID NO: 3507882 - RNA, 21 nt, Pseudomonas aeruginosa PA01
gagcgcgcccaggcaggcgau

SEQ ID NO: 3507883 - RNA, 14 nt, Pseudomonas aeruginosa PA01
gagcgcgcccaggu

SEQ ID NO: 3507884 - RNA, 17 nt, Pseudomonas aeruginosa PA01
gagcgcgcccugcaggc

SEQ ID NO: 3507885 - RNA, 19 nt, Pseudomonas aeruginosa PA01
gagcgcgcccugcaggccg

SEQ ID NO: 3507886 - RNA, 22 nt, Pseudomonas aeruginosa PA01
gagcgcgcccugcaggccgaau

SEQ ID NO: 3507887 - RNA, 12 nt, Pseudomonas aeruginosa PA01
gagcgcggccgg

SEQ ID NO: 3507888 - RNA, 15 nt, Pseudomonas aeruginosa PA01
gagcgcggcgcaggc

SEQ ID NO: 3507889 - RNA, 20 nt, Pseudomonas aeruginosa PA01
gagcgcggcuucagagcugg

SEQ ID NO: 3507890 - RNA, 19 nt, Pseudomonas aeruginosa PA01
gagcgcuccaccgcgcucc

SEQ ID NO: 3507891 - RNA, 23 nt, Pseudomonas aeruginosa PA01
gagcgcuccaccgcgcuccgcug

SEQ ID NO: 3507892 - RNA, 14 nt, Pseudomonas aeruginosa PA01
gagcgcucgcgcag

SEQ ID NO: 3507893 - RNA, 16 nt, Pseudomonas aeruginosa PA01
gagcgcucgcgcagcc

SEQ ID NO: 3507894 - RNA, 22 nt, Pseudomonas aeruginosa PA01
gagcgcuucauccugcgcgccu

SEQ ID NO: 3507895 - RNA, 19 nt, Pseudomonas aeruginosa PA01
gagcggaaaagcaggccaa

SEQ ID NO: 3507896 - RNA, 20 nt, Pseudomonas aeruginosa PA01
gagcggaaacccgugguccg

SEQ ID NO: 3507897 - RNA, 22 nt, Pseudomonas aeruginosa PA01
gagcggaaacccgugguccgcc

SEQ ID NO: 3507898 - RNA, 20 nt, Pseudomonas aeruginosa PA01
gagcggaacgggacgccugg

SEQ ID NO: 3507899 - RNA, 15 nt, Pseudomonas aeruginosa PA01
gagcggaucgucgcg

SEQ ID NO: 3507900 - RNA, 16 nt, Pseudomonas aeruginosa PA01
gagcggaucgucgcgg

SEQ ID NO: 3507901 - RNA, 21 nt, Pseudomonas aeruginosa PA01
gagcggaucgucgcggcgcga

SEQ ID NO: 3507902 - RNA, 16 nt, Pseudomonas aeruginosa PA01
gagcggcaaggccaag

SEQ ID NO: 3507903 - RNA, 23 nt, Pseudomonas aeruginosa PA01
gagcggcaaggccaagucggccg

SEQ ID NO: 3507904 - RNA, 21 nt, Pseudomonas aeruginosa PA01
gagcggcaccucgauggcggc

SEQ ID NO: 3507905 - RNA, 23 nt, Pseudomonas aeruginosa PA01
gagcggcaccucgauggcggcgg

SEQ ID NO: 3507906 - RNA, 17 nt, Pseudomonas aeruginosa PA01
gagcggcaggccgccga

SEQ ID NO: 3507907 - RNA, 17 nt, Pseudomonas aeruginosa PA01
gagcggccaggucgagg

SEQ ID NO: 3507908 - RNA, 13 nt, Pseudomonas aeruginosa PA01
gagcggccggcgc

SEQ ID NO: 3507909 - RNA, 14 nt, Pseudomonas aeruginosa PA01
gagcggccggcgcg

SEQ ID NO: 3507910 - RNA, 20 nt, Pseudomonas aeruginosa PA01
gagcggccggcgcggcgcgu

SEQ ID NO: 3507911 - RNA, 12 nt, Pseudomonas aeruginosa PA01
gagcggccgugc

SEQ ID NO: 3507912 - RNA, 13 nt, Pseudomonas aeruginosa PA01
gagcggccgugca

SEQ ID NO: 3507913 - RNA, 22 nt, Pseudomonas aeruginosa PA01
gagcggccgugcaugccgacga

SEQ ID NO: 3507914 - RNA, 13 nt, Pseudomonas aeruginosa PA01
gagcggcgccagg

SEQ ID NO: 3507915 - RNA, 14 nt, Pseudomonas aeruginosa PA01
gagcggcgcccugg

SEQ ID NO: 3507916 - RNA, 15 nt, Pseudomonas aeruginosa PA01
gagcggcgcccuggc

SEQ ID NO: 3507917 - RNA, 12 nt, Pseudomonas aeruginosa PA01
gagcggcgcgaa

SEQ ID NO: 3507918 - RNA, 16 nt, Pseudomonas aeruginosa PA01
gagcggcggcacgacc

SEQ ID NO: 3507919 - RNA, 12 nt, Pseudomonas aeruginosa PA01
gagcggcggccg

SEQ ID NO: 3507920 - RNA, 14 nt, Pseudomonas aeruginosa PA01
gagcggcugccgag

SEQ ID NO: 3507921 - RNA, 16 nt, Pseudomonas aeruginosa PA01
gagcggcugccgaggc

SEQ ID NO: 3507922 - RNA, 14 nt, Pseudomonas aeruginosa PA01
gagcggcugguggc

SEQ ID NO: 3507923 - RNA, 14 nt, Pseudomonas aeruginosa PA01
gagcgggccgaggg

SEQ ID NO: 3507924 - RNA, 21 nt, Pseudomonas aeruginosa PA01
gagcgggcgagggcggcgcgg

SEQ ID NO: 3507925 - RNA, 22 nt, Pseudomonas aeruginosa PA01
gagcgggcgagggcggcgcggg

SEQ ID NO: 3507926 - RNA, 13 nt, Pseudomonas aeruginosa PA01
gagcgggcgccgg

SEQ ID NO: 3507927 - RNA, 18 nt, Pseudomonas aeruginosa PA01
gagcgggcgccggaccag

SEQ ID NO: 3507928 - RNA, 21 nt, Pseudomonas aeruginosa PA01
gagcgggcgccggaccagccg

SEQ ID NO: 3507929 - RNA, 13 nt, Pseudomonas aeruginosa PA01
gagcgggcggucg

SEQ ID NO: 3507930 - RNA, 20 nt, Pseudomonas aeruginosa PA01
gagcgggucagcagcaccgc

SEQ ID NO: 3507931 - RNA, 15 nt, Pseudomonas aeruginosa PA01
gagcgggucgauggc

SEQ ID NO: 3507932 - RNA, 18 nt, Pseudomonas aeruginosa PA01
gagcggugaaaccggcaa

SEQ ID NO: 3507933 - RNA, 17 nt, Pseudomonas aeruginosa PA01
gagcgguuauucgcccu

SEQ ID NO: 3507934 - RNA, 18 nt, Pseudomonas aeruginosa PA01
gagcgguuauucgcccua

SEQ ID NO: 3507935 - RNA, 21 nt, Pseudomonas aeruginosa PA01
gagcgguuauucgcccuacgg

SEQ ID NO: 3507936 - RNA, 16 nt, Pseudomonas aeruginosa PA01
gagcguaucgaugcgc

SEQ ID NO: 3507937 - RNA, 22 nt, Pseudomonas aeruginosa PA01
gagcguaucgaugcgcgcggcg

SEQ ID NO: 3507938 - RNA, 17 nt, Pseudomonas aeruginosa PA01
gagcguccggcagggcc

SEQ ID NO: 3507939 - RNA, 18 nt, Pseudomonas aeruginosa PA01
gagcguccggcagggccu

SEQ ID NO: 3507940 - RNA, 15 nt, Pseudomonas aeruginosa PA01
gagcgucgagucgcg

SEQ ID NO: 3507941 - RNA, 19 nt, Pseudomonas aeruginosa PA01
gagcguuccaugaacucuu

SEQ ID NO: 3507942 - RNA, 20 nt, Pseudomonas aeruginosa PA01
gagcguucggaucggcccgg

SEQ ID NO: 3507943 - RNA, 18 nt, Pseudomonas aeruginosa PA01
gagcguuucgcggaaggc

SEQ ID NO: 3507944 - RNA, 18 nt, Pseudomonas aeruginosa PA01
gagcuacagcgauucagg

SEQ ID NO: 3507945 - RNA, 13 nt, Pseudomonas aeruginosa PA01
gagcuccagggcu

SEQ ID NO: 3507946 - RNA, 15 nt, Pseudomonas aeruginosa PA01
gagcuccagggcugc

SEQ ID NO: 3507947 - RNA, 13 nt, Pseudomonas aeruginosa PA01
gagcucccugccg

SEQ ID NO: 3507948 - RNA, 16 nt, Pseudomonas aeruginosa PA01
gagcucccugccgccc

SEQ ID NO: 3507949 - RNA, 17 nt, Pseudomonas aeruginosa PA01
gagcucccugccgcccu

SEQ ID NO: 3507950 - RNA, 14 nt, Pseudomonas aeruginosa PA01
gagcucggccaggc

SEQ ID NO: 3507951 - RNA, 15 nt, Pseudomonas aeruginosa PA01
gagcucggccaggca

SEQ ID NO: 3507952 - RNA, 15 nt, Pseudomonas aeruginosa PA01
gagcugaucgcgcag

SEQ ID NO: 3507953 - RNA, 22 nt, Pseudomonas aeruginosa PA01
gagcugcaaggcuucggcgguc

SEQ ID NO: 3507954 - RNA, 21 nt, Pseudomonas aeruginosa PA01
gagcugcacguuguugcccac

SEQ ID NO: 3507955 - RNA, 22 nt, Pseudomonas aeruginosa PA01
gagcugcaugagugucgccauc

SEQ ID NO: 3507956 - RNA, 19 nt, Pseudomonas aeruginosa PA01
gagcugccccucguggcgc

SEQ ID NO: 3507957 - RNA, 15 nt, Pseudomonas aeruginosa PA01
gagcugccgcaccgc

SEQ ID NO: 3507958 - RNA, 17 nt, Pseudomonas aeruginosa PA01
gagcugccgcaccgccu

SEQ ID NO: 3507959 - RNA, 15 nt, Pseudomonas aeruginosa PA01
gagcugcucgauggc

SEQ ID NO: 3507960 - RNA, 16 nt, Pseudomonas aeruginosa PA01
gagcugcucgauggcg

SEQ ID NO: 3507961 - RNA, 14 nt, Pseudomonas aeruginosa PA01
gagcugcucggcgg

SEQ ID NO: 3507962 - RNA, 17 nt, Pseudomonas aeruginosa PA01
gagcugcucggcggugg

SEQ ID NO: 3507963 - RNA, 23 nt, Pseudomonas aeruginosa PA01
gagcuggaaauggcggucgccga

SEQ ID NO: 3507964 - RNA, 19 nt, Pseudomonas aeruginosa PA01
gagcuggaagucguccagc

SEQ ID NO: 3507965 - RNA, 20 nt, Pseudomonas aeruginosa PA01
gagcuggacgacgcuggccu

SEQ ID NO: 3507966 - RNA, 20 nt, Pseudomonas aeruginosa PA01
gagcuggcccaguugcccgg

SEQ ID NO: 3507967 - RNA, 21 nt, Pseudomonas aeruginosa PA01
gagcuggcccaguugcccggc

SEQ ID NO: 3507968 - RNA, 22 nt, Pseudomonas aeruginosa PA01
gagcuggcccaguugcccggcc

SEQ ID NO: 3507969 - RNA, 13 nt, Pseudomonas aeruginosa PA01
gagcuggccgagc

SEQ ID NO: 3507970 - RNA, 14 nt, Pseudomonas aeruginosa PA01
gagcuggccgagcg

SEQ ID NO: 3507971 - RNA, 11 nt, Pseudomonas aeruginosa PA01
gagcuggcgcc

SEQ ID NO: 3507972 - RNA, 11 nt, Pseudomonas aeruginosa PA01
gagcuggcgcu

SEQ ID NO: 3507973 - RNA, 21 nt, Pseudomonas aeruginosa PA01
gagcugggucacuccgcuggu

SEQ ID NO: 3507974 - RNA, 16 nt, Pseudomonas aeruginosa PA01
gagcugguacgccccc

SEQ ID NO: 3507975 - RNA, 20 nt, Pseudomonas aeruginosa PA01
gagcugguacgcccccuccc

SEQ ID NO: 3507976 - RNA, 23 nt, Pseudomonas aeruginosa PA01
gagcugguggauguucgccgcca

SEQ ID NO: 3507977 - RNA, 20 nt, Pseudomonas aeruginosa PA01
gagcuguccaucucgccgcg

SEQ ID NO: 3507978 - RNA, 16 nt, Pseudomonas aeruginosa PA01
gagcuguccggcgcug

SEQ ID NO: 3507979 - RNA, 13 nt, Pseudomonas aeruginosa PA01
gagcugugguugu

SEQ ID NO: 3507980 - RNA, 17 nt, Pseudomonas aeruginosa PA01
gagcuguuucagcccac

SEQ ID NO: 3507981 - RNA, 19 nt, Pseudomonas aeruginosa PA01
gagcuguuucagcccacgc

SEQ ID NO: 3507982 - RNA, 16 nt, Pseudomonas aeruginosa PA01
gagcuucccgcauggc

SEQ ID NO: 3507983 - RNA, 14 nt, Pseudomonas aeruginosa PA01
gagcuucgccgcgc

SEQ ID NO: 3507984 - RNA, 15 nt, Pseudomonas aeruginosa PA01
gagcuucgccgcgca

SEQ ID NO: 3507985 - RNA, 14 nt, Pseudomonas aeruginosa PA01
gagcuucucgucgc

SEQ ID NO: 3507986 - RNA, 19 nt, Pseudomonas aeruginosa PA01
gagcuucucgucgccgccg

SEQ ID NO: 3507987 - RNA, 18 nt, Pseudomonas aeruginosa PA01
gagcuugaugaagcccgc

SEQ ID NO: 3507988 - RNA, 19 nt, Pseudomonas aeruginosa PA01
gagcuugaugaagcccgcg

SEQ ID NO: 3507989 - RNA, 20 nt, Pseudomonas aeruginosa PA01
gagcuugaugaagcccgcgg

SEQ ID NO: 3507990 - RNA, 14 nt, Pseudomonas aeruginosa PA01
gagcuugcaauccg

SEQ ID NO: 3507991 - RNA, 14 nt, Pseudomonas aeruginosa PA01
gagcuuggcccugg

SEQ ID NO: 3507992 - RNA, 18 nt, Pseudomonas aeruginosa PA01
gagcuuguccagggcgcc

SEQ ID NO: 3507993 - RNA, 13 nt, Pseudomonas aeruginosa PA01
gagcuuugcaggg

SEQ ID NO: 3507994 - RNA, 16 nt, Pseudomonas aeruginosa PA01
gagcuuugcgcagcca

SEQ ID NO: 3507995 - RNA, 17 nt, Pseudomonas aeruginosa PA01
gagcuuugcgcagccac

SEQ ID NO: 3507996 - RNA, 17 nt, Pseudomonas aeruginosa PA01
gaggaaaaacgggggcu

SEQ ID NO: 3507997 - RNA, 18 nt, Pseudomonas aeruginosa PA01
gaggaaauacagcacccg

SEQ ID NO: 3507998 - RNA, 22 nt, Pseudomonas aeruginosa PA01
gaggaaaugauguugcgccaga

SEQ ID NO: 3507999 - RNA, 15 nt, Pseudomonas aeruginosa PA01
gaggaacacccagaa

SEQ ID NO: 3508000 - RNA, 21 nt, Pseudomonas aeruginosa PA01
gaggaacagcgagaggggcgc

SEQ ID NO: 3508001 - RNA, 19 nt, Pseudomonas aeruginosa PA01
gaggaacaguucggcgagu

SEQ ID NO: 3508002 - RNA, 20 nt, Pseudomonas aeruginosa PA01
gaggaacgccgacaggccgg

SEQ ID NO: 3508003 - RNA, 19 nt, Pseudomonas aeruginosa PA01
gaggaacuccuccucgcuc

SEQ ID NO: 3508004 - RNA, 18 nt, Pseudomonas aeruginosa PA01
gaggaacuugucgaccac

SEQ ID NO: 3508005 - RNA, 19 nt, Pseudomonas aeruginosa PA01
gaggaagaaaaagcccgcu

SEQ ID NO: 3508006 - RNA, 22 nt, Pseudomonas aeruginosa PA01
gaggaagagcagcgcggcggcg

SEQ ID NO: 3508007 - RNA, 19 nt, Pseudomonas aeruginosa PA01
gaggaagccgaccggcgcc

SEQ ID NO: 3508008 - RNA, 15 nt, Pseudomonas aeruginosa PA01
gaggaaggccagcag

SEQ ID NO: 3508009 - RNA, 15 nt, Pseudomonas aeruginosa PA01
gaggaaggcgccggc

SEQ ID NO: 3508010 - RNA, 18 nt, Pseudomonas aeruginosa PA01
gaggaaggcgcuggcgcu

SEQ ID NO: 3508011 - RNA, 23 nt, Pseudomonas aeruginosa PA01
gaggaaguaguagaugcggcugu

SEQ ID NO: 3508012 - RNA, 21 nt, Pseudomonas aeruginosa PA01
gaggaagucgcuucaccgggc

SEQ ID NO: 3508013 - RNA, 13 nt, Pseudomonas aeruginosa PA01
gaggaagucggcg

SEQ ID NO: 3508014 - RNA, 17 nt, Pseudomonas aeruginosa PA01
gaggaagucggcggccg

SEQ ID NO: 3508015 - RNA, 22 nt, Pseudomonas aeruginosa PA01
gaggaagucggcggccgccuug

SEQ ID NO: 3508016 - RNA, 17 nt, Pseudomonas aeruginosa PA01
gaggaaguggccggugu

SEQ ID NO: 3508017 - RNA, 22 nt, Pseudomonas aeruginosa PA01
gaggaaguuaucggggccaggu

SEQ ID NO: 3508018 - RNA, 15 nt, Pseudomonas aeruginosa PA01
gaggaaguugcgcag

SEQ ID NO: 3508019 - RNA, 18 nt, Pseudomonas aeruginosa PA01
gaggaaguugcgcagcaa

SEQ ID NO: 3508020 - RNA, 19 nt, Pseudomonas aeruginosa PA01
gaggaauaaagaaaaggcc

SEQ ID NO: 3508021 - RNA, 21 nt, Pseudomonas aeruginosa PA01
gaggaauaaagaaaaggccgc

SEQ ID NO: 3508022 - RNA, 14 nt, Pseudomonas aeruginosa PA01
gaggacccggcgga

SEQ ID NO: 3508023 - RNA, 14 nt, Pseudomonas aeruginosa PA01
gaggaccuggccgc

SEQ ID NO: 3508024 - RNA, 15 nt, Pseudomonas aeruginosa PA01
gaggacgaucagcuc

SEQ ID NO: 3508025 - RNA, 17 nt, Pseudomonas aeruginosa PA01
gaggacgccgggcuggu

SEQ ID NO: 3508026 - RNA, 15 nt, Pseudomonas aeruginosa PA01
gaggacugccagggu

SEQ ID NO: 3508027 - RNA, 21 nt, Pseudomonas aeruginosa PA01
gaggagccuuucacuuucagg

SEQ ID NO: 3508028 - RNA, 22 nt, Pseudomonas aeruginosa PA01
gaggaggaucucgcgccccggg

SEQ ID NO: 3508029 - RNA, 13 nt, Pseudomonas aeruginosa PA01
gaggaggcgccgg

SEQ ID NO: 3508030 - RNA, 14 nt, Pseudomonas aeruginosa PA01
gaggaggcgccggg

SEQ ID NO: 3508031 - RNA, 16 nt, Pseudomonas aeruginosa PA01
gaggaggcgccgggua

SEQ ID NO: 3508032 - RNA, 18 nt, Pseudomonas aeruginosa PA01
gaggagggcgaggucacc

SEQ ID NO: 3508033 - RNA, 16 nt, Pseudomonas aeruginosa PA01
gaggagguuggucugc

SEQ ID NO: 3508034 - RNA, 21 nt, Pseudomonas aeruginosa PA01
gaggagguuggucugcucggc

SEQ ID NO: 3508035 - RNA, 19 nt, Pseudomonas aeruginosa PA01
gaggauaccgcacggccgu

SEQ ID NO: 3508036 - RNA, 18 nt, Pseudomonas aeruginosa PA01
gaggauacgcucaggaag

SEQ ID NO: 3508037 - RNA, 16 nt, Pseudomonas aeruginosa PA01
gaggauacggcgcagc

SEQ ID NO: 3508038 - RNA, 14 nt, Pseudomonas aeruginosa PA01
gaggaucacgcagc

SEQ ID NO: 3508039 - RNA, 21 nt, Pseudomonas aeruginosa PA01
gaggaucacgcagcaggcgac

SEQ ID NO: 3508040 - RNA, 13 nt, Pseudomonas aeruginosa PA01
gaggaucagccac

SEQ ID NO: 3508041 - RNA, 22 nt, Pseudomonas aeruginosa PA01
gaggaucagccacgggcgccag

SEQ ID NO: 3508042 - RNA, 15 nt, Pseudomonas aeruginosa PA01
gaggaucgccagcaa

SEQ ID NO: 3508043 - RNA, 16 nt, Pseudomonas aeruginosa PA01
gaggaucgccagcaau

SEQ ID NO: 3508044 - RNA, 21 nt, Pseudomonas aeruginosa PA01
gaggaucgcgaagcgcagcac

SEQ ID NO: 3508045 - RNA, 14 nt, Pseudomonas aeruginosa PA01
gaggaucgcggccu

SEQ ID NO: 3508046 - RNA, 23 nt, Pseudomonas aeruginosa PA01
gaggaucgcggccuucucgucgc

SEQ ID NO: 3508047 - RNA, 18 nt, Pseudomonas aeruginosa PA01
gaggaucgcucccaggcu

SEQ ID NO: 3508048 - RNA, 13 nt, Pseudomonas aeruginosa PA01
gaggaucggccaa

SEQ ID NO: 3508049 - RNA, 15 nt, Pseudomonas aeruginosa PA01
gaggaucggccaacu

SEQ ID NO: 3508050 - RNA, 17 nt, Pseudomonas aeruginosa PA01
gaggaucuccaacuggc

SEQ ID NO: 3508051 - RNA, 23 nt, Pseudomonas aeruginosa PA01
gaggaucuccaacuggcggcugg

SEQ ID NO: 3508052 - RNA, 14 nt, Pseudomonas aeruginosa PA01
gaggaucucgccac

SEQ ID NO: 3508053 - RNA, 14 nt, Pseudomonas aeruginosa PA01
gaggaucucgcgcc

SEQ ID NO: 3508054 - RNA, 16 nt, Pseudomonas aeruginosa PA01
gaggaucuugcgcccg

SEQ ID NO: 3508055 - RNA, 17 nt, Pseudomonas aeruginosa PA01
gaggaucuugcgcccgg

SEQ ID NO: 3508056 - RNA, 18 nt, Pseudomonas aeruginosa PA01
gaggaucuugcgcccggc

SEQ ID NO: 3508057 - RNA, 15 nt, Pseudomonas aeruginosa PA01
gaggaugccggccuc

SEQ ID NO: 3508058 - RNA, 17 nt, Pseudomonas aeruginosa PA01
gaggaugcggauguagu

SEQ ID NO: 3508059 - RNA, 15 nt, Pseudomonas aeruginosa PA01
gaggauggccguccu

SEQ ID NO: 3508060 - RNA, 17 nt, Pseudomonas aeruginosa PA01
gaggauggucaggccgg

SEQ ID NO: 3508061 - RNA, 20 nt, Pseudomonas aeruginosa PA01
gaggauggucaggccggcgc

SEQ ID NO: 3508062 - RNA, 20 nt, Pseudomonas aeruginosa PA01
gaggaugucggcgaacuggc

SEQ ID NO: 3508063 - RNA, 17 nt, Pseudomonas aeruginosa PA01
gaggauuuccgcgcccg

SEQ ID NO: 3508064 - RNA, 21 nt, Pseudomonas aeruginosa PA01
gaggauuuccggcuugccgau

SEQ ID NO: 3508065 - RNA, 16 nt, Pseudomonas aeruginosa PA01
gaggauuuccucgcgc

SEQ ID NO: 3508066 - RNA, 20 nt, Pseudomonas aeruginosa PA01
gaggauuuucuccggcgccg

SEQ ID NO: 3508067 - RNA, 18 nt, Pseudomonas aeruginosa PA01
gaggcaacaccaucggcc

SEQ ID NO: 3508068 - RNA, 19 nt, Pseudomonas aeruginosa PA01
gaggcaacaccaucggccc

SEQ ID NO: 3508069 - RNA, 20 nt, Pseudomonas aeruginosa PA01
gaggcaaucugcccggcauc

SEQ ID NO: 3508070 - RNA, 22 nt, Pseudomonas aeruginosa PA01
gaggcaaucugcccggcaucgu

SEQ ID NO: 3508071 - RNA, 13 nt, Pseudomonas aeruginosa PA01
gaggcagccgucg

SEQ ID NO: 3508072 - RNA, 22 nt, Pseudomonas aeruginosa PA01
gaggcauucucgcgacccuggc

SEQ ID NO: 3508073 - RNA, 22 nt, Pseudomonas aeruginosa PA01
gaggccaccacuucgcggacca

SEQ ID NO: 3508074 - RNA, 16 nt, Pseudomonas aeruginosa PA01
gaggccagcagcagaa

SEQ ID NO: 3508075 - RNA, 13 nt, Pseudomonas aeruginosa PA01
gaggccaggaucg

SEQ ID NO: 3508076 - RNA, 15 nt, Pseudomonas aeruginosa PA01
gaggccaggaucguc

SEQ ID NO: 3508077 - RNA, 14 nt, Pseudomonas aeruginosa PA01
gaggccaggccgag

SEQ ID NO: 3508078 - RNA, 21 nt, Pseudomonas aeruginosa PA01
gaggccaggccgagcgccagg

SEQ ID NO: 3508079 - RNA, 22 nt, Pseudomonas aeruginosa PA01
gaggccauccccgaggcgacgc

SEQ ID NO: 3508080 - RNA, 17 nt, Pseudomonas aeruginosa PA01
gaggcccacgggcggcc

SEQ ID NO: 3508081 - RNA, 18 nt, Pseudomonas aeruginosa PA01
gaggcccacgggcggccg

SEQ ID NO: 3508082 - RNA, 21 nt, Pseudomonas aeruginosa PA01
gaggcccacgggcggccgacg

SEQ ID NO: 3508083 - RNA, 14 nt, Pseudomonas aeruginosa PA01
gaggcccagcgacu

SEQ ID NO: 3508084 - RNA, 16 nt, Pseudomonas aeruginosa PA01
gaggcccgcgccgccg

SEQ ID NO: 3508085 - RNA, 17 nt, Pseudomonas aeruginosa PA01
gaggcccgcgccgccgg

SEQ ID NO: 3508086 - RNA, 17 nt, Pseudomonas aeruginosa PA01
gaggcccucggcgccga

SEQ ID NO: 3508087 - RNA, 19 nt, Pseudomonas aeruginosa PA01
gaggcccucggcgccgagc

SEQ ID NO: 3508088 - RNA, 22 nt, Pseudomonas aeruginosa PA01
gaggccgacgaacagccagagg

SEQ ID NO: 3508089 - RNA, 15 nt, Pseudomonas aeruginosa PA01
gaggccgagccgaca

SEQ ID NO: 3508090 - RNA, 16 nt, Pseudomonas aeruginosa PA01
gaggccgagccgacau

SEQ ID NO: 3508091 - RNA, 16 nt, Pseudomonas aeruginosa PA01
gaggccgagccggcau

SEQ ID NO: 3508092 - RNA, 17 nt, Pseudomonas aeruginosa PA01
gaggccgcccagcgcag

SEQ ID NO: 3508093 - RNA, 18 nt, Pseudomonas aeruginosa PA01
gaggccgccgcgggcaac

SEQ ID NO: 3508094 - RNA, 23 nt, Pseudomonas aeruginosa PA01
gaggccggcaugcagguggcgcu

SEQ ID NO: 3508095 - RNA, 23 nt, Pseudomonas aeruginosa PA01
gaggccggcgaucagcucgcggu

SEQ ID NO: 3508096 - RNA, 22 nt, Pseudomonas aeruginosa PA01
gaggccgguguagcgacggaag

SEQ ID NO: 3508097 - RNA, 14 nt, Pseudomonas aeruginosa PA01
gaggccgugguggc

SEQ ID NO: 3508098 - RNA, 21 nt, Pseudomonas aeruginosa PA01
gaggccuacuucucgacgaag

SEQ ID NO: 3508099 - RNA, 22 nt, Pseudomonas aeruginosa PA01
gaggccucgucguucagcccac

SEQ ID NO: 3508100 - RNA, 16 nt, Pseudomonas aeruginosa PA01
gaggcgaacggcaggu

SEQ ID NO: 3508101 - RNA, 13 nt, Pseudomonas aeruginosa PA01
gaggcgaccagcc

SEQ ID NO: 3508102 - RNA, 15 nt, Pseudomonas aeruginosa PA01
gaggcgaccuuggcc

SEQ ID NO: 3508103 - RNA, 18 nt, Pseudomonas aeruginosa PA01
gaggcgaccuuggccagc

SEQ ID NO: 3508104 - RNA, 15 nt, Pseudomonas aeruginosa PA01
gaggcgacgcccugu

SEQ ID NO: 3508105 - RNA, 22 nt, Pseudomonas aeruginosa PA01
gaggcgaggaaaaggaucgccg

SEQ ID NO: 3508106 - RNA, 13 nt, Pseudomonas aeruginosa PA01
gaggcgaggucgc

SEQ ID NO: 3508107 - RNA, 17 nt, Pseudomonas aeruginosa PA01
gaggcgaucgccgcggc

SEQ ID NO: 3508108 - RNA, 18 nt, Pseudomonas aeruginosa PA01
gaggcgcacaggcggaag

SEQ ID NO: 3508109 - RNA, 16 nt, Pseudomonas aeruginosa PA01
gaggcgcagcagcgcc

SEQ ID NO: 3508110 - RNA, 20 nt, Pseudomonas aeruginosa PA01
gaggcgcagcagcgccaguu

SEQ ID NO: 3508111 - RNA, 13 nt, Pseudomonas aeruginosa PA01
gaggcgcccgccg

SEQ ID NO: 3508112 - RNA, 13 nt, Pseudomonas aeruginosa PA01
gaggcgccgacca

SEQ ID NO: 3508113 - RNA, 13 nt, Pseudomonas aeruginosa PA01
gaggcgccgcgcc

SEQ ID NO: 3508114 - RNA, 14 nt, Pseudomonas aeruginosa PA01
gaggcgccgcgcca

SEQ ID NO: 3508115 - RNA, 16 nt, Pseudomonas aeruginosa PA01
gaggcgccgcgccagg

SEQ ID NO: 3508116 - RNA, 12 nt, Pseudomonas aeruginosa PA01
gaggcgcgccga

SEQ ID NO: 3508117 - RNA, 14 nt, Pseudomonas aeruginosa PA01
gaggcgcgccgaca

SEQ ID NO: 3508118 - RNA, 14 nt, Pseudomonas aeruginosa PA01
gaggcgcgccuggu

SEQ ID NO: 3508119 - RNA, 15 nt, Pseudomonas aeruginosa PA01
gaggcgcgcgccgaa

SEQ ID NO: 3508120 - RNA, 19 nt, Pseudomonas aeruginosa PA01
gaggcgcuccaccagggcc

SEQ ID NO: 3508121 - RNA, 21 nt, Pseudomonas aeruginosa PA01
gaggcgcuccaccagggccuc

SEQ ID NO: 3508122 - RNA, 23 nt, Pseudomonas aeruginosa PA01
gaggcgcuccaccagggccucgg

SEQ ID NO: 3508123 - RNA, 16 nt, Pseudomonas aeruginosa PA01
gaggcgcuccaccgcc

SEQ ID NO: 3508124 - RNA, 11 nt, Pseudomonas aeruginosa PA01
gaggcgcucgu

SEQ ID NO: 3508125 - RNA, 22 nt, Pseudomonas aeruginosa PA01
gaggcgcuggccagcgcuucca

SEQ ID NO: 3508126 - RNA, 19 nt, Pseudomonas aeruginosa PA01
gaggcgcuucugcucggcc

SEQ ID NO: 3508127 - RNA, 19 nt, Pseudomonas aeruginosa PA01
gaggcggauuugccgccga

SEQ ID NO: 3508128 - RNA, 22 nt, Pseudomonas aeruginosa PA01
gaggcggauuugccgccgaggg

SEQ ID NO: 3508129 - RNA, 12 nt, Pseudomonas aeruginosa PA01
gaggcggccgag

SEQ ID NO: 3508130 - RNA, 15 nt, Pseudomonas aeruginosa PA01
gaggcggccgagggc

SEQ ID NO: 3508131 - RNA, 13 nt, Pseudomonas aeruginosa PA01
gaggcggcgguca

SEQ ID NO: 3508132 - RNA, 14 nt, Pseudomonas aeruginosa PA01
gaggcgggccagca

SEQ ID NO: 3508133 - RNA, 15 nt, Pseudomonas aeruginosa PA01
gaggcgggccagcag

SEQ ID NO: 3508134 - RNA, 17 nt, Pseudomonas aeruginosa PA01
gaggcgggccagcaggg

SEQ ID NO: 3508135 - RNA, 14 nt, Pseudomonas aeruginosa PA01
gaggcgggcuggaa

SEQ ID NO: 3508136 - RNA, 20 nt, Pseudomonas aeruginosa PA01
gaggcggugcagcggaagcc

SEQ ID NO: 3508137 - RNA, 18 nt, Pseudomonas aeruginosa PA01
gaggcgucggcgggaagg

SEQ ID NO: 3508138 - RNA, 14 nt, Pseudomonas aeruginosa PA01
gaggcguggaaggg

SEQ ID NO: 3508139 - RNA, 22 nt, Pseudomonas aeruginosa PA01
gaggcguucaugaaagccagca

SEQ ID NO: 3508140 - RNA, 21 nt, Pseudomonas aeruginosa PA01
gaggcguuccaggugguggcg

SEQ ID NO: 3508141 - RNA, 15 nt, Pseudomonas aeruginosa PA01
gaggcguuccaguuc

SEQ ID NO: 3508142 - RNA, 20 nt, Pseudomonas aeruginosa PA01
gaggcguuccaguucggccg

SEQ ID NO: 3508143 - RNA, 22 nt, Pseudomonas aeruginosa PA01
gaggcguuccaguucggccgcg

SEQ ID NO: 3508144 - RNA, 23 nt, Pseudomonas aeruginosa PA01
gaggcguucgaucuccucgcgca

SEQ ID NO: 3508145 - RNA, 16 nt, Pseudomonas aeruginosa PA01
gaggcuaacgccgagg

SEQ ID NO: 3508146 - RNA, 17 nt, Pseudomonas aeruginosa PA01
gaggcuaacgccgagga

SEQ ID NO: 3508147 - RNA, 13 nt, Pseudomonas aeruginosa PA01
gaggcucagccga

SEQ ID NO: 3508148 - RNA, 18 nt, Pseudomonas aeruginosa PA01
gaggcucagcgcgccgag

SEQ ID NO: 3508149 - RNA, 12 nt, Pseudomonas aeruginosa PA01
gaggcucgccgg

SEQ ID NO: 3508150 - RNA, 14 nt, Pseudomonas aeruginosa PA01
gaggcucggcggcc

SEQ ID NO: 3508151 - RNA, 15 nt, Pseudomonas aeruginosa PA01
gaggcugacccgcug

SEQ ID NO: 3508152 - RNA, 16 nt, Pseudomonas aeruginosa PA01
gaggcugacccgcugu

SEQ ID NO: 3508153 - RNA, 19 nt, Pseudomonas aeruginosa PA01
gaggcugccgaagccuucg

SEQ ID NO: 3508154 - RNA, 16 nt, Pseudomonas aeruginosa PA01
gaggcuggccagcaau

SEQ ID NO: 3508155 - RNA, 13 nt, Pseudomonas aeruginosa PA01
gaggcuguccagc

SEQ ID NO: 3508156 - RNA, 15 nt, Pseudomonas aeruginosa PA01
gaggcuguccagcag

SEQ ID NO: 3508157 - RNA, 17 nt, Pseudomonas aeruginosa PA01
gaggcuguccagcaggc

SEQ ID NO: 3508158 - RNA, 23 nt, Pseudomonas aeruginosa PA01
gaggcugugggucgggucggcga

SEQ ID NO: 3508159 - RNA, 14 nt, Pseudomonas aeruginosa PA01
gaggcuuuccagca

SEQ ID NO: 3508160 - RNA, 15 nt, Pseudomonas aeruginosa PA01
gagggagcgccuggc

SEQ ID NO: 3508161 - RNA, 15 nt, Pseudomonas aeruginosa PA01
gagggaggaggcgcc

SEQ ID NO: 3508162 - RNA, 16 nt, Pseudomonas aeruginosa PA01
gagggaggaggcgccg

SEQ ID NO: 3508163 - RNA, 22 nt, Pseudomonas aeruginosa PA01
gagggaggucgcacgcagcgcc

SEQ ID NO: 3508164 - RNA, 22 nt, Pseudomonas aeruginosa PA01
gagggauaccaacuuucccucu

SEQ ID NO: 3508165 - RNA, 16 nt, Pseudomonas aeruginosa PA01
gagggaucgcgcggcu

SEQ ID NO: 3508166 - RNA, 22 nt, Pseudomonas aeruginosa PA01
gagggcaaaggcgcgcagggcc

SEQ ID NO: 3508167 - RNA, 21 nt, Pseudomonas aeruginosa PA01
gagggcauguuggcgccuucg

SEQ ID NO: 3508168 - RNA, 23 nt, Pseudomonas aeruginosa PA01
gagggccacgaacugcauggccu

SEQ ID NO: 3508169 - RNA, 11 nt, Pseudomonas aeruginosa PA01
gagggccgcgc

SEQ ID NO: 3508170 - RNA, 14 nt, Pseudomonas aeruginosa PA01
gagggccgcgccga

SEQ ID NO: 3508171 - RNA, 20 nt, Pseudomonas aeruginosa PA01
gagggccggguugcgccucc

SEQ ID NO: 3508172 - RNA, 23 nt, Pseudomonas aeruginosa PA01
gagggcgaagaucucgccauggc

SEQ ID NO: 3508173 - RNA, 15 nt, Pseudomonas aeruginosa PA01
gagggcgaccgccag

SEQ ID NO: 3508174 - RNA, 17 nt, Pseudomonas aeruginosa PA01
gagggcgaccgccaggc

SEQ ID NO: 3508175 - RNA, 21 nt, Pseudomonas aeruginosa PA01
gagggcgaccgccaggcggcc

SEQ ID NO: 3508176 - RNA, 22 nt, Pseudomonas aeruginosa PA01
gagggcgaccgccaggcggccg

SEQ ID NO: 3508177 - RNA, 21 nt, Pseudomonas aeruginosa PA01
gagggcgacguugcgcagggg

SEQ ID NO: 3508178 - RNA, 22 nt, Pseudomonas aeruginosa PA01
gagggcgaugcccuuggccagc

SEQ ID NO: 3508179 - RNA, 19 nt, Pseudomonas aeruginosa PA01
gagggcgcgcaguagcugg

SEQ ID NO: 3508180 - RNA, 13 nt, Pseudomonas aeruginosa PA01
gagggcgcggcgc

SEQ ID NO: 3508181 - RNA, 14 nt, Pseudomonas aeruginosa PA01
gagggcgcggcgcc

SEQ ID NO: 3508182 - RNA, 17 nt, Pseudomonas aeruginosa PA01
gagggcgcggcgccagc

SEQ ID NO: 3508183 - RNA, 20 nt, Pseudomonas aeruginosa PA01
gagggcgcguugcccagccc

SEQ ID NO: 3508184 - RNA, 22 nt, Pseudomonas aeruginosa PA01
gagggcggcggcucaggccgcc

SEQ ID NO: 3508185 - RNA, 23 nt, Pseudomonas aeruginosa PA01
gagggcguccugcuuccagaccu

SEQ ID NO: 3508186 - RNA, 15 nt, Pseudomonas aeruginosa PA01
gagggcguccuugcc

SEQ ID NO: 3508187 - RNA, 15 nt, Pseudomonas aeruginosa PA01
gagggcugcugucca

SEQ ID NO: 3508188 - RNA, 20 nt, Pseudomonas aeruginosa PA01
gagggcugcuguccagcgcu

SEQ ID NO: 3508189 - RNA, 17 nt, Pseudomonas aeruginosa PA01
gagggcugggcagcgcc

SEQ ID NO: 3508190 - RNA, 22 nt, Pseudomonas aeruginosa PA01
gaggggaagaucuccgggucca

SEQ ID NO: 3508191 - RNA, 16 nt, Pseudomonas aeruginosa PA01
gaggggcggccgccga

SEQ ID NO: 3508192 - RNA, 21 nt, Pseudomonas aeruginosa PA01
gagggggccucggccagcgcc

SEQ ID NO: 3508193 - RNA, 22 nt, Pseudomonas aeruginosa PA01
gagggguaaggcaugcccaggc

SEQ ID NO: 3508194 - RNA, 16 nt, Pseudomonas aeruginosa PA01
gagggucagaccagcc

SEQ ID NO: 3508195 - RNA, 20 nt, Pseudomonas aeruginosa PA01
gagggucagccgcaggccgu

SEQ ID NO: 3508196 - RNA, 14 nt, Pseudomonas aeruginosa PA01
gagggucagccggc

SEQ ID NO: 3508197 - RNA, 16 nt, Pseudomonas aeruginosa PA01
gagggucagccggccg

SEQ ID NO: 3508198 - RNA, 12 nt, Pseudomonas aeruginosa PA01
gagggucagcga

SEQ ID NO: 3508199 - RNA, 20 nt, Pseudomonas aeruginosa PA01
gagggucaggccgagggcug

SEQ ID NO: 3508200 - RNA, 22 nt, Pseudomonas aeruginosa PA01
gagggucgccuugaccagcggc

SEQ ID NO: 3508201 - RNA, 23 nt, Pseudomonas aeruginosa PA01
gagggucgccuugaccagcggcc

SEQ ID NO: 3508202 - RNA, 17 nt, Pseudomonas aeruginosa PA01
gagggucugcucgacga

SEQ ID NO: 3508203 - RNA, 19 nt, Pseudomonas aeruginosa PA01
gagggugaacuggccgucg

SEQ ID NO: 3508204 - RNA, 15 nt, Pseudomonas aeruginosa PA01
gaggguggaacccau

SEQ ID NO: 3508205 - RNA, 22 nt, Pseudomonas aeruginosa PA01
gaggguggaacccauggcgcga

SEQ ID NO: 3508206 - RNA, 23 nt, Pseudomonas aeruginosa PA01
gaggguggcgcccaugccgcccg

SEQ ID NO: 3508207 - RNA, 15 nt, Pseudomonas aeruginosa PA01
gaggguggucgcgcu

SEQ ID NO: 3508208 - RNA, 19 nt, Pseudomonas aeruginosa PA01
gagggugucguagaggcug

SEQ ID NO: 3508209 - RNA, 18 nt, Pseudomonas aeruginosa PA01
gaggguguucagcggcgc

SEQ ID NO: 3508210 - RNA, 20 nt, Pseudomonas aeruginosa PA01
gaggguguugcgauggaagu

SEQ ID NO: 3508211 - RNA, 22 nt, Pseudomonas aeruginosa PA01
gaggguugcacaagccguuacg

SEQ ID NO: 3508212 - RNA, 16 nt, Pseudomonas aeruginosa PA01
gaggguugggcagcgu

SEQ ID NO: 3508213 - RNA, 16 nt, Pseudomonas aeruginosa PA01
gaggguugucaccggc

SEQ ID NO: 3508214 - RNA, 13 nt, Pseudomonas aeruginosa PA01
gagguaagugauu

SEQ ID NO: 3508215 - RNA, 20 nt, Pseudomonas aeruginosa PA01
gagguagaacaggcugccgc

SEQ ID NO: 3508216 - RNA, 16 nt, Pseudomonas aeruginosa PA01
gagguagaagcggccg

SEQ ID NO: 3508217 - RNA, 18 nt, Pseudomonas aeruginosa PA01
gagguagagcacgccguc

SEQ ID NO: 3508218 - RNA, 22 nt, Pseudomonas aeruginosa PA01
gagguagagcacgccgucgcgc

SEQ ID NO: 3508219 - RNA, 16 nt, Pseudomonas aeruginosa PA01
gagguagcugcgccgc

SEQ ID NO: 3508220 - RNA, 16 nt, Pseudomonas aeruginosa PA01
gagguaggccagcccc

SEQ ID NO: 3508221 - RNA, 15 nt, Pseudomonas aeruginosa PA01
gagguagguccaggc

SEQ ID NO: 3508222 - RNA, 18 nt, Pseudomonas aeruginosa PA01
gagguagguccaggcgac

SEQ ID NO: 3508223 - RNA, 18 nt, Pseudomonas aeruginosa PA01
gaggucaccugcaguucg

SEQ ID NO: 3508224 - RNA, 20 nt, Pseudomonas aeruginosa PA01
gaggucaguucggugccgcc

SEQ ID NO: 3508225 - RNA, 21 nt, Pseudomonas aeruginosa PA01
gagguccggcuccggcugcgu

SEQ ID NO: 3508226 - RNA, 22 nt, Pseudomonas aeruginosa PA01
gaggucgaaagcuucgucgcgc

SEQ ID NO: 3508227 - RNA, 15 nt, Pseudomonas aeruginosa PA01
gaggucgaccagcca

SEQ ID NO: 3508228 - RNA, 23 nt, Pseudomonas aeruginosa PA01
gaggucgaccagccagucggcgg

SEQ ID NO: 3508229 - RNA, 19 nt, Pseudomonas aeruginosa PA01
gaggucgcacgcagcgccg

SEQ ID NO: 3508230 - RNA, 20 nt, Pseudomonas aeruginosa PA01
gaggucgcacgcagcgccgc

SEQ ID NO: 3508231 - RNA, 22 nt, Pseudomonas aeruginosa PA01
gaggucgcagcguuccagcgcu

SEQ ID NO: 3508232 - RNA, 15 nt, Pseudomonas aeruginosa PA01
gaggucgccgccagc

SEQ ID NO: 3508233 - RNA, 22 nt, Pseudomonas aeruginosa PA01
gaggucgccgccagcuaccggc

SEQ ID NO: 3508234 - RNA, 20 nt, Pseudomonas aeruginosa PA01
gaggucgccguccuugucgc

SEQ ID NO: 3508235 - RNA, 14 nt, Pseudomonas aeruginosa PA01
gaggucgcggacga

SEQ ID NO: 3508236 - RNA, 17 nt, Pseudomonas aeruginosa PA01
gaggucgcgggccaggc

SEQ ID NO: 3508237 - RNA, 19 nt, Pseudomonas aeruginosa PA01
gaggucgcgggccaggccc

SEQ ID NO: 3508238 - RNA, 20 nt, Pseudomonas aeruginosa PA01
gaggucgcgggccaggcccu

SEQ ID NO: 3508239 - RNA, 14 nt, Pseudomonas aeruginosa PA01
gaggucggcaaagc

SEQ ID NO: 3508240 - RNA, 13 nt, Pseudomonas aeruginosa PA01
gaggucggccucg

SEQ ID NO: 3508241 - RNA, 14 nt, Pseudomonas aeruginosa PA01
gaggucggccucga

SEQ ID NO: 3508242 - RNA, 19 nt, Pseudomonas aeruginosa PA01
gaggucggcgaacagggug

SEQ ID NO: 3508243 - RNA, 18 nt, Pseudomonas aeruginosa PA01
gaggucggcgcgcccggc

SEQ ID NO: 3508244 - RNA, 14 nt, Pseudomonas aeruginosa PA01
gaggucggcgcgcg

SEQ ID NO: 3508245 - RNA, 13 nt, Pseudomonas aeruginosa PA01
gaggucggcggcg

SEQ ID NO: 3508246 - RNA, 14 nt, Pseudomonas aeruginosa PA01
gaggucggcggcgg

SEQ ID NO: 3508247 - RNA, 12 nt, Pseudomonas aeruginosa PA01
gaggucguccac

SEQ ID NO: 3508248 - RNA, 16 nt, Pseudomonas aeruginosa PA01
gaggucuuggccagcc

SEQ ID NO: 3508249 - RNA, 15 nt, Pseudomonas aeruginosa PA01
gaggugcggcgguga

SEQ ID NO: 3508250 - RNA, 16 nt, Pseudomonas aeruginosa PA01
gaggugcggcugccgg

SEQ ID NO: 3508251 - RNA, 21 nt, Pseudomonas aeruginosa PA01
gagguggccgaguggccgaag

SEQ ID NO: 3508252 - RNA, 22 nt, Pseudomonas aeruginosa PA01
gagguggcugaagccccagccc

SEQ ID NO: 3508253 - RNA, 16 nt, Pseudomonas aeruginosa PA01
gaggugguauugcagc

SEQ ID NO: 3508254 - RNA, 19 nt, Pseudomonas aeruginosa PA01
gaggugucgccgcggacgg

SEQ ID NO: 3508255 - RNA, 19 nt, Pseudomonas aeruginosa PA01
gagguuaacaguugagcug

SEQ ID NO: 3508256 - RNA, 18 nt, Pseudomonas aeruginosa PA01
gagguucgaauccuccug

SEQ ID NO: 3508257 - RNA, 23 nt, Pseudomonas aeruginosa PA01
gagguucuuccacuugcgccggc

SEQ ID NO: 3508258 - RNA, 20 nt, Pseudomonas aeruginosa PA01
gagguugcccacggccaggc

SEQ ID NO: 3508259 - RNA, 13 nt, Pseudomonas aeruginosa PA01
gagguugcgcagg

SEQ ID NO: 3508260 - RNA, 14 nt, Pseudomonas aeruginosa PA01
gagguugcgcggca

SEQ ID NO: 3508261 - RNA, 20 nt, Pseudomonas aeruginosa PA01
gagguugcgcggcaggacga

SEQ ID NO: 3508262 - RNA, 18 nt, Pseudomonas aeruginosa PA01
gagguugcuguagaaugc

SEQ ID NO: 3508263 - RNA, 16 nt, Pseudomonas aeruginosa PA01
gagguuggucugcucg

SEQ ID NO: 3508264 - RNA, 21 nt, Pseudomonas aeruginosa PA01
gagguuuccaguugcagggug

SEQ ID NO: 3508265 - RNA, 16 nt, Pseudomonas aeruginosa PA01
gaguaaaacggcaggc

SEQ ID NO: 3508266 - RNA, 17 nt, Pseudomonas aeruginosa PA01
gaguaaaugcuugaaaa

SEQ ID NO: 3508267 - RNA, 15 nt, Pseudomonas aeruginosa PA01
gaguaccaccgugcc

SEQ ID NO: 3508268 - RNA, 14 nt, Pseudomonas aeruginosa PA01
gaguaccaggccac

SEQ ID NO: 3508269 - RNA, 13 nt, Pseudomonas aeruginosa PA01
gaguagaaaagaa

SEQ ID NO: 3508270 - RNA, 17 nt, Pseudomonas aeruginosa PA01
gaguagaaaagaaaauu

SEQ ID NO: 3508271 - RNA, 16 nt, Pseudomonas aeruginosa PA01
gaguagccggcggcga

SEQ ID NO: 3508272 - RNA, 14 nt, Pseudomonas aeruginosa PA01
gaguagcuggcgca

SEQ ID NO: 3508273 - RNA, 17 nt, Pseudomonas aeruginosa PA01
gaguagcuggcgcaggg

SEQ ID NO: 3508274 - RNA, 16 nt, Pseudomonas aeruginosa PA01
gaguaggggcagaccu

SEQ ID NO: 3508275 - RNA, 22 nt, Pseudomonas aeruginosa PA01
gaguagguccaggcgucggcgc

SEQ ID NO: 3508276 - RNA, 16 nt, Pseudomonas aeruginosa PA01
gaguaguagcguuccu

SEQ ID NO: 3508277 - RNA, 20 nt, Pseudomonas aeruginosa PA01
gaguaucgcccuggccucgg

SEQ ID NO: 3508278 - RNA, 15 nt, Pseudomonas aeruginosa PA01
gagucaacgccuggc

SEQ ID NO: 3508279 - RNA, 22 nt, Pseudomonas aeruginosa PA01
gagucaccccgaccagcgcgcu

SEQ ID NO: 3508280 - RNA, 15 nt, Pseudomonas aeruginosa PA01
gagucaggcgccggc

SEQ ID NO: 3508281 - RNA, 16 nt, Pseudomonas aeruginosa PA01
gagucaggcgccggcc

SEQ ID NO: 3508282 - RNA, 17 nt, Pseudomonas aeruginosa PA01
gagucaggcgccggccu

SEQ ID NO: 3508283 - RNA, 18 nt, Pseudomonas aeruginosa PA01
gagucaggcgccggccuc

SEQ ID NO: 3508284 - RNA, 17 nt, Pseudomonas aeruginosa PA01
gaguccaggcgggccag

SEQ ID NO: 3508285 - RNA, 16 nt, Pseudomonas aeruginosa PA01
gagucccuugcggcag

SEQ ID NO: 3508286 - RNA, 17 nt, Pseudomonas aeruginosa PA01
gagucccuugcggcaga

SEQ ID NO: 3508287 - RNA, 15 nt, Pseudomonas aeruginosa PA01
gaguccuucggcgca

SEQ ID NO: 3508288 - RNA, 13 nt, Pseudomonas aeruginosa PA01
gagucgacccagg

SEQ ID NO: 3508289 - RNA, 16 nt, Pseudomonas aeruginosa PA01
gagucgacccaggccc

SEQ ID NO: 3508290 - RNA, 18 nt, Pseudomonas aeruginosa PA01
gagucgacccaggcccag

SEQ ID NO: 3508291 - RNA, 16 nt, Pseudomonas aeruginosa PA01
gagucgaucaggucgc

SEQ ID NO: 3508292 - RNA, 16 nt, Pseudomonas aeruginosa PA01
gagucgaucucggugg

SEQ ID NO: 3508293 - RNA, 16 nt, Pseudomonas aeruginosa PA01
gagucgccggcgaacu

SEQ ID NO: 3508294 - RNA, 14 nt, Pseudomonas aeruginosa PA01
gagucgccgguuca

SEQ ID NO: 3508295 - RNA, 14 nt, Pseudomonas aeruginosa PA01
gagucgcucgcgca

SEQ ID NO: 3508296 - RNA, 13 nt, Pseudomonas aeruginosa PA01
gagucgcuggcca

SEQ ID NO: 3508297 - RNA, 15 nt, Pseudomonas aeruginosa PA01
gagucguagcgcaug

SEQ ID NO: 3508298 - RNA, 14 nt, Pseudomonas aeruginosa PA01
gagucguagcgcgc

SEQ ID NO: 3508299 - RNA, 19 nt, Pseudomonas aeruginosa PA01
gagugcagcgagucgccgu

SEQ ID NO: 3508300 - RNA, 15 nt, Pseudomonas aeruginosa PA01
gagugcccaggcgcu

SEQ ID NO: 3508301 - RNA, 18 nt, Pseudomonas aeruginosa PA01
gagugcccaggcgcuggc

SEQ ID NO: 3508302 - RNA, 21 nt, Pseudomonas aeruginosa PA01
gagugcccaggcgcuggcgcc

SEQ ID NO: 3508303 - RNA, 14 nt, Pseudomonas aeruginosa PA01
gagugcgcagcagc

SEQ ID NO: 3508304 - RNA, 15 nt, Pseudomonas aeruginosa PA01
gagugcgcagcagcg

SEQ ID NO: 3508305 - RNA, 16 nt, Pseudomonas aeruginosa PA01
gagugcgcagcagcgu

SEQ ID NO: 3508306 - RNA, 17 nt, Pseudomonas aeruginosa PA01
gagugcgcccagcagca

SEQ ID NO: 3508307 - RNA, 20 nt, Pseudomonas aeruginosa PA01
gagugcgcccagcagcaggc

SEQ ID NO: 3508308 - RNA, 16 nt, Pseudomonas aeruginosa PA01
gagugcuucugggugu

SEQ ID NO: 3508309 - RNA, 14 nt, Pseudomonas aeruginosa PA01
gaguggaggaucuc

SEQ ID NO: 3508310 - RNA, 13 nt, Pseudomonas aeruginosa PA01
gaguggaugucgu

SEQ ID NO: 3508311 - RNA, 21 nt, Pseudomonas aeruginosa PA01
gaguggccgcgccccacggcg

SEQ ID NO: 3508312 - RNA, 12 nt, Pseudomonas aeruginosa PA01
gaguggccgcug

SEQ ID NO: 3508313 - RNA, 13 nt, Pseudomonas aeruginosa PA01
gaguggccgcuga

SEQ ID NO: 3508314 - RNA, 15 nt, Pseudomonas aeruginosa PA01
gaguggcgcagcgcc

SEQ ID NO: 3508315 - RNA, 16 nt, Pseudomonas aeruginosa PA01
gaguggcgcggcugau

SEQ ID NO: 3508316 - RNA, 20 nt, Pseudomonas aeruginosa PA01
gaguggcgcggcugaucggc

SEQ ID NO: 3508317 - RNA, 18 nt, Pseudomonas aeruginosa PA01
gagugucgccaucaguga

SEQ ID NO: 3508318 - RNA, 18 nt, Pseudomonas aeruginosa PA01
gagugugccggccaugca

SEQ ID NO: 3508319 - RNA, 17 nt, Pseudomonas aeruginosa PA01
gaguucccagaccuggc

SEQ ID NO: 3508320 - RNA, 18 nt, Pseudomonas aeruginosa PA01
gaguucccagaccuggcc

SEQ ID NO: 3508321 - RNA, 20 nt, Pseudomonas aeruginosa PA01
gaguucccagaccuggccgc

SEQ ID NO: 3508322 - RNA, 23 nt, Pseudomonas aeruginosa PA01
gaguucccagaccuggccgcugu

SEQ ID NO: 3508323 - RNA, 16 nt, Pseudomonas aeruginosa PA01
gaguucgcccagcucg

SEQ ID NO: 3508324 - RNA, 21 nt, Pseudomonas aeruginosa PA01
gaguucgccgcgagcaccaug

SEQ ID NO: 3508325 - RNA, 13 nt, Pseudomonas aeruginosa PA01
gaguucgccggcc

SEQ ID NO: 3508326 - RNA, 22 nt, Pseudomonas aeruginosa PA01
gaguucgcgcaggcgcuggcgg

SEQ ID NO: 3508327 - RNA, 21 nt, Pseudomonas aeruginosa PA01
gaguucgcgcaggcgguugga

SEQ ID NO: 3508328 - RNA, 21 nt, Pseudomonas aeruginosa PA01
gaguucgcugaaggucgccgc

SEQ ID NO: 3508329 - RNA, 14 nt, Pseudomonas aeruginosa PA01
gaguucgcugagga

SEQ ID NO: 3508330 - RNA, 18 nt, Pseudomonas aeruginosa PA01
gaguucgcugaggacugc

SEQ ID NO: 3508331 - RNA, 15 nt, Pseudomonas aeruginosa PA01
gaguucgcugcgcgc

SEQ ID NO: 3508332 - RNA, 13 nt, Pseudomonas aeruginosa PA01
gaguucggcugcg

SEQ ID NO: 3508333 - RNA, 16 nt, Pseudomonas aeruginosa PA01
gaguucgucaaccagc

SEQ ID NO: 3508334 - RNA, 18 nt, Pseudomonas aeruginosa PA01
gaguucgucaaccagcac

SEQ ID NO: 3508335 - RNA, 20 nt, Pseudomonas aeruginosa PA01
gaguucgucgagcaugacga

SEQ ID NO: 3508336 - RNA, 16 nt, Pseudomonas aeruginosa PA01
gaguugaccagcaugu

SEQ ID NO: 3508337 - RNA, 19 nt, Pseudomonas aeruginosa PA01
gaguugaucggcguggcgg

SEQ ID NO: 3508338 - RNA, 13 nt, Pseudomonas aeruginosa PA01
gaguugcaggccg

SEQ ID NO: 3508339 - RNA, 22 nt, Pseudomonas aeruginosa PA01
gaguugccagacgaucagcggc

SEQ ID NO: 3508340 - RNA, 16 nt, Pseudomonas aeruginosa PA01
gaguugcuuggcgcgc

SEQ ID NO: 3508341 - RNA, 17 nt, Pseudomonas aeruginosa PA01
gaguugcuuggcgcgcu

SEQ ID NO: 3508342 - RNA, 20 nt, Pseudomonas aeruginosa PA01
gaguugcuuggcgcgcuggc

SEQ ID NO: 3508343 - RNA, 19 nt, Pseudomonas aeruginosa PA01
gaguuuagccgccagugca

SEQ ID NO: 3508344 - RNA, 17 nt, Pseudomonas aeruginosa PA01
gaguuugcccagcgccg

SEQ ID NO: 3508345 - RNA, 18 nt, Pseudomonas aeruginosa PA01
gaguuugcccagcgccgc

SEQ ID NO: 3508346 - RNA, 21 nt, Pseudomonas aeruginosa PA01
gaguuugcccagcgccgccug

SEQ ID NO: 3508347 - RNA, 20 nt, Pseudomonas aeruginosa PA01
gaguuugccgaacugcaggg

SEQ ID NO: 3508348 - RNA, 22 nt, Pseudomonas aeruginosa PA01
gauaaagcuggaccaccguggc

SEQ ID NO: 3508349 - RNA, 15 nt, Pseudomonas aeruginosa PA01
gauaacgccgauggc

SEQ ID NO: 3508350 - RNA, 15 nt, Pseudomonas aeruginosa PA01
gauaacgccgguggc

SEQ ID NO: 3508351 - RNA, 14 nt, Pseudomonas aeruginosa PA01
gauaacggcagccg

SEQ ID NO: 3508352 - RNA, 17 nt, Pseudomonas aeruginosa PA01
gauaacggcagccgcgu

SEQ ID NO: 3508353 - RNA, 22 nt, Pseudomonas aeruginosa PA01
gauaagcucggcuugacuggca

SEQ ID NO: 3508354 - RNA, 14 nt, Pseudomonas aeruginosa PA01
gauaaggcaaagcg

SEQ ID NO: 3508355 - RNA, 22 nt, Pseudomonas aeruginosa PA01
gauacaccgcauccucguucca

SEQ ID NO: 3508356 - RNA, 17 nt, Pseudomonas aeruginosa PA01
gauacaggcgcagcagc

SEQ ID NO: 3508357 - RNA, 18 nt, Pseudomonas aeruginosa PA01
gauacaggcgcagcagca

SEQ ID NO: 3508358 - RNA, 16 nt, Pseudomonas aeruginosa PA01
gauaccacccgcagcc

SEQ ID NO: 3508359 - RNA, 13 nt, Pseudomonas aeruginosa PA01
gauaccagcgccg

SEQ ID NO: 3508360 - RNA, 15 nt, Pseudomonas aeruginosa PA01
gauaccagcgccgcu

SEQ ID NO: 3508361 - RNA, 22 nt, Pseudomonas aeruginosa PA01
gauaccagcgccgcuccuccuc

SEQ ID NO: 3508362 - RNA, 18 nt, Pseudomonas aeruginosa PA01
gauacccaccggcucgcu

SEQ ID NO: 3508363 - RNA, 16 nt, Pseudomonas aeruginosa PA01
gauacccuucaucccu

SEQ ID NO: 3508364 - RNA, 15 nt, Pseudomonas aeruginosa PA01
gauaccgccggcggc

SEQ ID NO: 3508365 - RNA, 16 nt, Pseudomonas aeruginosa PA01
gauaccgcuggccagg

SEQ ID NO: 3508366 - RNA, 20 nt, Pseudomonas aeruginosa PA01
gauaccggccaucagcacca

SEQ ID NO: 3508367 - RNA, 21 nt, Pseudomonas aeruginosa PA01
gauaccggccaucagcaccag

SEQ ID NO: 3508368 - RNA, 21 nt, Pseudomonas aeruginosa PA01
gauaccucguuucccggcgcg

SEQ ID NO: 3508369 - RNA, 21 nt, Pseudomonas aeruginosa PA01
gauacgaaaaagccccugcgc

SEQ ID NO: 3508370 - RNA, 15 nt, Pseudomonas aeruginosa PA01
gauacgcacgcuggu

SEQ ID NO: 3508371 - RNA, 22 nt, Pseudomonas aeruginosa PA01
gauacgcaggaacuggucgauc

SEQ ID NO: 3508372 - RNA, 22 nt, Pseudomonas aeruginosa PA01
gauacgcuccggugccagggcg

SEQ ID NO: 3508373 - RNA, 17 nt, Pseudomonas aeruginosa PA01
gauacgucuucgauggc

SEQ ID NO: 3508374 - RNA, 21 nt, Pseudomonas aeruginosa PA01
gauacgucuucgauggcggcc

SEQ ID NO: 3508375 - RNA, 15 nt, Pseudomonas aeruginosa PA01
gauacuccagcagcg

SEQ ID NO: 3508376 - RNA, 13 nt, Pseudomonas aeruginosa PA01
gauacuccuucaa

SEQ ID NO: 3508377 - RNA, 20 nt, Pseudomonas aeruginosa PA01
gauagaccaggaaggccggg

SEQ ID NO: 3508378 - RNA, 16 nt, Pseudomonas aeruginosa PA01
gauagagcacgcccau

SEQ ID NO: 3508379 - RNA, 13 nt, Pseudomonas aeruginosa PA01
gauagagcuucuc

SEQ ID NO: 3508380 - RNA, 22 nt, Pseudomonas aeruginosa PA01
gauagagcuucucgucgccgcc

SEQ ID NO: 3508381 - RNA, 11 nt, Pseudomonas aeruginosa PA01
gauagaggaau

SEQ ID NO: 3508382 - RNA, 13 nt, Pseudomonas aeruginosa PA01
gauagaucaggcc

SEQ ID NO: 3508383 - RNA, 15 nt, Pseudomonas aeruginosa PA01
gauagccaaccagau

SEQ ID NO: 3508384 - RNA, 16 nt, Pseudomonas aeruginosa PA01
gauagccgaccaggcc

SEQ ID NO: 3508385 - RNA, 13 nt, Pseudomonas aeruginosa PA01
gauagccgcaagc

SEQ ID NO: 3508386 - RNA, 20 nt, Pseudomonas aeruginosa PA01
gauagccggcgcguucacuc

SEQ ID NO: 3508387 - RNA, 17 nt, Pseudomonas aeruginosa PA01
gauagccgugcagcagc

SEQ ID NO: 3508388 - RNA, 14 nt, Pseudomonas aeruginosa PA01
gauagccuccuccg

SEQ ID NO: 3508389 - RNA, 20 nt, Pseudomonas aeruginosa PA01
gauagcgauaggccuugccu

SEQ ID NO: 3508390 - RNA, 23 nt, Pseudomonas aeruginosa PA01
gauagcgauaggccuugccuucg

SEQ ID NO: 3508391 - RNA, 21 nt, Pseudomonas aeruginosa PA01
gauagcgcgcaggcgcuaucc

SEQ ID NO: 3508392 - RNA, 15 nt, Pseudomonas aeruginosa PA01
gauagcggcgcgagg

SEQ ID NO: 3508393 - RNA, 19 nt, Pseudomonas aeruginosa PA01
gauagcguccaggugcggc

SEQ ID NO: 3508394 - RNA, 23 nt, Pseudomonas aeruginosa PA01
gauaggcggcggauaaccgcgag

SEQ ID NO: 3508395 - RNA, 19 nt, Pseudomonas aeruginosa PA01
gauagggaaacacgucgau

SEQ ID NO: 3508396 - RNA, 16 nt, Pseudomonas aeruginosa PA01
gauagggcaucagccc

SEQ ID NO: 3508397 - RNA, 21 nt, Pseudomonas aeruginosa PA01
gauagggcaucagccccucgg

SEQ ID NO: 3508398 - RNA, 21 nt, Pseudomonas aeruginosa PA01
gauagucguucuuccugagca

SEQ ID NO: 3508399 - RNA, 15 nt, Pseudomonas aeruginosa PA01
gauagugcggccagg

SEQ ID NO: 3508400 - RNA, 17 nt, Pseudomonas aeruginosa PA01
gauagugcggccaggcg

SEQ ID NO: 3508401 - RNA, 16 nt, Pseudomonas aeruginosa PA01
gauaucacgccccucc

SEQ ID NO: 3508402 - RNA, 19 nt, Pseudomonas aeruginosa PA01
gauauccagggccaggaug

SEQ ID NO: 3508403 - RNA, 20 nt, Pseudomonas aeruginosa PA01
gauaucccgccgccgcgccu

SEQ ID NO: 3508404 - RNA, 21 nt, Pseudomonas aeruginosa PA01
gauaucccgccgccgcgccuu

SEQ ID NO: 3508405 - RNA, 13 nt, Pseudomonas aeruginosa PA01
gauauccgccagg

SEQ ID NO: 3508406 - RNA, 15 nt, Pseudomonas aeruginosa PA01
gauauccgccaggcg

SEQ ID NO: 3508407 - RNA, 17 nt, Pseudomonas aeruginosa PA01
gauauccgccagggagc

SEQ ID NO: 3508408 - RNA, 22 nt, Pseudomonas aeruginosa PA01
gauauccgggcccaggcuggcg

SEQ ID NO: 3508409 - RNA, 18 nt, Pseudomonas aeruginosa PA01
gauaucgcaggccaggcc

SEQ ID NO: 3508410 - RNA, 16 nt, Pseudomonas aeruginosa PA01
gauaucgcccagggcc

SEQ ID NO: 3508411 - RNA, 19 nt, Pseudomonas aeruginosa PA01
gauaucgcccagggccagc

SEQ ID NO: 3508412 - RNA, 13 nt, Pseudomonas aeruginosa PA01
gauaucggcgccg

SEQ ID NO: 3508413 - RNA, 14 nt, Pseudomonas aeruginosa PA01
gauaucggcgccgg

SEQ ID NO: 3508414 - RNA, 15 nt, Pseudomonas aeruginosa PA01
gauaucggcgccggc

SEQ ID NO: 3508415 - RNA, 16 nt, Pseudomonas aeruginosa PA01
gauaucggcgccggcc

SEQ ID NO: 3508416 - RNA, 14 nt, Pseudomonas aeruginosa PA01
gauaucugggccau

SEQ ID NO: 3508417 - RNA, 16 nt, Pseudomonas aeruginosa PA01
gauaucugggccaucg

SEQ ID NO: 3508418 - RNA, 22 nt, Pseudomonas aeruginosa PA01
gauauggaccggcucgucggcg

SEQ ID NO: 3508419 - RNA, 22 nt, Pseudomonas aeruginosa PA01
gauauggccgaucaccuggcca

SEQ ID NO: 3508420 - RNA, 15 nt, Pseudomonas aeruginosa PA01
gauauggcuggcgca

SEQ ID NO: 3508421 - RNA, 12 nt, Pseudomonas aeruginosa PA01
gauauugaacac

SEQ ID NO: 3508422 - RNA, 17 nt, Pseudomonas aeruginosa PA01
gaucaacgcggccagca

SEQ ID NO: 3508423 - RNA, 19 nt, Pseudomonas aeruginosa PA01
gaucaacgcggccagcagc

SEQ ID NO: 3508424 - RNA, 20 nt, Pseudomonas aeruginosa PA01
gaucaacgcggccagcagca

SEQ ID NO: 3508425 - RNA, 18 nt, Pseudomonas aeruginosa PA01
gaucaacuccgccaggcg

SEQ ID NO: 3508426 - RNA, 19 nt, Pseudomonas aeruginosa PA01
gaucaacuggucgcagccg

SEQ ID NO: 3508427 - RNA, 21 nt, Pseudomonas aeruginosa PA01
gaucaacuggucgcagccgcg

SEQ ID NO: 3508428 - RNA, 22 nt, Pseudomonas aeruginosa PA01
gaucacaccgaagucgcccgcc

SEQ ID NO: 3508429 - RNA, 17 nt, Pseudomonas aeruginosa PA01
gaucacaucgcccggca

SEQ ID NO: 3508430 - RNA, 14 nt, Pseudomonas aeruginosa PA01
gaucaccaccaccg

SEQ ID NO: 3508431 - RNA, 15 nt, Pseudomonas aeruginosa PA01
gaucaccaccaccgu

SEQ ID NO: 3508432 - RNA, 14 nt, Pseudomonas aeruginosa PA01
gaucaccaccacgc

SEQ ID NO: 3508433 - RNA, 13 nt, Pseudomonas aeruginosa PA01
gaucaccaccagc

SEQ ID NO: 3508434 - RNA, 19 nt, Pseudomonas aeruginosa PA01
gaucaccaccagcaucagc

SEQ ID NO: 3508435 - RNA, 17 nt, Pseudomonas aeruginosa PA01
gaucaccaccagcgccg

SEQ ID NO: 3508436 - RNA, 21 nt, Pseudomonas aeruginosa PA01
gaucaccaccagcgccgccac

SEQ ID NO: 3508437 - RNA, 13 nt, Pseudomonas aeruginosa PA01
gaucaccaccugg

SEQ ID NO: 3508438 - RNA, 12 nt, Pseudomonas aeruginosa PA01
gaucaccagcaa

SEQ ID NO: 3508439 - RNA, 22 nt, Pseudomonas aeruginosa PA01
gaucaccagcaauugccggcgu

SEQ ID NO: 3508440 - RNA, 16 nt, Pseudomonas aeruginosa PA01
gaucaccagccacugc

SEQ ID NO: 3508441 - RNA, 14 nt, Pseudomonas aeruginosa PA01
gaucaccagcgcca

SEQ ID NO: 3508442 - RNA, 17 nt, Pseudomonas aeruginosa PA01
gaucaccagcgccaggc

SEQ ID NO: 3508443 - RNA, 23 nt, Pseudomonas aeruginosa PA01
gaucaccagcgccaggccgccga

SEQ ID NO: 3508444 - RNA, 12 nt, Pseudomonas aeruginosa PA01
gaucaccaggac

SEQ ID NO: 3508445 - RNA, 18 nt, Pseudomonas aeruginosa PA01
gaucacccccagcgagcc

SEQ ID NO: 3508446 - RNA, 22 nt, Pseudomonas aeruginosa PA01
gaucacccccagcgagccgagc

SEQ ID NO: 3508447 - RNA, 23 nt, Pseudomonas aeruginosa PA01
gaucacccccagcgagccgagca

SEQ ID NO: 3508448 - RNA, 15 nt, Pseudomonas aeruginosa PA01
gaucacccgcccgcc

SEQ ID NO: 3508449 - RNA, 16 nt, Pseudomonas aeruginosa PA01
gaucacccgcccgccg

SEQ ID NO: 3508450 - RNA, 20 nt, Pseudomonas aeruginosa PA01
gaucacccgcccgccgucgc

SEQ ID NO: 3508451 - RNA, 18 nt, Pseudomonas aeruginosa PA01
gaucacccgcgaggccgg

SEQ ID NO: 3508452 - RNA, 20 nt, Pseudomonas aeruginosa PA01
gaucacccgcgaggccggcc

SEQ ID NO: 3508453 - RNA, 22 nt, Pseudomonas aeruginosa PA01
gaucaccgcguccauccccgcc

SEQ ID NO: 3508454 - RNA, 14 nt, Pseudomonas aeruginosa PA01
gaucaccggaaccg

SEQ ID NO: 3508455 - RNA, 15 nt, Pseudomonas aeruginosa PA01
gaucaccggcuggcc

SEQ ID NO: 3508456 - RNA, 16 nt, Pseudomonas aeruginosa PA01
gaucaccggcuggccc

SEQ ID NO: 3508457 - RNA, 21 nt, Pseudomonas aeruginosa PA01
gaucaccggcuggcccuccau

SEQ ID NO: 3508458 - RNA, 14 nt, Pseudomonas aeruginosa PA01
gaucaccuggccau

SEQ ID NO: 3508459 - RNA, 17 nt, Pseudomonas aeruginosa PA01
gaucaccuggccgguga

SEQ ID NO: 3508460 - RNA, 16 nt, Pseudomonas aeruginosa PA01
gaucaccuggccgugc

SEQ ID NO: 3508461 - RNA, 17 nt, Pseudomonas aeruginosa PA01
gaucaccuggccgugcu

SEQ ID NO: 3508462 - RNA, 20 nt, Pseudomonas aeruginosa PA01
gaucaccuggccgugcucga

SEQ ID NO: 3508463 - RNA, 21 nt, Pseudomonas aeruginosa PA01
gaucaccuuaguuaucacaac

SEQ ID NO: 3508464 - RNA, 22 nt, Pseudomonas aeruginosa PA01
gaucaccuucaccggcacgccc

SEQ ID NO: 3508465 - RNA, 23 nt, Pseudomonas aeruginosa PA01
gaucaccuucucguagcgcucgu

SEQ ID NO: 3508466 - RNA, 20 nt, Pseudomonas aeruginosa PA01
gaucacgaacagcuugccgu

SEQ ID NO: 3508467 - RNA, 17 nt, Pseudomonas aeruginosa PA01
gaucacgaagcggucgc

SEQ ID NO: 3508468 - RNA, 19 nt, Pseudomonas aeruginosa PA01
gaucacgaagcggucgccg

SEQ ID NO: 3508469 - RNA, 20 nt, Pseudomonas aeruginosa PA01
gaucacgaagcggucgccgg

SEQ ID NO: 3508470 - RNA, 19 nt, Pseudomonas aeruginosa PA01
gaucacgaucggcaccauc

SEQ ID NO: 3508471 - RNA, 22 nt, Pseudomonas aeruginosa PA01
gaucacgaucggcaccaucacc

SEQ ID NO: 3508472 - RNA, 14 nt, Pseudomonas aeruginosa PA01
gaucacgauggccg

SEQ ID NO: 3508473 - RNA, 17 nt, Pseudomonas aeruginosa PA01
gaucacgauggccggca

SEQ ID NO: 3508474 - RNA, 22 nt, Pseudomonas aeruginosa PA01
gaucacgauggccggcagcagc

SEQ ID NO: 3508475 - RNA, 23 nt, Pseudomonas aeruginosa PA01
gaucacgcaagugcccugggcga

SEQ ID NO: 3508476 - RNA, 14 nt, Pseudomonas aeruginosa PA01
gaucacgcagcagg

SEQ ID NO: 3508477 - RNA, 15 nt, Pseudomonas aeruginosa PA01
gaucacgcagcaggc

SEQ ID NO: 3508478 - RNA, 16 nt, Pseudomonas aeruginosa PA01
gaucacgucggcgucc

SEQ ID NO: 3508479 - RNA, 20 nt, Pseudomonas aeruginosa PA01
gaucacgucguacucggcgg

SEQ ID NO: 3508480 - RNA, 14 nt, Pseudomonas aeruginosa PA01
gaucacucccugcu

SEQ ID NO: 3508481 - RNA, 17 nt, Pseudomonas aeruginosa PA01
gaucacucccugcucgc

SEQ ID NO: 3508482 - RNA, 13 nt, Pseudomonas aeruginosa PA01
gaucacucgccgc

SEQ ID NO: 3508483 - RNA, 18 nt, Pseudomonas aeruginosa PA01
gaucacucgccgccgucc

SEQ ID NO: 3508484 - RNA, 19 nt, Pseudomonas aeruginosa PA01
gaucagcaccgccaccagc

SEQ ID NO: 3508485 - RNA, 11 nt, Pseudomonas aeruginosa PA01
gaucagcagca

SEQ ID NO: 3508486 - RNA, 14 nt, Pseudomonas aeruginosa PA01
gaucagcagcaccg

SEQ ID NO: 3508487 - RNA, 17 nt, Pseudomonas aeruginosa PA01
gaucagcagcagcgcca

SEQ ID NO: 3508488 - RNA, 19 nt, Pseudomonas aeruginosa PA01
gaucagcagcagcgccaug

SEQ ID NO: 3508489 - RNA, 21 nt, Pseudomonas aeruginosa PA01
gaucagcagcagcgccaugcu

SEQ ID NO: 3508490 - RNA, 15 nt, Pseudomonas aeruginosa PA01
gaucagcagcgccac

SEQ ID NO: 3508491 - RNA, 18 nt, Pseudomonas aeruginosa PA01
gaucagcauggggcggca

SEQ ID NO: 3508492 - RNA, 13 nt, Pseudomonas aeruginosa PA01
gaucagccacggg

SEQ ID NO: 3508493 - RNA, 13 nt, Pseudomonas aeruginosa PA01
gaucagccagggc

SEQ ID NO: 3508494 - RNA, 20 nt, Pseudomonas aeruginosa PA01
gaucagccagggcaacgcca

SEQ ID NO: 3508495 - RNA, 22 nt, Pseudomonas aeruginosa PA01
gaucagccauuggccgacgccg

SEQ ID NO: 3508496 - RNA, 21 nt, Pseudomonas aeruginosa PA01
gaucagcccgccaacguccuc

SEQ ID NO: 3508497 - RNA, 14 nt, Pseudomonas aeruginosa PA01
gaucagcccgccgg

SEQ ID NO: 3508498 - RNA, 16 nt, Pseudomonas aeruginosa PA01
gaucagcccgccggcg

SEQ ID NO: 3508499 - RNA, 17 nt, Pseudomonas aeruginosa PA01
gaucagcccgccggcga

SEQ ID NO: 3508500 - RNA, 19 nt, Pseudomonas aeruginosa PA01
gaucagcccgcugaccggg

SEQ ID NO: 3508501 - RNA, 17 nt, Pseudomonas aeruginosa PA01
gaucagcccuucgcgcu

SEQ ID NO: 3508502 - RNA, 18 nt, Pseudomonas aeruginosa PA01
gaucagcccuucgcgcuc

SEQ ID NO: 3508503 - RNA, 19 nt, Pseudomonas aeruginosa PA01
gaucagcccuucgcgcucg

SEQ ID NO: 3508504 - RNA, 13 nt, Pseudomonas aeruginosa PA01
gaucagccgcagg

SEQ ID NO: 3508505 - RNA, 17 nt, Pseudomonas aeruginosa PA01
gaucagccgcaggcaga

SEQ ID NO: 3508506 - RNA, 14 nt, Pseudomonas aeruginosa PA01
gaucagccgcucca

SEQ ID NO: 3508507 - RNA, 16 nt, Pseudomonas aeruginosa PA01
gaucagccgcuccagg

SEQ ID NO: 3508508 - RNA, 21 nt, Pseudomonas aeruginosa PA01
gaucagccgcuccaggaucgc

SEQ ID NO: 3508509 - RNA, 22 nt, Pseudomonas aeruginosa PA01
gaucagccggcccauccgccgc

SEQ ID NO: 3508510 - RNA, 22 nt, Pseudomonas aeruginosa PA01
gaucagcgagagcuguccggcg

SEQ ID NO: 3508511 - RNA, 20 nt, Pseudomonas aeruginosa PA01
gaucagcgagcuucgccgcg

SEQ ID NO: 3508512 - RNA, 19 nt, Pseudomonas aeruginosa PA01
gaucagcgccucggcgcag

SEQ ID NO: 3508513 - RNA, 20 nt, Pseudomonas aeruginosa PA01
gaucagcgcgccuucgacgc

SEQ ID NO: 3508514 - RNA, 16 nt, Pseudomonas aeruginosa PA01
gaucagcgcgcggacc

SEQ ID NO: 3508515 - RNA, 23 nt, Pseudomonas aeruginosa PA01
gaucagcgcgcguuccaggucgc

SEQ ID NO: 3508516 - RNA, 13 nt, Pseudomonas aeruginosa PA01
gaucagcgcggcc

SEQ ID NO: 3508517 - RNA, 23 nt, Pseudomonas aeruginosa PA01
gaucagcgcggugagcaggguga

SEQ ID NO: 3508518 - RNA, 16 nt, Pseudomonas aeruginosa PA01
gaucagcggcccgagc

SEQ ID NO: 3508519 - RNA, 17 nt, Pseudomonas aeruginosa PA01
gaucagcggcccgagca

SEQ ID NO: 3508520 - RNA, 16 nt, Pseudomonas aeruginosa PA01
gaucagcggcggggcc

SEQ ID NO: 3508521 - RNA, 22 nt, Pseudomonas aeruginosa PA01
gaucagcggcggucccaucagc

SEQ ID NO: 3508522 - RNA, 17 nt, Pseudomonas aeruginosa PA01
gaucagcuccgccucga

SEQ ID NO: 3508523 - RNA, 22 nt, Pseudomonas aeruginosa PA01
gaucagcuccgccucgaucuuc

SEQ ID NO: 3508524 - RNA, 18 nt, Pseudomonas aeruginosa PA01
gaucagcucgaucagccc

SEQ ID NO: 3508525 - RNA, 23 nt, Pseudomonas aeruginosa PA01
gaucagcucgcgguaggccagcu

SEQ ID NO: 3508526 - RNA, 19 nt, Pseudomonas aeruginosa PA01
gaucagcucguugcccggc

SEQ ID NO: 3508527 - RNA, 22 nt, Pseudomonas aeruginosa PA01
gaucagcucguugcccggcuug

SEQ ID NO: 3508528 - RNA, 20 nt, Pseudomonas aeruginosa PA01
gaucagcuucagcuccgagc

SEQ ID NO: 3508529 - RNA, 15 nt, Pseudomonas aeruginosa PA01
gaucagcuuggccuu

SEQ ID NO: 3508530 - RNA, 23 nt, Pseudomonas aeruginosa PA01
gaucagcuuguggucguggcgga

SEQ ID NO: 3508531 - RNA, 19 nt, Pseudomonas aeruginosa PA01
gaucaggaggaucgccagg

SEQ ID NO: 3508532 - RNA, 21 nt, Pseudomonas aeruginosa PA01
gaucaggcccauuucguagcc

SEQ ID NO: 3508533 - RNA, 12 nt, Pseudomonas aeruginosa PA01
gaucaggccgag

SEQ ID NO: 3508534 - RNA, 13 nt, Pseudomonas aeruginosa PA01
gaucaggccgagc

SEQ ID NO: 3508535 - RNA, 14 nt, Pseudomonas aeruginosa PA01
gaucaggccgagca

SEQ ID NO: 3508536 - RNA, 17 nt, Pseudomonas aeruginosa PA01
gaucaggccgagcaccg

SEQ ID NO: 3508537 - RNA, 20 nt, Pseudomonas aeruginosa PA01
gaucaggccgaggaugcucg

SEQ ID NO: 3508538 - RNA, 14 nt, Pseudomonas aeruginosa PA01
gaucaggccgaugc

SEQ ID NO: 3508539 - RNA, 21 nt, Pseudomonas aeruginosa PA01
gaucaggccgaugcgcaacgg

SEQ ID NO: 3508540 - RNA, 17 nt, Pseudomonas aeruginosa PA01
gaucaggccggcgucga

SEQ ID NO: 3508541 - RNA, 23 nt, Pseudomonas aeruginosa PA01
gaucaggcgcaugcccagggcca

SEQ ID NO: 3508542 - RNA, 18 nt, Pseudomonas aeruginosa PA01
gaucaggcgggcgucguc

SEQ ID NO: 3508543 - RNA, 20 nt, Pseudomonas aeruginosa PA01
gaucaggcgggcgucgucgg

SEQ ID NO: 3508544 - RNA, 20 nt, Pseudomonas aeruginosa PA01
gaucaggcgggcuccgccgc

SEQ ID NO: 3508545 - RNA, 19 nt, Pseudomonas aeruginosa PA01
gaucaggcugaagcggccg

SEQ ID NO: 3508546 - RNA, 16 nt, Pseudomonas aeruginosa PA01
gaucaggcugggguug

SEQ ID NO: 3508547 - RNA, 23 nt, Pseudomonas aeruginosa PA01
gaucaggcugggguugcggcgcc

SEQ ID NO: 3508548 - RNA, 16 nt, Pseudomonas aeruginosa PA01
gaucagggcaccgccg

SEQ ID NO: 3508549 - RNA, 19 nt, Pseudomonas aeruginosa PA01
gaucagggcaccgccgagg

SEQ ID NO: 3508550 - RNA, 19 nt, Pseudomonas aeruginosa PA01
gaucagguaggcgccgugc

SEQ ID NO: 3508551 - RNA, 20 nt, Pseudomonas aeruginosa PA01
gaucagguaggcgccgugcu

SEQ ID NO: 3508552 - RNA, 20 nt, Pseudomonas aeruginosa PA01
gaucagguagucgcccggcu

SEQ ID NO: 3508553 - RNA, 20 nt, Pseudomonas aeruginosa PA01
gaucagguccuggccgaagu

SEQ ID NO: 3508554 - RNA, 16 nt, Pseudomonas aeruginosa PA01
gaucaggucgccagcg

SEQ ID NO: 3508555 - RNA, 13 nt, Pseudomonas aeruginosa PA01
gaucaggucgccg

SEQ ID NO: 3508556 - RNA, 15 nt, Pseudomonas aeruginosa PA01
gaucaggucgccgcc

SEQ ID NO: 3508557 - RNA, 22 nt, Pseudomonas aeruginosa PA01
gaucaggucgccgccgccggga

SEQ ID NO: 3508558 - RNA, 17 nt, Pseudomonas aeruginosa PA01
gaucaggucgcgcgccu

SEQ ID NO: 3508559 - RNA, 18 nt, Pseudomonas aeruginosa PA01
gaucaggucgcgcgccuu

SEQ ID NO: 3508560 - RNA, 15 nt, Pseudomonas aeruginosa PA01
gaucagguucggcag

SEQ ID NO: 3508561 - RNA, 20 nt, Pseudomonas aeruginosa PA01
gaucagguucggcagcgccu

SEQ ID NO: 3508562 - RNA, 17 nt, Pseudomonas aeruginosa PA01
gaucagguugccggcgu

SEQ ID NO: 3508563 - RNA, 19 nt, Pseudomonas aeruginosa PA01
gaucaguaccggcagcgcc

SEQ ID NO: 3508564 - RNA, 21 nt, Pseudomonas aeruginosa PA01
gaucaguaccggcagcgccga

SEQ ID NO: 3508565 - RNA, 15 nt, Pseudomonas aeruginosa PA01
gaucagucaggaucg

SEQ ID NO: 3508566 - RNA, 19 nt, Pseudomonas aeruginosa PA01
gaucagugcaucggccgcc

SEQ ID NO: 3508567 - RNA, 24 nt, Pseudomonas aeruginosa PA01
gaucagugcaucggccgccaggcu

SEQ ID NO: 3508568 - RNA, 13 nt, Pseudomonas aeruginosa PA01
gaucaguggucgc

SEQ ID NO: 3508569 - RNA, 20 nt, Pseudomonas aeruginosa PA01
gaucaguggucgcagcucca

SEQ ID NO: 3508570 - RNA, 17 nt, Pseudomonas aeruginosa PA01
gaucaguucgugccagg

SEQ ID NO: 3508571 - RNA, 15 nt, Pseudomonas aeruginosa PA01
gaucaucagcagggu

SEQ ID NO: 3508572 - RNA, 22 nt, Pseudomonas aeruginosa PA01
gaucaucaucagguagagggcg

SEQ ID NO: 3508573 - RNA, 21 nt, Pseudomonas aeruginosa PA01
gaucauccgcaccauccgccg

SEQ ID NO: 3508574 - RNA, 14 nt, Pseudomonas aeruginosa PA01
gaucaucgccagcg

SEQ ID NO: 3508575 - RNA, 20 nt, Pseudomonas aeruginosa PA01
gaucaucgccagcggcguau

SEQ ID NO: 3508576 - RNA, 14 nt, Pseudomonas aeruginosa PA01
gaucaucgccugcu

SEQ ID NO: 3508577 - RNA, 16 nt, Pseudomonas aeruginosa PA01
gaucaucgccugcugg

SEQ ID NO: 3508578 - RNA, 23 nt, Pseudomonas aeruginosa PA01
gaucaucgccugcugguggguga

SEQ ID NO: 3508579 - RNA, 17 nt, Pseudomonas aeruginosa PA01
gaucaucggcuggucgu

SEQ ID NO: 3508580 - RNA, 22 nt, Pseudomonas aeruginosa PA01
gaucaucggcuggucgucgcgg

SEQ ID NO: 3508581 - RNA, 23 nt, Pseudomonas aeruginosa PA01
gaucaucugcugcagcaucaggc

SEQ ID NO: 3508582 - RNA, 15 nt, Pseudomonas aeruginosa PA01
gaucaucugggccau

SEQ ID NO: 3508583 - RNA, 17 nt, Pseudomonas aeruginosa PA01
gaucaucugggccaucg

SEQ ID NO: 3508584 - RNA, 19 nt, Pseudomonas aeruginosa PA01
gaucaucuucuggacaccg

SEQ ID NO: 3508585 - RNA, 23 nt, Pseudomonas aeruginosa PA01
gaucaucuucuggacaccgaugc

SEQ ID NO: 3508586 - RNA, 16 nt, Pseudomonas aeruginosa PA01
gaucaugggggccagc

SEQ ID NO: 3508587 - RNA, 19 nt, Pseudomonas aeruginosa PA01
gaucaugggggccagcagg

SEQ ID NO: 3508588 - RNA, 21 nt, Pseudomonas aeruginosa PA01
gaucaugggggccagcagggc

SEQ ID NO: 3508589 - RNA, 15 nt, Pseudomonas aeruginosa PA01
gaucauguagagcag

SEQ ID NO: 3508590 - RNA, 19 nt, Pseudomonas aeruginosa PA01
gaucauguagagcaggcug

SEQ ID NO: 3508591 - RNA, 20 nt, Pseudomonas aeruginosa PA01
gaucauguagagcaggcugc

SEQ ID NO: 3508592 - RNA, 24 nt, Pseudomonas aeruginosa PA01
gaucauuuuccgggucaugccgcc

SEQ ID NO: 3508593 - RNA, 22 nt, Pseudomonas aeruginosa PA01
gauccacagcagguugcuggcg

SEQ ID NO: 3508594 - RNA, 16 nt, Pseudomonas aeruginosa PA01
gauccaccgccagggc

SEQ ID NO: 3508595 - RNA, 15 nt, Pseudomonas aeruginosa PA01
gauccacgccuggcc

SEQ ID NO: 3508596 - RNA, 17 nt, Pseudomonas aeruginosa PA01
gauccacgccuggcccu

SEQ ID NO: 3508597 - RNA, 14 nt, Pseudomonas aeruginosa PA01
gauccacuugccgu

SEQ ID NO: 3508598 - RNA, 19 nt, Pseudomonas aeruginosa PA01
gauccagaagaucagcgcg

SEQ ID NO: 3508599 - RNA, 22 nt, Pseudomonas aeruginosa PA01
gauccagaagaucagcgcggug

SEQ ID NO: 3508600 - RNA, 14 nt, Pseudomonas aeruginosa PA01
gauccagcagucgc

SEQ ID NO: 3508601 - RNA, 23 nt, Pseudomonas aeruginosa PA01
gauccagcagucgcggcccuggu

SEQ ID NO: 3508602 - RNA, 12 nt, Pseudomonas aeruginosa PA01
gauccagcggca

SEQ ID NO: 3508603 - RNA, 21 nt, Pseudomonas aeruginosa PA01
gauccagcgguacuuuggggc

SEQ ID NO: 3508604 - RNA, 18 nt, Pseudomonas aeruginosa PA01
gauccaggaaccggccau

SEQ ID NO: 3508605 - RNA, 20 nt, Pseudomonas aeruginosa PA01
gauccaggucgaucagcagc

SEQ ID NO: 3508606 - RNA, 23 nt, Pseudomonas aeruginosa PA01
gauccaggucgaucagcagcagc

SEQ ID NO: 3508607 - RNA, 14 nt, Pseudomonas aeruginosa PA01
gauccaggugcgcg

SEQ ID NO: 3508608 - RNA, 16 nt, Pseudomonas aeruginosa PA01
gauccaggugcgcggc

SEQ ID NO: 3508609 - RNA, 19 nt, Pseudomonas aeruginosa PA01
gauccaggugcgcggcagg

SEQ ID NO: 3508610 - RNA, 17 nt, Pseudomonas aeruginosa PA01
gauccauguagaaggcg

SEQ ID NO: 3508611 - RNA, 15 nt, Pseudomonas aeruginosa PA01
gaucccaggucggcg

SEQ ID NO: 3508612 - RNA, 17 nt, Pseudomonas aeruginosa PA01
gaucccaggucggcggg

SEQ ID NO: 3508613 - RNA, 20 nt, Pseudomonas aeruginosa PA01
gaucccaggucggcgggcac

SEQ ID NO: 3508614 - RNA, 18 nt, Pseudomonas aeruginosa PA01
gauccccaacccggccag

SEQ ID NO: 3508615 - RNA, 22 nt, Pseudomonas aeruginosa PA01
gauccccucccgcgccagcgcc

SEQ ID NO: 3508616 - RNA, 23 nt, Pseudomonas aeruginosa PA01
gauccccucccgcgccagcgccg

SEQ ID NO: 3508617 - RNA, 24 nt, Pseudomonas aeruginosa PA01
gaucccgacgcccuccagcaccgc

SEQ ID NO: 3508618 - RNA, 12 nt, Pseudomonas aeruginosa PA01
gaucccgaucgc

SEQ ID NO: 3508619 - RNA, 17 nt, Pseudomonas aeruginosa PA01
gaucccgaucgccaaua

SEQ ID NO: 3508620 - RNA, 22 nt, Pseudomonas aeruginosa PA01
gaucccgaucucgguuuccagg

SEQ ID NO: 3508621 - RNA, 16 nt, Pseudomonas aeruginosa PA01
gaucccgcgcgggccg

SEQ ID NO: 3508622 - RNA, 19 nt, Pseudomonas aeruginosa PA01
gaucccgcgcgggccgagg

SEQ ID NO: 3508623 - RNA, 19 nt, Pseudomonas aeruginosa PA01
gaucccggaggcggcgagc

SEQ ID NO: 3508624 - RNA, 19 nt, Pseudomonas aeruginosa PA01
gaucccggauucgccgagg

SEQ ID NO: 3508625 - RNA, 17 nt, Pseudomonas aeruginosa PA01
gaucccggcgcggaacu

SEQ ID NO: 3508626 - RNA, 12 nt, Pseudomonas aeruginosa PA01
gaucccggcggc

SEQ ID NO: 3508627 - RNA, 16 nt, Pseudomonas aeruginosa PA01
gaucccggcggcgacc

SEQ ID NO: 3508628 - RNA, 22 nt, Pseudomonas aeruginosa PA01
gaucccggcggcgacccagacc

SEQ ID NO: 3508629 - RNA, 17 nt, Pseudomonas aeruginosa PA01
gaucccguagaccggcu

SEQ ID NO: 3508630 - RNA, 18 nt, Pseudomonas aeruginosa PA01
gaucccguagaccggcuc

SEQ ID NO: 3508631 - RNA, 21 nt, Pseudomonas aeruginosa PA01
gaucccguguaccacgcccgc

SEQ ID NO: 3508632 - RNA, 12 nt, Pseudomonas aeruginosa PA01
gauccgcacccg

SEQ ID NO: 3508633 - RNA, 20 nt, Pseudomonas aeruginosa PA01
gauccgcacccgcgacucga

SEQ ID NO: 3508634 - RNA, 14 nt, Pseudomonas aeruginosa PA01
gauccgccagcaga

SEQ ID NO: 3508635 - RNA, 22 nt, Pseudomonas aeruginosa PA01
gauccgcccgcaugccagggcc

SEQ ID NO: 3508636 - RNA, 23 nt, Pseudomonas aeruginosa PA01
gauccgcccgcaugccagggccu

SEQ ID NO: 3508637 - RNA, 20 nt, Pseudomonas aeruginosa PA01
gauccgccgugaggcgcgcg

SEQ ID NO: 3508638 - RNA, 22 nt, Pseudomonas aeruginosa PA01
gauccgccgugaggcgcgcgcc

SEQ ID NO: 3508639 - RNA, 22 nt, Pseudomonas aeruginosa PA01
gauccgcgaauagggcggcgcc

SEQ ID NO: 3508640 - RNA, 23 nt, Pseudomonas aeruginosa PA01
gauccgcgaauagggcggcgcca

SEQ ID NO: 3508641 - RNA, 17 nt, Pseudomonas aeruginosa PA01
gauccgcgacaguucgc

SEQ ID NO: 3508642 - RNA, 15 nt, Pseudomonas aeruginosa PA01
gauccgcgacgaggg

SEQ ID NO: 3508643 - RNA, 13 nt, Pseudomonas aeruginosa PA01
gauccgcgccugc

SEQ ID NO: 3508644 - RNA, 23 nt, Pseudomonas aeruginosa PA01
gauccgcgcuuccgcaucggccg

SEQ ID NO: 3508645 - RNA, 18 nt, Pseudomonas aeruginosa PA01
gauccgcggaucguccgg

SEQ ID NO: 3508646 - RNA, 17 nt, Pseudomonas aeruginosa PA01
gauccgcguggcgugcu

SEQ ID NO: 3508647 - RNA, 19 nt, Pseudomonas aeruginosa PA01
gauccgcguuaccguccgc

SEQ ID NO: 3508648 - RNA, 22 nt, Pseudomonas aeruginosa PA01
gauccgcguuaccguccgcgcc

SEQ ID NO: 3508649 - RNA, 16 nt, Pseudomonas aeruginosa PA01
gauccgcuccagcgcc

SEQ ID NO: 3508650 - RNA, 13 nt, Pseudomonas aeruginosa PA01
gauccgcuccagg

SEQ ID NO: 3508651 - RNA, 15 nt, Pseudomonas aeruginosa PA01
gauccgcuccaggcu

SEQ ID NO: 3508652 - RNA, 15 nt, Pseudomonas aeruginosa PA01
gauccgcucgauccc

SEQ ID NO: 3508653 - RNA, 12 nt, Pseudomonas aeruginosa PA01
gauccgcugcaa

SEQ ID NO: 3508654 - RNA, 22 nt, Pseudomonas aeruginosa PA01
gauccggguggagaggcgugcu

SEQ ID NO: 3508655 - RNA, 14 nt, Pseudomonas aeruginosa PA01
gauccggugcaggc

SEQ ID NO: 3508656 - RNA, 19 nt, Pseudomonas aeruginosa PA01
gauccggugcaggccgagc

SEQ ID NO: 3508657 - RNA, 17 nt, Pseudomonas aeruginosa PA01
gauccgugccaggcgcu

SEQ ID NO: 3508658 - RNA, 15 nt, Pseudomonas aeruginosa PA01
gauccuccgccagcc

SEQ ID NO: 3508659 - RNA, 16 nt, Pseudomonas aeruginosa PA01
gauccuccgccagccc

SEQ ID NO: 3508660 - RNA, 18 nt, Pseudomonas aeruginosa PA01
gauccuccgccagcccca

SEQ ID NO: 3508661 - RNA, 18 nt, Pseudomonas aeruginosa PA01
gauccucgccucgcgcca

SEQ ID NO: 3508662 - RNA, 18 nt, Pseudomonas aeruginosa PA01
gauccugaccguccuggc

SEQ ID NO: 3508663 - RNA, 20 nt, Pseudomonas aeruginosa PA01
gauccugcucagcggcccag

SEQ ID NO: 3508664 - RNA, 20 nt, Pseudomonas aeruginosa PA01
gauccugcugguugaagccg

SEQ ID NO: 3508665 - RNA, 15 nt, Pseudomonas aeruginosa PA01
gauccuggccggcgg

SEQ ID NO: 3508666 - RNA, 16 nt, Pseudomonas aeruginosa PA01
gauccuggccggcggc

SEQ ID NO: 3508667 - RNA, 17 nt, Pseudomonas aeruginosa PA01
gauccuggccggcggcg

SEQ ID NO: 3508668 - RNA, 16 nt, Pseudomonas aeruginosa PA01
gauccugggcgccagc

SEQ ID NO: 3508669 - RNA, 21 nt, Pseudomonas aeruginosa PA01
gauccugggcgccagccgcca

SEQ ID NO: 3508670 - RNA, 21 nt, Pseudomonas aeruginosa PA01
gauccuggguagauuuacaag

SEQ ID NO: 3508671 - RNA, 22 nt, Pseudomonas aeruginosa PA01
gaucgaacuggccagcaccagu

SEQ ID NO: 3508672 - RNA, 16 nt, Pseudomonas aeruginosa PA01
gaucgaagcccaucga

SEQ ID NO: 3508673 - RNA, 17 nt, Pseudomonas aeruginosa PA01
gaucgaaguagucggcg

SEQ ID NO: 3508674 - RNA, 18 nt, Pseudomonas aeruginosa PA01
gaucgacagcagcgccag

SEQ ID NO: 3508675 - RNA, 20 nt, Pseudomonas aeruginosa PA01
gaucgacagcagcgccaggg

SEQ ID NO: 3508676 - RNA, 14 nt, Pseudomonas aeruginosa PA01
gaucgacaggccgc

SEQ ID NO: 3508677 - RNA, 15 nt, Pseudomonas aeruginosa PA01
gaucgacaggccgcc

SEQ ID NO: 3508678 - RNA, 20 nt, Pseudomonas aeruginosa PA01
gaucgacaggccgccguaga

SEQ ID NO: 3508679 - RNA, 23 nt, Pseudomonas aeruginosa PA01
gaucgaccccgccggggcgugca

SEQ ID NO: 3508680 - RNA, 22 nt, Pseudomonas aeruginosa PA01
gaucgaccgguuaauggcgcuc

SEQ ID NO: 3508681 - RNA, 16 nt, Pseudomonas aeruginosa PA01
gaucgaccucgcgggc

SEQ ID NO: 3508682 - RNA, 17 nt, Pseudomonas aeruginosa PA01
gaucgaccucgcgggcg

SEQ ID NO: 3508683 - RNA, 20 nt, Pseudomonas aeruginosa PA01
gaucgaccucgcgggcgacg

SEQ ID NO: 3508684 - RNA, 12 nt, Pseudomonas aeruginosa PA01
gaucgaccugcc

SEQ ID NO: 3508685 - RNA, 13 nt, Pseudomonas aeruginosa PA01
gaucgacgccagc

SEQ ID NO: 3508686 - RNA, 16 nt, Pseudomonas aeruginosa PA01
gaucgacgccagcucg

SEQ ID NO: 3508687 - RNA, 15 nt, Pseudomonas aeruginosa PA01
gaucgacgccgcugg

SEQ ID NO: 3508688 - RNA, 16 nt, Pseudomonas aeruginosa PA01
gaucgacgccgcuggc

SEQ ID NO: 3508689 - RNA, 19 nt, Pseudomonas aeruginosa PA01
gaucgacgccgcuggcggc

SEQ ID NO: 3508690 - RNA, 20 nt, Pseudomonas aeruginosa PA01
gaucgacgccgcuggcggcg

SEQ ID NO: 3508691 - RNA, 22 nt, Pseudomonas aeruginosa PA01
gaucgacgccgcuggcggcgcu

SEQ ID NO: 3508692 - RNA, 23 nt, Pseudomonas aeruginosa PA01
gaucgacgccuucguggccgcgg

SEQ ID NO: 3508693 - RNA, 19 nt, Pseudomonas aeruginosa PA01
gaucgagcagcggcgccaa

SEQ ID NO: 3508694 - RNA, 14 nt, Pseudomonas aeruginosa PA01
gaucgagccagcgc

SEQ ID NO: 3508695 - RNA, 14 nt, Pseudomonas aeruginosa PA01
gaucgagcccuugc

SEQ ID NO: 3508696 - RNA, 20 nt, Pseudomonas aeruginosa PA01
gaucgagcccuugcgcggcg

SEQ ID NO: 3508697 - RNA, 13 nt, Pseudomonas aeruginosa PA01
gaucgagccgccg

SEQ ID NO: 3508698 - RNA, 19 nt, Pseudomonas aeruginosa PA01
gaucgagccuugcggcgcu

SEQ ID NO: 3508699 - RNA, 15 nt, Pseudomonas aeruginosa PA01
gaucgagcggcccgc

SEQ ID NO: 3508700 - RNA, 15 nt, Pseudomonas aeruginosa PA01
gaucgagcuguccau

SEQ ID NO: 3508701 - RNA, 19 nt, Pseudomonas aeruginosa PA01
gaucgagcuguccaucucg

SEQ ID NO: 3508702 - RNA, 23 nt, Pseudomonas aeruginosa PA01
gaucgagcuguccaucucgccgc

SEQ ID NO: 3508703 - RNA, 20 nt, Pseudomonas aeruginosa PA01
gaucgaggaauuccggcagc

SEQ ID NO: 3508704 - RNA, 17 nt, Pseudomonas aeruginosa PA01
gaucgaggccuacccgc

SEQ ID NO: 3508705 - RNA, 19 nt, Pseudomonas aeruginosa PA01
gaucgaggccuacccgcgc

SEQ ID NO: 3508706 - RNA, 16 nt, Pseudomonas aeruginosa PA01
gaucgagucgccggcg

SEQ ID NO: 3508707 - RNA, 17 nt, Pseudomonas aeruginosa PA01
gaucgagucgccggcga

SEQ ID NO: 3508708 - RNA, 16 nt, Pseudomonas aeruginosa PA01
gaucgaucagcagcac

SEQ ID NO: 3508709 - RNA, 13 nt, Pseudomonas aeruginosa PA01
gaucgcaagauua

SEQ ID NO: 3508710 - RNA, 15 nt, Pseudomonas aeruginosa PA01
gaucgcacggcggga

SEQ ID NO: 3508711 - RNA, 23 nt, Pseudomonas aeruginosa PA01
gaucgcauuguugcggucgcgcc

SEQ ID NO: 3508712 - RNA, 20 nt, Pseudomonas aeruginosa PA01
gaucgccaccccgccgcugg

SEQ ID NO: 3508713 - RNA, 23 nt, Pseudomonas aeruginosa PA01
gaucgccaccccgccgcuggcgg

SEQ ID NO: 3508714 - RNA, 16 nt, Pseudomonas aeruginosa PA01
gaucgccacgccggcg

SEQ ID NO: 3508715 - RNA, 19 nt, Pseudomonas aeruginosa PA01
gaucgccacgccggcgcuc

SEQ ID NO: 3508716 - RNA, 12 nt, Pseudomonas aeruginosa PA01
gaucgccagccc

SEQ ID NO: 3508717 - RNA, 14 nt, Pseudomonas aeruginosa PA01
gaucgccagcgcca

SEQ ID NO: 3508718 - RNA, 18 nt, Pseudomonas aeruginosa PA01
gaucgccagcgccagcag

SEQ ID NO: 3508719 - RNA, 19 nt, Pseudomonas aeruginosa PA01
gaucgccagcgccagcagg

SEQ ID NO: 3508720 - RNA, 14 nt, Pseudomonas aeruginosa PA01
gaucgccagcucgc

SEQ ID NO: 3508721 - RNA, 18 nt, Pseudomonas aeruginosa PA01
gaucgccagcucgccgcg

SEQ ID NO: 3508722 - RNA, 19 nt, Pseudomonas aeruginosa PA01
gaucgccagcucgccgcgc

SEQ ID NO: 3508723 - RNA, 20 nt, Pseudomonas aeruginosa PA01
gaucgccagcucgccgcgcu

SEQ ID NO: 3508724 - RNA, 12 nt, Pseudomonas aeruginosa PA01
gaucgccaggcg

SEQ ID NO: 3508725 - RNA, 21 nt, Pseudomonas aeruginosa PA01
gaucgccauaggaugccgagg

SEQ ID NO: 3508726 - RNA, 14 nt, Pseudomonas aeruginosa PA01
gaucgcccagcggc

SEQ ID NO: 3508727 - RNA, 15 nt, Pseudomonas aeruginosa PA01
gaucgcccagcggcu

SEQ ID NO: 3508728 - RNA, 16 nt, Pseudomonas aeruginosa PA01
gaucgcccagcggcug

SEQ ID NO: 3508729 - RNA, 19 nt, Pseudomonas aeruginosa PA01
gaucgcccagcggcuggcg

SEQ ID NO: 3508730 - RNA, 23 nt, Pseudomonas aeruginosa PA01
gaucgcccagcggcuggcgggcg

SEQ ID NO: 3508731 - RNA, 16 nt, Pseudomonas aeruginosa PA01
gaucgcccgaacgccg

SEQ ID NO: 3508732 - RNA, 18 nt, Pseudomonas aeruginosa PA01
gaucgcccgaacgccgac

SEQ ID NO: 3508733 - RNA, 17 nt, Pseudomonas aeruginosa PA01
gaucgcccgcgccucga

SEQ ID NO: 3508734 - RNA, 12 nt, Pseudomonas aeruginosa PA01
gaucgcccggcg

SEQ ID NO: 3508735 - RNA, 13 nt, Pseudomonas aeruginosa PA01
gaucgcccggcgc

SEQ ID NO: 3508736 - RNA, 15 nt, Pseudomonas aeruginosa PA01
gaucgcccggcgcuc

SEQ ID NO: 3508737 - RNA, 23 nt, Pseudomonas aeruginosa PA01
gaucgcccggcgcuccaacagca

SEQ ID NO: 3508738 - RNA, 15 nt, Pseudomonas aeruginosa PA01
gaucgcccggcugca

SEQ ID NO: 3508739 - RNA, 12 nt, Pseudomonas aeruginosa PA01
gaucgcccuggc

SEQ ID NO: 3508740 - RNA, 18 nt, Pseudomonas aeruginosa PA01
gaucgcccuggcgccagc

SEQ ID NO: 3508741 - RNA, 19 nt, Pseudomonas aeruginosa PA01
gaucgcccuggcgccagcg

SEQ ID NO: 3508742 - RNA, 20 nt, Pseudomonas aeruginosa PA01
gaucgcccuggcgccagcgu

SEQ ID NO: 3508743 - RNA, 22 nt, Pseudomonas aeruginosa PA01
gaucgccgccuugcguaccagc

SEQ ID NO: 3508744 - RNA, 16 nt, Pseudomonas aeruginosa PA01
gaucgccgcgaggugg

SEQ ID NO: 3508745 - RNA, 12 nt, Pseudomonas aeruginosa PA01
gaucgccgcgcc

SEQ ID NO: 3508746 - RNA, 14 nt, Pseudomonas aeruginosa PA01
gaucgccgcgccgc

SEQ ID NO: 3508747 - RNA, 15 nt, Pseudomonas aeruginosa PA01
gaucgccgcgccgcc

SEQ ID NO: 3508748 - RNA, 17 nt, Pseudomonas aeruginosa PA01
gaucgccgcgcggucga

SEQ ID NO: 3508749 - RNA, 19 nt, Pseudomonas aeruginosa PA01
gaucgccgcgcggucgagc

SEQ ID NO: 3508750 - RNA, 17 nt, Pseudomonas aeruginosa PA01
gaucgccgcguagcgcc

SEQ ID NO: 3508751 - RNA, 22 nt, Pseudomonas aeruginosa PA01
gaucgccggguugccgcuggcc

SEQ ID NO: 3508752 - RNA, 14 nt, Pseudomonas aeruginosa PA01
gaucgccguguuga

SEQ ID NO: 3508753 - RNA, 22 nt, Pseudomonas aeruginosa PA01
gaucgccguguugaugccgauc

SEQ ID NO: 3508754 - RNA, 23 nt, Pseudomonas aeruginosa PA01
gaucgccguguugaugccgauca

SEQ ID NO: 3508755 - RNA, 14 nt, Pseudomonas aeruginosa PA01
gaucgccuccacca

SEQ ID NO: 3508756 - RNA, 20 nt, Pseudomonas aeruginosa PA01
gaucgccuccaccagcgccg

SEQ ID NO: 3508757 - RNA, 22 nt, Pseudomonas aeruginosa PA01
gaucgccuccaccagcgccggc

SEQ ID NO: 3508758 - RNA, 23 nt, Pseudomonas aeruginosa PA01
gaucgccuccaccagcgccggcg

SEQ ID NO: 3508759 - RNA, 15 nt, Pseudomonas aeruginosa PA01
gaucgccuccggcac

SEQ ID NO: 3508760 - RNA, 13 nt, Pseudomonas aeruginosa PA01
gaucgccucggcc

SEQ ID NO: 3508761 - RNA, 15 nt, Pseudomonas aeruginosa PA01
gaucgccucggccau

SEQ ID NO: 3508762 - RNA, 17 nt, Pseudomonas aeruginosa PA01
gaucgccucggcgcgcg

SEQ ID NO: 3508763 - RNA, 19 nt, Pseudomonas aeruginosa PA01
gaucgccucggcgcgcgcc

SEQ ID NO: 3508764 - RNA, 17 nt, Pseudomonas aeruginosa PA01
gaucgccucgggcgagc

SEQ ID NO: 3508765 - RNA, 16 nt, Pseudomonas aeruginosa PA01
gaucgccucgucgagc

SEQ ID NO: 3508766 - RNA, 16 nt, Pseudomonas aeruginosa PA01
gaucgccugcuggccg

SEQ ID NO: 3508767 - RNA, 17 nt, Pseudomonas aeruginosa PA01
gaucgccugcuggccgg

SEQ ID NO: 3508768 - RNA, 20 nt, Pseudomonas aeruginosa PA01
gaucgccuugcgcgugcugg

SEQ ID NO: 3508769 - RNA, 23 nt, Pseudomonas aeruginosa PA01
gaucgcgaagaacacgccccaga

SEQ ID NO: 3508770 - RNA, 16 nt, Pseudomonas aeruginosa PA01
gaucgcgaagcgcagc

SEQ ID NO: 3508771 - RNA, 12 nt, Pseudomonas aeruginosa PA01
gaucgcgcggcu

SEQ ID NO: 3508772 - RNA, 13 nt, Pseudomonas aeruginosa PA01
gaucgcgcggcug

SEQ ID NO: 3508773 - RNA, 15 nt, Pseudomonas aeruginosa PA01
gaucgcgcggcuggc

SEQ ID NO: 3508774 - RNA, 16 nt, Pseudomonas aeruginosa PA01
gaucgcgcggcuggcu

SEQ ID NO: 3508775 - RNA, 13 nt, Pseudomonas aeruginosa PA01
gaucgcgcuggcc

SEQ ID NO: 3508776 - RNA, 18 nt, Pseudomonas aeruginosa PA01
gaucgcggccagccgcua

SEQ ID NO: 3508777 - RNA, 16 nt, Pseudomonas aeruginosa PA01
gaucgcggccuucucg

SEQ ID NO: 3508778 - RNA, 20 nt, Pseudomonas aeruginosa PA01
gaucgcgucguauaggcgcu

SEQ ID NO: 3508779 - RNA, 20 nt, Pseudomonas aeruginosa PA01
gaucgcgugggccaccauca

SEQ ID NO: 3508780 - RNA, 15 nt, Pseudomonas aeruginosa PA01
gaucgcguuccagca

SEQ ID NO: 3508781 - RNA, 16 nt, Pseudomonas aeruginosa PA01
gaucgcguuccagcaa

SEQ ID NO: 3508782 - RNA, 20 nt, Pseudomonas aeruginosa PA01
gaucgcguuugccgucccgg

SEQ ID NO: 3508783 - RNA, 14 nt, Pseudomonas aeruginosa PA01
gaucgcuaccgaca

SEQ ID NO: 3508784 - RNA, 16 nt, Pseudomonas aeruginosa PA01
gaucgcucucgcgcuu

SEQ ID NO: 3508785 - RNA, 17 nt, Pseudomonas aeruginosa PA01
gaucgcuucgcggaucu

SEQ ID NO: 3508786 - RNA, 17 nt, Pseudomonas aeruginosa PA01
gaucggaagaucgcccg

SEQ ID NO: 3508787 - RNA, 21 nt, Pseudomonas aeruginosa PA01
gaucggagagacccgccagcg

SEQ ID NO: 3508788 - RNA, 17 nt, Pseudomonas aeruginosa PA01
gaucggauagccgugca

SEQ ID NO: 3508789 - RNA, 19 nt, Pseudomonas aeruginosa PA01
gaucggauugaggacgcug

SEQ ID NO: 3508790 - RNA, 23 nt, Pseudomonas aeruginosa PA01
gaucggauugaggacgcugggac

SEQ ID NO: 3508791 - RNA, 20 nt, Pseudomonas aeruginosa PA01
gaucggcaacuggcuggccu

SEQ ID NO: 3508792 - RNA, 24 nt, Pseudomonas aeruginosa PA01
gaucggcaagcugaagcgccgcgg

SEQ ID NO: 3508793 - RNA, 13 nt, Pseudomonas aeruginosa PA01
gaucggcagcauc

SEQ ID NO: 3508794 - RNA, 17 nt, Pseudomonas aeruginosa PA01
gaucggcagcaucagcc

SEQ ID NO: 3508795 - RNA, 19 nt, Pseudomonas aeruginosa PA01
gaucggcagcaucagccgc

SEQ ID NO: 3508796 - RNA, 12 nt, Pseudomonas aeruginosa PA01
gaucggcagccg

SEQ ID NO: 3508797 - RNA, 14 nt, Pseudomonas aeruginosa PA01
gaucggcaggcugg

SEQ ID NO: 3508798 - RNA, 16 nt, Pseudomonas aeruginosa PA01
gaucggcaggcuggcg

SEQ ID NO: 3508799 - RNA, 17 nt, Pseudomonas aeruginosa PA01
gaucggcagggcgccga

SEQ ID NO: 3508800 - RNA, 20 nt, Pseudomonas aeruginosa PA01
gaucggcagggcgccgacca

SEQ ID NO: 3508801 - RNA, 19 nt, Pseudomonas aeruginosa PA01
gaucggcauguugugcuug

SEQ ID NO: 3508802 - RNA, 17 nt, Pseudomonas aeruginosa PA01
gaucggccccaccuggc

SEQ ID NO: 3508803 - RNA, 12 nt, Pseudomonas aeruginosa PA01
gaucggcccggc

SEQ ID NO: 3508804 - RNA, 13 nt, Pseudomonas aeruginosa PA01
gaucggcccggcg

SEQ ID NO: 3508805 - RNA, 12 nt, Pseudomonas aeruginosa PA01
gaucggcccggg

SEQ ID NO: 3508806 - RNA, 13 nt, Pseudomonas aeruginosa PA01
gaucggcccgggc

SEQ ID NO: 3508807 - RNA, 20 nt, Pseudomonas aeruginosa PA01
gaucggcccgggcgccaccg

SEQ ID NO: 3508808 - RNA, 16 nt, Pseudomonas aeruginosa PA01
gaucggccgccagugc

SEQ ID NO: 3508809 - RNA, 15 nt, Pseudomonas aeruginosa PA01
gaucggccucgcggc

SEQ ID NO: 3508810 - RNA, 19 nt, Pseudomonas aeruginosa PA01
gaucggccucgcggcgcuc

SEQ ID NO: 3508811 - RNA, 20 nt, Pseudomonas aeruginosa PA01
gaucggccucgcggcgcucg

SEQ ID NO: 3508812 - RNA, 13 nt, Pseudomonas aeruginosa PA01
gaucggccuuggc

SEQ ID NO: 3508813 - RNA, 21 nt, Pseudomonas aeruginosa PA01
gaucggcgcccagcaccacag

SEQ ID NO: 3508814 - RNA, 21 nt, Pseudomonas aeruginosa PA01
gaucggcgcgcagggccagca

SEQ ID NO: 3508815 - RNA, 22 nt, Pseudomonas aeruginosa PA01
gaucggcgcgcagggccagcaa

SEQ ID NO: 3508816 - RNA, 12 nt, Pseudomonas aeruginosa PA01
gaucggcgcgcc

SEQ ID NO: 3508817 - RNA, 13 nt, Pseudomonas aeruginosa PA01
gaucggcgcgccg

SEQ ID NO: 3508818 - RNA, 14 nt, Pseudomonas aeruginosa PA01
gaucggcgcgccgg

SEQ ID NO: 3508819 - RNA, 15 nt, Pseudomonas aeruginosa PA01
gaucggcgcgccggc

SEQ ID NO: 3508820 - RNA, 16 nt, Pseudomonas aeruginosa PA01
gaucggcgcgccggcc

SEQ ID NO: 3508821 - RNA, 20 nt, Pseudomonas aeruginosa PA01
gaucggcgcgccggcccggg

SEQ ID NO: 3508822 - RNA, 13 nt, Pseudomonas aeruginosa PA01
gaucggcggcgcg

SEQ ID NO: 3508823 - RNA, 13 nt, Pseudomonas aeruginosa PA01
gaucggcguccgc

SEQ ID NO: 3508824 - RNA, 14 nt, Pseudomonas aeruginosa PA01
gaucggcguccgcg

SEQ ID NO: 3508825 - RNA, 17 nt, Pseudomonas aeruginosa PA01
gaucggcguccgcggcc

SEQ ID NO: 3508826 - RNA, 19 nt, Pseudomonas aeruginosa PA01
gaucggcguuuacgcgcca

SEQ ID NO: 3508827 - RNA, 20 nt, Pseudomonas aeruginosa PA01
gaucggcugaccggcaucga

SEQ ID NO: 3508828 - RNA, 19 nt, Pseudomonas aeruginosa PA01
gaucggcugcaacgccggc

SEQ ID NO: 3508829 - RNA, 15 nt, Pseudomonas aeruginosa PA01
gaucgggcuucggca

SEQ ID NO: 3508830 - RNA, 17 nt, Pseudomonas aeruginosa PA01
gaucgggcuucggcagc

SEQ ID NO: 3508831 - RNA, 19 nt, Pseudomonas aeruginosa PA01
gaucggggaagggacgucg

SEQ ID NO: 3508832 - RNA, 23 nt, Pseudomonas aeruginosa PA01
gaucggggaagggacgucgccag

SEQ ID NO: 3508833 - RNA, 19 nt, Pseudomonas aeruginosa PA01
gaucggguagagcgcggcg

SEQ ID NO: 3508834 - RNA, 21 nt, Pseudomonas aeruginosa PA01
gaucggguagagcgcggcgca

SEQ ID NO: 3508835 - RNA, 15 nt, Pseudomonas aeruginosa PA01
gaucggugcgggcag

SEQ ID NO: 3508836 - RNA, 23 nt, Pseudomonas aeruginosa PA01
gaucggugcgggcagacaccacc

SEQ ID NO: 3508837 - RNA, 23 nt, Pseudomonas aeruginosa PA01
gaucggugcuuugcauggccugu

SEQ ID NO: 3508838 - RNA, 15 nt, Pseudomonas aeruginosa PA01
gaucgguucccgccc

SEQ ID NO: 3508839 - RNA, 19 nt, Pseudomonas aeruginosa PA01
gaucgguucccgcccgcuc

SEQ ID NO: 3508840 - RNA, 24 nt, Pseudomonas aeruginosa PA01
gaucguccgggcgguacaggcgca

SEQ ID NO: 3508841 - RNA, 21 nt, Pseudomonas aeruginosa PA01
gaucgucgaaagccucgacga

SEQ ID NO: 3508842 - RNA, 16 nt, Pseudomonas aeruginosa PA01
gaucgucgaagcucgg

SEQ ID NO: 3508843 - RNA, 20 nt, Pseudomonas aeruginosa PA01
gaucgucgagaugcugcggg

SEQ ID NO: 3508844 - RNA, 16 nt, Pseudomonas aeruginosa PA01
gaucgucgcggcgcga

SEQ ID NO: 3508845 - RNA, 13 nt, Pseudomonas aeruginosa PA01
gaucuaccugcgu

SEQ ID NO: 3508846 - RNA, 16 nt, Pseudomonas aeruginosa PA01
gaucuccaacuggcgg

SEQ ID NO: 3508847 - RNA, 21 nt, Pseudomonas aeruginosa PA01
gaucuccaacuggcggcuggg

SEQ ID NO: 3508848 - RNA, 22 nt, Pseudomonas aeruginosa PA01
gaucuccaacuggcggcugggc

SEQ ID NO: 3508849 - RNA, 19 nt, Pseudomonas aeruginosa PA01
gaucuccacccguucgccg

SEQ ID NO: 3508850 - RNA, 22 nt, Pseudomonas aeruginosa PA01
gaucuccacccguucgccggcc

SEQ ID NO: 3508851 - RNA, 13 nt, Pseudomonas aeruginosa PA01
gaucucccgcgau

SEQ ID NO: 3508852 - RNA, 22 nt, Pseudomonas aeruginosa PA01
gaucuccgccaggcggccgaag

SEQ ID NO: 3508853 - RNA, 19 nt, Pseudomonas aeruginosa PA01
gaucuccgcgccacgcgca

SEQ ID NO: 3508854 - RNA, 13 nt, Pseudomonas aeruginosa PA01
gaucuccgcgccg

SEQ ID NO: 3508855 - RNA, 14 nt, Pseudomonas aeruginosa PA01
gaucuccgcgccgg

SEQ ID NO: 3508856 - RNA, 21 nt, Pseudomonas aeruginosa PA01
gaucuccgcgccgggcuggcc

SEQ ID NO: 3508857 - RNA, 22 nt, Pseudomonas aeruginosa PA01
gaucuccgggagcaucuggccc

SEQ ID NO: 3508858 - RNA, 17 nt, Pseudomonas aeruginosa PA01
gaucuccuccucggcgg

SEQ ID NO: 3508859 - RNA, 18 nt, Pseudomonas aeruginosa PA01
gaucuccuccucggcggc

SEQ ID NO: 3508860 - RNA, 21 nt, Pseudomonas aeruginosa PA01
gaucuccucgacggcgggagc

SEQ ID NO: 3508861 - RNA, 16 nt, Pseudomonas aeruginosa PA01
gaucuccucgauccgc

SEQ ID NO: 3508862 - RNA, 19 nt, Pseudomonas aeruginosa PA01
gaucuccucgcgcagcggc

SEQ ID NO: 3508863 - RNA, 20 nt, Pseudomonas aeruginosa PA01
gaucuccucgcgcagcggcu

SEQ ID NO: 3508864 - RNA, 17 nt, Pseudomonas aeruginosa PA01
gaucuccugcugggcgu

SEQ ID NO: 3508865 - RNA, 16 nt, Pseudomonas aeruginosa PA01
gaucuccugggucgac

SEQ ID NO: 3508866 - RNA, 19 nt, Pseudomonas aeruginosa PA01
gaucucgaagaccagcgga

SEQ ID NO: 3508867 - RNA, 22 nt, Pseudomonas aeruginosa PA01
gaucucgcccagggcguggucg

SEQ ID NO: 3508868 - RNA, 16 nt, Pseudomonas aeruginosa PA01
gaucucgcccaguacc

SEQ ID NO: 3508869 - RNA, 14 nt, Pseudomonas aeruginosa PA01
gaucucgccgaagg

SEQ ID NO: 3508870 - RNA, 16 nt, Pseudomonas aeruginosa PA01
gaucucgcggcgcggc

SEQ ID NO: 3508871 - RNA, 17 nt, Pseudomonas aeruginosa PA01
gaucucgcggcgcggcg

SEQ ID NO: 3508872 - RNA, 13 nt, Pseudomonas aeruginosa PA01
gaucucggcgcgg

SEQ ID NO: 3508873 - RNA, 16 nt, Pseudomonas aeruginosa PA01
gaucucggcggccagg

SEQ ID NO: 3508874 - RNA, 19 nt, Pseudomonas aeruginosa PA01
gaucucgguaucgcuucca

SEQ ID NO: 3508875 - RNA, 22 nt, Pseudomonas aeruginosa PA01
gaucucgguuuccaggaugcaa

SEQ ID NO: 3508876 - RNA, 12 nt, Pseudomonas aeruginosa PA01
gaucucguccuc

SEQ ID NO: 3508877 - RNA, 13 nt, Pseudomonas aeruginosa PA01
gaucucgucgccg

SEQ ID NO: 3508878 - RNA, 16 nt, Pseudomonas aeruginosa PA01
gaucucgucgccgacc

SEQ ID NO: 3508879 - RNA, 15 nt, Pseudomonas aeruginosa PA01
gaucucgucggcggg

SEQ ID NO: 3508880 - RNA, 16 nt, Pseudomonas aeruginosa PA01
gaucucgucggcgggg

SEQ ID NO: 3508881 - RNA, 16 nt, Pseudomonas aeruginosa PA01
gaucucgucguagucg

SEQ ID NO: 3508882 - RNA, 21 nt, Pseudomonas aeruginosa PA01
gaucucgugcuuggugucggc

SEQ ID NO: 3508883 - RNA, 19 nt, Pseudomonas aeruginosa PA01
gaucucgugggccagcagg

SEQ ID NO: 3508884 - RNA, 20 nt, Pseudomonas aeruginosa PA01
gaucucguucggguagucga

SEQ ID NO: 3508885 - RNA, 19 nt, Pseudomonas aeruginosa PA01
gaucucuacuaccgccagc

SEQ ID NO: 3508886 - RNA, 11 nt, Pseudomonas aeruginosa PA01
gaucugcaggu

SEQ ID NO: 3508887 - RNA, 18 nt, Pseudomonas aeruginosa PA01
gaucugcaugccguccgg

SEQ ID NO: 3508888 - RNA, 19 nt, Pseudomonas aeruginosa PA01
gaucugccgguaggucacc

SEQ ID NO: 3508889 - RNA, 13 nt, Pseudomonas aeruginosa PA01
gaucugcgagcgc

SEQ ID NO: 3508890 - RNA, 16 nt, Pseudomonas aeruginosa PA01
gaucugcgagcgcaca

SEQ ID NO: 3508891 - RNA, 15 nt, Pseudomonas aeruginosa PA01
gaucugcuccugcag

SEQ ID NO: 3508892 - RNA, 16 nt, Pseudomonas aeruginosa PA01
gaucugcucgacgucg

SEQ ID NO: 3508893 - RNA, 18 nt, Pseudomonas aeruginosa PA01
gaucugcucgacgucguc

SEQ ID NO: 3508894 - RNA, 19 nt, Pseudomonas aeruginosa PA01
gaucugcucguccaggccg

SEQ ID NO: 3508895 - RNA, 20 nt, Pseudomonas aeruginosa PA01
gaucugcucguccaggccgc

SEQ ID NO: 3508896 - RNA, 21 nt, Pseudomonas aeruginosa PA01
gaucugcucguccaggccgca

SEQ ID NO: 3508897 - RNA, 22 nt, Pseudomonas aeruginosa PA01
gaucugcucguccaggccgcag

SEQ ID NO: 3508898 - RNA, 17 nt, Pseudomonas aeruginosa PA01
gaucugcugggucaucg

SEQ ID NO: 3508899 - RNA, 21 nt, Pseudomonas aeruginosa PA01
gaucugcugggucaucgaggc

SEQ ID NO: 3508900 - RNA, 20 nt, Pseudomonas aeruginosa PA01
gaucugcuugcgcgccgccg

SEQ ID NO: 3508901 - RNA, 18 nt, Pseudomonas aeruginosa PA01
gaucuggaauucgccgcg

SEQ ID NO: 3508902 - RNA, 17 nt, Pseudomonas aeruginosa PA01
gaucuggcccugcaaca

SEQ ID NO: 3508903 - RNA, 13 nt, Pseudomonas aeruginosa PA01
gaucuggcugccc

SEQ ID NO: 3508904 - RNA, 17 nt, Pseudomonas aeruginosa PA01
gaucugguggaacagca

SEQ ID NO: 3508905 - RNA, 17 nt, Pseudomonas aeruginosa PA01
gaucugucgauaccagc

SEQ ID NO: 3508906 - RNA, 20 nt, Pseudomonas aeruginosa PA01
gaucugucgauaccagcgcc

SEQ ID NO: 3508907 - RNA, 21 nt, Pseudomonas aeruginosa PA01
gaucugucgauaccagcgccg

SEQ ID NO: 3508908 - RNA, 22 nt, Pseudomonas aeruginosa PA01
gaucugucgauaccagcgccgc

SEQ ID NO: 3508909 - RNA, 15 nt, Pseudomonas aeruginosa PA01
gaucugugcgagcgc

SEQ ID NO: 3508910 - RNA, 16 nt, Pseudomonas aeruginosa PA01
gaucuguucgaccagu

SEQ ID NO: 3508911 - RNA, 19 nt, Pseudomonas aeruginosa PA01
gaucuguuucaacucccag

SEQ ID NO: 3508912 - RNA, 17 nt, Pseudomonas aeruginosa PA01
gaucuucuaccuggcgc

SEQ ID NO: 3508913 - RNA, 21 nt, Pseudomonas aeruginosa PA01
gaucuucuccgccgcgugcgc

SEQ ID NO: 3508914 - RNA, 12 nt, Pseudomonas aeruginosa PA01
gaucuucugcac

SEQ ID NO: 3508915 - RNA, 17 nt, Pseudomonas aeruginosa PA01
gaucuucuuccccgcca

SEQ ID NO: 3508916 - RNA, 19 nt, Pseudomonas aeruginosa PA01
gaucuugaucugcaugccg

SEQ ID NO: 3508917 - RNA, 13 nt, Pseudomonas aeruginosa PA01
gaucuugcgcccg

SEQ ID NO: 3508918 - RNA, 16 nt, Pseudomonas aeruginosa PA01
gaucuugcgcccggcg

SEQ ID NO: 3508919 - RNA, 21 nt, Pseudomonas aeruginosa PA01
gaucuugcgcccggcgcgacc

SEQ ID NO: 3508920 - RNA, 13 nt, Pseudomonas aeruginosa PA01
gaucuuguagccg

SEQ ID NO: 3508921 - RNA, 13 nt, Pseudomonas aeruginosa PA01
gaugaaaccggcc

SEQ ID NO: 3508922 - RNA, 19 nt, Pseudomonas aeruginosa PA01
gaugaaacgcagggccgga

SEQ ID NO: 3508923 - RNA, 15 nt, Pseudomonas aeruginosa PA01
gaugaaacugcccgg

SEQ ID NO: 3508924 - RNA, 12 nt, Pseudomonas aeruginosa PA01
gaugaaauagcu

SEQ ID NO: 3508925 - RNA, 16 nt, Pseudomonas aeruginosa PA01
gaugaacaaccgcuug

SEQ ID NO: 3508926 - RNA, 22 nt, Pseudomonas aeruginosa PA01
gaugaacaagugcucgauggcg

SEQ ID NO: 3508927 - RNA, 20 nt, Pseudomonas aeruginosa PA01
gaugaacagcgacucgaugc

SEQ ID NO: 3508928 - RNA, 17 nt, Pseudomonas aeruginosa PA01
gaugaacgacuccagcu

SEQ ID NO: 3508929 - RNA, 22 nt, Pseudomonas aeruginosa PA01
gaugaacucgacuucuucgcug

SEQ ID NO: 3508930 - RNA, 19 nt, Pseudomonas aeruginosa PA01
gaugaacuggucgcuccag

SEQ ID NO: 3508931 - RNA, 21 nt, Pseudomonas aeruginosa PA01
gaugaacuggucgcuccagcc

SEQ ID NO: 3508932 - RNA, 22 nt, Pseudomonas aeruginosa PA01
gaugaagaagccauugccgaug

SEQ ID NO: 3508933 - RNA, 22 nt, Pseudomonas aeruginosa PA01
gaugaagcacaccuccagcggc

SEQ ID NO: 3508934 - RNA, 13 nt, Pseudomonas aeruginosa PA01
gaugaagccgcga

SEQ ID NO: 3508935 - RNA, 12 nt, Pseudomonas aeruginosa PA01
gaugaagcgccg

SEQ ID NO: 3508936 - RNA, 16 nt, Pseudomonas aeruginosa PA01
gaugaagcgccgcagu

SEQ ID NO: 3508937 - RNA, 12 nt, Pseudomonas aeruginosa PA01
gaugaaucgccu

SEQ ID NO: 3508938 - RNA, 19 nt, Pseudomonas aeruginosa PA01
gaugaccacgucgcgaccg

SEQ ID NO: 3508939 - RNA, 19 nt, Pseudomonas aeruginosa PA01
gaugaccaggguggcggcg

SEQ ID NO: 3508940 - RNA, 20 nt, Pseudomonas aeruginosa PA01
gaugaccaggguggcggcgg

SEQ ID NO: 3508941 - RNA, 17 nt, Pseudomonas aeruginosa PA01
gaugaccccggcgaugc

SEQ ID NO: 3508942 - RNA, 14 nt, Pseudomonas aeruginosa PA01
gaugacgaacugca

SEQ ID NO: 3508943 - RNA, 15 nt, Pseudomonas aeruginosa PA01
gaugacgauggccgc

SEQ ID NO: 3508944 - RNA, 17 nt, Pseudomonas aeruginosa PA01
gaugacguugcugcccu

SEQ ID NO: 3508945 - RNA, 23 nt, Pseudomonas aeruginosa PA01
gaugacguugcugcccuggcgcg

SEQ ID NO: 3508946 - RNA, 15 nt, Pseudomonas aeruginosa PA01
gaugagcuucgccgg

SEQ ID NO: 3508947 - RNA, 21 nt, Pseudomonas aeruginosa PA01
gaugaggcuguccagcaggcg

SEQ ID NO: 3508948 - RNA, 20 nt, Pseudomonas aeruginosa PA01
gaugauacgcacgcuggugc

SEQ ID NO: 3508949 - RNA, 12 nt, Pseudomonas aeruginosa PA01
gaugaucagccc

SEQ ID NO: 3508950 - RNA, 13 nt, Pseudomonas aeruginosa PA01
gaugaucagcccu

SEQ ID NO: 3508951 - RNA, 22 nt, Pseudomonas aeruginosa PA01
gaugaucaggccgagcaccggc

SEQ ID NO: 3508952 - RNA, 20 nt, Pseudomonas aeruginosa PA01
gaugaucagggcaccgccga

SEQ ID NO: 3508953 - RNA, 18 nt, Pseudomonas aeruginosa PA01
gaugauccacuugccgcc

SEQ ID NO: 3508954 - RNA, 23 nt, Pseudomonas aeruginosa PA01
gaugauccgcucgaucccggcgc

SEQ ID NO: 3508955 - RNA, 17 nt, Pseudomonas aeruginosa PA01
gaugaucgccaccgggu

SEQ ID NO: 3508956 - RNA, 12 nt, Pseudomonas aeruginosa PA01
gaugaucgccga

SEQ ID NO: 3508957 - RNA, 15 nt, Pseudomonas aeruginosa PA01
gaugaucggcagccg

SEQ ID NO: 3508958 - RNA, 21 nt, Pseudomonas aeruginosa PA01
gaugaucggcagccguccgcc

SEQ ID NO: 3508959 - RNA, 20 nt, Pseudomonas aeruginosa PA01
gaugaucgguucccgcccgc

SEQ ID NO: 3508960 - RNA, 17 nt, Pseudomonas aeruginosa PA01
gaugaucuccgcgccgg

SEQ ID NO: 3508961 - RNA, 17 nt, Pseudomonas aeruginosa PA01
gaugauggucaacacca

SEQ ID NO: 3508962 - RNA, 14 nt, Pseudomonas aeruginosa PA01
gaugcacaccagcu

SEQ ID NO: 3508963 - RNA, 23 nt, Pseudomonas aeruginosa PA01
gaugcacaccagcuccccguccc

SEQ ID NO: 3508964 - RNA, 14 nt, Pseudomonas aeruginosa PA01
gaugcaccggccac

SEQ ID NO: 3508965 - RNA, 21 nt, Pseudomonas aeruginosa PA01
gaugcaccggccacucgcagc

SEQ ID NO: 3508966 - RNA, 21 nt, Pseudomonas aeruginosa PA01
gaugcacgugcagcucggcac

SEQ ID NO: 3508967 - RNA, 18 nt, Pseudomonas aeruginosa PA01
gaugcacguugggauagc

SEQ ID NO: 3508968 - RNA, 17 nt, Pseudomonas aeruginosa PA01
gaugcagauccagcggc

SEQ ID NO: 3508969 - RNA, 15 nt, Pseudomonas aeruginosa PA01
gaugcagccgauggc

SEQ ID NO: 3508970 - RNA, 19 nt, Pseudomonas aeruginosa PA01
gaugcagccggggcucagg

SEQ ID NO: 3508971 - RNA, 18 nt, Pseudomonas aeruginosa PA01
gaugcagcgucgcgcguc

SEQ ID NO: 3508972 - RNA, 19 nt, Pseudomonas aeruginosa PA01
gaugcagucccgccaggcg

SEQ ID NO: 3508973 - RNA, 21 nt, Pseudomonas aeruginosa PA01
gaugcagucccgccaggcgcc

SEQ ID NO: 3508974 - RNA, 23 nt, Pseudomonas aeruginosa PA01
gaugcagucccgccaggcgccga

SEQ ID NO: 3508975 - RNA, 15 nt, Pseudomonas aeruginosa PA01
gaugcagucggcacc

SEQ ID NO: 3508976 - RNA, 17 nt, Pseudomonas aeruginosa PA01
gaugcagucggcaccga

SEQ ID NO: 3508977 - RNA, 22 nt, Pseudomonas aeruginosa PA01
gaugcaguugagucgcgcgcgc

SEQ ID NO: 3508978 - RNA, 13 nt, Pseudomonas aeruginosa PA01
gaugccaccgcuc

SEQ ID NO: 3508979 - RNA, 19 nt, Pseudomonas aeruginosa PA01
gaugccacugacgcgcagc

SEQ ID NO: 3508980 - RNA, 22 nt, Pseudomonas aeruginosa PA01
gaugccacugacgcgcagcgcc

SEQ ID NO: 3508981 - RNA, 23 nt, Pseudomonas aeruginosa PA01
gaugccacugacgcgcagcgccg

SEQ ID NO: 3508982 - RNA, 24 nt, Pseudomonas aeruginosa PA01
gaugccacugacgcgcagcgccgc

SEQ ID NO: 3508983 - RNA, 22 nt, Pseudomonas aeruginosa PA01
gaugccaucgaggccaggccga

SEQ ID NO: 3508984 - RNA, 17 nt, Pseudomonas aeruginosa PA01
gaugcccagccagggcc

SEQ ID NO: 3508985 - RNA, 19 nt, Pseudomonas aeruginosa PA01
gaugcccagccagggccgc

SEQ ID NO: 3508986 - RNA, 21 nt, Pseudomonas aeruginosa PA01
gaugcccagccagggccgcga

SEQ ID NO: 3508987 - RNA, 19 nt, Pseudomonas aeruginosa PA01
gaugcccagcggcgccagc

SEQ ID NO: 3508988 - RNA, 14 nt, Pseudomonas aeruginosa PA01
gaugcccaggccgc

SEQ ID NO: 3508989 - RNA, 14 nt, Pseudomonas aeruginosa PA01
gaugcccgccagca

SEQ ID NO: 3508990 - RNA, 16 nt, Pseudomonas aeruginosa PA01
gaugcccgccagcagg

SEQ ID NO: 3508991 - RNA, 17 nt, Pseudomonas aeruginosa PA01
gaugcccgccagcaggc

SEQ ID NO: 3508992 - RNA, 22 nt, Pseudomonas aeruginosa PA01
gaugcccgccagcaggcgccgg

SEQ ID NO: 3508993 - RNA, 17 nt, Pseudomonas aeruginosa PA01
gaugcccgccucgcgca

SEQ ID NO: 3508994 - RNA, 16 nt, Pseudomonas aeruginosa PA01
gaugcccggccgcagg

SEQ ID NO: 3508995 - RNA, 20 nt, Pseudomonas aeruginosa PA01
gaugcccggccgcaggcagc

SEQ ID NO: 3508996 - RNA, 14 nt, Pseudomonas aeruginosa PA01
gaugcccucgcggc

SEQ ID NO: 3508997 - RNA, 18 nt, Pseudomonas aeruginosa PA01
gaugcccucgcggcggca

SEQ ID NO: 3508998 - RNA, 15 nt, Pseudomonas aeruginosa PA01
gaugcccuggccgcu

SEQ ID NO: 3508999 - RNA, 17 nt, Pseudomonas aeruginosa PA01
gaugcccuggccgcugc

SEQ ID NO: 3509000 - RNA, 23 nt, Pseudomonas aeruginosa PA01
gaugcccuggcuuuccagggccu

SEQ ID NO: 3509001 - RNA, 16 nt, Pseudomonas aeruginosa PA01
gaugcccuuggccagc

SEQ ID NO: 3509002 - RNA, 17 nt, Pseudomonas aeruginosa PA01
gaugccgaacaccugca

SEQ ID NO: 3509003 - RNA, 19 nt, Pseudomonas aeruginosa PA01
gaugccgaacaccugcauc

SEQ ID NO: 3509004 - RNA, 18 nt, Pseudomonas aeruginosa PA01
gaugccgaaggcgugggc

SEQ ID NO: 3509005 - RNA, 23 nt, Pseudomonas aeruginosa PA01
gaugccgaaggcgugggcgccgg

SEQ ID NO: 3509006 - RNA, 18 nt, Pseudomonas aeruginosa PA01
gaugccgagguguagaaa

SEQ ID NO: 3509007 - RNA, 21 nt, Pseudomonas aeruginosa PA01
gaugccgagguguagaaaccg

SEQ ID NO: 3509008 - RNA, 16 nt, Pseudomonas aeruginosa PA01
gaugccgaucucgccc

SEQ ID NO: 3509009 - RNA, 17 nt, Pseudomonas aeruginosa PA01
gaugccgaucucgccca

SEQ ID NO: 3509010 - RNA, 13 nt, Pseudomonas aeruginosa PA01
gaugccgauggcg

SEQ ID NO: 3509011 - RNA, 19 nt, Pseudomonas aeruginosa PA01
gaugccgauggcgccgccg

SEQ ID NO: 3509012 - RNA, 20 nt, Pseudomonas aeruginosa PA01
gaugccgcacaggcuggcca

SEQ ID NO: 3509013 - RNA, 14 nt, Pseudomonas aeruginosa PA01
gaugccgcccagca

SEQ ID NO: 3509014 - RNA, 16 nt, Pseudomonas aeruginosa PA01
gaugccgcccagcacc

SEQ ID NO: 3509015 - RNA, 18 nt, Pseudomonas aeruginosa PA01
gaugccgcccugcggcag

SEQ ID NO: 3509016 - RNA, 20 nt, Pseudomonas aeruginosa PA01
gaugccgcccugcggcaggc

SEQ ID NO: 3509017 - RNA, 13 nt, Pseudomonas aeruginosa PA01
gaugccgccgacc

SEQ ID NO: 3509018 - RNA, 22 nt, Pseudomonas aeruginosa PA01
gaugccgccgaccucggccgcc

SEQ ID NO: 3509019 - RNA, 23 nt, Pseudomonas aeruginosa PA01
gaugccgccgaccucggccgcca

SEQ ID NO: 3509020 - RNA, 15 nt, Pseudomonas aeruginosa PA01
gaugccgccgccgcc

SEQ ID NO: 3509021 - RNA, 22 nt, Pseudomonas aeruginosa PA01
gaugccgccgccgccccagcaa

SEQ ID NO: 3509022 - RNA, 18 nt, Pseudomonas aeruginosa PA01
gaugccgccugcgucagc

SEQ ID NO: 3509023 - RNA, 24 nt, Pseudomonas aeruginosa PA01
gaugccgccugcgucagcgaggcg

SEQ ID NO: 3509024 - RNA, 14 nt, Pseudomonas aeruginosa PA01
gaugccgcgagcca

SEQ ID NO: 3509025 - RNA, 17 nt, Pseudomonas aeruginosa PA01
gaugccgcgagccagcc

SEQ ID NO: 3509026 - RNA, 22 nt, Pseudomonas aeruginosa PA01
gaugccgcgagccagccguggc

SEQ ID NO: 3509027 - RNA, 15 nt, Pseudomonas aeruginosa PA01
gaugccgcgccaggc

SEQ ID NO: 3509028 - RNA, 13 nt, Pseudomonas aeruginosa PA01
gaugccgcgccgg

SEQ ID NO: 3509029 - RNA, 16 nt, Pseudomonas aeruginosa PA01
gaugccgcgcgccugg

SEQ ID NO: 3509030 - RNA, 19 nt, Pseudomonas aeruginosa PA01
gaugccgcgguaggucagc

SEQ ID NO: 3509031 - RNA, 14 nt, Pseudomonas aeruginosa PA01
gaugccgcgucggc

SEQ ID NO: 3509032 - RNA, 18 nt, Pseudomonas aeruginosa PA01
gaugccggaaagccuggc

SEQ ID NO: 3509033 - RNA, 20 nt, Pseudomonas aeruginosa PA01
gaugccggaaagccuggccg

SEQ ID NO: 3509034 - RNA, 21 nt, Pseudomonas aeruginosa PA01
gaugccggaaagccuggccgg

SEQ ID NO: 3509035 - RNA, 22 nt, Pseudomonas aeruginosa PA01
gaugccggaaagccuggccggc

SEQ ID NO: 3509036 - RNA, 21 nt, Pseudomonas aeruginosa PA01
gaugccggccggcagcgagcg

SEQ ID NO: 3509037 - RNA, 14 nt, Pseudomonas aeruginosa PA01
gaugccggccucga

SEQ ID NO: 3509038 - RNA, 12 nt, Pseudomonas aeruginosa PA01
gaugccggcgau

SEQ ID NO: 3509039 - RNA, 17 nt, Pseudomonas aeruginosa PA01
gaugccggcgaugaugg

SEQ ID NO: 3509040 - RNA, 23 nt, Pseudomonas aeruginosa PA01
gaugccggcgcugucucgccagc

SEQ ID NO: 3509041 - RNA, 24 nt, Pseudomonas aeruginosa PA01
gaugccggcgcugucucgccagcc

SEQ ID NO: 3509042 - RNA, 17 nt, Pseudomonas aeruginosa PA01
gaugccggugcuggugc

SEQ ID NO: 3509043 - RNA, 20 nt, Pseudomonas aeruginosa PA01
gaugccguuaccuuggccac

SEQ ID NO: 3509044 - RNA, 23 nt, Pseudomonas aeruginosa PA01
gaugccguuguggcaggcgcugc

SEQ ID NO: 3509045 - RNA, 17 nt, Pseudomonas aeruginosa PA01
gaugccuucggcggccg

SEQ ID NO: 3509046 - RNA, 18 nt, Pseudomonas aeruginosa PA01
gaugccuucggcggccgg

SEQ ID NO: 3509047 - RNA, 19 nt, Pseudomonas aeruginosa PA01
gaugccuucggcggccggg

SEQ ID NO: 3509048 - RNA, 15 nt, Pseudomonas aeruginosa PA01
gaugcgcaacgggcg

SEQ ID NO: 3509049 - RNA, 19 nt, Pseudomonas aeruginosa PA01
gaugcgcaacgggcggcgg

SEQ ID NO: 3509050 - RNA, 23 nt, Pseudomonas aeruginosa PA01
gaugcgcagcuugcucgaugcca

SEQ ID NO: 3509051 - RNA, 14 nt, Pseudomonas aeruginosa PA01
gaugcgcaggccgg

SEQ ID NO: 3509052 - RNA, 12 nt, Pseudomonas aeruginosa PA01
gaugcgccagcg

SEQ ID NO: 3509053 - RNA, 18 nt, Pseudomonas aeruginosa PA01
gaugcgccagcggcccgg

SEQ ID NO: 3509054 - RNA, 17 nt, Pseudomonas aeruginosa PA01
gaugcgccccagcgccu

SEQ ID NO: 3509055 - RNA, 15 nt, Pseudomonas aeruginosa PA01
gaugcgcccggagcu

SEQ ID NO: 3509056 - RNA, 13 nt, Pseudomonas aeruginosa PA01
gaugcgccgcagg

SEQ ID NO: 3509057 - RNA, 14 nt, Pseudomonas aeruginosa PA01
gaugcgccgcaggu

SEQ ID NO: 3509058 - RNA, 22 nt, Pseudomonas aeruginosa PA01
gaugcgccgguccuuguccggg

SEQ ID NO: 3509059 - RNA, 13 nt, Pseudomonas aeruginosa PA01
gaugcgccucagc

SEQ ID NO: 3509060 - RNA, 23 nt, Pseudomonas aeruginosa PA01
gaugcgcgaauaccgcgcgcgca

SEQ ID NO: 3509061 - RNA, 17 nt, Pseudomonas aeruginosa PA01
gaugcgcgacucgaagc

SEQ ID NO: 3509062 - RNA, 20 nt, Pseudomonas aeruginosa PA01
gaugcgcgacucgaagcucu

SEQ ID NO: 3509063 - RNA, 21 nt, Pseudomonas aeruginosa PA01
gaugcgcgaggucugugccgu

SEQ ID NO: 3509064 - RNA, 15 nt, Pseudomonas aeruginosa PA01
gaugcgcgcccugac

SEQ ID NO: 3509065 - RNA, 15 nt, Pseudomonas aeruginosa PA01
gaugcgcgcggcgag

SEQ ID NO: 3509066 - RNA, 16 nt, Pseudomonas aeruginosa PA01
gaugcgcgcggcgagg

SEQ ID NO: 3509067 - RNA, 16 nt, Pseudomonas aeruginosa PA01
gaugcgcggcagcagg

SEQ ID NO: 3509068 - RNA, 13 nt, Pseudomonas aeruginosa PA01
gaugcgcggcagg

SEQ ID NO: 3509069 - RNA, 19 nt, Pseudomonas aeruginosa PA01
gaugcgcggcagguagccg

SEQ ID NO: 3509070 - RNA, 17 nt, Pseudomonas aeruginosa PA01
gaugcgcgucgccgaac

SEQ ID NO: 3509071 - RNA, 13 nt, Pseudomonas aeruginosa PA01
gaugcgcguggca

SEQ ID NO: 3509072 - RNA, 22 nt, Pseudomonas aeruginosa PA01
gaugcgcuacggcaucaccggc

SEQ ID NO: 3509073 - RNA, 21 nt, Pseudomonas aeruginosa PA01
gaugcgcuuuuccucgaccca

SEQ ID NO: 3509074 - RNA, 16 nt, Pseudomonas aeruginosa PA01
gaugcggauguaguuc

SEQ ID NO: 3509075 - RNA, 16 nt, Pseudomonas aeruginosa PA01
gaugcggcccgccggc

SEQ ID NO: 3509076 - RNA, 17 nt, Pseudomonas aeruginosa PA01
gaugcggcccgccggcg

SEQ ID NO: 3509077 - RNA, 13 nt, Pseudomonas aeruginosa PA01
gaugcggcgcugc

SEQ ID NO: 3509078 - RNA, 13 nt, Pseudomonas aeruginosa PA01
gaugcggcugugc

SEQ ID NO: 3509079 - RNA, 17 nt, Pseudomonas aeruginosa PA01
gaugcggcugugcucga

SEQ ID NO: 3509080 - RNA, 22 nt, Pseudomonas aeruginosa PA01
gaugcggcugugcucgaggaag

SEQ ID NO: 3509081 - RNA, 14 nt, Pseudomonas aeruginosa PA01
gaugcggggcgacc

SEQ ID NO: 3509082 - RNA, 15 nt, Pseudomonas aeruginosa PA01
gaugcggggcgacca

SEQ ID NO: 3509083 - RNA, 16 nt, Pseudomonas aeruginosa PA01
gaugcggggcgaccag

SEQ ID NO: 3509084 - RNA, 17 nt, Pseudomonas aeruginosa PA01
gaugcggggcgaccagc

SEQ ID NO: 3509085 - RNA, 19 nt, Pseudomonas aeruginosa PA01
gaugcgguuccuggcugga

SEQ ID NO: 3509086 - RNA, 15 nt, Pseudomonas aeruginosa PA01
gaugcguccgcgcag

SEQ ID NO: 3509087 - RNA, 19 nt, Pseudomonas aeruginosa PA01
gaugcguuccagggcgaag

SEQ ID NO: 3509088 - RNA, 15 nt, Pseudomonas aeruginosa PA01
gaugcguucgaugga

SEQ ID NO: 3509089 - RNA, 13 nt, Pseudomonas aeruginosa PA01
gaugcguugcacg

SEQ ID NO: 3509090 - RNA, 22 nt, Pseudomonas aeruginosa PA01
gaugcguugcucgcaccaggcc

SEQ ID NO: 3509091 - RNA, 22 nt, Pseudomonas aeruginosa PA01
gaugcguuugucgaccugcccc

SEQ ID NO: 3509092 - RNA, 21 nt, Pseudomonas aeruginosa PA01
gaugcuaucgcguggcugccg

SEQ ID NO: 3509093 - RNA, 14 nt, Pseudomonas aeruginosa PA01
gaugcucagcgccg

SEQ ID NO: 3509094 - RNA, 14 nt, Pseudomonas aeruginosa PA01
gaugcucaggcgcu

SEQ ID NO: 3509095 - RNA, 14 nt, Pseudomonas aeruginosa PA01
gaugcuccagggag

SEQ ID NO: 3509096 - RNA, 14 nt, Pseudomonas aeruginosa PA01
gaugcuccagguuc

SEQ ID NO: 3509097 - RNA, 13 nt, Pseudomonas aeruginosa PA01
gaugcucccgagc

SEQ ID NO: 3509098 - RNA, 14 nt, Pseudomonas aeruginosa PA01
gaugcucccgagca

SEQ ID NO: 3509099 - RNA, 16 nt, Pseudomonas aeruginosa PA01
gaugcucccgagcaag

SEQ ID NO: 3509100 - RNA, 15 nt, Pseudomonas aeruginosa PA01
gaugcucgcgccagc

SEQ ID NO: 3509101 - RNA, 16 nt, Pseudomonas aeruginosa PA01
gaugcucgcgccagcc

SEQ ID NO: 3509102 - RNA, 12 nt, Pseudomonas aeruginosa PA01
gaugcucggugu

SEQ ID NO: 3509103 - RNA, 22 nt, Pseudomonas aeruginosa PA01
gaugcucggugugaucaccagc

SEQ ID NO: 3509104 - RNA, 21 nt, Pseudomonas aeruginosa PA01
gaugcucgguugccaggccgg

SEQ ID NO: 3509105 - RNA, 22 nt, Pseudomonas aeruginosa PA01
gaugcugaacuguucgaucucg

SEQ ID NO: 3509106 - RNA, 17 nt, Pseudomonas aeruginosa PA01
gaugcugaucacccgcc

SEQ ID NO: 3509107 - RNA, 16 nt, Pseudomonas aeruginosa PA01
gaugcugcacagccau

SEQ ID NO: 3509108 - RNA, 13 nt, Pseudomonas aeruginosa PA01
gaugcugcgggcg

SEQ ID NO: 3509109 - RNA, 18 nt, Pseudomonas aeruginosa PA01
gaugcuggagcuugccgg

SEQ ID NO: 3509110 - RNA, 19 nt, Pseudomonas aeruginosa PA01
gaugcuggcaacggcgggc

SEQ ID NO: 3509111 - RNA, 21 nt, Pseudomonas aeruginosa PA01
gaugcuggcaacggcgggccg

SEQ ID NO: 3509112 - RNA, 22 nt, Pseudomonas aeruginosa PA01
gaugcuggcaacggcgggccgc

SEQ ID NO: 3509113 - RNA, 21 nt, Pseudomonas aeruginosa PA01
gaugcuguaguugacgucgcc

SEQ ID NO: 3509114 - RNA, 23 nt, Pseudomonas aeruginosa PA01
gaugcuguaguugacgucgccga

SEQ ID NO: 3509115 - RNA, 19 nt, Pseudomonas aeruginosa PA01
gaugcuguauuccuugcgg

SEQ ID NO: 3509116 - RNA, 16 nt, Pseudomonas aeruginosa PA01
gaugcugucagcgccc

SEQ ID NO: 3509117 - RNA, 14 nt, Pseudomonas aeruginosa PA01
gaugcugucccaac

SEQ ID NO: 3509118 - RNA, 15 nt, Pseudomonas aeruginosa PA01
gaugcuguggguggu

SEQ ID NO: 3509119 - RNA, 21 nt, Pseudomonas aeruginosa PA01
gauggaaaucggccacuccag

SEQ ID NO: 3509120 - RNA, 24 nt, Pseudomonas aeruginosa PA01
gauggaacgaagaaccccggccau

SEQ ID NO: 3509121 - RNA, 16 nt, Pseudomonas aeruginosa PA01
gauggauacccuucau

SEQ ID NO: 3509122 - RNA, 16 nt, Pseudomonas aeruginosa PA01
gauggccagccaggac

SEQ ID NO: 3509123 - RNA, 17 nt, Pseudomonas aeruginosa PA01
gauggccagccaggaca

SEQ ID NO: 3509124 - RNA, 22 nt, Pseudomonas aeruginosa PA01
gauggccagcccggagccguug

SEQ ID NO: 3509125 - RNA, 13 nt, Pseudomonas aeruginosa PA01
gauggccagcgcg

SEQ ID NO: 3509126 - RNA, 20 nt, Pseudomonas aeruginosa PA01
gauggccaucagggucggcc

SEQ ID NO: 3509127 - RNA, 22 nt, Pseudomonas aeruginosa PA01
gauggccccggcgauccgcgca

SEQ ID NO: 3509128 - RNA, 19 nt, Pseudomonas aeruginosa PA01
gauggcccguuccaccgcc

SEQ ID NO: 3509129 - RNA, 20 nt, Pseudomonas aeruginosa PA01
gauggccgccagcaggccga

SEQ ID NO: 3509130 - RNA, 19 nt, Pseudomonas aeruginosa PA01
gauggccgccgccgccguc

SEQ ID NO: 3509131 - RNA, 20 nt, Pseudomonas aeruginosa PA01
gauggccgccgccgccgucg

SEQ ID NO: 3509132 - RNA, 21 nt, Pseudomonas aeruginosa PA01
gauggccgccgccgccgucga

SEQ ID NO: 3509133 - RNA, 12 nt, Pseudomonas aeruginosa PA01
gauggccgccgu

SEQ ID NO: 3509134 - RNA, 15 nt, Pseudomonas aeruginosa PA01
gauggccgccguucu

SEQ ID NO: 3509135 - RNA, 12 nt, Pseudomonas aeruginosa PA01
gauggccgccug

SEQ ID NO: 3509136 - RNA, 14 nt, Pseudomonas aeruginosa PA01
gauggccggcacca

SEQ ID NO: 3509137 - RNA, 15 nt, Pseudomonas aeruginosa PA01
gauggccggcaccag

SEQ ID NO: 3509138 - RNA, 21 nt, Pseudomonas aeruginosa PA01
gauggccggcagcagcgccag

SEQ ID NO: 3509139 - RNA, 12 nt, Pseudomonas aeruginosa PA01
gauggccggcgc

SEQ ID NO: 3509140 - RNA, 16 nt, Pseudomonas aeruginosa PA01
gauggccggcggagau

SEQ ID NO: 3509141 - RNA, 17 nt, Pseudomonas aeruginosa PA01
gauggccguccaggcug

SEQ ID NO: 3509142 - RNA, 20 nt, Pseudomonas aeruginosa PA01
gauggccguccaggcugccg

SEQ ID NO: 3509143 - RNA, 21 nt, Pseudomonas aeruginosa PA01
gauggccguccaggcugccgc

SEQ ID NO: 3509144 - RNA, 21 nt, Pseudomonas aeruginosa PA01
gauggccguccucgucgaggu

SEQ ID NO: 3509145 - RNA, 20 nt, Pseudomonas aeruginosa PA01
gauggccuggucggcgcggc

SEQ ID NO: 3509146 - RNA, 23 nt, Pseudomonas aeruginosa PA01
gauggcgaacaugaagccgcgcg

SEQ ID NO: 3509147 - RNA, 13 nt, Pseudomonas aeruginosa PA01
gauggcgaagccg

SEQ ID NO: 3509148 - RNA, 14 nt, Pseudomonas aeruginosa PA01
gauggcgaagccga

SEQ ID NO: 3509149 - RNA, 15 nt, Pseudomonas aeruginosa PA01
gauggcgauauggcc

SEQ ID NO: 3509150 - RNA, 17 nt, Pseudomonas aeruginosa PA01
gauggcgauauggccgu

SEQ ID NO: 3509151 - RNA, 17 nt, Pseudomonas aeruginosa PA01
gauggcgcaccacugca

SEQ ID NO: 3509152 - RNA, 22 nt, Pseudomonas aeruginosa PA01
gauggcgccauugugcgcgcgc

SEQ ID NO: 3509153 - RNA, 14 nt, Pseudomonas aeruginosa PA01
gauggcgccgccga

SEQ ID NO: 3509154 - RNA, 16 nt, Pseudomonas aeruginosa PA01
gauggcgccgccgagg

SEQ ID NO: 3509155 - RNA, 13 nt, Pseudomonas aeruginosa PA01
gauggcgccgcga

SEQ ID NO: 3509156 - RNA, 18 nt, Pseudomonas aeruginosa PA01
gauggcgccgcgauggua

SEQ ID NO: 3509157 - RNA, 13 nt, Pseudomonas aeruginosa PA01
gauggcgcggggc

SEQ ID NO: 3509158 - RNA, 15 nt, Pseudomonas aeruginosa PA01
gauggcgcgguccgc

SEQ ID NO: 3509159 - RNA, 19 nt, Pseudomonas aeruginosa PA01
gauggcgcggugggccuug

SEQ ID NO: 3509160 - RNA, 22 nt, Pseudomonas aeruginosa PA01
gauggcgcugccaaacgccguc

SEQ ID NO: 3509161 - RNA, 18 nt, Pseudomonas aeruginosa PA01
gauggcgcuggaacagcg

SEQ ID NO: 3509162 - RNA, 22 nt, Pseudomonas aeruginosa PA01
gauggcggcauugagcgccagc

SEQ ID NO: 3509163 - RNA, 14 nt, Pseudomonas aeruginosa PA01
gauggcggccgcca

SEQ ID NO: 3509164 - RNA, 14 nt, Pseudomonas aeruginosa PA01
gauggcggccuggu

SEQ ID NO: 3509165 - RNA, 16 nt, Pseudomonas aeruginosa PA01
gauggcguccaccgcu

SEQ ID NO: 3509166 - RNA, 22 nt, Pseudomonas aeruginosa PA01
gauggcgugaaguagccgccgg

SEQ ID NO: 3509167 - RNA, 23 nt, Pseudomonas aeruginosa PA01
gauggcguuugcgucauccgccu

SEQ ID NO: 3509168 - RNA, 17 nt, Pseudomonas aeruginosa PA01
gauggcuaaacaagcca

SEQ ID NO: 3509169 - RNA, 13 nt, Pseudomonas aeruginosa PA01
gauggcucgcggc

SEQ ID NO: 3509170 - RNA, 12 nt, Pseudomonas aeruginosa PA01
gauggcugaccc

SEQ ID NO: 3509171 - RNA, 15 nt, Pseudomonas aeruginosa PA01
gauggcuggucaggc

SEQ ID NO: 3509172 - RNA, 13 nt, Pseudomonas aeruginosa PA01
gauggcuucgagg

SEQ ID NO: 3509173 - RNA, 16 nt, Pseudomonas aeruginosa PA01
gauggcuucgaggcgg

SEQ ID NO: 3509174 - RNA, 19 nt, Pseudomonas aeruginosa PA01
gauggcuucgaggcgggcg

SEQ ID NO: 3509175 - RNA, 20 nt, Pseudomonas aeruginosa PA01
gaugggaacgaguugggcga

SEQ ID NO: 3509176 - RNA, 19 nt, Pseudomonas aeruginosa PA01
gaugggcacgaucugcgcc

SEQ ID NO: 3509177 - RNA, 21 nt, Pseudomonas aeruginosa PA01
gaugggcacgaucugcgccgc

SEQ ID NO: 3509178 - RNA, 22 nt, Pseudomonas aeruginosa PA01
gaugggcacgaucugcgccgca

SEQ ID NO: 3509179 - RNA, 14 nt, Pseudomonas aeruginosa PA01
gaugggccguaggu

SEQ ID NO: 3509180 - RNA, 14 nt, Pseudomonas aeruginosa PA01
gaugggcgagcgac

SEQ ID NO: 3509181 - RNA, 20 nt, Pseudomonas aeruginosa PA01
gauggguaucaugcgccccg

SEQ ID NO: 3509182 - RNA, 21 nt, Pseudomonas aeruginosa PA01
gaugguaguccgcugcgagca

SEQ ID NO: 3509183 - RNA, 15 nt, Pseudomonas aeruginosa PA01
gauggucaacaccag

SEQ ID NO: 3509184 - RNA, 17 nt, Pseudomonas aeruginosa PA01
gauggucaacaccagcg

SEQ ID NO: 3509185 - RNA, 21 nt, Pseudomonas aeruginosa PA01
gauggucaacaccagcgccgc

SEQ ID NO: 3509186 - RNA, 17 nt, Pseudomonas aeruginosa PA01
gauggucacgccgaggc

SEQ ID NO: 3509187 - RNA, 21 nt, Pseudomonas aeruginosa PA01
gauggucacuggcgaggcugc

SEQ ID NO: 3509188 - RNA, 12 nt, Pseudomonas aeruginosa PA01
gauggucaggcu

SEQ ID NO: 3509189 - RNA, 16 nt, Pseudomonas aeruginosa PA01
gauggucaggcuggug

SEQ ID NO: 3509190 - RNA, 21 nt, Pseudomonas aeruginosa PA01
gaugguccccggccccgcggu

SEQ ID NO: 3509191 - RNA, 16 nt, Pseudomonas aeruginosa PA01
gauggucgagggcgcg

SEQ ID NO: 3509192 - RNA, 11 nt, Pseudomonas aeruginosa PA01
gauggucgccg

SEQ ID NO: 3509193 - RNA, 22 nt, Pseudomonas aeruginosa PA01
gauggucgccggagucguagcg

SEQ ID NO: 3509194 - RNA, 23 nt, Pseudomonas aeruginosa PA01
gauggugaucacgucggcgucca

SEQ ID NO: 3509195 - RNA, 18 nt, Pseudomonas aeruginosa PA01
gauggugcgcucgcggac

SEQ ID NO: 3509196 - RNA, 12 nt, Pseudomonas aeruginosa PA01
gauggugcgcuu

SEQ ID NO: 3509197 - RNA, 13 nt, Pseudomonas aeruginosa PA01
gauggugcggugg

SEQ ID NO: 3509198 - RNA, 20 nt, Pseudomonas aeruginosa PA01
gauggugcgguggcuggcgu

SEQ ID NO: 3509199 - RNA, 16 nt, Pseudomonas aeruginosa PA01
gaugguggucggcagc

SEQ ID NO: 3509200 - RNA, 18 nt, Pseudomonas aeruginosa PA01
gauggugugcagcagcac

SEQ ID NO: 3509201 - RNA, 21 nt, Pseudomonas aeruginosa PA01
gaugguuugaaggucggcgca

SEQ ID NO: 3509202 - RNA, 22 nt, Pseudomonas aeruginosa PA01
gauguacggcaccaccaccgac

SEQ ID NO: 3509203 - RNA, 18 nt, Pseudomonas aeruginosa PA01
gauguacucgcggccgaa

SEQ ID NO: 3509204 - RNA, 17 nt, Pseudomonas aeruginosa PA01
gauguagcggaaguuca

SEQ ID NO: 3509205 - RNA, 13 nt, Pseudomonas aeruginosa PA01
gauguagcugccg

SEQ ID NO: 3509206 - RNA, 13 nt, Pseudomonas aeruginosa PA01
gauguaggacagg

SEQ ID NO: 3509207 - RNA, 14 nt, Pseudomonas aeruginosa PA01
gauguaggacgccu

SEQ ID NO: 3509208 - RNA, 14 nt, Pseudomonas aeruginosa PA01
gauguaggccucgg

SEQ ID NO: 3509209 - RNA, 20 nt, Pseudomonas aeruginosa PA01
gauguaggucaccgcgccgg

SEQ ID NO: 3509210 - RNA, 17 nt, Pseudomonas aeruginosa PA01
gauguaguagacguccu

SEQ ID NO: 3509211 - RNA, 16 nt, Pseudomonas aeruginosa PA01
gauguaguccagcgcc

SEQ ID NO: 3509212 - RNA, 18 nt, Pseudomonas aeruginosa PA01
gauguaguccagcgccgc

SEQ ID NO: 3509213 - RNA, 21 nt, Pseudomonas aeruginosa PA01
gauguccaucagccgcgcgcu

SEQ ID NO: 3509214 - RNA, 18 nt, Pseudomonas aeruginosa PA01
gauguccccggccagcag

SEQ ID NO: 3509215 - RNA, 20 nt, Pseudomonas aeruginosa PA01
gauguccccggccagcagcg

SEQ ID NO: 3509216 - RNA, 20 nt, Pseudomonas aeruginosa PA01
gauguccuggaucggcagcu

SEQ ID NO: 3509217 - RNA, 23 nt, Pseudomonas aeruginosa PA01
gauguccugggccaccuggcucu

SEQ ID NO: 3509218 - RNA, 19 nt, Pseudomonas aeruginosa PA01
gaugucgaacaacccgcca

SEQ ID NO: 3509219 - RNA, 21 nt, Pseudomonas aeruginosa PA01
gaugucgaacaacccgccagc

SEQ ID NO: 3509220 - RNA, 19 nt, Pseudomonas aeruginosa PA01
gaugucgaccacgaucucg

SEQ ID NO: 3509221 - RNA, 21 nt, Pseudomonas aeruginosa PA01
gaugucgaccuggguaccgac

SEQ ID NO: 3509222 - RNA, 15 nt, Pseudomonas aeruginosa PA01
gaugucgcggcaggc

SEQ ID NO: 3509223 - RNA, 17 nt, Pseudomonas aeruginosa PA01
gaugucgcggcaggcgg

SEQ ID NO: 3509224 - RNA, 19 nt, Pseudomonas aeruginosa PA01
gaugucgcggcaggcggcg

SEQ ID NO: 3509225 - RNA, 20 nt, Pseudomonas aeruginosa PA01
gaugucgcggcugacgaagu

SEQ ID NO: 3509226 - RNA, 13 nt, Pseudomonas aeruginosa PA01
gaugucgcuggcc

SEQ ID NO: 3509227 - RNA, 20 nt, Pseudomonas aeruginosa PA01
gaugucggcgaacuggccac

SEQ ID NO: 3509228 - RNA, 19 nt, Pseudomonas aeruginosa PA01
gaugucggcgcugucgccg

SEQ ID NO: 3509229 - RNA, 22 nt, Pseudomonas aeruginosa PA01
gaugucgggcucgacgaggaac

SEQ ID NO: 3509230 - RNA, 16 nt, Pseudomonas aeruginosa PA01
gaugucguagccgcgc

SEQ ID NO: 3509231 - RNA, 19 nt, Pseudomonas aeruginosa PA01
gaugugagccccaugccgu

SEQ ID NO: 3509232 - RNA, 13 nt, Pseudomonas aeruginosa PA01
gaugugcaccagc

SEQ ID NO: 3509233 - RNA, 14 nt, Pseudomonas aeruginosa PA01
gaugugcaccagca

SEQ ID NO: 3509234 - RNA, 23 nt, Pseudomonas aeruginosa PA01
gaugugcaguucgaccuccaggc

SEQ ID NO: 3509235 - RNA, 17 nt, Pseudomonas aeruginosa PA01
gauguggcuggugaugc

SEQ ID NO: 3509236 - RNA, 16 nt, Pseudomonas aeruginosa PA01
gauguucgaggcgccg

SEQ ID NO: 3509237 - RNA, 22 nt, Pseudomonas aeruginosa PA01
gauguucgccacgcugcugccg

SEQ ID NO: 3509238 - RNA, 23 nt, Pseudomonas aeruginosa PA01
gauguucgccacgcugcugccgg

SEQ ID NO: 3509239 - RNA, 14 nt, Pseudomonas aeruginosa PA01
gauguucgccgcca

SEQ ID NO: 3509240 - RNA, 18 nt, Pseudomonas aeruginosa PA01
gauguucgccgccaccac

SEQ ID NO: 3509241 - RNA, 18 nt, Pseudomonas aeruginosa PA01
gauguugaacagcgccgg

SEQ ID NO: 3509242 - RNA, 15 nt, Pseudomonas aeruginosa PA01
gauguugacgauggc

SEQ ID NO: 3509243 - RNA, 19 nt, Pseudomonas aeruginosa PA01
gauguugccgccgccgagg

SEQ ID NO: 3509244 - RNA, 13 nt, Pseudomonas aeruginosa PA01
gauguugcgcagg

SEQ ID NO: 3509245 - RNA, 15 nt, Pseudomonas aeruginosa PA01
gauuacuuggcuuca

SEQ ID NO: 3509246 - RNA, 20 nt, Pseudomonas aeruginosa PA01
gauuaucugcgacugacggu

SEQ ID NO: 3509247 - RNA, 14 nt, Pseudomonas aeruginosa PA01
gauucaggcgcgcu

SEQ ID NO: 3509248 - RNA, 22 nt, Pseudomonas aeruginosa PA01
gauucaggcggcgaaagccauc

SEQ ID NO: 3509249 - RNA, 14 nt, Pseudomonas aeruginosa PA01
gauucaucggcggc

SEQ ID NO: 3509250 - RNA, 21 nt, Pseudomonas aeruginosa PA01
gauucaucggcggcaggccga

SEQ ID NO: 3509251 - RNA, 13 nt, Pseudomonas aeruginosa PA01
gauuccacccgcu

SEQ ID NO: 3509252 - RNA, 17 nt, Pseudomonas aeruginosa PA01
gauuccacccgcuccgc

SEQ ID NO: 3509253 - RNA, 23 nt, Pseudomonas aeruginosa PA01
gauuccacccgcuccgcggccgg

SEQ ID NO: 3509254 - RNA, 18 nt, Pseudomonas aeruginosa PA01
gauucccagugcucccgc

SEQ ID NO: 3509255 - RNA, 19 nt, Pseudomonas aeruginosa PA01
gauucccagugcucccgca

SEQ ID NO: 3509256 - RNA, 19 nt, Pseudomonas aeruginosa PA01
gauucccgaggguggcgcu

SEQ ID NO: 3509257 - RNA, 14 nt, Pseudomonas aeruginosa PA01
gauuccgcgcaccu

SEQ ID NO: 3509258 - RNA, 20 nt, Pseudomonas aeruginosa PA01
gauuccucuauccggcacca

SEQ ID NO: 3509259 - RNA, 17 nt, Pseudomonas aeruginosa PA01
gauuccuggaccccgcc

SEQ ID NO: 3509260 - RNA, 16 nt, Pseudomonas aeruginosa PA01
gauuccugucuccgca

SEQ ID NO: 3509261 - RNA, 17 nt, Pseudomonas aeruginosa PA01
gauuccugucuccgcac

SEQ ID NO: 3509262 - RNA, 22 nt, Pseudomonas aeruginosa PA01
gauucgaaccacugcgccaugc

SEQ ID NO: 3509263 - RNA, 13 nt, Pseudomonas aeruginosa PA01
gauucgacgcagc

SEQ ID NO: 3509264 - RNA, 17 nt, Pseudomonas aeruginosa PA01
gauucgacgcagcgcgc

SEQ ID NO: 3509265 - RNA, 20 nt, Pseudomonas aeruginosa PA01
gauucgccagccucggcgaa

SEQ ID NO: 3509266 - RNA, 20 nt, Pseudomonas aeruginosa PA01
gauucgccggccaccaggcu

SEQ ID NO: 3509267 - RNA, 14 nt, Pseudomonas aeruginosa PA01
gauucgcggcgaca

SEQ ID NO: 3509268 - RNA, 22 nt, Pseudomonas aeruginosa PA01
gauucguccggagccgggcaac

SEQ ID NO: 3509269 - RNA, 18 nt, Pseudomonas aeruginosa PA01
gauucguucgagcagcuc

SEQ ID NO: 3509270 - RNA, 19 nt, Pseudomonas aeruginosa PA01
gauucguugaggcccauca

SEQ ID NO: 3509271 - RNA, 13 nt, Pseudomonas aeruginosa PA01
gauucucucccag

SEQ ID NO: 3509272 - RNA, 14 nt, Pseudomonas aeruginosa PA01
gauucugcaggcgc

SEQ ID NO: 3509273 - RNA, 17 nt, Pseudomonas aeruginosa PA01
gauugagggucagcuug

SEQ ID NO: 3509274 - RNA, 19 nt, Pseudomonas aeruginosa PA01
gauugcagcuccuggucgc

SEQ ID NO: 3509275 - RNA, 22 nt, Pseudomonas aeruginosa PA01
gauugcagcuccuggucgcggg

SEQ ID NO: 3509276 - RNA, 20 nt, Pseudomonas aeruginosa PA01
gauugcagguaguucuccag

SEQ ID NO: 3509277 - RNA, 18 nt, Pseudomonas aeruginosa PA01
gauugcguacgcccagca

SEQ ID NO: 3509278 - RNA, 15 nt, Pseudomonas aeruginosa PA01
gauuggagaugcuca

SEQ ID NO: 3509279 - RNA, 20 nt, Pseudomonas aeruginosa PA01
gauuggagaugcucaggcgc

SEQ ID NO: 3509280 - RNA, 11 nt, Pseudomonas aeruginosa PA01
gauuggccggg

SEQ ID NO: 3509281 - RNA, 14 nt, Pseudomonas aeruginosa PA01
gauuguccaccggc

SEQ ID NO: 3509282 - RNA, 13 nt, Pseudomonas aeruginosa PA01
gauugugcagggc

SEQ ID NO: 3509283 - RNA, 16 nt, Pseudomonas aeruginosa PA01
gauugugcagggccgc

SEQ ID NO: 3509284 - RNA, 18 nt, Pseudomonas aeruginosa PA01
gauuuacggauucucucc

SEQ ID NO: 3509285 - RNA, 16 nt, Pseudomonas aeruginosa PA01
gauuucagcaggccga

SEQ ID NO: 3509286 - RNA, 17 nt, Pseudomonas aeruginosa PA01
gauuucagcuucaucgc

SEQ ID NO: 3509287 - RNA, 17 nt, Pseudomonas aeruginosa PA01
gauuuccgauccuccug

SEQ ID NO: 3509288 - RNA, 15 nt, Pseudomonas aeruginosa PA01
gauuuccgcggccgg

SEQ ID NO: 3509289 - RNA, 18 nt, Pseudomonas aeruginosa PA01
gauuuccggcuugccgau

SEQ ID NO: 3509290 - RNA, 12 nt, Pseudomonas aeruginosa PA01
gauuucgccgag

SEQ ID NO: 3509291 - RNA, 15 nt, Pseudomonas aeruginosa PA01
gauuucuucagccug

SEQ ID NO: 3509292 - RNA, 14 nt, Pseudomonas aeruginosa PA01
gauuugcccggcga

SEQ ID NO: 3509293 - RNA, 15 nt, Pseudomonas aeruginosa PA01
gauuugccgccgagg

SEQ ID NO: 3509294 - RNA, 18 nt, Pseudomonas aeruginosa PA01
gauuuucuccggcgccgg

SEQ ID NO: 3509295 - RNA, 14 nt, Pseudomonas aeruginosa PA01
gauuuugggcagcg

SEQ ID NO: 3509296 - RNA, 15 nt, Pseudomonas aeruginosa PA01
gauuuugggcucaga

SEQ ID NO: 3509297 - RNA, 12 nt, Pseudomonas aeruginosa PA01
gcaaaaaaaggg

SEQ ID NO: 3509298 - RNA, 15 nt, Pseudomonas aeruginosa PA01
gcaaaaaaaggggau

SEQ ID NO: 3509299 - RNA, 17 nt, Pseudomonas aeruginosa PA01
gcaaaaaagcgcgcccg

SEQ ID NO: 3509300 - RNA, 18 nt, Pseudomonas aeruginosa PA01
gcaaaagaaaacgcccgg

SEQ ID NO: 3509301 - RNA, 23 nt, Pseudomonas aeruginosa PA01
gcaaaagaaaacgcccggcaucu

SEQ ID NO: 3509302 - RNA, 14 nt, Pseudomonas aeruginosa PA01
gcaaacccauuucc

SEQ ID NO: 3509303 - RNA, 15 nt, Pseudomonas aeruginosa PA01
gcaaaccucccgggc

SEQ ID NO: 3509304 - RNA, 16 nt, Pseudomonas aeruginosa PA01
gcaaacgccauccgcc

SEQ ID NO: 3509305 - RNA, 13 nt, Pseudomonas aeruginosa PA01
gcaaacgccgcca

SEQ ID NO: 3509306 - RNA, 14 nt, Pseudomonas aeruginosa PA01
gcaaacgccgccac

SEQ ID NO: 3509307 - RNA, 15 nt, Pseudomonas aeruginosa PA01
gcaaagaggcgcuca

SEQ ID NO: 3509308 - RNA, 22 nt, Pseudomonas aeruginosa PA01
gcaaagcccgcuuuccccggcg

SEQ ID NO: 3509309 - RNA, 19 nt, Pseudomonas aeruginosa PA01
gcaaagcgagcgcccgccg

SEQ ID NO: 3509310 - RNA, 15 nt, Pseudomonas aeruginosa PA01
gcaaagcggcgacgc

SEQ ID NO: 3509311 - RNA, 17 nt, Pseudomonas aeruginosa PA01
gcaaagcggcgacgcca

SEQ ID NO: 3509312 - RNA, 15 nt, Pseudomonas aeruginosa PA01
gcaaaggcccggcgc

SEQ ID NO: 3509313 - RNA, 15 nt, Pseudomonas aeruginosa PA01
gcaaaggcgcgcagg

SEQ ID NO: 3509314 - RNA, 16 nt, Pseudomonas aeruginosa PA01
gcaaaggcgcgcaggg

SEQ ID NO: 3509315 - RNA, 21 nt, Pseudomonas aeruginosa PA01
gcaaagugcggucggaucgga

SEQ ID NO: 3509316 - RNA, 14 nt, Pseudomonas aeruginosa PA01
gcaacacaugcagg

SEQ ID NO: 3509317 - RNA, 15 nt, Pseudomonas aeruginosa PA01
gcaacacaugcaggc

SEQ ID NO: 3509318 - RNA, 16 nt, Pseudomonas aeruginosa PA01
gcaacaccaucggccc

SEQ ID NO: 3509319 - RNA, 14 nt, Pseudomonas aeruginosa PA01
gcaacacccaggcc

SEQ ID NO: 3509320 - RNA, 17 nt, Pseudomonas aeruginosa PA01
gcaacacccaggccugg

SEQ ID NO: 3509321 - RNA, 18 nt, Pseudomonas aeruginosa PA01
gcaacacccaggccuggg

SEQ ID NO: 3509322 - RNA, 14 nt, Pseudomonas aeruginosa PA01
gcaacaccgcgcag

SEQ ID NO: 3509323 - RNA, 20 nt, Pseudomonas aeruginosa PA01
gcaacaccgcgcagaugauc

SEQ ID NO: 3509324 - RNA, 15 nt, Pseudomonas aeruginosa PA01
gcaacaccuggcgcu

SEQ ID NO: 3509325 - RNA, 20 nt, Pseudomonas aeruginosa PA01
gcaacaccuugcgcaccgcc

SEQ ID NO: 3509326 - RNA, 19 nt, Pseudomonas aeruginosa PA01
gcaacacgucggacuugcg

SEQ ID NO: 3509327 - RNA, 20 nt, Pseudomonas aeruginosa PA01
gcaacagaaguugcuggcga

SEQ ID NO: 3509328 - RNA, 18 nt, Pseudomonas aeruginosa PA01
gcaacagaucuuccucgg

SEQ ID NO: 3509329 - RNA, 15 nt, Pseudomonas aeruginosa PA01
gcaacagcaggagaa

SEQ ID NO: 3509330 - RNA, 24 nt, Pseudomonas aeruginosa PA01
gcaacagcaggagaagcgccucgc

SEQ ID NO: 3509331 - RNA, 16 nt, Pseudomonas aeruginosa PA01
gcaacagcccgcgccg

SEQ ID NO: 3509332 - RNA, 17 nt, Pseudomonas aeruginosa PA01
gcaacagcccgcgccgc

SEQ ID NO: 3509333 - RNA, 15 nt, Pseudomonas aeruginosa PA01
gcaacagcgccgcgc

SEQ ID NO: 3509334 - RNA, 18 nt, Pseudomonas aeruginosa PA01
gcaacagcgccgcgcgcu

SEQ ID NO: 3509335 - RNA, 18 nt, Pseudomonas aeruginosa PA01
gcaacagcgcggcggugc

SEQ ID NO: 3509336 - RNA, 18 nt, Pseudomonas aeruginosa PA01
gcaacagcgucgccaacg

SEQ ID NO: 3509337 - RNA, 15 nt, Pseudomonas aeruginosa PA01
gcaacaggacccagc

SEQ ID NO: 3509338 - RNA, 16 nt, Pseudomonas aeruginosa PA01
gcaacaggacccagcc

SEQ ID NO: 3509339 - RNA, 18 nt, Pseudomonas aeruginosa PA01
gcaacagggcauuggcca

SEQ ID NO: 3509340 - RNA, 22 nt, Pseudomonas aeruginosa PA01
gcaacaguggguaggccaggca

SEQ ID NO: 3509341 - RNA, 17 nt, Pseudomonas aeruginosa PA01
gcaacaguucugccgca

SEQ ID NO: 3509342 - RNA, 17 nt, Pseudomonas aeruginosa PA01
gcaacaguugccgcagc

SEQ ID NO: 3509343 - RNA, 21 nt, Pseudomonas aeruginosa PA01
gcaacaguugccgcagcagcg

SEQ ID NO: 3509344 - RNA, 22 nt, Pseudomonas aeruginosa PA01
gcaacaguugccgcagcagcgg

SEQ ID NO: 3509345 - RNA, 23 nt, Pseudomonas aeruginosa PA01
gcaacaguugccgcagcagcggc

SEQ ID NO: 3509346 - RNA, 15 nt, Pseudomonas aeruginosa PA01
gcaacauggcgucgg

SEQ ID NO: 3509347 - RNA, 18 nt, Pseudomonas aeruginosa PA01
gcaacauggcgucggcga

SEQ ID NO: 3509348 - RNA, 22 nt, Pseudomonas aeruginosa PA01
gcaacauggcgucggcgaucac

SEQ ID NO: 3509349 - RNA, 17 nt, Pseudomonas aeruginosa PA01
gcaaccagaccagcagg

SEQ ID NO: 3509350 - RNA, 18 nt, Pseudomonas aeruginosa PA01
gcaaccagcccuggcgca

SEQ ID NO: 3509351 - RNA, 23 nt, Pseudomonas aeruginosa PA01
gcaaccagcgcucguagccggcg

SEQ ID NO: 3509352 - RNA, 16 nt, Pseudomonas aeruginosa PA01
gcaacccagggcgcug

SEQ ID NO: 3509353 - RNA, 21 nt, Pseudomonas aeruginosa PA01
gcaaccccgaaggaucgggga

SEQ ID NO: 3509354 - RNA, 20 nt, Pseudomonas aeruginosa PA01
gcaaccccuucggucgcgcc

SEQ ID NO: 3509355 - RNA, 20 nt, Pseudomonas aeruginosa PA01
gcaacccgcccuugcucgcg

SEQ ID NO: 3509356 - RNA, 22 nt, Pseudomonas aeruginosa PA01
gcaacccgcccuugcucgcggc

SEQ ID NO: 3509357 - RNA, 14 nt, Pseudomonas aeruginosa PA01
gcaacccgccgcug

SEQ ID NO: 3509358 - RNA, 18 nt, Pseudomonas aeruginosa PA01
gcaacccgcuccgucgcu

SEQ ID NO: 3509359 - RNA, 16 nt, Pseudomonas aeruginosa PA01
gcaacccggcccagcg

SEQ ID NO: 3509360 - RNA, 13 nt, Pseudomonas aeruginosa PA01
gcaacccugccca

SEQ ID NO: 3509361 - RNA, 21 nt, Pseudomonas aeruginosa PA01
gcaacccugcccagugggcca

SEQ ID NO: 3509362 - RNA, 23 nt, Pseudomonas aeruginosa PA01
gcaacccuuugauggcgcugcca

SEQ ID NO: 3509363 - RNA, 19 nt, Pseudomonas aeruginosa PA01
gcaaccgauauggcuggcg

SEQ ID NO: 3509364 - RNA, 20 nt, Pseudomonas aeruginosa PA01
gcaaccgcagacuccggcgc

SEQ ID NO: 3509365 - RNA, 12 nt, Pseudomonas aeruginosa PA01
gcaaccgccgcc

SEQ ID NO: 3509366 - RNA, 21 nt, Pseudomonas aeruginosa PA01
gcaaccgccgccgcaaccgcc

SEQ ID NO: 3509367 - RNA, 18 nt, Pseudomonas aeruginosa PA01
gcaaccgcgauggcguga

SEQ ID NO: 3509368 - RNA, 16 nt, Pseudomonas aeruginosa PA01
gcaaccgcggcggccu

SEQ ID NO: 3509369 - RNA, 15 nt, Pseudomonas aeruginosa PA01
gcaaccgcugccgcc

SEQ ID NO: 3509370 - RNA, 16 nt, Pseudomonas aeruginosa PA01
gcaaccgcugccgccg

SEQ ID NO: 3509371 - RNA, 17 nt, Pseudomonas aeruginosa PA01
gcaaccgcugccgccgu

SEQ ID NO: 3509372 - RNA, 18 nt, Pseudomonas aeruginosa PA01
gcaaccggguaccugcuc

SEQ ID NO: 3509373 - RNA, 20 nt, Pseudomonas aeruginosa PA01
gcaaccggguaccugcucgc

SEQ ID NO: 3509374 - RNA, 22 nt, Pseudomonas aeruginosa PA01
gcaaccggguaccugcucgcgg

SEQ ID NO: 3509375 - RNA, 18 nt, Pseudomonas aeruginosa PA01
gcaaccgguccucgcccg

SEQ ID NO: 3509376 - RNA, 17 nt, Pseudomonas aeruginosa PA01
gcaaccgucgaacaggu

SEQ ID NO: 3509377 - RNA, 23 nt, Pseudomonas aeruginosa PA01
gcaaccgucgaacagguggcuuu

SEQ ID NO: 3509378 - RNA, 15 nt, Pseudomonas aeruginosa PA01
gcaaccguuccagcg

SEQ ID NO: 3509379 - RNA, 18 nt, Pseudomonas aeruginosa PA01
gcaaccugccagaaaacc

SEQ ID NO: 3509380 - RNA, 22 nt, Pseudomonas aeruginosa PA01
gcaaccuugcacauccagcccu

SEQ ID NO: 3509381 - RNA, 18 nt, Pseudomonas aeruginosa PA01
gcaacgaaaaagggcggc

SEQ ID NO: 3509382 - RNA, 19 nt, Pseudomonas aeruginosa PA01
gcaacgaaaaagggcggcc

SEQ ID NO: 3509383 - RNA, 21 nt, Pseudomonas aeruginosa PA01
gcaacgaaaaagggcggccac

SEQ ID NO: 3509384 - RNA, 22 nt, Pseudomonas aeruginosa PA01
gcaacgaaaaagggcggccacc

SEQ ID NO: 3509385 - RNA, 16 nt, Pseudomonas aeruginosa PA01
gcaacgacgaggccug

SEQ ID NO: 3509386 - RNA, 19 nt, Pseudomonas aeruginosa PA01
gcaacgauaccgccgccgg

SEQ ID NO: 3509387 - RNA, 20 nt, Pseudomonas aeruginosa PA01
gcaacgauaccgccgccggc

SEQ ID NO: 3509388 - RNA, 22 nt, Pseudomonas aeruginosa PA01
gcaacgauucgacgcagcgcgc

SEQ ID NO: 3509389 - RNA, 20 nt, Pseudomonas aeruginosa PA01
gcaacgcaggucaugaagga

SEQ ID NO: 3509390 - RNA, 18 nt, Pseudomonas aeruginosa PA01
gcaacgccagcaggcgca

SEQ ID NO: 3509391 - RNA, 20 nt, Pseudomonas aeruginosa PA01
gcaacgccagcaggcgcagg

SEQ ID NO: 3509392 - RNA, 12 nt, Pseudomonas aeruginosa PA01
gcaacgccaggc

SEQ ID NO: 3509393 - RNA, 13 nt, Pseudomonas aeruginosa PA01
gcaacgccaggcu

SEQ ID NO: 3509394 - RNA, 18 nt, Pseudomonas aeruginosa PA01
gcaacgccaggcugucag

SEQ ID NO: 3509395 - RNA, 16 nt, Pseudomonas aeruginosa PA01
gcaacgcccgcgagcc

SEQ ID NO: 3509396 - RNA, 12 nt, Pseudomonas aeruginosa PA01
gcaacgccgacg

SEQ ID NO: 3509397 - RNA, 14 nt, Pseudomonas aeruginosa PA01
gcaacgccgacggc

SEQ ID NO: 3509398 - RNA, 15 nt, Pseudomonas aeruginosa PA01
gcaacgccgacggcg

SEQ ID NO: 3509399 - RNA, 19 nt, Pseudomonas aeruginosa PA01
gcaacgccgacggcgugcc

SEQ ID NO: 3509400 - RNA, 12 nt, Pseudomonas aeruginosa PA01
gcaacgccgcca

SEQ ID NO: 3509401 - RNA, 14 nt, Pseudomonas aeruginosa PA01
gcaacgccgccaac

SEQ ID NO: 3509402 - RNA, 15 nt, Pseudomonas aeruginosa PA01
gcaacgccgccaacu

SEQ ID NO: 3509403 - RNA, 16 nt, Pseudomonas aeruginosa PA01
gcaacgccgccaacug

SEQ ID NO: 3509404 - RNA, 18 nt, Pseudomonas aeruginosa PA01
gcaacgccgccaacuggc

SEQ ID NO: 3509405 - RNA, 16 nt, Pseudomonas aeruginosa PA01
gcaacgccgcccccag

SEQ ID NO: 3509406 - RNA, 19 nt, Pseudomonas aeruginosa PA01
gcaacgccgcccccagcgc

SEQ ID NO: 3509407 - RNA, 24 nt, Pseudomonas aeruginosa PA01
gcaacgccgcccccagcgcgccgc

SEQ ID NO: 3509408 - RNA, 14 nt, Pseudomonas aeruginosa PA01
gcaacgccggcagg

SEQ ID NO: 3509409 - RNA, 18 nt, Pseudomonas aeruginosa PA01
gcaacgcgcccacuccuc

SEQ ID NO: 3509410 - RNA, 14 nt, Pseudomonas aeruginosa PA01
gcaacgcgcgcagg

SEQ ID NO: 3509411 - RNA, 18 nt, Pseudomonas aeruginosa PA01
gcaacgcggagcaggcgg

SEQ ID NO: 3509412 - RNA, 21 nt, Pseudomonas aeruginosa PA01
gcaacgcggagcaggcggaga

SEQ ID NO: 3509413 - RNA, 13 nt, Pseudomonas aeruginosa PA01
gcaacgcggcguc

SEQ ID NO: 3509414 - RNA, 16 nt, Pseudomonas aeruginosa PA01
gcaacgcggcgucagg

SEQ ID NO: 3509415 - RNA, 17 nt, Pseudomonas aeruginosa PA01
gcaacgcuguccgccau

SEQ ID NO: 3509416 - RNA, 18 nt, Pseudomonas aeruginosa PA01
gcaacgcuuccagcaccu

SEQ ID NO: 3509417 - RNA, 16 nt, Pseudomonas aeruginosa PA01
gcaacggaaacacagc

SEQ ID NO: 3509418 - RNA, 22 nt, Pseudomonas aeruginosa PA01
gcaacggacguuccaccuggcg

SEQ ID NO: 3509419 - RNA, 23 nt, Pseudomonas aeruginosa PA01
gcaacggacguuccaccuggcgc

SEQ ID NO: 3509420 - RNA, 12 nt, Pseudomonas aeruginosa PA01
gcaacggcacga

SEQ ID NO: 3509421 - RNA, 22 nt, Pseudomonas aeruginosa PA01
gcaacgggacgccaggcguccc

SEQ ID NO: 3509422 - RNA, 18 nt, Pseudomonas aeruginosa PA01
gcaacgguuccaugcgaa

SEQ ID NO: 3509423 - RNA, 20 nt, Pseudomonas aeruginosa PA01
gcaacgucaggcuguagccu

SEQ ID NO: 3509424 - RNA, 15 nt, Pseudomonas aeruginosa PA01
gcaacguccucgcgc

SEQ ID NO: 3509425 - RNA, 17 nt, Pseudomonas aeruginosa PA01
gcaacguccucgcgccg

SEQ ID NO: 3509426 - RNA, 21 nt, Pseudomonas aeruginosa PA01
gcaacucgaaaaugucggugc

SEQ ID NO: 3509427 - RNA, 14 nt, Pseudomonas aeruginosa PA01
gcaacucgccgccg

SEQ ID NO: 3509428 - RNA, 13 nt, Pseudomonas aeruginosa PA01
gcaacucggcggc

SEQ ID NO: 3509429 - RNA, 18 nt, Pseudomonas aeruginosa PA01
gcaacucggcgucgcgcu

SEQ ID NO: 3509430 - RNA, 22 nt, Pseudomonas aeruginosa PA01
gcaacucggcgucgcgcuugcc

SEQ ID NO: 3509431 - RNA, 13 nt, Pseudomonas aeruginosa PA01
gcaacucgucguc

SEQ ID NO: 3509432 - RNA, 21 nt, Pseudomonas aeruginosa PA01
gcaacucgucguccagcggcu

SEQ ID NO: 3509433 - RNA, 23 nt, Pseudomonas aeruginosa PA01
gcaacucuuccagggucggcacc

SEQ ID NO: 3509434 - RNA, 13 nt, Pseudomonas aeruginosa PA01
gcaacugaccugg

SEQ ID NO: 3509435 - RNA, 17 nt, Pseudomonas aeruginosa PA01
gcaacugaccuggccgu

SEQ ID NO: 3509436 - RNA, 18 nt, Pseudomonas aeruginosa PA01
gcaacugaccuggccguc

SEQ ID NO: 3509437 - RNA, 14 nt, Pseudomonas aeruginosa PA01
gcaacugacggcgg

SEQ ID NO: 3509438 - RNA, 18 nt, Pseudomonas aeruginosa PA01
gcaacugacggcggaagg

SEQ ID NO: 3509439 - RNA, 17 nt, Pseudomonas aeruginosa PA01
gcaacugaucagccggg

SEQ ID NO: 3509440 - RNA, 17 nt, Pseudomonas aeruginosa PA01
gcaacugcauguugccg

SEQ ID NO: 3509441 - RNA, 19 nt, Pseudomonas aeruginosa PA01
gcaacugccaaccgcgcuc

SEQ ID NO: 3509442 - RNA, 22 nt, Pseudomonas aeruginosa PA01
gcaacugccaaccgcgcucggc

SEQ ID NO: 3509443 - RNA, 13 nt, Pseudomonas aeruginosa PA01
gcaacugccgccc

SEQ ID NO: 3509444 - RNA, 14 nt, Pseudomonas aeruginosa PA01
gcaacugcgccagc

SEQ ID NO: 3509445 - RNA, 18 nt, Pseudomonas aeruginosa PA01
gcaacugcggggcgcuca

SEQ ID NO: 3509446 - RNA, 12 nt, Pseudomonas aeruginosa PA01
gcaacuggaagg

SEQ ID NO: 3509447 - RNA, 17 nt, Pseudomonas aeruginosa PA01
gcaacuggaaggccgcg

SEQ ID NO: 3509448 - RNA, 20 nt, Pseudomonas aeruginosa PA01
gcaacuggaaggccgcgccg

SEQ ID NO: 3509449 - RNA, 14 nt, Pseudomonas aeruginosa PA01
gcaacuggccgaga

SEQ ID NO: 3509450 - RNA, 14 nt, Pseudomonas aeruginosa PA01
gcaacuggcuggcc

SEQ ID NO: 3509451 - RNA, 16 nt, Pseudomonas aeruginosa PA01
gcaacuggucgcggcu

SEQ ID NO: 3509452 - RNA, 17 nt, Pseudomonas aeruginosa PA01
gcaacuggucgcggcug

SEQ ID NO: 3509453 - RNA, 18 nt, Pseudomonas aeruginosa PA01
gcaacuggucgcggcugc

SEQ ID NO: 3509454 - RNA, 20 nt, Pseudomonas aeruginosa PA01
gcaagaguguucccucagga

SEQ ID NO: 3509455 - RNA, 20 nt, Pseudomonas aeruginosa PA01
gcaagcaccuugagggccuu

SEQ ID NO: 3509456 - RNA, 15 nt, Pseudomonas aeruginosa PA01
gcaagcaggccgcgg

SEQ ID NO: 3509457 - RNA, 18 nt, Pseudomonas aeruginosa PA01
gcaagcccaagggcuccg

SEQ ID NO: 3509458 - RNA, 20 nt, Pseudomonas aeruginosa PA01
gcaagcccgugggaucgcca

SEQ ID NO: 3509459 - RNA, 12 nt, Pseudomonas aeruginosa PA01
gcaagccgcagc

SEQ ID NO: 3509460 - RNA, 16 nt, Pseudomonas aeruginosa PA01
gcaagccgcagcgccc

SEQ ID NO: 3509461 - RNA, 17 nt, Pseudomonas aeruginosa PA01
gcaagccgcagcgcccc

SEQ ID NO: 3509462 - RNA, 15 nt, Pseudomonas aeruginosa PA01
gcaagccuggcgcgc

SEQ ID NO: 3509463 - RNA, 20 nt, Pseudomonas aeruginosa PA01
gcaagcgaucucucagucca

SEQ ID NO: 3509464 - RNA, 16 nt, Pseudomonas aeruginosa PA01
gcaagcgcccggcgaa

SEQ ID NO: 3509465 - RNA, 14 nt, Pseudomonas aeruginosa PA01
gcaagcgccggcaa

SEQ ID NO: 3509466 - RNA, 16 nt, Pseudomonas aeruginosa PA01
gcaagcgccggcaaca

SEQ ID NO: 3509467 - RNA, 19 nt, Pseudomonas aeruginosa PA01
gcaagcgccggcaacagca

SEQ ID NO: 3509468 - RNA, 21 nt, Pseudomonas aeruginosa PA01
gcaagcgccggcaacagcagc

SEQ ID NO: 3509469 - RNA, 15 nt, Pseudomonas aeruginosa PA01
gcaagcggcggcuuc

SEQ ID NO: 3509470 - RNA, 22 nt, Pseudomonas aeruginosa PA01
gcaagcgguauugucgaugggc

SEQ ID NO: 3509471 - RNA, 18 nt, Pseudomonas aeruginosa PA01
gcaagcgguuauucgccc

SEQ ID NO: 3509472 - RNA, 22 nt, Pseudomonas aeruginosa PA01
gcaagcgguuauucgcccuacc

SEQ ID NO: 3509473 - RNA, 19 nt, Pseudomonas aeruginosa PA01
gcaagcuccccgccgccag

SEQ ID NO: 3509474 - RNA, 15 nt, Pseudomonas aeruginosa PA01
gcaagcucgacgagc

SEQ ID NO: 3509475 - RNA, 19 nt, Pseudomonas aeruginosa PA01
gcaagcucgucacccgcgc

SEQ ID NO: 3509476 - RNA, 23 nt, Pseudomonas aeruginosa PA01
gcaagcugaagcgccgcggcccg

SEQ ID NO: 3509477 - RNA, 13 nt, Pseudomonas aeruginosa PA01
gcaaggaccugcu

SEQ ID NO: 3509478 - RNA, 14 nt, Pseudomonas aeruginosa PA01
gcaaggaccugcug

SEQ ID NO: 3509479 - RNA, 21 nt, Pseudomonas aeruginosa PA01
gcaaggaccugcugcccggca

SEQ ID NO: 3509480 - RNA, 13 nt, Pseudomonas aeruginosa PA01
gcaaggagcccuu

SEQ ID NO: 3509481 - RNA, 16 nt, Pseudomonas aeruginosa PA01
gcaaggcacacgcccg

SEQ ID NO: 3509482 - RNA, 17 nt, Pseudomonas aeruginosa PA01
gcaaggcacacgcccgg

SEQ ID NO: 3509483 - RNA, 15 nt, Pseudomonas aeruginosa PA01
gcaaggccaagucgg

SEQ ID NO: 3509484 - RNA, 21 nt, Pseudomonas aeruginosa PA01
gcaaggccaagucggccgccc

SEQ ID NO: 3509485 - RNA, 14 nt, Pseudomonas aeruginosa PA01
gcaaggccagcggc

SEQ ID NO: 3509486 - RNA, 21 nt, Pseudomonas aeruginosa PA01
gcaaggccagggcggcgccga

SEQ ID NO: 3509487 - RNA, 17 nt, Pseudomonas aeruginosa PA01
gcaaggccgaagaggcc

SEQ ID NO: 3509488 - RNA, 15 nt, Pseudomonas aeruginosa PA01
gcaaggcgaucccgg

SEQ ID NO: 3509489 - RNA, 16 nt, Pseudomonas aeruginosa PA01
gcaaggcgaucccggc

SEQ ID NO: 3509490 - RNA, 17 nt, Pseudomonas aeruginosa PA01
gcaaggcgaucccggcg

SEQ ID NO: 3509491 - RNA, 12 nt, Pseudomonas aeruginosa PA01
gcaaggcgcuga

SEQ ID NO: 3509492 - RNA, 19 nt, Pseudomonas aeruginosa PA01
gcaaggcgcugaagcggcc

SEQ ID NO: 3509493 - RNA, 13 nt, Pseudomonas aeruginosa PA01
gcaaggcggccuc

SEQ ID NO: 3509494 - RNA, 18 nt, Pseudomonas aeruginosa PA01
gcaaggcuucggcgguca

SEQ ID NO: 3509495 - RNA, 22 nt, Pseudomonas aeruginosa PA01
gcaaggcuucggcggucaggcu

SEQ ID NO: 3509496 - RNA, 18 nt, Pseudomonas aeruginosa PA01
gcaagggcacgugcagcg

SEQ ID NO: 3509497 - RNA, 14 nt, Pseudomonas aeruginosa PA01
gcaagggcacuucg

SEQ ID NO: 3509498 - RNA, 22 nt, Pseudomonas aeruginosa PA01
gcaagggcacuucguccaggcc

SEQ ID NO: 3509499 - RNA, 23 nt, Pseudomonas aeruginosa PA01
gcaagggcacuucguccaggccg

SEQ ID NO: 3509500 - RNA, 21 nt, Pseudomonas aeruginosa PA01
gcaagggccugcucagcgucc

SEQ ID NO: 3509501 - RNA, 19 nt, Pseudomonas aeruginosa PA01
gcaagggcgccgccgacgc

SEQ ID NO: 3509502 - RNA, 15 nt, Pseudomonas aeruginosa PA01
gcaagggcgucgcuu

SEQ ID NO: 3509503 - RNA, 17 nt, Pseudomonas aeruginosa PA01
gcaagggugcucaggac

SEQ ID NO: 3509504 - RNA, 21 nt, Pseudomonas aeruginosa PA01
gcaaggguuucgugaaacgcc

SEQ ID NO: 3509505 - RNA, 18 nt, Pseudomonas aeruginosa PA01
gcaaggugcgggccgucg

SEQ ID NO: 3509506 - RNA, 18 nt, Pseudomonas aeruginosa PA01
gcaaggugcgggcgacgc

SEQ ID NO: 3509507 - RNA, 20 nt, Pseudomonas aeruginosa PA01
gcaaguaaugccgaaggcgu

SEQ ID NO: 3509508 - RNA, 16 nt, Pseudomonas aeruginosa PA01
gcaaguaccgccggca

SEQ ID NO: 3509509 - RNA, 20 nt, Pseudomonas aeruginosa PA01
gcaagucgaacaggcccuug

SEQ ID NO: 3509510 - RNA, 15 nt, Pseudomonas aeruginosa PA01
gcaagucggccugca

SEQ ID NO: 3509511 - RNA, 23 nt, Pseudomonas aeruginosa PA01
gcaagucggccugcaccagccag

SEQ ID NO: 3509512 - RNA, 22 nt, Pseudomonas aeruginosa PA01
gcaagugcccugggcgaacagc

SEQ ID NO: 3509513 - RNA, 13 nt, Pseudomonas aeruginosa PA01
gcaaguggcggcu

SEQ ID NO: 3509514 - RNA, 15 nt, Pseudomonas aeruginosa PA01
gcaaguggcggcuga

SEQ ID NO: 3509515 - RNA, 16 nt, Pseudomonas aeruginosa PA01
gcaauacaccgcugcg

SEQ ID NO: 3509516 - RNA, 24 nt, Pseudomonas aeruginosa PA01
gcaaucagcgcgauuuugggcuca

SEQ ID NO: 3509517 - RNA, 16 nt, Pseudomonas aeruginosa PA01
gcaaucagcgggccuu

SEQ ID NO: 3509518 - RNA, 17 nt, Pseudomonas aeruginosa PA01
gcaaucagggcugggcg

SEQ ID NO: 3509519 - RNA, 18 nt, Pseudomonas aeruginosa PA01
gcaaucagggcugggcgc

SEQ ID NO: 3509520 - RNA, 21 nt, Pseudomonas aeruginosa PA01
gcaaucagggcugggcgcccu

SEQ ID NO: 3509521 - RNA, 18 nt, Pseudomonas aeruginosa PA01
gcaaucaucgcgucgccg

SEQ ID NO: 3509522 - RNA, 12 nt, Pseudomonas aeruginosa PA01
gcaauccgaccg

SEQ ID NO: 3509523 - RNA, 16 nt, Pseudomonas aeruginosa PA01
gcaauccgaccgggga

SEQ ID NO: 3509524 - RNA, 15 nt, Pseudomonas aeruginosa PA01
gcaauccggcgcugc

SEQ ID NO: 3509525 - RNA, 23 nt, Pseudomonas aeruginosa PA01
gcaauccggcgcugccgaacagc

SEQ ID NO: 3509526 - RNA, 20 nt, Pseudomonas aeruginosa PA01
gcaauccguuaccgcgggcu

SEQ ID NO: 3509527 - RNA, 20 nt, Pseudomonas aeruginosa PA01
gcaauccucggugcgcacgc

SEQ ID NO: 3509528 - RNA, 23 nt, Pseudomonas aeruginosa PA01
gcaaucgacuucccacaaacccc

SEQ ID NO: 3509529 - RNA, 15 nt, Pseudomonas aeruginosa PA01
gcaaucgaugucgug

SEQ ID NO: 3509530 - RNA, 19 nt, Pseudomonas aeruginosa PA01
gcaaucggcgagccgcagc

SEQ ID NO: 3509531 - RNA, 14 nt, Pseudomonas aeruginosa PA01
gcaaucucccccuc

SEQ ID NO: 3509532 - RNA, 15 nt, Pseudomonas aeruginosa PA01
gcaaucugcccggca

SEQ ID NO: 3509533 - RNA, 17 nt, Pseudomonas aeruginosa PA01
gcaaugaaaaaggcgau

SEQ ID NO: 3509534 - RNA, 18 nt, Pseudomonas aeruginosa PA01
gcaaugccagcgccacgc

SEQ ID NO: 3509535 - RNA, 19 nt, Pseudomonas aeruginosa PA01
gcaaugcccagcgcaggcc

SEQ ID NO: 3509536 - RNA, 17 nt, Pseudomonas aeruginosa PA01
gcaaugcccgcgccugg

SEQ ID NO: 3509537 - RNA, 20 nt, Pseudomonas aeruginosa PA01
gcaauggauguugccgccgc

SEQ ID NO: 3509538 - RNA, 12 nt, Pseudomonas aeruginosa PA01
gcaauggccggc

SEQ ID NO: 3509539 - RNA, 14 nt, Pseudomonas aeruginosa PA01
gcaauggccggcgg

SEQ ID NO: 3509540 - RNA, 19 nt, Pseudomonas aeruginosa PA01
gcaauggcgcagccgcugg

SEQ ID NO: 3509541 - RNA, 14 nt, Pseudomonas aeruginosa PA01
gcaauggggcggcc

SEQ ID NO: 3509542 - RNA, 18 nt, Pseudomonas aeruginosa PA01
gcaauuccaccggcuggc

SEQ ID NO: 3509543 - RNA, 19 nt, Pseudomonas aeruginosa PA01
gcaauuccaccggcuggcc

SEQ ID NO: 3509544 - RNA, 20 nt, Pseudomonas aeruginosa PA01
gcaauuccaccggcuggccg

SEQ ID NO: 3509545 - RNA, 17 nt, Pseudomonas aeruginosa PA01
gcaauuccgcagccuug

SEQ ID NO: 3509546 - RNA, 23 nt, Pseudomonas aeruginosa PA01
gcaauugcaggcccggccgccug

SEQ ID NO: 3509547 - RNA, 15 nt, Pseudomonas aeruginosa PA01
gcaauugccgcugca

SEQ ID NO: 3509548 - RNA, 14 nt, Pseudomonas aeruginosa PA01
gcaauugccggcgu

SEQ ID NO: 3509549 - RNA, 15 nt, Pseudomonas aeruginosa PA01
gcacaaaaaagcccg

SEQ ID NO: 3509550 - RNA, 14 nt, Pseudomonas aeruginosa PA01
gcacaaaaaaggcg

SEQ ID NO: 3509551 - RNA, 17 nt, Pseudomonas aeruginosa PA01
gcacaacgggugcugcg

SEQ ID NO: 3509552 - RNA, 20 nt, Pseudomonas aeruginosa PA01
gcacaacgggugcugcggau

SEQ ID NO: 3509553 - RNA, 15 nt, Pseudomonas aeruginosa PA01
gcacaccgcgcgcgc

SEQ ID NO: 3509554 - RNA, 16 nt, Pseudomonas aeruginosa PA01
gcacaccgcgcgcgcc

SEQ ID NO: 3509555 - RNA, 17 nt, Pseudomonas aeruginosa PA01
gcacaccgcgcgcgccu

SEQ ID NO: 3509556 - RNA, 18 nt, Pseudomonas aeruginosa PA01
gcacaccgcgcgcgccug

SEQ ID NO: 3509557 - RNA, 20 nt, Pseudomonas aeruginosa PA01
gcacaccgcgcgcgccugca

SEQ ID NO: 3509558 - RNA, 23 nt, Pseudomonas aeruginosa PA01
gcacaccgcgcgcgccugcaacg

SEQ ID NO: 3509559 - RNA, 16 nt, Pseudomonas aeruginosa PA01
gcacaccuccagcggc

SEQ ID NO: 3509560 - RNA, 17 nt, Pseudomonas aeruginosa PA01
gcacaccuccagcggcu

SEQ ID NO: 3509561 - RNA, 18 nt, Pseudomonas aeruginosa PA01
gcacaccuccagcggcuu

SEQ ID NO: 3509562 - RNA, 21 nt, Pseudomonas aeruginosa PA01
gcacaccuggucuucgguggc

SEQ ID NO: 3509563 - RNA, 23 nt, Pseudomonas aeruginosa PA01
gcacaccuggucuucgguggcgg

SEQ ID NO: 3509564 - RNA, 22 nt, Pseudomonas aeruginosa PA01
gcacacgcccggcacucgccgg

SEQ ID NO: 3509565 - RNA, 15 nt, Pseudomonas aeruginosa PA01
gcacacgcucccaac

SEQ ID NO: 3509566 - RNA, 19 nt, Pseudomonas aeruginosa PA01
gcacacggucgagacccgc

SEQ ID NO: 3509567 - RNA, 16 nt, Pseudomonas aeruginosa PA01
gcacagccauagcgcc

SEQ ID NO: 3509568 - RNA, 20 nt, Pseudomonas aeruginosa PA01
gcacagccauagcgccggca

SEQ ID NO: 3509569 - RNA, 21 nt, Pseudomonas aeruginosa PA01
gcacagccauagcgccggcac

SEQ ID NO: 3509570 - RNA, 18 nt, Pseudomonas aeruginosa PA01
gcacagccauagugcugg

SEQ ID NO: 3509571 - RNA, 16 nt, Pseudomonas aeruginosa PA01
gcacagccauuucugc

SEQ ID NO: 3509572 - RNA, 18 nt, Pseudomonas aeruginosa PA01
gcacagccccagccucgg

SEQ ID NO: 3509573 - RNA, 13 nt, Pseudomonas aeruginosa PA01
gcacagcguggcc

SEQ ID NO: 3509574 - RNA, 21 nt, Pseudomonas aeruginosa PA01
gcacaggacccuuccagcgug

SEQ ID NO: 3509575 - RNA, 14 nt, Pseudomonas aeruginosa PA01
gcacaggcggcugu

SEQ ID NO: 3509576 - RNA, 19 nt, Pseudomonas aeruginosa PA01
gcacaggcggcuguugccg

SEQ ID NO: 3509577 - RNA, 17 nt, Pseudomonas aeruginosa PA01
gcacaggcguaccagcu

SEQ ID NO: 3509578 - RNA, 14 nt, Pseudomonas aeruginosa PA01
gcacaggcuggcca

SEQ ID NO: 3509579 - RNA, 13 nt, Pseudomonas aeruginosa PA01
gcacagggacgcg

SEQ ID NO: 3509580 - RNA, 11 nt, Pseudomonas aeruginosa PA01
gcacagguaga

SEQ ID NO: 3509581 - RNA, 22 nt, Pseudomonas aeruginosa PA01
gcacagguugacgaugcggccc

SEQ ID NO: 3509582 - RNA, 17 nt, Pseudomonas aeruginosa PA01
gcacaguacgccuugca

SEQ ID NO: 3509583 - RNA, 19 nt, Pseudomonas aeruginosa PA01
gcacaguacgccuugcagg

SEQ ID NO: 3509584 - RNA, 14 nt, Pseudomonas aeruginosa PA01
gcacaguugcgcgc

SEQ ID NO: 3509585 - RNA, 23 nt, Pseudomonas aeruginosa PA01
gcacauagagggucagccggccg

SEQ ID NO: 3509586 - RNA, 18 nt, Pseudomonas aeruginosa PA01
gcacaucaccuucgcccu

SEQ ID NO: 3509587 - RNA, 23 nt, Pseudomonas aeruginosa PA01
gcacaucaccuucgcccucagca

SEQ ID NO: 3509588 - RNA, 20 nt, Pseudomonas aeruginosa PA01
gcacaugccacgcaccacca

SEQ ID NO: 3509589 - RNA, 14 nt, Pseudomonas aeruginosa PA01
gcacaugccgagcg

SEQ ID NO: 3509590 - RNA, 23 nt, Pseudomonas aeruginosa PA01
gcacauuacccccuugcccgucg

SEQ ID NO: 3509591 - RNA, 13 nt, Pseudomonas aeruginosa PA01
gcaccaccaccga

SEQ ID NO: 3509592 - RNA, 16 nt, Pseudomonas aeruginosa PA01
gcaccaccaccgacag

SEQ ID NO: 3509593 - RNA, 13 nt, Pseudomonas aeruginosa PA01
gcaccaccaccgg

SEQ ID NO: 3509594 - RNA, 21 nt, Pseudomonas aeruginosa PA01
gcaccaccagcgcgcgcuggc

SEQ ID NO: 3509595 - RNA, 15 nt, Pseudomonas aeruginosa PA01
gcaccaccaggucga

SEQ ID NO: 3509596 - RNA, 17 nt, Pseudomonas aeruginosa PA01
gcaccacccaucugccg

SEQ ID NO: 3509597 - RNA, 19 nt, Pseudomonas aeruginosa PA01
gcaccacccaucugccggc

SEQ ID NO: 3509598 - RNA, 23 nt, Pseudomonas aeruginosa PA01
gcaccacccaucugccggccacc

SEQ ID NO: 3509599 - RNA, 17 nt, Pseudomonas aeruginosa PA01
gcaccacccggccgcgc

SEQ ID NO: 3509600 - RNA, 18 nt, Pseudomonas aeruginosa PA01
gcaccacccggccgcgcu

SEQ ID NO: 3509601 - RNA, 22 nt, Pseudomonas aeruginosa PA01
gcaccacccggcgcacgccggc

SEQ ID NO: 3509602 - RNA, 14 nt, Pseudomonas aeruginosa PA01
gcaccaccgccgcc

SEQ ID NO: 3509603 - RNA, 15 nt, Pseudomonas aeruginosa PA01
gcaccaccgccgcca

SEQ ID NO: 3509604 - RNA, 19 nt, Pseudomonas aeruginosa PA01
gcaccaccgccgccagcaa

SEQ ID NO: 3509605 - RNA, 16 nt, Pseudomonas aeruginosa PA01
gcaccaccucgccaag

SEQ ID NO: 3509606 - RNA, 18 nt, Pseudomonas aeruginosa PA01
gcaccaccucgccaagcu

SEQ ID NO: 3509607 - RNA, 21 nt, Pseudomonas aeruginosa PA01
gcaccaccucgccaagcuggc

SEQ ID NO: 3509608 - RNA, 24 nt, Pseudomonas aeruginosa PA01
gcaccaccugcuugggcgccucgc

SEQ ID NO: 3509609 - RNA, 12 nt, Pseudomonas aeruginosa PA01
gcaccaccuggc

SEQ ID NO: 3509610 - RNA, 17 nt, Pseudomonas aeruginosa PA01
gcaccaccuggcaggua

SEQ ID NO: 3509611 - RNA, 14 nt, Pseudomonas aeruginosa PA01
gcaccacgcaggcg

SEQ ID NO: 3509612 - RNA, 16 nt, Pseudomonas aeruginosa PA01
gcaccacgcaggcgcg

SEQ ID NO: 3509613 - RNA, 17 nt, Pseudomonas aeruginosa PA01
gcaccacgcaggcgcgu

SEQ ID NO: 3509614 - RNA, 17 nt, Pseudomonas aeruginosa PA01
gcaccacgccgcuggcg

SEQ ID NO: 3509615 - RNA, 18 nt, Pseudomonas aeruginosa PA01
gcaccacgcgcaagccag

SEQ ID NO: 3509616 - RNA, 20 nt, Pseudomonas aeruginosa PA01
gcaccacgcgcaagccagcc

SEQ ID NO: 3509617 - RNA, 19 nt, Pseudomonas aeruginosa PA01
gcaccacggcgauggucag

SEQ ID NO: 3509618 - RNA, 17 nt, Pseudomonas aeruginosa PA01
gcaccacguagccggcg

SEQ ID NO: 3509619 - RNA, 20 nt, Pseudomonas aeruginosa PA01
gcaccacguagccggcgucc

SEQ ID NO: 3509620 - RNA, 13 nt, Pseudomonas aeruginosa PA01
gcaccacgucgga

SEQ ID NO: 3509621 - RNA, 15 nt, Pseudomonas aeruginosa PA01
gcaccacgugcagca

SEQ ID NO: 3509622 - RNA, 15 nt, Pseudomonas aeruginosa PA01
gcaccacguucggcg

SEQ ID NO: 3509623 - RNA, 19 nt, Pseudomonas aeruginosa PA01
gcaccacguucggcgcggg

SEQ ID NO: 3509624 - RNA, 13 nt, Pseudomonas aeruginosa PA01
gcaccagcacgcc

SEQ ID NO: 3509625 - RNA, 14 nt, Pseudomonas aeruginosa PA01
gcaccagcacuucc

SEQ ID NO: 3509626 - RNA, 20 nt, Pseudomonas aeruginosa PA01
gcaccagcacuuccggcgcg

SEQ ID NO: 3509627 - RNA, 10 nt, Pseudomonas aeruginosa PA01
gcaccagcag

SEQ ID NO: 3509628 - RNA, 11 nt, Pseudomonas aeruginosa PA01
gcaccagcagg

SEQ ID NO: 3509629 - RNA, 14 nt, Pseudomonas aeruginosa PA01
gcaccagcaggccg

SEQ ID NO: 3509630 - RNA, 15 nt, Pseudomonas aeruginosa PA01
gcaccagcaggccga

SEQ ID NO: 3509631 - RNA, 16 nt, Pseudomonas aeruginosa PA01
gcaccagcaggccgau

SEQ ID NO: 3509632 - RNA, 22 nt, Pseudomonas aeruginosa PA01
gcaccagcaggccgaucaccag

SEQ ID NO: 3509633 - RNA, 14 nt, Pseudomonas aeruginosa PA01
gcaccagcaggcga

SEQ ID NO: 3509634 - RNA, 16 nt, Pseudomonas aeruginosa PA01
gcaccagcaggcgaca

SEQ ID NO: 3509635 - RNA, 16 nt, Pseudomonas aeruginosa PA01
gcaccagcaggucgag

SEQ ID NO: 3509636 - RNA, 17 nt, Pseudomonas aeruginosa PA01
gcaccagcaggucggcg

SEQ ID NO: 3509637 - RNA, 21 nt, Pseudomonas aeruginosa PA01
gcaccagcaggucggcgcgac

SEQ ID NO: 3509638 - RNA, 24 nt, Pseudomonas aeruginosa PA01
gcaccagcaggucggcgcgacggc

SEQ ID NO: 3509639 - RNA, 23 nt, Pseudomonas aeruginosa PA01
gcaccagcaguagugcgacgcag

SEQ ID NO: 3509640 - RNA, 20 nt, Pseudomonas aeruginosa PA01
gcaccagccaguccggcagc

SEQ ID NO: 3509641 - RNA, 15 nt, Pseudomonas aeruginosa PA01
gcaccagccggccgc

SEQ ID NO: 3509642 - RNA, 16 nt, Pseudomonas aeruginosa PA01
gcaccagccggccgcg

SEQ ID NO: 3509643 - RNA, 13 nt, Pseudomonas aeruginosa PA01
gcaccagccggcg

SEQ ID NO: 3509644 - RNA, 14 nt, Pseudomonas aeruginosa PA01
gcaccagccggcgc

SEQ ID NO: 3509645 - RNA, 16 nt, Pseudomonas aeruginosa PA01
gcaccagccggcgcuc

SEQ ID NO: 3509646 - RNA, 23 nt, Pseudomonas aeruginosa PA01
gcaccagccggcgcucggccagg

SEQ ID NO: 3509647 - RNA, 22 nt, Pseudomonas aeruginosa PA01
gcaccagcggaccgucgggcag

SEQ ID NO: 3509648 - RNA, 15 nt, Pseudomonas aeruginosa PA01
gcaccagcgggaugu

SEQ ID NO: 3509649 - RNA, 21 nt, Pseudomonas aeruginosa PA01
gcaccagcgggucgucgaagc

SEQ ID NO: 3509650 - RNA, 19 nt, Pseudomonas aeruginosa PA01
gcaccagcgguacguagcg

SEQ ID NO: 3509651 - RNA, 15 nt, Pseudomonas aeruginosa PA01
gcaccagcucccggc

SEQ ID NO: 3509652 - RNA, 16 nt, Pseudomonas aeruginosa PA01
gcaccagcucccggcu

SEQ ID NO: 3509653 - RNA, 16 nt, Pseudomonas aeruginosa PA01
gcaccaggaagcccca

SEQ ID NO: 3509654 - RNA, 22 nt, Pseudomonas aeruginosa PA01
gcaccaggaagccccagaagau

SEQ ID NO: 3509655 - RNA, 12 nt, Pseudomonas aeruginosa PA01
gcaccaggccag

SEQ ID NO: 3509656 - RNA, 13 nt, Pseudomonas aeruginosa PA01
gcaccaggccagg

SEQ ID NO: 3509657 - RNA, 16 nt, Pseudomonas aeruginosa PA01
gcaccaggccaggcug

SEQ ID NO: 3509658 - RNA, 14 nt, Pseudomonas aeruginosa PA01
gcaccaggccaggu

SEQ ID NO: 3509659 - RNA, 18 nt, Pseudomonas aeruginosa PA01
gcaccaggccaggugguc

SEQ ID NO: 3509660 - RNA, 20 nt, Pseudomonas aeruginosa PA01
gcaccaggccagguggucga

SEQ ID NO: 3509661 - RNA, 12 nt, Pseudomonas aeruginosa PA01
gcaccaggcccu

SEQ ID NO: 3509662 - RNA, 15 nt, Pseudomonas aeruginosa PA01
gcaccaggccgaugu

SEQ ID NO: 3509663 - RNA, 15 nt, Pseudomonas aeruginosa PA01
gcaccaggccgccau

SEQ ID NO: 3509664 - RNA, 16 nt, Pseudomonas aeruginosa PA01
gcaccaggccgccaug

SEQ ID NO: 3509665 - RNA, 14 nt, Pseudomonas aeruginosa PA01
gcaccaggccuccc

SEQ ID NO: 3509666 - RNA, 16 nt, Pseudomonas aeruginosa PA01
gcaccaggccucccag

SEQ ID NO: 3509667 - RNA, 15 nt, Pseudomonas aeruginosa PA01
gcaccaggcgaugcg

SEQ ID NO: 3509668 - RNA, 17 nt, Pseudomonas aeruginosa PA01
gcaccaggcgaugcgcc

SEQ ID NO: 3509669 - RNA, 21 nt, Pseudomonas aeruginosa PA01
gcaccaggcgaugcgccggau

SEQ ID NO: 3509670 - RNA, 13 nt, Pseudomonas aeruginosa PA01
gcaccaggcucgc

SEQ ID NO: 3509671 - RNA, 14 nt, Pseudomonas aeruginosa PA01
gcaccaggcuggcc

SEQ ID NO: 3509672 - RNA, 15 nt, Pseudomonas aeruginosa PA01
gcaccaggcuggcca

SEQ ID NO: 3509673 - RNA, 17 nt, Pseudomonas aeruginosa PA01
gcaccaggcuggccagu

SEQ ID NO: 3509674 - RNA, 18 nt, Pseudomonas aeruginosa PA01
gcaccagggccagggcga

SEQ ID NO: 3509675 - RNA, 19 nt, Pseudomonas aeruginosa PA01
gcaccagggcuucgcgcag

SEQ ID NO: 3509676 - RNA, 20 nt, Pseudomonas aeruginosa PA01
gcaccaggguaucgcugucg

SEQ ID NO: 3509677 - RNA, 15 nt, Pseudomonas aeruginosa PA01
gcaccaggucgcgcu

SEQ ID NO: 3509678 - RNA, 19 nt, Pseudomonas aeruginosa PA01
gcaccaggucgucgucacg

SEQ ID NO: 3509679 - RNA, 20 nt, Pseudomonas aeruginosa PA01
gcaccagucccuggccggcg

SEQ ID NO: 3509680 - RNA, 16 nt, Pseudomonas aeruginosa PA01
gcaccaguggcgccgc

SEQ ID NO: 3509681 - RNA, 17 nt, Pseudomonas aeruginosa PA01
gcaccaguggcgccgcc

SEQ ID NO: 3509682 - RNA, 18 nt, Pseudomonas aeruginosa PA01
gcaccaguggcgccgcca

SEQ ID NO: 3509683 - RNA, 20 nt, Pseudomonas aeruginosa PA01
gcaccauagcgagccgcgcu

SEQ ID NO: 3509684 - RNA, 13 nt, Pseudomonas aeruginosa PA01
gcaccaucaccga

SEQ ID NO: 3509685 - RNA, 14 nt, Pseudomonas aeruginosa PA01
gcaccaucagccag

SEQ ID NO: 3509686 - RNA, 19 nt, Pseudomonas aeruginosa PA01
gcaccaucagccagcccag

SEQ ID NO: 3509687 - RNA, 12 nt, Pseudomonas aeruginosa PA01
gcaccauccgcc

SEQ ID NO: 3509688 - RNA, 23 nt, Pseudomonas aeruginosa PA01
gcaccauccgccgcaggucggcg

SEQ ID NO: 3509689 - RNA, 22 nt, Pseudomonas aeruginosa PA01
gcaccaugcagcggcaugguca

SEQ ID NO: 3509690 - RNA, 18 nt, Pseudomonas aeruginosa PA01
gcaccaugcgcggcagga

SEQ ID NO: 3509691 - RNA, 22 nt, Pseudomonas aeruginosa PA01
gcacccaggauuuguccgcgcc

SEQ ID NO: 3509692 - RNA, 16 nt, Pseudomonas aeruginosa PA01
gcacccaggccacgcc

SEQ ID NO: 3509693 - RNA, 18 nt, Pseudomonas aeruginosa PA01
gcacccaggccacgccca

SEQ ID NO: 3509694 - RNA, 19 nt, Pseudomonas aeruginosa PA01
gcacccagucuucgcuggc

SEQ ID NO: 3509695 - RNA, 21 nt, Pseudomonas aeruginosa PA01
gcacccagucuucgcuggcga

SEQ ID NO: 3509696 - RNA, 21 nt, Pseudomonas aeruginosa PA01
gcacccaugaaaaaggccggu

SEQ ID NO: 3509697 - RNA, 14 nt, Pseudomonas aeruginosa PA01
gcacccccagcagg

SEQ ID NO: 3509698 - RNA, 16 nt, Pseudomonas aeruginosa PA01
gcacccccagcaggcc

SEQ ID NO: 3509699 - RNA, 16 nt, Pseudomonas aeruginosa PA01
gcaccccgaccacccu

SEQ ID NO: 3509700 - RNA, 16 nt, Pseudomonas aeruginosa PA01
gcaccccgagcggcgc

SEQ ID NO: 3509701 - RNA, 19 nt, Pseudomonas aeruginosa PA01
gcaccccgucgacgcccug

SEQ ID NO: 3509702 - RNA, 19 nt, Pseudomonas aeruginosa PA01
gcaccccuugcagccagcc

SEQ ID NO: 3509703 - RNA, 15 nt, Pseudomonas aeruginosa PA01
gcacccgcaccagcc

SEQ ID NO: 3509704 - RNA, 15 nt, Pseudomonas aeruginosa PA01
gcacccgcgacucga

SEQ ID NO: 3509705 - RNA, 14 nt, Pseudomonas aeruginosa PA01
gcacccgcucggcc

SEQ ID NO: 3509706 - RNA, 22 nt, Pseudomonas aeruginosa PA01
gcacccgcuguuucuccaguuc

SEQ ID NO: 3509707 - RNA, 20 nt, Pseudomonas aeruginosa PA01
gcacccggaccuuguccagg

SEQ ID NO: 3509708 - RNA, 20 nt, Pseudomonas aeruginosa PA01
gcacccggcccauggcgacg

SEQ ID NO: 3509709 - RNA, 13 nt, Pseudomonas aeruginosa PA01
gcacccggcuggg

SEQ ID NO: 3509710 - RNA, 20 nt, Pseudomonas aeruginosa PA01
gcacccggcuggguucggcg

SEQ ID NO: 3509711 - RNA, 18 nt, Pseudomonas aeruginosa PA01
gcacccgggcgaccugcu

SEQ ID NO: 3509712 - RNA, 19 nt, Pseudomonas aeruginosa PA01
gcacccgggcgaccugcuc

SEQ ID NO: 3509713 - RNA, 13 nt, Pseudomonas aeruginosa PA01
gcacccgguagcc

SEQ ID NO: 3509714 - RNA, 18 nt, Pseudomonas aeruginosa PA01
gcacccgguagccgauca

SEQ ID NO: 3509715 - RNA, 17 nt, Pseudomonas aeruginosa PA01
gcacccucuuccgcgcu

SEQ ID NO: 3509716 - RNA, 22 nt, Pseudomonas aeruginosa PA01
gcacccucuuccgcgcugaccu

SEQ ID NO: 3509717 - RNA, 22 nt, Pseudomonas aeruginosa PA01
gcacccugaccgcgagcgccgc

SEQ ID NO: 3509718 - RNA, 20 nt, Pseudomonas aeruginosa PA01
gcacccuggacccgggccuc

SEQ ID NO: 3509719 - RNA, 12 nt, Pseudomonas aeruginosa PA01
gcacccuggcca

SEQ ID NO: 3509720 - RNA, 14 nt, Pseudomonas aeruginosa PA01
gcacccuggccacg

SEQ ID NO: 3509721 - RNA, 13 nt, Pseudomonas aeruginosa PA01
gcaccgacacgca

SEQ ID NO: 3509722 - RNA, 16 nt, Pseudomonas aeruginosa PA01
gcaccgacacgcacuc

SEQ ID NO: 3509723 - RNA, 17 nt, Pseudomonas aeruginosa PA01
gcaccgacacgcacuca

SEQ ID NO: 3509724 - RNA, 13 nt, Pseudomonas aeruginosa PA01
gcaccgacgccga

SEQ ID NO: 3509725 - RNA, 14 nt, Pseudomonas aeruginosa PA01
gcaccgacgccgcc

SEQ ID NO: 3509726 - RNA, 19 nt, Pseudomonas aeruginosa PA01
gcaccgacgccgccugcgc

SEQ ID NO: 3509727 - RNA, 15 nt, Pseudomonas aeruginosa PA01
gcaccgacucgcccu

SEQ ID NO: 3509728 - RNA, 17 nt, Pseudomonas aeruginosa PA01
gcaccgagacgcccugg

SEQ ID NO: 3509729 - RNA, 18 nt, Pseudomonas aeruginosa PA01
gcaccgagacgcccugga

SEQ ID NO: 3509730 - RNA, 20 nt, Pseudomonas aeruginosa PA01
gcaccgagacgcccuggaug

SEQ ID NO: 3509731 - RNA, 14 nt, Pseudomonas aeruginosa PA01
gcaccgagcaggca

SEQ ID NO: 3509732 - RNA, 16 nt, Pseudomonas aeruginosa PA01
gcaccgagcaggcacc

SEQ ID NO: 3509733 - RNA, 19 nt, Pseudomonas aeruginosa PA01
gcaccgagcaggcacccgc

SEQ ID NO: 3509734 - RNA, 20 nt, Pseudomonas aeruginosa PA01
gcaccgagcaggcacccgcg

SEQ ID NO: 3509735 - RNA, 20 nt, Pseudomonas aeruginosa PA01
gcaccgagcugaucgcgcag

SEQ ID NO: 3509736 - RNA, 13 nt, Pseudomonas aeruginosa PA01
gcaccgaggagaa

SEQ ID NO: 3509737 - RNA, 14 nt, Pseudomonas aeruginosa PA01
gcaccgaggcgcgc

SEQ ID NO: 3509738 - RNA, 17 nt, Pseudomonas aeruginosa PA01
gcaccgaggcgcgccga

SEQ ID NO: 3509739 - RNA, 18 nt, Pseudomonas aeruginosa PA01
gcaccgaggcgcgccgac

SEQ ID NO: 3509740 - RNA, 20 nt, Pseudomonas aeruginosa PA01
gcaccgagggcauuuccugg

SEQ ID NO: 3509741 - RNA, 23 nt, Pseudomonas aeruginosa PA01
gcaccgagguagucccagaccac

SEQ ID NO: 3509742 - RNA, 17 nt, Pseudomonas aeruginosa PA01
gcaccgaguugaccagc

SEQ ID NO: 3509743 - RNA, 18 nt, Pseudomonas aeruginosa PA01
gcaccgaguugaccagca

SEQ ID NO: 3509744 - RNA, 14 nt, Pseudomonas aeruginosa PA01
gcaccgaucgcccg

SEQ ID NO: 3509745 - RNA, 21 nt, Pseudomonas aeruginosa PA01
gcaccgauuuccccaaggcac

SEQ ID NO: 3509746 - RNA, 14 nt, Pseudomonas aeruginosa PA01
gcaccgccaccagc

SEQ ID NO: 3509747 - RNA, 14 nt, Pseudomonas aeruginosa PA01
gcaccgccagcagu

SEQ ID NO: 3509748 - RNA, 13 nt, Pseudomonas aeruginosa PA01
gcaccgccagccc

SEQ ID NO: 3509749 - RNA, 14 nt, Pseudomonas aeruginosa PA01
gcaccgccagcccg

SEQ ID NO: 3509750 - RNA, 13 nt, Pseudomonas aeruginosa PA01
gcaccgccagcgu

SEQ ID NO: 3509751 - RNA, 15 nt, Pseudomonas aeruginosa PA01
gcaccgcccagccga

SEQ ID NO: 3509752 - RNA, 12 nt, Pseudomonas aeruginosa PA01
gcaccgccgagg

SEQ ID NO: 3509753 - RNA, 21 nt, Pseudomonas aeruginosa PA01
gcaccgccggguacagcgcca

SEQ ID NO: 3509754 - RNA, 23 nt, Pseudomonas aeruginosa PA01
gcaccgccggguacagcgccacg

SEQ ID NO: 3509755 - RNA, 19 nt, Pseudomonas aeruginosa PA01
gcaccgccucgugcagcaa

SEQ ID NO: 3509756 - RNA, 18 nt, Pseudomonas aeruginosa PA01
gcaccgccugcaacucgu

SEQ ID NO: 3509757 - RNA, 16 nt, Pseudomonas aeruginosa PA01
gcaccgccugcagcac

SEQ ID NO: 3509758 - RNA, 18 nt, Pseudomonas aeruginosa PA01
gcaccgccuggcgcaagg

SEQ ID NO: 3509759 - RNA, 12 nt, Pseudomonas aeruginosa PA01
gcaccgcgagca

SEQ ID NO: 3509760 - RNA, 19 nt, Pseudomonas aeruginosa PA01
gcaccgcgcagaccaucag

SEQ ID NO: 3509761 - RNA, 22 nt, Pseudomonas aeruginosa PA01
gcaccgcgcagcgucaccgcgu

SEQ ID NO: 3509762 - RNA, 11 nt, Pseudomonas aeruginosa PA01
gcaccgcgccg

SEQ ID NO: 3509763 - RNA, 13 nt, Pseudomonas aeruginosa PA01
gcaccgcgccggc

SEQ ID NO: 3509764 - RNA, 14 nt, Pseudomonas aeruginosa PA01
gcaccgcgccggga

SEQ ID NO: 3509765 - RNA, 16 nt, Pseudomonas aeruginosa PA01
gcaccgcgccuuccag

SEQ ID NO: 3509766 - RNA, 18 nt, Pseudomonas aeruginosa PA01
gcaccgcgccuuccagcc

SEQ ID NO: 3509767 - RNA, 23 nt, Pseudomonas aeruginosa PA01
gcaccgcggcgagccgguagugc

SEQ ID NO: 3509768 - RNA, 13 nt, Pseudomonas aeruginosa PA01
gcaccgcggcgcg

SEQ ID NO: 3509769 - RNA, 15 nt, Pseudomonas aeruginosa PA01
gcaccgcggcgcgga

SEQ ID NO: 3509770 - RNA, 18 nt, Pseudomonas aeruginosa PA01
gcaccgcggcgcggaugu

SEQ ID NO: 3509771 - RNA, 18 nt, Pseudomonas aeruginosa PA01
gcaccgcggucuucccgu

SEQ ID NO: 3509772 - RNA, 15 nt, Pseudomonas aeruginosa PA01
gcaccgcuugccagc

SEQ ID NO: 3509773 - RNA, 16 nt, Pseudomonas aeruginosa PA01
gcaccgcuugccagcc

SEQ ID NO: 3509774 - RNA, 22 nt, Pseudomonas aeruginosa PA01
gcaccgcuuucaccagggucgc

SEQ ID NO: 3509775 - RNA, 16 nt, Pseudomonas aeruginosa PA01
gcaccggcaggacgau

SEQ ID NO: 3509776 - RNA, 18 nt, Pseudomonas aeruginosa PA01
gcaccggcaggacgauga

SEQ ID NO: 3509777 - RNA, 22 nt, Pseudomonas aeruginosa PA01
gcaccggcauguagcgcgccga

SEQ ID NO: 3509778 - RNA, 12 nt, Pseudomonas aeruginosa PA01
gcaccggccagg

SEQ ID NO: 3509779 - RNA, 14 nt, Pseudomonas aeruginosa PA01
gcaccggccaggcg

SEQ ID NO: 3509780 - RNA, 22 nt, Pseudomonas aeruginosa PA01
gcaccggccaggcgcuggucca

SEQ ID NO: 3509781 - RNA, 18 nt, Pseudomonas aeruginosa PA01
gcaccggccucaagcaag

SEQ ID NO: 3509782 - RNA, 21 nt, Pseudomonas aeruginosa PA01
gcaccggccucaagcaagcga

SEQ ID NO: 3509783 - RNA, 21 nt, Pseudomonas aeruginosa PA01
gcaccggcgacgaaagacgcu

SEQ ID NO: 3509784 - RNA, 15 nt, Pseudomonas aeruginosa PA01
gcaccggcgauggcc

SEQ ID NO: 3509785 - RNA, 20 nt, Pseudomonas aeruginosa PA01
gcaccggcgauggccggcac

SEQ ID NO: 3509786 - RNA, 22 nt, Pseudomonas aeruginosa PA01
gcaccggcgauggccggcacca

SEQ ID NO: 3509787 - RNA, 18 nt, Pseudomonas aeruginosa PA01
gcaccggcgcggccagcu

SEQ ID NO: 3509788 - RNA, 12 nt, Pseudomonas aeruginosa PA01
gcaccggcggcg

SEQ ID NO: 3509789 - RNA, 16 nt, Pseudomonas aeruginosa PA01
gcaccggcggcgccag

SEQ ID NO: 3509790 - RNA, 17 nt, Pseudomonas aeruginosa PA01
gcaccggcggcgccagg

SEQ ID NO: 3509791 - RNA, 19 nt, Pseudomonas aeruginosa PA01
gcaccggcggcgccaggcc

SEQ ID NO: 3509792 - RNA, 22 nt, Pseudomonas aeruginosa PA01
gcaccggcggcgccaggccggc

SEQ ID NO: 3509793 - RNA, 14 nt, Pseudomonas aeruginosa PA01
gcaccggcuucugg

SEQ ID NO: 3509794 - RNA, 21 nt, Pseudomonas aeruginosa PA01
gcaccggcuuguugcgcucca

SEQ ID NO: 3509795 - RNA, 16 nt, Pseudomonas aeruginosa PA01
gcaccgggaggcgccg

SEQ ID NO: 3509796 - RNA, 19 nt, Pseudomonas aeruginosa PA01
gcaccgggaggcgccgcgc

SEQ ID NO: 3509797 - RNA, 23 nt, Pseudomonas aeruginosa PA01
gcaccgggaggcgccgcgccagg

SEQ ID NO: 3509798 - RNA, 18 nt, Pseudomonas aeruginosa PA01
gcaccgggccgaccugcc

SEQ ID NO: 3509799 - RNA, 18 nt, Pseudomonas aeruginosa PA01
gcaccgguucgacacgcu

SEQ ID NO: 3509800 - RNA, 22 nt, Pseudomonas aeruginosa PA01
gcaccguagcggcugcgguagg

SEQ ID NO: 3509801 - RNA, 15 nt, Pseudomonas aeruginosa PA01
gcaccguaggccagg

SEQ ID NO: 3509802 - RNA, 16 nt, Pseudomonas aeruginosa PA01
gcaccguaggccaggc

SEQ ID NO: 3509803 - RNA, 17 nt, Pseudomonas aeruginosa PA01
gcaccguaggccaggca

SEQ ID NO: 3509804 - RNA, 22 nt, Pseudomonas aeruginosa PA01
gcaccguaggccaggcagacca

SEQ ID NO: 3509805 - RNA, 18 nt, Pseudomonas aeruginosa PA01
gcaccgucaagggccagg

SEQ ID NO: 3509806 - RNA, 23 nt, Pseudomonas aeruginosa PA01
gcaccgucaccuguucggcgcug

SEQ ID NO: 3509807 - RNA, 17 nt, Pseudomonas aeruginosa PA01
gcaccgucgagcaccag

SEQ ID NO: 3509808 - RNA, 20 nt, Pseudomonas aeruginosa PA01
gcaccgucgagcaccaggcg

SEQ ID NO: 3509809 - RNA, 17 nt, Pseudomonas aeruginosa PA01
gcaccgugcgcgcggcc

SEQ ID NO: 3509810 - RNA, 18 nt, Pseudomonas aeruginosa PA01
gcaccgugcgcgcggccu

SEQ ID NO: 3509811 - RNA, 19 nt, Pseudomonas aeruginosa PA01
gcaccgugcgcgcggccug

SEQ ID NO: 3509812 - RNA, 15 nt, Pseudomonas aeruginosa PA01
gcaccguggcgccau

SEQ ID NO: 3509813 - RNA, 17 nt, Pseudomonas aeruginosa PA01
gcaccguggcgccaucc

SEQ ID NO: 3509814 - RNA, 20 nt, Pseudomonas aeruginosa PA01
gcaccguggcgccauccucc

SEQ ID NO: 3509815 - RNA, 13 nt, Pseudomonas aeruginosa PA01
gcaccguggucag

SEQ ID NO: 3509816 - RNA, 14 nt, Pseudomonas aeruginosa PA01
gcaccguggucagc

SEQ ID NO: 3509817 - RNA, 17 nt, Pseudomonas aeruginosa PA01
gcaccguggucagcacc

SEQ ID NO: 3509818 - RNA, 19 nt, Pseudomonas aeruginosa PA01
gcaccguggucagcaccag

SEQ ID NO: 3509819 - RNA, 20 nt, Pseudomonas aeruginosa PA01
gcaccguggucagcaccagg

SEQ ID NO: 3509820 - RNA, 21 nt, Pseudomonas aeruginosa PA01
gcaccguggucagcaccaggg

SEQ ID NO: 3509821 - RNA, 18 nt, Pseudomonas aeruginosa PA01
gcaccuaccaguaguucu

SEQ ID NO: 3509822 - RNA, 15 nt, Pseudomonas aeruginosa PA01
gcaccucaugcugcg

SEQ ID NO: 3509823 - RNA, 17 nt, Pseudomonas aeruginosa PA01
gcaccucccccagcggg

SEQ ID NO: 3509824 - RNA, 18 nt, Pseudomonas aeruginosa PA01
gcaccucccccagcgggc

SEQ ID NO: 3509825 - RNA, 17 nt, Pseudomonas aeruginosa PA01
gcaccucgaccgcgccg

SEQ ID NO: 3509826 - RNA, 17 nt, Pseudomonas aeruginosa PA01
gcaccucgaccugguag

SEQ ID NO: 3509827 - RNA, 20 nt, Pseudomonas aeruginosa PA01
gcaccucgaccugguagccg

SEQ ID NO: 3509828 - RNA, 16 nt, Pseudomonas aeruginosa PA01
gcaccucgacgcccgc

SEQ ID NO: 3509829 - RNA, 16 nt, Pseudomonas aeruginosa PA01
gcaccucgauggcggc

SEQ ID NO: 3509830 - RNA, 18 nt, Pseudomonas aeruginosa PA01
gcaccucgauggcggcgg

SEQ ID NO: 3509831 - RNA, 12 nt, Pseudomonas aeruginosa PA01
gcaccucgcggg

SEQ ID NO: 3509832 - RNA, 16 nt, Pseudomonas aeruginosa PA01
gcaccucggccaggcg

SEQ ID NO: 3509833 - RNA, 16 nt, Pseudomonas aeruginosa PA01
gcaccucguaggccga

SEQ ID NO: 3509834 - RNA, 18 nt, Pseudomonas aeruginosa PA01
gcaccucguaggccgacu

SEQ ID NO: 3509835 - RNA, 23 nt, Pseudomonas aeruginosa PA01
gcaccucguccagcaggacgucg

SEQ ID NO: 3509836 - RNA, 19 nt, Pseudomonas aeruginosa PA01
gcaccucgucgagcagcgc

SEQ ID NO: 3509837 - RNA, 20 nt, Pseudomonas aeruginosa PA01
gcaccucgucgagcagcgcg

SEQ ID NO: 3509838 - RNA, 13 nt, Pseudomonas aeruginosa PA01
gcaccugcgcccc

SEQ ID NO: 3509839 - RNA, 18 nt, Pseudomonas aeruginosa PA01
gcaccugcgggcugcgug

SEQ ID NO: 3509840 - RNA, 19 nt, Pseudomonas aeruginosa PA01
gcaccugcgggcugcgugc

SEQ ID NO: 3509841 - RNA, 21 nt, Pseudomonas aeruginosa PA01
gcaccugcgggcugcgugcca

SEQ ID NO: 3509842 - RNA, 15 nt, Pseudomonas aeruginosa PA01
gcaccugcucggggc

SEQ ID NO: 3509843 - RNA, 16 nt, Pseudomonas aeruginosa PA01
gcaccuggaccgggau

SEQ ID NO: 3509844 - RNA, 14 nt, Pseudomonas aeruginosa PA01
gcaccuggcgaugc

SEQ ID NO: 3509845 - RNA, 20 nt, Pseudomonas aeruginosa PA01
gcaccuggcgaugcccuggc

SEQ ID NO: 3509846 - RNA, 17 nt, Pseudomonas aeruginosa PA01
gcaccuggcggucgccg

SEQ ID NO: 3509847 - RNA, 20 nt, Pseudomonas aeruginosa PA01
gcaccuggcggucgccgccg

SEQ ID NO: 3509848 - RNA, 21 nt, Pseudomonas aeruginosa PA01
gcaccuggcggucgccgccgg

SEQ ID NO: 3509849 - RNA, 24 nt, Pseudomonas aeruginosa PA01
gcaccuggcggucgccgccggcga

SEQ ID NO: 3509850 - RNA, 20 nt, Pseudomonas aeruginosa PA01
gcaccugggacucccgcaga

SEQ ID NO: 3509851 - RNA, 17 nt, Pseudomonas aeruginosa PA01
gcaccugggcguuggcc

SEQ ID NO: 3509852 - RNA, 20 nt, Pseudomonas aeruginosa PA01
gcaccugggcguuggccagc

SEQ ID NO: 3509853 - RNA, 13 nt, Pseudomonas aeruginosa PA01
gcaccugggugcu

SEQ ID NO: 3509854 - RNA, 20 nt, Pseudomonas aeruginosa PA01
gcaccugggugcuuuccugc

SEQ ID NO: 3509855 - RNA, 17 nt, Pseudomonas aeruginosa PA01
gcaccugguggacaccc

SEQ ID NO: 3509856 - RNA, 20 nt, Pseudomonas aeruginosa PA01
gcaccugguggacacccugc

SEQ ID NO: 3509857 - RNA, 15 nt, Pseudomonas aeruginosa PA01
gcaccuguuccagca

SEQ ID NO: 3509858 - RNA, 17 nt, Pseudomonas aeruginosa PA01
gcaccuguuccagcaac

SEQ ID NO: 3509859 - RNA, 19 nt, Pseudomonas aeruginosa PA01
gcaccuguuccagcaacgc

SEQ ID NO: 3509860 - RNA, 21 nt, Pseudomonas aeruginosa PA01
gcaccuguuccagcaacgccu

SEQ ID NO: 3509861 - RNA, 18 nt, Pseudomonas aeruginosa PA01
gcaccuguuucagcgggu

SEQ ID NO: 3509862 - RNA, 18 nt, Pseudomonas aeruginosa PA01
gcaccuucaucaccaggu

SEQ ID NO: 3509863 - RNA, 21 nt, Pseudomonas aeruginosa PA01
gcaccuucaucaccaggucgc

SEQ ID NO: 3509864 - RNA, 22 nt, Pseudomonas aeruginosa PA01
gcaccuucaucaccaggucgcu

SEQ ID NO: 3509865 - RNA, 18 nt, Pseudomonas aeruginosa PA01
gcaccuugcgaaaagccc

SEQ ID NO: 3509866 - RNA, 19 nt, Pseudomonas aeruginosa PA01
gcaccuugcgaaaagcccg

SEQ ID NO: 3509867 - RNA, 12 nt, Pseudomonas aeruginosa PA01
gcaccuuggcca

SEQ ID NO: 3509868 - RNA, 16 nt, Pseudomonas aeruginosa PA01
gcaccuuggccacgcu

SEQ ID NO: 3509869 - RNA, 14 nt, Pseudomonas aeruginosa PA01
gcaccuuggccaug

SEQ ID NO: 3509870 - RNA, 15 nt, Pseudomonas aeruginosa PA01
gcaccuuggccaugg

SEQ ID NO: 3509871 - RNA, 20 nt, Pseudomonas aeruginosa PA01
gcaccuuggccaugggcacg

SEQ ID NO: 3509872 - RNA, 17 nt, Pseudomonas aeruginosa PA01
gcaccuugggaucgucg

SEQ ID NO: 3509873 - RNA, 13 nt, Pseudomonas aeruginosa PA01
gcacgaaagccau

SEQ ID NO: 3509874 - RNA, 18 nt, Pseudomonas aeruginosa PA01
gcacgaaagccaugccca

SEQ ID NO: 3509875 - RNA, 20 nt, Pseudomonas aeruginosa PA01
gcacgaaagccaugcccaga

SEQ ID NO: 3509876 - RNA, 21 nt, Pseudomonas aeruginosa PA01
gcacgaaagccaugcccagac

SEQ ID NO: 3509877 - RNA, 23 nt, Pseudomonas aeruginosa PA01
gcacgaaagcguucuucagcacu

SEQ ID NO: 3509878 - RNA, 23 nt, Pseudomonas aeruginosa PA01
gcacgaacagggucuucaggccg

SEQ ID NO: 3509879 - RNA, 17 nt, Pseudomonas aeruginosa PA01
gcacgaacaggugcugg

SEQ ID NO: 3509880 - RNA, 16 nt, Pseudomonas aeruginosa PA01
gcacgaacccaggcgc

SEQ ID NO: 3509881 - RNA, 17 nt, Pseudomonas aeruginosa PA01
gcacgaacccaggcgcu

SEQ ID NO: 3509882 - RNA, 17 nt, Pseudomonas aeruginosa PA01
gcacgaauuuccuggcg

SEQ ID NO: 3509883 - RNA, 19 nt, Pseudomonas aeruginosa PA01
gcacgaauuuccuggcgcg

SEQ ID NO: 3509884 - RNA, 20 nt, Pseudomonas aeruginosa PA01
gcacgaauuuccuggcgcgu

SEQ ID NO: 3509885 - RNA, 18 nt, Pseudomonas aeruginosa PA01
gcacgaccacaucggcca

SEQ ID NO: 3509886 - RNA, 19 nt, Pseudomonas aeruginosa PA01
gcacgaccacaucggccag

SEQ ID NO: 3509887 - RNA, 13 nt, Pseudomonas aeruginosa PA01
gcacgacgccggu

SEQ ID NO: 3509888 - RNA, 19 nt, Pseudomonas aeruginosa PA01
gcacgaggauuuccgcgcc

SEQ ID NO: 3509889 - RNA, 20 nt, Pseudomonas aeruginosa PA01
gcacgaggauuuccgcgccc

SEQ ID NO: 3509890 - RNA, 24 nt, Pseudomonas aeruginosa PA01
gcacgaggauuuccgcgcccggcu

SEQ ID NO: 3509891 - RNA, 14 nt, Pseudomonas aeruginosa PA01
gcacgaggcgggcu

SEQ ID NO: 3509892 - RNA, 17 nt, Pseudomonas aeruginosa PA01
gcacgagucgaggcgau

SEQ ID NO: 3509893 - RNA, 15 nt, Pseudomonas aeruginosa PA01
gcacgaugcacaggc

SEQ ID NO: 3509894 - RNA, 20 nt, Pseudomonas aeruginosa PA01
gcacgcaauagugcagcucc

SEQ ID NO: 3509895 - RNA, 14 nt, Pseudomonas aeruginosa PA01
gcacgcaauggcgc

SEQ ID NO: 3509896 - RNA, 17 nt, Pseudomonas aeruginosa PA01
gcacgcaauggcgcagc

SEQ ID NO: 3509897 - RNA, 22 nt, Pseudomonas aeruginosa PA01
gcacgcagcagcuucggcgcga

SEQ ID NO: 3509898 - RNA, 16 nt, Pseudomonas aeruginosa PA01
gcacgcaggccgcugc

SEQ ID NO: 3509899 - RNA, 16 nt, Pseudomonas aeruginosa PA01
gcacgcauagcgcgcu

SEQ ID NO: 3509900 - RNA, 15 nt, Pseudomonas aeruginosa PA01
gcacgccauccuccg

SEQ ID NO: 3509901 - RNA, 12 nt, Pseudomonas aeruginosa PA01
gcacgcccaggc

SEQ ID NO: 3509902 - RNA, 13 nt, Pseudomonas aeruginosa PA01
gcacgcccaggcg

SEQ ID NO: 3509903 - RNA, 14 nt, Pseudomonas aeruginosa PA01
gcacgcccaggcgc

SEQ ID NO: 3509904 - RNA, 21 nt, Pseudomonas aeruginosa PA01
gcacgcccaggcgcucggcga

SEQ ID NO: 3509905 - RNA, 19 nt, Pseudomonas aeruginosa PA01
gcacgcccaguugcgccgc

SEQ ID NO: 3509906 - RNA, 21 nt, Pseudomonas aeruginosa PA01
gcacgcccaguugcgccgccu

SEQ ID NO: 3509907 - RNA, 23 nt, Pseudomonas aeruginosa PA01
gcacgcccaucgccaccagcagg

SEQ ID NO: 3509908 - RNA, 15 nt, Pseudomonas aeruginosa PA01
gcacgcccauggaga

SEQ ID NO: 3509909 - RNA, 20 nt, Pseudomonas aeruginosa PA01
gcacgccccauccgggcggc

SEQ ID NO: 3509910 - RNA, 21 nt, Pseudomonas aeruginosa PA01
gcacgccccauccgggcggcg

SEQ ID NO: 3509911 - RNA, 23 nt, Pseudomonas aeruginosa PA01
gcacgccccauccgggcggcggg

SEQ ID NO: 3509912 - RNA, 20 nt, Pseudomonas aeruginosa PA01
gcacgcccugggacaggcgu

SEQ ID NO: 3509913 - RNA, 21 nt, Pseudomonas aeruginosa PA01
gcacgcccugggacaggcguc

SEQ ID NO: 3509914 - RNA, 22 nt, Pseudomonas aeruginosa PA01
gcacgcccugggacaggcgucc

SEQ ID NO: 3509915 - RNA, 12 nt, Pseudomonas aeruginosa PA01
gcacgccgaagu

SEQ ID NO: 3509916 - RNA, 18 nt, Pseudomonas aeruginosa PA01
gcacgccgaaguccugca

SEQ ID NO: 3509917 - RNA, 20 nt, Pseudomonas aeruginosa PA01
gcacgccgaaguccugcaac

SEQ ID NO: 3509918 - RNA, 23 nt, Pseudomonas aeruginosa PA01
gcacgccgaaguccugcaacagg

SEQ ID NO: 3509919 - RNA, 20 nt, Pseudomonas aeruginosa PA01
gcacgccgagcaacggcagc

SEQ ID NO: 3509920 - RNA, 12 nt, Pseudomonas aeruginosa PA01
gcacgccgaucc

SEQ ID NO: 3509921 - RNA, 16 nt, Pseudomonas aeruginosa PA01
gcacgccgcgaccgaa

SEQ ID NO: 3509922 - RNA, 17 nt, Pseudomonas aeruginosa PA01
gcacgccgcucugcccg

SEQ ID NO: 3509923 - RNA, 14 nt, Pseudomonas aeruginosa PA01
gcacgccgguggcc

SEQ ID NO: 3509924 - RNA, 17 nt, Pseudomonas aeruginosa PA01
gcacgccgguggccagg

SEQ ID NO: 3509925 - RNA, 18 nt, Pseudomonas aeruginosa PA01
gcacgccgguggccaggc

SEQ ID NO: 3509926 - RNA, 19 nt, Pseudomonas aeruginosa PA01
gcacgccgguggccaggcu

SEQ ID NO: 3509927 - RNA, 20 nt, Pseudomonas aeruginosa PA01
gcacgccgguggccaggcuc

SEQ ID NO: 3509928 - RNA, 12 nt, Pseudomonas aeruginosa PA01
gcacgccgucgc

SEQ ID NO: 3509929 - RNA, 20 nt, Pseudomonas aeruginosa PA01
gcacgccgugcagggucagg

SEQ ID NO: 3509930 - RNA, 20 nt, Pseudomonas aeruginosa PA01
gcacgccgugcaucaccggc

SEQ ID NO: 3509931 - RNA, 22 nt, Pseudomonas aeruginosa PA01
gcacgccgugcaucaccggcag

SEQ ID NO: 3509932 - RNA, 23 nt, Pseudomonas aeruginosa PA01
gcacgccgugcaucaccggcagc

SEQ ID NO: 3509933 - RNA, 13 nt, Pseudomonas aeruginosa PA01
gcacgccuuccag

SEQ ID NO: 3509934 - RNA, 11 nt, Pseudomonas aeruginosa PA01
gcacgcgccgg

SEQ ID NO: 3509935 - RNA, 16 nt, Pseudomonas aeruginosa PA01
gcacgcgccgggucgg

SEQ ID NO: 3509936 - RNA, 18 nt, Pseudomonas aeruginosa PA01
gcacgcggaucuggcccu

SEQ ID NO: 3509937 - RNA, 15 nt, Pseudomonas aeruginosa PA01
gcacgcucaggcagc

SEQ ID NO: 3509938 - RNA, 14 nt, Pseudomonas aeruginosa PA01
gcacgcucaggcgc

SEQ ID NO: 3509939 - RNA, 19 nt, Pseudomonas aeruginosa PA01
gcacgcucuggccguucuc

SEQ ID NO: 3509940 - RNA, 16 nt, Pseudomonas aeruginosa PA01
gcacgcucuguuucgg

SEQ ID NO: 3509941 - RNA, 23 nt, Pseudomonas aeruginosa PA01
gcacgcucuguuucgggucgccc

SEQ ID NO: 3509942 - RNA, 13 nt, Pseudomonas aeruginosa PA01
gcacgcugaagau

SEQ ID NO: 3509943 - RNA, 18 nt, Pseudomonas aeruginosa PA01
gcacgcugaagaucgcca

SEQ ID NO: 3509944 - RNA, 20 nt, Pseudomonas aeruginosa PA01
gcacgcugaagaucgccacg

SEQ ID NO: 3509945 - RNA, 18 nt, Pseudomonas aeruginosa PA01
gcacgcugacgccggcac

SEQ ID NO: 3509946 - RNA, 15 nt, Pseudomonas aeruginosa PA01
gcacgcugccagcag

SEQ ID NO: 3509947 - RNA, 18 nt, Pseudomonas aeruginosa PA01
gcacgcugccagcaggcc

SEQ ID NO: 3509948 - RNA, 21 nt, Pseudomonas aeruginosa PA01
gcacgcugccagcaggccgag

SEQ ID NO: 3509949 - RNA, 16 nt, Pseudomonas aeruginosa PA01
gcacgcugccgccgau

SEQ ID NO: 3509950 - RNA, 18 nt, Pseudomonas aeruginosa PA01
gcacgcugccgccgaugc

SEQ ID NO: 3509951 - RNA, 17 nt, Pseudomonas aeruginosa PA01
gcacgcugcgccggcgc

SEQ ID NO: 3509952 - RNA, 18 nt, Pseudomonas aeruginosa PA01
gcacgcugcgccggcgcu

SEQ ID NO: 3509953 - RNA, 16 nt, Pseudomonas aeruginosa PA01
gcacgcugcuugcgca

SEQ ID NO: 3509954 - RNA, 20 nt, Pseudomonas aeruginosa PA01
gcacgcugcuugcgcaccuc

SEQ ID NO: 3509955 - RNA, 12 nt, Pseudomonas aeruginosa PA01
gcacgcuggcga

SEQ ID NO: 3509956 - RNA, 13 nt, Pseudomonas aeruginosa PA01
gcacgcuggcgag

SEQ ID NO: 3509957 - RNA, 20 nt, Pseudomonas aeruginosa PA01
gcacgcuggcgaggacgccg

SEQ ID NO: 3509958 - RNA, 22 nt, Pseudomonas aeruginosa PA01
gcacgcuggcgaggacgccggg

SEQ ID NO: 3509959 - RNA, 23 nt, Pseudomonas aeruginosa PA01
gcacgcuggcgaggacgccgggc

SEQ ID NO: 3509960 - RNA, 22 nt, Pseudomonas aeruginosa PA01
gcacgcuggugaugucgcggca

SEQ ID NO: 3509961 - RNA, 23 nt, Pseudomonas aeruginosa PA01
gcacgcuggugaugucgcggcag

SEQ ID NO: 3509962 - RNA, 23 nt, Pseudomonas aeruginosa PA01
gcacgcuggugccgacgcugauc

SEQ ID NO: 3509963 - RNA, 16 nt, Pseudomonas aeruginosa PA01
gcacgcuguagaccag

SEQ ID NO: 3509964 - RNA, 20 nt, Pseudomonas aeruginosa PA01
gcacgcuucuccucggccga

SEQ ID NO: 3509965 - RNA, 18 nt, Pseudomonas aeruginosa PA01
gcacggaaacgccgagaa

SEQ ID NO: 3509966 - RNA, 17 nt, Pseudomonas aeruginosa PA01
gcacggaagggaaaaaa

SEQ ID NO: 3509967 - RNA, 15 nt, Pseudomonas aeruginosa PA01
gcacggaggcgcuca

SEQ ID NO: 3509968 - RNA, 16 nt, Pseudomonas aeruginosa PA01
gcacggaggcgcucag

SEQ ID NO: 3509969 - RNA, 20 nt, Pseudomonas aeruginosa PA01
gcacggauaccacccgcagc

SEQ ID NO: 3509970 - RNA, 15 nt, Pseudomonas aeruginosa PA01
gcacggaucgcgcug

SEQ ID NO: 3509971 - RNA, 21 nt, Pseudomonas aeruginosa PA01
gcacggaucgcgcugggcgca

SEQ ID NO: 3509972 - RNA, 23 nt, Pseudomonas aeruginosa PA01
gcacggaucgcgcugggcgcagc

SEQ ID NO: 3509973 - RNA, 14 nt, Pseudomonas aeruginosa PA01
gcacggaugcccag

SEQ ID NO: 3509974 - RNA, 16 nt, Pseudomonas aeruginosa PA01
gcacggcauagccacg

SEQ ID NO: 3509975 - RNA, 17 nt, Pseudomonas aeruginosa PA01
gcacggcauagccacgg

SEQ ID NO: 3509976 - RNA, 18 nt, Pseudomonas aeruginosa PA01
gcacggcauagccacggc

SEQ ID NO: 3509977 - RNA, 15 nt, Pseudomonas aeruginosa PA01
gcacggccaggccac

SEQ ID NO: 3509978 - RNA, 21 nt, Pseudomonas aeruginosa PA01
gcacggccaggccacggccgg

SEQ ID NO: 3509979 - RNA, 23 nt, Pseudomonas aeruginosa PA01
gcacggccaggccacggccggcg

SEQ ID NO: 3509980 - RNA, 18 nt, Pseudomonas aeruginosa PA01
gcacggccagucgcguug

SEQ ID NO: 3509981 - RNA, 16 nt, Pseudomonas aeruginosa PA01
gcacggccgucacggc

SEQ ID NO: 3509982 - RNA, 21 nt, Pseudomonas aeruginosa PA01
gcacggccgucacggccuccg

SEQ ID NO: 3509983 - RNA, 22 nt, Pseudomonas aeruginosa PA01
gcacggccgucacggccuccgg

SEQ ID NO: 3509984 - RNA, 12 nt, Pseudomonas aeruginosa PA01
gcacggccgucc

SEQ ID NO: 3509985 - RNA, 16 nt, Pseudomonas aeruginosa PA01
gcacggccucgcgugc

SEQ ID NO: 3509986 - RNA, 15 nt, Pseudomonas aeruginosa PA01
gcacggccugcaccu

SEQ ID NO: 3509987 - RNA, 18 nt, Pseudomonas aeruginosa PA01
gcacggcgaacaccgggc

SEQ ID NO: 3509988 - RNA, 19 nt, Pseudomonas aeruginosa PA01
gcacggcgaacaccgggcc

SEQ ID NO: 3509989 - RNA, 18 nt, Pseudomonas aeruginosa PA01
gcacggcgaauucgucgc

SEQ ID NO: 3509990 - RNA, 19 nt, Pseudomonas aeruginosa PA01
gcacggcgaauucgucgcc

SEQ ID NO: 3509991 - RNA, 18 nt, Pseudomonas aeruginosa PA01
gcacggcgacccgcacgu

SEQ ID NO: 3509992 - RNA, 22 nt, Pseudomonas aeruginosa PA01
gcacggcgacccgcacguugag

SEQ ID NO: 3509993 - RNA, 18 nt, Pseudomonas aeruginosa PA01
gcacggcgacggugccgg

SEQ ID NO: 3509994 - RNA, 18 nt, Pseudomonas aeruginosa PA01
gcacggcgauacccaggc

SEQ ID NO: 3509995 - RNA, 20 nt, Pseudomonas aeruginosa PA01
gcacggcgauacccaggccg

SEQ ID NO: 3509996 - RNA, 23 nt, Pseudomonas aeruginosa PA01
gcacggcgauacccaggccgucg

SEQ ID NO: 3509997 - RNA, 19 nt, Pseudomonas aeruginosa PA01
gcacggcggcuacccgcgc

SEQ ID NO: 3509998 - RNA, 13 nt, Pseudomonas aeruginosa PA01
gcacggcucggcg

SEQ ID NO: 3509999 - RNA, 16 nt, Pseudomonas aeruginosa PA01
gcacggcucggcgagg

SEQ ID NO: 3510000 - RNA, 22 nt, Pseudomonas aeruginosa PA01
gcacggcucggcgaggaacagc

SEQ ID NO: 3510001 - RNA, 23 nt, Pseudomonas aeruginosa PA01
gcacggcucggcgaggaacagca

SEQ ID NO: 3510002 - RNA, 19 nt, Pseudomonas aeruginosa PA01
gcacggcuucagcgccagg

SEQ ID NO: 3510003 - RNA, 20 nt, Pseudomonas aeruginosa PA01
gcacgggauuuccgauccuc

SEQ ID NO: 3510004 - RNA, 17 nt, Pseudomonas aeruginosa PA01
gcacggucauggccagc

SEQ ID NO: 3510005 - RNA, 12 nt, Pseudomonas aeruginosa PA01
gcacgguccgcg

SEQ ID NO: 3510006 - RNA, 19 nt, Pseudomonas aeruginosa PA01
gcacgguccgcgaaccgcu

SEQ ID NO: 3510007 - RNA, 15 nt, Pseudomonas aeruginosa PA01
gcacggucugcucgg

SEQ ID NO: 3510008 - RNA, 15 nt, Pseudomonas aeruginosa PA01
gcacggucuuggcgu

SEQ ID NO: 3510009 - RNA, 17 nt, Pseudomonas aeruginosa PA01
gcacggugaaccaggcg

SEQ ID NO: 3510010 - RNA, 19 nt, Pseudomonas aeruginosa PA01
gcacggugaaccaggcgcc

SEQ ID NO: 3510011 - RNA, 20 nt, Pseudomonas aeruginosa PA01
gcacggugacacccugccgc

SEQ ID NO: 3510012 - RNA, 23 nt, Pseudomonas aeruginosa PA01
gcacggugacacccugccgcgcc

SEQ ID NO: 3510013 - RNA, 16 nt, Pseudomonas aeruginosa PA01
gcacggugcuggcguc

SEQ ID NO: 3510014 - RNA, 19 nt, Pseudomonas aeruginosa PA01
gcacguacuuuggucgagu

SEQ ID NO: 3510015 - RNA, 15 nt, Pseudomonas aeruginosa PA01
gcacguagccgcccu

SEQ ID NO: 3510016 - RNA, 20 nt, Pseudomonas aeruginosa PA01
gcacgucgauauccagcggc

SEQ ID NO: 3510017 - RNA, 21 nt, Pseudomonas aeruginosa PA01
gcacgucgauauccagcggca

SEQ ID NO: 3510018 - RNA, 15 nt, Pseudomonas aeruginosa PA01
gcacgucgcggauca

SEQ ID NO: 3510019 - RNA, 22 nt, Pseudomonas aeruginosa PA01
gcacgucgcggcggauaacgcc

SEQ ID NO: 3510020 - RNA, 18 nt, Pseudomonas aeruginosa PA01
gcacgucguccagcgccg

SEQ ID NO: 3510021 - RNA, 20 nt, Pseudomonas aeruginosa PA01
gcacgucguccagcgccgag

SEQ ID NO: 3510022 - RNA, 14 nt, Pseudomonas aeruginosa PA01
gcacgugcagcggc

SEQ ID NO: 3510023 - RNA, 17 nt, Pseudomonas aeruginosa PA01
gcacgugcagcggcagc

SEQ ID NO: 3510024 - RNA, 15 nt, Pseudomonas aeruginosa PA01
gcacgugcagcucgg

SEQ ID NO: 3510025 - RNA, 18 nt, Pseudomonas aeruginosa PA01
gcacguugaggucgaaga

SEQ ID NO: 3510026 - RNA, 16 nt, Pseudomonas aeruginosa PA01
gcacguugccauccag

SEQ ID NO: 3510027 - RNA, 20 nt, Pseudomonas aeruginosa PA01
gcacguugccauccagcgcc

SEQ ID NO: 3510028 - RNA, 19 nt, Pseudomonas aeruginosa PA01
gcacguugcugugcugcac

SEQ ID NO: 3510029 - RNA, 21 nt, Pseudomonas aeruginosa PA01
gcacguugcugugcugcacca

SEQ ID NO: 3510030 - RNA, 22 nt, Pseudomonas aeruginosa PA01
gcacguugcugugcugcaccag

SEQ ID NO: 3510031 - RNA, 21 nt, Pseudomonas aeruginosa PA01
gcacguugggauagcuuucca

SEQ ID NO: 3510032 - RNA, 18 nt, Pseudomonas aeruginosa PA01
gcacguuguugcccaccu

SEQ ID NO: 3510033 - RNA, 13 nt, Pseudomonas aeruginosa PA01
gcacuacgcccau

SEQ ID NO: 3510034 - RNA, 14 nt, Pseudomonas aeruginosa PA01
gcacucagccagcg

SEQ ID NO: 3510035 - RNA, 15 nt, Pseudomonas aeruginosa PA01
gcacucagccagcgg

SEQ ID NO: 3510036 - RNA, 22 nt, Pseudomonas aeruginosa PA01
gcacucaggaaaaaacgccggu

SEQ ID NO: 3510037 - RNA, 14 nt, Pseudomonas aeruginosa PA01
gcacucauagcuca

SEQ ID NO: 3510038 - RNA, 16 nt, Pseudomonas aeruginosa PA01
gcacucauagcucagc

SEQ ID NO: 3510039 - RNA, 17 nt, Pseudomonas aeruginosa PA01
gcacucauagcucagcu

SEQ ID NO: 3510040 - RNA, 18 nt, Pseudomonas aeruginosa PA01
gcacucauagcucagcug

SEQ ID NO: 3510041 - RNA, 20 nt, Pseudomonas aeruginosa PA01
gcacuccggcauaccgcccg

SEQ ID NO: 3510042 - RNA, 21 nt, Pseudomonas aeruginosa PA01
gcacuccgggcagaccagcag

SEQ ID NO: 3510043 - RNA, 23 nt, Pseudomonas aeruginosa PA01
gcacuccgggcagaccagcagcg

SEQ ID NO: 3510044 - RNA, 17 nt, Pseudomonas aeruginosa PA01
gcacucgaugaacagcg

SEQ ID NO: 3510045 - RNA, 14 nt, Pseudomonas aeruginosa PA01
gcacucgccgggcg

SEQ ID NO: 3510046 - RNA, 14 nt, Pseudomonas aeruginosa PA01
gcacucgcuccucc

SEQ ID NO: 3510047 - RNA, 14 nt, Pseudomonas aeruginosa PA01
gcacucggcgacca

SEQ ID NO: 3510048 - RNA, 22 nt, Pseudomonas aeruginosa PA01
gcacucggcgaccacccggcgg

SEQ ID NO: 3510049 - RNA, 23 nt, Pseudomonas aeruginosa PA01
gcacucggcgaccacccggcggu

SEQ ID NO: 3510050 - RNA, 20 nt, Pseudomonas aeruginosa PA01
gcacugagcuuaaggcaggu

SEQ ID NO: 3510051 - RNA, 21 nt, Pseudomonas aeruginosa PA01
gcacugagggucagccgcagg

SEQ ID NO: 3510052 - RNA, 23 nt, Pseudomonas aeruginosa PA01
gcacugagggucagccgcaggcc

SEQ ID NO: 3510053 - RNA, 14 nt, Pseudomonas aeruginosa PA01
gcacugccaggagc

SEQ ID NO: 3510054 - RNA, 18 nt, Pseudomonas aeruginosa PA01
gcacugccaggagcacgc

SEQ ID NO: 3510055 - RNA, 13 nt, Pseudomonas aeruginosa PA01
gcacugcggcggu

SEQ ID NO: 3510056 - RNA, 23 nt, Pseudomonas aeruginosa PA01
gcacugcguggguagccauggcg

SEQ ID NO: 3510057 - RNA, 20 nt, Pseudomonas aeruginosa PA01
gcacuggcccucucucgccu

SEQ ID NO: 3510058 - RNA, 21 nt, Pseudomonas aeruginosa PA01
gcacuggucggccaguuccuu

SEQ ID NO: 3510059 - RNA, 23 nt, Pseudomonas aeruginosa PA01
gcacuggucggccaguuccuuca

SEQ ID NO: 3510060 - RNA, 18 nt, Pseudomonas aeruginosa PA01
gcacugguggcgaacagc

SEQ ID NO: 3510061 - RNA, 19 nt, Pseudomonas aeruginosa PA01
gcacugguggcgaacagca

SEQ ID NO: 3510062 - RNA, 20 nt, Pseudomonas aeruginosa PA01
gcacugguggcgaacagcac

SEQ ID NO: 3510063 - RNA, 23 nt, Pseudomonas aeruginosa PA01
gcacugguggcgaacagcaccuu

SEQ ID NO: 3510064 - RNA, 18 nt, Pseudomonas aeruginosa PA01
gcacuuccacuccaggcg

SEQ ID NO: 3510065 - RNA, 17 nt, Pseudomonas aeruginosa PA01
gcacuuccaggcgccaa

SEQ ID NO: 3510066 - RNA, 21 nt, Pseudomonas aeruginosa PA01
gcacuucccaggugcccugga

SEQ ID NO: 3510067 - RNA, 23 nt, Pseudomonas aeruginosa PA01
gcacuuccggacugcccagcgcc

SEQ ID NO: 3510068 - RNA, 15 nt, Pseudomonas aeruginosa PA01
gcacuuccucggcga

SEQ ID NO: 3510069 - RNA, 20 nt, Pseudomonas aeruginosa PA01
gcacuuccugaaggcgcggg

SEQ ID NO: 3510070 - RNA, 12 nt, Pseudomonas aeruginosa PA01
gcacuucggcgc

SEQ ID NO: 3510071 - RNA, 19 nt, Pseudomonas aeruginosa PA01
gcacuucggcgcgcggcag

SEQ ID NO: 3510072 - RNA, 18 nt, Pseudomonas aeruginosa PA01
gcacuucguccaggccgc

SEQ ID NO: 3510073 - RNA, 20 nt, Pseudomonas aeruginosa PA01
gcacuucguccaggccgccu

SEQ ID NO: 3510074 - RNA, 21 nt, Pseudomonas aeruginosa PA01
gcacuucguccaggccgccua

SEQ ID NO: 3510075 - RNA, 16 nt, Pseudomonas aeruginosa PA01
gcacuucguccgccac

SEQ ID NO: 3510076 - RNA, 16 nt, Pseudomonas aeruginosa PA01
gcacuucucgaacagc

SEQ ID NO: 3510077 - RNA, 17 nt, Pseudomonas aeruginosa PA01
gcacuucucgaacagcu

SEQ ID NO: 3510078 - RNA, 19 nt, Pseudomonas aeruginosa PA01
gcacuucucgaacagcucc

SEQ ID NO: 3510079 - RNA, 16 nt, Pseudomonas aeruginosa PA01
gcacuuguugguaugg

SEQ ID NO: 3510080 - RNA, 11 nt, Pseudomonas aeruginosa PA01
gcacuuugcau

SEQ ID NO: 3510081 - RNA, 13 nt, Pseudomonas aeruginosa PA01
gcagaacacccgg

SEQ ID NO: 3510082 - RNA, 22 nt, Pseudomonas aeruginosa PA01
gcagaaccagacgcucggccag

SEQ ID NO: 3510083 - RNA, 13 nt, Pseudomonas aeruginosa PA01
gcagaaccgccag

SEQ ID NO: 3510084 - RNA, 14 nt, Pseudomonas aeruginosa PA01
gcagaacgccccgc

SEQ ID NO: 3510085 - RNA, 16 nt, Pseudomonas aeruginosa PA01
gcagaacggauagcga

SEQ ID NO: 3510086 - RNA, 22 nt, Pseudomonas aeruginosa PA01
gcagaacuugcgcaccgcgccg

SEQ ID NO: 3510087 - RNA, 20 nt, Pseudomonas aeruginosa PA01
gcagaagcuuucccauuguu

SEQ ID NO: 3510088 - RNA, 22 nt, Pseudomonas aeruginosa PA01
gcagaaggcgcuuucguagggg

SEQ ID NO: 3510089 - RNA, 13 nt, Pseudomonas aeruginosa PA01
gcagaagggcgga

SEQ ID NO: 3510090 - RNA, 15 nt, Pseudomonas aeruginosa PA01
gcagaagggcggaga

SEQ ID NO: 3510091 - RNA, 16 nt, Pseudomonas aeruginosa PA01
gcagacaucgccgagg

SEQ ID NO: 3510092 - RNA, 13 nt, Pseudomonas aeruginosa PA01
gcagaccagcagc

SEQ ID NO: 3510093 - RNA, 16 nt, Pseudomonas aeruginosa PA01
gcagaccagcagcgca

SEQ ID NO: 3510094 - RNA, 24 nt, Pseudomonas aeruginosa PA01
gcagaccagcagcgcaccauccuc

SEQ ID NO: 3510095 - RNA, 15 nt, Pseudomonas aeruginosa PA01
gcagaccagcgaacc

SEQ ID NO: 3510096 - RNA, 21 nt, Pseudomonas aeruginosa PA01
gcagaccagcgaaccgccggc

SEQ ID NO: 3510097 - RNA, 23 nt, Pseudomonas aeruginosa PA01
gcagaccagcgaaccgccggccu

SEQ ID NO: 3510098 - RNA, 22 nt, Pseudomonas aeruginosa PA01
gcagaccagcgcaagcggcggc

SEQ ID NO: 3510099 - RNA, 13 nt, Pseudomonas aeruginosa PA01
gcagaccaggccg

SEQ ID NO: 3510100 - RNA, 14 nt, Pseudomonas aeruginosa PA01
gcagaccaggccga

SEQ ID NO: 3510101 - RNA, 17 nt, Pseudomonas aeruginosa PA01
gcagaccaggccgagca

SEQ ID NO: 3510102 - RNA, 21 nt, Pseudomonas aeruginosa PA01
gcagaccaggccgagcaggaa

SEQ ID NO: 3510103 - RNA, 17 nt, Pseudomonas aeruginosa PA01
gcagaccaucagcugga

SEQ ID NO: 3510104 - RNA, 14 nt, Pseudomonas aeruginosa PA01
gcagaccugcagca

SEQ ID NO: 3510105 - RNA, 15 nt, Pseudomonas aeruginosa PA01
gcagaccugcagcag

SEQ ID NO: 3510106 - RNA, 16 nt, Pseudomonas aeruginosa PA01
gcagaccugcagcagg

SEQ ID NO: 3510107 - RNA, 20 nt, Pseudomonas aeruginosa PA01
gcagaccuggugggcggcgg

SEQ ID NO: 3510108 - RNA, 19 nt, Pseudomonas aeruginosa PA01
gcagacgcccugaggcuuu

SEQ ID NO: 3510109 - RNA, 21 nt, Pseudomonas aeruginosa PA01
gcagacggcacgacgccggug

SEQ ID NO: 3510110 - RNA, 23 nt, Pseudomonas aeruginosa PA01
gcagacggcuguugucgaacagg

SEQ ID NO: 3510111 - RNA, 17 nt, Pseudomonas aeruginosa PA01
gcagacggggccucgcu

SEQ ID NO: 3510112 - RNA, 21 nt, Pseudomonas aeruginosa PA01
gcagacggggccucgcugccu

SEQ ID NO: 3510113 - RNA, 17 nt, Pseudomonas aeruginosa PA01
gcagacgggugcugaag

SEQ ID NO: 3510114 - RNA, 17 nt, Pseudomonas aeruginosa PA01
gcagacgguucagcagc

SEQ ID NO: 3510115 - RNA, 18 nt, Pseudomonas aeruginosa PA01
gcagacgguucagcagcg

SEQ ID NO: 3510116 - RNA, 22 nt, Pseudomonas aeruginosa PA01
gcagacgguucagcagcggcac

SEQ ID NO: 3510117 - RNA, 13 nt, Pseudomonas aeruginosa PA01
gcagacgucgagg

SEQ ID NO: 3510118 - RNA, 18 nt, Pseudomonas aeruginosa PA01
gcagacgucuuccgggac

SEQ ID NO: 3510119 - RNA, 19 nt, Pseudomonas aeruginosa PA01
gcagacguggcauucgucg

SEQ ID NO: 3510120 - RNA, 18 nt, Pseudomonas aeruginosa PA01
gcagacuccggcgcagcc

SEQ ID NO: 3510121 - RNA, 21 nt, Pseudomonas aeruginosa PA01
gcagacuccggcgcagcccag

SEQ ID NO: 3510122 - RNA, 23 nt, Pseudomonas aeruginosa PA01
gcagacuccggcgcagcccagcc

SEQ ID NO: 3510123 - RNA, 18 nt, Pseudomonas aeruginosa PA01
gcagacuucgccgugcuc

SEQ ID NO: 3510124 - RNA, 18 nt, Pseudomonas aeruginosa PA01
gcagagaaaaggccgcuu

SEQ ID NO: 3510125 - RNA, 16 nt, Pseudomonas aeruginosa PA01
gcagagacgcagcgcu

SEQ ID NO: 3510126 - RNA, 16 nt, Pseudomonas aeruginosa PA01
gcagagaggcuggcgc

SEQ ID NO: 3510127 - RNA, 14 nt, Pseudomonas aeruginosa PA01
gcagagaucggcgg

SEQ ID NO: 3510128 - RNA, 16 nt, Pseudomonas aeruginosa PA01
gcagagaucggcggcg

SEQ ID NO: 3510129 - RNA, 14 nt, Pseudomonas aeruginosa PA01
gcagagcaucaccc

SEQ ID NO: 3510130 - RNA, 15 nt, Pseudomonas aeruginosa PA01
gcagagccagccgca

SEQ ID NO: 3510131 - RNA, 16 nt, Pseudomonas aeruginosa PA01
gcagagccagccgcag

SEQ ID NO: 3510132 - RNA, 18 nt, Pseudomonas aeruginosa PA01
gcagagccagccgcagcc

SEQ ID NO: 3510133 - RNA, 15 nt, Pseudomonas aeruginosa PA01
gcagagcgccagcca

SEQ ID NO: 3510134 - RNA, 14 nt, Pseudomonas aeruginosa PA01
gcagagcgccauga

SEQ ID NO: 3510135 - RNA, 19 nt, Pseudomonas aeruginosa PA01
gcagagcgccaugacccgc

SEQ ID NO: 3510136 - RNA, 14 nt, Pseudomonas aeruginosa PA01
gcagagcggcaggc

SEQ ID NO: 3510137 - RNA, 19 nt, Pseudomonas aeruginosa PA01
gcagagcggcaggccgccg

SEQ ID NO: 3510138 - RNA, 20 nt, Pseudomonas aeruginosa PA01
gcagagcggcaggccgccga

SEQ ID NO: 3510139 - RNA, 15 nt, Pseudomonas aeruginosa PA01
gcagagcggccaggu

SEQ ID NO: 3510140 - RNA, 21 nt, Pseudomonas aeruginosa PA01
gcagagcggccaggucgaggu

SEQ ID NO: 3510141 - RNA, 16 nt, Pseudomonas aeruginosa PA01
gcagagcuggaagucg

SEQ ID NO: 3510142 - RNA, 22 nt, Pseudomonas aeruginosa PA01
gcagagcuggaagucguccagc

SEQ ID NO: 3510143 - RNA, 14 nt, Pseudomonas aeruginosa PA01
gcagaggcgcucca

SEQ ID NO: 3510144 - RNA, 18 nt, Pseudomonas aeruginosa PA01
gcagaggcgcuccaccag

SEQ ID NO: 3510145 - RNA, 21 nt, Pseudomonas aeruginosa PA01
gcagaggcgcuccaccagggc

SEQ ID NO: 3510146 - RNA, 14 nt, Pseudomonas aeruginosa PA01
gcagagggcgaugc

SEQ ID NO: 3510147 - RNA, 15 nt, Pseudomonas aeruginosa PA01
gcagagggcgaugcc

SEQ ID NO: 3510148 - RNA, 17 nt, Pseudomonas aeruginosa PA01
gcagagggucgccagcg

SEQ ID NO: 3510149 - RNA, 18 nt, Pseudomonas aeruginosa PA01
gcagaguuuagccgccag

SEQ ID NO: 3510150 - RNA, 23 nt, Pseudomonas aeruginosa PA01
gcagaguuucucggucgccgcca

SEQ ID NO: 3510151 - RNA, 14 nt, Pseudomonas aeruginosa PA01
gcagauaaagcugg

SEQ ID NO: 3510152 - RNA, 15 nt, Pseudomonas aeruginosa PA01
gcagauaaagcugga

SEQ ID NO: 3510153 - RNA, 18 nt, Pseudomonas aeruginosa PA01
gcagauaucgugcaggcg

SEQ ID NO: 3510154 - RNA, 14 nt, Pseudomonas aeruginosa PA01
gcagauccagcggc

SEQ ID NO: 3510155 - RNA, 16 nt, Pseudomonas aeruginosa PA01
gcagauccagcggcag

SEQ ID NO: 3510156 - RNA, 22 nt, Pseudomonas aeruginosa PA01
gcagaucgccgcguagcgccag

SEQ ID NO: 3510157 - RNA, 14 nt, Pseudomonas aeruginosa PA01
gcagaucgcgccga

SEQ ID NO: 3510158 - RNA, 15 nt, Pseudomonas aeruginosa PA01
gcagaucgcgccgag

SEQ ID NO: 3510159 - RNA, 16 nt, Pseudomonas aeruginosa PA01
gcagaucgcgccgagc

SEQ ID NO: 3510160 - RNA, 17 nt, Pseudomonas aeruginosa PA01
gcagaucgcgccgagcu

SEQ ID NO: 3510161 - RNA, 21 nt, Pseudomonas aeruginosa PA01
gcagaucgcgccgagcuggcg

SEQ ID NO: 3510162 - RNA, 15 nt, Pseudomonas aeruginosa PA01
gcagaucgcguccag

SEQ ID NO: 3510163 - RNA, 16 nt, Pseudomonas aeruginosa PA01
gcagaucgcguccagg

SEQ ID NO: 3510164 - RNA, 18 nt, Pseudomonas aeruginosa PA01
gcagaucgcguccagggu

SEQ ID NO: 3510165 - RNA, 20 nt, Pseudomonas aeruginosa PA01
gcagaucggugcgggcagac

SEQ ID NO: 3510166 - RNA, 21 nt, Pseudomonas aeruginosa PA01
gcagaucggugcgggcagaca

SEQ ID NO: 3510167 - RNA, 16 nt, Pseudomonas aeruginosa PA01
gcagaugaccagcgca

SEQ ID NO: 3510168 - RNA, 15 nt, Pseudomonas aeruginosa PA01
gcagaugaucgccac

SEQ ID NO: 3510169 - RNA, 13 nt, Pseudomonas aeruginosa PA01
gcagaugccgggc

SEQ ID NO: 3510170 - RNA, 15 nt, Pseudomonas aeruginosa PA01
gcagaugcggggcga

SEQ ID NO: 3510171 - RNA, 19 nt, Pseudomonas aeruginosa PA01
gcagaugcggggcgaccag

SEQ ID NO: 3510172 - RNA, 24 nt, Pseudomonas aeruginosa PA01
gcagaugcuccagggagcgcucgc

SEQ ID NO: 3510173 - RNA, 16 nt, Pseudomonas aeruginosa PA01
gcagauggucgccgga

SEQ ID NO: 3510174 - RNA, 13 nt, Pseudomonas aeruginosa PA01
gcagauguccagg

SEQ ID NO: 3510175 - RNA, 15 nt, Pseudomonas aeruginosa PA01
gcagauguccaggca

SEQ ID NO: 3510176 - RNA, 13 nt, Pseudomonas aeruginosa PA01
gcagaugucgguc

SEQ ID NO: 3510177 - RNA, 18 nt, Pseudomonas aeruginosa PA01
gcagaugucguucuugcg

SEQ ID NO: 3510178 - RNA, 23 nt, Pseudomonas aeruginosa PA01
gcagaugucguucuugcgcgguc

SEQ ID NO: 3510179 - RNA, 15 nt, Pseudomonas aeruginosa PA01
gcagauuccuggacc

SEQ ID NO: 3510180 - RNA, 16 nt, Pseudomonas aeruginosa PA01
gcagauuccuggaccc

SEQ ID NO: 3510181 - RNA, 13 nt, Pseudomonas aeruginosa PA01
gcagcaacagcgc

SEQ ID NO: 3510182 - RNA, 15 nt, Pseudomonas aeruginosa PA01
gcagcaacagcgccg

SEQ ID NO: 3510183 - RNA, 16 nt, Pseudomonas aeruginosa PA01
gcagcaacagcgccgc

SEQ ID NO: 3510184 - RNA, 18 nt, Pseudomonas aeruginosa PA01
gcagcaacagcgccgcgc

SEQ ID NO: 3510185 - RNA, 19 nt, Pseudomonas aeruginosa PA01
gcagcaacagcgccgcgcg

SEQ ID NO: 3510186 - RNA, 14 nt, Pseudomonas aeruginosa PA01
gcagcaacccggcc

SEQ ID NO: 3510187 - RNA, 16 nt, Pseudomonas aeruginosa PA01
gcagcaacccggccca

SEQ ID NO: 3510188 - RNA, 20 nt, Pseudomonas aeruginosa PA01
gcagcaacccggcccagcgu

SEQ ID NO: 3510189 - RNA, 21 nt, Pseudomonas aeruginosa PA01
gcagcaacggcgcaucgucga

SEQ ID NO: 3510190 - RNA, 19 nt, Pseudomonas aeruginosa PA01
gcagcaacuggucgccgca

SEQ ID NO: 3510191 - RNA, 16 nt, Pseudomonas aeruginosa PA01
gcagcaagccgcagcg

SEQ ID NO: 3510192 - RNA, 19 nt, Pseudomonas aeruginosa PA01
gcagcaagccgcagcgccc

SEQ ID NO: 3510193 - RNA, 16 nt, Pseudomonas aeruginosa PA01
gcagcacagccccagc

SEQ ID NO: 3510194 - RNA, 18 nt, Pseudomonas aeruginosa PA01
gcagcacagccccagccu

SEQ ID NO: 3510195 - RNA, 23 nt, Pseudomonas aeruginosa PA01
gcagcacagccccagccucggca

SEQ ID NO: 3510196 - RNA, 17 nt, Pseudomonas aeruginosa PA01
gcagcacaugccacgca

SEQ ID NO: 3510197 - RNA, 19 nt, Pseudomonas aeruginosa PA01
gcagcaccacauggguguc

SEQ ID NO: 3510198 - RNA, 13 nt, Pseudomonas aeruginosa PA01
gcagcaccaccuc

SEQ ID NO: 3510199 - RNA, 15 nt, Pseudomonas aeruginosa PA01
gcagcaccaccucgc

SEQ ID NO: 3510200 - RNA, 18 nt, Pseudomonas aeruginosa PA01
gcagcaccaccucgccaa

SEQ ID NO: 3510201 - RNA, 23 nt, Pseudomonas aeruginosa PA01
gcagcaccaccucgccaagcugg

SEQ ID NO: 3510202 - RNA, 12 nt, Pseudomonas aeruginosa PA01
gcagcaccagca

SEQ ID NO: 3510203 - RNA, 15 nt, Pseudomonas aeruginosa PA01
gcagcaccagcacca

SEQ ID NO: 3510204 - RNA, 14 nt, Pseudomonas aeruginosa PA01
gcagcaccaggcug

SEQ ID NO: 3510205 - RNA, 16 nt, Pseudomonas aeruginosa PA01
gcagcaccaggcuggc

SEQ ID NO: 3510206 - RNA, 20 nt, Pseudomonas aeruginosa PA01
gcagcaccaggcuggccagu

SEQ ID NO: 3510207 - RNA, 12 nt, Pseudomonas aeruginosa PA01
gcagcaccauca

SEQ ID NO: 3510208 - RNA, 16 nt, Pseudomonas aeruginosa PA01
gcagcaccaucagcca

SEQ ID NO: 3510209 - RNA, 13 nt, Pseudomonas aeruginosa PA01
gcagcacccccag

SEQ ID NO: 3510210 - RNA, 18 nt, Pseudomonas aeruginosa PA01
gcagcacccccagcaggc

SEQ ID NO: 3510211 - RNA, 19 nt, Pseudomonas aeruginosa PA01
gcagcacccccagcaggcc

SEQ ID NO: 3510212 - RNA, 22 nt, Pseudomonas aeruginosa PA01
gcagcacccccagcaggccagc

SEQ ID NO: 3510213 - RNA, 23 nt, Pseudomonas aeruginosa PA01
gcagcacccccagcaggccagcc

SEQ ID NO: 3510214 - RNA, 17 nt, Pseudomonas aeruginosa PA01
gcagcacccgcaccagc

SEQ ID NO: 3510215 - RNA, 21 nt, Pseudomonas aeruginosa PA01
gcagcacccgcaccagccggc

SEQ ID NO: 3510216 - RNA, 11 nt, Pseudomonas aeruginosa PA01
gcagcaccgcc

SEQ ID NO: 3510217 - RNA, 13 nt, Pseudomonas aeruginosa PA01
gcagcaccgccug

SEQ ID NO: 3510218 - RNA, 16 nt, Pseudomonas aeruginosa PA01
gcagcaccgccugguc

SEQ ID NO: 3510219 - RNA, 13 nt, Pseudomonas aeruginosa PA01
gcagcaccgcgag

SEQ ID NO: 3510220 - RNA, 14 nt, Pseudomonas aeruginosa PA01
gcagcaccgcgagc

SEQ ID NO: 3510221 - RNA, 15 nt, Pseudomonas aeruginosa PA01
gcagcaccgcgagca

SEQ ID NO: 3510222 - RNA, 17 nt, Pseudomonas aeruginosa PA01
gcagcaccgcgagcaug

SEQ ID NO: 3510223 - RNA, 15 nt, Pseudomonas aeruginosa PA01
gcagcaccgcgcgcu

SEQ ID NO: 3510224 - RNA, 12 nt, Pseudomonas aeruginosa PA01
gcagcaccggcu

SEQ ID NO: 3510225 - RNA, 22 nt, Pseudomonas aeruginosa PA01
gcagcaccggcuuguugcgcuc

SEQ ID NO: 3510226 - RNA, 15 nt, Pseudomonas aeruginosa PA01
gcagcacgaugaggc

SEQ ID NO: 3510227 - RNA, 14 nt, Pseudomonas aeruginosa PA01
gcagcacgaugcac

SEQ ID NO: 3510228 - RNA, 17 nt, Pseudomonas aeruginosa PA01
gcagcacgcugacgccg

SEQ ID NO: 3510229 - RNA, 19 nt, Pseudomonas aeruginosa PA01
gcagcacgcugacgccggc

SEQ ID NO: 3510230 - RNA, 20 nt, Pseudomonas aeruginosa PA01
gcagcacgcugacgccggca

SEQ ID NO: 3510231 - RNA, 20 nt, Pseudomonas aeruginosa PA01
gcagcacgcuggcgucgggc

SEQ ID NO: 3510232 - RNA, 14 nt, Pseudomonas aeruginosa PA01
gcagcacggccucg

SEQ ID NO: 3510233 - RNA, 16 nt, Pseudomonas aeruginosa PA01
gcagcacggccucgcg

SEQ ID NO: 3510234 - RNA, 16 nt, Pseudomonas aeruginosa PA01
gcagcacggcgacgaa

SEQ ID NO: 3510235 - RNA, 23 nt, Pseudomonas aeruginosa PA01
gcagcacggcgacgaaggccugg

SEQ ID NO: 3510236 - RNA, 23 nt, Pseudomonas aeruginosa PA01
gcagcacuuccugaaggcgcggg

SEQ ID NO: 3510237 - RNA, 14 nt, Pseudomonas aeruginosa PA01
gcagcagagcgcca

SEQ ID NO: 3510238 - RNA, 15 nt, Pseudomonas aeruginosa PA01
gcagcagagcgccac

SEQ ID NO: 3510239 - RNA, 23 nt, Pseudomonas aeruginosa PA01
gcagcagccaaccgucgcccugg

SEQ ID NO: 3510240 - RNA, 15 nt, Pseudomonas aeruginosa PA01
gcagcagcgaacgcc

SEQ ID NO: 3510241 - RNA, 16 nt, Pseudomonas aeruginosa PA01
gcagcagcgaacgccg

SEQ ID NO: 3510242 - RNA, 16 nt, Pseudomonas aeruginosa PA01
gcagcagcgaccugac

SEQ ID NO: 3510243 - RNA, 20 nt, Pseudomonas aeruginosa PA01
gcagcagcgaccugacccgc

SEQ ID NO: 3510244 - RNA, 18 nt, Pseudomonas aeruginosa PA01
gcagcagcgccaggaagc

SEQ ID NO: 3510245 - RNA, 13 nt, Pseudomonas aeruginosa PA01
gcagcagcgccgc

SEQ ID NO: 3510246 - RNA, 12 nt, Pseudomonas aeruginosa PA01
gcagcagcgccu

SEQ ID NO: 3510247 - RNA, 14 nt, Pseudomonas aeruginosa PA01
gcagcagcgccuuc

SEQ ID NO: 3510248 - RNA, 21 nt, Pseudomonas aeruginosa PA01
gcagcagcggauauucgacgc

SEQ ID NO: 3510249 - RNA, 21 nt, Pseudomonas aeruginosa PA01
gcagcagcggaucggcggugc

SEQ ID NO: 3510250 - RNA, 22 nt, Pseudomonas aeruginosa PA01
gcagcagcggaucggcggugcc

SEQ ID NO: 3510251 - RNA, 12 nt, Pseudomonas aeruginosa PA01
gcagcagcggca

SEQ ID NO: 3510252 - RNA, 19 nt, Pseudomonas aeruginosa PA01
gcagcagcgguacggucga

SEQ ID NO: 3510253 - RNA, 23 nt, Pseudomonas aeruginosa PA01
gcagcagcgguacggucgaggcg

SEQ ID NO: 3510254 - RNA, 14 nt, Pseudomonas aeruginosa PA01
gcagcagcgucgcg

SEQ ID NO: 3510255 - RNA, 14 nt, Pseudomonas aeruginosa PA01
gcagcagcuugccg

SEQ ID NO: 3510256 - RNA, 15 nt, Pseudomonas aeruginosa PA01
gcagcagcuugccgg

SEQ ID NO: 3510257 - RNA, 16 nt, Pseudomonas aeruginosa PA01
gcagcagcuugccggc

SEQ ID NO: 3510258 - RNA, 16 nt, Pseudomonas aeruginosa PA01
gcagcaggaucagcgc

SEQ ID NO: 3510259 - RNA, 16 nt, Pseudomonas aeruginosa PA01
gcagcaggauccaggu

SEQ ID NO: 3510260 - RNA, 23 nt, Pseudomonas aeruginosa PA01
gcagcaggauccaggugcgcggc

SEQ ID NO: 3510261 - RNA, 16 nt, Pseudomonas aeruginosa PA01
gcagcaggcacagggc

SEQ ID NO: 3510262 - RNA, 14 nt, Pseudomonas aeruginosa PA01
gcagcaggccgccg

SEQ ID NO: 3510263 - RNA, 15 nt, Pseudomonas aeruginosa PA01
gcagcaggccgccgc

SEQ ID NO: 3510264 - RNA, 17 nt, Pseudomonas aeruginosa PA01
gcagcaggccgccgcgu

SEQ ID NO: 3510265 - RNA, 19 nt, Pseudomonas aeruginosa PA01
gcagcaggccgccgcgugc

SEQ ID NO: 3510266 - RNA, 14 nt, Pseudomonas aeruginosa PA01
gcagcaggccgcug

SEQ ID NO: 3510267 - RNA, 15 nt, Pseudomonas aeruginosa PA01
gcagcaggccgcugg

SEQ ID NO: 3510268 - RNA, 18 nt, Pseudomonas aeruginosa PA01
gcagcaggccgcuggcga

SEQ ID NO: 3510269 - RNA, 15 nt, Pseudomonas aeruginosa PA01
gcagcaggccggcga

SEQ ID NO: 3510270 - RNA, 18 nt, Pseudomonas aeruginosa PA01
gcagcaggccggcgacca

SEQ ID NO: 3510271 - RNA, 18 nt, Pseudomonas aeruginosa PA01
gcagcaggcgacggucag

SEQ ID NO: 3510272 - RNA, 12 nt, Pseudomonas aeruginosa PA01
gcagcaggcgcu

SEQ ID NO: 3510273 - RNA, 15 nt, Pseudomonas aeruginosa PA01
gcagcaggcggccca

SEQ ID NO: 3510274 - RNA, 17 nt, Pseudomonas aeruginosa PA01
gcagcaggcggcccaug

SEQ ID NO: 3510275 - RNA, 18 nt, Pseudomonas aeruginosa PA01
gcagcaggcguucggcga

SEQ ID NO: 3510276 - RNA, 20 nt, Pseudomonas aeruginosa PA01
gcagcaggcuguacagcagg

SEQ ID NO: 3510277 - RNA, 23 nt, Pseudomonas aeruginosa PA01
gcagcaggcuguacagcaggagc

SEQ ID NO: 3510278 - RNA, 15 nt, Pseudomonas aeruginosa PA01
gcagcagggcgucgg

SEQ ID NO: 3510279 - RNA, 20 nt, Pseudomonas aeruginosa PA01
gcagcaggguaccgcuggcg

SEQ ID NO: 3510280 - RNA, 18 nt, Pseudomonas aeruginosa PA01
gcagcagggucagcagcg

SEQ ID NO: 3510281 - RNA, 20 nt, Pseudomonas aeruginosa PA01
gcagcagggucagcagcgcc

SEQ ID NO: 3510282 - RNA, 21 nt, Pseudomonas aeruginosa PA01
gcagcagggucagcagcgcca

SEQ ID NO: 3510283 - RNA, 14 nt, Pseudomonas aeruginosa PA01
gcagcagggucggg

SEQ ID NO: 3510284 - RNA, 16 nt, Pseudomonas aeruginosa PA01
gcagcagggucggggu

SEQ ID NO: 3510285 - RNA, 23 nt, Pseudomonas aeruginosa PA01
gcagcagguagaagaacaucggc

SEQ ID NO: 3510286 - RNA, 12 nt, Pseudomonas aeruginosa PA01
gcagcagguagu

SEQ ID NO: 3510287 - RNA, 22 nt, Pseudomonas aeruginosa PA01
gcagcagguagugcucggccag

SEQ ID NO: 3510288 - RNA, 14 nt, Pseudomonas aeruginosa PA01
gcagcaggucgagc

SEQ ID NO: 3510289 - RNA, 12 nt, Pseudomonas aeruginosa PA01
gcagcaggucgc

SEQ ID NO: 3510290 - RNA, 20 nt, Pseudomonas aeruginosa PA01
gcagcagguggcaagccucg

SEQ ID NO: 3510291 - RNA, 13 nt, Pseudomonas aeruginosa PA01
gcagcagguucga

SEQ ID NO: 3510292 - RNA, 23 nt, Pseudomonas aeruginosa PA01
gcagcagguucgaaugcugcccg

SEQ ID NO: 3510293 - RNA, 18 nt, Pseudomonas aeruginosa PA01
gcagcagguugaccccgc

SEQ ID NO: 3510294 - RNA, 22 nt, Pseudomonas aeruginosa PA01
gcagcagguugaccccgcggcc

SEQ ID NO: 3510295 - RNA, 16 nt, Pseudomonas aeruginosa PA01
gcagcaucagccgcga

SEQ ID NO: 3510296 - RNA, 15 nt, Pseudomonas aeruginosa PA01
gcagcaucaggcgcu

SEQ ID NO: 3510297 - RNA, 15 nt, Pseudomonas aeruginosa PA01
gcagcaucggaccgg

SEQ ID NO: 3510298 - RNA, 23 nt, Pseudomonas aeruginosa PA01
gcagcaucucggugcgccccagg

SEQ ID NO: 3510299 - RNA, 18 nt, Pseudomonas aeruginosa PA01
gcagcaucuucucggcga

SEQ ID NO: 3510300 - RNA, 19 nt, Pseudomonas aeruginosa PA01
gcagcaugaugccgaggcg

SEQ ID NO: 3510301 - RNA, 21 nt, Pseudomonas aeruginosa PA01
gcagcaugaugccgaggcggc

SEQ ID NO: 3510302 - RNA, 15 nt, Pseudomonas aeruginosa PA01
gcagcaugccgcucu

SEQ ID NO: 3510303 - RNA, 18 nt, Pseudomonas aeruginosa PA01
gcagcaugccgcucugcc

SEQ ID NO: 3510304 - RNA, 18 nt, Pseudomonas aeruginosa PA01
gcagcaugggauggcgcg

SEQ ID NO: 3510305 - RNA, 14 nt, Pseudomonas aeruginosa PA01
gcagcauguagaac

SEQ ID NO: 3510306 - RNA, 15 nt, Pseudomonas aeruginosa PA01
gcagcaugucgucga

SEQ ID NO: 3510307 - RNA, 20 nt, Pseudomonas aeruginosa PA01
gcagccaaccgucgcccugg

SEQ ID NO: 3510308 - RNA, 23 nt, Pseudomonas aeruginosa PA01
gcagccaaccgucgcccuggugc

SEQ ID NO: 3510309 - RNA, 19 nt, Pseudomonas aeruginosa PA01
gcagccaagccaccagcga

SEQ ID NO: 3510310 - RNA, 20 nt, Pseudomonas aeruginosa PA01
gcagccaagccaccagcgac

SEQ ID NO: 3510311 - RNA, 14 nt, Pseudomonas aeruginosa PA01
gcagccacaggcgc

SEQ ID NO: 3510312 - RNA, 15 nt, Pseudomonas aeruginosa PA01
gcagccacaggcgcc

SEQ ID NO: 3510313 - RNA, 13 nt, Pseudomonas aeruginosa PA01
gcagccaccaggu

SEQ ID NO: 3510314 - RNA, 13 nt, Pseudomonas aeruginosa PA01
gcagccacccagc

SEQ ID NO: 3510315 - RNA, 15 nt, Pseudomonas aeruginosa PA01
gcagccacccagcag

SEQ ID NO: 3510316 - RNA, 16 nt, Pseudomonas aeruginosa PA01
gcagccacccagcagc

SEQ ID NO: 3510317 - RNA, 13 nt, Pseudomonas aeruginosa PA01
gcagccacccgcg

SEQ ID NO: 3510318 - RNA, 14 nt, Pseudomonas aeruginosa PA01
gcagccacccgcgg

SEQ ID NO: 3510319 - RNA, 14 nt, Pseudomonas aeruginosa PA01
gcagccacccgcuc

SEQ ID NO: 3510320 - RNA, 15 nt, Pseudomonas aeruginosa PA01
gcagccacucggcca

SEQ ID NO: 3510321 - RNA, 19 nt, Pseudomonas aeruginosa PA01
gcagccacucggccaggcg

SEQ ID NO: 3510322 - RNA, 21 nt, Pseudomonas aeruginosa PA01
gcagccacucggccaggcgcc

SEQ ID NO: 3510323 - RNA, 15 nt, Pseudomonas aeruginosa PA01
gcagccacuguccau

SEQ ID NO: 3510324 - RNA, 15 nt, Pseudomonas aeruginosa PA01
gcagccagacccagu

SEQ ID NO: 3510325 - RNA, 21 nt, Pseudomonas aeruginosa PA01
gcagccagagcuccagggcug

SEQ ID NO: 3510326 - RNA, 15 nt, Pseudomonas aeruginosa PA01
gcagccagcacaugc

SEQ ID NO: 3510327 - RNA, 19 nt, Pseudomonas aeruginosa PA01
gcagccagcacaugcggug

SEQ ID NO: 3510328 - RNA, 20 nt, Pseudomonas aeruginosa PA01
gcagccagcacaugcggugc

SEQ ID NO: 3510329 - RNA, 14 nt, Pseudomonas aeruginosa PA01
gcagccagccgccg

SEQ ID NO: 3510330 - RNA, 16 nt, Pseudomonas aeruginosa PA01
gcagccagccgccgaa

SEQ ID NO: 3510331 - RNA, 13 nt, Pseudomonas aeruginosa PA01
gcagccagccguc

SEQ ID NO: 3510332 - RNA, 14 nt, Pseudomonas aeruginosa PA01
gcagccagccgucg

SEQ ID NO: 3510333 - RNA, 20 nt, Pseudomonas aeruginosa PA01
gcagccagccucagguacgg

SEQ ID NO: 3510334 - RNA, 20 nt, Pseudomonas aeruginosa PA01
gcagccagcuucagccgacc

SEQ ID NO: 3510335 - RNA, 22 nt, Pseudomonas aeruginosa PA01
gcagccaggccuugugcgccag

SEQ ID NO: 3510336 - RNA, 23 nt, Pseudomonas aeruginosa PA01
gcagccaggccuugugcgccagc

SEQ ID NO: 3510337 - RNA, 12 nt, Pseudomonas aeruginosa PA01
gcagccaggcga

SEQ ID NO: 3510338 - RNA, 13 nt, Pseudomonas aeruginosa PA01
gcagccaggcgaa

SEQ ID NO: 3510339 - RNA, 19 nt, Pseudomonas aeruginosa PA01
gcagccaggcgaaggcgau

SEQ ID NO: 3510340 - RNA, 21 nt, Pseudomonas aeruginosa PA01
gcagccaggcgaggaacagcg

SEQ ID NO: 3510341 - RNA, 23 nt, Pseudomonas aeruginosa PA01
gcagccaugaaaaagccgggaug

SEQ ID NO: 3510342 - RNA, 14 nt, Pseudomonas aeruginosa PA01
gcagccauggcugg

SEQ ID NO: 3510343 - RNA, 22 nt, Pseudomonas aeruginosa PA01
gcagccauggcuggugcgggug

SEQ ID NO: 3510344 - RNA, 14 nt, Pseudomonas aeruginosa PA01
gcagccauucgccg

SEQ ID NO: 3510345 - RNA, 17 nt, Pseudomonas aeruginosa PA01
gcagccauucgccgcga

SEQ ID NO: 3510346 - RNA, 18 nt, Pseudomonas aeruginosa PA01
gcagccauucgccgcgac

SEQ ID NO: 3510347 - RNA, 19 nt, Pseudomonas aeruginosa PA01
gcagccauuuuagaaaaau

SEQ ID NO: 3510348 - RNA, 14 nt, Pseudomonas aeruginosa PA01
gcagcccagccgcu

SEQ ID NO: 3510349 - RNA, 15 nt, Pseudomonas aeruginosa PA01
gcagcccagccgcuc

SEQ ID NO: 3510350 - RNA, 23 nt, Pseudomonas aeruginosa PA01
gcagcccagccgcucgcguccgc

SEQ ID NO: 3510351 - RNA, 13 nt, Pseudomonas aeruginosa PA01
gcagcccagcgcu

SEQ ID NO: 3510352 - RNA, 16 nt, Pseudomonas aeruginosa PA01
gcagcccagcgcuucc

SEQ ID NO: 3510353 - RNA, 17 nt, Pseudomonas aeruginosa PA01
gcagcccagcgcuuccu

SEQ ID NO: 3510354 - RNA, 13 nt, Pseudomonas aeruginosa PA01
gcagccccgaggc

SEQ ID NO: 3510355 - RNA, 14 nt, Pseudomonas aeruginosa PA01
gcagccccgccgga

SEQ ID NO: 3510356 - RNA, 15 nt, Pseudomonas aeruginosa PA01
gcagcccggccugga

SEQ ID NO: 3510357 - RNA, 13 nt, Pseudomonas aeruginosa PA01
gcagcccggucac

SEQ ID NO: 3510358 - RNA, 16 nt, Pseudomonas aeruginosa PA01
gcagcccggucacgcc

SEQ ID NO: 3510359 - RNA, 18 nt, Pseudomonas aeruginosa PA01
gcagcccgguccguccag

SEQ ID NO: 3510360 - RNA, 23 nt, Pseudomonas aeruginosa PA01
gcagcccuaggcgacccggcauu

SEQ ID NO: 3510361 - RNA, 13 nt, Pseudomonas aeruginosa PA01
gcagcccuggcgu

SEQ ID NO: 3510362 - RNA, 19 nt, Pseudomonas aeruginosa PA01
gcagcccuggcguggccgg

SEQ ID NO: 3510363 - RNA, 20 nt, Pseudomonas aeruginosa PA01
gcagcccuggcguggccggc

SEQ ID NO: 3510364 - RNA, 22 nt, Pseudomonas aeruginosa PA01
gcagcccuggcguggccggcga

SEQ ID NO: 3510365 - RNA, 16 nt, Pseudomonas aeruginosa PA01
gcagcccuugcaaccg

SEQ ID NO: 3510366 - RNA, 15 nt, Pseudomonas aeruginosa PA01
gcagccgauggcgaa

SEQ ID NO: 3510367 - RNA, 17 nt, Pseudomonas aeruginosa PA01
gcagccgauggcgaaca

SEQ ID NO: 3510368 - RNA, 16 nt, Pseudomonas aeruginosa PA01
gcagccgcaaggccag

SEQ ID NO: 3510369 - RNA, 17 nt, Pseudomonas aeruginosa PA01
gcagccgcaaggccagg

SEQ ID NO: 3510370 - RNA, 19 nt, Pseudomonas aeruginosa PA01
gcagccgcaaggccagggc

SEQ ID NO: 3510371 - RNA, 21 nt, Pseudomonas aeruginosa PA01
gcagccgcaaggccagggcgg

SEQ ID NO: 3510372 - RNA, 23 nt, Pseudomonas aeruginosa PA01
gcagccgcaaggccagggcggcg

SEQ ID NO: 3510373 - RNA, 12 nt, Pseudomonas aeruginosa PA01
gcagccgcagga

SEQ ID NO: 3510374 - RNA, 22 nt, Pseudomonas aeruginosa PA01
gcagccgcaggaugccgccugc

SEQ ID NO: 3510375 - RNA, 14 nt, Pseudomonas aeruginosa PA01
gcagccgccgcggc

SEQ ID NO: 3510376 - RNA, 19 nt, Pseudomonas aeruginosa PA01
gcagccgccgcggcaccgg

SEQ ID NO: 3510377 - RNA, 20 nt, Pseudomonas aeruginosa PA01
gcagccgccgcggcaccggc

SEQ ID NO: 3510378 - RNA, 14 nt, Pseudomonas aeruginosa PA01
gcagccgcgcucgg

SEQ ID NO: 3510379 - RNA, 21 nt, Pseudomonas aeruginosa PA01
gcagccgcggcuguagccacg

SEQ ID NO: 3510380 - RNA, 14 nt, Pseudomonas aeruginosa PA01
gcagccgcggggcu

SEQ ID NO: 3510381 - RNA, 20 nt, Pseudomonas aeruginosa PA01
gcagccgcgugcgcgccgcc

SEQ ID NO: 3510382 - RNA, 17 nt, Pseudomonas aeruginosa PA01
gcagccgcucggccgcc

SEQ ID NO: 3510383 - RNA, 18 nt, Pseudomonas aeruginosa PA01
gcagccgcucggccgcca

SEQ ID NO: 3510384 - RNA, 19 nt, Pseudomonas aeruginosa PA01
gcagccgcucggccgccag

SEQ ID NO: 3510385 - RNA, 21 nt, Pseudomonas aeruginosa PA01
gcagccgcucggccgccagca

SEQ ID NO: 3510386 - RNA, 15 nt, Pseudomonas aeruginosa PA01
gcagccgcugcugca

SEQ ID NO: 3510387 - RNA, 16 nt, Pseudomonas aeruginosa PA01
gcagccgcugcugcaa

SEQ ID NO: 3510388 - RNA, 20 nt, Pseudomonas aeruginosa PA01
gcagccgcugcugcaaccga

SEQ ID NO: 3510389 - RNA, 15 nt, Pseudomonas aeruginosa PA01
gcagccgcugggcca

SEQ ID NO: 3510390 - RNA, 16 nt, Pseudomonas aeruginosa PA01
gcagccggcgaacagg

SEQ ID NO: 3510391 - RNA, 21 nt, Pseudomonas aeruginosa PA01
gcagccggcgaacagguagcc

SEQ ID NO: 3510392 - RNA, 13 nt, Pseudomonas aeruginosa PA01
gcagccggcggcg

SEQ ID NO: 3510393 - RNA, 14 nt, Pseudomonas aeruginosa PA01
gcagccggcggcga

SEQ ID NO: 3510394 - RNA, 13 nt, Pseudomonas aeruginosa PA01
gcagccgggccgc

SEQ ID NO: 3510395 - RNA, 16 nt, Pseudomonas aeruginosa PA01
gcagccgggccgcagc

SEQ ID NO: 3510396 - RNA, 12 nt, Pseudomonas aeruginosa PA01
gcagccggggcu

SEQ ID NO: 3510397 - RNA, 23 nt, Pseudomonas aeruginosa PA01
gcagccgguggucuucagcacau

SEQ ID NO: 3510398 - RNA, 18 nt, Pseudomonas aeruginosa PA01
gcagccguauggccccuc

SEQ ID NO: 3510399 - RNA, 21 nt, Pseudomonas aeruginosa PA01
gcagccguccgcccaguucgc

SEQ ID NO: 3510400 - RNA, 15 nt, Pseudomonas aeruginosa PA01
gcagccguggcgcga

SEQ ID NO: 3510401 - RNA, 20 nt, Pseudomonas aeruginosa PA01
gcagccguucccggucgagg

SEQ ID NO: 3510402 - RNA, 17 nt, Pseudomonas aeruginosa PA01
gcagccguugccccaga

SEQ ID NO: 3510403 - RNA, 16 nt, Pseudomonas aeruginosa PA01
gcagccguuggccagc

SEQ ID NO: 3510404 - RNA, 20 nt, Pseudomonas aeruginosa PA01
gcagccguuggccagcaggc

SEQ ID NO: 3510405 - RNA, 20 nt, Pseudomonas aeruginosa PA01
gcagccucgcgcucggcggc

SEQ ID NO: 3510406 - RNA, 21 nt, Pseudomonas aeruginosa PA01
gcagccucgcgcucggcggcc

SEQ ID NO: 3510407 - RNA, 12 nt, Pseudomonas aeruginosa PA01
gcagccugcugg

SEQ ID NO: 3510408 - RNA, 21 nt, Pseudomonas aeruginosa PA01
gcagccuucgcaaagcgagcg

SEQ ID NO: 3510409 - RNA, 22 nt, Pseudomonas aeruginosa PA01
gcagccuucgcaaagcgagcgc

SEQ ID NO: 3510410 - RNA, 18 nt, Pseudomonas aeruginosa PA01
gcagccuuggcaugaccg

SEQ ID NO: 3510411 - RNA, 21 nt, Pseudomonas aeruginosa PA01
gcagccuuggcaugaccgagc

SEQ ID NO: 3510412 - RNA, 22 nt, Pseudomonas aeruginosa PA01
gcagccuuggcaugaccgagca

SEQ ID NO: 3510413 - RNA, 21 nt, Pseudomonas aeruginosa PA01
gcagccuuuuuugugcccgcc

SEQ ID NO: 3510414 - RNA, 14 nt, Pseudomonas aeruginosa PA01
gcagcgaacgccgc

SEQ ID NO: 3510415 - RNA, 21 nt, Pseudomonas aeruginosa PA01
gcagcgaacgggcguugccgg

SEQ ID NO: 3510416 - RNA, 22 nt, Pseudomonas aeruginosa PA01
gcagcgaacgggcguugccggc

SEQ ID NO: 3510417 - RNA, 23 nt, Pseudomonas aeruginosa PA01
gcagcgaacgggcguugccggca

SEQ ID NO: 3510418 - RNA, 18 nt, Pseudomonas aeruginosa PA01
gcagcgacacaacgcugc

SEQ ID NO: 3510419 - RNA, 13 nt, Pseudomonas aeruginosa PA01
gcagcgaccacca

SEQ ID NO: 3510420 - RNA, 16 nt, Pseudomonas aeruginosa PA01
gcagcgaccaccacca

SEQ ID NO: 3510421 - RNA, 19 nt, Pseudomonas aeruginosa PA01
gcagcgaccaccaccaggu

SEQ ID NO: 3510422 - RNA, 17 nt, Pseudomonas aeruginosa PA01
gcagcgaccugacccgc

SEQ ID NO: 3510423 - RNA, 18 nt, Pseudomonas aeruginosa PA01
gcagcgacuccagccagg

SEQ ID NO: 3510424 - RNA, 23 nt, Pseudomonas aeruginosa PA01
gcagcgacucgaugaacgcccug

SEQ ID NO: 3510425 - RNA, 21 nt, Pseudomonas aeruginosa PA01
gcagcgacucgcugggcgccg

SEQ ID NO: 3510426 - RNA, 15 nt, Pseudomonas aeruginosa PA01
gcagcgagcggguca

SEQ ID NO: 3510427 - RNA, 19 nt, Pseudomonas aeruginosa PA01
gcagcgaggggaagaucuc

SEQ ID NO: 3510428 - RNA, 15 nt, Pseudomonas aeruginosa PA01
gcagcgagucgccgu

SEQ ID NO: 3510429 - RNA, 17 nt, Pseudomonas aeruginosa PA01
gcagcgaucgccgccau

SEQ ID NO: 3510430 - RNA, 18 nt, Pseudomonas aeruginosa PA01
gcagcgaucgccgccauu

SEQ ID NO: 3510431 - RNA, 17 nt, Pseudomonas aeruginosa PA01
gcagcgcaagucggccu

SEQ ID NO: 3510432 - RNA, 18 nt, Pseudomonas aeruginosa PA01
gcagcgcaagucggccug

SEQ ID NO: 3510433 - RNA, 20 nt, Pseudomonas aeruginosa PA01
gcagcgcaagucggccugca

SEQ ID NO: 3510434 - RNA, 18 nt, Pseudomonas aeruginosa PA01
gcagcgcacgcuucuccu

SEQ ID NO: 3510435 - RNA, 21 nt, Pseudomonas aeruginosa PA01
gcagcgcacgcuucuccucgg

SEQ ID NO: 3510436 - RNA, 13 nt, Pseudomonas aeruginosa PA01
gcagcgcagccga

SEQ ID NO: 3510437 - RNA, 13 nt, Pseudomonas aeruginosa PA01
gcagcgccagcag

SEQ ID NO: 3510438 - RNA, 21 nt, Pseudomonas aeruginosa PA01
gcagcgccagcaggucgcgcu

SEQ ID NO: 3510439 - RNA, 14 nt, Pseudomonas aeruginosa PA01
gcagcgccagccag

SEQ ID NO: 3510440 - RNA, 16 nt, Pseudomonas aeruginosa PA01
gcagcgccagccaggg

SEQ ID NO: 3510441 - RNA, 13 nt, Pseudomonas aeruginosa PA01
gcagcgccagggc

SEQ ID NO: 3510442 - RNA, 15 nt, Pseudomonas aeruginosa PA01
gcagcgccagguagu

SEQ ID NO: 3510443 - RNA, 21 nt, Pseudomonas aeruginosa PA01
gcagcgccaguuggacgcggc

SEQ ID NO: 3510444 - RNA, 14 nt, Pseudomonas aeruginosa PA01
gcagcgccaugcuc

SEQ ID NO: 3510445 - RNA, 14 nt, Pseudomonas aeruginosa PA01
gcagcgccccagca

SEQ ID NO: 3510446 - RNA, 16 nt, Pseudomonas aeruginosa PA01
gcagcgccccagcacc

SEQ ID NO: 3510447 - RNA, 21 nt, Pseudomonas aeruginosa PA01
gcagcgccccagcaccucgcc

SEQ ID NO: 3510448 - RNA, 15 nt, Pseudomonas aeruginosa PA01
gcagcgccccuccca

SEQ ID NO: 3510449 - RNA, 21 nt, Pseudomonas aeruginosa PA01
gcagcgcccgauaggcgccgg

SEQ ID NO: 3510450 - RNA, 14 nt, Pseudomonas aeruginosa PA01
gcagcgccgagguc

SEQ ID NO: 3510451 - RNA, 12 nt, Pseudomonas aeruginosa PA01
gcagcgccgcca

SEQ ID NO: 3510452 - RNA, 15 nt, Pseudomonas aeruginosa PA01
gcagcgccgccagca

SEQ ID NO: 3510453 - RNA, 17 nt, Pseudomonas aeruginosa PA01
gcagcgccgccagcagg

SEQ ID NO: 3510454 - RNA, 18 nt, Pseudomonas aeruginosa PA01
gcagcgccgccagcagga

SEQ ID NO: 3510455 - RNA, 13 nt, Pseudomonas aeruginosa PA01
gcagcgccgccca

SEQ ID NO: 3510456 - RNA, 19 nt, Pseudomonas aeruginosa PA01
gcagcgccgcccuguucgu

SEQ ID NO: 3510457 - RNA, 13 nt, Pseudomonas aeruginosa PA01
gcagcgccgccgc

SEQ ID NO: 3510458 - RNA, 19 nt, Pseudomonas aeruginosa PA01
gcagcgccgccgcgucguc

SEQ ID NO: 3510459 - RNA, 16 nt, Pseudomonas aeruginosa PA01
gcagcgccgccgggcg

SEQ ID NO: 3510460 - RNA, 21 nt, Pseudomonas aeruginosa PA01
gcagcgccgccgggcguaacg

SEQ ID NO: 3510461 - RNA, 12 nt, Pseudomonas aeruginosa PA01
gcagcgccgcgc

SEQ ID NO: 3510462 - RNA, 13 nt, Pseudomonas aeruginosa PA01
gcagcgccgcgcc

SEQ ID NO: 3510463 - RNA, 15 nt, Pseudomonas aeruginosa PA01
gcagcgccgcgccug

SEQ ID NO: 3510464 - RNA, 16 nt, Pseudomonas aeruginosa PA01
gcagcgccgcgccugc

SEQ ID NO: 3510465 - RNA, 18 nt, Pseudomonas aeruginosa PA01
gcagcgccgcgcggcaac

SEQ ID NO: 3510466 - RNA, 13 nt, Pseudomonas aeruginosa PA01
gcagcgccgggca

SEQ ID NO: 3510467 - RNA, 22 nt, Pseudomonas aeruginosa PA01
gcagcgccguugccgaugccgg

SEQ ID NO: 3510468 - RNA, 12 nt, Pseudomonas aeruginosa PA01
gcagcgccuccc

SEQ ID NO: 3510469 - RNA, 17 nt, Pseudomonas aeruginosa PA01
gcagcgccucccgggcc

SEQ ID NO: 3510470 - RNA, 22 nt, Pseudomonas aeruginosa PA01
gcagcgccucccgggccucucg

SEQ ID NO: 3510471 - RNA, 22 nt, Pseudomonas aeruginosa PA01
gcagcgccuccucuaccaggcg

SEQ ID NO: 3510472 - RNA, 11 nt, Pseudomonas aeruginosa PA01
gcagcgccucg

SEQ ID NO: 3510473 - RNA, 12 nt, Pseudomonas aeruginosa PA01
gcagcgccucgg

SEQ ID NO: 3510474 - RNA, 22 nt, Pseudomonas aeruginosa PA01
gcagcgccucguggaacagcgc

SEQ ID NO: 3510475 - RNA, 23 nt, Pseudomonas aeruginosa PA01
gcagcgccucguggaacagcgcg

SEQ ID NO: 3510476 - RNA, 20 nt, Pseudomonas aeruginosa PA01
gcagcgccuguuccagggcc

SEQ ID NO: 3510477 - RNA, 14 nt, Pseudomonas aeruginosa PA01
gcagcgccuuuucg

SEQ ID NO: 3510478 - RNA, 23 nt, Pseudomonas aeruginosa PA01
gcagcgccuuuucggcacucagg

SEQ ID NO: 3510479 - RNA, 21 nt, Pseudomonas aeruginosa PA01
gcagcgcgauaucgcaggcca

SEQ ID NO: 3510480 - RNA, 13 nt, Pseudomonas aeruginosa PA01
gcagcgcgcgcug

SEQ ID NO: 3510481 - RNA, 15 nt, Pseudomonas aeruginosa PA01
gcagcgcgcgcuggu

SEQ ID NO: 3510482 - RNA, 15 nt, Pseudomonas aeruginosa PA01
gcagcgcgcggccag

SEQ ID NO: 3510483 - RNA, 20 nt, Pseudomonas aeruginosa PA01
gcagcgcgcggccaguucgg

SEQ ID NO: 3510484 - RNA, 14 nt, Pseudomonas aeruginosa PA01
gcagcgcgcggcuc

SEQ ID NO: 3510485 - RNA, 16 nt, Pseudomonas aeruginosa PA01
gcagcgcgcgucgguc

SEQ ID NO: 3510486 - RNA, 17 nt, Pseudomonas aeruginosa PA01
gcagcgcggcggcggcc

SEQ ID NO: 3510487 - RNA, 23 nt, Pseudomonas aeruginosa PA01
gcagcgcggcggcggccagcagc

SEQ ID NO: 3510488 - RNA, 21 nt, Pseudomonas aeruginosa PA01
gcagcgcggucauccgcccug

SEQ ID NO: 3510489 - RNA, 17 nt, Pseudomonas aeruginosa PA01
gcagcgcguagaccacc

SEQ ID NO: 3510490 - RNA, 19 nt, Pseudomonas aeruginosa PA01
gcagcgcguagaccaccuc

SEQ ID NO: 3510491 - RNA, 17 nt, Pseudomonas aeruginosa PA01
gcagcgcuagcgcaugg

SEQ ID NO: 3510492 - RNA, 13 nt, Pseudomonas aeruginosa PA01
gcagcgcuggcga

SEQ ID NO: 3510493 - RNA, 14 nt, Pseudomonas aeruginosa PA01
gcagcgcuggcgau

SEQ ID NO: 3510494 - RNA, 16 nt, Pseudomonas aeruginosa PA01
gcagcgcuggcgauca

SEQ ID NO: 3510495 - RNA, 21 nt, Pseudomonas aeruginosa PA01
gcagcgcuuguagcagccgca

SEQ ID NO: 3510496 - RNA, 13 nt, Pseudomonas aeruginosa PA01
gcagcgcuuuuca

SEQ ID NO: 3510497 - RNA, 15 nt, Pseudomonas aeruginosa PA01
gcagcggaagcccug

SEQ ID NO: 3510498 - RNA, 21 nt, Pseudomonas aeruginosa PA01
gcagcggaagcccugcuggcg

SEQ ID NO: 3510499 - RNA, 20 nt, Pseudomonas aeruginosa PA01
gcagcggacgcagcgggucg

SEQ ID NO: 3510500 - RNA, 20 nt, Pseudomonas aeruginosa PA01
gcagcggaggauucagcagg

SEQ ID NO: 3510501 - RNA, 20 nt, Pseudomonas aeruginosa PA01
gcagcggauauucgacgcgc

SEQ ID NO: 3510502 - RNA, 23 nt, Pseudomonas aeruginosa PA01
gcagcggauauucgacgcgcggc

SEQ ID NO: 3510503 - RNA, 18 nt, Pseudomonas aeruginosa PA01
gcagcggauccgggugga

SEQ ID NO: 3510504 - RNA, 15 nt, Pseudomonas aeruginosa PA01
gcagcggaucggcgg

SEQ ID NO: 3510505 - RNA, 21 nt, Pseudomonas aeruginosa PA01
gcagcggcaaaggcccggcgc

SEQ ID NO: 3510506 - RNA, 13 nt, Pseudomonas aeruginosa PA01
gcagcggcaccag

SEQ ID NO: 3510507 - RNA, 14 nt, Pseudomonas aeruginosa PA01
gcagcggcaccagc

SEQ ID NO: 3510508 - RNA, 15 nt, Pseudomonas aeruginosa PA01
gcagcggcacccggc

SEQ ID NO: 3510509 - RNA, 19 nt, Pseudomonas aeruginosa PA01
gcagcggcacgcucuggcc

SEQ ID NO: 3510510 - RNA, 20 nt, Pseudomonas aeruginosa PA01
gcagcggcacgcucuggccg

SEQ ID NO: 3510511 - RNA, 12 nt, Pseudomonas aeruginosa PA01
gcagcggcagcc

SEQ ID NO: 3510512 - RNA, 14 nt, Pseudomonas aeruginosa PA01
gcagcggcagcgcc

SEQ ID NO: 3510513 - RNA, 15 nt, Pseudomonas aeruginosa PA01
gcagcggcagcgcca

SEQ ID NO: 3510514 - RNA, 15 nt, Pseudomonas aeruginosa PA01
gcagcggcagcggcu

SEQ ID NO: 3510515 - RNA, 16 nt, Pseudomonas aeruginosa PA01
gcagcggcagcggcuc

SEQ ID NO: 3510516 - RNA, 18 nt, Pseudomonas aeruginosa PA01
gcagcggcaugcccugcc

SEQ ID NO: 3510517 - RNA, 19 nt, Pseudomonas aeruginosa PA01
gcagcggcaugcccugccg

SEQ ID NO: 3510518 - RNA, 22 nt, Pseudomonas aeruginosa PA01
gcagcggcaugcccugccggcg

SEQ ID NO: 3510519 - RNA, 22 nt, Pseudomonas aeruginosa PA01
gcagcggcauggucagcccaua

SEQ ID NO: 3510520 - RNA, 14 nt, Pseudomonas aeruginosa PA01
gcagcggccaggga

SEQ ID NO: 3510521 - RNA, 14 nt, Pseudomonas aeruginosa PA01
gcagcggccccgag

SEQ ID NO: 3510522 - RNA, 22 nt, Pseudomonas aeruginosa PA01
gcagcggccccgagcgggccga

SEQ ID NO: 3510523 - RNA, 24 nt, Pseudomonas aeruginosa PA01
gcagcggccccgagcgggccgagg

SEQ ID NO: 3510524 - RNA, 13 nt, Pseudomonas aeruginosa PA01
gcagcggcccuug

SEQ ID NO: 3510525 - RNA, 16 nt, Pseudomonas aeruginosa PA01
gcagcggcgaacccuc

SEQ ID NO: 3510526 - RNA, 18 nt, Pseudomonas aeruginosa PA01
gcagcggcgacaccgcca

SEQ ID NO: 3510527 - RNA, 21 nt, Pseudomonas aeruginosa PA01
gcagcggcgacaccgccagca

SEQ ID NO: 3510528 - RNA, 12 nt, Pseudomonas aeruginosa PA01
gcagcggcgccg

SEQ ID NO: 3510529 - RNA, 13 nt, Pseudomonas aeruginosa PA01
gcagcggcgccga

SEQ ID NO: 3510530 - RNA, 16 nt, Pseudomonas aeruginosa PA01
gcagcggcgcuuucca

SEQ ID NO: 3510531 - RNA, 13 nt, Pseudomonas aeruginosa PA01
gcagcggcggaua

SEQ ID NO: 3510532 - RNA, 14 nt, Pseudomonas aeruginosa PA01
gcagcggcggcgcc

SEQ ID NO: 3510533 - RNA, 20 nt, Pseudomonas aeruginosa PA01
gcagcggcggcgccggcagg

SEQ ID NO: 3510534 - RNA, 21 nt, Pseudomonas aeruginosa PA01
gcagcggcgugaagccgccgc

SEQ ID NO: 3510535 - RNA, 22 nt, Pseudomonas aeruginosa PA01
gcagcggcgugaagccgccgcc

SEQ ID NO: 3510536 - RNA, 23 nt, Pseudomonas aeruginosa PA01
gcagcggcucacgccccagcgca

SEQ ID NO: 3510537 - RNA, 12 nt, Pseudomonas aeruginosa PA01
gcagcggcuggc

SEQ ID NO: 3510538 - RNA, 13 nt, Pseudomonas aeruginosa PA01
gcagcggcuggcc

SEQ ID NO: 3510539 - RNA, 14 nt, Pseudomonas aeruginosa PA01
gcagcggcuggccg

SEQ ID NO: 3510540 - RNA, 22 nt, Pseudomonas aeruginosa PA01
gcagcggcuggccgucgacccg

SEQ ID NO: 3510541 - RNA, 20 nt, Pseudomonas aeruginosa PA01
gcagcggcuguugccggaau

SEQ ID NO: 3510542 - RNA, 21 nt, Pseudomonas aeruginosa PA01
gcagcgggccaggcgguauuc

SEQ ID NO: 3510543 - RNA, 20 nt, Pseudomonas aeruginosa PA01
gcagcgggcguccggcgagc

SEQ ID NO: 3510544 - RNA, 24 nt, Pseudomonas aeruginosa PA01
gcagcgggcugaagugggucgccg

SEQ ID NO: 3510545 - RNA, 23 nt, Pseudomonas aeruginosa PA01
gcagcggguccuggguggcgacg

SEQ ID NO: 3510546 - RNA, 17 nt, Pseudomonas aeruginosa PA01
gcagcgggucgaucagg

SEQ ID NO: 3510547 - RNA, 21 nt, Pseudomonas aeruginosa PA01
gcagcgggucgaucaggcgca

SEQ ID NO: 3510548 - RNA, 22 nt, Pseudomonas aeruginosa PA01
gcagcgggucgaucaggcgcau

SEQ ID NO: 3510549 - RNA, 17 nt, Pseudomonas aeruginosa PA01
gcagcgguacaggcgga

SEQ ID NO: 3510550 - RNA, 16 nt, Pseudomonas aeruginosa PA01
gcagcgguacggucga

SEQ ID NO: 3510551 - RNA, 17 nt, Pseudomonas aeruginosa PA01
gcagcggucgccggucg

SEQ ID NO: 3510552 - RNA, 13 nt, Pseudomonas aeruginosa PA01
gcagcgucaccgc

SEQ ID NO: 3510553 - RNA, 18 nt, Pseudomonas aeruginosa PA01
gcagcgucgacgccgagc

SEQ ID NO: 3510554 - RNA, 17 nt, Pseudomonas aeruginosa PA01
gcagcgucgagcuggcg

SEQ ID NO: 3510555 - RNA, 19 nt, Pseudomonas aeruginosa PA01
gcagcgucgagcuggcgca

SEQ ID NO: 3510556 - RNA, 21 nt, Pseudomonas aeruginosa PA01
gcagcgucgagcuggcgcagg

SEQ ID NO: 3510557 - RNA, 22 nt, Pseudomonas aeruginosa PA01
gcagcgucgagcuggcgcaggc

SEQ ID NO: 3510558 - RNA, 23 nt, Pseudomonas aeruginosa PA01
gcagcgucgagcuggcgcaggcc

SEQ ID NO: 3510559 - RNA, 15 nt, Pseudomonas aeruginosa PA01
gcagcgucgccgggc

SEQ ID NO: 3510560 - RNA, 21 nt, Pseudomonas aeruginosa PA01
gcagcgucgccgggcguaacg

SEQ ID NO: 3510561 - RNA, 19 nt, Pseudomonas aeruginosa PA01
gcagcgucgcgucggccug

SEQ ID NO: 3510562 - RNA, 23 nt, Pseudomonas aeruginosa PA01
gcagcgucguagagcgugcggcc

SEQ ID NO: 3510563 - RNA, 14 nt, Pseudomonas aeruginosa PA01
gcagcgucucagcc

SEQ ID NO: 3510564 - RNA, 15 nt, Pseudomonas aeruginosa PA01
gcagcgucucagccc

SEQ ID NO: 3510565 - RNA, 17 nt, Pseudomonas aeruginosa PA01
gcagcgucucggcugcc

SEQ ID NO: 3510566 - RNA, 22 nt, Pseudomonas aeruginosa PA01
gcagcgucucggcugccgccag

SEQ ID NO: 3510567 - RNA, 14 nt, Pseudomonas aeruginosa PA01
gcagcguuccagcg

SEQ ID NO: 3510568 - RNA, 15 nt, Pseudomonas aeruginosa PA01
gcagcguuccagcgc

SEQ ID NO: 3510569 - RNA, 18 nt, Pseudomonas aeruginosa PA01
gcagcguuccagcgcugg

SEQ ID NO: 3510570 - RNA, 12 nt, Pseudomonas aeruginosa PA01
gcagcuccaccg

SEQ ID NO: 3510571 - RNA, 13 nt, Pseudomonas aeruginosa PA01
gcagcuccaccga

SEQ ID NO: 3510572 - RNA, 14 nt, Pseudomonas aeruginosa PA01
gcagcuccagcgga

SEQ ID NO: 3510573 - RNA, 15 nt, Pseudomonas aeruginosa PA01
gcagcuccauguccg

SEQ ID NO: 3510574 - RNA, 19 nt, Pseudomonas aeruginosa PA01
gcagcucccuugccgccgg

SEQ ID NO: 3510575 - RNA, 14 nt, Pseudomonas aeruginosa PA01
gcagcuccggcagc

SEQ ID NO: 3510576 - RNA, 15 nt, Pseudomonas aeruginosa PA01
gcagcuccggcagca

SEQ ID NO: 3510577 - RNA, 14 nt, Pseudomonas aeruginosa PA01
gcagcuccggcggg

SEQ ID NO: 3510578 - RNA, 15 nt, Pseudomonas aeruginosa PA01
gcagcuccggcgggc

SEQ ID NO: 3510579 - RNA, 17 nt, Pseudomonas aeruginosa PA01
gcagcuccggcgggcgg

SEQ ID NO: 3510580 - RNA, 16 nt, Pseudomonas aeruginosa PA01
gcagcuccgggcuggc

SEQ ID NO: 3510581 - RNA, 18 nt, Pseudomonas aeruginosa PA01
gcagcuccgggcuggcca

SEQ ID NO: 3510582 - RNA, 19 nt, Pseudomonas aeruginosa PA01
gcagcuccgggcuggccac

SEQ ID NO: 3510583 - RNA, 23 nt, Pseudomonas aeruginosa PA01
gcagcuccgggcuggccaccagc

SEQ ID NO: 3510584 - RNA, 12 nt, Pseudomonas aeruginosa PA01
gcagcuccucgg

SEQ ID NO: 3510585 - RNA, 13 nt, Pseudomonas aeruginosa PA01
gcagcucgccgcu

SEQ ID NO: 3510586 - RNA, 20 nt, Pseudomonas aeruginosa PA01
gcagcucgccgcuacccagg

SEQ ID NO: 3510587 - RNA, 16 nt, Pseudomonas aeruginosa PA01
gcagcucgccggcguc

SEQ ID NO: 3510588 - RNA, 19 nt, Pseudomonas aeruginosa PA01
gcagcucgccggcguccuc

SEQ ID NO: 3510589 - RNA, 20 nt, Pseudomonas aeruginosa PA01
gcagcucgcuaugcagcagg

SEQ ID NO: 3510590 - RNA, 21 nt, Pseudomonas aeruginosa PA01
gcagcucgcuaugcagcaggu

SEQ ID NO: 3510591 - RNA, 13 nt, Pseudomonas aeruginosa PA01
gcagcucggcacg

SEQ ID NO: 3510592 - RNA, 18 nt, Pseudomonas aeruginosa PA01
gcagcucggccgagggca

SEQ ID NO: 3510593 - RNA, 22 nt, Pseudomonas aeruginosa PA01
gcagcucggccgagggcagccu

SEQ ID NO: 3510594 - RNA, 13 nt, Pseudomonas aeruginosa PA01
gcagcucggccug

SEQ ID NO: 3510595 - RNA, 24 nt, Pseudomonas aeruginosa PA01
gcagcucggccugguccggcacuu

SEQ ID NO: 3510596 - RNA, 16 nt, Pseudomonas aeruginosa PA01
gcagcucggugaggaa

SEQ ID NO: 3510597 - RNA, 21 nt, Pseudomonas aeruginosa PA01
gcagcucguucgcccagaccu

SEQ ID NO: 3510598 - RNA, 21 nt, Pseudomonas aeruginosa PA01
gcagcucguugcacagcgccc

SEQ ID NO: 3510599 - RNA, 20 nt, Pseudomonas aeruginosa PA01
gcagcucguuggccaccugc

SEQ ID NO: 3510600 - RNA, 15 nt, Pseudomonas aeruginosa PA01
gcagcucugcgauca

SEQ ID NO: 3510601 - RNA, 21 nt, Pseudomonas aeruginosa PA01
gcagcucugcgaucagggccu

SEQ ID NO: 3510602 - RNA, 14 nt, Pseudomonas aeruginosa PA01
gcagcugcggcggc

SEQ ID NO: 3510603 - RNA, 16 nt, Pseudomonas aeruginosa PA01
gcagcuggauccgugc

SEQ ID NO: 3510604 - RNA, 17 nt, Pseudomonas aeruginosa PA01
gcagcugguaggagccg

SEQ ID NO: 3510605 - RNA, 21 nt, Pseudomonas aeruginosa PA01
gcagcuucggcgcgacgcuac

SEQ ID NO: 3510606 - RNA, 20 nt, Pseudomonas aeruginosa PA01
gcagcuucugcagggcggcu

SEQ ID NO: 3510607 - RNA, 14 nt, Pseudomonas aeruginosa PA01
gcagcuugccggca

SEQ ID NO: 3510608 - RNA, 19 nt, Pseudomonas aeruginosa PA01
gcagcuugccuuccaggcu

SEQ ID NO: 3510609 - RNA, 17 nt, Pseudomonas aeruginosa PA01
gcagcuuggcgaauagc

SEQ ID NO: 3510610 - RNA, 22 nt, Pseudomonas aeruginosa PA01
gcagcuuggcgaauagccggcg

SEQ ID NO: 3510611 - RNA, 14 nt, Pseudomonas aeruginosa PA01
gcagcuuggcgacg

SEQ ID NO: 3510612 - RNA, 14 nt, Pseudomonas aeruginosa PA01
gcagcuuggcgguc

SEQ ID NO: 3510613 - RNA, 23 nt, Pseudomonas aeruginosa PA01
gcagcuugguauccaccucgccc

SEQ ID NO: 3510614 - RNA, 22 nt, Pseudomonas aeruginosa PA01
gcagcuugugggcaugcucggc

SEQ ID NO: 3510615 - RNA, 19 nt, Pseudomonas aeruginosa PA01
gcaggaaaacgcucaggcc

SEQ ID NO: 3510616 - RNA, 20 nt, Pseudomonas aeruginosa PA01
gcaggaaaacgcucaggcca

SEQ ID NO: 3510617 - RNA, 19 nt, Pseudomonas aeruginosa PA01
gcaggaaaccccucggcua

SEQ ID NO: 3510618 - RNA, 15 nt, Pseudomonas aeruginosa PA01
gcaggaaauccgccg

SEQ ID NO: 3510619 - RNA, 12 nt, Pseudomonas aeruginosa PA01
gcaggaacagcc

SEQ ID NO: 3510620 - RNA, 18 nt, Pseudomonas aeruginosa PA01
gcaggaacgcccgcggca

SEQ ID NO: 3510621 - RNA, 21 nt, Pseudomonas aeruginosa PA01
gcaggaacgcccgcggcagca

SEQ ID NO: 3510622 - RNA, 22 nt, Pseudomonas aeruginosa PA01
gcaggaacgcccgcggcagcag

SEQ ID NO: 3510623 - RNA, 21 nt, Pseudomonas aeruginosa PA01
gcaggaacucgaucagcgcgg

SEQ ID NO: 3510624 - RNA, 23 nt, Pseudomonas aeruginosa PA01
gcaggaacucgaucagcgcggcc

SEQ ID NO: 3510625 - RNA, 20 nt, Pseudomonas aeruginosa PA01
gcaggaacuggucgauccgc

SEQ ID NO: 3510626 - RNA, 13 nt, Pseudomonas aeruginosa PA01
gcaggaagaagcc

SEQ ID NO: 3510627 - RNA, 15 nt, Pseudomonas aeruginosa PA01
gcaggaagccgacca

SEQ ID NO: 3510628 - RNA, 19 nt, Pseudomonas aeruginosa PA01
gcaggaagccgaccacucg

SEQ ID NO: 3510629 - RNA, 13 nt, Pseudomonas aeruginosa PA01
gcaggaagcgccg

SEQ ID NO: 3510630 - RNA, 14 nt, Pseudomonas aeruginosa PA01
gcaggaagcgccgg

SEQ ID NO: 3510631 - RNA, 21 nt, Pseudomonas aeruginosa PA01
gcaggaagcugacgaacaucg

SEQ ID NO: 3510632 - RNA, 13 nt, Pseudomonas aeruginosa PA01
gcaggaaggcgac

SEQ ID NO: 3510633 - RNA, 23 nt, Pseudomonas aeruginosa PA01
gcaggacagcagggucgcgccgu

SEQ ID NO: 3510634 - RNA, 17 nt, Pseudomonas aeruginosa PA01
gcaggaccacgcugguc

SEQ ID NO: 3510635 - RNA, 19 nt, Pseudomonas aeruginosa PA01
gcaggaccacgcuggucac

SEQ ID NO: 3510636 - RNA, 23 nt, Pseudomonas aeruginosa PA01
gcaggaccacgcuggucaccguc

SEQ ID NO: 3510637 - RNA, 13 nt, Pseudomonas aeruginosa PA01
gcaggacccagaa

SEQ ID NO: 3510638 - RNA, 16 nt, Pseudomonas aeruginosa PA01
gcaggacccaucgaug

SEQ ID NO: 3510639 - RNA, 12 nt, Pseudomonas aeruginosa PA01
gcaggacccgcg

SEQ ID NO: 3510640 - RNA, 14 nt, Pseudomonas aeruginosa PA01
gcaggaccgccaug

SEQ ID NO: 3510641 - RNA, 16 nt, Pseudomonas aeruginosa PA01
gcaggaccgccauggc

SEQ ID NO: 3510642 - RNA, 17 nt, Pseudomonas aeruginosa PA01
gcaggaccgccauggcg

SEQ ID NO: 3510643 - RNA, 18 nt, Pseudomonas aeruginosa PA01
gcaggaccgccauggcgc

SEQ ID NO: 3510644 - RNA, 14 nt, Pseudomonas aeruginosa PA01
gcaggaccuggcug

SEQ ID NO: 3510645 - RNA, 23 nt, Pseudomonas aeruginosa PA01
gcaggaccuuggugaugaagucg

SEQ ID NO: 3510646 - RNA, 22 nt, Pseudomonas aeruginosa PA01
gcaggacgaagucgccggcauc

SEQ ID NO: 3510647 - RNA, 22 nt, Pseudomonas aeruginosa PA01
gcaggacgaggaaggcgcgcac

SEQ ID NO: 3510648 - RNA, 21 nt, Pseudomonas aeruginosa PA01
gcaggacgaugaucaccagga

SEQ ID NO: 3510649 - RNA, 23 nt, Pseudomonas aeruginosa PA01
gcaggacgaugaucaccaggacc

SEQ ID NO: 3510650 - RNA, 20 nt, Pseudomonas aeruginosa PA01
gcaggacgccgaacccgccu

SEQ ID NO: 3510651 - RNA, 21 nt, Pseudomonas aeruginosa PA01
gcaggacggauaacggcagcc

SEQ ID NO: 3510652 - RNA, 23 nt, Pseudomonas aeruginosa PA01
gcaggacggauaacggcagccgc

SEQ ID NO: 3510653 - RNA, 20 nt, Pseudomonas aeruginosa PA01
gcaggacgucguagccaggc

SEQ ID NO: 3510654 - RNA, 12 nt, Pseudomonas aeruginosa PA01
gcaggagaagcg

SEQ ID NO: 3510655 - RNA, 14 nt, Pseudomonas aeruginosa PA01
gcaggagaagcgcc

SEQ ID NO: 3510656 - RNA, 20 nt, Pseudomonas aeruginosa PA01
gcaggagaagcgccucgccu

SEQ ID NO: 3510657 - RNA, 20 nt, Pseudomonas aeruginosa PA01
gcaggagcagcuugcgcgag

SEQ ID NO: 3510658 - RNA, 23 nt, Pseudomonas aeruginosa PA01
gcaggagcaugucuucgucgcgc

SEQ ID NO: 3510659 - RNA, 18 nt, Pseudomonas aeruginosa PA01
gcaggaggauacggcgca

SEQ ID NO: 3510660 - RNA, 19 nt, Pseudomonas aeruginosa PA01
gcaggaggaucgcggccuu

SEQ ID NO: 3510661 - RNA, 23 nt, Pseudomonas aeruginosa PA01
gcaggauaucgcccagggccagc

SEQ ID NO: 3510662 - RNA, 19 nt, Pseudomonas aeruginosa PA01
gcaggaucaccugcuucug

SEQ ID NO: 3510663 - RNA, 13 nt, Pseudomonas aeruginosa PA01
gcaggaucaggcu

SEQ ID NO: 3510664 - RNA, 23 nt, Pseudomonas aeruginosa PA01
gcaggauccaggugcgcggcagg

SEQ ID NO: 3510665 - RNA, 18 nt, Pseudomonas aeruginosa PA01
gcaggaucgacagcagcg

SEQ ID NO: 3510666 - RNA, 19 nt, Pseudomonas aeruginosa PA01
gcaggaucgacagcagcgc

SEQ ID NO: 3510667 - RNA, 22 nt, Pseudomonas aeruginosa PA01
gcaggaucgacagcagcgccag

SEQ ID NO: 3510668 - RNA, 23 nt, Pseudomonas aeruginosa PA01
gcaggaucgacagcagcgccagg

SEQ ID NO: 3510669 - RNA, 21 nt, Pseudomonas aeruginosa PA01
gcaggaucgagcccuggucga

SEQ ID NO: 3510670 - RNA, 16 nt, Pseudomonas aeruginosa PA01
gcaggaucggcgcggu

SEQ ID NO: 3510671 - RNA, 22 nt, Pseudomonas aeruginosa PA01
gcaggaugcagucggcaccgau

SEQ ID NO: 3510672 - RNA, 14 nt, Pseudomonas aeruginosa PA01
gcaggaugccgccu

SEQ ID NO: 3510673 - RNA, 15 nt, Pseudomonas aeruginosa PA01
gcaggaugccgccug

SEQ ID NO: 3510674 - RNA, 16 nt, Pseudomonas aeruginosa PA01
gcaggaugccgccugc

SEQ ID NO: 3510675 - RNA, 21 nt, Pseudomonas aeruginosa PA01
gcaggaugccgccugcgucag

SEQ ID NO: 3510676 - RNA, 13 nt, Pseudomonas aeruginosa PA01
gcaggaugcugca

SEQ ID NO: 3510677 - RNA, 18 nt, Pseudomonas aeruginosa PA01
gcaggaugcugcacagcc

SEQ ID NO: 3510678 - RNA, 15 nt, Pseudomonas aeruginosa PA01
gcaggauguccuugu

SEQ ID NO: 3510679 - RNA, 17 nt, Pseudomonas aeruginosa PA01
gcaggauguugaacagg

SEQ ID NO: 3510680 - RNA, 14 nt, Pseudomonas aeruginosa PA01
gcaggcacagggcg

SEQ ID NO: 3510681 - RNA, 15 nt, Pseudomonas aeruginosa PA01
gcaggcacagggcga

SEQ ID NO: 3510682 - RNA, 17 nt, Pseudomonas aeruginosa PA01
gcaggcacagggcgacu

SEQ ID NO: 3510683 - RNA, 15 nt, Pseudomonas aeruginosa PA01
gcaggcacccgcggu

SEQ ID NO: 3510684 - RNA, 15 nt, Pseudomonas aeruginosa PA01
gcaggcacgcugcca

SEQ ID NO: 3510685 - RNA, 16 nt, Pseudomonas aeruginosa PA01
gcaggcacgcugccag

SEQ ID NO: 3510686 - RNA, 16 nt, Pseudomonas aeruginosa PA01
gcaggcagcacaugcc

SEQ ID NO: 3510687 - RNA, 13 nt, Pseudomonas aeruginosa PA01
gcaggcagcgcgc

SEQ ID NO: 3510688 - RNA, 20 nt, Pseudomonas aeruginosa PA01
gcaggcagcgcgcgucgguc

SEQ ID NO: 3510689 - RNA, 15 nt, Pseudomonas aeruginosa PA01
gcaggcaggccuggg

SEQ ID NO: 3510690 - RNA, 19 nt, Pseudomonas aeruginosa PA01
gcaggcaggucaucaggau

SEQ ID NO: 3510691 - RNA, 20 nt, Pseudomonas aeruginosa PA01
gcaggcagucccagaaggcc

SEQ ID NO: 3510692 - RNA, 14 nt, Pseudomonas aeruginosa PA01
gcaggcagugccgg

SEQ ID NO: 3510693 - RNA, 21 nt, Pseudomonas aeruginosa PA01
gcaggcaguggcgccagccag

SEQ ID NO: 3510694 - RNA, 17 nt, Pseudomonas aeruginosa PA01
gcaggcaugcggccccg

SEQ ID NO: 3510695 - RNA, 19 nt, Pseudomonas aeruginosa PA01
gcaggcaugcggccccggc

SEQ ID NO: 3510696 - RNA, 21 nt, Pseudomonas aeruginosa PA01
gcaggcaugcggccccggcgc

SEQ ID NO: 3510697 - RNA, 21 nt, Pseudomonas aeruginosa PA01
gcaggcauuggaagugucggu

SEQ ID NO: 3510698 - RNA, 23 nt, Pseudomonas aeruginosa PA01
gcaggccaccggauugucgaugu

SEQ ID NO: 3510699 - RNA, 16 nt, Pseudomonas aeruginosa PA01
gcaggccacggccgcu

SEQ ID NO: 3510700 - RNA, 18 nt, Pseudomonas aeruginosa PA01
gcaggccacggccgcugc

SEQ ID NO: 3510701 - RNA, 14 nt, Pseudomonas aeruginosa PA01
gcaggccagcaggu

SEQ ID NO: 3510702 - RNA, 17 nt, Pseudomonas aeruginosa PA01
gcaggccagccaacugc

SEQ ID NO: 3510703 - RNA, 22 nt, Pseudomonas aeruginosa PA01
gcaggccagccaacugcuucag

SEQ ID NO: 3510704 - RNA, 12 nt, Pseudomonas aeruginosa PA01
gcaggccagcgc

SEQ ID NO: 3510705 - RNA, 13 nt, Pseudomonas aeruginosa PA01
gcaggccagcgcc

SEQ ID NO: 3510706 - RNA, 15 nt, Pseudomonas aeruginosa PA01
gcaggccagcgccag

SEQ ID NO: 3510707 - RNA, 17 nt, Pseudomonas aeruginosa PA01
gcaggccagcgccaggg

SEQ ID NO: 3510708 - RNA, 21 nt, Pseudomonas aeruginosa PA01
gcaggccagcuuccaggcgcg

SEQ ID NO: 3510709 - RNA, 22 nt, Pseudomonas aeruginosa PA01
gcaggccagcuuccaggcgcgc

SEQ ID NO: 3510710 - RNA, 13 nt, Pseudomonas aeruginosa PA01
gcaggccaggcgc

SEQ ID NO: 3510711 - RNA, 17 nt, Pseudomonas aeruginosa PA01
gcaggccaggcgcagug

SEQ ID NO: 3510712 - RNA, 20 nt, Pseudomonas aeruginosa PA01
gcaggccaggcgcagugccu

SEQ ID NO: 3510713 - RNA, 19 nt, Pseudomonas aeruginosa PA01
gcaggccaugggugucggc

SEQ ID NO: 3510714 - RNA, 12 nt, Pseudomonas aeruginosa PA01
gcaggcccagcc

SEQ ID NO: 3510715 - RNA, 23 nt, Pseudomonas aeruginosa PA01
gcaggcccagccauugcgccagg

SEQ ID NO: 3510716 - RNA, 23 nt, Pseudomonas aeruginosa PA01
gcaggcccagcuucuuggcccgg

SEQ ID NO: 3510717 - RNA, 20 nt, Pseudomonas aeruginosa PA01
gcaggcccaguucgcugccg

SEQ ID NO: 3510718 - RNA, 14 nt, Pseudomonas aeruginosa PA01
gcaggcccggccgc

SEQ ID NO: 3510719 - RNA, 15 nt, Pseudomonas aeruginosa PA01
gcaggcccggccgcc

SEQ ID NO: 3510720 - RNA, 18 nt, Pseudomonas aeruginosa PA01
gcaggcccggccgccugc

SEQ ID NO: 3510721 - RNA, 21 nt, Pseudomonas aeruginosa PA01
gcaggcccggccgccugccuu

SEQ ID NO: 3510722 - RNA, 16 nt, Pseudomonas aeruginosa PA01
gcaggccgaagcgugg

SEQ ID NO: 3510723 - RNA, 18 nt, Pseudomonas aeruginosa PA01
gcaggccgaagcgugggc

SEQ ID NO: 3510724 - RNA, 23 nt, Pseudomonas aeruginosa PA01
gcaggccgaagcgugggcggccg

SEQ ID NO: 3510725 - RNA, 17 nt, Pseudomonas aeruginosa PA01
gcaggccgaaggccagg

SEQ ID NO: 3510726 - RNA, 20 nt, Pseudomonas aeruginosa PA01
gcaggccgaaggccaggacc

SEQ ID NO: 3510727 - RNA, 17 nt, Pseudomonas aeruginosa PA01
gcaggccgaauccgccg

SEQ ID NO: 3510728 - RNA, 19 nt, Pseudomonas aeruginosa PA01
gcaggccgaauccgccggc

SEQ ID NO: 3510729 - RNA, 20 nt, Pseudomonas aeruginosa PA01
gcaggccgaauccgccggcg

SEQ ID NO: 3510730 - RNA, 15 nt, Pseudomonas aeruginosa PA01
gcaggccgaccucgg

SEQ ID NO: 3510731 - RNA, 21 nt, Pseudomonas aeruginosa PA01
gcaggccgaccucggcgguca

SEQ ID NO: 3510732 - RNA, 22 nt, Pseudomonas aeruginosa PA01
gcaggccgaccucggcggucag

SEQ ID NO: 3510733 - RNA, 13 nt, Pseudomonas aeruginosa PA01
gcaggccgacggc

SEQ ID NO: 3510734 - RNA, 22 nt, Pseudomonas aeruginosa PA01
gcaggccgagaagguucucggc

SEQ ID NO: 3510735 - RNA, 20 nt, Pseudomonas aeruginosa PA01
gcaggccgagaccgcagccc

SEQ ID NO: 3510736 - RNA, 12 nt, Pseudomonas aeruginosa PA01
gcaggccgagcc

SEQ ID NO: 3510737 - RNA, 16 nt, Pseudomonas aeruginosa PA01
gcaggccgagcccgag

SEQ ID NO: 3510738 - RNA, 18 nt, Pseudomonas aeruginosa PA01
gcaggccgagcccgagug

SEQ ID NO: 3510739 - RNA, 16 nt, Pseudomonas aeruginosa PA01
gcaggccgagcugcuc

SEQ ID NO: 3510740 - RNA, 18 nt, Pseudomonas aeruginosa PA01
gcaggccgaggccggcga

SEQ ID NO: 3510741 - RNA, 15 nt, Pseudomonas aeruginosa PA01
gcaggccgaggucgg

SEQ ID NO: 3510742 - RNA, 20 nt, Pseudomonas aeruginosa PA01
gcaggccgaggucggcggcg

SEQ ID NO: 3510743 - RNA, 22 nt, Pseudomonas aeruginosa PA01
gcaggccgagguuuccaguugc

SEQ ID NO: 3510744 - RNA, 20 nt, Pseudomonas aeruginosa PA01
gcaggccgaucaccagcgcc

SEQ ID NO: 3510745 - RNA, 18 nt, Pseudomonas aeruginosa PA01
gacaccccgaaguagcga

SEQ ID NO: 3510746 - RNA, 17 nt, Pseudomonas aeruginosa PA01
gacaccccggucaggcc

SEQ ID NO: 3510747 - RNA, 22 nt, Pseudomonas aeruginosa PA01
gacaccccgucucgcugccgaa

SEQ ID NO: 3510748 - RNA, 14 nt, Pseudomonas aeruginosa PA01
gacacccgcgccgc

SEQ ID NO: 3510749 - RNA, 21 nt, Pseudomonas aeruginosa PA01
gacacccgcgccgccgcggcc

SEQ ID NO: 3510750 - RNA, 14 nt, Pseudomonas aeruginosa PA01
gacacccugccgcg

SEQ ID NO: 3510751 - RNA, 20 nt, Pseudomonas aeruginosa PA01
gacacccugccgcgccggau

SEQ ID NO: 3510752 - RNA, 15 nt, Pseudomonas aeruginosa PA01
gacacccugcugcug

SEQ ID NO: 3510753 - RNA, 16 nt, Pseudomonas aeruginosa PA01
gacacccugcugcugc

SEQ ID NO: 3510754 - RNA, 21 nt, Pseudomonas aeruginosa PA01
gacacccugcugcugcucagc

SEQ ID NO: 3510755 - RNA, 17 nt, Pseudomonas aeruginosa PA01
gacaccgaucaccuggc

SEQ ID NO: 3510756 - RNA, 22 nt, Pseudomonas aeruginosa PA01
gacaccgaucaccuggccggug

SEQ ID NO: 3510757 - RNA, 15 nt, Pseudomonas aeruginosa PA01
gacaccgaugccgaa

SEQ ID NO: 3510758 - RNA, 13 nt, Pseudomonas aeruginosa PA01
gacaccgccagca

SEQ ID NO: 3510759 - RNA, 14 nt, Pseudomonas aeruginosa PA01
gacaccgccagcac

SEQ ID NO: 3510760 - RNA, 15 nt, Pseudomonas aeruginosa PA01
gacaccgccagcacc

SEQ ID NO: 3510761 - RNA, 16 nt, Pseudomonas aeruginosa PA01
gacaccgcggugucgg

SEQ ID NO: 3510762 - RNA, 18 nt, Pseudomonas aeruginosa PA01
gacaccugcaacgcccgc

SEQ ID NO: 3510763 - RNA, 19 nt, Pseudomonas aeruginosa PA01
gacaccugcaacgcccgcg

SEQ ID NO: 3510764 - RNA, 20 nt, Pseudomonas aeruginosa PA01
gacaccuggcaacaaggcau

SEQ ID NO: 3510765 - RNA, 18 nt, Pseudomonas aeruginosa PA01
gacacgaaaaagccggcg

SEQ ID NO: 3510766 - RNA, 19 nt, Pseudomonas aeruginosa PA01
gacacgaaaaagccggcgc

SEQ ID NO: 3510767 - RNA, 16 nt, Pseudomonas aeruginosa PA01
gacacgagccgcugcg

SEQ ID NO: 3510768 - RNA, 16 nt, Pseudomonas aeruginosa PA01
gacacgcaggcgccga

SEQ ID NO: 3510769 - RNA, 17 nt, Pseudomonas aeruginosa PA01
gacacgugccccaggcc

SEQ ID NO: 3510770 - RNA, 18 nt, Pseudomonas aeruginosa PA01
gacacgugccccaggccg

SEQ ID NO: 3510771 - RNA, 15 nt, Pseudomonas aeruginosa PA01
gacacguucaggcgu

SEQ ID NO: 3510772 - RNA, 14 nt, Pseudomonas aeruginosa PA01
gacacucugguagc

SEQ ID NO: 3510773 - RNA, 16 nt, Pseudomonas aeruginosa PA01
gacagagcggccggcg

SEQ ID NO: 3510774 - RNA, 22 nt, Pseudomonas aeruginosa PA01
gacagagcggccggcgcggcgc

SEQ ID NO: 3510775 - RNA, 17 nt, Pseudomonas aeruginosa PA01
gacagcaccacgccgcu

SEQ ID NO: 3510776 - RNA, 22 nt, Pseudomonas aeruginosa PA01
gacagcaccacgccgcuggcgu

SEQ ID NO: 3510777 - RNA, 14 nt, Pseudomonas aeruginosa PA01
gacagcaccaugcc

SEQ ID NO: 3510778 - RNA, 16 nt, Pseudomonas aeruginosa PA01
gacagcaccaugcccu

SEQ ID NO: 3510779 - RNA, 18 nt, Pseudomonas aeruginosa PA01
gacagcacgauggcgagg

SEQ ID NO: 3510780 - RNA, 16 nt, Pseudomonas aeruginosa PA01
gacagcacgcucaggc

SEQ ID NO: 3510781 - RNA, 21 nt, Pseudomonas aeruginosa PA01
gacagcacgcucaggcagcga

SEQ ID NO: 3510782 - RNA, 13 nt, Pseudomonas aeruginosa PA01
gacagcagcgcca

SEQ ID NO: 3510783 - RNA, 16 nt, Pseudomonas aeruginosa PA01
gacagcagcgccaggg

SEQ ID NO: 3510784 - RNA, 14 nt, Pseudomonas aeruginosa PA01
gacagcaggcugcc

SEQ ID NO: 3510785 - RNA, 15 nt, Pseudomonas aeruginosa PA01
gacagcaggcugccg

SEQ ID NO: 3510786 - RNA, 14 nt, Pseudomonas aeruginosa PA01
gacagcagggucgc

SEQ ID NO: 3510787 - RNA, 18 nt, Pseudomonas aeruginosa PA01
gacagcaggucgugcugg

SEQ ID NO: 3510788 - RNA, 19 nt, Pseudomonas aeruginosa PA01
gacagcaucugcugguccu

SEQ ID NO: 3510789 - RNA, 19 nt, Pseudomonas aeruginosa PA01
gacagcauggccuugccgg

SEQ ID NO: 3510790 - RNA, 23 nt, Pseudomonas aeruginosa PA01
gacagcauggccuugccggcauc

SEQ ID NO: 3510791 - RNA, 14 nt, Pseudomonas aeruginosa PA01
gacagccccggccc

SEQ ID NO: 3510792 - RNA, 18 nt, Pseudomonas aeruginosa PA01
gacagcccgcgcucggcc

SEQ ID NO: 3510793 - RNA, 21 nt, Pseudomonas aeruginosa PA01
gacagcccgcgcucggccgcc

SEQ ID NO: 3510794 - RNA, 22 nt, Pseudomonas aeruginosa PA01
gacagcccuccaaagaaaagcc

SEQ ID NO: 3510795 - RNA, 22 nt, Pseudomonas aeruginosa PA01
gacagccucaagccucgcccuu

SEQ ID NO: 3510796 - RNA, 14 nt, Pseudomonas aeruginosa PA01
gacagccugggcgg

SEQ ID NO: 3510797 - RNA, 16 nt, Pseudomonas aeruginosa PA01
gacagccugggcggcu

SEQ ID NO: 3510798 - RNA, 22 nt, Pseudomonas aeruginosa PA01
gacagccugggcggcuuccugc

SEQ ID NO: 3510799 - RNA, 19 nt, Pseudomonas aeruginosa PA01
gacagcgaaugcuugccgg

SEQ ID NO: 3510800 - RNA, 22 nt, Pseudomonas aeruginosa PA01
gacagcgaaugcuugccggcgc

SEQ ID NO: 3510801 - RNA, 18 nt, Pseudomonas aeruginosa PA01
gacagcgcggaucaguca

SEQ ID NO: 3510802 - RNA, 19 nt, Pseudomonas aeruginosa PA01
gacagcgcggaucagucag

SEQ ID NO: 3510803 - RNA, 16 nt, Pseudomonas aeruginosa PA01
gacagcggcuggcgcu

SEQ ID NO: 3510804 - RNA, 18 nt, Pseudomonas aeruginosa PA01
gacagcgucugggugacc

SEQ ID NO: 3510805 - RNA, 12 nt, Pseudomonas aeruginosa PA01
gacagcucgcgg

SEQ ID NO: 3510806 - RNA, 18 nt, Pseudomonas aeruginosa PA01
gacagcucuggggucagu

SEQ ID NO: 3510807 - RNA, 18 nt, Pseudomonas aeruginosa PA01
gacagcuuggccagcagg

SEQ ID NO: 3510808 - RNA, 17 nt, Pseudomonas aeruginosa PA01
gacaggaaaaagcccgc

SEQ ID NO: 3510809 - RNA, 19 nt, Pseudomonas aeruginosa PA01
gacaggaaaaagcccgcgu

SEQ ID NO: 3510810 - RNA, 15 nt, Pseudomonas aeruginosa PA01
gacaggaagagcagg

SEQ ID NO: 3510811 - RNA, 12 nt, Pseudomonas aeruginosa PA01
gacaggcagccg

SEQ ID NO: 3510812 - RNA, 15 nt, Pseudomonas aeruginosa PA01
gacaggcagccggcc

SEQ ID NO: 3510813 - RNA, 17 nt, Pseudomonas aeruginosa PA01
gacaggcagccggccau

SEQ ID NO: 3510814 - RNA, 15 nt, Pseudomonas aeruginosa PA01
gacaggcagcgccgc

SEQ ID NO: 3510815 - RNA, 17 nt, Pseudomonas aeruginosa PA01
gacaggcauuccgggca

SEQ ID NO: 3510816 - RNA, 23 nt, Pseudomonas aeruginosa PA01
gacaggccacccgccucgucgcc

SEQ ID NO: 3510817 - RNA, 12 nt, Pseudomonas aeruginosa PA01
gacaggccagcu

SEQ ID NO: 3510818 - RNA, 18 nt, Pseudomonas aeruginosa PA01
gacaggccauucuucucc

SEQ ID NO: 3510819 - RNA, 17 nt, Pseudomonas aeruginosa PA01
gacaggccgaccagcag

SEQ ID NO: 3510820 - RNA, 13 nt, Pseudomonas aeruginosa PA01
gacaggccgccgu

SEQ ID NO: 3510821 - RNA, 13 nt, Pseudomonas aeruginosa PA01
gacaggccggugc

SEQ ID NO: 3510822 - RNA, 16 nt, Pseudomonas aeruginosa PA01
gacaggccuccagcaa

SEQ ID NO: 3510823 - RNA, 23 nt, Pseudomonas aeruginosa PA01
gacaggccuccagcaacgccgcc

SEQ ID NO: 3510824 - RNA, 13 nt, Pseudomonas aeruginosa PA01
gacaggcgaucga

SEQ ID NO: 3510825 - RNA, 19 nt, Pseudomonas aeruginosa PA01
gacaggcgccccugguccu

SEQ ID NO: 3510826 - RNA, 19 nt, Pseudomonas aeruginosa PA01
gacaggcgucccuggagca

SEQ ID NO: 3510827 - RNA, 23 nt, Pseudomonas aeruginosa PA01
gacaggcgucccuggagcagggc

SEQ ID NO: 3510828 - RNA, 22 nt, Pseudomonas aeruginosa PA01
gacaggcuaggaauaucuugcg

SEQ ID NO: 3510829 - RNA, 17 nt, Pseudomonas aeruginosa PA01
gacaggcuggaggcugg

SEQ ID NO: 3510830 - RNA, 16 nt, Pseudomonas aeruginosa PA01
gacaggcuggugccgu

SEQ ID NO: 3510831 - RNA, 17 nt, Pseudomonas aeruginosa PA01
gacaggcuggugccgua

SEQ ID NO: 3510832 - RNA, 14 nt, Pseudomonas aeruginosa PA01
gacagggccaggcc

SEQ ID NO: 3510833 - RNA, 16 nt, Pseudomonas aeruginosa PA01
gacagggccaggccga

SEQ ID NO: 3510834 - RNA, 18 nt, Pseudomonas aeruginosa PA01
gacagggccaggccgagc

SEQ ID NO: 3510835 - RNA, 19 nt, Pseudomonas aeruginosa PA01
gacagggcggcagcgugcu

SEQ ID NO: 3510836 - RNA, 16 nt, Pseudomonas aeruginosa PA01
gacagguacucggccc

SEQ ID NO: 3510837 - RNA, 22 nt, Pseudomonas aeruginosa PA01
gacagguacucggcccgggccu

SEQ ID NO: 3510838 - RNA, 18 nt, Pseudomonas aeruginosa PA01
gacaggucgcggaagugc

SEQ ID NO: 3510839 - RNA, 18 nt, Pseudomonas aeruginosa PA01
gacaggucggccggcagc

SEQ ID NO: 3510840 - RNA, 18 nt, Pseudomonas aeruginosa PA01
gacaggucggcgaaaucc

SEQ ID NO: 3510841 - RNA, 17 nt, Pseudomonas aeruginosa PA01
gacaggucgguguugcg

SEQ ID NO: 3510842 - RNA, 17 nt, Pseudomonas aeruginosa PA01
gacagguucaggacgcu

SEQ ID NO: 3510843 - RNA, 14 nt, Pseudomonas aeruginosa PA01
gacagguuggcgcc

SEQ ID NO: 3510844 - RNA, 15 nt, Pseudomonas aeruginosa PA01
gacagguuggcgccg

SEQ ID NO: 3510845 - RNA, 13 nt, Pseudomonas aeruginosa PA01
gacaguucgccgc

SEQ ID NO: 3510846 - RNA, 14 nt, Pseudomonas aeruginosa PA01
gacauacaggcgcg

SEQ ID NO: 3510847 - RNA, 14 nt, Pseudomonas aeruginosa PA01
gacauagcggcugc

SEQ ID NO: 3510848 - RNA, 15 nt, Pseudomonas aeruginosa PA01
gacaucaccacgcga

SEQ ID NO: 3510849 - RNA, 19 nt, Pseudomonas aeruginosa PA01
gaccaugguguuggcggcc

SEQ ID NO: 3510850 - RNA, 21 nt, Pseudomonas aeruginosa PA01
gaccaugguguuggcggccug

SEQ ID NO: 3510851 - RNA, 22 nt, Pseudomonas aeruginosa PA01
gaccaugguguuggcggccugg

SEQ ID NO: 3510852 - RNA, 19 nt, Pseudomonas aeruginosa PA01
gaccauguucaccagcgcu

SEQ ID NO: 3510853 - RNA, 19 nt, Pseudomonas aeruginosa PA01
gacccaaauuaacggccau

SEQ ID NO: 3510854 - RNA, 16 nt, Pseudomonas aeruginosa PA01
gacccacuccggcagg

SEQ ID NO: 3510855 - RNA, 19 nt, Pseudomonas aeruginosa PA01
gacccacuccggcaggcgc

SEQ ID NO: 3510856 - RNA, 20 nt, Pseudomonas aeruginosa PA01
gacccacuccggcaggcgcu

SEQ ID NO: 3510857 - RNA, 16 nt, Pseudomonas aeruginosa PA01
gacccagacaggccug

SEQ ID NO: 3510858 - RNA, 17 nt, Pseudomonas aeruginosa PA01
gacccagagccgcucgg

SEQ ID NO: 3510859 - RNA, 20 nt, Pseudomonas aeruginosa PA01
gacccagagccgcucggcgg

SEQ ID NO: 3510860 - RNA, 20 nt, Pseudomonas aeruginosa PA01
gacccaggccgacagcggcu

SEQ ID NO: 3510861 - RNA, 22 nt, Pseudomonas aeruginosa PA01
gacccaggccgacagcggcugg

SEQ ID NO: 3510862 - RNA, 16 nt, Pseudomonas aeruginosa PA01
gacccaggugcgcagg

SEQ ID NO: 3510863 - RNA, 20 nt, Pseudomonas aeruginosa PA01
gacccaggugcgcaggcgcu

SEQ ID NO: 3510864 - RNA, 22 nt, Pseudomonas aeruginosa PA01
gacccaggugcgcaggcgcucg

SEQ ID NO: 3510865 - RNA, 17 nt, Pseudomonas aeruginosa PA01
gacccaguugggccagg

SEQ ID NO: 3510866 - RNA, 22 nt, Pseudomonas aeruginosa PA01
gacccaucgaugcucauccugc

SEQ ID NO: 3510867 - RNA, 14 nt, Pseudomonas aeruginosa PA01
gacccaugccgcua

SEQ ID NO: 3510868 - RNA, 22 nt, Pseudomonas aeruginosa PA01
gacccaugccgcuagcccugcu

SEQ ID NO: 3510869 - RNA, 19 nt, Pseudomonas aeruginosa PA01
gaccccaccggucuuggcg

SEQ ID NO: 3510870 - RNA, 23 nt, Pseudomonas aeruginosa PA01
gaccccaccggucuuggcgcgcg

SEQ ID NO: 3510871 - RNA, 17 nt, Pseudomonas aeruginosa PA01
gaccccacgccggccgg

SEQ ID NO: 3510872 - RNA, 16 nt, Pseudomonas aeruginosa PA01
gacccccugcggcccg

SEQ ID NO: 3510873 - RNA, 15 nt, Pseudomonas aeruginosa PA01
gaccccgaggucggc

SEQ ID NO: 3510874 - RNA, 22 nt, Pseudomonas aeruginosa PA01
gaccccgcccuagcgguccgga

SEQ ID NO: 3510875 - RNA, 12 nt, Pseudomonas aeruginosa PA01
gaccccgccggg

SEQ ID NO: 3510876 - RNA, 23 nt, Pseudomonas aeruginosa PA01
gaccccgccggggcgugcaggcc

SEQ ID NO: 3510877 - RNA, 14 nt, Pseudomonas aeruginosa PA01
gaccccgcggccga

SEQ ID NO: 3510878 - RNA, 15 nt, Pseudomonas aeruginosa PA01
gaccccgcggccgag

SEQ ID NO: 3510879 - RNA, 14 nt, Pseudomonas aeruginosa PA01
gaccccggaaaggu

SEQ ID NO: 3510880 - RNA, 17 nt, Pseudomonas aeruginosa PA01
gaccccggccuccaggc

SEQ ID NO: 3510881 - RNA, 17 nt, Pseudomonas aeruginosa PA01
gaccccggccuggcugg

SEQ ID NO: 3510882 - RNA, 20 nt, Pseudomonas aeruginosa PA01
gaccccggccuggcuggccu

SEQ ID NO: 3510883 - RNA, 23 nt, Pseudomonas aeruginosa PA01
gaccccggcgaucuucagguagg

SEQ ID NO: 3510884 - RNA, 17 nt, Pseudomonas aeruginosa PA01
gaccccggcgaugcugc

SEQ ID NO: 3510885 - RNA, 13 nt, Pseudomonas aeruginosa PA01
gaccccggcggcg

SEQ ID NO: 3510886 - RNA, 18 nt, Pseudomonas aeruginosa PA01
gaccccggugugcgcugc

SEQ ID NO: 3510887 - RNA, 19 nt, Pseudomonas aeruginosa PA01
gaccccggugugcgcugca

SEQ ID NO: 3510888 - RNA, 14 nt, Pseudomonas aeruginosa PA01
gacccgaaggucgc

SEQ ID NO: 3510889 - RNA, 19 nt, Pseudomonas aeruginosa PA01
gacccgcaacaccuguacc

SEQ ID NO: 3510890 - RNA, 18 nt, Pseudomonas aeruginosa PA01
gacccgcaccuggaccgg

SEQ ID NO: 3510891 - RNA, 16 nt, Pseudomonas aeruginosa PA01
gacccgcacggcgacg

SEQ ID NO: 3510892 - RNA, 19 nt, Pseudomonas aeruginosa PA01
gacccgcacuuuaccccga

SEQ ID NO: 3510893 - RNA, 16 nt, Pseudomonas aeruginosa PA01
gacccgcaggccggcc

SEQ ID NO: 3510894 - RNA, 17 nt, Pseudomonas aeruginosa PA01
gacccgcaggccggcca

SEQ ID NO: 3510895 - RNA, 19 nt, Pseudomonas aeruginosa PA01
gacccgcaggccggccagg

SEQ ID NO: 3510896 - RNA, 22 nt, Pseudomonas aeruginosa PA01
gacccgcaguuccuugggcauc

SEQ ID NO: 3510897 - RNA, 12 nt, Pseudomonas aeruginosa PA01
gacccgccagcg

SEQ ID NO: 3510898 - RNA, 14 nt, Pseudomonas aeruginosa PA01
gacccgccagcggc

SEQ ID NO: 3510899 - RNA, 15 nt, Pseudomonas aeruginosa PA01
gacccgccagcggca

SEQ ID NO: 3510900 - RNA, 16 nt, Pseudomonas aeruginosa PA01
gacccgccagcggcau

SEQ ID NO: 3510901 - RNA, 13 nt, Pseudomonas aeruginosa PA01
gacccgccccugc

SEQ ID NO: 3510902 - RNA, 23 nt, Pseudomonas aeruginosa PA01
gacccgccccugcuccucgccgu

SEQ ID NO: 3510903 - RNA, 20 nt, Pseudomonas aeruginosa PA01
gacccgcccgccguccucca

SEQ ID NO: 3510904 - RNA, 21 nt, Pseudomonas aeruginosa PA01
gacccgcccgccguccuccag

SEQ ID NO: 3510905 - RNA, 18 nt, Pseudomonas aeruginosa PA01
gacccgccguucgcccgc

SEQ ID NO: 3510906 - RNA, 18 nt, Pseudomonas aeruginosa PA01
gacccgcgccggcagcuc

SEQ ID NO: 3510907 - RNA, 13 nt, Pseudomonas aeruginosa PA01
gacccgcggcagg

SEQ ID NO: 3510908 - RNA, 13 nt, Pseudomonas aeruginosa PA01
gacccgcucgccg

SEQ ID NO: 3510909 - RNA, 14 nt, Pseudomonas aeruginosa PA01
gacccgcucgccgg

SEQ ID NO: 3510910 - RNA, 13 nt, Pseudomonas aeruginosa PA01
gacccgcucggcc

SEQ ID NO: 3510911 - RNA, 14 nt, Pseudomonas aeruginosa PA01
gacccgcucggccu

SEQ ID NO: 3510912 - RNA, 14 nt, Pseudomonas aeruginosa PA01
gacccgcugaagga

SEQ ID NO: 3510913 - RNA, 16 nt, Pseudomonas aeruginosa PA01
gacccgcugcaccagc

SEQ ID NO: 3510914 - RNA, 13 nt, Pseudomonas aeruginosa PA01
gacccgcugcugg

SEQ ID NO: 3510915 - RNA, 16 nt, Pseudomonas aeruginosa PA01
gacccgcuguccgccg

SEQ ID NO: 3510916 - RNA, 18 nt, Pseudomonas aeruginosa PA01
gacccgcuguccgccggc

SEQ ID NO: 3510917 - RNA, 22 nt, Pseudomonas aeruginosa PA01
gacccgcuguccgccggccucg

SEQ ID NO: 3510918 - RNA, 23 nt, Pseudomonas aeruginosa PA01
gacccgcuguccgccggccucga

SEQ ID NO: 3510919 - RNA, 13 nt, Pseudomonas aeruginosa PA01
gacccggacagcc

SEQ ID NO: 3510920 - RNA, 14 nt, Pseudomonas aeruginosa PA01
gacccggacagccu

SEQ ID NO: 3510921 - RNA, 22 nt, Pseudomonas aeruginosa PA01
gacccggauaccccgguugugc

SEQ ID NO: 3510922 - RNA, 16 nt, Pseudomonas aeruginosa PA01
gacccggccgaccagg

SEQ ID NO: 3510923 - RNA, 12 nt, Pseudomonas aeruginosa PA01
gacccggcugca

SEQ ID NO: 3510924 - RNA, 13 nt, Pseudomonas aeruginosa PA01
gacccgggccucc

SEQ ID NO: 3510925 - RNA, 14 nt, Pseudomonas aeruginosa PA01
gacccgggucaggc

SEQ ID NO: 3510926 - RNA, 17 nt, Pseudomonas aeruginosa PA01
gacccgggucaggccga

SEQ ID NO: 3510927 - RNA, 18 nt, Pseudomonas aeruginosa PA01
gacccgggucaggccgag

SEQ ID NO: 3510928 - RNA, 19 nt, Pseudomonas aeruginosa PA01
gacccggguuuccugcccg

SEQ ID NO: 3510929 - RNA, 16 nt, Pseudomonas aeruginosa PA01
gacccgguacagcgcc

SEQ ID NO: 3510930 - RNA, 17 nt, Pseudomonas aeruginosa PA01
gacccgguacagcgccu

SEQ ID NO: 3510931 - RNA, 20 nt, Pseudomonas aeruginosa PA01
gacccgguacagcgccuggu

SEQ ID NO: 3510932 - RNA, 15 nt, Pseudomonas aeruginosa PA01
gacccgguacuccuc

SEQ ID NO: 3510933 - RNA, 15 nt, Pseudomonas aeruginosa PA01
gacccggucgcugac

SEQ ID NO: 3510934 - RNA, 23 nt, Pseudomonas aeruginosa PA01
gacccggucgcugaccagcccgg

SEQ ID NO: 3510935 - RNA, 20 nt, Pseudomonas aeruginosa PA01
gacccgguuaccggcgacca

SEQ ID NO: 3510936 - RNA, 14 nt, Pseudomonas aeruginosa PA01
gacccgugcgccgc

SEQ ID NO: 3510937 - RNA, 16 nt, Pseudomonas aeruginosa PA01
gacccgugcgccgcgg

SEQ ID NO: 3510938 - RNA, 17 nt, Pseudomonas aeruginosa PA01
gacccguugccgaccga

SEQ ID NO: 3510939 - RNA, 20 nt, Pseudomonas aeruginosa PA01
gacccguugccgaccgagca

SEQ ID NO: 3510940 - RNA, 22 nt, Pseudomonas aeruginosa PA01
gacccguugccgaccgagcagc

SEQ ID NO: 3510941 - RNA, 15 nt, Pseudomonas aeruginosa PA01
gacccguugcgccuc

SEQ ID NO: 3510942 - RNA, 21 nt, Pseudomonas aeruginosa PA01
gacccguugcgccucgccgcc

SEQ ID NO: 3510943 - RNA, 19 nt, Pseudomonas aeruginosa PA01
gacccucauggaaaccccg

SEQ ID NO: 3510944 - RNA, 14 nt, Pseudomonas aeruginosa PA01
gacccucggcgagg

SEQ ID NO: 3510945 - RNA, 15 nt, Pseudomonas aeruginosa PA01
gacccugcuggccgg

SEQ ID NO: 3510946 - RNA, 19 nt, Pseudomonas aeruginosa PA01
gacccugcuggccggugcc

SEQ ID NO: 3510947 - RNA, 22 nt, Pseudomonas aeruginosa PA01
gacccugcuggccggugccgcc

SEQ ID NO: 3510948 - RNA, 11 nt, Pseudomonas aeruginosa PA01
gacccuggccg

SEQ ID NO: 3510949 - RNA, 14 nt, Pseudomonas aeruginosa PA01
gacccuggccgcgc

SEQ ID NO: 3510950 - RNA, 15 nt, Pseudomonas aeruginosa PA01
gacccuggcgccgac

SEQ ID NO: 3510951 - RNA, 16 nt, Pseudomonas aeruginosa PA01
gacccuggcgccgacc

SEQ ID NO: 3510952 - RNA, 19 nt, Pseudomonas aeruginosa PA01
gacccuggcgccgaccucc

SEQ ID NO: 3510953 - RNA, 12 nt, Pseudomonas aeruginosa PA01
gacccuggcgcu

SEQ ID NO: 3510954 - RNA, 18 nt, Pseudomonas aeruginosa PA01
gacccuggcgcugucgcc

SEQ ID NO: 3510955 - RNA, 16 nt, Pseudomonas aeruginosa PA01
gacccuggggucgccg

SEQ ID NO: 3510956 - RNA, 19 nt, Pseudomonas aeruginosa PA01
gacccugguaguccagcag

SEQ ID NO: 3510957 - RNA, 19 nt, Pseudomonas aeruginosa PA01
gacccuucaacggcgaccg

SEQ ID NO: 3510958 - RNA, 18 nt, Pseudomonas aeruginosa PA01
gaccgaacaucagcagca

SEQ ID NO: 3510959 - RNA, 20 nt, Pseudomonas aeruginosa PA01
gaccgaagccgcgcagcacu

SEQ ID NO: 3510960 - RNA, 17 nt, Pseudomonas aeruginosa PA01
gaccgacacguucaggc

SEQ ID NO: 3510961 - RNA, 22 nt, Pseudomonas aeruginosa PA01
gaccgacacguucaggcguacg

SEQ ID NO: 3510962 - RNA, 15 nt, Pseudomonas aeruginosa PA01
gaccgaccaguacca

SEQ ID NO: 3510963 - RNA, 19 nt, Pseudomonas aeruginosa PA01
gaccgaccaguaccagcaa

SEQ ID NO: 3510964 - RNA, 18 nt, Pseudomonas aeruginosa PA01
gaccgacgcucgcggcau

SEQ ID NO: 3510965 - RNA, 21 nt, Pseudomonas aeruginosa PA01
gaccgacguugagaaggcgcc

SEQ ID NO: 3510966 - RNA, 13 nt, Pseudomonas aeruginosa PA01
gaccgacuggccg

SEQ ID NO: 3510967 - RNA, 14 nt, Pseudomonas aeruginosa PA01
gaccgagaugcucg

SEQ ID NO: 3510968 - RNA, 22 nt, Pseudomonas aeruginosa PA01
gaccgagaugcucgcgcagcga

SEQ ID NO: 3510969 - RNA, 19 nt, Pseudomonas aeruginosa PA01
gaccgagauucugcaggcg

SEQ ID NO: 3510970 - RNA, 13 nt, Pseudomonas aeruginosa PA01
gaccgagcagcgg

SEQ ID NO: 3510971 - RNA, 15 nt, Pseudomonas aeruginosa PA01
gaccgagcagcggac

SEQ ID NO: 3510972 - RNA, 19 nt, Pseudomonas aeruginosa PA01
gaccgagcagcggacgcag

SEQ ID NO: 3510973 - RNA, 14 nt, Pseudomonas aeruginosa PA01
gaccgagcaugcgc

SEQ ID NO: 3510974 - RNA, 18 nt, Pseudomonas aeruginosa PA01
gaccgagcaugcgcggca

SEQ ID NO: 3510975 - RNA, 15 nt, Pseudomonas aeruginosa PA01
gaccgaucaugcccu

SEQ ID NO: 3510976 - RNA, 15 nt, Pseudomonas aeruginosa PA01
gaccgauccagcagu

SEQ ID NO: 3510977 - RNA, 18 nt, Pseudomonas aeruginosa PA01
gaccgauccagcagucgc

SEQ ID NO: 3510978 - RNA, 16 nt, Pseudomonas aeruginosa PA01
gaccgaucucguucgg

SEQ ID NO: 3510979 - RNA, 15 nt, Pseudomonas aeruginosa PA01
gaccgauggcgccgc

SEQ ID NO: 3510980 - RNA, 21 nt, Pseudomonas aeruginosa PA01
gaccgcaaccgguccucgccc

SEQ ID NO: 3510981 - RNA, 15 nt, Pseudomonas aeruginosa PA01
gaccgcaccgccagc

SEQ ID NO: 3510982 - RNA, 16 nt, Pseudomonas aeruginosa PA01
gaccgcaccgccagcg

SEQ ID NO: 3510983 - RNA, 17 nt, Pseudomonas aeruginosa PA01
gaccgcaccgccagcgu

SEQ ID NO: 3510984 - RNA, 15 nt, Pseudomonas aeruginosa PA01
gaccgcaccuggugg

SEQ ID NO: 3510985 - RNA, 21 nt, Pseudomonas aeruginosa PA01
gaccgcagaaccagacgcucg

SEQ ID NO: 3510986 - RNA, 16 nt, Pseudomonas aeruginosa PA01
gaccgcagcccaguuc

SEQ ID NO: 3510987 - RNA, 12 nt, Pseudomonas aeruginosa PA01
gaccgcagccgg

SEQ ID NO: 3510988 - RNA, 21 nt, Pseudomonas aeruginosa PA01
gaccgcaucguuggcgccguc

SEQ ID NO: 3510989 - RNA, 12 nt, Pseudomonas aeruginosa PA01
gaccgccaggcc

SEQ ID NO: 3510990 - RNA, 15 nt, Pseudomonas aeruginosa PA01
gaccgccaggcggcc

SEQ ID NO: 3510991 - RNA, 16 nt, Pseudomonas aeruginosa PA01
gaccgccaggcggccg

SEQ ID NO: 3510992 - RNA, 19 nt, Pseudomonas aeruginosa PA01
gaccgccaggcggccgcug

SEQ ID NO: 3510993 - RNA, 15 nt, Pseudomonas aeruginosa PA01
gaccgccauggcgcu

SEQ ID NO: 3510994 - RNA, 14 nt, Pseudomonas aeruginosa PA01
gaccgcccaggcug

SEQ ID NO: 3510995 - RNA, 21 nt, Pseudomonas aeruginosa PA01
gaccgcccaggcugccgccgc

SEQ ID NO: 3510996 - RNA, 23 nt, Pseudomonas aeruginosa PA01
gaccgcccaggcugccgccgccg

SEQ ID NO: 3510997 - RNA, 21 nt, Pseudomonas aeruginosa PA01
gaccgcccagggggccgggcc

SEQ ID NO: 3510998 - RNA, 17 nt, Pseudomonas aeruginosa PA01
gaccgcccgccucaggc

SEQ ID NO: 3510999 - RNA, 22 nt, Pseudomonas aeruginosa PA01
gaccgcccgccucaggccggga

SEQ ID NO: 3511000 - RNA, 13 nt, Pseudomonas aeruginosa PA01
gaccgccgccgcc

SEQ ID NO: 3511001 - RNA, 11 nt, Pseudomonas aeruginosa PA01
gaccgccgccu

SEQ ID NO: 3511002 - RNA, 12 nt, Pseudomonas aeruginosa PA01
gaccgccgccug

SEQ ID NO: 3511003 - RNA, 22 nt, Pseudomonas aeruginosa PA01
gaccgccucgaccaucggcggc

SEQ ID NO: 3511004 - RNA, 16 nt, Pseudomonas aeruginosa PA01
gaccgccugccagacc

SEQ ID NO: 3511005 - RNA, 19 nt, Pseudomonas aeruginosa PA01
gaccgccugcucgcggcug

SEQ ID NO: 3511006 - RNA, 20 nt, Pseudomonas aeruginosa PA01
gaccgccugcucgcggcugg

SEQ ID NO: 3511007 - RNA, 22 nt, Pseudomonas aeruginosa PA01
gaccgccugcucgcggcuggcc

SEQ ID NO: 3511008 - RNA, 21 nt, Pseudomonas aeruginosa PA01
gaccgcgaauggcagcaggca

SEQ ID NO: 3511009 - RNA, 17 nt, Pseudomonas aeruginosa PA01
gaccgcgacaacccugu

SEQ ID NO: 3511010 - RNA, 18 nt, Pseudomonas aeruginosa PA01
gaccgcgacaacccuguc

SEQ ID NO: 3511011 - RNA, 21 nt, Pseudomonas aeruginosa PA01
gaccgcgacaacccugucccc

SEQ ID NO: 3511012 - RNA, 15 nt, Pseudomonas aeruginosa PA01
gaccgcgagcgccgc

SEQ ID NO: 3511013 - RNA, 18 nt, Pseudomonas aeruginosa PA01
gaccgcgaguucgccggc

SEQ ID NO: 3511014 - RNA, 20 nt, Pseudomonas aeruginosa PA01
gaccgcgaguucgccggcca

SEQ ID NO: 3511015 - RNA, 21 nt, Pseudomonas aeruginosa PA01
gaccgcgaguucgccggccag

SEQ ID NO: 3511016 - RNA, 22 nt, Pseudomonas aeruginosa PA01
gaccgcgaguucgccggccagg

SEQ ID NO: 3511017 - RNA, 12 nt, Pseudomonas aeruginosa PA01
gaccgcgcccgg

SEQ ID NO: 3511018 - RNA, 12 nt, Pseudomonas aeruginosa PA01
gaccgcgccggc

SEQ ID NO: 3511019 - RNA, 16 nt, Pseudomonas aeruginosa PA01
gaccgcgcgccauggc

SEQ ID NO: 3511020 - RNA, 17 nt, Pseudomonas aeruginosa PA01
gaccgcgcgccauggcc

SEQ ID NO: 3511021 - RNA, 20 nt, Pseudomonas aeruginosa PA01
gaccgcgcgccauggccugg

SEQ ID NO: 3511022 - RNA, 15 nt, Pseudomonas aeruginosa PA01
gaccgcgcgccugca

SEQ ID NO: 3511023 - RNA, 16 nt, Pseudomonas aeruginosa PA01
gaccgcgcgccugcaa

SEQ ID NO: 3511024 - RNA, 22 nt, Pseudomonas aeruginosa PA01
gaccgcgcgccugcaacgccag

SEQ ID NO: 3511025 - RNA, 18 nt, Pseudomonas aeruginosa PA01
gaccgcguccaugccgua

SEQ ID NO: 3511026 - RNA, 14 nt, Pseudomonas aeruginosa PA01
gaccgcucccaggc

SEQ ID NO: 3511027 - RNA, 16 nt, Pseudomonas aeruginosa PA01
gaccgcucccaggcaa

SEQ ID NO: 3511028 - RNA, 15 nt, Pseudomonas aeruginosa PA01
gaccgcucgucaggc

SEQ ID NO: 3511029 - RNA, 16 nt, Pseudomonas aeruginosa PA01
gaccgcucgucaggcg

SEQ ID NO: 3511030 - RNA, 19 nt, Pseudomonas aeruginosa PA01
gaccgcucgucaggcgcuc

SEQ ID NO: 3511031 - RNA, 22 nt, Pseudomonas aeruginosa PA01
gaccgcuggaccaguucagcgc

SEQ ID NO: 3511032 - RNA, 20 nt, Pseudomonas aeruginosa PA01
gaccggaagguugucgaagc

SEQ ID NO: 3511033 - RNA, 22 nt, Pseudomonas aeruginosa PA01
gaccggaaucacgucgaucugc

SEQ ID NO: 3511034 - RNA, 21 nt, Pseudomonas aeruginosa PA01
gaccggauguucgaaggccag

SEQ ID NO: 3511035 - RNA, 16 nt, Pseudomonas aeruginosa PA01
gaccggcagccggguu

SEQ ID NO: 3511036 - RNA, 13 nt, Pseudomonas aeruginosa PA01
gaccggcagcgcc

SEQ ID NO: 3511037 - RNA, 14 nt, Pseudomonas aeruginosa PA01
gaccggcagcgccg

SEQ ID NO: 3511038 - RNA, 15 nt, Pseudomonas aeruginosa PA01
gaccggcagcgccgc

SEQ ID NO: 3511039 - RNA, 16 nt, Pseudomonas aeruginosa PA01
gaccggcagcgccgcc

SEQ ID NO: 3511040 - RNA, 17 nt, Pseudomonas aeruginosa PA01
gaccggcaucgaccagc

SEQ ID NO: 3511041 - RNA, 12 nt, Pseudomonas aeruginosa PA01
gaccggccggcu

SEQ ID NO: 3511042 - RNA, 15 nt, Pseudomonas aeruginosa PA01
gaccggcgccgggau

SEQ ID NO: 3511043 - RNA, 16 nt, Pseudomonas aeruginosa PA01
gaccggcucgucggcg

SEQ ID NO: 3511044 - RNA, 18 nt, Pseudomonas aeruginosa PA01
gaccggcucucuucggcc

SEQ ID NO: 3511045 - RNA, 20 nt, Pseudomonas aeruginosa PA01
gaccggcugcuuggccaggu

SEQ ID NO: 3511046 - RNA, 22 nt, Pseudomonas aeruginosa PA01
gaccggcuuggucacgccguuc

SEQ ID NO: 3511047 - RNA, 15 nt, Pseudomonas aeruginosa PA01
gaccgggcgccucgu

SEQ ID NO: 3511048 - RNA, 13 nt, Pseudomonas aeruginosa PA01
gaccgggcggauc

SEQ ID NO: 3511049 - RNA, 16 nt, Pseudomonas aeruginosa PA01
gaccgggcggcaggcg

SEQ ID NO: 3511050 - RNA, 17 nt, Pseudomonas aeruginosa PA01
gaccgggcggcaggcgc

SEQ ID NO: 3511051 - RNA, 18 nt, Pseudomonas aeruginosa PA01
gaccgggcggcaggcgcc

SEQ ID NO: 3511052 - RNA, 15 nt, Pseudomonas aeruginosa PA01
gaccgggcggcgcgg

SEQ ID NO: 3511053 - RNA, 19 nt, Pseudomonas aeruginosa PA01
gaccgggcggcgcggcgca

SEQ ID NO: 3511054 - RNA, 20 nt, Pseudomonas aeruginosa PA01
gaccgggcggcgcggcgcaa

SEQ ID NO: 3511055 - RNA, 19 nt, Pseudomonas aeruginosa PA01
gaccgggcgggucuggcgg

SEQ ID NO: 3511056 - RNA, 16 nt, Pseudomonas aeruginosa PA01
gaccggguccugcaga

SEQ ID NO: 3511057 - RNA, 17 nt, Pseudomonas aeruginosa PA01
gaccggguccugcagau

SEQ ID NO: 3511058 - RNA, 17 nt, Pseudomonas aeruginosa PA01
gaccggguugaugccga

SEQ ID NO: 3511059 - RNA, 16 nt, Pseudomonas aeruginosa PA01
gaccgguagccaugau

SEQ ID NO: 3511060 - RNA, 23 nt, Pseudomonas aeruginosa PA01
gaccgguuaauggcgcuccaggg

SEQ ID NO: 3511061 - RNA, 14 nt, Pseudomonas aeruginosa PA01
gaccgguuccagcg

SEQ ID NO: 3511062 - RNA, 17 nt, Pseudomonas aeruginosa PA01
gaccgguuccagcggcc

SEQ ID NO: 3511063 - RNA, 18 nt, Pseudomonas aeruginosa PA01
gaccgguuccagcggccg

SEQ ID NO: 3511064 - RNA, 19 nt, Pseudomonas aeruginosa PA01
gaccgguuccagcggccgc

SEQ ID NO: 3511065 - RNA, 21 nt, Pseudomonas aeruginosa PA01
gaccgguuccagcggccgcga

SEQ ID NO: 3511066 - RNA, 15 nt, Pseudomonas aeruginosa PA01
gaccgucagccaggc

SEQ ID NO: 3511067 - RNA, 23 nt, Pseudomonas aeruginosa PA01
gaccgucauguuguucgcgcacc

SEQ ID NO: 3511068 - RNA, 16 nt, Pseudomonas aeruginosa PA01
gaccguccagcgcgcc

SEQ ID NO: 3511069 - RNA, 19 nt, Pseudomonas aeruginosa PA01
gaccguccagcgcgccgcg

SEQ ID NO: 3511070 - RNA, 21 nt, Pseudomonas aeruginosa PA01
gaccguccagcgcgccgcgca

SEQ ID NO: 3511071 - RNA, 12 nt, Pseudomonas aeruginosa PA01
gaccguccuggc

SEQ ID NO: 3511072 - RNA, 18 nt, Pseudomonas aeruginosa PA01
gaccguccuggcccugcc

SEQ ID NO: 3511073 - RNA, 22 nt, Pseudomonas aeruginosa PA01
gaccgucgcgauagacgccggc

SEQ ID NO: 3511074 - RNA, 14 nt, Pseudomonas aeruginosa PA01
gaccgucggccggg

SEQ ID NO: 3511075 - RNA, 16 nt, Pseudomonas aeruginosa PA01
gaccgugaugcccagc

SEQ ID NO: 3511076 - RNA, 18 nt, Pseudomonas aeruginosa PA01
gaccgugaugcccagcgg

SEQ ID NO: 3511077 - RNA, 21 nt, Pseudomonas aeruginosa PA01
gaccgugaugcccagcggcgc

SEQ ID NO: 3511078 - RNA, 13 nt, Pseudomonas aeruginosa PA01
gaccgugccgccg

SEQ ID NO: 3511079 - RNA, 14 nt, Pseudomonas aeruginosa PA01
gaccgugccgccgg

SEQ ID NO: 3511080 - RNA, 15 nt, Pseudomonas aeruginosa PA01
gaccgugccgccggg

SEQ ID NO: 3511081 - RNA, 14 nt, Pseudomonas aeruginosa PA01
gaccgugcgggucg

SEQ ID NO: 3511082 - RNA, 20 nt, Pseudomonas aeruginosa PA01
gaccgugcgggucgaggccg

SEQ ID NO: 3511083 - RNA, 22 nt, Pseudomonas aeruginosa PA01
gaccguggauuucagcaggccg

SEQ ID NO: 3511084 - RNA, 22 nt, Pseudomonas aeruginosa PA01
gaccguggcgcuacgcucgccg

SEQ ID NO: 3511085 - RNA, 18 nt, Pseudomonas aeruginosa PA01
gaccguuucgccgccggc

SEQ ID NO: 3511086 - RNA, 14 nt, Pseudomonas aeruginosa PA01
gaccuccagccggc

SEQ ID NO: 3511087 - RNA, 16 nt, Pseudomonas aeruginosa PA01
gaccuccagccggcca

SEQ ID NO: 3511088 - RNA, 17 nt, Pseudomonas aeruginosa PA01
gaccuccagccggccau

SEQ ID NO: 3511089 - RNA, 22 nt, Pseudomonas aeruginosa PA01
gaccuccaggccgaagccgccg

SEQ ID NO: 3511090 - RNA, 17 nt, Pseudomonas aeruginosa PA01
gaccuccagggccagcu

SEQ ID NO: 3511091 - RNA, 13 nt, Pseudomonas aeruginosa PA01
gaccuccagguag

SEQ ID NO: 3511092 - RNA, 14 nt, Pseudomonas aeruginosa PA01
gaccucccgcgcca

SEQ ID NO: 3511093 - RNA, 19 nt, Pseudomonas aeruginosa PA01
gaccucccgcgccagcucg

SEQ ID NO: 3511094 - RNA, 17 nt, Pseudomonas aeruginosa PA01
gaccuccgccaggucga

SEQ ID NO: 3511095 - RNA, 14 nt, Pseudomonas aeruginosa PA01
gaccuccucgauga

SEQ ID NO: 3511096 - RNA, 16 nt, Pseudomonas aeruginosa PA01
gaccucgaagcuggcc

SEQ ID NO: 3511097 - RNA, 17 nt, Pseudomonas aeruginosa PA01
gaccucgaagcuggcca

SEQ ID NO: 3511098 - RNA, 18 nt, Pseudomonas aeruginosa PA01
gaccucgaagcuggccag

SEQ ID NO: 3511099 - RNA, 18 nt, Pseudomonas aeruginosa PA01
gaccucgaaguccugcag

SEQ ID NO: 3511100 - RNA, 20 nt, Pseudomonas aeruginosa PA01
gaccucgaaguccugcagga

SEQ ID NO: 3511101 - RNA, 14 nt, Pseudomonas aeruginosa PA01
gaccucgacgccga

SEQ ID NO: 3511102 - RNA, 21 nt, Pseudomonas aeruginosa PA01
gaccucgacgccgagccagcc

SEQ ID NO: 3511103 - RNA, 15 nt, Pseudomonas aeruginosa PA01
gaccucgagcaggcc

SEQ ID NO: 3511104 - RNA, 17 nt, Pseudomonas aeruginosa PA01
gaccucgagcuggacgc

SEQ ID NO: 3511105 - RNA, 13 nt, Pseudomonas aeruginosa PA01
gaccucgauggcg

SEQ ID NO: 3511106 - RNA, 20 nt, Pseudomonas aeruginosa PA01
gaccucgauggcgauauggc

SEQ ID NO: 3511107 - RNA, 14 nt, Pseudomonas aeruginosa PA01
gaccucgauguccg

SEQ ID NO: 3511108 - RNA, 12 nt, Pseudomonas aeruginosa PA01
gaccucgcccau

SEQ ID NO: 3511109 - RNA, 14 nt, Pseudomonas aeruginosa PA01
gaccucgcccaucg

SEQ ID NO: 3511110 - RNA, 17 nt, Pseudomonas aeruginosa PA01
gaccucgcccaucgcca

SEQ ID NO: 3511111 - RNA, 20 nt, Pseudomonas aeruginosa PA01
gaccucgcccaucgccaggg

SEQ ID NO: 3511112 - RNA, 11 nt, Pseudomonas aeruginosa PA01
gaccucgcggg

SEQ ID NO: 3511113 - RNA, 19 nt, Pseudomonas aeruginosa PA01
gaccucgcgggcgacgugg

SEQ ID NO: 3511114 - RNA, 18 nt, Pseudomonas aeruginosa PA01
gaccucgcugacuuccau

SEQ ID NO: 3511115 - RNA, 14 nt, Pseudomonas aeruginosa PA01
gaccucggccgcca

SEQ ID NO: 3511116 - RNA, 13 nt, Pseudomonas aeruginosa PA01
gaccucggcgguc

SEQ ID NO: 3511117 - RNA, 16 nt, Pseudomonas aeruginosa PA01
gaccucggcggucagg

SEQ ID NO: 3511118 - RNA, 22 nt, Pseudomonas aeruginosa PA01
gaccucgggcagcuuggcgguc

SEQ ID NO: 3511119 - RNA, 23 nt, Pseudomonas aeruginosa PA01
gaccucgggcagcuuggcgguca

SEQ ID NO: 3511120 - RNA, 23 nt, Pseudomonas aeruginosa PA01
gaccucgggcgagaaucgccgag

SEQ ID NO: 3511121 - RNA, 19 nt, Pseudomonas aeruginosa PA01
gaccucggguuuggcgccc

SEQ ID NO: 3511122 - RNA, 18 nt, Pseudomonas aeruginosa PA01
gaccucguugcaggcacg

SEQ ID NO: 3511123 - RNA, 21 nt, Pseudomonas aeruginosa PA01
gaccugagaucagcgcccggc

SEQ ID NO: 3511124 - RNA, 22 nt, Pseudomonas aeruginosa PA01
gaccugcaauuccaccggcugg

SEQ ID NO: 3511125 - RNA, 24 nt, Pseudomonas aeruginosa PA01
gaccugcaauuccaccggcuggcc

SEQ ID NO: 3511126 - RNA, 14 nt, Pseudomonas aeruginosa PA01
gaccugcagcagga

SEQ ID NO: 3511127 - RNA, 14 nt, Pseudomonas aeruginosa PA01
gaccugcagcgccu

SEQ ID NO: 3511128 - RNA, 16 nt, Pseudomonas aeruginosa PA01
gaccugcagcgccucg

SEQ ID NO: 3511129 - RNA, 19 nt, Pseudomonas aeruginosa PA01
gaccugcagcgccucgugg

SEQ ID NO: 3511130 - RNA, 16 nt, Pseudomonas aeruginosa PA01
gaccugccgcccggcc

SEQ ID NO: 3511131 - RNA, 18 nt, Pseudomonas aeruginosa PA01
gaccugccgcccggccag

SEQ ID NO: 3511132 - RNA, 19 nt, Pseudomonas aeruginosa PA01
gaccugcgaggcgucgauc

SEQ ID NO: 3511133 - RNA, 21 nt, Pseudomonas aeruginosa PA01
gaccugcggcaagugggucac

SEQ ID NO: 3511134 - RNA, 14 nt, Pseudomonas aeruginosa PA01
gaccugcggggcgg

SEQ ID NO: 3511135 - RNA, 20 nt, Pseudomonas aeruginosa PA01
gaccugcucgaaccggaaaa

SEQ ID NO: 3511136 - RNA, 17 nt, Pseudomonas aeruginosa PA01
gaccugcucgcgcaccg

SEQ ID NO: 3511137 - RNA, 23 nt, Pseudomonas aeruginosa PA01
gaccugcucgcgcaccgcggcca

SEQ ID NO: 3511138 - RNA, 20 nt, Pseudomonas aeruginosa PA01
gaccugcucgucgaugcugc

SEQ ID NO: 3511139 - RNA, 22 nt, Pseudomonas aeruginosa PA01
gaccugcucgucgaugcugccg

SEQ ID NO: 3511140 - RNA, 14 nt, Pseudomonas aeruginosa PA01
gaccugcugcccgg

SEQ ID NO: 3511141 - RNA, 19 nt, Pseudomonas aeruginosa PA01
gaccugcugggccagcgcc

SEQ ID NO: 3511142 - RNA, 20 nt, Pseudomonas aeruginosa PA01
gaccugcugggccagcgccg

SEQ ID NO: 3511143 - RNA, 13 nt, Pseudomonas aeruginosa PA01
gaccuggccgcgu

SEQ ID NO: 3511144 - RNA, 20 nt, Pseudomonas aeruginosa PA01
gaccuggccgcguucgccga

SEQ ID NO: 3511145 - RNA, 14 nt, Pseudomonas aeruginosa PA01
gaccuggccgcugu

SEQ ID NO: 3511146 - RNA, 16 nt, Pseudomonas aeruginosa PA01
gaccuggccggcgacc

SEQ ID NO: 3511147 - RNA, 19 nt, Pseudomonas aeruginosa PA01
gaccuggccggcgaccuug

SEQ ID NO: 3511148 - RNA, 15 nt, Pseudomonas aeruginosa PA01
gaccuggccgucccu

SEQ ID NO: 3511149 - RNA, 20 nt, Pseudomonas aeruginosa PA01
gaccuggccgucccugacca

SEQ ID NO: 3511150 - RNA, 21 nt, Pseudomonas aeruginosa PA01
gaccuggccgucccugaccag

SEQ ID NO: 3511151 - RNA, 17 nt, Pseudomonas aeruginosa PA01
gaccuggcuccacugcu

SEQ ID NO: 3511152 - RNA, 17 nt, Pseudomonas aeruginosa PA01
gaccugggcgucgcugu

SEQ ID NO: 3511153 - RNA, 17 nt, Pseudomonas aeruginosa PA01
gaccuggggcggccuca

SEQ ID NO: 3511154 - RNA, 21 nt, Pseudomonas aeruginosa PA01
gaccuggggcggccucaggcc

SEQ ID NO: 3511155 - RNA, 20 nt, Pseudomonas aeruginosa PA01
gaccuggguaccgacggucg

SEQ ID NO: 3511156 - RNA, 16 nt, Pseudomonas aeruginosa PA01
gaccuggucguugcgc

SEQ ID NO: 3511157 - RNA, 15 nt, Pseudomonas aeruginosa PA01
gaccugguggcgccg

SEQ ID NO: 3511158 - RNA, 20 nt, Pseudomonas aeruginosa PA01
gaccugguggcgccggcuga

SEQ ID NO: 3511159 - RNA, 20 nt, Pseudomonas aeruginosa PA01
gaccuggugggcggcggcua

SEQ ID NO: 3511160 - RNA, 20 nt, Pseudomonas aeruginosa PA01
gaccuguaccgcuccccacu

SEQ ID NO: 3511161 - RNA, 21 nt, Pseudomonas aeruginosa PA01
gaccugucccgauuccgcgca

SEQ ID NO: 3511162 - RNA, 12 nt, Pseudomonas aeruginosa PA01
gaccugucggcu

SEQ ID NO: 3511163 - RNA, 22 nt, Pseudomonas aeruginosa PA01
gaccuguucgaaguucuccagc

SEQ ID NO: 3511164 - RNA, 19 nt, Pseudomonas aeruginosa PA01
gaccuguucgcgcccgucg

SEQ ID NO: 3511165 - RNA, 22 nt, Pseudomonas aeruginosa PA01
gaccuguucgcgcccgucgucg

SEQ ID NO: 3511166 - RNA, 19 nt, Pseudomonas aeruginosa PA01
gaccuguugcagagcggcc

SEQ ID NO: 3511167 - RNA, 21 nt, Pseudomonas aeruginosa PA01
gaccuguugcagagcggccag

SEQ ID NO: 3511168 - RNA, 13 nt, Pseudomonas aeruginosa PA01
gaccuucacuucg

SEQ ID NO: 3511169 - RNA, 14 nt, Pseudomonas aeruginosa PA01
gaccuucagcaccu

SEQ ID NO: 3511170 - RNA, 17 nt, Pseudomonas aeruginosa PA01
gaccuucagcgggucga

SEQ ID NO: 3511171 - RNA, 22 nt, Pseudomonas aeruginosa PA01
gaccuucaucaggcggcacucg

SEQ ID NO: 3511172 - RNA, 17 nt, Pseudomonas aeruginosa PA01
gaccuuccagccgcgcg

SEQ ID NO: 3511173 - RNA, 20 nt, Pseudomonas aeruginosa PA01
gaccuuccagccgcgcgcgu

SEQ ID NO: 3511174 - RNA, 14 nt, Pseudomonas aeruginosa PA01
gaccuuccgccagc

SEQ ID NO: 3511175 - RNA, 18 nt, Pseudomonas aeruginosa PA01
gaccuuccgccagcaggc

SEQ ID NO: 3511176 - RNA, 21 nt, Pseudomonas aeruginosa PA01
gaccuuccgccagcaggcgcg

SEQ ID NO: 3511177 - RNA, 18 nt, Pseudomonas aeruginosa PA01
gaccuuccugccagcgcg

SEQ ID NO: 3511178 - RNA, 17 nt, Pseudomonas aeruginosa PA01
gaccuucgacggcaggu

SEQ ID NO: 3511179 - RNA, 17 nt, Pseudomonas aeruginosa PA01
gaccuucuccgaccagg

SEQ ID NO: 3511180 - RNA, 12 nt, Pseudomonas aeruginosa PA01
gaccuucugcac

SEQ ID NO: 3511181 - RNA, 13 nt, Pseudomonas aeruginosa PA01
gaccuucugcacc

SEQ ID NO: 3511182 - RNA, 19 nt, Pseudomonas aeruginosa PA01
gaccuucugcaccgugcgc

SEQ ID NO: 3511183 - RNA, 13 nt, Pseudomonas aeruginosa PA01
gaccuugaacucg

SEQ ID NO: 3511184 - RNA, 17 nt, Pseudomonas aeruginosa PA01
gaccuugaacucgcccg

SEQ ID NO: 3511185 - RNA, 17 nt, Pseudomonas aeruginosa PA01
gaccuugacgaagccgg

SEQ ID NO: 3511186 - RNA, 21 nt, Pseudomonas aeruginosa PA01
gaccuugccccaggugcuuca

SEQ ID NO: 3511187 - RNA, 19 nt, Pseudomonas aeruginosa PA01
gaccuugcccucggcgccc

SEQ ID NO: 3511188 - RNA, 16 nt, Pseudomonas aeruginosa PA01
gaccuugccgacgccg

SEQ ID NO: 3511189 - RNA, 15 nt, Pseudomonas aeruginosa PA01
gaccuugccgagcgc

SEQ ID NO: 3511190 - RNA, 17 nt, Pseudomonas aeruginosa PA01
gaccuugccgagcgcga

SEQ ID NO: 3511191 - RNA, 14 nt, Pseudomonas aeruginosa PA01
gaccuugccgcgaa

SEQ ID NO: 3511192 - RNA, 21 nt, Pseudomonas aeruginosa PA01
gaccuugccgguuaucgaggc

SEQ ID NO: 3511193 - RNA, 20 nt, Pseudomonas aeruginosa PA01
gaccuugcgcaccagggcca

SEQ ID NO: 3511194 - RNA, 14 nt, Pseudomonas aeruginosa PA01
gaccuugcucuucu

SEQ ID NO: 3511195 - RNA, 16 nt, Pseudomonas aeruginosa PA01
gaccuugcucuucugg

SEQ ID NO: 3511196 - RNA, 23 nt, Pseudomonas aeruginosa PA01
gaccuugcuggugcccugggcgg

SEQ ID NO: 3511197 - RNA, 13 nt, Pseudomonas aeruginosa PA01
gaccuuggccagc

SEQ ID NO: 3511198 - RNA, 17 nt, Pseudomonas aeruginosa PA01
gaccuuguccuggccgg

SEQ ID NO: 3511199 - RNA, 19 nt, Pseudomonas aeruginosa PA01
gaccuuguccuggccggcg

SEQ ID NO: 3511200 - RNA, 15 nt, Pseudomonas aeruginosa PA01
gaccuugucgauggu

SEQ ID NO: 3511201 - RNA, 13 nt, Pseudomonas aeruginosa PA01
gaccuugucggcc

SEQ ID NO: 3511202 - RNA, 18 nt, Pseudomonas aeruginosa PA01
gacgaaacgguagcccgc

SEQ ID NO: 3511203 - RNA, 19 nt, Pseudomonas aeruginosa PA01
gacgaaacgguagcccgcg

SEQ ID NO: 3511204 - RNA, 21 nt, Pseudomonas aeruginosa PA01
gacgaaacucaucaggcugcc

SEQ ID NO: 3511205 - RNA, 15 nt, Pseudomonas aeruginosa PA01
gacgaaagaagccgc

SEQ ID NO: 3511206 - RNA, 16 nt, Pseudomonas aeruginosa PA01
gacgaaagaagccgca

SEQ ID NO: 3511207 - RNA, 22 nt, Pseudomonas aeruginosa PA01
gacgaaagacgcugcgaccugg

SEQ ID NO: 3511208 - RNA, 16 nt, Pseudomonas aeruginosa PA01
gacgaaaggccgcgcc

SEQ ID NO: 3511209 - RNA, 19 nt, Pseudomonas aeruginosa PA01
gacgaaauaaugcggcgcg

SEQ ID NO: 3511210 - RNA, 20 nt, Pseudomonas aeruginosa PA01
gacgaaauaaugcggcgcga

SEQ ID NO: 3511211 - RNA, 23 nt, Pseudomonas aeruginosa PA01
gacgaaauacucgucgacggccu

SEQ ID NO: 3511212 - RNA, 22 nt, Pseudomonas aeruginosa PA01
gacgaaauagucgcgggccugg

SEQ ID NO: 3511213 - RNA, 19 nt, Pseudomonas aeruginosa PA01
gacgaacaucgccagcgcc

SEQ ID NO: 3511214 - RNA, 20 nt, Pseudomonas aeruginosa PA01
gacgaacaucgccagcgcca

SEQ ID NO: 3511215 - RNA, 16 nt, Pseudomonas aeruginosa PA01
gacgaacgagaagccg

SEQ ID NO: 3511216 - RNA, 15 nt, Pseudomonas aeruginosa PA01
gacgaacgccuuggu

SEQ ID NO: 3511217 - RNA, 16 nt, Pseudomonas aeruginosa PA01
gacgaacggaucgcuc

SEQ ID NO: 3511218 - RNA, 21 nt, Pseudomonas aeruginosa PA01
gacgaacucaacgaagugaag

SEQ ID NO: 3511219 - RNA, 14 nt, Pseudomonas aeruginosa PA01
gacgaacucgacgc

SEQ ID NO: 3511220 - RNA, 16 nt, Pseudomonas aeruginosa PA01
gacgaagacgcugcgc

SEQ ID NO: 3511221 - RNA, 14 nt, Pseudomonas aeruginosa PA01
gacgaagcccaggc

SEQ ID NO: 3511222 - RNA, 15 nt, Pseudomonas aeruginosa PA01
gacgaagcccaggcu

SEQ ID NO: 3511223 - RNA, 17 nt, Pseudomonas aeruginosa PA01
gacgaagcccaggcuga

SEQ ID NO: 3511224 - RNA, 22 nt, Pseudomonas aeruginosa PA01
gacgaagcccaggcugacccgg

SEQ ID NO: 3511225 - RNA, 12 nt, Pseudomonas aeruginosa PA01
gacgaagcccuc

SEQ ID NO: 3511226 - RNA, 19 nt, Pseudomonas aeruginosa PA01
gacgaagcccucgcgacgg

SEQ ID NO: 3511227 - RNA, 13 nt, Pseudomonas aeruginosa PA01
gacgaagccggcg

SEQ ID NO: 3511228 - RNA, 13 nt, Pseudomonas aeruginosa PA01
gacgaagcgccgg

SEQ ID NO: 3511229 - RNA, 14 nt, Pseudomonas aeruginosa PA01
gacgaagcgccggc

SEQ ID NO: 3511230 - RNA, 17 nt, Pseudomonas aeruginosa PA01
gacgaagcggaagccgg

SEQ ID NO: 3511231 - RNA, 14 nt, Pseudomonas aeruginosa PA01
gacgaaggccgcgg

SEQ ID NO: 3511232 - RNA, 19 nt, Pseudomonas aeruginosa PA01
gacgaaggcggcagcggug

SEQ ID NO: 3511233 - RNA, 18 nt, Pseudomonas aeruginosa PA01
gacgaaggcuggagcgcu

SEQ ID NO: 3511234 - RNA, 20 nt, Pseudomonas aeruginosa PA01
gacgaaggcuggagcgcugc

SEQ ID NO: 3511235 - RNA, 19 nt, Pseudomonas aeruginosa PA01
gacgaagggcucagcccag

SEQ ID NO: 3511236 - RNA, 20 nt, Pseudomonas aeruginosa PA01
gacgaagggcucagcccagg

SEQ ID NO: 3511237 - RNA, 21 nt, Pseudomonas aeruginosa PA01
gacgaagggcucagcccaggc

SEQ ID NO: 3511238 - RNA, 15 nt, Pseudomonas aeruginosa PA01
gacgaaggucggcgg

SEQ ID NO: 3511239 - RNA, 17 nt, Pseudomonas aeruginosa PA01
gacgaaggucggcggca

SEQ ID NO: 3511240 - RNA, 19 nt, Pseudomonas aeruginosa PA01
gacgaaggucggcggcagc

SEQ ID NO: 3511241 - RNA, 20 nt, Pseudomonas aeruginosa PA01
gacgaaggucggcggcagcu

SEQ ID NO: 3511242 - RNA, 23 nt, Pseudomonas aeruginosa PA01
gacgaaggucggcggcagcugcg

SEQ ID NO: 3511243 - RNA, 13 nt, Pseudomonas aeruginosa PA01
gacgaagucgccg

SEQ ID NO: 3511244 - RNA, 14 nt, Pseudomonas aeruginosa PA01
gacgaagucgccgg

SEQ ID NO: 3511245 - RNA, 20 nt, Pseudomonas aeruginosa PA01
gacgaaguuggcggccgacg

SEQ ID NO: 3511246 - RNA, 20 nt, Pseudomonas aeruginosa PA01
gacgaaugcccgugcgcugc

SEQ ID NO: 3511247 - RNA, 19 nt, Pseudomonas aeruginosa PA01
gacgaauuccgauuucagc

SEQ ID NO: 3511248 - RNA, 19 nt, Pseudomonas aeruginosa PA01
gacgacaucucguccucgg

SEQ ID NO: 3511249 - RNA, 21 nt, Pseudomonas aeruginosa PA01
gacgaccucagaccacgcccu

SEQ ID NO: 3511250 - RNA, 16 nt, Pseudomonas aeruginosa PA01
gacgacgaaagaagcc

SEQ ID NO: 3511251 - RNA, 18 nt, Pseudomonas aeruginosa PA01
gacgacgaaagaagccgc

SEQ ID NO: 3511252 - RNA, 13 nt, Pseudomonas aeruginosa PA01
gacgacgaaaggc

SEQ ID NO: 3511253 - RNA, 20 nt, Pseudomonas aeruginosa PA01
gacgacgaaaggccgcgccg

SEQ ID NO: 3511254 - RNA, 21 nt, Pseudomonas aeruginosa PA01
gacgacgaaaggccgcgccgg

SEQ ID NO: 3511255 - RNA, 13 nt, Pseudomonas aeruginosa PA01
gacgacgaacgcc

SEQ ID NO: 3511256 - RNA, 19 nt, Pseudomonas aeruginosa PA01
gacgacgaacgccuuggug

SEQ ID NO: 3511257 - RNA, 23 nt, Pseudomonas aeruginosa PA01
gacgacgaagugaccgcgcgcca

SEQ ID NO: 3511258 - RNA, 15 nt, Pseudomonas aeruginosa PA01
gacgacgcuggccug

SEQ ID NO: 3511259 - RNA, 16 nt, Pseudomonas aeruginosa PA01
gacgacgcuggccugc

SEQ ID NO: 3511260 - RNA, 20 nt, Pseudomonas aeruginosa PA01
gacgacgcuggccugccgau

SEQ ID NO: 3511261 - RNA, 20 nt, Pseudomonas aeruginosa PA01
gacgacgugcccauuuucca

SEQ ID NO: 3511262 - RNA, 16 nt, Pseudomonas aeruginosa PA01
gacgacugcacgcaga

SEQ ID NO: 3511263 - RNA, 14 nt, Pseudomonas aeruginosa PA01
gacgacugcggcag

SEQ ID NO: 3511264 - RNA, 19 nt, Pseudomonas aeruginosa PA01
gacgacugcggcagcuugg

SEQ ID NO: 3511265 - RNA, 22 nt, Pseudomonas aeruginosa PA01
gacgacugcggcagcuuggcga

SEQ ID NO: 3511266 - RNA, 22 nt, Pseudomonas aeruginosa PA01
gacgagaaaaagcccggcauuc

SEQ ID NO: 3511267 - RNA, 13 nt, Pseudomonas aeruginosa PA01
gacgagacgccga

SEQ ID NO: 3511268 - RNA, 15 nt, Pseudomonas aeruginosa PA01
gacgagacgccgagg

SEQ ID NO: 3511269 - RNA, 20 nt, Pseudomonas aeruginosa PA01
gacgagauugaugaagcgcu

SEQ ID NO: 3511270 - RNA, 17 nt, Pseudomonas aeruginosa PA01
gacgagcagcucgccgg

SEQ ID NO: 3511271 - RNA, 22 nt, Pseudomonas aeruginosa PA01
gacgagccgcgacgcgaccucc

SEQ ID NO: 3511272 - RNA, 16 nt, Pseudomonas aeruginosa PA01
gacgagccggacggcg

SEQ ID NO: 3511273 - RNA, 18 nt, Pseudomonas aeruginosa PA01
gacgagccggacggcggc

SEQ ID NO: 3511274 - RNA, 20 nt, Pseudomonas aeruginosa PA01
gacgagccggacggcggcgu

SEQ ID NO: 3511275 - RNA, 14 nt, Pseudomonas aeruginosa PA01
gacgagcguccgcc

SEQ ID NO: 3511276 - RNA, 18 nt, Pseudomonas aeruginosa PA01
gacgagcguccgccgccg

SEQ ID NO: 3511277 - RNA, 16 nt, Pseudomonas aeruginosa PA01
gacgagcuuuccugcu

SEQ ID NO: 3511278 - RNA, 23 nt, Pseudomonas aeruginosa PA01
gacgaggaacgccucgcagagcg

SEQ ID NO: 3511279 - RNA, 17 nt, Pseudomonas aeruginosa PA01
gacgaggaaggcgcgca

SEQ ID NO: 3511280 - RNA, 18 nt, Pseudomonas aeruginosa PA01
gacgaggaaggcgcgcac

SEQ ID NO: 3511281 - RNA, 17 nt, Pseudomonas aeruginosa PA01
gacgaggacgccgccgg

SEQ ID NO: 3511282 - RNA, 16 nt, Pseudomonas aeruginosa PA01
gacgaggauggucagg

SEQ ID NO: 3511283 - RNA, 20 nt, Pseudomonas aeruginosa PA01
gacgaggauggucaggccgg

SEQ ID NO: 3511284 - RNA, 22 nt, Pseudomonas aeruginosa PA01
gacgaggauggucaggccggcg

SEQ ID NO: 3511285 - RNA, 24 nt, Pseudomonas aeruginosa PA01
gacgaggcccgcccaguugcgggc

SEQ ID NO: 3511286 - RNA, 15 nt, Pseudomonas aeruginosa PA01
gacgaggcgcggcgg

SEQ ID NO: 3511287 - RNA, 12 nt, Pseudomonas aeruginosa PA01
gacgagggcacg

SEQ ID NO: 3511288 - RNA, 20 nt, Pseudomonas aeruginosa PA01
gacgaggggcugcggagcgu

SEQ ID NO: 3511289 - RNA, 21 nt, Pseudomonas aeruginosa PA01
gacgaggggcugcggagcguc

SEQ ID NO: 3511290 - RNA, 15 nt, Pseudomonas aeruginosa PA01
gacgagguugcucug

SEQ ID NO: 3511291 - RNA, 19 nt, Pseudomonas aeruginosa PA01
gacgagguugcucugggca

SEQ ID NO: 3511292 - RNA, 19 nt, Pseudomonas aeruginosa PA01
gacgaguaaaacggcaggc

SEQ ID NO: 3511293 - RNA, 23 nt, Pseudomonas aeruginosa PA01
gacgauaucggcgccggccucca

SEQ ID NO: 3511294 - RNA, 15 nt, Pseudomonas aeruginosa PA01
gacgaucacccccag

SEQ ID NO: 3511295 - RNA, 16 nt, Pseudomonas aeruginosa PA01
gacgaucacucccugc

SEQ ID NO: 3511296 - RNA, 19 nt, Pseudomonas aeruginosa PA01
gacgaucacucccugcucg

SEQ ID NO: 3511297 - RNA, 20 nt, Pseudomonas aeruginosa PA01
gacgaucagcaggaugcagu

SEQ ID NO: 3511298 - RNA, 21 nt, Pseudomonas aeruginosa PA01
gacgaucagcaggaugcaguc

SEQ ID NO: 3511299 - RNA, 19 nt, Pseudomonas aeruginosa PA01
gacgaucagcggcccgagc

SEQ ID NO: 3511300 - RNA, 20 nt, Pseudomonas aeruginosa PA01
gacgaucagcggcccgagca

SEQ ID NO: 3511301 - RNA, 23 nt, Pseudomonas aeruginosa PA01
gacgaucagcuuguggucguggc

SEQ ID NO: 3511302 - RNA, 22 nt, Pseudomonas aeruginosa PA01
gacgaucaggugcaggaacagc

SEQ ID NO: 3511303 - RNA, 15 nt, Pseudomonas aeruginosa PA01
gacgaucccggcggu

SEQ ID NO: 3511304 - RNA, 22 nt, Pseudomonas aeruginosa PA01
gacgauccggccgaucuccugg

SEQ ID NO: 3511305 - RNA, 17 nt, Pseudomonas aeruginosa PA01
gacgaucgccccgcuac

SEQ ID NO: 3511306 - RNA, 21 nt, Pseudomonas aeruginosa PA01
gacgaucgccccgcuacccug

SEQ ID NO: 3511307 - RNA, 19 nt, Pseudomonas aeruginosa PA01
gacgaucucccgcgauucg

SEQ ID NO: 3511308 - RNA, 23 nt, Pseudomonas aeruginosa PA01
gacgaucucccgcgauucgccgg

SEQ ID NO: 3511309 - RNA, 20 nt, Pseudomonas aeruginosa PA01
gacgaucuccugcugggcgu

SEQ ID NO: 3511310 - RNA, 15 nt, Pseudomonas aeruginosa PA01
gacgaucugcgagcg

SEQ ID NO: 3511311 - RNA, 14 nt, Pseudomonas aeruginosa PA01
gacgaugaucacca

SEQ ID NO: 3511312 - RNA, 22 nt, Pseudomonas aeruginosa PA01
gacgaugaucaccaggacccag

SEQ ID NO: 3511313 - RNA, 20 nt, Pseudomonas aeruginosa PA01
gacgaugccgaucucgccca

SEQ ID NO: 3511314 - RNA, 15 nt, Pseudomonas aeruginosa PA01
gacgaugccgccgcc

SEQ ID NO: 3511315 - RNA, 18 nt, Pseudomonas aeruginosa PA01
gacgaugcgccccagcgc

SEQ ID NO: 3511316 - RNA, 22 nt, Pseudomonas aeruginosa PA01
gacgaugcgccccagcgccugg

SEQ ID NO: 3511317 - RNA, 23 nt, Pseudomonas aeruginosa PA01
gacgaugcgccccagcgccuggg

SEQ ID NO: 3511318 - RNA, 23 nt, Pseudomonas aeruginosa PA01
gacgaugcucgguugccaggccg

SEQ ID NO: 3511319 - RNA, 18 nt, Pseudomonas aeruginosa PA01
gacgauggaacgcggguu

SEQ ID NO: 3511320 - RNA, 14 nt, Pseudomonas aeruginosa PA01
gacgauggccagcc

SEQ ID NO: 3511321 - RNA, 18 nt, Pseudomonas aeruginosa PA01
gacgauggccagcccgga

SEQ ID NO: 3511322 - RNA, 15 nt, Pseudomonas aeruginosa PA01
gacgauggcccagau

SEQ ID NO: 3511323 - RNA, 14 nt, Pseudomonas aeruginosa PA01
gacgauggccgccg

SEQ ID NO: 3511324 - RNA, 16 nt, Pseudomonas aeruginosa PA01
gacgauggccgccgcc

SEQ ID NO: 3511325 - RNA, 13 nt, Pseudomonas aeruginosa PA01
gacgauggcgacg

SEQ ID NO: 3511326 - RNA, 19 nt, Pseudomonas aeruginosa PA01
gacgauggcgacguucugc

SEQ ID NO: 3511327 - RNA, 12 nt, Pseudomonas aeruginosa PA01
gacgauggcgcc

SEQ ID NO: 3511328 - RNA, 14 nt, Pseudomonas aeruginosa PA01
gacgauggcgccuu

SEQ ID NO: 3511329 - RNA, 19 nt, Pseudomonas aeruginosa PA01
gacgaugggcacgaucugc

SEQ ID NO: 3511330 - RNA, 12 nt, Pseudomonas aeruginosa PA01
gacgauggucgc

SEQ ID NO: 3511331 - RNA, 23 nt, Pseudomonas aeruginosa PA01
gacgauguucuccacgucguccg

SEQ ID NO: 3511332 - RNA, 23 nt, Pseudomonas aeruginosa PA01
gacgauugaccucccgcgccagc

SEQ ID NO: 3511333 - RNA, 19 nt, Pseudomonas aeruginosa PA01
gacgcaaacgccauccgcc

SEQ ID NO: 3511334 - RNA, 20 nt, Pseudomonas aeruginosa PA01
gacgcaaacgccauccgccu

SEQ ID NO: 3511335 - RNA, 15 nt, Pseudomonas aeruginosa PA01
gacgcaagcgcucgg

SEQ ID NO: 3511336 - RNA, 21 nt, Pseudomonas aeruginosa PA01
gacgcaagcgcucggccugcg

SEQ ID NO: 3511337 - RNA, 22 nt, Pseudomonas aeruginosa PA01
gacgcacaccgucgaaccagcc

SEQ ID NO: 3511338 - RNA, 12 nt, Pseudomonas aeruginosa PA01
gacgcaccagca

SEQ ID NO: 3511339 - RNA, 14 nt, Pseudomonas aeruginosa PA01
gacgcaccagcagg

SEQ ID NO: 3511340 - RNA, 21 nt, Pseudomonas aeruginosa PA01
gacgcaccagcaggccgauca

SEQ ID NO: 3511341 - RNA, 17 nt, Pseudomonas aeruginosa PA01
gacgcacucauagcuca

SEQ ID NO: 3511342 - RNA, 14 nt, Pseudomonas aeruginosa PA01
gacgcagagcgcca

SEQ ID NO: 3511343 - RNA, 17 nt, Pseudomonas aeruginosa PA01
gacgcagcacggcggcu

SEQ ID NO: 3511344 - RNA, 18 nt, Pseudomonas aeruginosa PA01
gacgcagcacggcggcua

SEQ ID NO: 3511345 - RNA, 16 nt, Pseudomonas aeruginosa PA01
gacgcagccgggccgc

SEQ ID NO: 3511346 - RNA, 22 nt, Pseudomonas aeruginosa PA01
gacgcagccgggccgcagcgca

SEQ ID NO: 3511347 - RNA, 13 nt, Pseudomonas aeruginosa PA01
gacgcagccguug

SEQ ID NO: 3511348 - RNA, 22 nt, Pseudomonas aeruginosa PA01
gacgcagccguuggccagcagg

SEQ ID NO: 3511349 - RNA, 13 nt, Pseudomonas aeruginosa PA01
gacgcagcgcgcg

SEQ ID NO: 3511350 - RNA, 15 nt, Pseudomonas aeruginosa PA01
gacgcagcgcgcgcc

SEQ ID NO: 3511351 - RNA, 17 nt, Pseudomonas aeruginosa PA01
gacgcagcgcgcgccga

SEQ ID NO: 3511352 - RNA, 19 nt, Pseudomonas aeruginosa PA01
gacgcagcgcgcgucggcg

SEQ ID NO: 3511353 - RNA, 17 nt, Pseudomonas aeruginosa PA01
gacgcagcgggucgauc

SEQ ID NO: 3511354 - RNA, 14 nt, Pseudomonas aeruginosa PA01
gacgcaggacgucg

SEQ ID NO: 3511355 - RNA, 14 nt, Pseudomonas aeruginosa PA01
gacgcaggccgacc

SEQ ID NO: 3511356 - RNA, 17 nt, Pseudomonas aeruginosa PA01
gacgcaggccgaccucg

SEQ ID NO: 3511357 - RNA, 21 nt, Pseudomonas aeruginosa PA01
gacgcaggccgaccucggcgg

SEQ ID NO: 3511358 - RNA, 15 nt, Pseudomonas aeruginosa PA01
gacgcagggcggcgc

SEQ ID NO: 3511359 - RNA, 16 nt, Pseudomonas aeruginosa PA01
gacgcagggcggcgcc

SEQ ID NO: 3511360 - RNA, 17 nt, Pseudomonas aeruginosa PA01
gacgcagggcggcgccu

SEQ ID NO: 3511361 - RNA, 19 nt, Pseudomonas aeruginosa PA01
gacgcagggcggcgccugg

SEQ ID NO: 3511362 - RNA, 13 nt, Pseudomonas aeruginosa PA01
gacgcauaaccgc

SEQ ID NO: 3511363 - RNA, 16 nt, Pseudomonas aeruginosa PA01
gacgcaucgacggggc

SEQ ID NO: 3511364 - RNA, 13 nt, Pseudomonas aeruginosa PA01
gacgccaccagcc

SEQ ID NO: 3511365 - RNA, 14 nt, Pseudomonas aeruginosa PA01
gacgccaccagcca

SEQ ID NO: 3511366 - RNA, 18 nt, Pseudomonas aeruginosa PA01
gacgccaccagccaggcg

SEQ ID NO: 3511367 - RNA, 22 nt, Pseudomonas aeruginosa PA01
gacgccaccagccaggcggcca

SEQ ID NO: 3511368 - RNA, 14 nt, Pseudomonas aeruginosa PA01
gacgccaccaggcc

SEQ ID NO: 3511369 - RNA, 18 nt, Pseudomonas aeruginosa PA01
gacgccaccaggccgcug

SEQ ID NO: 3511370 - RNA, 19 nt, Pseudomonas aeruginosa PA01
gacgccaccaggccgcugc

SEQ ID NO: 3511371 - RNA, 23 nt, Pseudomonas aeruginosa PA01
gacgccacccgcaucgaggccgc

SEQ ID NO: 3511372 - RNA, 17 nt, Pseudomonas aeruginosa PA01
gacgccagcggcgaucg

SEQ ID NO: 3511373 - RNA, 14 nt, Pseudomonas aeruginosa PA01
gacgccagcucggc

SEQ ID NO: 3511374 - RNA, 17 nt, Pseudomonas aeruginosa PA01
gacgccagcucggccgg

SEQ ID NO: 3511375 - RNA, 22 nt, Pseudomonas aeruginosa PA01
gacgccauccuucggcgugauc

SEQ ID NO: 3511376 - RNA, 12 nt, Pseudomonas aeruginosa PA01
gacgccauggcg

SEQ ID NO: 3511377 - RNA, 14 nt, Pseudomonas aeruginosa PA01
gacgccauucaggc

SEQ ID NO: 3511378 - RNA, 17 nt, Pseudomonas aeruginosa PA01
gacgccauucaggcgga

SEQ ID NO: 3511379 - RNA, 14 nt, Pseudomonas aeruginosa PA01
gacgcccagcaggg

SEQ ID NO: 3511380 - RNA, 15 nt, Pseudomonas aeruginosa PA01
gacgcccagcagggc

SEQ ID NO: 3511381 - RNA, 17 nt, Pseudomonas aeruginosa PA01
gacgcccagcagggcca

SEQ ID NO: 3511382 - RNA, 16 nt, Pseudomonas aeruginosa PA01
gacgcccgcuugcgcc

SEQ ID NO: 3511383 - RNA, 18 nt, Pseudomonas aeruginosa PA01
gacgcccgcuugcgccgc

SEQ ID NO: 3511384 - RNA, 23 nt, Pseudomonas aeruginosa PA01
gacgcccgcuugcgccgccucgc

SEQ ID NO: 3511385 - RNA, 13 nt, Pseudomonas aeruginosa PA01
gacgcccuccagc

SEQ ID NO: 3511386 - RNA, 23 nt, Pseudomonas aeruginosa PA01
gacgcccuccagcaccgccuggc

SEQ ID NO: 3511387 - RNA, 13 nt, Pseudomonas aeruginosa PA01
gacgcccucggcg

SEQ ID NO: 3511388 - RNA, 14 nt, Pseudomonas aeruginosa PA01
gacgcccucggcga

SEQ ID NO: 3511389 - RNA, 15 nt, Pseudomonas aeruginosa PA01
gacgcccucggcgac

SEQ ID NO: 3511390 - RNA, 16 nt, Pseudomonas aeruginosa PA01
gacgcccucggcgacg

SEQ ID NO: 3511391 - RNA, 20 nt, Pseudomonas aeruginosa PA01
gacgcccucggcgacgagga

SEQ ID NO: 3511392 - RNA, 14 nt, Pseudomonas aeruginosa PA01
gacgcccuggcgcu

SEQ ID NO: 3511393 - RNA, 16 nt, Pseudomonas aeruginosa PA01
gacgcccuggcgcuug

SEQ ID NO: 3511394 - RNA, 18 nt, Pseudomonas aeruginosa PA01
gacgcccuguucggcggg

SEQ ID NO: 3511395 - RNA, 19 nt, Pseudomonas aeruginosa PA01
gacgcccuugcggcgcggc

SEQ ID NO: 3511396 - RNA, 16 nt, Pseudomonas aeruginosa PA01
gacgccgaacccgccu

SEQ ID NO: 3511397 - RNA, 15 nt, Pseudomonas aeruginosa PA01
gacgccgaagcgggc

SEQ ID NO: 3511398 - RNA, 16 nt, Pseudomonas aeruginosa PA01
gacgccgaagcgggcu

SEQ ID NO: 3511399 - RNA, 20 nt, Pseudomonas aeruginosa PA01
gacgccgaaggacaggccgu

SEQ ID NO: 3511400 - RNA, 11 nt, Pseudomonas aeruginosa PA01
gacgccgagca

SEQ ID NO: 3511401 - RNA, 16 nt, Pseudomonas aeruginosa PA01
gacgccgagcagcacc

SEQ ID NO: 3511402 - RNA, 17 nt, Pseudomonas aeruginosa PA01
gacgccgagcagcacca

SEQ ID NO: 3511403 - RNA, 14 nt, Pseudomonas aeruginosa PA01
gacgccgagccagc

SEQ ID NO: 3511404 - RNA, 17 nt, Pseudomonas aeruginosa PA01
gacgccgagccagccgc

SEQ ID NO: 3511405 - RNA, 21 nt, Pseudomonas aeruginosa PA01
gacgccgagcugaccaccagg

SEQ ID NO: 3511406 - RNA, 19 nt, Pseudomonas aeruginosa PA01
gacgccgaggagacgcggc

SEQ ID NO: 3511407 - RNA, 22 nt, Pseudomonas aeruginosa PA01
gacgccgaggagacgcggcaug

SEQ ID NO: 3511408 - RNA, 13 nt, Pseudomonas aeruginosa PA01
gacgccgcaggaa

SEQ ID NO: 3511409 - RNA, 13 nt, Pseudomonas aeruginosa PA01
gacgccgcccggc

SEQ ID NO: 3511410 - RNA, 13 nt, Pseudomonas aeruginosa PA01
gacgccgccgagc

SEQ ID NO: 3511411 - RNA, 14 nt, Pseudomonas aeruginosa PA01
gacgccgccgagca

SEQ ID NO: 3511412 - RNA, 15 nt, Pseudomonas aeruginosa PA01
gacgccgccugcgcc

SEQ ID NO: 3511413 - RNA, 16 nt, Pseudomonas aeruginosa PA01
gacgccgccugcgccu

SEQ ID NO: 3511414 - RNA, 21 nt, Pseudomonas aeruginosa PA01
gacgccgcgauggcucgcggc

SEQ ID NO: 3511415 - RNA, 17 nt, Pseudomonas aeruginosa PA01
gacgccgcgcugcaagg

SEQ ID NO: 3511416 - RNA, 15 nt, Pseudomonas aeruginosa PA01
gacgccgcggccggc

SEQ ID NO: 3511417 - RNA, 22 nt, Pseudomonas aeruginosa PA01
gacgccgcuggaaccggccggc

SEQ ID NO: 3511418 - RNA, 14 nt, Pseudomonas aeruginosa PA01
gacgccgcuggcgg

SEQ ID NO: 3511419 - RNA, 16 nt, Pseudomonas aeruginosa PA01
gacgccgcuggcggcg

SEQ ID NO: 3511420 - RNA, 17 nt, Pseudomonas aeruginosa PA01
gacgccgcuggcggcgc

SEQ ID NO: 3511421 - RNA, 20 nt, Pseudomonas aeruginosa PA01
gacgccgcuggcggcgcuca

SEQ ID NO: 3511422 - RNA, 11 nt, Pseudomonas aeruginosa PA01
gacgccggacg

SEQ ID NO: 3511423 - RNA, 16 nt, Pseudomonas aeruginosa PA01
gacgccggacgcacca

SEQ ID NO: 3511424 - RNA, 13 nt, Pseudomonas aeruginosa PA01
gacgccggcgacg

SEQ ID NO: 3511425 - RNA, 13 nt, Pseudomonas aeruginosa PA01
gacgccgggcugg

SEQ ID NO: 3511426 - RNA, 14 nt, Pseudomonas aeruginosa PA01
gacgccgggcuggu

SEQ ID NO: 3511427 - RNA, 17 nt, Pseudomonas aeruginosa PA01
gacgccggucucggcga

SEQ ID NO: 3511428 - RNA, 16 nt, Pseudomonas aeruginosa PA01
gacgccggugacccac

SEQ ID NO: 3511429 - RNA, 18 nt, Pseudomonas aeruginosa PA01
gacgccggugccaggacc

SEQ ID NO: 3511430 - RNA, 19 nt, Pseudomonas aeruginosa PA01
gacgccguagcgcaguucg

SEQ ID NO: 3511431 - RNA, 18 nt, Pseudomonas aeruginosa PA01
gacgccguccaccagcca

SEQ ID NO: 3511432 - RNA, 22 nt, Pseudomonas aeruginosa PA01
gacgccgucccauuccucggcg

SEQ ID NO: 3511433 - RNA, 15 nt, Pseudomonas aeruginosa PA01
gacgccucggcgcga

SEQ ID NO: 3511434 - RNA, 16 nt, Pseudomonas aeruginosa PA01
gacgccucggcgcgau

SEQ ID NO: 3511435 - RNA, 14 nt, Pseudomonas aeruginosa PA01
gacgccucgucgga

SEQ ID NO: 3511436 - RNA, 15 nt, Pseudomonas aeruginosa PA01
gacgccucgucggag

SEQ ID NO: 3511437 - RNA, 17 nt, Pseudomonas aeruginosa PA01
gacgccucgucggaggc

SEQ ID NO: 3511438 - RNA, 18 nt, Pseudomonas aeruginosa PA01
gacgccuggcgucccguu

SEQ ID NO: 3511439 - RNA, 14 nt, Pseudomonas aeruginosa PA01
gacgccuucguggc

SEQ ID NO: 3511440 - RNA, 17 nt, Pseudomonas aeruginosa PA01
gacgccuucguggccgc

SEQ ID NO: 3511441 - RNA, 19 nt, Pseudomonas aeruginosa PA01
gacgccuugcccggcgcgu

SEQ ID NO: 3511442 - RNA, 17 nt, Pseudomonas aeruginosa PA01
gacgcgaccuccggcgc

SEQ ID NO: 3511443 - RNA, 18 nt, Pseudomonas aeruginosa PA01
gacgcgaccuccggcgcc

SEQ ID NO: 3511444 - RNA, 22 nt, Pseudomonas aeruginosa PA01
gacgcgaccuccggcgccaggc

SEQ ID NO: 3511445 - RNA, 23 nt, Pseudomonas aeruginosa PA01
gacgcgaccuccggcgccaggcc

SEQ ID NO: 3511446 - RNA, 19 nt, Pseudomonas aeruginosa PA01
gacgcgacugcugcugcgg

SEQ ID NO: 3511447 - RNA, 20 nt, Pseudomonas aeruginosa PA01
gacgcgacugcugcugcggg

SEQ ID NO: 3511448 - RNA, 14 nt, Pseudomonas aeruginosa PA01
gacgcgaucccgcu

SEQ ID NO: 3511449 - RNA, 14 nt, Pseudomonas aeruginosa PA01
gacgcgcagcggcg

SEQ ID NO: 3511450 - RNA, 16 nt, Pseudomonas aeruginosa PA01
gacgcgcagcggcgcc

SEQ ID NO: 3511451 - RNA, 17 nt, Pseudomonas aeruginosa PA01
gacgcgcagcggcgccg

SEQ ID NO: 3511452 - RNA, 14 nt, Pseudomonas aeruginosa PA01
gacgcgcaggccgg

SEQ ID NO: 3511453 - RNA, 17 nt, Pseudomonas aeruginosa PA01
gacgcgcagggucaggc

SEQ ID NO: 3511454 - RNA, 14 nt, Pseudomonas aeruginosa PA01
gacgcgcaugcagg

SEQ ID NO: 3511455 - RNA, 15 nt, Pseudomonas aeruginosa PA01
gacgcgcaugcaggg

SEQ ID NO: 3511456 - RNA, 17 nt, Pseudomonas aeruginosa PA01
gacgcgcaugcagggcg

SEQ ID NO: 3511457 - RNA, 14 nt, Pseudomonas aeruginosa PA01
gacgcgccacgcag

SEQ ID NO: 3511458 - RNA, 17 nt, Pseudomonas aeruginosa PA01
gacgcgccaggugcgcu

SEQ ID NO: 3511459 - RNA, 20 nt, Pseudomonas aeruginosa PA01
gacgcgccaggugcgcuggu

SEQ ID NO: 3511460 - RNA, 24 nt, Pseudomonas aeruginosa PA01
gacgcgccgcgguuuccgugcgga

SEQ ID NO: 3511461 - RNA, 14 nt, Pseudomonas aeruginosa PA01
gacgcgccggcgga

SEQ ID NO: 3511462 - RNA, 22 nt, Pseudomonas aeruginosa PA01
gacgcgcgcugccugcgaugga

SEQ ID NO: 3511463 - RNA, 12 nt, Pseudomonas aeruginosa PA01
gacgcgcggcug

SEQ ID NO: 3511464 - RNA, 19 nt, Pseudomonas aeruginosa PA01
gacgcgcugccccuggcuc

SEQ ID NO: 3511465 - RNA, 14 nt, Pseudomonas aeruginosa PA01
gacgcgcuggacca

SEQ ID NO: 3511466 - RNA, 21 nt, Pseudomonas aeruginosa PA01
gacgcgcuggaccauggccgg

SEQ ID NO: 3511467 - RNA, 14 nt, Pseudomonas aeruginosa PA01
gacgcgcuuguccu

SEQ ID NO: 3511468 - RNA, 21 nt, Pseudomonas aeruginosa PA01
gacgcgcuuguccuccagcug

SEQ ID NO: 3511469 - RNA, 15 nt, Pseudomonas aeruginosa PA01
gacgcggauaccgag

SEQ ID NO: 3511470 - RNA, 15 nt, Pseudomonas aeruginosa PA01
gacgcggaugcccug

SEQ ID NO: 3511471 - RNA, 15 nt, Pseudomonas aeruginosa PA01
gaccagcaccgccug

SEQ ID NO: 3511472 - RNA, 18 nt, Pseudomonas aeruginosa PA01
gaccagcaccgccugcaa

SEQ ID NO: 3511473 - RNA, 23 nt, Pseudomonas aeruginosa PA01
gaccagcacggcgaauucgucgc

SEQ ID NO: 3511474 - RNA, 18 nt, Pseudomonas aeruginosa PA01
gaccagcagcgagcaggc

SEQ ID NO: 3511475 - RNA, 16 nt, Pseudomonas aeruginosa PA01
gaccagcagcgcacca

SEQ ID NO: 3511476 - RNA, 14 nt, Pseudomonas aeruginosa PA01
gaccagcagcggca

SEQ ID NO: 3511477 - RNA, 17 nt, Pseudomonas aeruginosa PA01
gaccagcagcggcagcc

SEQ ID NO: 3511478 - RNA, 10 nt, Pseudomonas aeruginosa PA01
gaccagcagg

SEQ ID NO: 3511479 - RNA, 17 nt, Pseudomonas aeruginosa PA01
gaccagcagggccagca

SEQ ID NO: 3511480 - RNA, 22 nt, Pseudomonas aeruginosa PA01
gaccagcauguuguuauggccg

SEQ ID NO: 3511481 - RNA, 16 nt, Pseudomonas aeruginosa PA01
gaccagccccaguccc

SEQ ID NO: 3511482 - RNA, 15 nt, Pseudomonas aeruginosa PA01
gaccagcccgcgcga

SEQ ID NO: 3511483 - RNA, 16 nt, Pseudomonas aeruginosa PA01
gaccagcccgcgcgac

SEQ ID NO: 3511484 - RNA, 19 nt, Pseudomonas aeruginosa PA01
gaccagcccgcgcgacagc

SEQ ID NO: 3511485 - RNA, 15 nt, Pseudomonas aeruginosa PA01
gaccagcccggcggc

SEQ ID NO: 3511486 - RNA, 18 nt, Pseudomonas aeruginosa PA01
gaccagcccggcggcggc

SEQ ID NO: 3511487 - RNA, 20 nt, Pseudomonas aeruginosa PA01
gaccagcccggcggcggcac

SEQ ID NO: 3511488 - RNA, 16 nt, Pseudomonas aeruginosa PA01
gaccagcccguugcgg

SEQ ID NO: 3511489 - RNA, 15 nt, Pseudomonas aeruginosa PA01
gaccagcccuggcgc

SEQ ID NO: 3511490 - RNA, 19 nt, Pseudomonas aeruginosa PA01
gaccagcccuggcgcggca

SEQ ID NO: 3511491 - RNA, 18 nt, Pseudomonas aeruginosa PA01
gaccagccgcaggcugcc

SEQ ID NO: 3511492 - RNA, 12 nt, Pseudomonas aeruginosa PA01
gaccagccgggg

SEQ ID NO: 3511493 - RNA, 17 nt, Pseudomonas aeruginosa PA01
gaccagccguccgcggg

SEQ ID NO: 3511494 - RNA, 20 nt, Pseudomonas aeruginosa PA01
gaccagcgcaucggcgccuc

SEQ ID NO: 3511495 - RNA, 21 nt, Pseudomonas aeruginosa PA01
gaccagcgcaucggcgccucc

SEQ ID NO: 3511496 - RNA, 15 nt, Pseudomonas aeruginosa PA01
gaccagcgccaggcg

SEQ ID NO: 3511497 - RNA, 16 nt, Pseudomonas aeruginosa PA01
gaccagcgccaggcgc

SEQ ID NO: 3511498 - RNA, 19 nt, Pseudomonas aeruginosa PA01
gaccagcgccaggcgcggu

SEQ ID NO: 3511499 - RNA, 15 nt, Pseudomonas aeruginosa PA01
gaccagcgccgcggc

SEQ ID NO: 3511500 - RNA, 19 nt, Pseudomonas aeruginosa PA01
gaccagcgccgcggcgacc

SEQ ID NO: 3511501 - RNA, 23 nt, Pseudomonas aeruginosa PA01
gaccagcgccgcggcgaccagcg

SEQ ID NO: 3511502 - RNA, 23 nt, Pseudomonas aeruginosa PA01
gaccagcgcgcucuucgccgcgg

SEQ ID NO: 3511503 - RNA, 20 nt, Pseudomonas aeruginosa PA01
gaccagcgcgucgaccaccg

SEQ ID NO: 3511504 - RNA, 15 nt, Pseudomonas aeruginosa PA01
gaccagcggagcguc

SEQ ID NO: 3511505 - RNA, 16 nt, Pseudomonas aeruginosa PA01
gaccagcggcaccgag

SEQ ID NO: 3511506 - RNA, 17 nt, Pseudomonas aeruginosa PA01
gaccagcggcaccgaga

SEQ ID NO: 3511507 - RNA, 22 nt, Pseudomonas aeruginosa PA01
gaccagcgucgcgcgugccccg

SEQ ID NO: 3511508 - RNA, 17 nt, Pseudomonas aeruginosa PA01
gaccagcuccgaaggga

SEQ ID NO: 3511509 - RNA, 19 nt, Pseudomonas aeruginosa PA01
gaccagcucgaagccgccg

SEQ ID NO: 3511510 - RNA, 18 nt, Pseudomonas aeruginosa PA01
gaccagcucggcgggacg

SEQ ID NO: 3511511 - RNA, 14 nt, Pseudomonas aeruginosa PA01
gaccaggaaggccg

SEQ ID NO: 3511512 - RNA, 18 nt, Pseudomonas aeruginosa PA01
gaccaggaaggccgggcc

SEQ ID NO: 3511513 - RNA, 21 nt, Pseudomonas aeruginosa PA01
gaccaggaauuccuggccggu

SEQ ID NO: 3511514 - RNA, 13 nt, Pseudomonas aeruginosa PA01
gaccaggacagca

SEQ ID NO: 3511515 - RNA, 18 nt, Pseudomonas aeruginosa PA01
gaccaggacagcacgcuc

SEQ ID NO: 3511516 - RNA, 13 nt, Pseudomonas aeruginosa PA01
gaccaggaucacc

SEQ ID NO: 3511517 - RNA, 18 nt, Pseudomonas aeruginosa PA01
gaccaggaucgaccccgc

SEQ ID NO: 3511518 - RNA, 19 nt, Pseudomonas aeruginosa PA01
gaccaggaucgaccccgcc

SEQ ID NO: 3511519 - RNA, 12 nt, Pseudomonas aeruginosa PA01
gaccaggccgag

SEQ ID NO: 3511520 - RNA, 16 nt, Pseudomonas aeruginosa PA01
gaccaggccgagcagg

SEQ ID NO: 3511521 - RNA, 17 nt, Pseudomonas aeruginosa PA01
gaccaggcggccggugc

SEQ ID NO: 3511522 - RNA, 22 nt, Pseudomonas aeruginosa PA01
gaccaggcggccggugccuucg

SEQ ID NO: 3511523 - RNA, 16 nt, Pseudomonas aeruginosa PA01
gaccaggcggccgucg

SEQ ID NO: 3511524 - RNA, 20 nt, Pseudomonas aeruginosa PA01
gaccaggcggccgucggccu

SEQ ID NO: 3511525 - RNA, 22 nt, Pseudomonas aeruginosa PA01
gaccaggcggccgucggccugg

SEQ ID NO: 3511526 - RNA, 17 nt, Pseudomonas aeruginosa PA01
gaccaggcguuccacca

SEQ ID NO: 3511527 - RNA, 17 nt, Pseudomonas aeruginosa PA01
gaccaggcugaucagcc

SEQ ID NO: 3511528 - RNA, 18 nt, Pseudomonas aeruginosa PA01
gaccaggcugaucagccc

SEQ ID NO: 3511529 - RNA, 19 nt, Pseudomonas aeruginosa PA01
gaccaggcugaucagcccg

SEQ ID NO: 3511530 - RNA, 13 nt, Pseudomonas aeruginosa PA01
gaccagggccggg

SEQ ID NO: 3511531 - RNA, 16 nt, Pseudomonas aeruginosa PA01
gaccagggccgggucg

SEQ ID NO: 3511532 - RNA, 12 nt, Pseudomonas aeruginosa PA01
gaccagggcgcc

SEQ ID NO: 3511533 - RNA, 14 nt, Pseudomonas aeruginosa PA01
gaccagggcgccgg

SEQ ID NO: 3511534 - RNA, 16 nt, Pseudomonas aeruginosa PA01
gaccagggcgccgggc

SEQ ID NO: 3511535 - RNA, 22 nt, Pseudomonas aeruginosa PA01
gaccagggcgggccgcucgcgc

SEQ ID NO: 3511536 - RNA, 24 nt, Pseudomonas aeruginosa PA01
gaccagggcgggccgcucgcgcgg

SEQ ID NO: 3511537 - RNA, 20 nt, Pseudomonas aeruginosa PA01
gaccaggguacgacugacga

SEQ ID NO: 3511538 - RNA, 12 nt, Pseudomonas aeruginosa PA01
gaccaggguggc

SEQ ID NO: 3511539 - RNA, 19 nt, Pseudomonas aeruginosa PA01
gaccaggguggcggcggcg

SEQ ID NO: 3511540 - RNA, 17 nt, Pseudomonas aeruginosa PA01
gaccagguagagcagcc

SEQ ID NO: 3511541 - RNA, 14 nt, Pseudomonas aeruginosa PA01
gaccagguccggca

SEQ ID NO: 3511542 - RNA, 20 nt, Pseudomonas aeruginosa PA01
gaccaggucgaguuuccggu

SEQ ID NO: 3511543 - RNA, 15 nt, Pseudomonas aeruginosa PA01
gaccaggucgcuggc

SEQ ID NO: 3511544 - RNA, 23 nt, Pseudomonas aeruginosa PA01
gaccaggucgcuggcaccggcca

SEQ ID NO: 3511545 - RNA, 14 nt, Pseudomonas aeruginosa PA01
gaccaggugcuggu

SEQ ID NO: 3511546 - RNA, 16 nt, Pseudomonas aeruginosa PA01
gaccaguaccagcaau

SEQ ID NO: 3511547 - RNA, 17 nt, Pseudomonas aeruginosa PA01
gaccagucggccguugc

SEQ ID NO: 3511548 - RNA, 22 nt, Pseudomonas aeruginosa PA01
gaccagucggccguugcgggcg

SEQ ID NO: 3511549 - RNA, 22 nt, Pseudomonas aeruginosa PA01
gaccagucguugaagacgcuca

SEQ ID NO: 3511550 - RNA, 23 nt, Pseudomonas aeruginosa PA01
gaccagucguugaagacgcucac

SEQ ID NO: 3511551 - RNA, 17 nt, Pseudomonas aeruginosa PA01
gaccaguucagcgcgcu

SEQ ID NO: 3511552 - RNA, 19 nt, Pseudomonas aeruginosa PA01
gaccaguucagcgcgcucg

SEQ ID NO: 3511553 - RNA, 22 nt, Pseudomonas aeruginosa PA01
gaccaguucagcgcgcucgcug

SEQ ID NO: 3511554 - RNA, 17 nt, Pseudomonas aeruginosa PA01
gaccaguucgccgccgc

SEQ ID NO: 3511555 - RNA, 21 nt, Pseudomonas aeruginosa PA01
gaccaguugcccgagugccgg

SEQ ID NO: 3511556 - RNA, 22 nt, Pseudomonas aeruginosa PA01
gaccaguuucuucgcgugggcc

SEQ ID NO: 3511557 - RNA, 19 nt, Pseudomonas aeruginosa PA01
gaccauaggcuugcgccga

SEQ ID NO: 3511558 - RNA, 12 nt, Pseudomonas aeruginosa PA01
gaccaucaccag

SEQ ID NO: 3511559 - RNA, 16 nt, Pseudomonas aeruginosa PA01
gaccaucaccagcgcc

SEQ ID NO: 3511560 - RNA, 17 nt, Pseudomonas aeruginosa PA01
gaccaucaccagcgccg

SEQ ID NO: 3511561 - RNA, 14 nt, Pseudomonas aeruginosa PA01
gaccauccagccug

SEQ ID NO: 3511562 - RNA, 20 nt, Pseudomonas aeruginosa PA01
gaccauccagccugcgcugu

SEQ ID NO: 3511563 - RNA, 23 nt, Pseudomonas aeruginosa PA01
gaccauccagccugcgcuguucg

SEQ ID NO: 3511564 - RNA, 14 nt, Pseudomonas aeruginosa PA01
gaccaucgccggcg

SEQ ID NO: 3511565 - RNA, 15 nt, Pseudomonas aeruginosa PA01
gaccaucgccggcga

SEQ ID NO: 3511566 - RNA, 17 nt, Pseudomonas aeruginosa PA01
gaccaucgccggcgagc

SEQ ID NO: 3511567 - RNA, 23 nt, Pseudomonas aeruginosa PA01
gaccaucgccggcgagccgcugg

SEQ ID NO: 3511568 - RNA, 15 nt, Pseudomonas aeruginosa PA01
gaccaucggcggcgg

SEQ ID NO: 3511569 - RNA, 23 nt, Pseudomonas aeruginosa PA01
gaccaucgucgcuuccggcgcca

SEQ ID NO: 3511570 - RNA, 17 nt, Pseudomonas aeruginosa PA01
gaccaucuuuuccugcu

SEQ ID NO: 3511571 - RNA, 19 nt, Pseudomonas aeruginosa PA01
gaccaucuuuuccugcugg

SEQ ID NO: 3511572 - RNA, 22 nt, Pseudomonas aeruginosa PA01
gaccaucuuuuccugcuggcga

SEQ ID NO: 3511573 - RNA, 14 nt, Pseudomonas aeruginosa PA01
gaccauggccggcg

SEQ ID NO: 3511574 - RNA, 17 nt, Pseudomonas aeruginosa PA01
gacauccggguccagcg

SEQ ID NO: 3511575 - RNA, 15 nt, Pseudomonas aeruginosa PA01
gacauccuccaccgu

SEQ ID NO: 3511576 - RNA, 16 nt, Pseudomonas aeruginosa PA01
gacauccucccugccc

SEQ ID NO: 3511577 - RNA, 21 nt, Pseudomonas aeruginosa PA01
gacauccugucgaggccucgu

SEQ ID NO: 3511578 - RNA, 17 nt, Pseudomonas aeruginosa PA01
gacauccuuggucaggg

SEQ ID NO: 3511579 - RNA, 20 nt, Pseudomonas aeruginosa PA01
gacaucgacgcccucggcga

SEQ ID NO: 3511580 - RNA, 22 nt, Pseudomonas aeruginosa PA01
gacaucgauaacaccaggagcg

SEQ ID NO: 3511581 - RNA, 17 nt, Pseudomonas aeruginosa PA01
gacaucgccgagggcga

SEQ ID NO: 3511582 - RNA, 23 nt, Pseudomonas aeruginosa PA01
gacaucggagugcaugccgggga

SEQ ID NO: 3511583 - RNA, 15 nt, Pseudomonas aeruginosa PA01
gacaucggcgauggc

SEQ ID NO: 3511584 - RNA, 15 nt, Pseudomonas aeruginosa PA01
gacaucgucucgcga

SEQ ID NO: 3511585 - RNA, 23 nt, Pseudomonas aeruginosa PA01
gacaucgucucgcgacacgugcc

SEQ ID NO: 3511586 - RNA, 14 nt, Pseudomonas aeruginosa PA01
gacaucuccaggcc

SEQ ID NO: 3511587 - RNA, 15 nt, Pseudomonas aeruginosa PA01
gacaucuccaggccg

SEQ ID NO: 3511588 - RNA, 19 nt, Pseudomonas aeruginosa PA01
gacaugcaccaggccgcca

SEQ ID NO: 3511589 - RNA, 18 nt, Pseudomonas aeruginosa PA01
gacaugcaggccggccuc

SEQ ID NO: 3511590 - RNA, 21 nt, Pseudomonas aeruginosa PA01
gacaugcaggccggccuccag

SEQ ID NO: 3511591 - RNA, 15 nt, Pseudomonas aeruginosa PA01
gacaugccccgccga

SEQ ID NO: 3511592 - RNA, 19 nt, Pseudomonas aeruginosa PA01
gacaugccgguucccgcag

SEQ ID NO: 3511593 - RNA, 20 nt, Pseudomonas aeruginosa PA01
gacaugccgguucccgcagc

SEQ ID NO: 3511594 - RNA, 18 nt, Pseudomonas aeruginosa PA01
gacauggagaccuggcug

SEQ ID NO: 3511595 - RNA, 14 nt, Pseudomonas aeruginosa PA01
gacauggcgcucga

SEQ ID NO: 3511596 - RNA, 21 nt, Pseudomonas aeruginosa PA01
gacaugggccgcgcagaucgc

SEQ ID NO: 3511597 - RNA, 21 nt, Pseudomonas aeruginosa PA01
gacauguugcagggucgccgg

SEQ ID NO: 3511598 - RNA, 15 nt, Pseudomonas aeruginosa PA01
gaccaacagccggcg

SEQ ID NO: 3511599 - RNA, 13 nt, Pseudomonas aeruginosa PA01
gaccaacgggcug

SEQ ID NO: 3511600 - RNA, 12 nt, Pseudomonas aeruginosa PA01
gaccaacugcgc

SEQ ID NO: 3511601 - RNA, 23 nt, Pseudomonas aeruginosa PA01
gaccaacugcgcccccagcgccc

SEQ ID NO: 3511602 - RNA, 22 nt, Pseudomonas aeruginosa PA01
gaccacaggcggcggaagaagc

SEQ ID NO: 3511603 - RNA, 23 nt, Pseudomonas aeruginosa PA01
gaccacaggcggcggaagaagcc

SEQ ID NO: 3511604 - RNA, 16 nt, Pseudomonas aeruginosa PA01
gaccacaucggccagu

SEQ ID NO: 3511605 - RNA, 14 nt, Pseudomonas aeruginosa PA01
gaccaccaccaggu

SEQ ID NO: 3511606 - RNA, 17 nt, Pseudomonas aeruginosa PA01
gaccaccaccaggucgg

SEQ ID NO: 3511607 - RNA, 18 nt, Pseudomonas aeruginosa PA01
gaccaccaccaggucggc

SEQ ID NO: 3511608 - RNA, 23 nt, Pseudomonas aeruginosa PA01
gaccaccaccaggucggcgcgcg

SEQ ID NO: 3511609 - RNA, 12 nt, Pseudomonas aeruginosa PA01
gaccaccagcag

SEQ ID NO: 3511610 - RNA, 14 nt, Pseudomonas aeruginosa PA01
gaccaccagcagca

SEQ ID NO: 3511611 - RNA, 16 nt, Pseudomonas aeruginosa PA01
gaccaccagcagcagc

SEQ ID NO: 3511612 - RNA, 13 nt, Pseudomonas aeruginosa PA01
gaccaccagcagg

SEQ ID NO: 3511613 - RNA, 16 nt, Pseudomonas aeruginosa PA01
gaccaccaggaagcgu

SEQ ID NO: 3511614 - RNA, 11 nt, Pseudomonas aeruginosa PA01
gaccaccauca

SEQ ID NO: 3511615 - RNA, 15 nt, Pseudomonas aeruginosa PA01
gaccaccaucaccgc

SEQ ID NO: 3511616 - RNA, 17 nt, Pseudomonas aeruginosa PA01
gaccaccaucaccgcca

SEQ ID NO: 3511617 - RNA, 23 nt, Pseudomonas aeruginosa PA01
gaccaccaucaccgccaucagca

SEQ ID NO: 3511618 - RNA, 22 nt, Pseudomonas aeruginosa PA01
gaccacccggcgguccgccgcg

SEQ ID NO: 3511619 - RNA, 23 nt, Pseudomonas aeruginosa PA01
gaccacccggcgguccgccgcgg

SEQ ID NO: 3511620 - RNA, 14 nt, Pseudomonas aeruginosa PA01
gaccacccggcugc

SEQ ID NO: 3511621 - RNA, 15 nt, Pseudomonas aeruginosa PA01
gaccacccggcugca

SEQ ID NO: 3511622 - RNA, 20 nt, Pseudomonas aeruginosa PA01
gaccacccggcugcaugccg

SEQ ID NO: 3511623 - RNA, 17 nt, Pseudomonas aeruginosa PA01
gaccacccggugcagga

SEQ ID NO: 3511624 - RNA, 19 nt, Pseudomonas aeruginosa PA01
gaccacccuguccugcucc

SEQ ID NO: 3511625 - RNA, 20 nt, Pseudomonas aeruginosa PA01
gaccacccuguccugcuccu

SEQ ID NO: 3511626 - RNA, 23 nt, Pseudomonas aeruginosa PA01
gaccaccgacggcuccggauggc

SEQ ID NO: 3511627 - RNA, 12 nt, Pseudomonas aeruginosa PA01
gaccaccgccag

SEQ ID NO: 3511628 - RNA, 14 nt, Pseudomonas aeruginosa PA01
gaccaccgccaggc

SEQ ID NO: 3511629 - RNA, 22 nt, Pseudomonas aeruginosa PA01
gaccaccgccaggcuggccacg

SEQ ID NO: 3511630 - RNA, 21 nt, Pseudomonas aeruginosa PA01
gaccaccgcgaauccgcggcc

SEQ ID NO: 3511631 - RNA, 20 nt, Pseudomonas aeruginosa PA01
gaccaccgcguggugcugca

SEQ ID NO: 3511632 - RNA, 13 nt, Pseudomonas aeruginosa PA01
gaccaccgugcgc

SEQ ID NO: 3511633 - RNA, 21 nt, Pseudomonas aeruginosa PA01
gaccaccgugcgcaccucgcc

SEQ ID NO: 3511634 - RNA, 14 nt, Pseudomonas aeruginosa PA01
gaccaccguggcgc

SEQ ID NO: 3511635 - RNA, 18 nt, Pseudomonas aeruginosa PA01
gaccaccguggcgccggc

SEQ ID NO: 3511636 - RNA, 19 nt, Pseudomonas aeruginosa PA01
gaccaccguggcgccggcg

SEQ ID NO: 3511637 - RNA, 20 nt, Pseudomonas aeruginosa PA01
gaccaccguggcgccggcgc

SEQ ID NO: 3511638 - RNA, 21 nt, Pseudomonas aeruginosa PA01
gaccaccguggcgccggcgcg

SEQ ID NO: 3511639 - RNA, 17 nt, Pseudomonas aeruginosa PA01
gaccaccucggcgucgg

SEQ ID NO: 3511640 - RNA, 17 nt, Pseudomonas aeruginosa PA01
gaccaccuucaggcugc

SEQ ID NO: 3511641 - RNA, 18 nt, Pseudomonas aeruginosa PA01
gaccaccuucaggcugcu

SEQ ID NO: 3511642 - RNA, 17 nt, Pseudomonas aeruginosa PA01
gaccaccuucuacaccg

SEQ ID NO: 3511643 - RNA, 22 nt, Pseudomonas aeruginosa PA01
gaccacgaagcgaccgaucaug

SEQ ID NO: 3511644 - RNA, 15 nt, Pseudomonas aeruginosa PA01
gaccacgaccgcguc

SEQ ID NO: 3511645 - RNA, 20 nt, Pseudomonas aeruginosa PA01
gaccacgcagagcggcaggc

SEQ ID NO: 3511646 - RNA, 21 nt, Pseudomonas aeruginosa PA01
gaccacgcagagcggcaggcc

SEQ ID NO: 3511647 - RNA, 23 nt, Pseudomonas aeruginosa PA01
gaccacgcagagcggcaggccgc

SEQ ID NO: 3511648 - RNA, 14 nt, Pseudomonas aeruginosa PA01
gaccacgcaggcca

SEQ ID NO: 3511649 - RNA, 16 nt, Pseudomonas aeruginosa PA01
gaccacgcaggccagc

SEQ ID NO: 3511650 - RNA, 17 nt, Pseudomonas aeruginosa PA01
gaccacgcaggccagcg

SEQ ID NO: 3511651 - RNA, 19 nt, Pseudomonas aeruginosa PA01
gaccacgcaggccagcgcc

SEQ ID NO: 3511652 - RNA, 20 nt, Pseudomonas aeruginosa PA01
gaccacgcaggccagcgcca

SEQ ID NO: 3511653 - RNA, 21 nt, Pseudomonas aeruginosa PA01
gaccacgcaggccagcgccag

SEQ ID NO: 3511654 - RNA, 23 nt, Pseudomonas aeruginosa PA01
gaccacgcaggccagcgccaggg

SEQ ID NO: 3511655 - RNA, 19 nt, Pseudomonas aeruginosa PA01
gaccacgcccugcgccagc

SEQ ID NO: 3511656 - RNA, 13 nt, Pseudomonas aeruginosa PA01
gaccacgccugcc

SEQ ID NO: 3511657 - RNA, 17 nt, Pseudomonas aeruginosa PA01
gaccacgcuggucaccg

SEQ ID NO: 3511658 - RNA, 19 nt, Pseudomonas aeruginosa PA01
gaccacguaguaggcgcgg

SEQ ID NO: 3511659 - RNA, 22 nt, Pseudomonas aeruginosa PA01
gaccacguaguaggcgcgggug

SEQ ID NO: 3511660 - RNA, 13 nt, Pseudomonas aeruginosa PA01
gaccacgucgcga

SEQ ID NO: 3511661 - RNA, 17 nt, Pseudomonas aeruginosa PA01
gaccacucgcgagaugg

SEQ ID NO: 3511662 - RNA, 18 nt, Pseudomonas aeruginosa PA01
gaccacucgcgagauggc

SEQ ID NO: 3511663 - RNA, 22 nt, Pseudomonas aeruginosa PA01
gaccacucgcgagauggcgucg

SEQ ID NO: 3511664 - RNA, 20 nt, Pseudomonas aeruginosa PA01
gaccacuucggcgguggggc

SEQ ID NO: 3511665 - RNA, 21 nt, Pseudomonas aeruginosa PA01
gaccagaacgaaaaaggcgcg

SEQ ID NO: 3511666 - RNA, 23 nt, Pseudomonas aeruginosa PA01
gaccagaacgaaaaaggcgcgcc

SEQ ID NO: 3511667 - RNA, 13 nt, Pseudomonas aeruginosa PA01
gaccagagccgcc

SEQ ID NO: 3511668 - RNA, 18 nt, Pseudomonas aeruginosa PA01
gaccagagccgccgaaca

SEQ ID NO: 3511669 - RNA, 13 nt, Pseudomonas aeruginosa PA01
gaccagaggcuga

SEQ ID NO: 3511670 - RNA, 22 nt, Pseudomonas aeruginosa PA01
gaccagaucggcauggccgacc

SEQ ID NO: 3511671 - RNA, 14 nt, Pseudomonas aeruginosa PA01
gaccagaucggcgc

SEQ ID NO: 3511672 - RNA, 15 nt, Pseudomonas aeruginosa PA01
gaccagaucggcgcg

SEQ ID NO: 3511673 - RNA, 16 nt, Pseudomonas aeruginosa PA01
gaccagaucggcgcgc

SEQ ID NO: 3511674 - RNA, 19 nt, Pseudomonas aeruginosa PA01
gaccagaucggcgcgcagg

SEQ ID NO: 3511675 - RNA, 14 nt, Pseudomonas aeruginosa PA01
gaccagcaacaaac

SEQ ID NO: 3511676 - RNA, 11 nt, Pseudomonas aeruginosa PA01
gaccagcaccg

SEQ ID NO: 3511677 - RNA, 14 nt, Pseudomonas aeruginosa PA01
gaaggcggauggcg

SEQ ID NO: 3511678 - RNA, 18 nt, Pseudomonas aeruginosa PA01
gaaggcggauggcguuug

SEQ ID NO: 3511679 - RNA, 17 nt, Pseudomonas aeruginosa PA01
gaaggcggcagcgguga

SEQ ID NO: 3511680 - RNA, 24 nt, Pseudomonas aeruginosa PA01
gaaggcggcgucgucgcugcgcgg

SEQ ID NO: 3511681 - RNA, 20 nt, Pseudomonas aeruginosa PA01
gaaggcgguguagaccacca

SEQ ID NO: 3511682 - RNA, 22 nt, Pseudomonas aeruginosa PA01
gaaggcguagaaacgcgccucc

SEQ ID NO: 3511683 - RNA, 16 nt, Pseudomonas aeruginosa PA01
gaaggcguccaccggc

SEQ ID NO: 3511684 - RNA, 14 nt, Pseudomonas aeruginosa PA01
gaaggcguccaggg

SEQ ID NO: 3511685 - RNA, 19 nt, Pseudomonas aeruginosa PA01
gaaggcgucgaaggccucg

SEQ ID NO: 3511686 - RNA, 15 nt, Pseudomonas aeruginosa PA01
gaaggcgucgccguc

SEQ ID NO: 3511687 - RNA, 16 nt, Pseudomonas aeruginosa PA01
gaaggcgugccgcugg

SEQ ID NO: 3511688 - RNA, 17 nt, Pseudomonas aeruginosa PA01
gaaggcgugggcgccgg

SEQ ID NO: 3511689 - RNA, 20 nt, Pseudomonas aeruginosa PA01
gaaggcgugggcgccggcgc

SEQ ID NO: 3511690 - RNA, 21 nt, Pseudomonas aeruginosa PA01
gaaggcucguucguagauccc

SEQ ID NO: 3511691 - RNA, 15 nt, Pseudomonas aeruginosa PA01
gaaggcugccgggcu

SEQ ID NO: 3511692 - RNA, 18 nt, Pseudomonas aeruginosa PA01
gaaggcugccgggcucug

SEQ ID NO: 3511693 - RNA, 20 nt, Pseudomonas aeruginosa PA01
gaaggcugccgggcucuggu

SEQ ID NO: 3511694 - RNA, 16 nt, Pseudomonas aeruginosa PA01
gaaggcuggagcgcug

SEQ ID NO: 3511695 - RNA, 19 nt, Pseudomonas aeruginosa PA01
gaaggcuggagcgcugcgg

SEQ ID NO: 3511696 - RNA, 17 nt, Pseudomonas aeruginosa PA01
gaaggcuuccuggaagc

SEQ ID NO: 3511697 - RNA, 22 nt, Pseudomonas aeruginosa PA01
gaaggcuuccuggaagcgaugg

SEQ ID NO: 3511698 - RNA, 15 nt, Pseudomonas aeruginosa PA01
gaaggcuucuuccug

SEQ ID NO: 3511699 - RNA, 19 nt, Pseudomonas aeruginosa PA01
gaaggcuucuuccuggccg

SEQ ID NO: 3511700 - RNA, 16 nt, Pseudomonas aeruginosa PA01
gaaggcuugccacugc

SEQ ID NO: 3511701 - RNA, 21 nt, Pseudomonas aeruginosa PA01
gaaggcuugccacugcgcgcc

SEQ ID NO: 3511702 - RNA, 22 nt, Pseudomonas aeruginosa PA01
gaaggcuuguccuuggccuccg

SEQ ID NO: 3511703 - RNA, 15 nt, Pseudomonas aeruginosa PA01
gaagggaaacaccag

SEQ ID NO: 3511704 - RNA, 16 nt, Pseudomonas aeruginosa PA01
gaagggaaacaccagg

SEQ ID NO: 3511705 - RNA, 17 nt, Pseudomonas aeruginosa PA01
gaagggaaacaccaggc

SEQ ID NO: 3511706 - RNA, 20 nt, Pseudomonas aeruginosa PA01
gaagggaaacaccaggccga

SEQ ID NO: 3511707 - RNA, 13 nt, Pseudomonas aeruginosa PA01
gaagggaacccgc

SEQ ID NO: 3511708 - RNA, 23 nt, Pseudomonas aeruginosa PA01
gaagggaacccgcggcgcgccuu

SEQ ID NO: 3511709 - RNA, 15 nt, Pseudomonas aeruginosa PA01
gaagggaucgaccgg

SEQ ID NO: 3511710 - RNA, 14 nt, Pseudomonas aeruginosa PA01
gaagggccgcaggu

SEQ ID NO: 3511711 - RNA, 19 nt, Pseudomonas aeruginosa PA01
gaagggccgcagguuggcc

SEQ ID NO: 3511712 - RNA, 19 nt, Pseudomonas aeruginosa PA01
gaagggccggacguuucca

SEQ ID NO: 3511713 - RNA, 18 nt, Pseudomonas aeruginosa PA01
gaagggcgcgccccgucc

SEQ ID NO: 3511714 - RNA, 24 nt, Pseudomonas aeruginosa PA01
gaagggucugcuugcgcuggccgg

SEQ ID NO: 3511715 - RNA, 21 nt, Pseudomonas aeruginosa PA01
gaaggguuggccgcagcagcg

SEQ ID NO: 3511716 - RNA, 15 nt, Pseudomonas aeruginosa PA01
gaagguacugccgcu

SEQ ID NO: 3511717 - RNA, 18 nt, Pseudomonas aeruginosa PA01
gaagguaucgaagucgcc

SEQ ID NO: 3511718 - RNA, 20 nt, Pseudomonas aeruginosa PA01
gaagguaucggccauggccg

SEQ ID NO: 3511719 - RNA, 22 nt, Pseudomonas aeruginosa PA01
gaaggucagguagguggaggcc

SEQ ID NO: 3511720 - RNA, 20 nt, Pseudomonas aeruginosa PA01
gaagguccuugggccaggca

SEQ ID NO: 3511721 - RNA, 22 nt, Pseudomonas aeruginosa PA01
gaagguccuugggccaggcauc

SEQ ID NO: 3511722 - RNA, 20 nt, Pseudomonas aeruginosa PA01
gaaggucgaaggcgcggcgg

SEQ ID NO: 3511723 - RNA, 14 nt, Pseudomonas aeruginosa PA01
gaaggucgccgcgc

SEQ ID NO: 3511724 - RNA, 15 nt, Pseudomonas aeruginosa PA01
gaaggucgccgcgcu

SEQ ID NO: 3511725 - RNA, 16 nt, Pseudomonas aeruginosa PA01
gaaggucgccgggcuc

SEQ ID NO: 3511726 - RNA, 15 nt, Pseudomonas aeruginosa PA01
gaaggucggcggcag

SEQ ID NO: 3511727 - RNA, 16 nt, Pseudomonas aeruginosa PA01
gaaggucggcggcagc

SEQ ID NO: 3511728 - RNA, 19 nt, Pseudomonas aeruginosa PA01
gaaggucguuggcaaagcc

SEQ ID NO: 3511729 - RNA, 17 nt, Pseudomonas aeruginosa PA01
gaaggucugccccggcu

SEQ ID NO: 3511730 - RNA, 19 nt, Pseudomonas aeruginosa PA01
gaaggucugcccguggcgc

SEQ ID NO: 3511731 - RNA, 16 nt, Pseudomonas aeruginosa PA01
gaaggugcaggccgcg

SEQ ID NO: 3511732 - RNA, 17 nt, Pseudomonas aeruginosa PA01
gaaggugcaggccgcgc

SEQ ID NO: 3511733 - RNA, 13 nt, Pseudomonas aeruginosa PA01
gaagguggcgacc

SEQ ID NO: 3511734 - RNA, 19 nt, Pseudomonas aeruginosa PA01
gaagguggcgaccugguag

SEQ ID NO: 3511735 - RNA, 22 nt, Pseudomonas aeruginosa PA01
gaagguucaggugaaaagcgcu

SEQ ID NO: 3511736 - RNA, 16 nt, Pseudomonas aeruginosa PA01
gaaguacuggucgcgc

SEQ ID NO: 3511737 - RNA, 16 nt, Pseudomonas aeruginosa PA01
gaaguagaucgcccgc

SEQ ID NO: 3511738 - RNA, 13 nt, Pseudomonas aeruginosa PA01
gaaguagccgccg

SEQ ID NO: 3511739 - RNA, 15 nt, Pseudomonas aeruginosa PA01
gaaguaggccuggcc

SEQ ID NO: 3511740 - RNA, 18 nt, Pseudomonas aeruginosa PA01
gaaguaggcggcggaguc

SEQ ID NO: 3511741 - RNA, 21 nt, Pseudomonas aeruginosa PA01
gaaguaguagaugcggcugug

SEQ ID NO: 3511742 - RNA, 23 nt, Pseudomonas aeruginosa PA01
gaaguagucgccccgguuggcgc

SEQ ID NO: 3511743 - RNA, 23 nt, Pseudomonas aeruginosa PA01
gaaguaucggcguuuagcgcccg

SEQ ID NO: 3511744 - RNA, 18 nt, Pseudomonas aeruginosa PA01
gaaguauuucaaccaggc

SEQ ID NO: 3511745 - RNA, 18 nt, Pseudomonas aeruginosa PA01
gaagucagccagguucuu

SEQ ID NO: 3511746 - RNA, 18 nt, Pseudomonas aeruginosa PA01
gaaguccaccaggcgccg

SEQ ID NO: 3511747 - RNA, 19 nt, Pseudomonas aeruginosa PA01
gaaguccugcaacagggca

SEQ ID NO: 3511748 - RNA, 15 nt, Pseudomonas aeruginosa PA01
gaagucgaagcagcc

SEQ ID NO: 3511749 - RNA, 17 nt, Pseudomonas aeruginosa PA01
gaagucgagcuggugga

SEQ ID NO: 3511750 - RNA, 14 nt, Pseudomonas aeruginosa PA01
gaagucgcagucgu

SEQ ID NO: 3511751 - RNA, 18 nt, Pseudomonas aeruginosa PA01
gaagucgcagucguagcg

SEQ ID NO: 3511752 - RNA, 22 nt, Pseudomonas aeruginosa PA01
gaagucgcagucguagcgcagu

SEQ ID NO: 3511753 - RNA, 22 nt, Pseudomonas aeruginosa PA01
gaagucgcccgccggcgugccg

SEQ ID NO: 3511754 - RNA, 13 nt, Pseudomonas aeruginosa PA01
gaagucgccggca

SEQ ID NO: 3511755 - RNA, 13 nt, Pseudomonas aeruginosa PA01
gaagucggcgagc

SEQ ID NO: 3511756 - RNA, 14 nt, Pseudomonas aeruginosa PA01
gaagucggcgagcc

SEQ ID NO: 3511757 - RNA, 14 nt, Pseudomonas aeruginosa PA01
gaagucggcgcgcc

SEQ ID NO: 3511758 - RNA, 15 nt, Pseudomonas aeruginosa PA01
gaagucggcgcgcca

SEQ ID NO: 3511759 - RNA, 14 nt, Pseudomonas aeruginosa PA01
gaagucggcggccg

SEQ ID NO: 3511760 - RNA, 18 nt, Pseudomonas aeruginosa PA01
gaagucggcggccgccuu

SEQ ID NO: 3511761 - RNA, 19 nt, Pseudomonas aeruginosa PA01
gaagucggcguaggccagu

SEQ ID NO: 3511762 - RNA, 18 nt, Pseudomonas aeruginosa PA01
gaagucguagucguagcg

SEQ ID NO: 3511763 - RNA, 20 nt, Pseudomonas aeruginosa PA01
gaagucguccucgcccugcu

SEQ ID NO: 3511764 - RNA, 19 nt, Pseudomonas aeruginosa PA01
gaagucguucccggccugg

SEQ ID NO: 3511765 - RNA, 16 nt, Pseudomonas aeruginosa PA01
gaagucguugaagcgg

SEQ ID NO: 3511766 - RNA, 16 nt, Pseudomonas aeruginosa PA01
gaagugaagcgaucca

SEQ ID NO: 3511767 - RNA, 20 nt, Pseudomonas aeruginosa PA01
gaagugauggaagagcgccg

SEQ ID NO: 3511768 - RNA, 14 nt, Pseudomonas aeruginosa PA01
gaagugcgccgguu

SEQ ID NO: 3511769 - RNA, 20 nt, Pseudomonas aeruginosa PA01
gaagugcgcugcuugaacac

SEQ ID NO: 3511770 - RNA, 18 nt, Pseudomonas aeruginosa PA01
gaaguggcagcgccguug

SEQ ID NO: 3511771 - RNA, 11 nt, Pseudomonas aeruginosa PA01
gaaguggcgga

SEQ ID NO: 3511772 - RNA, 17 nt, Pseudomonas aeruginosa PA01
gaaguguuacagcagga

SEQ ID NO: 3511773 - RNA, 23 nt, Pseudomonas aeruginosa PA01
gaaguucaccucggugagguagc

SEQ ID NO: 3511774 - RNA, 20 nt, Pseudomonas aeruginosa PA01
gaaguucacguaggagccgg

SEQ ID NO: 3511775 - RNA, 14 nt, Pseudomonas aeruginosa PA01
gaaguucagggagg

SEQ ID NO: 3511776 - RNA, 23 nt, Pseudomonas aeruginosa PA01
gaaguucccgccgcucugcuggc

SEQ ID NO: 3511777 - RNA, 17 nt, Pseudomonas aeruginosa PA01
gaaguugagcaccggca

SEQ ID NO: 3511778 - RNA, 14 nt, Pseudomonas aeruginosa PA01
gaaguugccgccag

SEQ ID NO: 3511779 - RNA, 13 nt, Pseudomonas aeruginosa PA01
gaaguugccgccg

SEQ ID NO: 3511780 - RNA, 16 nt, Pseudomonas aeruginosa PA01
gaagcgcuugcccagg

SEQ ID NO: 3511781 - RNA, 15 nt, Pseudomonas aeruginosa PA01
gaagcggaagccggg

SEQ ID NO: 3511782 - RNA, 22 nt, Pseudomonas aeruginosa PA01
gaagcggaucucgucgccgacc

SEQ ID NO: 3511783 - RNA, 23 nt, Pseudomonas aeruginosa PA01
gaagcggaucucgucgccgaccc

SEQ ID NO: 3511784 - RNA, 14 nt, Pseudomonas aeruginosa PA01
gaagcggccgacca

SEQ ID NO: 3511785 - RNA, 18 nt, Pseudomonas aeruginosa PA01
gaagcggccgaccaggcc

SEQ ID NO: 3511786 - RNA, 12 nt, Pseudomonas aeruginosa PA01
gaagcggccgag

SEQ ID NO: 3511787 - RNA, 23 nt, Pseudomonas aeruginosa PA01
gaagcggccgagauccugcagca

SEQ ID NO: 3511788 - RNA, 23 nt, Pseudomonas aeruginosa PA01
gaagcggccgccgaaaugcugca

SEQ ID NO: 3511789 - RNA, 14 nt, Pseudomonas aeruginosa PA01
gaagcggcucggcc

SEQ ID NO: 3511790 - RNA, 16 nt, Pseudomonas aeruginosa PA01
gaagcggcucggccag

SEQ ID NO: 3511791 - RNA, 19 nt, Pseudomonas aeruginosa PA01
gaagcggcucggccagggc

SEQ ID NO: 3511792 - RNA, 14 nt, Pseudomonas aeruginosa PA01
gaagcggcuggccg

SEQ ID NO: 3511793 - RNA, 14 nt, Pseudomonas aeruginosa PA01
gaagcgggccucgg

SEQ ID NO: 3511794 - RNA, 17 nt, Pseudomonas aeruginosa PA01
gaagcgguagugggcga

SEQ ID NO: 3511795 - RNA, 19 nt, Pseudomonas aeruginosa PA01
gaagcgguagugggcgagg

SEQ ID NO: 3511796 - RNA, 16 nt, Pseudomonas aeruginosa PA01
gaagcggucgccggcg

SEQ ID NO: 3511797 - RNA, 20 nt, Pseudomonas aeruginosa PA01
gaagcggucgccggcgcgca

SEQ ID NO: 3511798 - RNA, 16 nt, Pseudomonas aeruginosa PA01
gaagcgucagccgcgg

SEQ ID NO: 3511799 - RNA, 23 nt, Pseudomonas aeruginosa PA01
gaagcguccgagguggcugaagc

SEQ ID NO: 3511800 - RNA, 22 nt, Pseudomonas aeruginosa PA01
gaagcgucgugcgccggccucu

SEQ ID NO: 3511801 - RNA, 15 nt, Pseudomonas aeruginosa PA01
gaagcgugggcggcc

SEQ ID NO: 3511802 - RNA, 16 nt, Pseudomonas aeruginosa PA01
gaagcgugggcggccg

SEQ ID NO: 3511803 - RNA, 17 nt, Pseudomonas aeruginosa PA01
gaagcgugggcggccgg

SEQ ID NO: 3511804 - RNA, 21 nt, Pseudomonas aeruginosa PA01
gaagcgugggcggccggccag

SEQ ID NO: 3511805 - RNA, 22 nt, Pseudomonas aeruginosa PA01
gaagcgugggcggccggccagg

SEQ ID NO: 3511806 - RNA, 15 nt, Pseudomonas aeruginosa PA01
gaagcguucgccgag

SEQ ID NO: 3511807 - RNA, 14 nt, Pseudomonas aeruginosa PA01
gaagcguugcucga

SEQ ID NO: 3511808 - RNA, 20 nt, Pseudomonas aeruginosa PA01
gaagcucaccuugaagccuu

SEQ ID NO: 3511809 - RNA, 17 nt, Pseudomonas aeruginosa PA01
gaagcucggcagcacgc

SEQ ID NO: 3511810 - RNA, 16 nt, Pseudomonas aeruginosa PA01
gaagcucucgccgcgc

SEQ ID NO: 3511811 - RNA, 17 nt, Pseudomonas aeruginosa PA01
gaagcucucgccgcgcu

SEQ ID NO: 3511812 - RNA, 16 nt, Pseudomonas aeruginosa PA01
gaagcugacgaacauc

SEQ ID NO: 3511813 - RNA, 17 nt, Pseudomonas aeruginosa PA01
gaagcugaggccggugu

SEQ ID NO: 3511814 - RNA, 13 nt, Pseudomonas aeruginosa PA01
gaagcugccggca

SEQ ID NO: 3511815 - RNA, 15 nt, Pseudomonas aeruginosa PA01
gaagcugccuuccag

SEQ ID NO: 3511816 - RNA, 18 nt, Pseudomonas aeruginosa PA01
gaagcugccuuccagcag

SEQ ID NO: 3511817 - RNA, 14 nt, Pseudomonas aeruginosa PA01
gaagcugcgcucgg

SEQ ID NO: 3511818 - RNA, 18 nt, Pseudomonas aeruginosa PA01
gaagcuggagcagcagcg

SEQ ID NO: 3511819 - RNA, 21 nt, Pseudomonas aeruginosa PA01
gaagcuggcgcaacugcgcca

SEQ ID NO: 3511820 - RNA, 22 nt, Pseudomonas aeruginosa PA01
gaagcuggcgcaacugcgccag

SEQ ID NO: 3511821 - RNA, 20 nt, Pseudomonas aeruginosa PA01
gaagcugucguaguccuggg

SEQ ID NO: 3511822 - RNA, 14 nt, Pseudomonas aeruginosa PA01
gaagcuguuggcca

SEQ ID NO: 3511823 - RNA, 16 nt, Pseudomonas aeruginosa PA01
gaagcuuccagcuugg

SEQ ID NO: 3511824 - RNA, 15 nt, Pseudomonas aeruginosa PA01
gaagcuucgcugggu

SEQ ID NO: 3511825 - RNA, 16 nt, Pseudomonas aeruginosa PA01
gaagcuucgcuggguu

SEQ ID NO: 3511826 - RNA, 14 nt, Pseudomonas aeruginosa PA01
gaaggaaugcugcc

SEQ ID NO: 3511827 - RNA, 15 nt, Pseudomonas aeruginosa PA01
gaaggaaugcugcca

SEQ ID NO: 3511828 - RNA, 14 nt, Pseudomonas aeruginosa PA01
gaaggacaggucgc

SEQ ID NO: 3511829 - RNA, 14 nt, Pseudomonas aeruginosa PA01
gaaggaccagcuug

SEQ ID NO: 3511830 - RNA, 14 nt, Pseudomonas aeruginosa PA01
gaaggaucgagcca

SEQ ID NO: 3511831 - RNA, 18 nt, Pseudomonas aeruginosa PA01
gaaggaucgagccagcgc

SEQ ID NO: 3511832 - RNA, 15 nt, Pseudomonas aeruginosa PA01
gaaggcaacagcccg

SEQ ID NO: 3511833 - RNA, 18 nt, Pseudomonas aeruginosa PA01
gaaggcaacagcccgcgc

SEQ ID NO: 3511834 - RNA, 23 nt, Pseudomonas aeruginosa PA01
gaaggcaacagcccgcgccgcga

SEQ ID NO: 3511835 - RNA, 17 nt, Pseudomonas aeruginosa PA01
gaaggcaaugccgcccu

SEQ ID NO: 3511836 - RNA, 16 nt, Pseudomonas aeruginosa PA01
gaaggcauauccccuc

SEQ ID NO: 3511837 - RNA, 22 nt, Pseudomonas aeruginosa PA01
gaaggccacgccgacgccgagu

SEQ ID NO: 3511838 - RNA, 16 nt, Pseudomonas aeruginosa PA01
gaaggccacgccgccg

SEQ ID NO: 3511839 - RNA, 20 nt, Pseudomonas aeruginosa PA01
gaaggccacuauuccuugcg

SEQ ID NO: 3511840 - RNA, 16 nt, Pseudomonas aeruginosa PA01
gaaggccagcucgucg

SEQ ID NO: 3511841 - RNA, 18 nt, Pseudomonas aeruginosa PA01
gaaggccagcucgucgcc

SEQ ID NO: 3511842 - RNA, 22 nt, Pseudomonas aeruginosa PA01
gaaggccaggaccgcgauggua

SEQ ID NO: 3511843 - RNA, 12 nt, Pseudomonas aeruginosa PA01
gaaggccaggcc

SEQ ID NO: 3511844 - RNA, 14 nt, Pseudomonas aeruginosa PA01
gaaggccaggccgg

SEQ ID NO: 3511845 - RNA, 19 nt, Pseudomonas aeruginosa PA01
gaaggccaggccggcgccu

SEQ ID NO: 3511846 - RNA, 12 nt, Pseudomonas aeruginosa PA01
gaaggccagguc

SEQ ID NO: 3511847 - RNA, 14 nt, Pseudomonas aeruginosa PA01
gaaggccaggucgc

SEQ ID NO: 3511848 - RNA, 16 nt, Pseudomonas aeruginosa PA01
gaaggccaggucgccc

SEQ ID NO: 3511849 - RNA, 18 nt, Pseudomonas aeruginosa PA01
gaaggccaggucgcccac

SEQ ID NO: 3511850 - RNA, 20 nt, Pseudomonas aeruginosa PA01
gaaggccaggucgcccaccu

SEQ ID NO: 3511851 - RNA, 21 nt, Pseudomonas aeruginosa PA01
gaaggccaguccggcaccgcu

SEQ ID NO: 3511852 - RNA, 19 nt, Pseudomonas aeruginosa PA01
gaaggcccgcgagccgcgc

SEQ ID NO: 3511853 - RNA, 13 nt, Pseudomonas aeruginosa PA01
gaaggccgcgccg

SEQ ID NO: 3511854 - RNA, 17 nt, Pseudomonas aeruginosa PA01
gaaggccgcggucgggc

SEQ ID NO: 3511855 - RNA, 18 nt, Pseudomonas aeruginosa PA01
gaaggccgcuucgccgcc

SEQ ID NO: 3511856 - RNA, 14 nt, Pseudomonas aeruginosa PA01
gaaggccuccucgu

SEQ ID NO: 3511857 - RNA, 18 nt, Pseudomonas aeruginosa PA01
gaaggccucggucaggcg

SEQ ID NO: 3511858 - RNA, 18 nt, Pseudomonas aeruginosa PA01
gaaggccugcgcuuccgg

SEQ ID NO: 3511859 - RNA, 21 nt, Pseudomonas aeruginosa PA01
gaaggccugcgcuuccggcag

SEQ ID NO: 3511860 - RNA, 17 nt, Pseudomonas aeruginosa PA01
gaaggccuggaacacca

SEQ ID NO: 3511861 - RNA, 20 nt, Pseudomonas aeruginosa PA01
gaaggccuggaacaccaggc

SEQ ID NO: 3511862 - RNA, 21 nt, Pseudomonas aeruginosa PA01
gaaggccuggaacaccaggcc

SEQ ID NO: 3511863 - RNA, 14 nt, Pseudomonas aeruginosa PA01
gaaggccuggccgu

SEQ ID NO: 3511864 - RNA, 16 nt, Pseudomonas aeruginosa PA01
gaaggccuggccguug

SEQ ID NO: 3511865 - RNA, 13 nt, Pseudomonas aeruginosa PA01
gaaggccuggucg

SEQ ID NO: 3511866 - RNA, 23 nt, Pseudomonas aeruginosa PA01
gaaggccuggucgaaagccugcc

SEQ ID NO: 3511867 - RNA, 19 nt, Pseudomonas aeruginosa PA01
gaaggcgaaccacaccagg

SEQ ID NO: 3511868 - RNA, 20 nt, Pseudomonas aeruginosa PA01
gaaggcgaaccacaccaggu

SEQ ID NO: 3511869 - RNA, 16 nt, Pseudomonas aeruginosa PA01
gaaggcgaagccguug

SEQ ID NO: 3511870 - RNA, 15 nt, Pseudomonas aeruginosa PA01
gaaggcgaucaucgc

SEQ ID NO: 3511871 - RNA, 19 nt, Pseudomonas aeruginosa PA01
gaaggcgaucaucgccacc

SEQ ID NO: 3511872 - RNA, 13 nt, Pseudomonas aeruginosa PA01
gaaggcgccggca

SEQ ID NO: 3511873 - RNA, 11 nt, Pseudomonas aeruginosa PA01
gaaggcgccuu

SEQ ID NO: 3511874 - RNA, 15 nt, Pseudomonas aeruginosa PA01
gaaggcgccuuccag

SEQ ID NO: 3511875 - RNA, 16 nt, Pseudomonas aeruginosa PA01
gaaggcgccuuccagg

SEQ ID NO: 3511876 - RNA, 21 nt, Pseudomonas aeruginosa PA01
gaaggcgcgcaccagcggguc

SEQ ID NO: 3511877 - RNA, 16 nt, Pseudomonas aeruginosa PA01
gaaggcgcggggcgag

SEQ ID NO: 3511878 - RNA, 22 nt, Pseudomonas aeruginosa PA01
gaaggcgcggggcgaggucggc

SEQ ID NO: 3511879 - RNA, 20 nt, Pseudomonas aeruginosa PA01
gaaggcgcuccggaacgccu

SEQ ID NO: 3511880 - RNA, 17 nt, Pseudomonas aeruginosa PA01
gaaggcgcugagcgccu

SEQ ID NO: 3511881 - RNA, 12 nt, Pseudomonas aeruginosa PA01
gaaggcgcuggc

SEQ ID NO: 3511882 - RNA, 18 nt, Pseudomonas aeruginosa PA01
gaaggcgcugggcggcug

SEQ ID NO: 3511883 - RNA, 11 nt, Pseudomonas aeruginosa PA01
gaaggcgcuuu

SEQ ID NO: 3511884 - RNA, 18 nt, Pseudomonas aeruginosa PA01
gaacagcgccgcggcugg

SEQ ID NO: 3511885 - RNA, 19 nt, Pseudomonas aeruginosa PA01
gaacagcgccgcggcuggc

SEQ ID NO: 3511886 - RNA, 16 nt, Pseudomonas aeruginosa PA01
gaacagcgcuuccugg

SEQ ID NO: 3511887 - RNA, 19 nt, Pseudomonas aeruginosa PA01
gaacagcgcuuccugggaa

SEQ ID NO: 3511888 - RNA, 23 nt, Pseudomonas aeruginosa PA01
gaacagcggcccgagggucgccu

SEQ ID NO: 3511889 - RNA, 11 nt, Pseudomonas aeruginosa PA01
gaacagcggcu

SEQ ID NO: 3511890 - RNA, 24 nt, Pseudomonas aeruginosa PA01
gaacagcggcuggcccucggcguu

SEQ ID NO: 3511891 - RNA, 21 nt, Pseudomonas aeruginosa PA01
gaacagcgggucgcggcuggc

SEQ ID NO: 3511892 - RNA, 22 nt, Pseudomonas aeruginosa PA01
gaacagcgggucgcggcuggcc

SEQ ID NO: 3511893 - RNA, 11 nt, Pseudomonas aeruginosa PA01
gaacagcuccu

SEQ ID NO: 3511894 - RNA, 18 nt, Pseudomonas aeruginosa PA01
gaacagcuccuccagccg

SEQ ID NO: 3511895 - RNA, 21 nt, Pseudomonas aeruginosa PA01
gaacagcuccuccagccgcgg

SEQ ID NO: 3511896 - RNA, 23 nt, Pseudomonas aeruginosa PA01
gaacagcucggucucgaucggcc

SEQ ID NO: 3511897 - RNA, 22 nt, Pseudomonas aeruginosa PA01
gaacagcuggcgcgucgcugcc

SEQ ID NO: 3511898 - RNA, 23 nt, Pseudomonas aeruginosa PA01
gaacagcuugaaccgcgagaccc

SEQ ID NO: 3511899 - RNA, 15 nt, Pseudomonas aeruginosa PA01
gaacagcuugccgcu

SEQ ID NO: 3511900 - RNA, 16 nt, Pseudomonas aeruginosa PA01
gaacagcuugccgcug

SEQ ID NO: 3511901 - RNA, 17 nt, Pseudomonas aeruginosa PA01
gaacagcuugccgcugc

SEQ ID NO: 3511902 - RNA, 21 nt, Pseudomonas aeruginosa PA01
gaacagcuugccgcugcgcau

SEQ ID NO: 3511903 - RNA, 12 nt, Pseudomonas aeruginosa PA01
gaacaggaaacu

SEQ ID NO: 3511904 - RNA, 16 nt, Pseudomonas aeruginosa PA01
gaacaggaagcgcggg

SEQ ID NO: 3511905 - RNA, 20 nt, Pseudomonas aeruginosa PA01
gaacaggagccaucgcucca

SEQ ID NO: 3511906 - RNA, 21 nt, Pseudomonas aeruginosa PA01
gaacaggaucuccucggccaa

SEQ ID NO: 3511907 - RNA, 14 nt, Pseudomonas aeruginosa PA01
gaacaggcagcggg

SEQ ID NO: 3511908 - RNA, 21 nt, Pseudomonas aeruginosa PA01
gaacaggcagcgggccaggcg

SEQ ID NO: 3511909 - RNA, 21 nt, Pseudomonas aeruginosa PA01
gaacaggcgacgguaccaggg

SEQ ID NO: 3511910 - RNA, 20 nt, Pseudomonas aeruginosa PA01
gaacaggcgauagccgacca

SEQ ID NO: 3511911 - RNA, 17 nt, Pseudomonas aeruginosa PA01
gaacaggcgcuucagcu

SEQ ID NO: 3511912 - RNA, 21 nt, Pseudomonas aeruginosa PA01
gaacaggcuggcgucgacgcc

SEQ ID NO: 3511913 - RNA, 22 nt, Pseudomonas aeruginosa PA01
gaacaggcugugcgccaggccg

SEQ ID NO: 3511914 - RNA, 23 nt, Pseudomonas aeruginosa PA01
gaacaggcugugcgccaggccgg

SEQ ID NO: 3511915 - RNA, 18 nt, Pseudomonas aeruginosa PA01
gaacagggcgaaggccac

SEQ ID NO: 3511916 - RNA, 19 nt, Pseudomonas aeruginosa PA01
gaacagggcgaaggccacc

SEQ ID NO: 3511917 - RNA, 19 nt, Pseudomonas aeruginosa PA01
gaacagggcgaaggucugc

SEQ ID NO: 3511918 - RNA, 15 nt, Pseudomonas aeruginosa PA01
gaacagggcgagcag

SEQ ID NO: 3511919 - RNA, 16 nt, Pseudomonas aeruginosa PA01
gaacagggcgagcagg

SEQ ID NO: 3511920 - RNA, 19 nt, Pseudomonas aeruginosa PA01
gaacagggucuucaggccg

SEQ ID NO: 3511921 - RNA, 13 nt, Pseudomonas aeruginosa PA01
gaacagguagccc

SEQ ID NO: 3511922 - RNA, 16 nt, Pseudomonas aeruginosa PA01
gaacagguagccccgg

SEQ ID NO: 3511923 - RNA, 15 nt, Pseudomonas aeruginosa PA01
gaacaggucgacgcc

SEQ ID NO: 3511924 - RNA, 22 nt, Pseudomonas aeruginosa PA01
gaacaggugcugguggcccugg

SEQ ID NO: 3511925 - RNA, 17 nt, Pseudomonas aeruginosa PA01
gaacagguggcuuucca

SEQ ID NO: 3511926 - RNA, 18 nt, Pseudomonas aeruginosa PA01
gaacagguucggcaggcc

SEQ ID NO: 3511927 - RNA, 23 nt, Pseudomonas aeruginosa PA01
gaacagguucggcuugacgaugc

SEQ ID NO: 3511928 - RNA, 15 nt, Pseudomonas aeruginosa PA01
gaacagugcgcccgu

SEQ ID NO: 3511929 - RNA, 22 nt, Pseudomonas aeruginosa PA01
gaacaguucgaugggccgguac

SEQ ID NO: 3511930 - RNA, 23 nt, Pseudomonas aeruginosa PA01
gaacaguucggcgguggagcaga

SEQ ID NO: 3511931 - RNA, 17 nt, Pseudomonas aeruginosa PA01
gaacaucagcagcgcca

SEQ ID NO: 3511932 - RNA, 19 nt, Pseudomonas aeruginosa PA01
gaacaucagcagcgccagc

SEQ ID NO: 3511933 - RNA, 21 nt, Pseudomonas aeruginosa PA01
gaacaucauccacagcgugca

SEQ ID NO: 3511934 - RNA, 20 nt, Pseudomonas aeruginosa PA01
gaacauccgcggccccggcg

SEQ ID NO: 3511935 - RNA, 15 nt, Pseudomonas aeruginosa PA01
gaacaucgccagcgc

SEQ ID NO: 3511936 - RNA, 17 nt, Pseudomonas aeruginosa PA01
gaacaucgccagcgcca

SEQ ID NO: 3511937 - RNA, 23 nt, Pseudomonas aeruginosa PA01
gaacaucgccugcuuggcggcgg

SEQ ID NO: 3511938 - RNA, 17 nt, Pseudomonas aeruginosa PA01
gaacaucggcgcuccgc

SEQ ID NO: 3511939 - RNA, 18 nt, Pseudomonas aeruginosa PA01
gaacaucggcgcuccgcc

SEQ ID NO: 3511940 - RNA, 13 nt, Pseudomonas aeruginosa PA01
gaacaugaagccg

SEQ ID NO: 3511941 - RNA, 15 nt, Pseudomonas aeruginosa PA01
gaaccacaccagguc

SEQ ID NO: 3511942 - RNA, 20 nt, Pseudomonas aeruginosa PA01
gaaccacaccaggucgccgc

SEQ ID NO: 3511943 - RNA, 23 nt, Pseudomonas aeruginosa PA01
gaaccacaccaggucgccgcaca

SEQ ID NO: 3511944 - RNA, 14 nt, Pseudomonas aeruginosa PA01
gaaccacaccugca

SEQ ID NO: 3511945 - RNA, 17 nt, Pseudomonas aeruginosa PA01
gaaccacaccugcaaca

SEQ ID NO: 3511946 - RNA, 22 nt, Pseudomonas aeruginosa PA01
gaaccacgacgaagcgccggcg

SEQ ID NO: 3511947 - RNA, 17 nt, Pseudomonas aeruginosa PA01
gaaccacugcgccaugc

SEQ ID NO: 3511948 - RNA, 18 nt, Pseudomonas aeruginosa PA01
gaaccacugcgccaugcc

SEQ ID NO: 3511949 - RNA, 21 nt, Pseudomonas aeruginosa PA01
gaaccagacgcucggccagcg

SEQ ID NO: 3511950 - RNA, 12 nt, Pseudomonas aeruginosa PA01
gaaccagcagca

SEQ ID NO: 3511951 - RNA, 13 nt, Pseudomonas aeruginosa PA01
gaaccagcagcag

SEQ ID NO: 3511952 - RNA, 16 nt, Pseudomonas aeruginosa PA01
gaaccagcagcagguc

SEQ ID NO: 3511953 - RNA, 18 nt, Pseudomonas aeruginosa PA01
gaaccagcauguccugca

SEQ ID NO: 3511954 - RNA, 21 nt, Pseudomonas aeruginosa PA01
gaaccagcucagcuccaggcc

SEQ ID NO: 3511955 - RNA, 23 nt, Pseudomonas aeruginosa PA01
gaaccagcucagcuccaggccgc

SEQ ID NO: 3511956 - RNA, 20 nt, Pseudomonas aeruginosa PA01
gaaccaggcaauggccggcg

SEQ ID NO: 3511957 - RNA, 12 nt, Pseudomonas aeruginosa PA01
gaaccaggcgcc

SEQ ID NO: 3511958 - RNA, 14 nt, Pseudomonas aeruginosa PA01
gaaccaggcgccga

SEQ ID NO: 3511959 - RNA, 17 nt, Pseudomonas aeruginosa PA01
gaaccaggcgccgaugc

SEQ ID NO: 3511960 - RNA, 21 nt, Pseudomonas aeruginosa PA01
gaaccaggcggugucgcgguu

SEQ ID NO: 3511961 - RNA, 17 nt, Pseudomonas aeruginosa PA01
gaaccagggacgcccgg

SEQ ID NO: 3511962 - RNA, 16 nt, Pseudomonas aeruginosa PA01
gaaccaggggucgacg

SEQ ID NO: 3511963 - RNA, 18 nt, Pseudomonas aeruginosa PA01
gaaccagugcaccgccgg

SEQ ID NO: 3511964 - RNA, 15 nt, Pseudomonas aeruginosa PA01
gaaccagugcgcggu

SEQ ID NO: 3511965 - RNA, 21 nt, Pseudomonas aeruginosa PA01
gaaccagugcgcgguccgcgu

SEQ ID NO: 3511966 - RNA, 19 nt, Pseudomonas aeruginosa PA01
gaacccagacagcccucca

SEQ ID NO: 3511967 - RNA, 17 nt, Pseudomonas aeruginosa PA01
gaacccaggccgcgcag

SEQ ID NO: 3511968 - RNA, 20 nt, Pseudomonas aeruginosa PA01
gaacccaggccgcgcagcaa

SEQ ID NO: 3511969 - RNA, 23 nt, Pseudomonas aeruginosa PA01
gaacccaggcgcugcguuccugu

SEQ ID NO: 3511970 - RNA, 20 nt, Pseudomonas aeruginosa PA01
gaacccauggcgcgaugcuc

SEQ ID NO: 3511971 - RNA, 17 nt, Pseudomonas aeruginosa PA01
gaaccccgaacuucccc

SEQ ID NO: 3511972 - RNA, 15 nt, Pseudomonas aeruginosa PA01
gaaccccgggccgcg

SEQ ID NO: 3511973 - RNA, 12 nt, Pseudomonas aeruginosa PA01
gaacccgcccuc

SEQ ID NO: 3511974 - RNA, 15 nt, Pseudomonas aeruginosa PA01
gaacccgcggcgcgc

SEQ ID NO: 3511975 - RNA, 21 nt, Pseudomonas aeruginosa PA01
gaacccgcuucgucggucgcg

SEQ ID NO: 3511976 - RNA, 21 nt, Pseudomonas aeruginosa PA01
gaacccggcgcggcgcagcca

SEQ ID NO: 3511977 - RNA, 15 nt, Pseudomonas aeruginosa PA01
gaaccgacgcgcagg

SEQ ID NO: 3511978 - RNA, 14 nt, Pseudomonas aeruginosa PA01
gaaccgauggccag

SEQ ID NO: 3511979 - RNA, 15 nt, Pseudomonas aeruginosa PA01
gaaccgcagaagacg

SEQ ID NO: 3511980 - RNA, 14 nt, Pseudomonas aeruginosa PA01
gaaccgccagcagu

SEQ ID NO: 3511981 - RNA, 20 nt, Pseudomonas aeruginosa PA01
gaaccgcgagaccccggcgg

SEQ ID NO: 3511982 - RNA, 18 nt, Pseudomonas aeruginosa PA01
gaaccggaaaagaagccg

SEQ ID NO: 3511983 - RNA, 20 nt, Pseudomonas aeruginosa PA01
gaaccggaaaagaagccgcg

SEQ ID NO: 3511984 - RNA, 23 nt, Pseudomonas aeruginosa PA01
gaaccggaaaagaagccgcgcaa

SEQ ID NO: 3511985 - RNA, 14 nt, Pseudomonas aeruginosa PA01
gaaccggggcggcc

SEQ ID NO: 3511986 - RNA, 16 nt, Pseudomonas aeruginosa PA01
gaaccggggcguuaca

SEQ ID NO: 3511987 - RNA, 20 nt, Pseudomonas aeruginosa PA01
gaaagaccgaacaucagcag

SEQ ID NO: 3511988 - RNA, 19 nt, Pseudomonas aeruginosa PA01
gaaagaccggcgccccugc

SEQ ID NO: 3511989 - RNA, 20 nt, Pseudomonas aeruginosa PA01
gaaagacgcugcgaccuggc

SEQ ID NO: 3511990 - RNA, 19 nt, Pseudomonas aeruginosa PA01
gaaagcaaaaaaagcccau

SEQ ID NO: 3511991 - RNA, 17 nt, Pseudomonas aeruginosa PA01
gaaagcaguucgcccgg

SEQ ID NO: 3511992 - RNA, 14 nt, Pseudomonas aeruginosa PA01
gaaagcaucguugu

SEQ ID NO: 3511993 - RNA, 14 nt, Pseudomonas aeruginosa PA01
gaaagccaugccca

SEQ ID NO: 3511994 - RNA, 15 nt, Pseudomonas aeruginosa PA01
gaaagccaugcccag

SEQ ID NO: 3511995 - RNA, 16 nt, Pseudomonas aeruginosa PA01
gaaagccaugcccaga

SEQ ID NO: 3511996 - RNA, 18 nt, Pseudomonas aeruginosa PA01
gaaagccccugccgcgga

SEQ ID NO: 3511997 - RNA, 14 nt, Pseudomonas aeruginosa PA01
gaaagccgaagcgc

SEQ ID NO: 3511998 - RNA, 17 nt, Pseudomonas aeruginosa PA01
gaaagccucaggcgcug

SEQ ID NO: 3511999 - RNA, 17 nt, Pseudomonas aeruginosa PA01
gaaagccuccagcagcu

SEQ ID NO: 3512000 - RNA, 16 nt, Pseudomonas aeruginosa PA01
gaaagccucgacgaca

SEQ ID NO: 3512001 - RNA, 17 nt, Pseudomonas aeruginosa PA01
gaaagccuggccggcga

SEQ ID NO: 3512002 - RNA, 13 nt, Pseudomonas aeruginosa PA01
gaaagcgacgccg

SEQ ID NO: 3512003 - RNA, 16 nt, Pseudomonas aeruginosa PA01
gaaagcgacgccgcga

SEQ ID NO: 3512004 - RNA, 20 nt, Pseudomonas aeruginosa PA01
gaaagcgauagccggggccg

SEQ ID NO: 3512005 - RNA, 13 nt, Pseudomonas aeruginosa PA01
gaaagcgccuucu

SEQ ID NO: 3512006 - RNA, 22 nt, Pseudomonas aeruginosa PA01
gaaagcgguaccgggccaggca

SEQ ID NO: 3512007 - RNA, 16 nt, Pseudomonas aeruginosa PA01
gaaagcgucagcgcgc

SEQ ID NO: 3512008 - RNA, 21 nt, Pseudomonas aeruginosa PA01
gaaagcgucagcgcgccagca

SEQ ID NO: 3512009 - RNA, 13 nt, Pseudomonas aeruginosa PA01
gaaagcuccucgg

SEQ ID NO: 3512010 - RNA, 17 nt, Pseudomonas aeruginosa PA01
gaaaggcugcuucggca

SEQ ID NO: 3512011 - RNA, 13 nt, Pseudomonas aeruginosa PA01
gaaagggaaaucc

SEQ ID NO: 3512012 - RNA, 17 nt, Pseudomonas aeruginosa PA01
gaaagggcggcagcacg

SEQ ID NO: 3512013 - RNA, 19 nt, Pseudomonas aeruginosa PA01
gaaaggggcucgaaacgaa

SEQ ID NO: 3512014 - RNA, 19 nt, Pseudomonas aeruginosa PA01
gaaagucugugaucaggcu

SEQ ID NO: 3512015 - RNA, 14 nt, Pseudomonas aeruginosa PA01
gaaauacagcaccc

SEQ ID NO: 3512016 - RNA, 19 nt, Pseudomonas aeruginosa PA01
gaaauacucgucgacggcc

SEQ ID NO: 3512017 - RNA, 16 nt, Pseudomonas aeruginosa PA01
gaaaucaccgccaccu

SEQ ID NO: 3512018 - RNA, 15 nt, Pseudomonas aeruginosa PA01
gaaauccaccagcac

SEQ ID NO: 3512019 - RNA, 18 nt, Pseudomonas aeruginosa PA01
gaaauccggcuggcgccg

SEQ ID NO: 3512020 - RNA, 15 nt, Pseudomonas aeruginosa PA01
gaaauccggugccuu

SEQ ID NO: 3512021 - RNA, 15 nt, Pseudomonas aeruginosa PA01
gaaaucgagcugcuc

SEQ ID NO: 3512022 - RNA, 20 nt, Pseudomonas aeruginosa PA01
gaaaucgaugucgcggcgcu

SEQ ID NO: 3512023 - RNA, 18 nt, Pseudomonas aeruginosa PA01
gaaaucgcccaccagguc

SEQ ID NO: 3512024 - RNA, 18 nt, Pseudomonas aeruginosa PA01
gaaaucggccacuccagc

SEQ ID NO: 3512025 - RNA, 21 nt, Pseudomonas aeruginosa PA01
gaaaucggccacuccagcccc

SEQ ID NO: 3512026 - RNA, 19 nt, Pseudomonas aeruginosa PA01
gaaaucgguugccgcgcca

SEQ ID NO: 3512027 - RNA, 17 nt, Pseudomonas aeruginosa PA01
gaaaugaaaaaggccgg

SEQ ID NO: 3512028 - RNA, 16 nt, Pseudomonas aeruginosa PA01
gaaaugccgcacccca

SEQ ID NO: 3512029 - RNA, 20 nt, Pseudomonas aeruginosa PA01
gaaaugcucgugcagguagc

SEQ ID NO: 3512030 - RNA, 14 nt, Pseudomonas aeruginosa PA01
gaaaugcugcaggc

SEQ ID NO: 3512031 - RNA, 20 nt, Pseudomonas aeruginosa PA01
gaaauggcaacccagggcgc

SEQ ID NO: 3512032 - RNA, 19 nt, Pseudomonas aeruginosa PA01
gaaauggguucccagcagc

SEQ ID NO: 3512033 - RNA, 19 nt, Pseudomonas aeruginosa PA01
gaaauggucaccaugauca

SEQ ID NO: 3512034 - RNA, 16 nt, Pseudomonas aeruginosa PA01
gaaauucgcgcuggau

SEQ ID NO: 3512035 - RNA, 22 nt, Pseudomonas aeruginosa PA01
gaaauugccuccgcucugcugg

SEQ ID NO: 3512036 - RNA, 15 nt, Pseudomonas aeruginosa PA01
gaacaacccgccagc

SEQ ID NO: 3512037 - RNA, 16 nt, Pseudomonas aeruginosa PA01
gaacaacccgccagca

SEQ ID NO: 3512038 - RNA, 16 nt, Pseudomonas aeruginosa PA01
gaacaaccgcucgcgg

SEQ ID NO: 3512039 - RNA, 15 nt, Pseudomonas aeruginosa PA01
gaacaaccgcuugcg

SEQ ID NO: 3512040 - RNA, 16 nt, Pseudomonas aeruginosa PA01
gaacaaccgcuugcgg

SEQ ID NO: 3512041 - RNA, 14 nt, Pseudomonas aeruginosa PA01
gaacaacuccugca

SEQ ID NO: 3512042 - RNA, 14 nt, Pseudomonas aeruginosa PA01
gaacaagcccuggu

SEQ ID NO: 3512043 - RNA, 15 nt, Pseudomonas aeruginosa PA01
gaacaagccgccuuc

SEQ ID NO: 3512044 - RNA, 17 nt, Pseudomonas aeruginosa PA01
gaacaagugcucgaugg

SEQ ID NO: 3512045 - RNA, 23 nt, Pseudomonas aeruginosa PA01
gaacaaucccagcucgccgaaga

SEQ ID NO: 3512046 - RNA, 16 nt, Pseudomonas aeruginosa PA01
gaacaaucggucgccc

SEQ ID NO: 3512047 - RNA, 16 nt, Pseudomonas aeruginosa PA01
gaacacacccugcgca

SEQ ID NO: 3512048 - RNA, 15 nt, Pseudomonas aeruginosa PA01
gaacacacgaauggc

SEQ ID NO: 3512049 - RNA, 13 nt, Pseudomonas aeruginosa PA01
gaacaccacccgg

SEQ ID NO: 3512050 - RNA, 14 nt, Pseudomonas aeruginosa PA01
gaacaccaggcgcc

SEQ ID NO: 3512051 - RNA, 20 nt, Pseudomonas aeruginosa PA01
gaacaccggcgccgccuggc

SEQ ID NO: 3512052 - RNA, 21 nt, Pseudomonas aeruginosa PA01
gaacaccggcgccgccuggcc

SEQ ID NO: 3512053 - RNA, 19 nt, Pseudomonas aeruginosa PA01
gaacaccgggccgccggcg

SEQ ID NO: 3512054 - RNA, 21 nt, Pseudomonas aeruginosa PA01
gaacaccguguugaucgccgc

SEQ ID NO: 3512055 - RNA, 18 nt, Pseudomonas aeruginosa PA01
gaacaccucuucgccauc

SEQ ID NO: 3512056 - RNA, 19 nt, Pseudomonas aeruginosa PA01
gaacaccucuucgccaucc

SEQ ID NO: 3512057 - RNA, 21 nt, Pseudomonas aeruginosa PA01
gaacaccugcaucaccaggcu

SEQ ID NO: 3512058 - RNA, 20 nt, Pseudomonas aeruginosa PA01
gaacaccugcguggcgaacg

SEQ ID NO: 3512059 - RNA, 14 nt, Pseudomonas aeruginosa PA01
gaacacgccccaga

SEQ ID NO: 3512060 - RNA, 21 nt, Pseudomonas aeruginosa PA01
gaacacgccccagaagcccca

SEQ ID NO: 3512061 - RNA, 18 nt, Pseudomonas aeruginosa PA01
gaacagcaaagcgcaggu

SEQ ID NO: 3512062 - RNA, 18 nt, Pseudomonas aeruginosa PA01
gaacagcaacaccgcgca

SEQ ID NO: 3512063 - RNA, 19 nt, Pseudomonas aeruginosa PA01
gaacagcaccgagcaggca

SEQ ID NO: 3512064 - RNA, 11 nt, Pseudomonas aeruginosa PA01
gaacagcaccu

SEQ ID NO: 3512065 - RNA, 14 nt, Pseudomonas aeruginosa PA01
gaacagcaccuugg

SEQ ID NO: 3512066 - RNA, 21 nt, Pseudomonas aeruginosa PA01
gaacagcaccuuggccauggg

SEQ ID NO: 3512067 - RNA, 11 nt, Pseudomonas aeruginosa PA01
gaacagcagca

SEQ ID NO: 3512068 - RNA, 13 nt, Pseudomonas aeruginosa PA01
gaacagcagcaag

SEQ ID NO: 3512069 - RNA, 14 nt, Pseudomonas aeruginosa PA01
gaacagcagcaagc

SEQ ID NO: 3512070 - RNA, 20 nt, Pseudomonas aeruginosa PA01
gaacagcagcaagccgauga

SEQ ID NO: 3512071 - RNA, 15 nt, Pseudomonas aeruginosa PA01
gaacagcagccaggc

SEQ ID NO: 3512072 - RNA, 12 nt, Pseudomonas aeruginosa PA01
gaacagcaggga

SEQ ID NO: 3512073 - RNA, 15 nt, Pseudomonas aeruginosa PA01
gaacagcagggaggc

SEQ ID NO: 3512074 - RNA, 17 nt, Pseudomonas aeruginosa PA01
gaacagcagggaggcgc

SEQ ID NO: 3512075 - RNA, 15 nt, Pseudomonas aeruginosa PA01
gaacagcauggugaa

SEQ ID NO: 3512076 - RNA, 13 nt, Pseudomonas aeruginosa PA01
gaacagccagagg

SEQ ID NO: 3512077 - RNA, 15 nt, Pseudomonas aeruginosa PA01
gaacagccaguaguc

SEQ ID NO: 3512078 - RNA, 13 nt, Pseudomonas aeruginosa PA01
gaacagcccgucg

SEQ ID NO: 3512079 - RNA, 20 nt, Pseudomonas aeruginosa PA01
gaacagcccgucgcgcgccg

SEQ ID NO: 3512080 - RNA, 17 nt, Pseudomonas aeruginosa PA01
gaacagccgcagcggca

SEQ ID NO: 3512081 - RNA, 22 nt, Pseudomonas aeruginosa PA01
gaacagccgcagcggcaugccc

SEQ ID NO: 3512082 - RNA, 20 nt, Pseudomonas aeruginosa PA01
gaacagccgccccaccacca

SEQ ID NO: 3512083 - RNA, 21 nt, Pseudomonas aeruginosa PA01
gaacagccgccccaccaccau

SEQ ID NO: 3512084 - RNA, 16 nt, Pseudomonas aeruginosa PA01
gaacagcgagaccucg

SEQ ID NO: 3512085 - RNA, 21 nt, Pseudomonas aeruginosa PA01
gaacagcgagaggggcgcucg

SEQ ID NO: 3512086 - RNA, 14 nt, Pseudomonas aeruginosa PA01
gaacagcgccacca

SEQ ID NO: 3512087 - RNA, 15 nt, Pseudomonas aeruginosa PA01
gaacagcgccaccag

SEQ ID NO: 3512088 - RNA, 14 nt, Pseudomonas aeruginosa PA01
gaacagcgccagcg

SEQ ID NO: 3512089 - RNA, 19 nt, Pseudomonas aeruginosa PA01
gaacagcgccagcggcagc

SEQ ID NO: 3512090 - RNA, 17 nt, Pseudomonas aeruginosa PA01
gaacagcgccgcggcug

SEQ ID NO: 3512091 - RNA, 21 nt, Pseudomonas aeruginosa PA01
gaagcccaggcgcucggcggc

SEQ ID NO: 3512092 - RNA, 14 nt, Pseudomonas aeruginosa PA01
gaagcccaggcguc

SEQ ID NO: 3512093 - RNA, 19 nt, Pseudomonas aeruginosa PA01
gaagcccaggcgucgcgcc

SEQ ID NO: 3512094 - RNA, 16 nt, Pseudomonas aeruginosa PA01
gaagcccaucgacugc

SEQ ID NO: 3512095 - RNA, 23 nt, Pseudomonas aeruginosa PA01
gaagccccagagcccgccgaaca

SEQ ID NO: 3512096 - RNA, 13 nt, Pseudomonas aeruginosa PA01
gaagccccgcagc

SEQ ID NO: 3512097 - RNA, 17 nt, Pseudomonas aeruginosa PA01
gaagccccgcagccgcg

SEQ ID NO: 3512098 - RNA, 19 nt, Pseudomonas aeruginosa PA01
gaagccccgcagccgcggg

SEQ ID NO: 3512099 - RNA, 21 nt, Pseudomonas aeruginosa PA01
gaagccccgcuauggcggggc

SEQ ID NO: 3512100 - RNA, 21 nt, Pseudomonas aeruginosa PA01
gaagcccgccuugauggcggg

SEQ ID NO: 3512101 - RNA, 13 nt, Pseudomonas aeruginosa PA01
gaagcccucgcga

SEQ ID NO: 3512102 - RNA, 18 nt, Pseudomonas aeruginosa PA01
gaagcccucgcgacggca

SEQ ID NO: 3512103 - RNA, 22 nt, Pseudomonas aeruginosa PA01
gaagcccugcaaagcggcgacg

SEQ ID NO: 3512104 - RNA, 21 nt, Pseudomonas aeruginosa PA01
gaagcccugcuggcgcagcca

SEQ ID NO: 3512105 - RNA, 20 nt, Pseudomonas aeruginosa PA01
gaagccgaccacucgcgaga

SEQ ID NO: 3512106 - RNA, 17 nt, Pseudomonas aeruginosa PA01
gaagccgaccggcgccg

SEQ ID NO: 3512107 - RNA, 18 nt, Pseudomonas aeruginosa PA01
gaagccgaccggcgccgg

SEQ ID NO: 3512108 - RNA, 20 nt, Pseudomonas aeruginosa PA01
gaagccgaccggcgccggga

SEQ ID NO: 3512109 - RNA, 11 nt, Pseudomonas aeruginosa PA01
gaagccgagcu

SEQ ID NO: 3512110 - RNA, 14 nt, Pseudomonas aeruginosa PA01
gaagccgagcugcc

SEQ ID NO: 3512111 - RNA, 16 nt, Pseudomonas aeruginosa PA01
gaagccgagcugccgg

SEQ ID NO: 3512112 - RNA, 17 nt, Pseudomonas aeruginosa PA01
gaagccgaggcuuucca

SEQ ID NO: 3512113 - RNA, 18 nt, Pseudomonas aeruginosa PA01
gaagccgaggcuuuccag

SEQ ID NO: 3512114 - RNA, 23 nt, Pseudomonas aeruginosa PA01
gaagccgaggcuuuccagcaggc

SEQ ID NO: 3512115 - RNA, 22 nt, Pseudomonas aeruginosa PA01
gaagccgauacccugggagccg

SEQ ID NO: 3512116 - RNA, 18 nt, Pseudomonas aeruginosa PA01
gaagccgaucaccaccag

SEQ ID NO: 3512117 - RNA, 19 nt, Pseudomonas aeruginosa PA01
gaagccgaucaccaccagc

SEQ ID NO: 3512118 - RNA, 21 nt, Pseudomonas aeruginosa PA01
gaagccgaucaccaccagcau

SEQ ID NO: 3512119 - RNA, 22 nt, Pseudomonas aeruginosa PA01
gaagccgaucaccaccagcauc

SEQ ID NO: 3512120 - RNA, 18 nt, Pseudomonas aeruginosa PA01
gaagccgcacuuccaggc

SEQ ID NO: 3512121 - RNA, 19 nt, Pseudomonas aeruginosa PA01
gaagccgcacuuccaggcg

SEQ ID NO: 3512122 - RNA, 20 nt, Pseudomonas aeruginosa PA01
gaagccgcacuuccaggcgc

SEQ ID NO: 3512123 - RNA, 21 nt, Pseudomonas aeruginosa PA01
gaagccgcacuuccaggcgcc

SEQ ID NO: 3512124 - RNA, 20 nt, Pseudomonas aeruginosa PA01
gaagccgcccacgggcggcu

SEQ ID NO: 3512125 - RNA, 21 nt, Pseudomonas aeruginosa PA01
gaagccgcccacgggcggcuu

SEQ ID NO: 3512126 - RNA, 15 nt, Pseudomonas aeruginosa PA01
gaagccgccgcccag

SEQ ID NO: 3512127 - RNA, 16 nt, Pseudomonas aeruginosa PA01
gaagccgccgcccagc

SEQ ID NO: 3512128 - RNA, 20 nt, Pseudomonas aeruginosa PA01
gaagccgccgcccagcagca

SEQ ID NO: 3512129 - RNA, 13 nt, Pseudomonas aeruginosa PA01
gaagccgccgccg

SEQ ID NO: 3512130 - RNA, 21 nt, Pseudomonas aeruginosa PA01
gaagccgccguugaugacgaa

SEQ ID NO: 3512131 - RNA, 16 nt, Pseudomonas aeruginosa PA01
gaagccgcgcaaggca

SEQ ID NO: 3512132 - RNA, 22 nt, Pseudomonas aeruginosa PA01
gaagccgcgcagcacuuccuga

SEQ ID NO: 3512133 - RNA, 16 nt, Pseudomonas aeruginosa PA01
gaagccgcgccccagc

SEQ ID NO: 3512134 - RNA, 18 nt, Pseudomonas aeruginosa PA01
gaagccgcgccccagcgg

SEQ ID NO: 3512135 - RNA, 21 nt, Pseudomonas aeruginosa PA01
gaagccgcgccccagcggcag

SEQ ID NO: 3512136 - RNA, 14 nt, Pseudomonas aeruginosa PA01
gaagccgcugaccu

SEQ ID NO: 3512137 - RNA, 17 nt, Pseudomonas aeruginosa PA01
gaagccggauucgcgca

SEQ ID NO: 3512138 - RNA, 20 nt, Pseudomonas aeruginosa PA01
gaagccggauucgcgcagca

SEQ ID NO: 3512139 - RNA, 19 nt, Pseudomonas aeruginosa PA01
gaagccggcacgguagccg

SEQ ID NO: 3512140 - RNA, 15 nt, Pseudomonas aeruginosa PA01
gaagccggccccugg

SEQ ID NO: 3512141 - RNA, 12 nt, Pseudomonas aeruginosa PA01
gaagccggcggc

SEQ ID NO: 3512142 - RNA, 21 nt, Pseudomonas aeruginosa PA01
gaagccggcggcgcggcagug

SEQ ID NO: 3512143 - RNA, 17 nt, Pseudomonas aeruginosa PA01
gaagccgggaagccgcu

SEQ ID NO: 3512144 - RNA, 17 nt, Pseudomonas aeruginosa PA01
gaagccggggcaggcau

SEQ ID NO: 3512145 - RNA, 19 nt, Pseudomonas aeruginosa PA01
gaagccggggcaggcaugc

SEQ ID NO: 3512146 - RNA, 13 nt, Pseudomonas aeruginosa PA01
gaagccgucggcg

SEQ ID NO: 3512147 - RNA, 22 nt, Pseudomonas aeruginosa PA01
gaagccgucggcgaucgccagu

SEQ ID NO: 3512148 - RNA, 14 nt, Pseudomonas aeruginosa PA01
gaagccguggcggg

SEQ ID NO: 3512149 - RNA, 16 nt, Pseudomonas aeruginosa PA01
gaagccugccagaccg

SEQ ID NO: 3512150 - RNA, 14 nt, Pseudomonas aeruginosa PA01
gaagccuucgccca

SEQ ID NO: 3512151 - RNA, 15 nt, Pseudomonas aeruginosa PA01
gaagccuucgcccag

SEQ ID NO: 3512152 - RNA, 15 nt, Pseudomonas aeruginosa PA01
gaagcgaaccaggca

SEQ ID NO: 3512153 - RNA, 16 nt, Pseudomonas aeruginosa PA01
gaagcgaaccaggcaa

SEQ ID NO: 3512154 - RNA, 19 nt, Pseudomonas aeruginosa PA01
gaagcgaccgaucaugccc

SEQ ID NO: 3512155 - RNA, 13 nt, Pseudomonas aeruginosa PA01
gaagcgacugcgc

SEQ ID NO: 3512156 - RNA, 22 nt, Pseudomonas aeruginosa PA01
gaagcgacugcgcuggccgagc

SEQ ID NO: 3512157 - RNA, 20 nt, Pseudomonas aeruginosa PA01
gaagcgaucuccugccgcgg

SEQ ID NO: 3512158 - RNA, 21 nt, Pseudomonas aeruginosa PA01
gaagcgaucuccugccgcggc

SEQ ID NO: 3512159 - RNA, 14 nt, Pseudomonas aeruginosa PA01
gaagcgcagcaggu

SEQ ID NO: 3512160 - RNA, 15 nt, Pseudomonas aeruginosa PA01
gaagcgcagccauuc

SEQ ID NO: 3512161 - RNA, 14 nt, Pseudomonas aeruginosa PA01
gaagcgcagcuccg

SEQ ID NO: 3512162 - RNA, 15 nt, Pseudomonas aeruginosa PA01
gaagcgcagcuccgg

SEQ ID NO: 3512163 - RNA, 20 nt, Pseudomonas aeruginosa PA01
gaagcgcagcuccggcagca

SEQ ID NO: 3512164 - RNA, 22 nt, Pseudomonas aeruginosa PA01
gaagcgcagcuccggcagcagg

SEQ ID NO: 3512165 - RNA, 21 nt, Pseudomonas aeruginosa PA01
gaagcgcaggccgccggcggc

SEQ ID NO: 3512166 - RNA, 22 nt, Pseudomonas aeruginosa PA01
gaagcgcaggccgccggcggcc

SEQ ID NO: 3512167 - RNA, 23 nt, Pseudomonas aeruginosa PA01
gaagcgcaggccgccggcggcca

SEQ ID NO: 3512168 - RNA, 13 nt, Pseudomonas aeruginosa PA01
gaagcgcaggcgg

SEQ ID NO: 3512169 - RNA, 14 nt, Pseudomonas aeruginosa PA01
gaagcgcaggcggc

SEQ ID NO: 3512170 - RNA, 15 nt, Pseudomonas aeruginosa PA01
gaagcgcaggcggcu

SEQ ID NO: 3512171 - RNA, 17 nt, Pseudomonas aeruginosa PA01
gaagcgcaggcggcugg

SEQ ID NO: 3512172 - RNA, 14 nt, Pseudomonas aeruginosa PA01
gaagcgcaggugca

SEQ ID NO: 3512173 - RNA, 12 nt, Pseudomonas aeruginosa PA01
gaagcgccaggc

SEQ ID NO: 3512174 - RNA, 13 nt, Pseudomonas aeruginosa PA01
gaagcgccaggcg

SEQ ID NO: 3512175 - RNA, 20 nt, Pseudomonas aeruginosa PA01
gaagcgcccucgcugagcag

SEQ ID NO: 3512176 - RNA, 14 nt, Pseudomonas aeruginosa PA01
gaagcgccgcggcc

SEQ ID NO: 3512177 - RNA, 19 nt, Pseudomonas aeruginosa PA01
gaagcgccgcggcccggcg

SEQ ID NO: 3512178 - RNA, 15 nt, Pseudomonas aeruginosa PA01
gaagcgccggcggcc

SEQ ID NO: 3512179 - RNA, 17 nt, Pseudomonas aeruginosa PA01
gaagcgccggcggccug

SEQ ID NO: 3512180 - RNA, 13 nt, Pseudomonas aeruginosa PA01
gaagcgccgggcc

SEQ ID NO: 3512181 - RNA, 19 nt, Pseudomonas aeruginosa PA01
gaagcgcgccugcucuucg

SEQ ID NO: 3512182 - RNA, 20 nt, Pseudomonas aeruginosa PA01
gaagcgcgcgccagucccgc

SEQ ID NO: 3512183 - RNA, 20 nt, Pseudomonas aeruginosa PA01
gaagcgcgcgguacccagcu

SEQ ID NO: 3512184 - RNA, 14 nt, Pseudomonas aeruginosa PA01
gaagcgcggcggcg

SEQ ID NO: 3512185 - RNA, 15 nt, Pseudomonas aeruginosa PA01
gaagcgcggcggcgc

SEQ ID NO: 3512186 - RNA, 17 nt, Pseudomonas aeruginosa PA01
gaagcgcucggucagcu

SEQ ID NO: 3512187 - RNA, 16 nt, Pseudomonas aeruginosa PA01
gaagcgcugcucgacc

SEQ ID NO: 3512188 - RNA, 15 nt, Pseudomonas aeruginosa PA01
gaagcgcugcugggc

SEQ ID NO: 3512189 - RNA, 16 nt, Pseudomonas aeruginosa PA01
gaagcgcugcugggcg

SEQ ID NO: 3512190 - RNA, 17 nt, Pseudomonas aeruginosa PA01
gaagcgcugcugggcgg

SEQ ID NO: 3512191 - RNA, 19 nt, Pseudomonas aeruginosa PA01
gaagcgcugcugggcggcg

SEQ ID NO: 3512192 - RNA, 16 nt, Pseudomonas aeruginosa PA01
gaagcgcuucugcagg

SEQ ID NO: 3512193 - RNA, 18 nt, Pseudomonas aeruginosa PA01
gaagcgcuucugcaggcc

SEQ ID NO: 3512194 - RNA, 18 nt, Pseudomonas aeruginosa PA01
gaaccggggcguuacagu

SEQ ID NO: 3512195 - RNA, 15 nt, Pseudomonas aeruginosa PA01
gaaccguggcggccg

SEQ ID NO: 3512196 - RNA, 19 nt, Pseudomonas aeruginosa PA01
gaaccguggcggccgccgc

SEQ ID NO: 3512197 - RNA, 23 nt, Pseudomonas aeruginosa PA01
gaaccgugguucucggucgggcg

SEQ ID NO: 3512198 - RNA, 14 nt, Pseudomonas aeruginosa PA01
gaaccucggcaggc

SEQ ID NO: 3512199 - RNA, 14 nt, Pseudomonas aeruginosa PA01
gaaccugaccaucg

SEQ ID NO: 3512200 - RNA, 19 nt, Pseudomonas aeruginosa PA01
gaaccugaccaucgucgcu

SEQ ID NO: 3512201 - RNA, 16 nt, Pseudomonas aeruginosa PA01
gaaccugcaugucacc

SEQ ID NO: 3512202 - RNA, 21 nt, Pseudomonas aeruginosa PA01
gaaccuguccgaacagggcga

SEQ ID NO: 3512203 - RNA, 17 nt, Pseudomonas aeruginosa PA01
gaacgaaaaaggcgcgc

SEQ ID NO: 3512204 - RNA, 18 nt, Pseudomonas aeruginosa PA01
gaacgaaaaaggcgcgcc

SEQ ID NO: 3512205 - RNA, 21 nt, Pseudomonas aeruginosa PA01
gaacgaaaaaggcgcgccggu

SEQ ID NO: 3512206 - RNA, 20 nt, Pseudomonas aeruginosa PA01
gaacgaagaagccggccccu

SEQ ID NO: 3512207 - RNA, 17 nt, Pseudomonas aeruginosa PA01
gaacgacagcaccaugc

SEQ ID NO: 3512208 - RNA, 21 nt, Pseudomonas aeruginosa PA01
gaacgacagcaccaugcccuu

SEQ ID NO: 3512209 - RNA, 14 nt, Pseudomonas aeruginosa PA01
gaacgacaugcuca

SEQ ID NO: 3512210 - RNA, 14 nt, Pseudomonas aeruginosa PA01
gaacgaccacgccu

SEQ ID NO: 3512211 - RNA, 16 nt, Pseudomonas aeruginosa PA01
gaacgaccgguagcca

SEQ ID NO: 3512212 - RNA, 20 nt, Pseudomonas aeruginosa PA01
gaacgacuccagcuucuucu

SEQ ID NO: 3512213 - RNA, 23 nt, Pseudomonas aeruginosa PA01
gaacgacuccagcuucuucugca

SEQ ID NO: 3512214 - RNA, 13 nt, Pseudomonas aeruginosa PA01
gaacgacucuucg

SEQ ID NO: 3512215 - RNA, 20 nt, Pseudomonas aeruginosa PA01
gaacgagaagccgaucaggu

SEQ ID NO: 3512216 - RNA, 14 nt, Pseudomonas aeruginosa PA01
gaacgagcccaggc

SEQ ID NO: 3512217 - RNA, 16 nt, Pseudomonas aeruginosa PA01
gaacgagcccaggcag

SEQ ID NO: 3512218 - RNA, 17 nt, Pseudomonas aeruginosa PA01
gaacgaggcgacccggg

SEQ ID NO: 3512219 - RNA, 20 nt, Pseudomonas aeruginosa PA01
gaacgaggcucggucgcgcg

SEQ ID NO: 3512220 - RNA, 22 nt, Pseudomonas aeruginosa PA01
gaacgaguugggcgaccugcuc

SEQ ID NO: 3512221 - RNA, 15 nt, Pseudomonas aeruginosa PA01
gaacgaugccgcagg

SEQ ID NO: 3512222 - RNA, 15 nt, Pseudomonas aeruginosa PA01
gaacgaugguggucg

SEQ ID NO: 3512223 - RNA, 22 nt, Pseudomonas aeruginosa PA01
gaacgcacuucguccgccacca

SEQ ID NO: 3512224 - RNA, 19 nt, Pseudomonas aeruginosa PA01
gaacgcaggggcaccggcg

SEQ ID NO: 3512225 - RNA, 20 nt, Pseudomonas aeruginosa PA01
gaacgccaccagggccuugc

SEQ ID NO: 3512226 - RNA, 13 nt, Pseudomonas aeruginosa PA01
gaacgccagccca

SEQ ID NO: 3512227 - RNA, 12 nt, Pseudomonas aeruginosa PA01
gaacgccaggca

SEQ ID NO: 3512228 - RNA, 19 nt, Pseudomonas aeruginosa PA01
gaacgccaggcaggcgguc

SEQ ID NO: 3512229 - RNA, 13 nt, Pseudomonas aeruginosa PA01
gaacgccccgcaa

SEQ ID NO: 3512230 - RNA, 14 nt, Pseudomonas aeruginosa PA01
gaacgcccgcggca

SEQ ID NO: 3512231 - RNA, 19 nt, Pseudomonas aeruginosa PA01
gaacgcccgcggcagcagc

SEQ ID NO: 3512232 - RNA, 23 nt, Pseudomonas aeruginosa PA01
gaacgcccuuguagaucgacagc

SEQ ID NO: 3512233 - RNA, 17 nt, Pseudomonas aeruginosa PA01
gaacgccgacaggccgg

SEQ ID NO: 3512234 - RNA, 18 nt, Pseudomonas aeruginosa PA01
gaacgccgacaggccggu

SEQ ID NO: 3512235 - RNA, 20 nt, Pseudomonas aeruginosa PA01
gaacgccgacaggccggugc

SEQ ID NO: 3512236 - RNA, 18 nt, Pseudomonas aeruginosa PA01
gaacgccgaccgacuggc

SEQ ID NO: 3512237 - RNA, 12 nt, Pseudomonas aeruginosa PA01
gaacgccgcagc

SEQ ID NO: 3512238 - RNA, 17 nt, Pseudomonas aeruginosa PA01
gaacgccgcagcucggc

SEQ ID NO: 3512239 - RNA, 12 nt, Pseudomonas aeruginosa PA01
gaacgccgcgca

SEQ ID NO: 3512240 - RNA, 20 nt, Pseudomonas aeruginosa PA01
gaacgccgcgcaccucgacc

SEQ ID NO: 3512241 - RNA, 22 nt, Pseudomonas aeruginosa PA01
gaacgccgggcaacgccaggcc

SEQ ID NO: 3512242 - RNA, 21 nt, Pseudomonas aeruginosa PA01
gaacgccgggucuucaguggg

SEQ ID NO: 3512243 - RNA, 22 nt, Pseudomonas aeruginosa PA01
gaacgccucgcagagcgccagc

SEQ ID NO: 3512244 - RNA, 16 nt, Pseudomonas aeruginosa PA01
gaacgccucugcgcug

SEQ ID NO: 3512245 - RNA, 12 nt, Pseudomonas aeruginosa PA01
gaacgcgccacg

SEQ ID NO: 3512246 - RNA, 12 nt, Pseudomonas aeruginosa PA01
gaacgcgcccgg

SEQ ID NO: 3512247 - RNA, 14 nt, Pseudomonas aeruginosa PA01
gaacgcgcccggcc

SEQ ID NO: 3512248 - RNA, 17 nt, Pseudomonas aeruginosa PA01
gaacgcgcccggccagg

SEQ ID NO: 3512249 - RNA, 18 nt, Pseudomonas aeruginosa PA01
gaacgcgcccggccaggc

SEQ ID NO: 3512250 - RNA, 20 nt, Pseudomonas aeruginosa PA01
gaacgcgcccggccaggccg

SEQ ID NO: 3512251 - RNA, 21 nt, Pseudomonas aeruginosa PA01
gaacgcguaggggaccacccc

SEQ ID NO: 3512252 - RNA, 19 nt, Pseudomonas aeruginosa PA01
gaacgcgugaagcuggagc

SEQ ID NO: 3512253 - RNA, 15 nt, Pseudomonas aeruginosa PA01
gaacgcuucgaagcu

SEQ ID NO: 3512254 - RNA, 17 nt, Pseudomonas aeruginosa PA01
gaacgcuugagccccgg

SEQ ID NO: 3512255 - RNA, 15 nt, Pseudomonas aeruginosa PA01
gaacggaacggaccu

SEQ ID NO: 3512256 - RNA, 21 nt, Pseudomonas aeruginosa PA01
gaacggaccugagaucagcgc

SEQ ID NO: 3512257 - RNA, 16 nt, Pseudomonas aeruginosa PA01
gaacggaucgcucucg

SEQ ID NO: 3512258 - RNA, 21 nt, Pseudomonas aeruginosa PA01
gaacggaucgcucucgcgcuu

SEQ ID NO: 3512259 - RNA, 19 nt, Pseudomonas aeruginosa PA01
gaacggcagcgucucagcc

SEQ ID NO: 3512260 - RNA, 23 nt, Pseudomonas aeruginosa PA01
gaacggcagcuggauccgugcca

SEQ ID NO: 3512261 - RNA, 22 nt, Pseudomonas aeruginosa PA01
gaacggcagguggucguugcgc

SEQ ID NO: 3512262 - RNA, 14 nt, Pseudomonas aeruginosa PA01
gaacggcaucucga

SEQ ID NO: 3512263 - RNA, 23 nt, Pseudomonas aeruginosa PA01
gaacggcaucuucaaucgcgcgu

SEQ ID NO: 3512264 - RNA, 19 nt, Pseudomonas aeruginosa PA01
gaacggccaggucuucugg

SEQ ID NO: 3512265 - RNA, 21 nt, Pseudomonas aeruginosa PA01
gaacggccaggucuucuggaa

SEQ ID NO: 3512266 - RNA, 16 nt, Pseudomonas aeruginosa PA01
gaacggcccgcucuug

SEQ ID NO: 3512267 - RNA, 12 nt, Pseudomonas aeruginosa PA01
gaacggcgcuuc

SEQ ID NO: 3512268 - RNA, 16 nt, Pseudomonas aeruginosa PA01
gaacggcgcuucaacu

SEQ ID NO: 3512269 - RNA, 19 nt, Pseudomonas aeruginosa PA01
gaacggcgugagggucgcg

SEQ ID NO: 3512270 - RNA, 22 nt, Pseudomonas aeruginosa PA01
gaacggcgugagggucgcgccg

SEQ ID NO: 3512271 - RNA, 20 nt, Pseudomonas aeruginosa PA01
gaacggcucaauccggcugg

SEQ ID NO: 3512272 - RNA, 14 nt, Pseudomonas aeruginosa PA01
gaacggcuggucgg

SEQ ID NO: 3512273 - RNA, 18 nt, Pseudomonas aeruginosa PA01
gaacggcuggucggcuuc

SEQ ID NO: 3512274 - RNA, 20 nt, Pseudomonas aeruginosa PA01
gaacggcuuguucagcucgg

SEQ ID NO: 3512275 - RNA, 12 nt, Pseudomonas aeruginosa PA01
gaacgggaagua

SEQ ID NO: 3512276 - RNA, 21 nt, Pseudomonas aeruginosa PA01
gaacgggacgccuggcguccc

SEQ ID NO: 3512277 - RNA, 13 nt, Pseudomonas aeruginosa PA01
gaacgggcucacc

SEQ ID NO: 3512278 - RNA, 17 nt, Pseudomonas aeruginosa PA01
gaacggguugaucaggu

SEQ ID NO: 3512279 - RNA, 21 nt, Pseudomonas aeruginosa PA01
gaacggguugaucagguucgg

SEQ ID NO: 3512280 - RNA, 14 nt, Pseudomonas aeruginosa PA01
gaacgucucggcga

SEQ ID NO: 3512281 - RNA, 16 nt, Pseudomonas aeruginosa PA01
gaacgugcgcgcaacu

SEQ ID NO: 3512282 - RNA, 15 nt, Pseudomonas aeruginosa PA01
gaacgugcggccugc

SEQ ID NO: 3512283 - RNA, 20 nt, Pseudomonas aeruginosa PA01
gaacguucaguucugggcgg

SEQ ID NO: 3512284 - RNA, 23 nt, Pseudomonas aeruginosa PA01
gaacguucaguucugggcggcca

SEQ ID NO: 3512285 - RNA, 15 nt, Pseudomonas aeruginosa PA01
gaacuagcccucgac

SEQ ID NO: 3512286 - RNA, 21 nt, Pseudomonas aeruginosa PA01
gaacuagcccucgaccuggcu

SEQ ID NO: 3512287 - RNA, 23 nt, Pseudomonas aeruginosa PA01
gaacucaacgaagugaagcgauc

SEQ ID NO: 3512288 - RNA, 14 nt, Pseudomonas aeruginosa PA01
gaacucaugcaggc

SEQ ID NO: 3512289 - RNA, 15 nt, Pseudomonas aeruginosa PA01
gaacucaugcaggcc

SEQ ID NO: 3512290 - RNA, 17 nt, Pseudomonas aeruginosa PA01
gaacucaugcaggccga

SEQ ID NO: 3512291 - RNA, 18 nt, Pseudomonas aeruginosa PA01
gaacucauucaucucgcc

SEQ ID NO: 3512292 - RNA, 22 nt, Pseudomonas aeruginosa PA01
gaacuccaccgguuucgccagu

SEQ ID NO: 3512293 - RNA, 17 nt, Pseudomonas aeruginosa PA01
gaacuccaucucgcggc

SEQ ID NO: 3512294 - RNA, 15 nt, Pseudomonas aeruginosa PA01
gaacuccgccagcac

SEQ ID NO: 3512295 - RNA, 16 nt, Pseudomonas aeruginosa PA01
gaacuccgccagcacc

SEQ ID NO: 3512296 - RNA, 14 nt, Pseudomonas aeruginosa PA01
gaacuccgccagcu

SEQ ID NO: 3512297 - RNA, 16 nt, Pseudomonas aeruginosa PA01
gaacuccgccagcuug

SEQ ID NO: 3512298 - RNA, 22 nt, Pseudomonas aeruginosa PA01
gaacuccggggugaagcucuuc

SEQ ID NO: 3512299 - RNA, 20 nt, Pseudomonas aeruginosa PA01
gaacucgaacgcgugaagcu

SEQ ID NO: 3512300 - RNA, 17 nt, Pseudomonas aeruginosa PA01
gaacucgaaggccagcu

SEQ ID NO: 3512301 - RNA, 23 nt, Pseudomonas aeruginosa PA01
gaacucgaaggccagcucgucgc

SEQ ID NO: 3512302 - RNA, 18 nt, Pseudomonas aeruginosa PA01
gaacucgacuucuucgcu

SEQ ID NO: 3512303 - RNA, 15 nt, Pseudomonas aeruginosa PA01
gaacucgaucagcgc

SEQ ID NO: 3512304 - RNA, 17 nt, Pseudomonas aeruginosa PA01
gaacucgaucagcgcgg

SEQ ID NO: 3512305 - RNA, 18 nt, Pseudomonas aeruginosa PA01
gaacucgaucagcgcggc

SEQ ID NO: 3512306 - RNA, 21 nt, Pseudomonas aeruginosa PA01
gaacucgaucagcgcggccac

SEQ ID NO: 3512307 - RNA, 23 nt, Pseudomonas aeruginosa PA01
gaacucgcccucgaucuugccgg

SEQ ID NO: 3512308 - RNA, 19 nt, Pseudomonas aeruginosa PA01
gaacucggcgcugccggcc

SEQ ID NO: 3512309 - RNA, 20 nt, Pseudomonas aeruginosa PA01
gaacucggcgcugccggcca

SEQ ID NO: 3512310 - RNA, 16 nt, Pseudomonas aeruginosa PA01
gaacucguccggucgc

SEQ ID NO: 3512311 - RNA, 21 nt, Pseudomonas aeruginosa PA01
gaacucguccggucgcaccgc

SEQ ID NO: 3512312 - RNA, 14 nt, Pseudomonas aeruginosa PA01
gaacucuggcggcg

SEQ ID NO: 3512313 - RNA, 14 nt, Pseudomonas aeruginosa PA01
gaacugaccaccag

SEQ ID NO: 3512314 - RNA, 15 nt, Pseudomonas aeruginosa PA01
gaacugaccaccagg

SEQ ID NO: 3512315 - RNA, 15 nt, Pseudomonas aeruginosa PA01
gaacugcacgcccau

SEQ ID NO: 3512316 - RNA, 17 nt, Pseudomonas aeruginosa PA01
gaacugcacgcccaucg

SEQ ID NO: 3512317 - RNA, 11 nt, Pseudomonas aeruginosa PA01
gaacugcaggg

SEQ ID NO: 3512318 - RNA, 19 nt, Pseudomonas aeruginosa PA01
gaacugcagggcgucgccg

SEQ ID NO: 3512319 - RNA, 13 nt, Pseudomonas aeruginosa PA01
gaacugcccgcag

SEQ ID NO: 3512320 - RNA, 15 nt, Pseudomonas aeruginosa PA01
gaacugcccgcaggg

SEQ ID NO: 3512321 - RNA, 19 nt, Pseudomonas aeruginosa PA01
gaacugccgacggcggcgg

SEQ ID NO: 3512322 - RNA, 19 nt, Pseudomonas aeruginosa PA01
gaacugcgguccggcgaag

SEQ ID NO: 3512323 - RNA, 21 nt, Pseudomonas aeruginosa PA01
gaacugcucgaaagccuccag

SEQ ID NO: 3512324 - RNA, 22 nt, Pseudomonas aeruginosa PA01
gaacugcucggcguccagcagg

SEQ ID NO: 3512325 - RNA, 16 nt, Pseudomonas aeruginosa PA01
gaacuggaagccugcc

SEQ ID NO: 3512326 - RNA, 17 nt, Pseudomonas aeruginosa PA01
gaacuggaagccugcca

SEQ ID NO: 3512327 - RNA, 20 nt, Pseudomonas aeruginosa PA01
gaacuggaucggccccaccu

SEQ ID NO: 3512328 - RNA, 17 nt, Pseudomonas aeruginosa PA01
gaacuggaugucgcugg

SEQ ID NO: 3512329 - RNA, 15 nt, Pseudomonas aeruginosa PA01
gaacuggucgauccg

SEQ ID NO: 3512330 - RNA, 16 nt, Pseudomonas aeruginosa PA01
gaacuggucgauccgc

SEQ ID NO: 3512331 - RNA, 21 nt, Pseudomonas aeruginosa PA01
gaacuggucgauccgcgccug

SEQ ID NO: 3512332 - RNA, 22 nt, Pseudomonas aeruginosa PA01
gaacuggucgauccgcgccugc

SEQ ID NO: 3512333 - RNA, 23 nt, Pseudomonas aeruginosa PA01
gaacuggucgauccgcgccugcu

SEQ ID NO: 3512334 - RNA, 16 nt, Pseudomonas aeruginosa PA01
gaacuggucgcuccag

SEQ ID NO: 3512335 - RNA, 21 nt, Pseudomonas aeruginosa PA01
gaacuggucgcuccagcccca

SEQ ID NO: 3512336 - RNA, 16 nt, Pseudomonas aeruginosa PA01
gaacuucaggccggcg

SEQ ID NO: 3512337 - RNA, 15 nt, Pseudomonas aeruginosa PA01
gaacuucagggcucc

SEQ ID NO: 3512338 - RNA, 23 nt, Pseudomonas aeruginosa PA01
gaacuucuccagguacagccgca

SEQ ID NO: 3512339 - RNA, 14 nt, Pseudomonas aeruginosa PA01
gaacuucuccgcca

SEQ ID NO: 3512340 - RNA, 14 nt, Pseudomonas aeruginosa PA01
gaacuugcgcaccg

SEQ ID NO: 3512341 - RNA, 21 nt, Pseudomonas aeruginosa PA01
gaacuugcgcaccgcgccggg

SEQ ID NO: 3512342 - RNA, 22 nt, Pseudomonas aeruginosa PA01
gaacuugucgaccacgcucuug

SEQ ID NO: 3512343 - RNA, 14 nt, Pseudomonas aeruginosa PA01
gaacuugucgccgc

SEQ ID NO: 3512344 - RNA, 17 nt, Pseudomonas aeruginosa PA01
gaacuugucgccgcugg

SEQ ID NO: 3512345 - RNA, 23 nt, Pseudomonas aeruginosa PA01
gaagaacagcgggucgcggcugg

SEQ ID NO: 3512346 - RNA, 16 nt, Pseudomonas aeruginosa PA01
gaagaacaucgccugc

SEQ ID NO: 3512347 - RNA, 21 nt, Pseudomonas aeruginosa PA01
gaagaacuccaucucgcggcg

SEQ ID NO: 3512348 - RNA, 17 nt, Pseudomonas aeruginosa PA01
gaagaacucggcgcugc

SEQ ID NO: 3512349 - RNA, 20 nt, Pseudomonas aeruginosa PA01
gaagaacucggcgcugccgg

SEQ ID NO: 3512350 - RNA, 14 nt, Pseudomonas aeruginosa PA01
gaagaagccauugc

SEQ ID NO: 3512351 - RNA, 19 nt, Pseudomonas aeruginosa PA01
gaagaagcugccccacagg

SEQ ID NO: 3512352 - RNA, 14 nt, Pseudomonas aeruginosa PA01
gaagaagcugccgg

SEQ ID NO: 3512353 - RNA, 16 nt, Pseudomonas aeruginosa PA01
gaagaagcugccggca

SEQ ID NO: 3512354 - RNA, 12 nt, Pseudomonas aeruginosa PA01
gaagaaggcgau

SEQ ID NO: 3512355 - RNA, 15 nt, Pseudomonas aeruginosa PA01
gaagaaggcucaccg

SEQ ID NO: 3512356 - RNA, 17 nt, Pseudomonas aeruginosa PA01
gaagaccagggugggga

SEQ ID NO: 3512357 - RNA, 20 nt, Pseudomonas aeruginosa PA01
gaagacccccugccgcccuc

SEQ ID NO: 3512358 - RNA, 14 nt, Pseudomonas aeruginosa PA01
gaagaccggccggc

SEQ ID NO: 3512359 - RNA, 15 nt, Pseudomonas aeruginosa PA01
gaagaccggccggcu

SEQ ID NO: 3512360 - RNA, 22 nt, Pseudomonas aeruginosa PA01
gaagacgaaguugagcaccggc

SEQ ID NO: 3512361 - RNA, 20 nt, Pseudomonas aeruginosa PA01
gaagacgaaguuggcggccg

SEQ ID NO: 3512362 - RNA, 19 nt, Pseudomonas aeruginosa PA01
gaagacgcccagcagggcc

SEQ ID NO: 3512363 - RNA, 21 nt, Pseudomonas aeruginosa PA01
gaagacgcccagcagggccag

SEQ ID NO: 3512364 - RNA, 18 nt, Pseudomonas aeruginosa PA01
gaagacgccugucggcac

SEQ ID NO: 3512365 - RNA, 22 nt, Pseudomonas aeruginosa PA01
gaagacguacagcgggucggcg

SEQ ID NO: 3512366 - RNA, 24 nt, Pseudomonas aeruginosa PA01
gaagagcaccuugucgcugaccgg

SEQ ID NO: 3512367 - RNA, 17 nt, Pseudomonas aeruginosa PA01
gaagagcccgccacgcu

SEQ ID NO: 3512368 - RNA, 14 nt, Pseudomonas aeruginosa PA01
gaagagcgccgcgg

SEQ ID NO: 3512369 - RNA, 18 nt, Pseudomonas aeruginosa PA01
gaagagcgccgcggcggc

SEQ ID NO: 3512370 - RNA, 20 nt, Pseudomonas aeruginosa PA01
gaagagcgccgcggcggcgu

SEQ ID NO: 3512371 - RNA, 23 nt, Pseudomonas aeruginosa PA01
gaagagcucccugccgcccuucg

SEQ ID NO: 3512372 - RNA, 16 nt, Pseudomonas aeruginosa PA01
gaagagcuggcggccg

SEQ ID NO: 3512373 - RNA, 22 nt, Pseudomonas aeruginosa PA01
gaagaggcccucggcgccgagc

SEQ ID NO: 3512374 - RNA, 23 nt, Pseudomonas aeruginosa PA01
gaagaggcccucggcgccgagca

SEQ ID NO: 3512375 - RNA, 23 nt, Pseudomonas aeruginosa PA01
gaagaguucgcugaaggucgccg

SEQ ID NO: 3512376 - RNA, 21 nt, Pseudomonas aeruginosa PA01
gaagauauaacgcgagccaca

SEQ ID NO: 3512377 - RNA, 22 nt, Pseudomonas aeruginosa PA01
gaagauccuguaguacaugacg

SEQ ID NO: 3512378 - RNA, 14 nt, Pseudomonas aeruginosa PA01
gaagaucgacaggc

SEQ ID NO: 3512379 - RNA, 12 nt, Pseudomonas aeruginosa PA01
gaagaucgccac

SEQ ID NO: 3512380 - RNA, 20 nt, Pseudomonas aeruginosa PA01
gaagaucggauugaggacgc

SEQ ID NO: 3512381 - RNA, 16 nt, Pseudomonas aeruginosa PA01
gaagauuccgcugagg

SEQ ID NO: 3512382 - RNA, 21 nt, Pseudomonas aeruginosa PA01
gaagcacgcucuucuuacagc

SEQ ID NO: 3512383 - RNA, 22 nt, Pseudomonas aeruginosa PA01
gaagcagaacgccccgcauugc

SEQ ID NO: 3512384 - RNA, 13 nt, Pseudomonas aeruginosa PA01
gaagcagagggcg

SEQ ID NO: 3512385 - RNA, 14 nt, Pseudomonas aeruginosa PA01
gaagcagccauggc

SEQ ID NO: 3512386 - RNA, 12 nt, Pseudomonas aeruginosa PA01
gaagcagcccag

SEQ ID NO: 3512387 - RNA, 23 nt, Pseudomonas aeruginosa PA01
gaagcagcccagcgcuuccucgg

SEQ ID NO: 3512388 - RNA, 22 nt, Pseudomonas aeruginosa PA01
gaagcaggcggaguagccggcg

SEQ ID NO: 3512389 - RNA, 15 nt, Pseudomonas aeruginosa PA01
gaagcauggccggcu

SEQ ID NO: 3512390 - RNA, 17 nt, Pseudomonas aeruginosa PA01
gaagcauggccggcuac

SEQ ID NO: 3512391 - RNA, 11 nt, Pseudomonas aeruginosa PA01
gaagccaggca

SEQ ID NO: 3512392 - RNA, 14 nt, Pseudomonas aeruginosa PA01
gaagccaggcaccg

SEQ ID NO: 3512393 - RNA, 13 nt, Pseudomonas aeruginosa PA01
gaagcccagcagg

SEQ ID NO: 3512394 - RNA, 23 nt, Pseudomonas aeruginosa PA01
gaagcccagcaggucgaucucga

SEQ ID NO: 3512395 - RNA, 15 nt, Pseudomonas aeruginosa PA01
gaagcccagcgagcc

SEQ ID NO: 3512396 - RNA, 20 nt, Pseudomonas aeruginosa PA01
gaagcccagcgagccgauca

SEQ ID NO: 3512397 - RNA, 14 nt, Pseudomonas aeruginosa PA01
gaagcccagcgccu

SEQ ID NO: 3512398 - RNA, 13 nt, Pseudomonas aeruginosa PA01
gaagcccaggcgc

SEQ ID NO: 3512399 - RNA, 17 nt, Pseudomonas aeruginosa PA01
gaagcccaggcgcucgg

SEQ ID NO: 3512400 - RNA, 22 nt, Pseudomonas aeruginosa PA01
accccgaaguagcgacggaagc

SEQ ID NO: 3512401 - RNA, 23 nt, Pseudomonas aeruginosa PA01
accccgaccacccuguccugcuc

SEQ ID NO: 3512402 - RNA, 18 nt, Pseudomonas aeruginosa PA01
accccgaccagcgcgcuc

SEQ ID NO: 3512403 - RNA, 17 nt, Pseudomonas aeruginosa PA01
accccgaggucggcgaa

SEQ ID NO: 3512404 - RNA, 14 nt, Pseudomonas aeruginosa PA01
accccgaucaccgg

SEQ ID NO: 3512405 - RNA, 15 nt, Pseudomonas aeruginosa PA01
accccgccaaggcgg

SEQ ID NO: 3512406 - RNA, 14 nt, Pseudomonas aeruginosa PA01
accccgcccuuggc

SEQ ID NO: 3512407 - RNA, 19 nt, Pseudomonas aeruginosa PA01
accccgccgcgcaucaccc

SEQ ID NO: 3512408 - RNA, 22 nt, Pseudomonas aeruginosa PA01
accccgccgcgcaucaccccgc

SEQ ID NO: 3512409 - RNA, 16 nt, Pseudomonas aeruginosa PA01
accccgccgcuggcgg

SEQ ID NO: 3512410 - RNA, 21 nt, Pseudomonas aeruginosa PA01
accccgccggcguucgacgcc

SEQ ID NO: 3512411 - RNA, 22 nt, Pseudomonas aeruginosa PA01
accccgccggcguucgacgccu

SEQ ID NO: 3512412 - RNA, 23 nt, Pseudomonas aeruginosa PA01
accccgccggggcgugcaggccg

SEQ ID NO: 3512413 - RNA, 17 nt, Pseudomonas aeruginosa PA01
accccgcggccgaggaa

SEQ ID NO: 3512414 - RNA, 15 nt, Pseudomonas aeruginosa PA01
accccggacugcccg

SEQ ID NO: 3512415 - RNA, 19 nt, Pseudomonas aeruginosa PA01
accccggccuccaggcugg

SEQ ID NO: 3512416 - RNA, 20 nt, Pseudomonas aeruginosa PA01
accccggccuccaggcuggc

SEQ ID NO: 3512417 - RNA, 12 nt, Pseudomonas aeruginosa PA01
accccggccugg

SEQ ID NO: 3512418 - RNA, 14 nt, Pseudomonas aeruginosa PA01
accccggccuggcg

SEQ ID NO: 3512419 - RNA, 16 nt, Pseudomonas aeruginosa PA01
accccggccuggcgcc

SEQ ID NO: 3512420 - RNA, 23 nt, Pseudomonas aeruginosa PA01
accccggcgaucuucagguaggc

SEQ ID NO: 3512421 - RNA, 14 nt, Pseudomonas aeruginosa PA01
accccggcggcgcg

SEQ ID NO: 3512422 - RNA, 17 nt, Pseudomonas aeruginosa PA01
accccgggucgcgcagc

SEQ ID NO: 3512423 - RNA, 22 nt, Pseudomonas aeruginosa PA01
accccgggucgcgcagcggcuc

SEQ ID NO: 3512424 - RNA, 23 nt, Pseudomonas aeruginosa PA01
accccgggucgcgcagcggcucc

SEQ ID NO: 3512425 - RNA, 23 nt, Pseudomonas aeruginosa PA01
accccggucauggugccgagcag

SEQ ID NO: 3512426 - RNA, 18 nt, Pseudomonas aeruginosa PA01
accccggugugcgcugca

SEQ ID NO: 3512427 - RNA, 16 nt, Pseudomonas aeruginosa PA01
accccguagcgcucgg

SEQ ID NO: 3512428 - RNA, 18 nt, Pseudomonas aeruginosa PA01
accccgucaacccuugcu

SEQ ID NO: 3512429 - RNA, 16 nt, Pseudomonas aeruginosa PA01
accccgucgacgcccu

SEQ ID NO: 3512430 - RNA, 20 nt, Pseudomonas aeruginosa PA01
accccgucgacgcccugggc

SEQ ID NO: 3512431 - RNA, 14 nt, Pseudomonas aeruginosa PA01
accccguuguaccc

SEQ ID NO: 3512432 - RNA, 23 nt, Pseudomonas aeruginosa PA01
accccuucgagcaacacaugcag

SEQ ID NO: 3512433 - RNA, 21 nt, Pseudomonas aeruginosa PA01
accccuucggucgcgccccgc

SEQ ID NO: 3512434 - RNA, 22 nt, Pseudomonas aeruginosa PA01
accccuucggucgcgccccgcc

SEQ ID NO: 3512435 - RNA, 23 nt, Pseudomonas aeruginosa PA01
accccuucggucgcgccccgcca

SEQ ID NO: 3512436 - RNA, 17 nt, Pseudomonas aeruginosa PA01
accccuuugccgagcgg

SEQ ID NO: 3512437 - RNA, 18 nt, Pseudomonas aeruginosa PA01
acccgaaucccuuggcug

SEQ ID NO: 3512438 - RNA, 16 nt, Pseudomonas aeruginosa PA01
acccgacaggcagcgc

SEQ ID NO: 3512439 - RNA, 18 nt, Pseudomonas aeruginosa PA01
acccgacaggcagcgccg

SEQ ID NO: 3512440 - RNA, 13 nt, Pseudomonas aeruginosa PA01
acccgagcaacug

SEQ ID NO: 3512441 - RNA, 15 nt, Pseudomonas aeruginosa PA01
acccgcaacaccugu

SEQ ID NO: 3512442 - RNA, 13 nt, Pseudomonas aeruginosa PA01
acccgcaccggca

SEQ ID NO: 3512443 - RNA, 19 nt, Pseudomonas aeruginosa PA01
acccgcaccgguucgacac

SEQ ID NO: 3512444 - RNA, 17 nt, Pseudomonas aeruginosa PA01
acccgcaccuugcccug

SEQ ID NO: 3512445 - RNA, 17 nt, Pseudomonas aeruginosa PA01
acccgcagccgcgugcg

SEQ ID NO: 3512446 - RNA, 13 nt, Pseudomonas aeruginosa PA01
acccgcagcggca

SEQ ID NO: 3512447 - RNA, 13 nt, Pseudomonas aeruginosa PA01
acccgcagggcuc

SEQ ID NO: 3512448 - RNA, 19 nt, Pseudomonas aeruginosa PA01
acccgcaguuccuugggca

SEQ ID NO: 3512449 - RNA, 17 nt, Pseudomonas aeruginosa PA01
acccgcaucgaggccgc

SEQ ID NO: 3512450 - RNA, 22 nt, Pseudomonas aeruginosa PA01
acccgcaucgaggccgcccagc

SEQ ID NO: 3512451 - RNA, 11 nt, Pseudomonas aeruginosa PA01
acccgccagcg

SEQ ID NO: 3512452 - RNA, 14 nt, Pseudomonas aeruginosa PA01
acccgccagcggca

SEQ ID NO: 3512453 - RNA, 17 nt, Pseudomonas aeruginosa PA01
acccgccccugcuccuc

SEQ ID NO: 3512454 - RNA, 21 nt, Pseudomonas aeruginosa PA01
acccgccccugcuccucgccg

SEQ ID NO: 3512455 - RNA, 14 nt, Pseudomonas aeruginosa PA01
acccgcccgccguc

SEQ ID NO: 3512456 - RNA, 22 nt, Pseudomonas aeruginosa PA01
acccgcccgccguccuccagca

SEQ ID NO: 3512457 - RNA, 13 nt, Pseudomonas aeruginosa PA01
acccgcccggcuc

SEQ ID NO: 3512458 - RNA, 12 nt, Pseudomonas aeruginosa PA01
acccgccgcugg

SEQ ID NO: 3512459 - RNA, 15 nt, Pseudomonas aeruginosa PA01
acccgcgaagccugc

SEQ ID NO: 3512460 - RNA, 17 nt, Pseudomonas aeruginosa PA01
acccgcgaccacaggcg

SEQ ID NO: 3512461 - RNA, 16 nt, Pseudomonas aeruginosa PA01
acccgcgacucgagca

SEQ ID NO: 3512462 - RNA, 17 nt, Pseudomonas aeruginosa PA01
acccgcgacucgagcac

SEQ ID NO: 3512463 - RNA, 23 nt, Pseudomonas aeruginosa PA01
acccgcgccgccgcggccagccc

SEQ ID NO: 3512464 - RNA, 14 nt, Pseudomonas aeruginosa PA01
acccgcgccggcag

SEQ ID NO: 3512465 - RNA, 15 nt, Pseudomonas aeruginosa PA01
acccgcgccggcagc

SEQ ID NO: 3512466 - RNA, 17 nt, Pseudomonas aeruginosa PA01
acccgcgcuucuucgac

SEQ ID NO: 3512467 - RNA, 14 nt, Pseudomonas aeruginosa PA01
acccgcggcgaggu

SEQ ID NO: 3512468 - RNA, 13 nt, Pseudomonas aeruginosa PA01
acccgcggcgcgc

SEQ ID NO: 3512469 - RNA, 16 nt, Pseudomonas aeruginosa PA01
acccgcgucccuugcg

SEQ ID NO: 3512470 - RNA, 14 nt, Pseudomonas aeruginosa PA01
acccgcuccggcuc

SEQ ID NO: 3512471 - RNA, 15 nt, Pseudomonas aeruginosa PA01
acccgcuccggcucu

SEQ ID NO: 3512472 - RNA, 14 nt, Pseudomonas aeruginosa PA01
acccgcuccgucgc

SEQ ID NO: 3512473 - RNA, 14 nt, Pseudomonas aeruginosa PA01
acccgcucgccggg

SEQ ID NO: 3512474 - RNA, 17 nt, Pseudomonas aeruginosa PA01
acccgcucggccuuagc

SEQ ID NO: 3512475 - RNA, 21 nt, Pseudomonas aeruginosa PA01
acccgcucggccuuagcgguu

SEQ ID NO: 3512476 - RNA, 18 nt, Pseudomonas aeruginosa PA01
acccgcugcaacuccgcc

SEQ ID NO: 3512477 - RNA, 13 nt, Pseudomonas aeruginosa PA01
acccgcugcacca

SEQ ID NO: 3512478 - RNA, 15 nt, Pseudomonas aeruginosa PA01
acccgcugcggaaga

SEQ ID NO: 3512479 - RNA, 21 nt, Pseudomonas aeruginosa PA01
acccgcugguaauccagggag

SEQ ID NO: 3512480 - RNA, 16 nt, Pseudomonas aeruginosa PA01
acccgcuguccgccgg

SEQ ID NO: 3512481 - RNA, 20 nt, Pseudomonas aeruginosa PA01
acccgcuguuucuccaguuc

SEQ ID NO: 3512482 - RNA, 22 nt, Pseudomonas aeruginosa PA01
acccgcuguuucuccaguucgg

SEQ ID NO: 3512483 - RNA, 20 nt, Pseudomonas aeruginosa PA01
acccgcuucgucggucgcga

SEQ ID NO: 3512484 - RNA, 21 nt, Pseudomonas aeruginosa PA01
acccgcuucgucggucgcgac

SEQ ID NO: 3512485 - RNA, 18 nt, Pseudomonas aeruginosa PA01
acccggauaccccgguug

SEQ ID NO: 3512486 - RNA, 22 nt, Pseudomonas aeruginosa PA01
acccggaucaugguauggagaa

SEQ ID NO: 3512487 - RNA, 14 nt, Pseudomonas aeruginosa PA01
acccggccagcccg

SEQ ID NO: 3512488 - RNA, 15 nt, Pseudomonas aeruginosa PA01
acccggccagcccgg

SEQ ID NO: 3512489 - RNA, 20 nt, Pseudomonas aeruginosa PA01
acccggccagcccggccucg

SEQ ID NO: 3512490 - RNA, 21 nt, Pseudomonas aeruginosa PA01
acccggccagcccggccucgc

SEQ ID NO: 3512491 - RNA, 20 nt, Pseudomonas aeruginosa PA01
acccggcccagcguucggcg

SEQ ID NO: 3512492 - RNA, 17 nt, Pseudomonas aeruginosa PA01
acccggcccauggcgac

SEQ ID NO: 3512493 - RNA, 17 nt, Pseudomonas aeruginosa PA01
acccggccgaccaggug

SEQ ID NO: 3512494 - RNA, 20 nt, Pseudomonas aeruginosa PA01
acccggccgccuuccucggc

SEQ ID NO: 3512495 - RNA, 24 nt, Pseudomonas aeruginosa PA01
acccggccgcgcucgacggucagc

SEQ ID NO: 3512496 - RNA, 19 nt, Pseudomonas aeruginosa PA01
acccggcgcacgccggccu

SEQ ID NO: 3512497 - RNA, 22 nt, Pseudomonas aeruginosa PA01
acccggcgcacgccggccucgc

SEQ ID NO: 3512498 - RNA, 16 nt, Pseudomonas aeruginosa PA01
acccggcgcggcgcag

SEQ ID NO: 3512499 - RNA, 21 nt, Pseudomonas aeruginosa PA01
acccggcgcggcgcagccaga

SEQ ID NO: 3512500 - RNA, 16 nt, Pseudomonas aeruginosa PA01
acccggcgcuggccgc

SEQ ID NO: 3512501 - RNA, 21 nt, Pseudomonas aeruginosa PA01
acccggcuggguucggcgagg

SEQ ID NO: 3512502 - RNA, 23 nt, Pseudomonas aeruginosa PA01
augccggccucgacgcagagcgc

SEQ ID NO: 3512503 - RNA, 23 nt, Pseudomonas aeruginosa PA01
augccggcgcugucucgccagcc

SEQ ID NO: 3512504 - RNA, 22 nt, Pseudomonas aeruginosa PA01
augccgggcgagucgaucaggu

SEQ ID NO: 3512505 - RNA, 14 nt, Pseudomonas aeruginosa PA01
augccgggguggag

SEQ ID NO: 3512506 - RNA, 23 nt, Pseudomonas aeruginosa PA01
augccgggguggaguaccaggcc

SEQ ID NO: 3512507 - RNA, 20 nt, Pseudomonas aeruginosa PA01
augccggugggcuuucccug

SEQ ID NO: 3512508 - RNA, 18 nt, Pseudomonas aeruginosa PA01
augccgguucccgcagcg

SEQ ID NO: 3512509 - RNA, 19 nt, Pseudomonas aeruginosa PA01
augccguacaggucggcgc

SEQ ID NO: 3512510 - RNA, 22 nt, Pseudomonas aeruginosa PA01
augccgugccguggaccaacag

SEQ ID NO: 3512511 - RNA, 19 nt, Pseudomonas aeruginosa PA01
augccgugggcgccgccgg

SEQ ID NO: 3512512 - RNA, 13 nt, Pseudomonas aeruginosa PA01
augccguucacua

SEQ ID NO: 3512513 - RNA, 16 nt, Pseudomonas aeruginosa PA01
augccguucacuaucu

SEQ ID NO: 3512514 - RNA, 17 nt, Pseudomonas aeruginosa PA01
augccguucaggccggc

SEQ ID NO: 3512515 - RNA, 14 nt, Pseudomonas aeruginosa PA01
augccguucaggcg

SEQ ID NO: 3512516 - RNA, 20 nt, Pseudomonas aeruginosa PA01
augccguugcccucgcgcug

SEQ ID NO: 3512517 - RNA, 18 nt, Pseudomonas aeruginosa PA01
augccguugggccagggc

SEQ ID NO: 3512518 - RNA, 20 nt, Pseudomonas aeruginosa PA01
augccguuguggcaggcgcu

SEQ ID NO: 3512519 - RNA, 21 nt, Pseudomonas aeruginosa PA01
augccguuguggcaggcgcug

SEQ ID NO: 3512520 - RNA, 16 nt, Pseudomonas aeruginosa PA01
augccuagcacccggg

SEQ ID NO: 3512521 - RNA, 13 nt, Pseudomonas aeruginosa PA01
augccucggcggc

SEQ ID NO: 3512522 - RNA, 14 nt, Pseudomonas aeruginosa PA01
augccucggcggcg

SEQ ID NO: 3512523 - RNA, 15 nt, Pseudomonas aeruginosa PA01
augccucggcggcgg

SEQ ID NO: 3512524 - RNA, 19 nt, Pseudomonas aeruginosa PA01
augccugcguuucgccggg

SEQ ID NO: 3512525 - RNA, 21 nt, Pseudomonas aeruginosa PA01
augccugcguuucgccgggca

SEQ ID NO: 3512526 - RNA, 18 nt, Pseudomonas aeruginosa PA01
augccugcuuucccugcu

SEQ ID NO: 3512527 - RNA, 14 nt, Pseudomonas aeruginosa PA01
augccuucaccggc

SEQ ID NO: 3512528 - RNA, 15 nt, Pseudomonas aeruginosa PA01
augccuucaccggcg

SEQ ID NO: 3512529 - RNA, 14 nt, Pseudomonas aeruginosa PA01
augccuuccgacgc

SEQ ID NO: 3512530 - RNA, 18 nt, Pseudomonas aeruginosa PA01
augccuuccgacgccgcg

SEQ ID NO: 3512531 - RNA, 14 nt, Pseudomonas aeruginosa PA01
augccuugcagcgc

SEQ ID NO: 3512532 - RNA, 16 nt, Pseudomonas aeruginosa PA01
augccuugcagcgcca

SEQ ID NO: 3512533 - RNA, 18 nt, Pseudomonas aeruginosa PA01
augccuuucggggugcag

SEQ ID NO: 3512534 - RNA, 20 nt, Pseudomonas aeruginosa PA01
augccuuucggggugcaggg

SEQ ID NO: 3512535 - RNA, 21 nt, Pseudomonas aeruginosa PA01
augcgcaacgggacgccaggc

SEQ ID NO: 3512536 - RNA, 22 nt, Pseudomonas aeruginosa PA01
augcgcaacgggacgccaggcg

SEQ ID NO: 3512537 - RNA, 23 nt, Pseudomonas aeruginosa PA01
augcgcaacgggacgccaggcgu

SEQ ID NO: 3512538 - RNA, 20 nt, Pseudomonas aeruginosa PA01
augcgcaacgggcggcggga

SEQ ID NO: 3512539 - RNA, 13 nt, Pseudomonas aeruginosa PA01
augcgcagcgcgu

SEQ ID NO: 3512540 - RNA, 18 nt, Pseudomonas aeruginosa PA01
augcgcaggccgggaaug

SEQ ID NO: 3512541 - RNA, 14 nt, Pseudomonas aeruginosa PA01
augcgcaugcgcag

SEQ ID NO: 3512542 - RNA, 12 nt, Pseudomonas aeruginosa PA01
augcgccagcgg

SEQ ID NO: 3512543 - RNA, 21 nt, Pseudomonas aeruginosa PA01
augcgccccagcgccugggcc

SEQ ID NO: 3512544 - RNA, 22 nt, Pseudomonas aeruginosa PA01
augcgccccagcgccugggccg

SEQ ID NO: 3512545 - RNA, 21 nt, Pseudomonas aeruginosa PA01
augcgcccccacgacgcacuc

SEQ ID NO: 3512546 - RNA, 16 nt, Pseudomonas aeruginosa PA01
augcgcccguccucca

SEQ ID NO: 3512547 - RNA, 22 nt, Pseudomonas aeruginosa PA01
augcgcccuacgccaccugagc

SEQ ID NO: 3512548 - RNA, 23 nt, Pseudomonas aeruginosa PA01
augcgccgacgccaccagccagg

SEQ ID NO: 3512549 - RNA, 22 nt, Pseudomonas aeruginosa PA01
augcgccgccacgugcacgccg

SEQ ID NO: 3512550 - RNA, 22 nt, Pseudomonas aeruginosa PA01
augcgccggaucggcugaccgg

SEQ ID NO: 3512551 - RNA, 12 nt, Pseudomonas aeruginosa PA01
augcgccgggcc

SEQ ID NO: 3512552 - RNA, 12 nt, Pseudomonas aeruginosa PA01
augcgccucagc

SEQ ID NO: 3512553 - RNA, 19 nt, Pseudomonas aeruginosa PA01
augcgccuccagguagacc

SEQ ID NO: 3512554 - RNA, 21 nt, Pseudomonas aeruginosa PA01
augcgcgaauaccgcgcgcgc

SEQ ID NO: 3512555 - RNA, 19 nt, Pseudomonas aeruginosa PA01
augcgcgcccugacgaugc

SEQ ID NO: 3512556 - RNA, 16 nt, Pseudomonas aeruginosa PA01
augcgcgcggcgaggg

SEQ ID NO: 3512557 - RNA, 23 nt, Pseudomonas aeruginosa PA01
augcgcgcggcgagggcgccggg

SEQ ID NO: 3512558 - RNA, 17 nt, Pseudomonas aeruginosa PA01
augcgcggcagcaggcg

SEQ ID NO: 3512559 - RNA, 13 nt, Pseudomonas aeruginosa PA01
augcgcggcagga

SEQ ID NO: 3512560 - RNA, 23 nt, Pseudomonas aeruginosa PA01
augcgcggcaggaaauccgccgc

SEQ ID NO: 3512561 - RNA, 21 nt, Pseudomonas aeruginosa PA01
augcgcggcagguagccgccu

SEQ ID NO: 3512562 - RNA, 15 nt, Pseudomonas aeruginosa PA01
augcgcggucaccag

SEQ ID NO: 3512563 - RNA, 19 nt, Pseudomonas aeruginosa PA01
augcgcgugguaucggcgc

SEQ ID NO: 3512564 - RNA, 18 nt, Pseudomonas aeruginosa PA01
augcgcguguugcgccgc

SEQ ID NO: 3512565 - RNA, 21 nt, Pseudomonas aeruginosa PA01
augcgcguguugcgccgcacc

SEQ ID NO: 3512566 - RNA, 18 nt, Pseudomonas aeruginosa PA01
augcgcuacggcaucacc

SEQ ID NO: 3512567 - RNA, 19 nt, Pseudomonas aeruginosa PA01
augcgcugguagcgcucca

SEQ ID NO: 3512568 - RNA, 19 nt, Pseudomonas aeruginosa PA01
augcggaacaccgccugga

SEQ ID NO: 3512569 - RNA, 18 nt, Pseudomonas aeruginosa PA01
augcggaaggcuuccugg

SEQ ID NO: 3512570 - RNA, 14 nt, Pseudomonas aeruginosa PA01
augcggccccggcg

SEQ ID NO: 3512571 - RNA, 15 nt, Pseudomonas aeruginosa PA01
augcggcccgccggc

SEQ ID NO: 3512572 - RNA, 16 nt, Pseudomonas aeruginosa PA01
augcggcccgccggcg

SEQ ID NO: 3512573 - RNA, 18 nt, Pseudomonas aeruginosa PA01
augcggccugcaacgccg

SEQ ID NO: 3512574 - RNA, 21 nt, Pseudomonas aeruginosa PA01
augcggcugugcucgaggaag

SEQ ID NO: 3512575 - RNA, 22 nt, Pseudomonas aeruginosa PA01
augcggcugugcucgaggaagc

SEQ ID NO: 3512576 - RNA, 14 nt, Pseudomonas aeruginosa PA01
augcgggcgcgagg

SEQ ID NO: 3512577 - RNA, 18 nt, Pseudomonas aeruginosa PA01
augcgggcgggugcgcga

SEQ ID NO: 3512578 - RNA, 17 nt, Pseudomonas aeruginosa PA01
augcggggcgaccagca

SEQ ID NO: 3512579 - RNA, 18 nt, Pseudomonas aeruginosa PA01
augcggggcgaccagcau

SEQ ID NO: 3512580 - RNA, 20 nt, Pseudomonas aeruginosa PA01
augcgguuccuggcuggagu

SEQ ID NO: 3512581 - RNA, 14 nt, Pseudomonas aeruginosa PA01
augcgguucggcgu

SEQ ID NO: 3512582 - RNA, 17 nt, Pseudomonas aeruginosa PA01
augcguccgcgcaggcg

SEQ ID NO: 3512583 - RNA, 21 nt, Pseudomonas aeruginosa PA01
augcguuccuguccauuucca

SEQ ID NO: 3512584 - RNA, 19 nt, Pseudomonas aeruginosa PA01
augcucacugcgagcacca

SEQ ID NO: 3512585 - RNA, 16 nt, Pseudomonas aeruginosa PA01
augcucagccgcgccg

SEQ ID NO: 3512586 - RNA, 20 nt, Pseudomonas aeruginosa PA01
augcucagcgccggccaggg

SEQ ID NO: 3512587 - RNA, 13 nt, Pseudomonas aeruginosa PA01
augcucaggcgcu

SEQ ID NO: 3512588 - RNA, 23 nt, Pseudomonas aeruginosa PA01
augcucaggucgaacugcacccg

SEQ ID NO: 3512589 - RNA, 15 nt, Pseudomonas aeruginosa PA01
augcuccgccuggcg

SEQ ID NO: 3512590 - RNA, 16 nt, Pseudomonas aeruginosa PA01
augcuccggggucagu

SEQ ID NO: 3512591 - RNA, 21 nt, Pseudomonas aeruginosa PA01
augcucggccagcucgccgaa

SEQ ID NO: 3512592 - RNA, 14 nt, Pseudomonas aeruginosa PA01
augcugaacuguuc

SEQ ID NO: 3512593 - RNA, 17 nt, Pseudomonas aeruginosa PA01
augcugaacuguucgau

SEQ ID NO: 3512594 - RNA, 17 nt, Pseudomonas aeruginosa PA01
augcugauaagcucggc

SEQ ID NO: 3512595 - RNA, 15 nt, Pseudomonas aeruginosa PA01
augcugcaggccgag

SEQ ID NO: 3512596 - RNA, 22 nt, Pseudomonas aeruginosa PA01
augcugcccggagcggcugccg

SEQ ID NO: 3512597 - RNA, 22 nt, Pseudomonas aeruginosa PA01
augcugcgggcgccgccgcugg

SEQ ID NO: 3512598 - RNA, 13 nt, Pseudomonas aeruginosa PA01
augcugcucggca

SEQ ID NO: 3512599 - RNA, 14 nt, Pseudomonas aeruginosa PA01
augcugcucggcau

SEQ ID NO: 3512600 - RNA, 23 nt, Pseudomonas aeruginosa PA01
augcugcucggcauucgacccgc

SEQ ID NO: 3512601 - RNA, 20 nt, Pseudomonas aeruginosa PA01
augcugcugaucaggaggau

SEQ ID NO: 3512602 - RNA, 22 nt, Pseudomonas aeruginosa PA01
augcuggcgcucucgaacacca

SEQ ID NO: 3512603 - RNA, 17 nt, Pseudomonas aeruginosa PA01
augcugggucuccgcuc

SEQ ID NO: 3512604 - RNA, 19 nt, Pseudomonas aeruginosa PA01
augcuguucagcaggagca

SEQ ID NO: 3512605 - RNA, 15 nt, Pseudomonas aeruginosa PA01
augcuguuccucguc

SEQ ID NO: 3512606 - RNA, 23 nt, Pseudomonas aeruginosa PA01
augcuguugccguggcggcgcgc

SEQ ID NO: 3512607 - RNA, 13 nt, Pseudomonas aeruginosa PA01
augcuugccggcg

SEQ ID NO: 3512608 - RNA, 22 nt, Pseudomonas aeruginosa PA01
augcuuucgaagcgcucccaga

SEQ ID NO: 3512609 - RNA, 15 nt, Pseudomonas aeruginosa PA01
augcuuuugaacacc

SEQ ID NO: 3512610 - RNA, 18 nt, Pseudomonas aeruginosa PA01
augcuuuugaacaccagc

SEQ ID NO: 3512611 - RNA, 14 nt, Pseudomonas aeruginosa PA01
auggaacagcagcc

SEQ ID NO: 3512612 - RNA, 17 nt, Pseudomonas aeruginosa PA01
auggaacagcagccagg

SEQ ID NO: 3512613 - RNA, 19 nt, Pseudomonas aeruginosa PA01
auggaacagcagccaggcg

SEQ ID NO: 3512614 - RNA, 20 nt, Pseudomonas aeruginosa PA01
auggaacgcggguugcccgg

SEQ ID NO: 3512615 - RNA, 19 nt, Pseudomonas aeruginosa PA01
auggacagcuuggccagca

SEQ ID NO: 3512616 - RNA, 16 nt, Pseudomonas aeruginosa PA01
auggacaggcgccccu

SEQ ID NO: 3512617 - RNA, 15 nt, Pseudomonas aeruginosa PA01
auggaccgagaccga

SEQ ID NO: 3512618 - RNA, 20 nt, Pseudomonas aeruginosa PA01
auggaccggcucgucggcgu

SEQ ID NO: 3512619 - RNA, 14 nt, Pseudomonas aeruginosa PA01
auggagacggcccg

SEQ ID NO: 3512620 - RNA, 13 nt, Pseudomonas aeruginosa PA01
auggagcaacagc

SEQ ID NO: 3512621 - RNA, 17 nt, Pseudomonas aeruginosa PA01
auggagcaacagcgucg

SEQ ID NO: 3512622 - RNA, 22 nt, Pseudomonas aeruginosa PA01
auggagcacagccauuucugcu

SEQ ID NO: 3512623 - RNA, 21 nt, Pseudomonas aeruginosa PA01
auggaucaacuggucgcagcc

SEQ ID NO: 3512624 - RNA, 23 nt, Pseudomonas aeruginosa PA01
auggaucaugggugaagaccagu

SEQ ID NO: 3512625 - RNA, 21 nt, Pseudomonas aeruginosa PA01
auggaucggcaacuggcuggc

SEQ ID NO: 3512626 - RNA, 14 nt, Pseudomonas aeruginosa PA01
auggaucggccucg

SEQ ID NO: 3512627 - RNA, 16 nt, Pseudomonas aeruginosa PA01
auggaucggccucgcg

SEQ ID NO: 3512628 - RNA, 15 nt, Pseudomonas aeruginosa PA01
auggauguugccgcc

SEQ ID NO: 3512629 - RNA, 22 nt, Pseudomonas aeruginosa PA01
auggcaacccagggcgcugccg

SEQ ID NO: 3512630 - RNA, 23 nt, Pseudomonas aeruginosa PA01
auggcacaguuccuguaccaggg

SEQ ID NO: 3512631 - RNA, 22 nt, Pseudomonas aeruginosa PA01
auggcaccgucaagggccagga

SEQ ID NO: 3512632 - RNA, 15 nt, Pseudomonas aeruginosa PA01
auggcacgcagggcu

SEQ ID NO: 3512633 - RNA, 16 nt, Pseudomonas aeruginosa PA01
auggcagaacaucgcc

SEQ ID NO: 3512634 - RNA, 15 nt, Pseudomonas aeruginosa PA01
auggcagcaggcaca

SEQ ID NO: 3512635 - RNA, 16 nt, Pseudomonas aeruginosa PA01
auggcagccuuggcca

SEQ ID NO: 3512636 - RNA, 22 nt, Pseudomonas aeruginosa PA01
auggcagccuuggccacggcau

SEQ ID NO: 3512637 - RNA, 14 nt, Pseudomonas aeruginosa PA01
auggcagcucugcg

SEQ ID NO: 3512638 - RNA, 22 nt, Pseudomonas aeruginosa PA01
auggcaugaggggaaucgccgu

SEQ ID NO: 3512639 - RNA, 15 nt, Pseudomonas aeruginosa PA01
auggccacgcucucg

SEQ ID NO: 3512640 - RNA, 21 nt, Pseudomonas aeruginosa PA01
auggccacgcucucgaacagc

SEQ ID NO: 3512641 - RNA, 23 nt, Pseudomonas aeruginosa PA01
auggccacgcucucgaacagcag

SEQ ID NO: 3512642 - RNA, 13 nt, Pseudomonas aeruginosa PA01
auggccagccagg

SEQ ID NO: 3512643 - RNA, 14 nt, Pseudomonas aeruginosa PA01
auggccagccagga

SEQ ID NO: 3512644 - RNA, 15 nt, Pseudomonas aeruginosa PA01
auggccagcgcguag

SEQ ID NO: 3512645 - RNA, 14 nt, Pseudomonas aeruginosa PA01
auggccagcucgac

SEQ ID NO: 3512646 - RNA, 17 nt, Pseudomonas aeruginosa PA01
auggccagggggccugg

SEQ ID NO: 3512647 - RNA, 16 nt, Pseudomonas aeruginosa PA01
auggccagucaucgcg

SEQ ID NO: 3512648 - RNA, 22 nt, Pseudomonas aeruginosa PA01
auggccauggcagagcuggaag

SEQ ID NO: 3512649 - RNA, 23 nt, Pseudomonas aeruginosa PA01
auggcccagauauccagggccag

SEQ ID NO: 3512650 - RNA, 13 nt, Pseudomonas aeruginosa PA01
auggcccagauga

SEQ ID NO: 3512651 - RNA, 15 nt, Pseudomonas aeruginosa PA01
auggccccuccaccu

SEQ ID NO: 3512652 - RNA, 18 nt, Pseudomonas aeruginosa PA01
auggccccuccaccucga

SEQ ID NO: 3512653 - RNA, 14 nt, Pseudomonas aeruginosa PA01
auggcccuucgccc

SEQ ID NO: 3512654 - RNA, 20 nt, Pseudomonas aeruginosa PA01
auggccgacccgugcgccgc

SEQ ID NO: 3512655 - RNA, 18 nt, Pseudomonas aeruginosa PA01
auggccgaccgccaggcc

SEQ ID NO: 3512656 - RNA, 16 nt, Pseudomonas aeruginosa PA01
auggccgcagcggcug

SEQ ID NO: 3512657 - RNA, 15 nt, Pseudomonas aeruginosa PA01
auggccgccagcagg

SEQ ID NO: 3512658 - RNA, 16 nt, Pseudomonas aeruginosa PA01
auggccgccagcaggc

SEQ ID NO: 3512659 - RNA, 18 nt, Pseudomonas aeruginosa PA01
auggccgccagcaggccg

SEQ ID NO: 3512660 - RNA, 11 nt, Pseudomonas aeruginosa PA01
auggccgccgc

SEQ ID NO: 3512661 - RNA, 14 nt, Pseudomonas aeruginosa PA01
auggccgccgccgc

SEQ ID NO: 3512662 - RNA, 18 nt, Pseudomonas aeruginosa PA01
auggccgcucccaccgcu

SEQ ID NO: 3512663 - RNA, 22 nt, Pseudomonas aeruginosa PA01
auggccggcagcagcgccagga

SEQ ID NO: 3512664 - RNA, 12 nt, Pseudomonas aeruginosa PA01
auggccgggccg

SEQ ID NO: 3512665 - RNA, 16 nt, Pseudomonas aeruginosa PA01
auggccguccaggcug

SEQ ID NO: 3512666 - RNA, 21 nt, Pseudomonas aeruginosa PA01
auggccuggcgcucagcgccg

SEQ ID NO: 3512667 - RNA, 22 nt, Pseudomonas aeruginosa PA01
auggccuggcgcucagcgccgc

SEQ ID NO: 3512668 - RNA, 13 nt, Pseudomonas aeruginosa PA01
auggccuggucgg

SEQ ID NO: 3512669 - RNA, 17 nt, Pseudomonas aeruginosa PA01
auggccuggucggcgcg

SEQ ID NO: 3512670 - RNA, 21 nt, Pseudomonas aeruginosa PA01
auggccuguaccaaggugcug

SEQ ID NO: 3512671 - RNA, 14 nt, Pseudomonas aeruginosa PA01
auggccuugccggc

SEQ ID NO: 3512672 - RNA, 19 nt, Pseudomonas aeruginosa PA01
auggcgaacaugaagccgc

SEQ ID NO: 3512673 - RNA, 19 nt, Pseudomonas aeruginosa PA01
auggcgaagcgcuugccca

SEQ ID NO: 3512674 - RNA, 21 nt, Pseudomonas aeruginosa PA01
auggcgaccugguggcgccgg

SEQ ID NO: 3512675 - RNA, 22 nt, Pseudomonas aeruginosa PA01
auggcgaggaugaucagggcac

SEQ ID NO: 3512676 - RNA, 23 nt, Pseudomonas aeruginosa PA01
auggcgaucgagcuguccaucuc

SEQ ID NO: 3512677 - RNA, 15 nt, Pseudomonas aeruginosa PA01
auggcgaucuccggg

SEQ ID NO: 3512678 - RNA, 16 nt, Pseudomonas aeruginosa PA01
auggcgaucuccggga

SEQ ID NO: 3512679 - RNA, 15 nt, Pseudomonas aeruginosa PA01
auggcgcacgccgcg

SEQ ID NO: 3512680 - RNA, 15 nt, Pseudomonas aeruginosa PA01
auggcgcagccgcug

SEQ ID NO: 3512681 - RNA, 16 nt, Pseudomonas aeruginosa PA01
auggcgccgccgaggu

SEQ ID NO: 3512682 - RNA, 18 nt, Pseudomonas aeruginosa PA01
auggcgccggccagagcu

SEQ ID NO: 3512683 - RNA, 20 nt, Pseudomonas aeruginosa PA01
auggcgcgaaucuucggcgc

SEQ ID NO: 3512684 - RNA, 12 nt, Pseudomonas aeruginosa PA01
auggcgcgccuc

SEQ ID NO: 3512685 - RNA, 17 nt, Pseudomonas aeruginosa PA01
auggcgcggugggccuu

SEQ ID NO: 3512686 - RNA, 20 nt, Pseudomonas aeruginosa PA01
auggcgcugaggaagagcag

SEQ ID NO: 3512687 - RNA, 22 nt, Pseudomonas aeruginosa PA01
auggcggaauaacucagcauca

SEQ ID NO: 3512688 - RNA, 16 nt, Pseudomonas aeruginosa PA01
auggcggacgaucacu

SEQ ID NO: 3512689 - RNA, 19 nt, Pseudomonas aeruginosa PA01
auggcggauagccgcaagc

SEQ ID NO: 3512690 - RNA, 20 nt, Pseudomonas aeruginosa PA01
auggcggccugguagucgcc

SEQ ID NO: 3512691 - RNA, 23 nt, Pseudomonas aeruginosa PA01
auggcggccugguagucgccggu

SEQ ID NO: 3512692 - RNA, 23 nt, Pseudomonas aeruginosa PA01
auggcggcggcguauucgccgaa

SEQ ID NO: 3512693 - RNA, 13 nt, Pseudomonas aeruginosa PA01
auggcggucgccg

SEQ ID NO: 3512694 - RNA, 22 nt, Pseudomonas aeruginosa PA01
auggcggugaccguuucgccgc

SEQ ID NO: 3512695 - RNA, 14 nt, Pseudomonas aeruginosa PA01
auggcguccaccgc

SEQ ID NO: 3512696 - RNA, 15 nt, Pseudomonas aeruginosa PA01
auggcguccaccgcu

SEQ ID NO: 3512697 - RNA, 23 nt, Pseudomonas aeruginosa PA01
auggcguccaccgcuucgcggau

SEQ ID NO: 3512698 - RNA, 23 nt, Pseudomonas aeruginosa PA01
auggcgucggcgaucacguccuu

SEQ ID NO: 3512699 - RNA, 21 nt, Pseudomonas aeruginosa PA01
auggcgugaaguagccgccgg

SEQ ID NO: 3512700 - RNA, 16 nt, Pseudomonas aeruginosa PA01
auggcgugggcugaca

SEQ ID NO: 3512701 - RNA, 16 nt, Pseudomonas aeruginosa PA01
auggcguuguugguca

SEQ ID NO: 3512702 - RNA, 20 nt, Pseudomonas aeruginosa PA01
auggcucgcggcgcucgucg

SEQ ID NO: 3512703 - RNA, 23 nt, Pseudomonas aeruginosa PA01
auggcugacccgcugcuggaugg

SEQ ID NO: 3512704 - RNA, 11 nt, Pseudomonas aeruginosa PA01
auggcugccga

SEQ ID NO: 3512705 - RNA, 12 nt, Pseudomonas aeruginosa PA01
auggcuggcgca

SEQ ID NO: 3512706 - RNA, 14 nt, Pseudomonas aeruginosa PA01
auggcugucggcgc

SEQ ID NO: 3512707 - RNA, 20 nt, Pseudomonas aeruginosa PA01
augggaaccucggcaggcug

SEQ ID NO: 3512708 - RNA, 14 nt, Pseudomonas aeruginosa PA01
augggacgaccuca

SEQ ID NO: 3512709 - RNA, 15 nt, Pseudomonas aeruginosa PA01
augggcaccgcgccg

SEQ ID NO: 3512710 - RNA, 16 nt, Pseudomonas aeruginosa PA01
augggcaccgcgccgg

SEQ ID NO: 3512711 - RNA, 19 nt, Pseudomonas aeruginosa PA01
augggcaccgcgccggcgg

SEQ ID NO: 3512712 - RNA, 18 nt, Pseudomonas aeruginosa PA01
augggcacgaucugcgcc

SEQ ID NO: 3512713 - RNA, 19 nt, Pseudomonas aeruginosa PA01
augggcacgaucugcgccg

SEQ ID NO: 3512714 - RNA, 20 nt, Pseudomonas aeruginosa PA01
augggcacgaucugcgccgc

SEQ ID NO: 3512715 - RNA, 17 nt, Pseudomonas aeruginosa PA01
augggcacgccgguggc

SEQ ID NO: 3512716 - RNA, 22 nt, Pseudomonas aeruginosa PA01
augggcacgccgguggccaggc

SEQ ID NO: 3512717 - RNA, 16 nt, Pseudomonas aeruginosa PA01
augggccggccgacga

SEQ ID NO: 3512718 - RNA, 18 nt, Pseudomonas aeruginosa PA01
augggcgagaccggggau

SEQ ID NO: 3512719 - RNA, 16 nt, Pseudomonas aeruginosa PA01
augggcgaugcgccgg

SEQ ID NO: 3512720 - RNA, 14 nt, Pseudomonas aeruginosa PA01
augggcgcgcgccg

SEQ ID NO: 3512721 - RNA, 15 nt, Pseudomonas aeruginosa PA01
augggcgcgcgccgg

SEQ ID NO: 3512722 - RNA, 16 nt, Pseudomonas aeruginosa PA01
augggcgcgcgccggg

SEQ ID NO: 3512723 - RNA, 23 nt, Pseudomonas aeruginosa PA01
augggcgcguucucccugagccu

SEQ ID NO: 3512724 - RNA, 12 nt, Pseudomonas aeruginosa PA01
augggcguccgg

SEQ ID NO: 3512725 - RNA, 13 nt, Pseudomonas aeruginosa PA01
auggggaucaccg

SEQ ID NO: 3512726 - RNA, 14 nt, Pseudomonas aeruginosa PA01
auggggcggccggc

SEQ ID NO: 3512727 - RNA, 16 nt, Pseudomonas aeruginosa PA01
auggggcugccggccc

SEQ ID NO: 3512728 - RNA, 18 nt, Pseudomonas aeruginosa PA01
augggguucgacagcgcg

SEQ ID NO: 3512729 - RNA, 18 nt, Pseudomonas aeruginosa PA01
auggguaucaugcgcccc

SEQ ID NO: 3512730 - RNA, 19 nt, Pseudomonas aeruginosa PA01
auggguaucaugcgccccg

SEQ ID NO: 3512731 - RNA, 13 nt, Pseudomonas aeruginosa PA01
augggucagcgcc

SEQ ID NO: 3512732 - RNA, 21 nt, Pseudomonas aeruginosa PA01
augggugaugaccccggcgau

SEQ ID NO: 3512733 - RNA, 16 nt, Pseudomonas aeruginosa PA01
auggguucccagcagc

SEQ ID NO: 3512734 - RNA, 18 nt, Pseudomonas aeruginosa PA01
auggguucccagcagcaa

SEQ ID NO: 3512735 - RNA, 22 nt, Pseudomonas aeruginosa PA01
auggguucccagcagcaacagc

SEQ ID NO: 3512736 - RNA, 22 nt, Pseudomonas aeruginosa PA01
augguaggcucccccgcgccgc

SEQ ID NO: 3512737 - RNA, 14 nt, Pseudomonas aeruginosa PA01
augguaucgccguc

SEQ ID NO: 3512738 - RNA, 19 nt, Pseudomonas aeruginosa PA01
auggucaacaccagcgccg

SEQ ID NO: 3512739 - RNA, 22 nt, Pseudomonas aeruginosa PA01
auggucaacaccagcgccgcca

SEQ ID NO: 3512740 - RNA, 15 nt, Pseudomonas aeruginosa PA01
auggucaccaugauc

SEQ ID NO: 3512741 - RNA, 12 nt, Pseudomonas aeruginosa PA01
auggucaggccg

SEQ ID NO: 3512742 - RNA, 13 nt, Pseudomonas aeruginosa PA01
auggucaggcugg

SEQ ID NO: 3512743 - RNA, 17 nt, Pseudomonas aeruginosa PA01
auggucaggcuggcccc

SEQ ID NO: 3512744 - RNA, 19 nt, Pseudomonas aeruginosa PA01
auggucgaaccagcucagc

SEQ ID NO: 3512745 - RNA, 21 nt, Pseudomonas aeruginosa PA01
auggucgagagaauccgccgu

SEQ ID NO: 3512746 - RNA, 24 nt, Pseudomonas aeruginosa PA01
auggucgccggagucguagcgcgc

SEQ ID NO: 3512747 - RNA, 14 nt, Pseudomonas aeruginosa PA01
auggucggccaggu

SEQ ID NO: 3512748 - RNA, 16 nt, Pseudomonas aeruginosa PA01
auggucgggcaggugg

SEQ ID NO: 3512749 - RNA, 16 nt, Pseudomonas aeruginosa PA01
auggucggugacccgc

SEQ ID NO: 3512750 - RNA, 15 nt, Pseudomonas aeruginosa PA01
auggucguucagcgg

SEQ ID NO: 3512751 - RNA, 22 nt, Pseudomonas aeruginosa PA01
auggucuucccagaccccggcg

SEQ ID NO: 3512752 - RNA, 16 nt, Pseudomonas aeruginosa PA01
auggugaacgccaggc

SEQ ID NO: 3512753 - RNA, 17 nt, Pseudomonas aeruginosa PA01
auggugaacgccaggca

SEQ ID NO: 3512754 - RNA, 17 nt, Pseudomonas aeruginosa PA01
auggugaucacgucggc

SEQ ID NO: 3512755 - RNA, 19 nt, Pseudomonas aeruginosa PA01
auggugcccagcaggcugc

SEQ ID NO: 3512756 - RNA, 21 nt, Pseudomonas aeruginosa PA01
auggugcccagcaggcugcug

SEQ ID NO: 3512757 - RNA, 13 nt, Pseudomonas aeruginosa PA01
auggugccgagca

SEQ ID NO: 3512758 - RNA, 16 nt, Pseudomonas aeruginosa PA01
augguggaccagcgcc

SEQ ID NO: 3512759 - RNA, 18 nt, Pseudomonas aeruginosa PA01
augguggaccagcgccgc

SEQ ID NO: 3512760 - RNA, 17 nt, Pseudomonas aeruginosa PA01
auggugggcgccgcugu

SEQ ID NO: 3512761 - RNA, 13 nt, Pseudomonas aeruginosa PA01
augguggucggca

SEQ ID NO: 3512762 - RNA, 14 nt, Pseudomonas aeruginosa PA01
auggugugcagcag

SEQ ID NO: 3512763 - RNA, 12 nt, Pseudomonas aeruginosa PA01
augguucaucuu

SEQ ID NO: 3512764 - RNA, 13 nt, Pseudomonas aeruginosa PA01
augguucaucuuc

SEQ ID NO: 3512765 - RNA, 17 nt, Pseudomonas aeruginosa PA01
augguuucgugccauuc

SEQ ID NO: 3512766 - RNA, 13 nt, Pseudomonas aeruginosa PA01
augguuucuuccc

SEQ ID NO: 3512767 - RNA, 16 nt, Pseudomonas aeruginosa PA01
auguacagggucuugc

SEQ ID NO: 3512768 - RNA, 13 nt, Pseudomonas aeruginosa PA01
auguacggcacca

SEQ ID NO: 3512769 - RNA, 16 nt, Pseudomonas aeruginosa PA01
auguacucgcggccga

SEQ ID NO: 3512770 - RNA, 17 nt, Pseudomonas aeruginosa PA01
auguagcgcgccgaggg

SEQ ID NO: 3512771 - RNA, 17 nt, Pseudomonas aeruginosa PA01
auguagcgcuccucgcg

SEQ ID NO: 3512772 - RNA, 23 nt, Pseudomonas aeruginosa PA01
auguagcgcuccucgcgcugccc

SEQ ID NO: 3512773 - RNA, 17 nt, Pseudomonas aeruginosa PA01
auguagcguugcaggca

SEQ ID NO: 3512774 - RNA, 12 nt, Pseudomonas aeruginosa PA01
auguaggcgcac

SEQ ID NO: 3512775 - RNA, 15 nt, Pseudomonas aeruginosa PA01
auguaggucaccgcg

SEQ ID NO: 3512776 - RNA, 16 nt, Pseudomonas aeruginosa PA01
auguagucgacgccgg

SEQ ID NO: 3512777 - RNA, 13 nt, Pseudomonas aeruginosa PA01
auguauucgaaca

SEQ ID NO: 3512778 - RNA, 22 nt, Pseudomonas aeruginosa PA01
auguauucgaacagcuugacga

SEQ ID NO: 3512779 - RNA, 20 nt, Pseudomonas aeruginosa PA01
auguauucggcgguccaggg

SEQ ID NO: 3512780 - RNA, 12 nt, Pseudomonas aeruginosa PA01
auguccagccag

SEQ ID NO: 3512781 - RNA, 11 nt, Pseudomonas aeruginosa PA01
auguccaggca

SEQ ID NO: 3512782 - RNA, 17 nt, Pseudomonas aeruginosa PA01
auguccgagcaggucgc

SEQ ID NO: 3512783 - RNA, 23 nt, Pseudomonas aeruginosa PA01
auguccgagcaggucgcggaacu

SEQ ID NO: 3512784 - RNA, 23 nt, Pseudomonas aeruginosa PA01
auguccgcaggcaggucgcugcc

SEQ ID NO: 3512785 - RNA, 21 nt, Pseudomonas aeruginosa PA01
auguccgggugaugcccgguc

SEQ ID NO: 3512786 - RNA, 14 nt, Pseudomonas aeruginosa PA01
auguccgguuggcg

SEQ ID NO: 3512787 - RNA, 15 nt, Pseudomonas aeruginosa PA01
auguccucggcgccg

SEQ ID NO: 3512788 - RNA, 20 nt, Pseudomonas aeruginosa PA01
auguccugcaggcucagcac

SEQ ID NO: 3512789 - RNA, 17 nt, Pseudomonas aeruginosa PA01
auguccugccgcaggcg

SEQ ID NO: 3512790 - RNA, 12 nt, Pseudomonas aeruginosa PA01
auguccugggcc

SEQ ID NO: 3512791 - RNA, 13 nt, Pseudomonas aeruginosa PA01
auguccugggcca

SEQ ID NO: 3512792 - RNA, 19 nt, Pseudomonas aeruginosa PA01
auguccugggccaccuggc

SEQ ID NO: 3512793 - RNA, 22 nt, Pseudomonas aeruginosa PA01
augucgagauugucgcguccgg

SEQ ID NO: 3512794 - RNA, 17 nt, Pseudomonas aeruginosa PA01
augucgaggaacagguc

SEQ ID NO: 3512795 - RNA, 15 nt, Pseudomonas aeruginosa PA01
augucgccggcaugg

SEQ ID NO: 3512796 - RNA, 15 nt, Pseudomonas aeruginosa PA01
augucgccggggaag

SEQ ID NO: 3512797 - RNA, 19 nt, Pseudomonas aeruginosa PA01
augucgcggcaggcggcgg

SEQ ID NO: 3512798 - RNA, 12 nt, Pseudomonas aeruginosa PA01
augucgcggccc

SEQ ID NO: 3512799 - RNA, 13 nt, Pseudomonas aeruginosa PA01
augucgcggcuga

SEQ ID NO: 3512800 - RNA, 16 nt, Pseudomonas aeruginosa PA01
augucgcgggcaugcu

SEQ ID NO: 3512801 - RNA, 22 nt, Pseudomonas aeruginosa PA01
augucgcgggcaugcugcucgg

SEQ ID NO: 3512802 - RNA, 11 nt, Pseudomonas aeruginosa PA01
augucgcuggc

SEQ ID NO: 3512803 - RNA, 14 nt, Pseudomonas aeruginosa PA01
augucgcuggccag

SEQ ID NO: 3512804 - RNA, 13 nt, Pseudomonas aeruginosa PA01
augucgcuggccu

SEQ ID NO: 3512805 - RNA, 19 nt, Pseudomonas aeruginosa PA01
augucggccugcagccugg

SEQ ID NO: 3512806 - RNA, 22 nt, Pseudomonas aeruginosa PA01
augucggccugcagccuggcgu

SEQ ID NO: 3512807 - RNA, 22 nt, Pseudomonas aeruginosa PA01
augucggcgaaaugcaggccgg

SEQ ID NO: 3512808 - RNA, 19 nt, Pseudomonas aeruginosa PA01
augucggcgcugucgccgu

SEQ ID NO: 3512809 - RNA, 17 nt, Pseudomonas aeruginosa PA01
augucguagacgcccgg

SEQ ID NO: 3512810 - RNA, 17 nt, Pseudomonas aeruginosa PA01
augucgucgaacgacuc

SEQ ID NO: 3512811 - RNA, 12 nt, Pseudomonas aeruginosa PA01
augucugcaacc

SEQ ID NO: 3512812 - RNA, 19 nt, Pseudomonas aeruginosa PA01
augucuucucaaagggcag

SEQ ID NO: 3512813 - RNA, 12 nt, Pseudomonas aeruginosa PA01
augugcaccagc

SEQ ID NO: 3512814 - RNA, 17 nt, Pseudomonas aeruginosa PA01
augugcgcggugacgac

SEQ ID NO: 3512815 - RNA, 16 nt, Pseudomonas aeruginosa PA01
augugcggcguggcga

SEQ ID NO: 3512816 - RNA, 20 nt, Pseudomonas aeruginosa PA01
augugcuugaccgccgccug

SEQ ID NO: 3512817 - RNA, 22 nt, Pseudomonas aeruginosa PA01
auguggccgucgcgccgcggaa

SEQ ID NO: 3512818 - RNA, 14 nt, Pseudomonas aeruginosa PA01
auguggcgcagcau

SEQ ID NO: 3512819 - RNA, 17 nt, Pseudomonas aeruginosa PA01
auguggguauccagcgg

SEQ ID NO: 3512820 - RNA, 16 nt, Pseudomonas aeruginosa PA01
auguucaccgcggccu

SEQ ID NO: 3512821 - RNA, 19 nt, Pseudomonas aeruginosa PA01
auguuccaaggugcugccg

SEQ ID NO: 3512822 - RNA, 23 nt, Pseudomonas aeruginosa PA01
auguuccaaggugcugccgauca

SEQ ID NO: 3512823 - RNA, 21 nt, Pseudomonas aeruginosa PA01
auguuccuccagagugcgcag

SEQ ID NO: 3512824 - RNA, 18 nt, Pseudomonas aeruginosa PA01
auguucgaggcgccgacc

SEQ ID NO: 3512825 - RNA, 15 nt, Pseudomonas aeruginosa PA01
auguugccgccgccg

SEQ ID NO: 3512826 - RNA, 14 nt, Pseudomonas aeruginosa PA01
auguugcgcagggu

SEQ ID NO: 3512827 - RNA, 19 nt, Pseudomonas aeruginosa PA01
auguuggcgccuucggcga

SEQ ID NO: 3512828 - RNA, 19 nt, Pseudomonas aeruginosa PA01
auguuguuauggccgaccc

SEQ ID NO: 3512829 - RNA, 19 nt, Pseudomonas aeruginosa PA01
auguuguucgcgcaccuug

SEQ ID NO: 3512830 - RNA, 12 nt, Pseudomonas aeruginosa PA01
auuaagugccuc

SEQ ID NO: 3512831 - RNA, 15 nt, Pseudomonas aeruginosa PA01
auuacuugcccacgc

SEQ ID NO: 3512832 - RNA, 15 nt, Pseudomonas aeruginosa PA01
auuacuuggcuucag

SEQ ID NO: 3512833 - RNA, 22 nt, Pseudomonas aeruginosa PA01
auuagaggaacccaaucacaac

SEQ ID NO: 3512834 - RNA, 17 nt, Pseudomonas aeruginosa PA01
auuagcgucgcgcggcc

SEQ ID NO: 3512835 - RNA, 22 nt, Pseudomonas aeruginosa PA01
auuagcgucgcgcggccagcgu

SEQ ID NO: 3512836 - RNA, 21 nt, Pseudomonas aeruginosa PA01
auuauauaggguuucucgcuc

SEQ ID NO: 3512837 - RNA, 19 nt, Pseudomonas aeruginosa PA01
auucaccgagcguuuuugg

SEQ ID NO: 3512838 - RNA, 20 nt, Pseudomonas aeruginosa PA01
auucagugggucgaugcccu

SEQ ID NO: 3512839 - RNA, 16 nt, Pseudomonas aeruginosa PA01
auucaucucgccgucg

SEQ ID NO: 3512840 - RNA, 15 nt, Pseudomonas aeruginosa PA01
auuccaccggcuggc

SEQ ID NO: 3512841 - RNA, 21 nt, Pseudomonas aeruginosa PA01
auuccaccggcuggccgcgac

SEQ ID NO: 3512842 - RNA, 21 nt, Pseudomonas aeruginosa PA01
auuccacgucgccgaccaggc

SEQ ID NO: 3512843 - RNA, 17 nt, Pseudomonas aeruginosa PA01
auuccaugggcagacga

SEQ ID NO: 3512844 - RNA, 18 nt, Pseudomonas aeruginosa PA01
auuccaugggcagacgau

SEQ ID NO: 3512845 - RNA, 21 nt, Pseudomonas aeruginosa PA01
auucccgaggguggcgcuggc

SEQ ID NO: 3512846 - RNA, 17 nt, Pseudomonas aeruginosa PA01
auucccgccgcuccggc

SEQ ID NO: 3512847 - RNA, 19 nt, Pseudomonas aeruginosa PA01
auuccgacaaggagcgcga

SEQ ID NO: 3512848 - RNA, 21 nt, Pseudomonas aeruginosa PA01
auuccgacaaggagcgcgagc

SEQ ID NO: 3512849 - RNA, 18 nt, Pseudomonas aeruginosa PA01
auuccgccaccagccagu

SEQ ID NO: 3512850 - RNA, 13 nt, Pseudomonas aeruginosa PA01
auuccgccgcggc

SEQ ID NO: 3512851 - RNA, 23 nt, Pseudomonas aeruginosa PA01
auuccggggacgcugucccggcc

SEQ ID NO: 3512852 - RNA, 21 nt, Pseudomonas aeruginosa PA01
auuccgggucgaggcugccga

SEQ ID NO: 3512853 - RNA, 16 nt, Pseudomonas aeruginosa PA01
auuccucagcgccggu

SEQ ID NO: 3512854 - RNA, 18 nt, Pseudomonas aeruginosa PA01
auuccucagugcgggcag

SEQ ID NO: 3512855 - RNA, 22 nt, Pseudomonas aeruginosa PA01
auuccugcggcuugcccaucuu

SEQ ID NO: 3512856 - RNA, 16 nt, Pseudomonas aeruginosa PA01
auuccugggccccggc

SEQ ID NO: 3512857 - RNA, 13 nt, Pseudomonas aeruginosa PA01
auuccuuccaggg

SEQ ID NO: 3512858 - RNA, 14 nt, Pseudomonas aeruginosa PA01
auuccuuccagggu

SEQ ID NO: 3512859 - RNA, 17 nt, Pseudomonas aeruginosa PA01
auuccuugcgccaugcg

SEQ ID NO: 3512860 - RNA, 22 nt, Pseudomonas aeruginosa PA01
auuccuugcgccaugcgcccgc

SEQ ID NO: 3512861 - RNA, 14 nt, Pseudomonas aeruginosa PA01
auucgaagcucggc

SEQ ID NO: 3512862 - RNA, 15 nt, Pseudomonas aeruginosa PA01
auucgacagcaggug

SEQ ID NO: 3512863 - RNA, 20 nt, Pseudomonas aeruginosa PA01
auucgacgcagcgcgcgccg

SEQ ID NO: 3512864 - RNA, 21 nt, Pseudomonas aeruginosa PA01
auucgacgccgaaacgccgac

SEQ ID NO: 3512865 - RNA, 17 nt, Pseudomonas aeruginosa PA01
auucgacgcgcggcugc

SEQ ID NO: 3512866 - RNA, 18 nt, Pseudomonas aeruginosa PA01
auucgaugccgcgcgccu

SEQ ID NO: 3512867 - RNA, 21 nt, Pseudomonas aeruginosa PA01
auucgcccagugguuccagga

SEQ ID NO: 3512868 - RNA, 22 nt, Pseudomonas aeruginosa PA01
auucgcccuaccccccaauugc

SEQ ID NO: 3512869 - RNA, 21 nt, Pseudomonas aeruginosa PA01
auucgcccuaccguccgcagc

SEQ ID NO: 3512870 - RNA, 15 nt, Pseudomonas aeruginosa PA01
auucgccgcgacgcu

SEQ ID NO: 3512871 - RNA, 19 nt, Pseudomonas aeruginosa PA01
auucgcgcugguugcccag

SEQ ID NO: 3512872 - RNA, 15 nt, Pseudomonas aeruginosa PA01
auucgcggacgccga

SEQ ID NO: 3512873 - RNA, 18 nt, Pseudomonas aeruginosa PA01
auucgcggacgccgaagc

SEQ ID NO: 3512874 - RNA, 22 nt, Pseudomonas aeruginosa PA01
auucgcggacgccgaagcgggc

SEQ ID NO: 3512875 - RNA, 18 nt, Pseudomonas aeruginosa PA01
auucgcguucggucaggc

SEQ ID NO: 3512876 - RNA, 15 nt, Pseudomonas aeruginosa PA01
auucgcucugcgcca

SEQ ID NO: 3512877 - RNA, 21 nt, Pseudomonas aeruginosa PA01
auucgcugacgaggacgccgc

SEQ ID NO: 3512878 - RNA, 14 nt, Pseudomonas aeruginosa PA01
auucgcugucaggg

SEQ ID NO: 3512879 - RNA, 21 nt, Pseudomonas aeruginosa PA01
auucgcugucgucggcgcggc

SEQ ID NO: 3512880 - RNA, 16 nt, Pseudomonas aeruginosa PA01
auucgcuucggccacc

SEQ ID NO: 3512881 - RNA, 18 nt, Pseudomonas aeruginosa PA01
auucgcuucggccaccag

SEQ ID NO: 3512882 - RNA, 19 nt, Pseudomonas aeruginosa PA01
auucgcuucggccaccagc

SEQ ID NO: 3512883 - RNA, 16 nt, Pseudomonas aeruginosa PA01
auucggaguugcauug

SEQ ID NO: 3512884 - RNA, 14 nt, Pseudomonas aeruginosa PA01
auucggccagcgcg

SEQ ID NO: 3512885 - RNA, 16 nt, Pseudomonas aeruginosa PA01
auucggccagcgcggc

SEQ ID NO: 3512886 - RNA, 20 nt, Pseudomonas aeruginosa PA01
auucggcccaugccuccgac

SEQ ID NO: 3512887 - RNA, 22 nt, Pseudomonas aeruginosa PA01
auucggugcgccguauucuuca

SEQ ID NO: 3512888 - RNA, 18 nt, Pseudomonas aeruginosa PA01
auucgucauuggccgaau

SEQ ID NO: 3512889 - RNA, 16 nt, Pseudomonas aeruginosa PA01
auucguccagccgccg

SEQ ID NO: 3512890 - RNA, 17 nt, Pseudomonas aeruginosa PA01
auucguccagccgccgc

SEQ ID NO: 3512891 - RNA, 18 nt, Pseudomonas aeruginosa PA01
auucguccagccgccgcu

SEQ ID NO: 3512892 - RNA, 14 nt, Pseudomonas aeruginosa PA01
auucgucgccgccg

SEQ ID NO: 3512893 - RNA, 16 nt, Pseudomonas aeruginosa PA01
auucgucgccgccgag

SEQ ID NO: 3512894 - RNA, 13 nt, Pseudomonas aeruginosa PA01
auucgucggccug

SEQ ID NO: 3512895 - RNA, 18 nt, Pseudomonas aeruginosa PA01
auucuccagcaggcucuu

SEQ ID NO: 3512896 - RNA, 17 nt, Pseudomonas aeruginosa PA01
auucucccucgccgacc

SEQ ID NO: 3512897 - RNA, 19 nt, Pseudomonas aeruginosa PA01
auucuccugggcggucucg

SEQ ID NO: 3512898 - RNA, 13 nt, Pseudomonas aeruginosa PA01
auugaaggccgac

SEQ ID NO: 3512899 - RNA, 22 nt, Pseudomonas aeruginosa PA01
auugacacggauauccgggccc

SEQ ID NO: 3512900 - RNA, 13 nt, Pseudomonas aeruginosa PA01
auugagcgcgccc

SEQ ID NO: 3512901 - RNA, 17 nt, Pseudomonas aeruginosa PA01
auugagggucagcuugc

SEQ ID NO: 3512902 - RNA, 15 nt, Pseudomonas aeruginosa PA01
auugcacaacgggug

SEQ ID NO: 3512903 - RNA, 21 nt, Pseudomonas aeruginosa PA01
auugcacaacgggugcugcgg

SEQ ID NO: 3512904 - RNA, 21 nt, Pseudomonas aeruginosa PA01
auugcacuuccacuccaggcg

SEQ ID NO: 3512905 - RNA, 17 nt, Pseudomonas aeruginosa PA01
auugcagcgucgacgcc

SEQ ID NO: 3512906 - RNA, 15 nt, Pseudomonas aeruginosa PA01
auugcagcuccuggu

SEQ ID NO: 3512907 - RNA, 14 nt, Pseudomonas aeruginosa PA01
auugcaggcccggc

SEQ ID NO: 3512908 - RNA, 21 nt, Pseudomonas aeruginosa PA01
auugcaggcccggccgccugc

SEQ ID NO: 3512909 - RNA, 20 nt, Pseudomonas aeruginosa PA01
auugcagguaguccagccag

SEQ ID NO: 3512910 - RNA, 15 nt, Pseudomonas aeruginosa PA01
auugcccggccaggc

SEQ ID NO: 3512911 - RNA, 16 nt, Pseudomonas aeruginosa PA01
auugcccggccaggcg

SEQ ID NO: 3512912 - RNA, 18 nt, Pseudomonas aeruginosa PA01
auugcccggccaggcgcg

SEQ ID NO: 3512913 - RNA, 23 nt, Pseudomonas aeruginosa PA01
auugcccgguggccuccugcaac

SEQ ID NO: 3512914 - RNA, 23 nt, Pseudomonas aeruginosa PA01
auugccgaugugcacgcugaaga

SEQ ID NO: 3512915 - RNA, 22 nt, Pseudomonas aeruginosa PA01
auugccgcgggcuauucccgcc

SEQ ID NO: 3512916 - RNA, 24 nt, Pseudomonas aeruginosa PA01
auugccuccgcucugcuggccacc

SEQ ID NO: 3512917 - RNA, 18 nt, Pseudomonas aeruginosa PA01
auugcgagcgagcuugca

SEQ ID NO: 3512918 - RNA, 21 nt, Pseudomonas aeruginosa PA01
auugcgagcgagcuugcaauc

SEQ ID NO: 3512919 - RNA, 15 nt, Pseudomonas aeruginosa PA01
auugcgccgccggcu

SEQ ID NO: 3512920 - RNA, 18 nt, Pseudomonas aeruginosa PA01
auugcgcguggcgucggc

SEQ ID NO: 3512921 - RNA, 15 nt, Pseudomonas aeruginosa PA01
auugcuacagcaauu

SEQ ID NO: 3512922 - RNA, 20 nt, Pseudomonas aeruginosa PA01
auugcugccgaggccgaggu

SEQ ID NO: 3512923 - RNA, 12 nt, Pseudomonas aeruginosa PA01
auugcugggugc

SEQ ID NO: 3512924 - RNA, 15 nt, Pseudomonas aeruginosa PA01
auuggaauugcugac

SEQ ID NO: 3512925 - RNA, 16 nt, Pseudomonas aeruginosa PA01
auuggagaugcucagg

SEQ ID NO: 3512926 - RNA, 18 nt, Pseudomonas aeruginosa PA01
auuggcacccuggacccg

SEQ ID NO: 3512927 - RNA, 16 nt, Pseudomonas aeruginosa PA01
auuggccaggcucgcg

SEQ ID NO: 3512928 - RNA, 18 nt, Pseudomonas aeruginosa PA01
auuggccaggcucgcgau

SEQ ID NO: 3512929 - RNA, 21 nt, Pseudomonas aeruginosa PA01
auuggccagggucacgccaga

SEQ ID NO: 3512930 - RNA, 17 nt, Pseudomonas aeruginosa PA01
auuggccaucagcgccg

SEQ ID NO: 3512931 - RNA, 18 nt, Pseudomonas aeruginosa PA01
auuggccaucagcgccgc

SEQ ID NO: 3512932 - RNA, 23 nt, Pseudomonas aeruginosa PA01
auuggccgaaucgaacagggcga

SEQ ID NO: 3512933 - RNA, 20 nt, Pseudomonas aeruginosa PA01
auuggccgccugcucggccu

SEQ ID NO: 3512934 - RNA, 14 nt, Pseudomonas aeruginosa PA01
auuggccgggccga

SEQ ID NO: 3512935 - RNA, 20 nt, Pseudomonas aeruginosa PA01
auuggcgaaguugccgccgc

SEQ ID NO: 3512936 - RNA, 15 nt, Pseudomonas aeruginosa PA01
auuggguuccucuaa

SEQ ID NO: 3512937 - RNA, 14 nt, Pseudomonas aeruginosa PA01
auugguauccaggu

SEQ ID NO: 3512938 - RNA, 22 nt, Pseudomonas aeruginosa PA01
auuggucaccacguugcgccgc

SEQ ID NO: 3512939 - RNA, 20 nt, Pseudomonas aeruginosa PA01
auuggugcugccgaugcuga

SEQ ID NO: 3512940 - RNA, 21 nt, Pseudomonas aeruginosa PA01
auugguggucaccagcguggg

SEQ ID NO: 3512941 - RNA, 19 nt, Pseudomonas aeruginosa PA01
auugugcguguucggcggc

SEQ ID NO: 3512942 - RNA, 15 nt, Pseudomonas aeruginosa PA01
auuguuggcgcucgg

SEQ ID NO: 3512943 - RNA, 12 nt, Pseudomonas aeruginosa PA01
auuuacaagccc

SEQ ID NO: 3512944 - RNA, 16 nt, Pseudomonas aeruginosa PA01
auuuacaggacugugc

SEQ ID NO: 3512945 - RNA, 13 nt, Pseudomonas aeruginosa PA01
auuucacgccgaa

SEQ ID NO: 3512946 - RNA, 22 nt, Pseudomonas aeruginosa PA01
auuuccagcaacgugaagcccu

SEQ ID NO: 3512947 - RNA, 18 nt, Pseudomonas aeruginosa PA01
auuuccccaacaucaacc

SEQ ID NO: 3512948 - RNA, 13 nt, Pseudomonas aeruginosa PA01
auuucccgcagua

SEQ ID NO: 3512949 - RNA, 13 nt, Pseudomonas aeruginosa PA01
auuuccgcgcccg

SEQ ID NO: 3512950 - RNA, 17 nt, Pseudomonas aeruginosa PA01
auuuccgcgcccggcug

SEQ ID NO: 3512951 - RNA, 17 nt, Pseudomonas aeruginosa PA01
auuuccgcggccggcag

SEQ ID NO: 3512952 - RNA, 16 nt, Pseudomonas aeruginosa PA01
auuuccucgucgccgu

SEQ ID NO: 3512953 - RNA, 13 nt, Pseudomonas aeruginosa PA01
auuuccuggcgcg

SEQ ID NO: 3512954 - RNA, 22 nt, Pseudomonas aeruginosa PA01
auuuccugggugccgcgaaugu

SEQ ID NO: 3512955 - RNA, 23 nt, Pseudomonas aeruginosa PA01
auuuccuugaccaucuuuuccug

SEQ ID NO: 3512956 - RNA, 20 nt, Pseudomonas aeruginosa PA01
auuucgcggaaguaggcggc

SEQ ID NO: 3512957 - RNA, 22 nt, Pseudomonas aeruginosa PA01
auuucguuggcccagaccuugg

SEQ ID NO: 3512958 - RNA, 13 nt, Pseudomonas aeruginosa PA01
auuugcccggcga

SEQ ID NO: 3512959 - RNA, 13 nt, Pseudomonas aeruginosa PA01
auuugccgccgag

SEQ ID NO: 3512960 - RNA, 19 nt, Pseudomonas aeruginosa PA01
auuuguuuuaaaguucgac

SEQ ID NO: 3512961 - RNA, 13 nt, Pseudomonas aeruginosa PA01
auuuuccagcagg

SEQ ID NO: 3512962 - RNA, 13 nt, Pseudomonas aeruginosa PA01
auuuucuccggcg

SEQ ID NO: 3512963 - RNA, 16 nt, Pseudomonas aeruginosa PA01
auuuugccggagaugu

SEQ ID NO: 3512964 - RNA, 14 nt, Pseudomonas aeruginosa PA01
caaaaaaggcggau

SEQ ID NO: 3512965 - RNA, 20 nt, Pseudomonas aeruginosa PA01
caaaauguauaggagccugc

SEQ ID NO: 3512966 - RNA, 21 nt, Pseudomonas aeruginosa PA01
caaaccauggcguagggcgaa

SEQ ID NO: 3512967 - RNA, 21 nt, Pseudomonas aeruginosa PA01
caaaccccugggaugccgcca

SEQ ID NO: 3512968 - RNA, 13 nt, Pseudomonas aeruginosa PA01
caaaccucccggg

SEQ ID NO: 3512969 - RNA, 18 nt, Pseudomonas aeruginosa PA01
caaacgauugcggcagaa

SEQ ID NO: 3512970 - RNA, 17 nt, Pseudomonas aeruginosa PA01
caaacgccauccgccuu

SEQ ID NO: 3512971 - RNA, 19 nt, Pseudomonas aeruginosa PA01
caaacgccgccaccaacca

SEQ ID NO: 3512972 - RNA, 22 nt, Pseudomonas aeruginosa PA01
caaacgggacagguugucgacc

SEQ ID NO: 3512973 - RNA, 21 nt, Pseudomonas aeruginosa PA01
caaacgggcaucgucgaaggg

SEQ ID NO: 3512974 - RNA, 23 nt, Pseudomonas aeruginosa PA01
caaagaaaaggcccgcugauugc

SEQ ID NO: 3512975 - RNA, 16 nt, Pseudomonas aeruginosa PA01
caaagcccgcuccgca

SEQ ID NO: 3512976 - RNA, 19 nt, Pseudomonas aeruginosa PA01
caaagccgcaauccgccgc

SEQ ID NO: 3512977 - RNA, 17 nt, Pseudomonas aeruginosa PA01
caaagccuggagcaggg

SEQ ID NO: 3512978 - RNA, 13 nt, Pseudomonas aeruginosa PA01
caaagcgagcgcc

SEQ ID NO: 3512979 - RNA, 14 nt, Pseudomonas aeruginosa PA01
caaagcgcgggcug

SEQ ID NO: 3512980 - RNA, 16 nt, Pseudomonas aeruginosa PA01
caaagcggcgacgcca

SEQ ID NO: 3512981 - RNA, 17 nt, Pseudomonas aeruginosa PA01
caaagcggcgacgccac

SEQ ID NO: 3512982 - RNA, 12 nt, Pseudomonas aeruginosa PA01
caaagcucgcgc

SEQ ID NO: 3512983 - RNA, 18 nt, Pseudomonas aeruginosa PA01
caaagcucgcgcaagcgc

SEQ ID NO: 3512984 - RNA, 19 nt, Pseudomonas aeruginosa PA01
caaagcucgcgcaagcgcc

SEQ ID NO: 3512985 - RNA, 17 nt, Pseudomonas aeruginosa PA01
caaaggaaucuucggcg

SEQ ID NO: 3512986 - RNA, 22 nt, Pseudomonas aeruginosa PA01
caaaggaaucuucggcgcccac

SEQ ID NO: 3512987 - RNA, 15 nt, Pseudomonas aeruginosa PA01
caaaggcccggcgcg

SEQ ID NO: 3512988 - RNA, 22 nt, Pseudomonas aeruginosa PA01
caaaggcccggcgcgguuucgc

SEQ ID NO: 3512989 - RNA, 14 nt, Pseudomonas aeruginosa PA01
caaaggcgcgcagg

SEQ ID NO: 3512990 - RNA, 16 nt, Pseudomonas aeruginosa PA01
caaaggcgcgcagggc

SEQ ID NO: 3512991 - RNA, 18 nt, Pseudomonas aeruginosa PA01
caaaggcgcgcagggccg

SEQ ID NO: 3512992 - RNA, 14 nt, Pseudomonas aeruginosa PA01
caaaggcgucgauc

SEQ ID NO: 3512993 - RNA, 14 nt, Pseudomonas aeruginosa PA01
caacaaaccucgag

SEQ ID NO: 3512994 - RNA, 23 nt, Pseudomonas aeruginosa PA01
caacaaggcauucaccagcgacg

SEQ ID NO: 3512995 - RNA, 16 nt, Pseudomonas aeruginosa PA01
caacacaugcaggcuc

SEQ ID NO: 3512996 - RNA, 13 nt, Pseudomonas aeruginosa PA01
caacaccagcgcc

SEQ ID NO: 3512997 - RNA, 15 nt, Pseudomonas aeruginosa PA01
caacaccuggcgcuc

SEQ ID NO: 3512998 - RNA, 20 nt, Pseudomonas aeruginosa PA01
caacaccuggcgcucgccgu

SEQ ID NO: 3512999 - RNA, 19 nt, Pseudomonas aeruginosa PA01
caacaccuugcgcaccgcc

SEQ ID NO: 3513000 - RNA, 20 nt, Pseudomonas aeruginosa PA01
caacaccuugcgcaccgccu

SEQ ID NO: 3513001 - RNA, 22 nt, Pseudomonas aeruginosa PA01
caacaccuugcgcaccgccugc

SEQ ID NO: 3513002 - RNA, 17 nt, Pseudomonas aeruginosa PA01
caacacggauagcaccg

SEQ ID NO: 3513003 - RNA, 16 nt, Pseudomonas aeruginosa PA01
caacagcaggagaagc

SEQ ID NO: 3513004 - RNA, 12 nt, Pseudomonas aeruginosa PA01
caacagcaggua

SEQ ID NO: 3513005 - RNA, 14 nt, Pseudomonas aeruginosa PA01
caacagcagguaga

SEQ ID NO: 3513006 - RNA, 19 nt, Pseudomonas aeruginosa PA01
caacagcagguagaccacg

SEQ ID NO: 3513007 - RNA, 12 nt, Pseudomonas aeruginosa PA01
caacagccggcg

SEQ ID NO: 3513008 - RNA, 14 nt, Pseudomonas aeruginosa PA01
caacagcgaagcug

SEQ ID NO: 3513009 - RNA, 19 nt, Pseudomonas aeruginosa PA01
caacagcgaagcuggcgca

SEQ ID NO: 3513010 - RNA, 15 nt, Pseudomonas aeruginosa PA01
caacagcgccgcgcg

SEQ ID NO: 3513011 - RNA, 16 nt, Pseudomonas aeruginosa PA01
caacagcgcggcggug

SEQ ID NO: 3513012 - RNA, 18 nt, Pseudomonas aeruginosa PA01
caacagcgcggcggugca

SEQ ID NO: 3513013 - RNA, 20 nt, Pseudomonas aeruginosa PA01
caacagcggugugcucaggc

SEQ ID NO: 3513014 - RNA, 13 nt, Pseudomonas aeruginosa PA01
caacagcguucac

SEQ ID NO: 3513015 - RNA, 16 nt, Pseudomonas aeruginosa PA01
caacagcguuuuccug

SEQ ID NO: 3513016 - RNA, 15 nt, Pseudomonas aeruginosa PA01
caacaggacccagcc

SEQ ID NO: 3513017 - RNA, 12 nt, Pseudomonas aeruginosa PA01
caacaggccggg

SEQ ID NO: 3513018 - RNA, 23 nt, Pseudomonas aeruginosa PA01
caacagggcauuggccaucagcg

SEQ ID NO: 3513019 - RNA, 20 nt, Pseudomonas aeruginosa PA01
caacagggcgucgucgaggc

SEQ ID NO: 3513020 - RNA, 18 nt, Pseudomonas aeruginosa PA01
caacagucgucgcgcagc

SEQ ID NO: 3513021 - RNA, 19 nt, Pseudomonas aeruginosa PA01
caacagucgucgcgcagcu

SEQ ID NO: 3513022 - RNA, 22 nt, Pseudomonas aeruginosa PA01
caacaguggguaggccaggcaa

SEQ ID NO: 3513023 - RNA, 14 nt, Pseudomonas aeruginosa PA01
caacaguucugccg

SEQ ID NO: 3513024 - RNA, 18 nt, Pseudomonas aeruginosa PA01
caacaguucugccgcaga

SEQ ID NO: 3513025 - RNA, 22 nt, Pseudomonas aeruginosa PA01
caacaguugccgcagcagcggc

SEQ ID NO: 3513026 - RNA, 23 nt, Pseudomonas aeruginosa PA01
caacaguugccgcagcagcggcg

SEQ ID NO: 3513027 - RNA, 16 nt, Pseudomonas aeruginosa PA01
caacauggcgucggcg

SEQ ID NO: 3513028 - RNA, 17 nt, Pseudomonas aeruginosa PA01
caaccaccaugcggcua

SEQ ID NO: 3513029 - RNA, 13 nt, Pseudomonas aeruginosa PA01
caaccaccggcgc

SEQ ID NO: 3513030 - RNA, 14 nt, Pseudomonas aeruginosa PA01
caaccaccggcgca

SEQ ID NO: 3513031 - RNA, 14 nt, Pseudomonas aeruginosa PA01
caaccacuccagcg

SEQ ID NO: 3513032 - RNA, 15 nt, Pseudomonas aeruginosa PA01
caaccacuccagcgg

SEQ ID NO: 3513033 - RNA, 14 nt, Pseudomonas aeruginosa PA01
caaccagaccagca

SEQ ID NO: 3513034 - RNA, 16 nt, Pseudomonas aeruginosa PA01
caaccagauccgggaa

SEQ ID NO: 3513035 - RNA, 13 nt, Pseudomonas aeruginosa PA01
caaccagcaccgc

SEQ ID NO: 3513036 - RNA, 22 nt, Pseudomonas aeruginosa PA01
caaccagcaccgcaagggugcu

SEQ ID NO: 3513037 - RNA, 22 nt, Pseudomonas aeruginosa PA01
caaccaggcgauaucccgccgc

SEQ ID NO: 3513038 - RNA, 13 nt, Pseudomonas aeruginosa PA01
caaccaguaggcg

SEQ ID NO: 3513039 - RNA, 17 nt, Pseudomonas aeruginosa PA01
caaccaguaggcguggu

SEQ ID NO: 3513040 - RNA, 23 nt, Pseudomonas aeruginosa PA01
caaccaguaggcguggucuuccu

SEQ ID NO: 3513041 - RNA, 17 nt, Pseudomonas aeruginosa PA01
caaccaugguuuccgcc

SEQ ID NO: 3513042 - RNA, 19 nt, Pseudomonas aeruginosa PA01
caaccaugguuuccgccgg

SEQ ID NO: 3513043 - RNA, 20 nt, Pseudomonas aeruginosa PA01
caaccaugguuuccgccgga

SEQ ID NO: 3513044 - RNA, 22 nt, Pseudomonas aeruginosa PA01
caaccaugguuuccgccggacc

SEQ ID NO: 3513045 - RNA, 23 nt, Pseudomonas aeruginosa PA01
caaccauucgucauuggccgaau

SEQ ID NO: 3513046 - RNA, 16 nt, Pseudomonas aeruginosa PA01
caacccagggcgcugc

SEQ ID NO: 3513047 - RNA, 17 nt, Pseudomonas aeruginosa PA01
caacccagggcgcugcc

SEQ ID NO: 3513048 - RNA, 24 nt, Pseudomonas aeruginosa PA01
caacccagggcgcugccgaucagc

SEQ ID NO: 3513049 - RNA, 15 nt, Pseudomonas aeruginosa PA01
caacccgccagcaag

SEQ ID NO: 3513050 - RNA, 16 nt, Pseudomonas aeruginosa PA01
caacccgccagcaaga

SEQ ID NO: 3513051 - RNA, 14 nt, Pseudomonas aeruginosa PA01
caacccgcccggcu

SEQ ID NO: 3513052 - RNA, 15 nt, Pseudomonas aeruginosa PA01
caacccgcccggcuc

SEQ ID NO: 3513053 - RNA, 23 nt, Pseudomonas aeruginosa PA01
caacccgcccggcucaacugcuu

SEQ ID NO: 3513054 - RNA, 14 nt, Pseudomonas aeruginosa PA01
caacccgccgcuga

SEQ ID NO: 3513055 - RNA, 13 nt, Pseudomonas aeruginosa PA01
caacccgcuccgu

SEQ ID NO: 3513056 - RNA, 14 nt, Pseudomonas aeruginosa PA01
caacccggccagcc

SEQ ID NO: 3513057 - RNA, 15 nt, Pseudomonas aeruginosa PA01
caacccggccagccc

SEQ ID NO: 3513058 - RNA, 21 nt, Pseudomonas aeruginosa PA01
caacccggccagcccggccuc

SEQ ID NO: 3513059 - RNA, 15 nt, Pseudomonas aeruginosa PA01
caacccggcgcuggc

SEQ ID NO: 3513060 - RNA, 16 nt, Pseudomonas aeruginosa PA01
caacccggcgcuggcc

SEQ ID NO: 3513061 - RNA, 20 nt, Pseudomonas aeruginosa PA01
caacccggcgcuggccgcgc

SEQ ID NO: 3513062 - RNA, 23 nt, Pseudomonas aeruginosa PA01
caacccuucauuucuacuucccu

SEQ ID NO: 3513063 - RNA, 17 nt, Pseudomonas aeruginosa PA01
caacccuugcucccgcc

SEQ ID NO: 3513064 - RNA, 21 nt, Pseudomonas aeruginosa PA01
caacccuuugauggcgcugcc

SEQ ID NO: 3513065 - RNA, 18 nt, Pseudomonas aeruginosa PA01
caaccgauauggcuggcg

SEQ ID NO: 3513066 - RNA, 20 nt, Pseudomonas aeruginosa PA01
caaccgauauggcuggcgca

SEQ ID NO: 3513067 - RNA, 20 nt, Pseudomonas aeruginosa PA01
caaccgcagacuccggcgca

SEQ ID NO: 3513068 - RNA, 11 nt, Pseudomonas aeruginosa PA01
caaccgcccga

SEQ ID NO: 3513069 - RNA, 19 nt, Pseudomonas aeruginosa PA01
caaccgcccgagcuuugcg

SEQ ID NO: 3513070 - RNA, 15 nt, Pseudomonas aeruginosa PA01
caaccgcccuggucc

SEQ ID NO: 3513071 - RNA, 13 nt, Pseudomonas aeruginosa PA01
caaccgccgccgc

SEQ ID NO: 3513072 - RNA, 22 nt, Pseudomonas aeruginosa PA01
caaccgccgccgcaaccgcccg

SEQ ID NO: 3513073 - RNA, 19 nt, Pseudomonas aeruginosa PA01
caaccgccguagccgucgu

SEQ ID NO: 3513074 - RNA, 17 nt, Pseudomonas aeruginosa PA01
caaccgcgauggcguga

SEQ ID NO: 3513075 - RNA, 15 nt, Pseudomonas aeruginosa PA01
caaccgcgcucggcg

SEQ ID NO: 3513076 - RNA, 13 nt, Pseudomonas aeruginosa PA01
caaccgcggcggc

SEQ ID NO: 3513077 - RNA, 16 nt, Pseudomonas aeruginosa PA01
caaccgcugccgccgu

SEQ ID NO: 3513078 - RNA, 17 nt, Pseudomonas aeruginosa PA01
caaccgcugccgccguc

SEQ ID NO: 3513079 - RNA, 15 nt, Pseudomonas aeruginosa PA01
caaccgcuugucgcc

SEQ ID NO: 3513080 - RNA, 21 nt, Pseudomonas aeruginosa PA01
caaccgcuugucgccuucccg

SEQ ID NO: 3513081 - RNA, 20 nt, Pseudomonas aeruginosa PA01
caaccggcguccccuuccuc

SEQ ID NO: 3513082 - RNA, 17 nt, Pseudomonas aeruginosa PA01
caaccgggcagcagccg

SEQ ID NO: 3513083 - RNA, 16 nt, Pseudomonas aeruginosa PA01
caaccgggcaucgccg

SEQ ID NO: 3513084 - RNA, 18 nt, Pseudomonas aeruginosa PA01
caaccgggcaucgccgac

SEQ ID NO: 3513085 - RNA, 19 nt, Pseudomonas aeruginosa PA01
caaccgggcaucgccgacc

SEQ ID NO: 3513086 - RNA, 21 nt, Pseudomonas aeruginosa PA01
caaccggguaccugcucgcgg

SEQ ID NO: 3513087 - RNA, 17 nt, Pseudomonas aeruginosa PA01
caaccgguccucgcccg

SEQ ID NO: 3513088 - RNA, 22 nt, Pseudomonas aeruginosa PA01
caaccgguuucccucgagcacc

SEQ ID NO: 3513089 - RNA, 11 nt, Pseudomonas aeruginosa PA01
caaccgucgaa

SEQ ID NO: 3513090 - RNA, 18 nt, Pseudomonas aeruginosa PA01
caaccgucgcccuggugc

SEQ ID NO: 3513091 - RNA, 17 nt, Pseudomonas aeruginosa PA01
caaccguuccagcgccu

SEQ ID NO: 3513092 - RNA, 20 nt, Pseudomonas aeruginosa PA01
caaccguucugccgcagcgc

SEQ ID NO: 3513093 - RNA, 22 nt, Pseudomonas aeruginosa PA01
caaccugccagaaaacccagcg

SEQ ID NO: 3513094 - RNA, 14 nt, Pseudomonas aeruginosa PA01
caaccuucucccuu

SEQ ID NO: 3513095 - RNA, 17 nt, Pseudomonas aeruginosa PA01
caaccuugcacauccag

SEQ ID NO: 3513096 - RNA, 18 nt, Pseudomonas aeruginosa PA01
caaccuuucggagugaac

SEQ ID NO: 3513097 - RNA, 19 nt, Pseudomonas aeruginosa PA01
caacgaaaaagggcggcca

SEQ ID NO: 3513098 - RNA, 21 nt, Pseudomonas aeruginosa PA01
caacgaaaaagggcggccacc

SEQ ID NO: 3513099 - RNA, 18 nt, Pseudomonas aeruginosa PA01
caacgaaaagagccgcgc

SEQ ID NO: 3513100 - RNA, 19 nt, Pseudomonas aeruginosa PA01
caacgaaaagccgccccga

SEQ ID NO: 3513101 - RNA, 14 nt, Pseudomonas aeruginosa PA01
caacgagccgagca

SEQ ID NO: 3513102 - RNA, 15 nt, Pseudomonas aeruginosa PA01
caacgagccgagcag

SEQ ID NO: 3513103 - RNA, 18 nt, Pseudomonas aeruginosa PA01
caacgauaccgccgccgg

SEQ ID NO: 3513104 - RNA, 20 nt, Pseudomonas aeruginosa PA01
caacgauucgacgcagcgcg

SEQ ID NO: 3513105 - RNA, 12 nt, Pseudomonas aeruginosa PA01
caacgcaggcgc

SEQ ID NO: 3513106 - RNA, 16 nt, Pseudomonas aeruginosa PA01
caacgccagcaggcgc

SEQ ID NO: 3513107 - RNA, 17 nt, Pseudomonas aeruginosa PA01
caacgccagcaggcgca

SEQ ID NO: 3513108 - RNA, 14 nt, Pseudomonas aeruginosa PA01
caacgcccgcgagc

SEQ ID NO: 3513109 - RNA, 16 nt, Pseudomonas aeruginosa PA01
caacgcccgcgagccg

SEQ ID NO: 3513110 - RNA, 19 nt, Pseudomonas aeruginosa PA01
caacgccgacggcgugccg

SEQ ID NO: 3513111 - RNA, 12 nt, Pseudomonas aeruginosa PA01
caacgccgccaa

SEQ ID NO: 3513112 - RNA, 14 nt, Pseudomonas aeruginosa PA01
caacgccgccaacu

SEQ ID NO: 3513113 - RNA, 18 nt, Pseudomonas aeruginosa PA01
caacgccgcccccagcgc

SEQ ID NO: 3513114 - RNA, 19 nt, Pseudomonas aeruginosa PA01
caacgccgcccccagcgcg

SEQ ID NO: 3513115 - RNA, 21 nt, Pseudomonas aeruginosa PA01
caacgccgcccccagcgcgcc

SEQ ID NO: 3513116 - RNA, 12 nt, Pseudomonas aeruginosa PA01
caacgccgccgg

SEQ ID NO: 3513117 - RNA, 15 nt, Pseudomonas aeruginosa PA01
caacgccggcccgug

SEQ ID NO: 3513118 - RNA, 16 nt, Pseudomonas aeruginosa PA01
caacgccucgcggcua

SEQ ID NO: 3513119 - RNA, 23 nt, Pseudomonas aeruginosa PA01
caacgccucgcggcuaucgauca

SEQ ID NO: 3513120 - RNA, 18 nt, Pseudomonas aeruginosa PA01
caacgccuggccacgcca

SEQ ID NO: 3513121 - RNA, 14 nt, Pseudomonas aeruginosa PA01
caacgcgcagaggc

SEQ ID NO: 3513122 - RNA, 20 nt, Pseudomonas aeruginosa PA01
caacgcgcagaggcgcucca

SEQ ID NO: 3513123 - RNA, 16 nt, Pseudomonas aeruginosa PA01
caacgcggccagcagc

SEQ ID NO: 3513124 - RNA, 17 nt, Pseudomonas aeruginosa PA01
caacgcggccagcagca

SEQ ID NO: 3513125 - RNA, 21 nt, Pseudomonas aeruginosa PA01
caacgcggccagcagcacgcc

SEQ ID NO: 3513126 - RNA, 13 nt, Pseudomonas aeruginosa PA01
caacgcggcguca

SEQ ID NO: 3513127 - RNA, 20 nt, Pseudomonas aeruginosa PA01
caacgcgguuauccgccgcu

SEQ ID NO: 3513128 - RNA, 23 nt, Pseudomonas aeruginosa PA01
caacgcugcaauucgucggccug

SEQ ID NO: 3513129 - RNA, 15 nt, Pseudomonas aeruginosa PA01
caacgcuuccagcac

SEQ ID NO: 3513130 - RNA, 16 nt, Pseudomonas aeruginosa PA01
caacgcuuccagcacc

SEQ ID NO: 3513131 - RNA, 20 nt, Pseudomonas aeruginosa PA01
caacgcuuccagcaccuccc

SEQ ID NO: 3513132 - RNA, 19 nt, Pseudomonas aeruginosa PA01
caacggaaaaaggcgccuu

SEQ ID NO: 3513133 - RNA, 23 nt, Pseudomonas aeruginosa PA01
caacggacguuccaccuggcgca

SEQ ID NO: 3513134 - RNA, 17 nt, Pseudomonas aeruginosa PA01
caacggagcugguacgc

SEQ ID NO: 3513135 - RNA, 16 nt, Pseudomonas aeruginosa PA01
caacggcagcgcuucg

SEQ ID NO: 3513136 - RNA, 22 nt, Pseudomonas aeruginosa PA01
caacggcccuuccacuucgaag

SEQ ID NO: 3513137 - RNA, 19 nt, Pseudomonas aeruginosa PA01
caacggccguugaagcaga

SEQ ID NO: 3513138 - RNA, 16 nt, Pseudomonas aeruginosa PA01
caacggcgaaucgucg

SEQ ID NO: 3513139 - RNA, 17 nt, Pseudomonas aeruginosa PA01
caacggcguguccaggg

SEQ ID NO: 3513140 - RNA, 22 nt, Pseudomonas aeruginosa PA01
caacggcguuauccgccgcuca

SEQ ID NO: 3513141 - RNA, 19 nt, Pseudomonas aeruginosa PA01
caacggcuccuugaaggcu

SEQ ID NO: 3513142 - RNA, 17 nt, Pseudomonas aeruginosa PA01
caacgggacgccaggcg

SEQ ID NO: 3513143 - RNA, 16 nt, Pseudomonas aeruginosa PA01
caacgguagcggauca

SEQ ID NO: 3513144 - RNA, 18 nt, Pseudomonas aeruginosa PA01
caacguccucgaugcccg

SEQ ID NO: 3513145 - RNA, 21 nt, Pseudomonas aeruginosa PA01
caacguccucgaugcccgccu

SEQ ID NO: 3513146 - RNA, 14 nt, Pseudomonas aeruginosa PA01
caacguccucgcgc

SEQ ID NO: 3513147 - RNA, 19 nt, Pseudomonas aeruginosa PA01
caacguccucgcgccgcuu

SEQ ID NO: 3513148 - RNA, 15 nt, Pseudomonas aeruginosa PA01
caacucagucgaggu

SEQ ID NO: 3513149 - RNA, 14 nt, Pseudomonas aeruginosa PA01
caacuccgccaggc

SEQ ID NO: 3513150 - RNA, 20 nt, Pseudomonas aeruginosa PA01
caacuccgccaggcgcucca

SEQ ID NO: 3513151 - RNA, 16 nt, Pseudomonas aeruginosa PA01
caacuccgccugucca

SEQ ID NO: 3513152 - RNA, 17 nt, Pseudomonas aeruginosa PA01
caacuccgccuguccac

SEQ ID NO: 3513153 - RNA, 13 nt, Pseudomonas aeruginosa PA01
caacuccugcaaa

SEQ ID NO: 3513154 - RNA, 12 nt, Pseudomonas aeruginosa PA01
caacucgccgcc

SEQ ID NO: 3513155 - RNA, 13 nt, Pseudomonas aeruginosa PA01
caacucgccgccg

SEQ ID NO: 3513156 - RNA, 14 nt, Pseudomonas aeruginosa PA01
caacucgccgccga

SEQ ID NO: 3513157 - RNA, 16 nt, Pseudomonas aeruginosa PA01
caacucggccuggaac

SEQ ID NO: 3513158 - RNA, 17 nt, Pseudomonas aeruginosa PA01
caacucggccuggaacc

SEQ ID NO: 3513159 - RNA, 12 nt, Pseudomonas aeruginosa PA01
caacucggcgcc

SEQ ID NO: 3513160 - RNA, 19 nt, Pseudomonas aeruginosa PA01
caacucggcggcgagcgcc

SEQ ID NO: 3513161 - RNA, 20 nt, Pseudomonas aeruginosa PA01
caacucggcggcgagcgccg

SEQ ID NO: 3513162 - RNA, 14 nt, Pseudomonas aeruginosa PA01
caacugacggcgga

SEQ ID NO: 3513163 - RNA, 15 nt, Pseudomonas aeruginosa PA01
caacugagcgcaacu

SEQ ID NO: 3513164 - RNA, 23 nt, Pseudomonas aeruginosa PA01
caacugauagucgacggaacagg

SEQ ID NO: 3513165 - RNA, 15 nt, Pseudomonas aeruginosa PA01
caacugaucagccgg

SEQ ID NO: 3513166 - RNA, 16 nt, Pseudomonas aeruginosa PA01
caacugaucagccggg

SEQ ID NO: 3513167 - RNA, 14 nt, Pseudomonas aeruginosa PA01
caacugccaaccgc

SEQ ID NO: 3513168 - RNA, 17 nt, Pseudomonas aeruginosa PA01
caacugccaaccgcgcu

SEQ ID NO: 3513169 - RNA, 19 nt, Pseudomonas aeruginosa PA01
caacugccgcccgcucaag

SEQ ID NO: 3513170 - RNA, 19 nt, Pseudomonas aeruginosa PA01
caacugcgcccccagcgcc

SEQ ID NO: 3513171 - RNA, 15 nt, Pseudomonas aeruginosa PA01
caacugcggggcgcu

SEQ ID NO: 3513172 - RNA, 13 nt, Pseudomonas aeruginosa PA01
caacugcguccga

SEQ ID NO: 3513173 - RNA, 11 nt, Pseudomonas aeruginosa PA01
caacugcucga

SEQ ID NO: 3513174 - RNA, 23 nt, Pseudomonas aeruginosa PA01
caacugcucgggcgucuccugcc

SEQ ID NO: 3513175 - RNA, 21 nt, Pseudomonas aeruginosa PA01
caacugcucuuuaacaagucg

SEQ ID NO: 3513176 - RNA, 16 nt, Pseudomonas aeruginosa PA01
caacugcuuaccuugc

SEQ ID NO: 3513177 - RNA, 17 nt, Pseudomonas aeruginosa PA01
caacugcuuaccuugcc

SEQ ID NO: 3513178 - RNA, 21 nt, Pseudomonas aeruginosa PA01
caacugcuuaccuugccggug

SEQ ID NO: 3513179 - RNA, 23 nt, Pseudomonas aeruginosa PA01
caacugcuuaccuugccggugcg

SEQ ID NO: 3513180 - RNA, 14 nt, Pseudomonas aeruginosa PA01
caacugcuucaggc

SEQ ID NO: 3513181 - RNA, 18 nt, Pseudomonas aeruginosa PA01
caacugcuucaggcgcgc

SEQ ID NO: 3513182 - RNA, 23 nt, Pseudomonas aeruginosa PA01
agccauuucugcugugcucuucg

SEQ ID NO: 3513183 - RNA, 17 nt, Pseudomonas aeruginosa PA01
agccauuuuagaaaaau

SEQ ID NO: 3513184 - RNA, 15 nt, Pseudomonas aeruginosa PA01
agcccaccaccaccg

SEQ ID NO: 3513185 - RNA, 19 nt, Pseudomonas aeruginosa PA01
agcccacccccagcccggc

SEQ ID NO: 3513186 - RNA, 20 nt, Pseudomonas aeruginosa PA01
agcccacccccggcccggcc

SEQ ID NO: 3513187 - RNA, 22 nt, Pseudomonas aeruginosa PA01
agcccacccccggcccggccau

SEQ ID NO: 3513188 - RNA, 15 nt, Pseudomonas aeruginosa PA01
agcccacgcgccugg

SEQ ID NO: 3513189 - RNA, 17 nt, Pseudomonas aeruginosa PA01
agcccacgcgccuggcc

SEQ ID NO: 3513190 - RNA, 22 nt, Pseudomonas aeruginosa PA01
agcccacucgauggugggcucu

SEQ ID NO: 3513191 - RNA, 15 nt, Pseudomonas aeruginosa PA01
agcccagaacagcaa

SEQ ID NO: 3513192 - RNA, 17 nt, Pseudomonas aeruginosa PA01
agcccagaacagcaaag

SEQ ID NO: 3513193 - RNA, 15 nt, Pseudomonas aeruginosa PA01
agcccagcaggucga

SEQ ID NO: 3513194 - RNA, 19 nt, Pseudomonas aeruginosa PA01
agcccagcaggucgaucuc

SEQ ID NO: 3513195 - RNA, 22 nt, Pseudomonas aeruginosa PA01
agcccagcgagccgaucaccag

SEQ ID NO: 3513196 - RNA, 12 nt, Pseudomonas aeruginosa PA01
agcccagcgccg

SEQ ID NO: 3513197 - RNA, 12 nt, Pseudomonas aeruginosa PA01
agcccagcgccu

SEQ ID NO: 3513198 - RNA, 16 nt, Pseudomonas aeruginosa PA01
agcccagcgccugcaa

SEQ ID NO: 3513199 - RNA, 21 nt, Pseudomonas aeruginosa PA01
agcccagcgcuuccucgggca

SEQ ID NO: 3513200 - RNA, 19 nt, Pseudomonas aeruginosa PA01
agcccagcggcagggcggc

SEQ ID NO: 3513201 - RNA, 21 nt, Pseudomonas aeruginosa PA01
agcccagcggcagggcggcga

SEQ ID NO: 3513202 - RNA, 21 nt, Pseudomonas aeruginosa PA01
agcccaggcagaucgcgccga

SEQ ID NO: 3513203 - RNA, 23 nt, Pseudomonas aeruginosa PA01
agcccaggcagaucgcgccgagc

SEQ ID NO: 3513204 - RNA, 14 nt, Pseudomonas aeruginosa PA01
agcccaggccgaag

SEQ ID NO: 3513205 - RNA, 18 nt, Pseudomonas aeruginosa PA01
agcccaggccgaaggccu

SEQ ID NO: 3513206 - RNA, 20 nt, Pseudomonas aeruginosa PA01
agcccaggccgaaggccugg

SEQ ID NO: 3513207 - RNA, 12 nt, Pseudomonas aeruginosa PA01
agcccaggcgcu

SEQ ID NO: 3513208 - RNA, 17 nt, Pseudomonas aeruginosa PA01
agcccaggcgcucggcg

SEQ ID NO: 3513209 - RNA, 23 nt, Pseudomonas aeruginosa PA01
agcccaggcgcucggcggcgcgc

SEQ ID NO: 3513210 - RNA, 13 nt, Pseudomonas aeruginosa PA01
agcccaggcgucg

SEQ ID NO: 3513211 - RNA, 21 nt, Pseudomonas aeruginosa PA01
agcccaggcgucgcgccagca

SEQ ID NO: 3513212 - RNA, 23 nt, Pseudomonas aeruginosa PA01
agcccaggcgucgcgccagcacc

SEQ ID NO: 3513213 - RNA, 20 nt, Pseudomonas aeruginosa PA01
agcccaggcugacccggucg

SEQ ID NO: 3513214 - RNA, 12 nt, Pseudomonas aeruginosa PA01
agcccaggggca

SEQ ID NO: 3513215 - RNA, 22 nt, Pseudomonas aeruginosa PA01
agcccagguacugggcgauguc

SEQ ID NO: 3513216 - RNA, 13 nt, Pseudomonas aeruginosa PA01
agcccagguggca

SEQ ID NO: 3513217 - RNA, 18 nt, Pseudomonas aeruginosa PA01
agcccagguggcaggccu

SEQ ID NO: 3513218 - RNA, 16 nt, Pseudomonas aeruginosa PA01
agcccauacaccaggc

SEQ ID NO: 3513219 - RNA, 23 nt, Pseudomonas aeruginosa PA01
agcccauacaccaggccggcggc

SEQ ID NO: 3513220 - RNA, 17 nt, Pseudomonas aeruginosa PA01
agcccaugaaaaagccc

SEQ ID NO: 3513221 - RNA, 16 nt, Pseudomonas aeruginosa PA01
agcccauggucagcgg

SEQ ID NO: 3513222 - RNA, 17 nt, Pseudomonas aeruginosa PA01
agccccaccgccagguu

SEQ ID NO: 3513223 - RNA, 22 nt, Pseudomonas aeruginosa PA01
agccccacgucguuucucggcg

SEQ ID NO: 3513224 - RNA, 23 nt, Pseudomonas aeruginosa PA01
agccccacgucguuucucggcga

SEQ ID NO: 3513225 - RNA, 21 nt, Pseudomonas aeruginosa PA01
agccccagagcccgccgaaca

SEQ ID NO: 3513226 - RNA, 15 nt, Pseudomonas aeruginosa PA01
agccccagaugggua

SEQ ID NO: 3513227 - RNA, 14 nt, Pseudomonas aeruginosa PA01
agccccagcacgcc

SEQ ID NO: 3513228 - RNA, 20 nt, Pseudomonas aeruginosa PA01
agccccagcacgccgagcaa

SEQ ID NO: 3513229 - RNA, 16 nt, Pseudomonas aeruginosa PA01
agccccagcccagggc

SEQ ID NO: 3513230 - RNA, 17 nt, Pseudomonas aeruginosa PA01
agccccagccucggcag

SEQ ID NO: 3513231 - RNA, 23 nt, Pseudomonas aeruginosa PA01
agccccagccucggcagggcgcc

SEQ ID NO: 3513232 - RNA, 20 nt, Pseudomonas aeruginosa PA01
agccccagguaggcgaaggc

SEQ ID NO: 3513233 - RNA, 22 nt, Pseudomonas aeruginosa PA01
agccccagguaggcgaaggcga

SEQ ID NO: 3513234 - RNA, 22 nt, Pseudomonas aeruginosa PA01
agccccaugccguucagcgucc

SEQ ID NO: 3513235 - RNA, 16 nt, Pseudomonas aeruginosa PA01
agcccccauaccgccu

SEQ ID NO: 3513236 - RNA, 15 nt, Pseudomonas aeruginosa PA01
agcccccgccgcuga

SEQ ID NO: 3513237 - RNA, 16 nt, Pseudomonas aeruginosa PA01
agcccccgccggccgg

SEQ ID NO: 3513238 - RNA, 14 nt, Pseudomonas aeruginosa PA01
agcccccggcgccc

SEQ ID NO: 3513239 - RNA, 15 nt, Pseudomonas aeruginosa PA01
agcccccggcgccca

SEQ ID NO: 3513240 - RNA, 17 nt, Pseudomonas aeruginosa PA01
agccccgaggccagcag

SEQ ID NO: 3513241 - RNA, 15 nt, Pseudomonas aeruginosa PA01
agccccgccgaagcg

SEQ ID NO: 3513242 - RNA, 19 nt, Pseudomonas aeruginosa PA01
agccccgccgaagcggggc

SEQ ID NO: 3513243 - RNA, 20 nt, Pseudomonas aeruginosa PA01
agccccgcucgucauggcgc

SEQ ID NO: 3513244 - RNA, 17 nt, Pseudomonas aeruginosa PA01
agccccggcaggcaggc

SEQ ID NO: 3513245 - RNA, 13 nt, Pseudomonas aeruginosa PA01
agccccggcccgg

SEQ ID NO: 3513246 - RNA, 23 nt, Pseudomonas aeruginosa PA01
agccccggccucaacgaccgccc

SEQ ID NO: 3513247 - RNA, 17 nt, Pseudomonas aeruginosa PA01
agccccgguuacucgcc

SEQ ID NO: 3513248 - RNA, 20 nt, Pseudomonas aeruginosa PA01
agccccgguuacucgccggc

SEQ ID NO: 3513249 - RNA, 22 nt, Pseudomonas aeruginosa PA01
agccccgguuacucgccggcau

SEQ ID NO: 3513250 - RNA, 17 nt, Pseudomonas aeruginosa PA01
agccccguuuuuccuug

SEQ ID NO: 3513251 - RNA, 13 nt, Pseudomonas aeruginosa PA01
agccccucgccau

SEQ ID NO: 3513252 - RNA, 17 nt, Pseudomonas aeruginosa PA01
agccccucggccaggac

SEQ ID NO: 3513253 - RNA, 15 nt, Pseudomonas aeruginosa PA01
agccccugcgccuca

SEQ ID NO: 3513254 - RNA, 16 nt, Pseudomonas aeruginosa PA01
agccccuggcgcuggg

SEQ ID NO: 3513255 - RNA, 15 nt, Pseudomonas aeruginosa PA01
agccccuugcgcucu

SEQ ID NO: 3513256 - RNA, 19 nt, Pseudomonas aeruginosa PA01
agccccuugcgcucuggcg

SEQ ID NO: 3513257 - RNA, 15 nt, Pseudomonas aeruginosa PA01
agcccgagugcgccc

SEQ ID NO: 3513258 - RNA, 22 nt, Pseudomonas aeruginosa PA01
agcccgagugcgcccagcagca

SEQ ID NO: 3513259 - RNA, 19 nt, Pseudomonas aeruginosa PA01
agcccgccaacguccucga

SEQ ID NO: 3513260 - RNA, 20 nt, Pseudomonas aeruginosa PA01
agcccgccaacguccucgau

SEQ ID NO: 3513261 - RNA, 13 nt, Pseudomonas aeruginosa PA01
agcccgccacgcu

SEQ ID NO: 3513262 - RNA, 14 nt, Pseudomonas aeruginosa PA01
agcccgccaggugg

SEQ ID NO: 3513263 - RNA, 16 nt, Pseudomonas aeruginosa PA01
agcccgccagguggcg

SEQ ID NO: 3513264 - RNA, 17 nt, Pseudomonas aeruginosa PA01
agcccgccagguggcgg

SEQ ID NO: 3513265 - RNA, 17 nt, Pseudomonas aeruginosa PA01
agcccgccgaacagcaa

SEQ ID NO: 3513266 - RNA, 16 nt, Pseudomonas aeruginosa PA01
agcccgccggcgaugc

SEQ ID NO: 3513267 - RNA, 17 nt, Pseudomonas aeruginosa PA01
agcccgccggcgaugcg

SEQ ID NO: 3513268 - RNA, 22 nt, Pseudomonas aeruginosa PA01
agcccgccgugcgcuccgccag

SEQ ID NO: 3513269 - RNA, 18 nt, Pseudomonas aeruginosa PA01
agcccgccuucaggcggg

SEQ ID NO: 3513270 - RNA, 23 nt, Pseudomonas aeruginosa PA01
agcccgccuucaggcgggcucuu

SEQ ID NO: 3513271 - RNA, 21 nt, Pseudomonas aeruginosa PA01
agcccgcgcucggccgccugg

SEQ ID NO: 3513272 - RNA, 14 nt, Pseudomonas aeruginosa PA01
agcccgcggaacgc

SEQ ID NO: 3513273 - RNA, 20 nt, Pseudomonas aeruginosa PA01
agcccgcggcaucggccugg

SEQ ID NO: 3513274 - RNA, 15 nt, Pseudomonas aeruginosa PA01
agcccgcggcgagca

SEQ ID NO: 3513275 - RNA, 20 nt, Pseudomonas aeruginosa PA01
agcccgcguccuccuggagg

SEQ ID NO: 3513276 - RNA, 13 nt, Pseudomonas aeruginosa PA01
agcccgcuccgca

SEQ ID NO: 3513277 - RNA, 14 nt, Pseudomonas aeruginosa PA01
agcccgcuccgcau

SEQ ID NO: 3513278 - RNA, 16 nt, Pseudomonas aeruginosa PA01
agcccgcuucgagcgg

SEQ ID NO: 3513279 - RNA, 23 nt, Pseudomonas aeruginosa PA01
agcccggagccguugaaacgcuc

SEQ ID NO: 3513280 - RNA, 20 nt, Pseudomonas aeruginosa PA01
agcccggcaaaugccgggcu

SEQ ID NO: 3513281 - RNA, 20 nt, Pseudomonas aeruginosa PA01
agcccggcaauagccgggcu

SEQ ID NO: 3513282 - RNA, 15 nt, Pseudomonas aeruginosa PA01
agcccggcauucgcc

SEQ ID NO: 3513283 - RNA, 18 nt, Pseudomonas aeruginosa PA01
agcccggcauucgccggg

SEQ ID NO: 3513284 - RNA, 13 nt, Pseudomonas aeruginosa PA01
agcccggccaucc

SEQ ID NO: 3513285 - RNA, 20 nt, Pseudomonas aeruginosa PA01
agcccggccauccuggccgg

SEQ ID NO: 3513286 - RNA, 16 nt, Pseudomonas aeruginosa PA01
agcccggccgcugccg

SEQ ID NO: 3513287 - RNA, 12 nt, Pseudomonas aeruginosa PA01
agcccggccggg

SEQ ID NO: 3513288 - RNA, 13 nt, Pseudomonas aeruginosa PA01
agcccggccucgc

SEQ ID NO: 3513289 - RNA, 22 nt, Pseudomonas aeruginosa PA01
agcccggccuggaucucugcga

SEQ ID NO: 3513290 - RNA, 14 nt, Pseudomonas aeruginosa PA01
agcccggccuggug

SEQ ID NO: 3513291 - RNA, 17 nt, Pseudomonas aeruginosa PA01
agcccggcggugaugcc

SEQ ID NO: 3513292 - RNA, 16 nt, Pseudomonas aeruginosa PA01
agcccgggcaacugcc

SEQ ID NO: 3513293 - RNA, 12 nt, Pseudomonas aeruginosa PA01
agcccggguugc

SEQ ID NO: 3513294 - RNA, 16 nt, Pseudomonas aeruginosa PA01
agcccggguugcccuc

SEQ ID NO: 3513295 - RNA, 21 nt, Pseudomonas aeruginosa PA01
agcccgguccguccagcgcgc

SEQ ID NO: 3513296 - RNA, 19 nt, Pseudomonas aeruginosa PA01
agcccgucgaagccaggca

SEQ ID NO: 3513297 - RNA, 13 nt, Pseudomonas aeruginosa PA01
agcccgucggccu

SEQ ID NO: 3513298 - RNA, 15 nt, Pseudomonas aeruginosa PA01
agcccgucggccucg

SEQ ID NO: 3513299 - RNA, 16 nt, Pseudomonas aeruginosa PA01
agcccgucggccucgc

SEQ ID NO: 3513300 - RNA, 21 nt, Pseudomonas aeruginosa PA01
agcccgucggcgacgggaagc

SEQ ID NO: 3513301 - RNA, 16 nt, Pseudomonas aeruginosa PA01
agcccgugucgccuuc

SEQ ID NO: 3513302 - RNA, 18 nt, Pseudomonas aeruginosa PA01
agcccguguucggccagc

SEQ ID NO: 3513303 - RNA, 20 nt, Pseudomonas aeruginosa PA01
agcccguugcgguagugccc

SEQ ID NO: 3513304 - RNA, 19 nt, Pseudomonas aeruginosa PA01
agcccuaggcgacccggca

SEQ ID NO: 3513305 - RNA, 15 nt, Pseudomonas aeruginosa PA01
agcccucgaccuggc

SEQ ID NO: 3513306 - RNA, 21 nt, Pseudomonas aeruginosa PA01
agcccucggcccggagccaac

SEQ ID NO: 3513307 - RNA, 16 nt, Pseudomonas aeruginosa PA01
agcccugcugcucgcc

SEQ ID NO: 3513308 - RNA, 15 nt, Pseudomonas aeruginosa PA01
agcccugcuggcgca

SEQ ID NO: 3513309 - RNA, 22 nt, Pseudomonas aeruginosa PA01
agcccugcuggcgcagccaggc

SEQ ID NO: 3513310 - RNA, 20 nt, Pseudomonas aeruginosa PA01
agcccuggaaaggccucggc

SEQ ID NO: 3513311 - RNA, 21 nt, Pseudomonas aeruginosa PA01
agcccuggaaaggccucggcg

SEQ ID NO: 3513312 - RNA, 22 nt, Pseudomonas aeruginosa PA01
agcccuggaaaggccucggcga

SEQ ID NO: 3513313 - RNA, 17 nt, Pseudomonas aeruginosa PA01
agcccuggcguggccgg

SEQ ID NO: 3513314 - RNA, 19 nt, Pseudomonas aeruginosa PA01
agcccuggcguggccggcg

SEQ ID NO: 3513315 - RNA, 20 nt, Pseudomonas aeruginosa PA01
agcccuggcguggccggcga

SEQ ID NO: 3513316 - RNA, 11 nt, Pseudomonas aeruginosa PA01
agcccugggcg

SEQ ID NO: 3513317 - RNA, 20 nt, Pseudomonas aeruginosa PA01
agcccugggcgccgccggug

SEQ ID NO: 3513318 - RNA, 22 nt, Pseudomonas aeruginosa PA01
agcccugguaggugcgcuggcg

SEQ ID NO: 3513319 - RNA, 23 nt, Pseudomonas aeruginosa PA01
agcccugguggugaucagcggcc

SEQ ID NO: 3513320 - RNA, 16 nt, Pseudomonas aeruginosa PA01
agcccuucugucuugu

SEQ ID NO: 3513321 - RNA, 17 nt, Pseudomonas aeruginosa PA01
agcccuucugucuuguc

SEQ ID NO: 3513322 - RNA, 18 nt, Pseudomonas aeruginosa PA01
agcccuucugucuugucc

SEQ ID NO: 3513323 - RNA, 16 nt, Pseudomonas aeruginosa PA01
agcccuugcaaccgcc

SEQ ID NO: 3513324 - RNA, 16 nt, Pseudomonas aeruginosa PA01
agcccuugcgcggcgc

SEQ ID NO: 3513325 - RNA, 16 nt, Pseudomonas aeruginosa PA01
agcccuuucagcggcu

SEQ ID NO: 3513326 - RNA, 18 nt, Pseudomonas aeruginosa PA01
agccgaacaguucggcgg

SEQ ID NO: 3513327 - RNA, 22 nt, Pseudomonas aeruginosa PA01
agccgaacaguucggcggugga

SEQ ID NO: 3513328 - RNA, 15 nt, Pseudomonas aeruginosa PA01
agccgaacggguaga

SEQ ID NO: 3513329 - RNA, 21 nt, Pseudomonas aeruginosa PA01
agccgaacggguagagcgggc

SEQ ID NO: 3513330 - RNA, 23 nt, Pseudomonas aeruginosa PA01
agccgaacggguagagcgggccg

SEQ ID NO: 3513331 - RNA, 16 nt, Pseudomonas aeruginosa PA01
agccgaacuccgccag

SEQ ID NO: 3513332 - RNA, 18 nt, Pseudomonas aeruginosa PA01
agccgaacuccgccagca

SEQ ID NO: 3513333 - RNA, 14 nt, Pseudomonas aeruginosa PA01
agccgaagucggcg

SEQ ID NO: 3513334 - RNA, 15 nt, Pseudomonas aeruginosa PA01
agccgaagucggcgu

SEQ ID NO: 3513335 - RNA, 22 nt, Pseudomonas aeruginosa PA01
agccgaccacucgcgagauggc

SEQ ID NO: 3513336 - RNA, 19 nt, Pseudomonas aeruginosa PA01
agccgaccaggccgaucgc

SEQ ID NO: 3513337 - RNA, 20 nt, Pseudomonas aeruginosa PA01
agccgaccccgggguucugc

SEQ ID NO: 3513338 - RNA, 15 nt, Pseudomonas aeruginosa PA01
agccgaccggcgccg

SEQ ID NO: 3513339 - RNA, 18 nt, Pseudomonas aeruginosa PA01
agccgaccguccgccugc

SEQ ID NO: 3513340 - RNA, 20 nt, Pseudomonas aeruginosa PA01
agccgaccuugcgucuucgc

SEQ ID NO: 3513341 - RNA, 13 nt, Pseudomonas aeruginosa PA01
agccgacgaaggc

SEQ ID NO: 3513342 - RNA, 16 nt, Pseudomonas aeruginosa PA01
agccgacgaaggcgag

SEQ ID NO: 3513343 - RNA, 22 nt, Pseudomonas aeruginosa PA01
agccgacgauccggccgaucuc

SEQ ID NO: 3513344 - RNA, 14 nt, Pseudomonas aeruginosa PA01
agccgacgccgagc

SEQ ID NO: 3513345 - RNA, 15 nt, Pseudomonas aeruginosa PA01
agccgacgccgagca

SEQ ID NO: 3513346 - RNA, 18 nt, Pseudomonas aeruginosa PA01
agccgacgccgagcagca

SEQ ID NO: 3513347 - RNA, 19 nt, Pseudomonas aeruginosa PA01
agccgacgccgagcagcac

SEQ ID NO: 3513348 - RNA, 23 nt, Pseudomonas aeruginosa PA01
agccgacguagggcaucgccgac

SEQ ID NO: 3513349 - RNA, 18 nt, Pseudomonas aeruginosa PA01
agccgacuggcgguacgc

SEQ ID NO: 3513350 - RNA, 23 nt, Pseudomonas aeruginosa PA01
agccgagaagcagaacgccccgc

SEQ ID NO: 3513351 - RNA, 21 nt, Pseudomonas aeruginosa PA01
agccgagcaggccacgcacca

SEQ ID NO: 3513352 - RNA, 17 nt, Pseudomonas aeruginosa PA01
agccgagcggcaaggcc

SEQ ID NO: 3513353 - RNA, 19 nt, Pseudomonas aeruginosa PA01
agccgagcggcaaggccaa

SEQ ID NO: 3513354 - RNA, 17 nt, Pseudomonas aeruginosa PA01
agccgagcugccgggcg

SEQ ID NO: 3513355 - RNA, 17 nt, Pseudomonas aeruginosa PA01
agccgaggcagccgucg

SEQ ID NO: 3513356 - RNA, 12 nt, Pseudomonas aeruginosa PA01
agccgaggcggc

SEQ ID NO: 3513357 - RNA, 21 nt, Pseudomonas aeruginosa PA01
agccgaggcuuuccagcaggc

SEQ ID NO: 3513358 - RNA, 19 nt, Pseudomonas aeruginosa PA01
agccgaggucgccgccagc

SEQ ID NO: 3513359 - RNA, 16 nt, Pseudomonas aeruginosa PA01
agccgaucaacgcggc

SEQ ID NO: 3513360 - RNA, 18 nt, Pseudomonas aeruginosa PA01
agccgaucaacgcggcca

SEQ ID NO: 3513361 - RNA, 21 nt, Pseudomonas aeruginosa PA01
agccgaucaacgcggccagca

SEQ ID NO: 3513362 - RNA, 18 nt, Pseudomonas aeruginosa PA01
agccgaucaccaccagca

SEQ ID NO: 3513363 - RNA, 15 nt, Pseudomonas aeruginosa PA01
agccgaucaccagca

SEQ ID NO: 3513364 - RNA, 15 nt, Pseudomonas aeruginosa PA01
agccgaucaggucgc

SEQ ID NO: 3513365 - RNA, 14 nt, Pseudomonas aeruginosa PA01
agccgaucgaagaa

SEQ ID NO: 3513366 - RNA, 19 nt, Pseudomonas aeruginosa PA01
agccgaugaaauagccggc

SEQ ID NO: 3513367 - RNA, 17 nt, Pseudomonas aeruginosa PA01
agccgaugcucgcgcca

SEQ ID NO: 3513368 - RNA, 19 nt, Pseudomonas aeruginosa PA01
agccgaugcucgcgccagc

SEQ ID NO: 3513369 - RNA, 17 nt, Pseudomonas aeruginosa PA01
agccgauuacuuggcuu

SEQ ID NO: 3513370 - RNA, 10 nt, Pseudomonas aeruginosa PA01
agccgcaagc

SEQ ID NO: 3513371 - RNA, 22 nt, Pseudomonas aeruginosa PA01
agccgcaagcggauaucccccc

SEQ ID NO: 3513372 - RNA, 17 nt, Pseudomonas aeruginosa PA01
agccgcaauccgccgcu

SEQ ID NO: 3513373 - RNA, 23 nt, Pseudomonas aeruginosa PA01
agccgcaauccgccgcucccggc

SEQ ID NO: 3513374 - RNA, 14 nt, Pseudomonas aeruginosa PA01
agccgcacuuccag

SEQ ID NO: 3513375 - RNA, 19 nt, Pseudomonas aeruginosa PA01
agccgcacuuccaggcgcc

SEQ ID NO: 3513376 - RNA, 16 nt, Pseudomonas aeruginosa PA01
agccgcagaugcucca

SEQ ID NO: 3513377 - RNA, 21 nt, Pseudomonas aeruginosa PA01
agccgcagaugcuccagggag

SEQ ID NO: 3513378 - RNA, 23 nt, Pseudomonas aeruginosa PA01
agccgcagcccgguccguccagc

SEQ ID NO: 3513379 - RNA, 23 nt, Pseudomonas aeruginosa PA01
agccgcagcggcaugcccugccg

SEQ ID NO: 3513380 - RNA, 21 nt, Pseudomonas aeruginosa PA01
agccgcaggaugccgccugcg

SEQ ID NO: 3513381 - RNA, 12 nt, Pseudomonas aeruginosa PA01
agccgcaggcag

SEQ ID NO: 3513382 - RNA, 12 nt, Pseudomonas aeruginosa PA01
agccgccaggac

SEQ ID NO: 3513383 - RNA, 18 nt, Pseudomonas aeruginosa PA01
agccgccaggacggcagg

SEQ ID NO: 3513384 - RNA, 17 nt, Pseudomonas aeruginosa PA01
agccgccagugcagccg

SEQ ID NO: 3513385 - RNA, 14 nt, Pseudomonas aeruginosa PA01
agccgccccaccac

SEQ ID NO: 3513386 - RNA, 21 nt, Pseudomonas aeruginosa PA01
agccggcgaugugcggcgugg

SEQ ID NO: 3513387 - RNA, 23 nt, Pseudomonas aeruginosa PA01
agccggcgaugugcggcguggcg

SEQ ID NO: 3513388 - RNA, 16 nt, Pseudomonas aeruginosa PA01
agccggcgauguucgc

SEQ ID NO: 3513389 - RNA, 21 nt, Pseudomonas aeruginosa PA01
agccggcgcaucagcgccggu

SEQ ID NO: 3513390 - RNA, 15 nt, Pseudomonas aeruginosa PA01
agccggcgccgucga

SEQ ID NO: 3513391 - RNA, 13 nt, Pseudomonas aeruginosa PA01
agccggcgcgccc

SEQ ID NO: 3513392 - RNA, 20 nt, Pseudomonas aeruginosa PA01
agccggcgcgcccggcgccc

SEQ ID NO: 3513393 - RNA, 22 nt, Pseudomonas aeruginosa PA01
agccggcgcgcuuccuccagua

SEQ ID NO: 3513394 - RNA, 14 nt, Pseudomonas aeruginosa PA01
agccggcgcggcgc

SEQ ID NO: 3513395 - RNA, 15 nt, Pseudomonas aeruginosa PA01
agccggcgcggcgca

SEQ ID NO: 3513396 - RNA, 19 nt, Pseudomonas aeruginosa PA01
agccggcgcucggccaggu

SEQ ID NO: 3513397 - RNA, 12 nt, Pseudomonas aeruginosa PA01
agccggcgcugg

SEQ ID NO: 3513398 - RNA, 15 nt, Pseudomonas aeruginosa PA01
agccggcgcuucugc

SEQ ID NO: 3513399 - RNA, 14 nt, Pseudomonas aeruginosa PA01
agccggcggcgaac

SEQ ID NO: 3513400 - RNA, 14 nt, Pseudomonas aeruginosa PA01
agccggcggcgcgg

SEQ ID NO: 3513401 - RNA, 20 nt, Pseudomonas aeruginosa PA01
agccggcugccgaagaucga

SEQ ID NO: 3513402 - RNA, 16 nt, Pseudomonas aeruginosa PA01
agccggcuuccucgcc

SEQ ID NO: 3513403 - RNA, 20 nt, Pseudomonas aeruginosa PA01
agccggcuuccucgcccuca

SEQ ID NO: 3513404 - RNA, 14 nt, Pseudomonas aeruginosa PA01
agccgggaagccgc

SEQ ID NO: 3513405 - RNA, 18 nt, Pseudomonas aeruginosa PA01
agccgggaagccgcucgg

SEQ ID NO: 3513406 - RNA, 21 nt, Pseudomonas aeruginosa PA01
agccgggaagccgcucggcgu

SEQ ID NO: 3513407 - RNA, 23 nt, Pseudomonas aeruginosa PA01
agccgggaucuccucgacggcgg

SEQ ID NO: 3513408 - RNA, 15 nt, Pseudomonas aeruginosa PA01
agccgggcagccguu

SEQ ID NO: 3513409 - RNA, 19 nt, Pseudomonas aeruginosa PA01
agccgggccgcagcgcagc

SEQ ID NO: 3513410 - RNA, 14 nt, Pseudomonas aeruginosa PA01
agccgggcgugucg

SEQ ID NO: 3513411 - RNA, 18 nt, Pseudomonas aeruginosa PA01
agccgggcuccgccgcga

SEQ ID NO: 3513412 - RNA, 19 nt, Pseudomonas aeruginosa PA01
agccggggccguucaggaa

SEQ ID NO: 3513413 - RNA, 19 nt, Pseudomonas aeruginosa PA01
agccgggguugaguugcag

SEQ ID NO: 3513414 - RNA, 16 nt, Pseudomonas aeruginosa PA01
agccgguacugcgcca

SEQ ID NO: 3513415 - RNA, 17 nt, Pseudomonas aeruginosa PA01
agccgguacugcgccag

SEQ ID NO: 3513416 - RNA, 19 nt, Pseudomonas aeruginosa PA01
agccgguaggggccgacga

SEQ ID NO: 3513417 - RNA, 19 nt, Pseudomonas aeruginosa PA01
agccggugaaacggaucac

SEQ ID NO: 3513418 - RNA, 14 nt, Pseudomonas aeruginosa PA01
agccggugccggcg

SEQ ID NO: 3513419 - RNA, 15 nt, Pseudomonas aeruginosa PA01
agccggugccggcgg

SEQ ID NO: 3513420 - RNA, 19 nt, Pseudomonas aeruginosa PA01
agccggugccggcggcgga

SEQ ID NO: 3513421 - RNA, 17 nt, Pseudomonas aeruginosa PA01
agccgguggucuucagc

SEQ ID NO: 3513422 - RNA, 18 nt, Pseudomonas aeruginosa PA01
agccgguggucuucagca

SEQ ID NO: 3513423 - RNA, 18 nt, Pseudomonas aeruginosa PA01
agccguagaacgccagga

SEQ ID NO: 3513424 - RNA, 19 nt, Pseudomonas aeruginosa PA01
agccgucaagcaacggcga

SEQ ID NO: 3513425 - RNA, 19 nt, Pseudomonas aeruginosa PA01
agccguccagcuugaggua

SEQ ID NO: 3513426 - RNA, 13 nt, Pseudomonas aeruginosa PA01
agccguccgccca

SEQ ID NO: 3513427 - RNA, 15 nt, Pseudomonas aeruginosa PA01
agccguccgcgggcg

SEQ ID NO: 3513428 - RNA, 22 nt, Pseudomonas aeruginosa PA01
agccguccgggucggucacgaa

SEQ ID NO: 3513429 - RNA, 15 nt, Pseudomonas aeruginosa PA01
agccguccugcggcc

SEQ ID NO: 3513430 - RNA, 20 nt, Pseudomonas aeruginosa PA01
agccguccugcggccgcaac

SEQ ID NO: 3513431 - RNA, 18 nt, Pseudomonas aeruginosa PA01
agccgucgaacagcagcu

SEQ ID NO: 3513432 - RNA, 14 nt, Pseudomonas aeruginosa PA01
agccgucgccggcg

SEQ ID NO: 3513433 - RNA, 16 nt, Pseudomonas aeruginosa PA01
agccgucggcgaucgc

SEQ ID NO: 3513434 - RNA, 23 nt, Pseudomonas aeruginosa PA01
agccgucguagcgcagcggcagg

SEQ ID NO: 3513435 - RNA, 13 nt, Pseudomonas aeruginosa PA01
agccgugcagcag

SEQ ID NO: 3513436 - RNA, 22 nt, Pseudomonas aeruginosa PA01
agccguggcacccaggccacgc

SEQ ID NO: 3513437 - RNA, 23 nt, Pseudomonas aeruginosa PA01
agccguggcacccaggccacgcc

SEQ ID NO: 3513438 - RNA, 14 nt, Pseudomonas aeruginosa PA01
agccguggcaggcg

SEQ ID NO: 3513439 - RNA, 17 nt, Pseudomonas aeruginosa PA01
agccguggcaggcgccc

SEQ ID NO: 3513440 - RNA, 13 nt, Pseudomonas aeruginosa PA01
agccguggcgcga

SEQ ID NO: 3513441 - RNA, 21 nt, Pseudomonas aeruginosa PA01
agccguggcgggccaugcgcu

SEQ ID NO: 3513442 - RNA, 23 nt, Pseudomonas aeruginosa PA01
agccgugggcguagagccuggag

SEQ ID NO: 3513443 - RNA, 19 nt, Pseudomonas aeruginosa PA01
agccguuccaggcggggcg

SEQ ID NO: 3513444 - RNA, 20 nt, Pseudomonas aeruginosa PA01
agccguugaaacgcucggcg

SEQ ID NO: 3513445 - RNA, 21 nt, Pseudomonas aeruginosa PA01
agccguugaaacgcucggcgu

SEQ ID NO: 3513446 - RNA, 18 nt, Pseudomonas aeruginosa PA01
agccguugaggccgucga

SEQ ID NO: 3513447 - RNA, 19 nt, Pseudomonas aeruginosa PA01
agccguuggccagcaggcg

SEQ ID NO: 3513448 - RNA, 21 nt, Pseudomonas aeruginosa PA01
agccguuggccagcaggcgcc

SEQ ID NO: 3513449 - RNA, 17 nt, Pseudomonas aeruginosa PA01
agccguuguagaucggc

SEQ ID NO: 3513450 - RNA, 21 nt, Pseudomonas aeruginosa PA01
agccguuguagaucggcagca

SEQ ID NO: 3513451 - RNA, 18 nt, Pseudomonas aeruginosa PA01
agccguugugcagguacg

SEQ ID NO: 3513452 - RNA, 18 nt, Pseudomonas aeruginosa PA01
agccguuugugaaaggac

SEQ ID NO: 3513453 - RNA, 16 nt, Pseudomonas aeruginosa PA01
agccucacccugcugg

SEQ ID NO: 3513454 - RNA, 19 nt, Pseudomonas aeruginosa PA01
agccucacccugcugggcg

SEQ ID NO: 3513455 - RNA, 22 nt, Pseudomonas aeruginosa PA01
agccucaggcgcugcgcggccu

SEQ ID NO: 3513456 - RNA, 20 nt, Pseudomonas aeruginosa PA01
agccucaguaccugcaaggc

SEQ ID NO: 3513457 - RNA, 15 nt, Pseudomonas aeruginosa PA01
agccuccagcagcuc

SEQ ID NO: 3513458 - RNA, 18 nt, Pseudomonas aeruginosa PA01
agccuccagcagcuccau

SEQ ID NO: 3513459 - RNA, 14 nt, Pseudomonas aeruginosa PA01
agccuccagcgccg

SEQ ID NO: 3513460 - RNA, 17 nt, Pseudomonas aeruginosa PA01
agccucccgccgcggcg

SEQ ID NO: 3513461 - RNA, 18 nt, Pseudomonas aeruginosa PA01
agccucccgccgcggcgu

SEQ ID NO: 3513462 - RNA, 17 nt, Pseudomonas aeruginosa PA01
agccucgcgcucggcgg

SEQ ID NO: 3513463 - RNA, 18 nt, Pseudomonas aeruginosa PA01
agccucgcgcucggcggc

SEQ ID NO: 3513464 - RNA, 19 nt, Pseudomonas aeruginosa PA01
agccucgcgcucggcggcc

SEQ ID NO: 3513465 - RNA, 20 nt, Pseudomonas aeruginosa PA01
agccucgcgcucggcggccu

SEQ ID NO: 3513466 - RNA, 23 nt, Pseudomonas aeruginosa PA01
agccucgcgcucggcggccucgc

SEQ ID NO: 3513467 - RNA, 23 nt, Pseudomonas aeruginosa PA01
agccucgcguucgcggucgguga

SEQ ID NO: 3513468 - RNA, 18 nt, Pseudomonas aeruginosa PA01
agccucggcagggcgccc

SEQ ID NO: 3513469 - RNA, 22 nt, Pseudomonas aeruginosa PA01
agccucggcagggcgcccgccc

SEQ ID NO: 3513470 - RNA, 23 nt, Pseudomonas aeruginosa PA01
agccugacguugccgcgcgggcc

SEQ ID NO: 3513471 - RNA, 22 nt, Pseudomonas aeruginosa PA01
agccugcagccagcuucagccg

SEQ ID NO: 3513472 - RNA, 15 nt, Pseudomonas aeruginosa PA01
agccugccagaccga

SEQ ID NO: 3513473 - RNA, 14 nt, Pseudomonas aeruginosa PA01
agccugccgggcaa

SEQ ID NO: 3513474 - RNA, 16 nt, Pseudomonas aeruginosa PA01
agccugccgggcaagc

SEQ ID NO: 3513475 - RNA, 14 nt, Pseudomonas aeruginosa PA01
agccugcggccagc

SEQ ID NO: 3513476 - RNA, 17 nt, Pseudomonas aeruginosa PA01
agccugcggccagcgcc

SEQ ID NO: 3513477 - RNA, 18 nt, Pseudomonas aeruginosa PA01
agccugcggccagcgcca

SEQ ID NO: 3513478 - RNA, 20 nt, Pseudomonas aeruginosa PA01
agccugcggccagcgccagg

SEQ ID NO: 3513479 - RNA, 21 nt, Pseudomonas aeruginosa PA01
agccugcggccagcgccagga

SEQ ID NO: 3513480 - RNA, 14 nt, Pseudomonas aeruginosa PA01
agccuggagcaggg

SEQ ID NO: 3513481 - RNA, 20 nt, Pseudomonas aeruginosa PA01
agccuggaguugugccagcg

SEQ ID NO: 3513482 - RNA, 20 nt, Pseudomonas aeruginosa PA01
agccuggauacgggcgccag

SEQ ID NO: 3513483 - RNA, 22 nt, Pseudomonas aeruginosa PA01
agccuggauacgggcgccaggg

SEQ ID NO: 3513484 - RNA, 13 nt, Pseudomonas aeruginosa PA01
agccuggccagcg

SEQ ID NO: 3513485 - RNA, 14 nt, Pseudomonas aeruginosa PA01
agccuggccagcgc

SEQ ID NO: 3513486 - RNA, 16 nt, Pseudomonas aeruginosa PA01
agccuggccagcgcuu

SEQ ID NO: 3513487 - RNA, 13 nt, Pseudomonas aeruginosa PA01
agccuggccaggc

SEQ ID NO: 3513488 - RNA, 13 nt, Pseudomonas aeruginosa PA01
agcgcccggcugu

SEQ ID NO: 3513489 - RNA, 14 nt, Pseudomonas aeruginosa PA01
agcgcccggcugug

SEQ ID NO: 3513490 - RNA, 14 nt, Pseudomonas aeruginosa PA01
agcgccgaccagca

SEQ ID NO: 3513491 - RNA, 13 nt, Pseudomonas aeruginosa PA01
agcgccgcaggcg

SEQ ID NO: 3513492 - RNA, 16 nt, Pseudomonas aeruginosa PA01
agcgccgcaggcgcua

SEQ ID NO: 3513493 - RNA, 20 nt, Pseudomonas aeruginosa PA01
agcgccgcauuggccaggcc

SEQ ID NO: 3513494 - RNA, 21 nt, Pseudomonas aeruginosa PA01
agcgccgcauuggccaggccc

SEQ ID NO: 3513495 - RNA, 13 nt, Pseudomonas aeruginosa PA01
agcgccgccaacc

SEQ ID NO: 3513496 - RNA, 23 nt, Pseudomonas aeruginosa PA01
agcgccgccaaccacuccgccac

SEQ ID NO: 3513497 - RNA, 12 nt, Pseudomonas aeruginosa PA01
agcgccgccacc

SEQ ID NO: 3513498 - RNA, 14 nt, Pseudomonas aeruginosa PA01
agcgccgccaccgc

SEQ ID NO: 3513499 - RNA, 13 nt, Pseudomonas aeruginosa PA01
agcgccgccagca

SEQ ID NO: 3513500 - RNA, 17 nt, Pseudomonas aeruginosa PA01
agcgccgccagcaggau

SEQ ID NO: 3513501 - RNA, 16 nt, Pseudomonas aeruginosa PA01
agcgccgccagcaggu

SEQ ID NO: 3513502 - RNA, 13 nt, Pseudomonas aeruginosa PA01
agcgccgccaggc

SEQ ID NO: 3513503 - RNA, 15 nt, Pseudomonas aeruginosa PA01
agcgccgccaggcag

SEQ ID NO: 3513504 - RNA, 23 nt, Pseudomonas aeruginosa PA01
agcgccgccaggcagaccaggcc

SEQ ID NO: 3513505 - RNA, 14 nt, Pseudomonas aeruginosa PA01
agcgccgccaggcc

SEQ ID NO: 3513506 - RNA, 23 nt, Pseudomonas aeruginosa PA01
agcgccgcccuguucgucuggcg

SEQ ID NO: 3513507 - RNA, 19 nt, Pseudomonas aeruginosa PA01
agcgccgccgcgucgucgg

SEQ ID NO: 3513508 - RNA, 22 nt, Pseudomonas aeruginosa PA01
agcgccgccgcgucgucggcga

SEQ ID NO: 3513509 - RNA, 23 nt, Pseudomonas aeruginosa PA01
agcgccgccgcgugggcuucgcc

SEQ ID NO: 3513510 - RNA, 14 nt, Pseudomonas aeruginosa PA01
agcgccgccgggcg

SEQ ID NO: 3513511 - RNA, 13 nt, Pseudomonas aeruginosa PA01
agcgccgccggua

SEQ ID NO: 3513512 - RNA, 15 nt, Pseudomonas aeruginosa PA01
agcgccgccgguauc

SEQ ID NO: 3513513 - RNA, 16 nt, Pseudomonas aeruginosa PA01
agcgccgccucgaagg

SEQ ID NO: 3513514 - RNA, 22 nt, Pseudomonas aeruginosa PA01
agcgccgccucgaaggccggca

SEQ ID NO: 3513515 - RNA, 13 nt, Pseudomonas aeruginosa PA01
agcgccgccucgc

SEQ ID NO: 3513516 - RNA, 14 nt, Pseudomonas aeruginosa PA01
agcgccgccucgcu

SEQ ID NO: 3513517 - RNA, 19 nt, Pseudomonas aeruginosa PA01
agcgccgccucgcugggcg

SEQ ID NO: 3513518 - RNA, 13 nt, Pseudomonas aeruginosa PA01
agcgccgccugcu

SEQ ID NO: 3513519 - RNA, 16 nt, Pseudomonas aeruginosa PA01
agcgccgccugggccg

SEQ ID NO: 3513520 - RNA, 15 nt, Pseudomonas aeruginosa PA01
agcgccgccuugagc

SEQ ID NO: 3513521 - RNA, 13 nt, Pseudomonas aeruginosa PA01
agcgccgcgaaca

SEQ ID NO: 3513522 - RNA, 22 nt, Pseudomonas aeruginosa PA01
agcgccgcgaacacacccugcg

SEQ ID NO: 3513523 - RNA, 17 nt, Pseudomonas aeruginosa PA01
agcgccgcgcagcgcgg

SEQ ID NO: 3513524 - RNA, 15 nt, Pseudomonas aeruginosa PA01
agcgccgcgccaacu

SEQ ID NO: 3513525 - RNA, 21 nt, Pseudomonas aeruginosa PA01
agcgccgcgccaacuggcgca

SEQ ID NO: 3513526 - RNA, 21 nt, Pseudomonas aeruginosa PA01
agcgccgcgcgcuuguggcga

SEQ ID NO: 3513527 - RNA, 13 nt, Pseudomonas aeruginosa PA01
agcgccgcggcga

SEQ ID NO: 3513528 - RNA, 15 nt, Pseudomonas aeruginosa PA01
agcgccgcggcgaac

SEQ ID NO: 3513529 - RNA, 13 nt, Pseudomonas aeruginosa PA01
agcgccgcggcgg

SEQ ID NO: 3513530 - RNA, 15 nt, Pseudomonas aeruginosa PA01
agcgccgcggcggcg

SEQ ID NO: 3513531 - RNA, 14 nt, Pseudomonas aeruginosa PA01
agcgccgcggcugg

SEQ ID NO: 3513532 - RNA, 16 nt, Pseudomonas aeruginosa PA01
agcgccgcggcuggcc

SEQ ID NO: 3513533 - RNA, 21 nt, Pseudomonas aeruginosa PA01
agcgccgcguaguaggcacag

SEQ ID NO: 3513534 - RNA, 15 nt, Pseudomonas aeruginosa PA01
agcgccgcucggcga

SEQ ID NO: 3513535 - RNA, 18 nt, Pseudomonas aeruginosa PA01
agcgccgcuucuucccgc

SEQ ID NO: 3513536 - RNA, 20 nt, Pseudomonas aeruginosa PA01
agcgccgcuucuucccgccc

SEQ ID NO: 3513537 - RNA, 11 nt, Pseudomonas aeruginosa PA01
agcgccggcca

SEQ ID NO: 3513538 - RNA, 13 nt, Pseudomonas aeruginosa PA01
agcgccggccagg

SEQ ID NO: 3513539 - RNA, 14 nt, Pseudomonas aeruginosa PA01
agcgccggccaggg

SEQ ID NO: 3513540 - RNA, 20 nt, Pseudomonas aeruginosa PA01
agcgccggccauugccgcca

SEQ ID NO: 3513541 - RNA, 24 nt, Pseudomonas aeruginosa PA01
agcgccggccauugccgccagagu

SEQ ID NO: 3513542 - RNA, 14 nt, Pseudomonas aeruginosa PA01
agcgccggcggcgc

SEQ ID NO: 3513543 - RNA, 15 nt, Pseudomonas aeruginosa PA01
agcgccggcggcgcg

SEQ ID NO: 3513544 - RNA, 19 nt, Pseudomonas aeruginosa PA01
agcgccgggccgcaucgcg

SEQ ID NO: 3513545 - RNA, 22 nt, Pseudomonas aeruginosa PA01
agcgccgguagcggcgcaccga

SEQ ID NO: 3513546 - RNA, 21 nt, Pseudomonas aeruginosa PA01
agcgccgguaguucgcugacc

SEQ ID NO: 3513547 - RNA, 22 nt, Pseudomonas aeruginosa PA01
agcgccgguaguucgcugaccg

SEQ ID NO: 3513548 - RNA, 16 nt, Pseudomonas aeruginosa PA01
agcgccgucaccagca

SEQ ID NO: 3513549 - RNA, 17 nt, Pseudomonas aeruginosa PA01
agcgccgucaccagcag

SEQ ID NO: 3513550 - RNA, 19 nt, Pseudomonas aeruginosa PA01
agcgccgucaccagcagcc

SEQ ID NO: 3513551 - RNA, 20 nt, Pseudomonas aeruginosa PA01
agcgccgucaccagcagccc

SEQ ID NO: 3513552 - RNA, 21 nt, Pseudomonas aeruginosa PA01
agcgccgucaccagcagcccc

SEQ ID NO: 3513553 - RNA, 23 nt, Pseudomonas aeruginosa PA01
agcgccgucaccagcagccccga

SEQ ID NO: 3513554 - RNA, 18 nt, Pseudomonas aeruginosa PA01
agcgccguucacgccugg

SEQ ID NO: 3513555 - RNA, 20 nt, Pseudomonas aeruginosa PA01
agcgccguucacgccuggcg

SEQ ID NO: 3513556 - RNA, 22 nt, Pseudomonas aeruginosa PA01
agcgccguucacgccuggcggc

SEQ ID NO: 3513557 - RNA, 16 nt, Pseudomonas aeruginosa PA01
agcgccguugcggcag

SEQ ID NO: 3513558 - RNA, 18 nt, Pseudomonas aeruginosa PA01
agcgccguugcggcagca

SEQ ID NO: 3513559 - RNA, 20 nt, Pseudomonas aeruginosa PA01
agcgccuccagcgucugccg

SEQ ID NO: 3513560 - RNA, 17 nt, Pseudomonas aeruginosa PA01
agcgccuccaucgacuc

SEQ ID NO: 3513561 - RNA, 16 nt, Pseudomonas aeruginosa PA01
agcgccucgaaggccu

SEQ ID NO: 3513562 - RNA, 14 nt, Pseudomonas aeruginosa PA01
agcgccucgaccag

SEQ ID NO: 3513563 - RNA, 14 nt, Pseudomonas aeruginosa PA01
agcgccucgccgag

SEQ ID NO: 3513564 - RNA, 22 nt, Pseudomonas aeruginosa PA01
agcgccucgcgggucugcgccu

SEQ ID NO: 3513565 - RNA, 12 nt, Pseudomonas aeruginosa PA01
agcgccucggca

SEQ ID NO: 3513566 - RNA, 13 nt, Pseudomonas aeruginosa PA01
agcgccucggcau

SEQ ID NO: 3513567 - RNA, 13 nt, Pseudomonas aeruginosa PA01
agcgccucggcgc

SEQ ID NO: 3513568 - RNA, 18 nt, Pseudomonas aeruginosa PA01
agcgccucggcgcaguag

SEQ ID NO: 3513569 - RNA, 16 nt, Pseudomonas aeruginosa PA01
agcgccucggcggcgu

SEQ ID NO: 3513570 - RNA, 17 nt, Pseudomonas aeruginosa PA01
agcgccugcaaagaggc

SEQ ID NO: 3513571 - RNA, 12 nt, Pseudomonas aeruginosa PA01
agcgccugcugc

SEQ ID NO: 3513572 - RNA, 21 nt, Pseudomonas aeruginosa PA01
agcgccuggcgcaacgccggc

SEQ ID NO: 3513573 - RNA, 18 nt, Pseudomonas aeruginosa PA01
agcgccuggcgcaguuca

SEQ ID NO: 3513574 - RNA, 13 nt, Pseudomonas aeruginosa PA01
agcgccugggccg

SEQ ID NO: 3513575 - RNA, 16 nt, Pseudomonas aeruginosa PA01
agcgccuggucggcgg

SEQ ID NO: 3513576 - RNA, 17 nt, Pseudomonas aeruginosa PA01
agcgccuggucggcggc

SEQ ID NO: 3513577 - RNA, 21 nt, Pseudomonas aeruginosa PA01
agcgccugguucugcuccgga

SEQ ID NO: 3513578 - RNA, 17 nt, Pseudomonas aeruginosa PA01
agcgccuguuccagggc

SEQ ID NO: 3513579 - RNA, 22 nt, Pseudomonas aeruginosa PA01
agcgccuucaccguucccagca

SEQ ID NO: 3513580 - RNA, 24 nt, Pseudomonas aeruginosa PA01
agcgccuugaccucgacgccgagc

SEQ ID NO: 3513581 - RNA, 17 nt, Pseudomonas aeruginosa PA01
agcgcgaaagcgccccg

SEQ ID NO: 3513582 - RNA, 18 nt, Pseudomonas aeruginosa PA01
agcgcgaaggcgccuucc

SEQ ID NO: 3513583 - RNA, 22 nt, Pseudomonas aeruginosa PA01
agcgcgaaggcgccuuccaggc

SEQ ID NO: 3513584 - RNA, 23 nt, Pseudomonas aeruginosa PA01
agcgcgaaggcgccuuccaggcg

SEQ ID NO: 3513585 - RNA, 13 nt, Pseudomonas aeruginosa PA01
agcgcgacaggcu

SEQ ID NO: 3513586 - RNA, 17 nt, Pseudomonas aeruginosa PA01
agcgcgacaggcuggcu

SEQ ID NO: 3513587 - RNA, 17 nt, Pseudomonas aeruginosa PA01
agcgcgacaucggcgau

SEQ ID NO: 3513588 - RNA, 22 nt, Pseudomonas aeruginosa PA01
agcgcgacucgguaaagcccag

SEQ ID NO: 3513589 - RNA, 18 nt, Pseudomonas aeruginosa PA01
agcgcgacuuggacagcg

SEQ ID NO: 3513590 - RNA, 20 nt, Pseudomonas aeruginosa PA01
agcgcgagcggcagauccgc

SEQ ID NO: 3513591 - RNA, 14 nt, Pseudomonas aeruginosa PA01
agcgcugcugggcg

SEQ ID NO: 3513592 - RNA, 18 nt, Pseudomonas aeruginosa PA01
agcgcugcugggcggcga

SEQ ID NO: 3513593 - RNA, 13 nt, Pseudomonas aeruginosa PA01
agcgcuggcaggu

SEQ ID NO: 3513594 - RNA, 18 nt, Pseudomonas aeruginosa PA01
agcgcugguugacgaaca

SEQ ID NO: 3513595 - RNA, 15 nt, Pseudomonas aeruginosa PA01
agcgcuucauccugc

SEQ ID NO: 3513596 - RNA, 19 nt, Pseudomonas aeruginosa PA01
agcgcuucauccugcgcgc

SEQ ID NO: 3513597 - RNA, 15 nt, Pseudomonas aeruginosa PA01
agcgcuuccaccgcc

SEQ ID NO: 3513598 - RNA, 22 nt, Pseudomonas aeruginosa PA01
agcgcuuccaccgccugcccca

SEQ ID NO: 3513599 - RNA, 16 nt, Pseudomonas aeruginosa PA01
agcgcuucccgcggcu

SEQ ID NO: 3513600 - RNA, 21 nt, Pseudomonas aeruginosa PA01
agcgcuucccgcggcuccagc

SEQ ID NO: 3513601 - RNA, 22 nt, Pseudomonas aeruginosa PA01
agcgcuucccgcggcuccagcc

SEQ ID NO: 3513602 - RNA, 15 nt, Pseudomonas aeruginosa PA01
agcgcuuccuugccc

SEQ ID NO: 3513603 - RNA, 16 nt, Pseudomonas aeruginosa PA01
agcgcuuccuugcccu

SEQ ID NO: 3513604 - RNA, 12 nt, Pseudomonas aeruginosa PA01
agcgcuucgcga

SEQ ID NO: 3513605 - RNA, 14 nt, Pseudomonas aeruginosa PA01
agcgcuucgcgauc

SEQ ID NO: 3513606 - RNA, 22 nt, Pseudomonas aeruginosa PA01
agcgcuucgcgcagcucggcca

SEQ ID NO: 3513607 - RNA, 15 nt, Pseudomonas aeruginosa PA01
agcgcuucugcaggc

SEQ ID NO: 3513608 - RNA, 15 nt, Pseudomonas aeruginosa PA01
agcgcuugaacgcgc

SEQ ID NO: 3513609 - RNA, 19 nt, Pseudomonas aeruginosa PA01
agcgcuugaacgcgcgccu

SEQ ID NO: 3513610 - RNA, 14 nt, Pseudomonas aeruginosa PA01
agcgcuugcuggcg

SEQ ID NO: 3513611 - RNA, 19 nt, Pseudomonas aeruginosa PA01
agcgcuuguagcagccgca

SEQ ID NO: 3513612 - RNA, 20 nt, Pseudomonas aeruginosa PA01
agcgcuuguagcagccgcag

SEQ ID NO: 3513613 - RNA, 17 nt, Pseudomonas aeruginosa PA01
agcgcuuuucaggaugu

SEQ ID NO: 3513614 - RNA, 17 nt, Pseudomonas aeruginosa PA01
agcggaaaagcaggcca

SEQ ID NO: 3513615 - RNA, 16 nt, Pseudomonas aeruginosa PA01
agcggaaacaagcucu

SEQ ID NO: 3513616 - RNA, 16 nt, Pseudomonas aeruginosa PA01
agcggaaaugcucgcc

SEQ ID NO: 3513617 - RNA, 19 nt, Pseudomonas aeruginosa PA01
agcggaacgaaggacaggu

SEQ ID NO: 3513618 - RNA, 21 nt, Pseudomonas aeruginosa PA01
agcggaagcacggcucggcga

SEQ ID NO: 3513619 - RNA, 15 nt, Pseudomonas aeruginosa PA01
agcggaagcccagca

SEQ ID NO: 3513620 - RNA, 14 nt, Pseudomonas aeruginosa PA01
agcggaagcccugc

SEQ ID NO: 3513621 - RNA, 15 nt, Pseudomonas aeruginosa PA01
agcggaagcccugcu

SEQ ID NO: 3513622 - RNA, 19 nt, Pseudomonas aeruginosa PA01
agcggaagcccugcuggcg

SEQ ID NO: 3513623 - RNA, 13 nt, Pseudomonas aeruginosa PA01
agcggaagccguc

SEQ ID NO: 3513624 - RNA, 16 nt, Pseudomonas aeruginosa PA01
agcggaagccgucggc

SEQ ID NO: 3513625 - RNA, 16 nt, Pseudomonas aeruginosa PA01
agcggaagcgcagcca

SEQ ID NO: 3513626 - RNA, 14 nt, Pseudomonas aeruginosa PA01
agcggaaguucacc

SEQ ID NO: 3513627 - RNA, 23 nt, Pseudomonas aeruginosa PA01
agcggaaugcuuccguaggugga

SEQ ID NO: 3513628 - RNA, 22 nt, Pseudomonas aeruginosa PA01
agcggaccccggccuccaggcu

SEQ ID NO: 3513629 - RNA, 23 nt, Pseudomonas aeruginosa PA01
agcggaccccggccuccaggcug

SEQ ID NO: 3513630 - RNA, 23 nt, Pseudomonas aeruginosa PA01
agcggacgcagcgggucgaucag

SEQ ID NO: 3513631 - RNA, 17 nt, Pseudomonas aeruginosa PA01
agcggagcgucgggcgg

SEQ ID NO: 3513632 - RNA, 19 nt, Pseudomonas aeruginosa PA01
agcggaggauucagcagga

SEQ ID NO: 3513633 - RNA, 22 nt, Pseudomonas aeruginosa PA01
agcggaguucgucaaccagcac

SEQ ID NO: 3513634 - RNA, 17 nt, Pseudomonas aeruginosa PA01
agcggauauccccccac

SEQ ID NO: 3513635 - RNA, 14 nt, Pseudomonas aeruginosa PA01
agcggaucagccgg

SEQ ID NO: 3513636 - RNA, 15 nt, Pseudomonas aeruginosa PA01
agcggaucaggccca

SEQ ID NO: 3513637 - RNA, 19 nt, Pseudomonas aeruginosa PA01
agcggauccggguggagag

SEQ ID NO: 3513638 - RNA, 13 nt, Pseudomonas aeruginosa PA01
agcggaucggcgg

SEQ ID NO: 3513639 - RNA, 14 nt, Pseudomonas aeruginosa PA01
agcggaucggcggu

SEQ ID NO: 3513640 - RNA, 15 nt, Pseudomonas aeruginosa PA01
agcggaucggcggug

SEQ ID NO: 3513641 - RNA, 23 nt, Pseudomonas aeruginosa PA01
agcggaucggcggugccauggau

SEQ ID NO: 3513642 - RNA, 15 nt, Pseudomonas aeruginosa PA01
agcggaucgucgcgg

SEQ ID NO: 3513643 - RNA, 16 nt, Pseudomonas aeruginosa PA01
agcggaucgucgcggc

SEQ ID NO: 3513644 - RNA, 20 nt, Pseudomonas aeruginosa PA01
agcggaucgucgcggcgcga

SEQ ID NO: 3513645 - RNA, 15 nt, Pseudomonas aeruginosa PA01
agcggaugcuggcgg

SEQ ID NO: 3513646 - RNA, 13 nt, Pseudomonas aeruginosa PA01
agcggcaaaggcc

SEQ ID NO: 3513647 - RNA, 13 nt, Pseudomonas aeruginosa PA01
agcggcaacgcgc

SEQ ID NO: 3513648 - RNA, 15 nt, Pseudomonas aeruginosa PA01
agcggcaacgcgccc

SEQ ID NO: 3513649 - RNA, 14 nt, Pseudomonas aeruginosa PA01
agcggcaaggccaa

SEQ ID NO: 3513650 - RNA, 23 nt, Pseudomonas aeruginosa PA01
agcggcaaggccaagucggccgc

SEQ ID NO: 3513651 - RNA, 21 nt, Pseudomonas aeruginosa PA01
agcggcaauguccgagcaggu

SEQ ID NO: 3513652 - RNA, 15 nt, Pseudomonas aeruginosa PA01
agcggcaccagcacg

SEQ ID NO: 3513653 - RNA, 18 nt, Pseudomonas aeruginosa PA01
agcggcacccggcugggu

SEQ ID NO: 3513654 - RNA, 22 nt, Pseudomonas aeruginosa PA01
agcggcaccucgauggcggcgg

SEQ ID NO: 3513655 - RNA, 17 nt, Pseudomonas aeruginosa PA01
agcggcacgcucuggcc

SEQ ID NO: 3513656 - RNA, 19 nt, Pseudomonas aeruginosa PA01
agcggcacgcucuggccgu

SEQ ID NO: 3513657 - RNA, 17 nt, Pseudomonas aeruginosa PA01
agcggcacggucauggc

SEQ ID NO: 3513658 - RNA, 16 nt, Pseudomonas aeruginosa PA01
agcggcacuucccgcc

SEQ ID NO: 3513659 - RNA, 22 nt, Pseudomonas aeruginosa PA01
agcggcagccacucggccaggc

SEQ ID NO: 3513660 - RNA, 14 nt, Pseudomonas aeruginosa PA01
agcggcagcgccag

SEQ ID NO: 3513661 - RNA, 12 nt, Pseudomonas aeruginosa PA01
agcggcagcggc

SEQ ID NO: 3513662 - RNA, 17 nt, Pseudomonas aeruginosa PA01
agcggcagcgguucgcc

SEQ ID NO: 3513663 - RNA, 18 nt, Pseudomonas aeruginosa PA01
agcggcagcgucucggcu

SEQ ID NO: 3513664 - RNA, 20 nt, Pseudomonas aeruginosa PA01
agcggcagcgucucggcugc

SEQ ID NO: 3513665 - RNA, 22 nt, Pseudomonas aeruginosa PA01
agcggcagcgucucggcugccg

SEQ ID NO: 3513666 - RNA, 14 nt, Pseudomonas aeruginosa PA01
agcggcagcucggc

SEQ ID NO: 3513667 - RNA, 15 nt, Pseudomonas aeruginosa PA01
agcggcagcucggcg

SEQ ID NO: 3513668 - RNA, 16 nt, Pseudomonas aeruginosa PA01
agcggcagcucggcga

SEQ ID NO: 3513669 - RNA, 13 nt, Pseudomonas aeruginosa PA01
agcggcaggagca

SEQ ID NO: 3513670 - RNA, 14 nt, Pseudomonas aeruginosa PA01
agcggcaggcacgc

SEQ ID NO: 3513671 - RNA, 20 nt, Pseudomonas aeruginosa PA01
agcggcaggccacggccgcu

SEQ ID NO: 3513672 - RNA, 16 nt, Pseudomonas aeruginosa PA01
agcggcagggcggcga

SEQ ID NO: 3513673 - RNA, 13 nt, Pseudomonas aeruginosa PA01
agcggcagguggu

SEQ ID NO: 3513674 - RNA, 17 nt, Pseudomonas aeruginosa PA01
agcggcauccgccgcug

SEQ ID NO: 3513675 - RNA, 18 nt, Pseudomonas aeruginosa PA01
agcggcauccgccgcugg

SEQ ID NO: 3513676 - RNA, 18 nt, Pseudomonas aeruginosa PA01
agcggcaugcccugccgg

SEQ ID NO: 3513677 - RNA, 22 nt, Pseudomonas aeruginosa PA01
agcggcaugcccugccggcgca

SEQ ID NO: 3513678 - RNA, 12 nt, Pseudomonas aeruginosa PA01
agcggcaugguc

SEQ ID NO: 3513679 - RNA, 14 nt, Pseudomonas aeruginosa PA01
agcggcauggucag

SEQ ID NO: 3513680 - RNA, 18 nt, Pseudomonas aeruginosa PA01
agcggcauucgaacggcu

SEQ ID NO: 3513681 - RNA, 11 nt, Pseudomonas aeruginosa PA01
agcggccaggg

SEQ ID NO: 3513682 - RNA, 16 nt, Pseudomonas aeruginosa PA01
agcggccaggucgagg

SEQ ID NO: 3513683 - RNA, 14 nt, Pseudomonas aeruginosa PA01
agcggcccagcgcc

SEQ ID NO: 3513684 - RNA, 15 nt, Pseudomonas aeruginosa PA01
agcggcccagcgccc

SEQ ID NO: 3513685 - RNA, 19 nt, Pseudomonas aeruginosa PA01
agcggcccagcgccccgcc

SEQ ID NO: 3513686 - RNA, 19 nt, Pseudomonas aeruginosa PA01
agcggccccgagcgggccg

SEQ ID NO: 3513687 - RNA, 22 nt, Pseudomonas aeruginosa PA01
agcggcccgagggucgccuuga

SEQ ID NO: 3513688 - RNA, 17 nt, Pseudomonas aeruginosa PA01
agcggcccggcaggcgc

SEQ ID NO: 3513689 - RNA, 18 nt, Pseudomonas aeruginosa PA01
agcggcccggcaggcgca

SEQ ID NO: 3513690 - RNA, 19 nt, Pseudomonas aeruginosa PA01
agcggcccggcaggcgcac

SEQ ID NO: 3513691 - RNA, 15 nt, Pseudomonas aeruginosa PA01
agcggccgaccaggc

SEQ ID NO: 3513692 - RNA, 18 nt, Pseudomonas aeruginosa PA01
agcggccgaccaggccgu

SEQ ID NO: 3513693 - RNA, 16 nt, Pseudomonas aeruginosa PA01
agcggccgagcaccac

SEQ ID NO: 3513694 - RNA, 14 nt, Pseudomonas aeruginosa PA01
agcgguaggcgcgu

SEQ ID NO: 3513695 - RNA, 19 nt, Pseudomonas aeruginosa PA01
agcgguagguguacccagg

SEQ ID NO: 3513696 - RNA, 15 nt, Pseudomonas aeruginosa PA01
agcgguagugggcga

SEQ ID NO: 3513697 - RNA, 22 nt, Pseudomonas aeruginosa PA01
agcgguagugggcgaggcgcuc

SEQ ID NO: 3513698 - RNA, 14 nt, Pseudomonas aeruginosa PA01
agcgguaugccgca

SEQ ID NO: 3513699 - RNA, 18 nt, Pseudomonas aeruginosa PA01
agcgguauugucgauggg

SEQ ID NO: 3513700 - RNA, 19 nt, Pseudomonas aeruginosa PA01
agcgguauugucgaugggc

SEQ ID NO: 3513701 - RNA, 21 nt, Pseudomonas aeruginosa PA01
agcgguauugucgaugggcag

SEQ ID NO: 3513702 - RNA, 20 nt, Pseudomonas aeruginosa PA01
agcgguccucgggcaccagc

SEQ ID NO: 3513703 - RNA, 21 nt, Pseudomonas aeruginosa PA01
agcgguccucgggcaccagca

SEQ ID NO: 3513704 - RNA, 17 nt, Pseudomonas aeruginosa PA01
agcggucgccggcgcgc

SEQ ID NO: 3513705 - RNA, 19 nt, Pseudomonas aeruginosa PA01
agcggucgccggcgcgcac

SEQ ID NO: 3513706 - RNA, 16 nt, Pseudomonas aeruginosa PA01
agcggucggguucuug

SEQ ID NO: 3513707 - RNA, 18 nt, Pseudomonas aeruginosa PA01
agcggucguagcccaugg

SEQ ID NO: 3513708 - RNA, 20 nt, Pseudomonas aeruginosa PA01
agcggucguagcccaugguc

SEQ ID NO: 3513709 - RNA, 18 nt, Pseudomonas aeruginosa PA01
agcggucgugcagcagcg

SEQ ID NO: 3513710 - RNA, 21 nt, Pseudomonas aeruginosa PA01
agcggucgugcagcagcgccu

SEQ ID NO: 3513711 - RNA, 20 nt, Pseudomonas aeruginosa PA01
agcggugaagguccgcgcca

SEQ ID NO: 3513712 - RNA, 23 nt, Pseudomonas aeruginosa PA01
agcggugaucgaaaaaaggcgcc

SEQ ID NO: 3513713 - RNA, 15 nt, Pseudomonas aeruginosa PA01
agcgguuagccggcg

SEQ ID NO: 3513714 - RNA, 16 nt, Pseudomonas aeruginosa PA01
agcgguuagccggcga

SEQ ID NO: 3513715 - RNA, 13 nt, Pseudomonas aeruginosa PA01
agcgguuauucgc

SEQ ID NO: 3513716 - RNA, 18 nt, Pseudomonas aeruginosa PA01
agcgguuauucgccccag

SEQ ID NO: 3513717 - RNA, 18 nt, Pseudomonas aeruginosa PA01
agcgguuauucgcccuac

SEQ ID NO: 3513718 - RNA, 18 nt, Pseudomonas aeruginosa PA01
agcgguucaggucgaggc

SEQ ID NO: 3513719 - RNA, 15 nt, Pseudomonas aeruginosa PA01
agcgguugagcaggg

SEQ ID NO: 3513720 - RNA, 17 nt, Pseudomonas aeruginosa PA01
agcguagggcgaauaac

SEQ ID NO: 3513721 - RNA, 16 nt, Pseudomonas aeruginosa PA01
agcguaucgaugcgcg

SEQ ID NO: 3513722 - RNA, 17 nt, Pseudomonas aeruginosa PA01
agcguaucgaugcgcgc

SEQ ID NO: 3513723 - RNA, 18 nt, Pseudomonas aeruginosa PA01
agcgucacucccaggcug

SEQ ID NO: 3513724 - RNA, 18 nt, Pseudomonas aeruginosa PA01
agcgucagccgcggccgg

SEQ ID NO: 3513725 - RNA, 13 nt, Pseudomonas aeruginosa PA01
agcgucagcgcgc

SEQ ID NO: 3513726 - RNA, 15 nt, Pseudomonas aeruginosa PA01
agcgucagcgcgcca

SEQ ID NO: 3513727 - RNA, 16 nt, Pseudomonas aeruginosa PA01
agcguccaccagcgcc

SEQ ID NO: 3513728 - RNA, 22 nt, Pseudomonas aeruginosa PA01
agcguccaggguuggaagaaag

SEQ ID NO: 3513729 - RNA, 19 nt, Pseudomonas aeruginosa PA01
agcguccaggugcggcugg

SEQ ID NO: 3513730 - RNA, 15 nt, Pseudomonas aeruginosa PA01
agcguccgaacgcgc

SEQ ID NO: 3513731 - RNA, 18 nt, Pseudomonas aeruginosa PA01
agcguccgaacgcgcuga

SEQ ID NO: 3513732 - RNA, 12 nt, Pseudomonas aeruginosa PA01
agcguccgccgc

SEQ ID NO: 3513733 - RNA, 15 nt, Pseudomonas aeruginosa PA01
agcguccggcagggc

SEQ ID NO: 3513734 - RNA, 16 nt, Pseudomonas aeruginosa PA01
agcguccggcagggcc

SEQ ID NO: 3513735 - RNA, 20 nt, Pseudomonas aeruginosa PA01
agcguccucagccucacccu

SEQ ID NO: 3513736 - RNA, 21 nt, Pseudomonas aeruginosa PA01
agcguccucagccucacccug

SEQ ID NO: 3513737 - RNA, 16 nt, Pseudomonas aeruginosa PA01
agcgucgagcuggcgc

SEQ ID NO: 3513738 - RNA, 10 nt, Pseudomonas aeruginosa PA01
agcgucgagu

SEQ ID NO: 3513739 - RNA, 17 nt, Pseudomonas aeruginosa PA01
agcgucgagucgcgcag

SEQ ID NO: 3513740 - RNA, 18 nt, Pseudomonas aeruginosa PA01
agcgucgaugaucccgau

SEQ ID NO: 3513741 - RNA, 20 nt, Pseudomonas aeruginosa PA01
agcgucgccaacgcgccguc

SEQ ID NO: 3513742 - RNA, 13 nt, Pseudomonas aeruginosa PA01
agcgucgccaggc

SEQ ID NO: 3513743 - RNA, 14 nt, Pseudomonas aeruginosa PA01
agcgucgccaggcc

SEQ ID NO: 3513744 - RNA, 13 nt, Pseudomonas aeruginosa PA01
agcgucgccgccg

SEQ ID NO: 3513745 - RNA, 13 nt, Pseudomonas aeruginosa PA01
agcgucgccggcc

SEQ ID NO: 3513746 - RNA, 12 nt, Pseudomonas aeruginosa PA01
agcgucgccggg

SEQ ID NO: 3513747 - RNA, 14 nt, Pseudomonas aeruginosa PA01
agcgucgccgggcg

SEQ ID NO: 3513748 - RNA, 18 nt, Pseudomonas aeruginosa PA01
agcgucgccugccaggcg

SEQ ID NO: 3513749 - RNA, 23 nt, Pseudomonas aeruginosa PA01
agcgucgcgccgcccggcucgcc

SEQ ID NO: 3513750 - RNA, 14 nt, Pseudomonas aeruginosa PA01
agcgucgcgcggcc

SEQ ID NO: 3513751 - RNA, 17 nt, Pseudomonas aeruginosa PA01
agcgucgcgcggccagc

SEQ ID NO: 3513752 - RNA, 19 nt, Pseudomonas aeruginosa PA01
agcgucgcgcggccagcgu

SEQ ID NO: 3513753 - RNA, 20 nt, Pseudomonas aeruginosa PA01
agcgucgcgcggccagcgug

SEQ ID NO: 3513754 - RNA, 19 nt, Pseudomonas aeruginosa PA01
agcgucgcgcguccagccg

SEQ ID NO: 3513755 - RNA, 16 nt, Pseudomonas aeruginosa PA01
agcgucgcgucggccu

SEQ ID NO: 3513756 - RNA, 18 nt, Pseudomonas aeruginosa PA01
agcgucguagagcgugcg

SEQ ID NO: 3513757 - RNA, 16 nt, Pseudomonas aeruginosa PA01
agcgucgugcgccggc

SEQ ID NO: 3513758 - RNA, 18 nt, Pseudomonas aeruginosa PA01
agcgucgugcgccggccu

SEQ ID NO: 3513759 - RNA, 16 nt, Pseudomonas aeruginosa PA01
agcgucucggcugccg

SEQ ID NO: 3513760 - RNA, 13 nt, Pseudomonas aeruginosa PA01
agcgucugcagcu

SEQ ID NO: 3513761 - RNA, 22 nt, Pseudomonas aeruginosa PA01
agcgucugcagcuugcgcgcca

SEQ ID NO: 3513762 - RNA, 17 nt, Pseudomonas aeruginosa PA01
agcgucugccgcuggcg

SEQ ID NO: 3513763 - RNA, 23 nt, Pseudomonas aeruginosa PA01
agcgugacccgcgcuuccagggu

SEQ ID NO: 3513764 - RNA, 15 nt, Pseudomonas aeruginosa PA01
agcgugcaccagcag

SEQ ID NO: 3513765 - RNA, 15 nt, Pseudomonas aeruginosa PA01
agcgugcagaccagg

SEQ ID NO: 3513766 - RNA, 19 nt, Pseudomonas aeruginosa PA01
agcgugcagaccaggguac

SEQ ID NO: 3513767 - RNA, 19 nt, Pseudomonas aeruginosa PA01
agcgugcgcaugcccgcgu

SEQ ID NO: 3513768 - RNA, 16 nt, Pseudomonas aeruginosa PA01
agcgugcggcccuugu

SEQ ID NO: 3513769 - RNA, 23 nt, Pseudomonas aeruginosa PA01
agcgugcggccgaucaucggcug

SEQ ID NO: 3513770 - RNA, 23 nt, Pseudomonas aeruginosa PA01
agcguggccagcgaacccaggcc

SEQ ID NO: 3513771 - RNA, 18 nt, Pseudomonas aeruginosa PA01
agcguggccagcgcccag

SEQ ID NO: 3513772 - RNA, 20 nt, Pseudomonas aeruginosa PA01
agcguggccagcgcccaggc

SEQ ID NO: 3513773 - RNA, 14 nt, Pseudomonas aeruginosa PA01
agcguggcgcgcau

SEQ ID NO: 3513774 - RNA, 22 nt, Pseudomonas aeruginosa PA01
agcguggcgcgcaucggugccg

SEQ ID NO: 3513775 - RNA, 21 nt, Pseudomonas aeruginosa PA01
agcgugggcggccggccaggu

SEQ ID NO: 3513776 - RNA, 22 nt, Pseudomonas aeruginosa PA01
agcguguggcgaaacuccagca

SEQ ID NO: 3513777 - RNA, 13 nt, Pseudomonas aeruginosa PA01
agcguuaucgccg

SEQ ID NO: 3513778 - RNA, 16 nt, Pseudomonas aeruginosa PA01
agcguuaucgccgguc

SEQ ID NO: 3513779 - RNA, 17 nt, Pseudomonas aeruginosa PA01
agcguuccagcgcuggc

SEQ ID NO: 3513780 - RNA, 22 nt, Pseudomonas aeruginosa PA01
agcguuccaugaacucuucccc

SEQ ID NO: 3513781 - RNA, 13 nt, Pseudomonas aeruginosa PA01
agcguuccuggcg

SEQ ID NO: 3513782 - RNA, 19 nt, Pseudomonas aeruginosa PA01
agcguuccuggcgcgcggc

SEQ ID NO: 3513783 - RNA, 13 nt, Pseudomonas aeruginosa PA01
agcguucgccgag

SEQ ID NO: 3513784 - RNA, 14 nt, Pseudomonas aeruginosa PA01
agcguucgccgagg

SEQ ID NO: 3513785 - RNA, 21 nt, Pseudomonas aeruginosa PA01
agcguucgccgagggcaaggu

SEQ ID NO: 3513786 - RNA, 21 nt, Pseudomonas aeruginosa PA01
agcguucggaucggcccggcg

SEQ ID NO: 3513787 - RNA, 16 nt, Pseudomonas aeruginosa PA01
agcguucggcgcuggc

SEQ ID NO: 3513788 - RNA, 17 nt, Pseudomonas aeruginosa PA01
agcguucggcgcuggcg

SEQ ID NO: 3513789 - RNA, 20 nt, Pseudomonas aeruginosa PA01
agcguucggcgcuggcgcgg

SEQ ID NO: 3513790 - RNA, 15 nt, Pseudomonas aeruginosa PA01
agcguucuucagcac

SEQ ID NO: 3513791 - RNA, 17 nt, Pseudomonas aeruginosa PA01
agcguucuucagcacuu

SEQ ID NO: 3513792 - RNA, 12 nt, Pseudomonas aeruginosa PA01
agcguugcaggc

SEQ ID NO: 3513793 - RNA, 16 nt, Pseudomonas aeruginosa PA01
agcguugcaggcaguc

SEQ ID NO: 3513794 - RNA, 15 nt, Pseudomonas aeruginosa PA01
agcguugcaggucga

SEQ ID NO: 3513795 - RNA, 16 nt, Pseudomonas aeruginosa PA01
agcguugcgccagacc

SEQ ID NO: 3513796 - RNA, 16 nt, Pseudomonas aeruginosa PA01
agcguugcgcgagcac

SEQ ID NO: 3513797 - RNA, 15 nt, Pseudomonas aeruginosa PA01
agcucggugccguca

SEQ ID NO: 3513798 - RNA, 14 nt, Pseudomonas aeruginosa PA01
agcucgucacccgc

SEQ ID NO: 3513799 - RNA, 18 nt, Pseudomonas aeruginosa PA01
agcucgucacccgcgccu

SEQ ID NO: 3513800 - RNA, 15 nt, Pseudomonas aeruginosa PA01
agcucgucgaugauc

SEQ ID NO: 3513801 - RNA, 15 nt, Pseudomonas aeruginosa PA01
agcucguggcuggcg

SEQ ID NO: 3513802 - RNA, 16 nt, Pseudomonas aeruginosa PA01
agcucguggcuggcgc

SEQ ID NO: 3513803 - RNA, 17 nt, Pseudomonas aeruginosa PA01
agcucguggcuggcgcc

SEQ ID NO: 3513804 - RNA, 14 nt, Pseudomonas aeruginosa PA01
agcucguucgccca

SEQ ID NO: 3513805 - RNA, 19 nt, Pseudomonas aeruginosa PA01
agcucguugcacagcgccc

SEQ ID NO: 3513806 - RNA, 15 nt, Pseudomonas aeruginosa PA01
agcucguugcccggc

SEQ ID NO: 3513807 - RNA, 16 nt, Pseudomonas aeruginosa PA01
agcucguugcccggcu

SEQ ID NO: 3513808 - RNA, 17 nt, Pseudomonas aeruginosa PA01
agcucguugcccggcuu

SEQ ID NO: 3513809 - RNA, 18 nt, Pseudomonas aeruginosa PA01
agcucguugcccggcuug

SEQ ID NO: 3513810 - RNA, 21 nt, Pseudomonas aeruginosa PA01
agcucguugcccggcuugccg

SEQ ID NO: 3513811 - RNA, 12 nt, Pseudomonas aeruginosa PA01
agcucucgccgc

SEQ ID NO: 3513812 - RNA, 21 nt, Pseudomonas aeruginosa PA01
agcucucgcugguggcgaggg

SEQ ID NO: 3513813 - RNA, 23 nt, Pseudomonas aeruginosa PA01
agcucugcgacuggaugcagccg

SEQ ID NO: 3513814 - RNA, 20 nt, Pseudomonas aeruginosa PA01
agcucugcgaucagggccuc

SEQ ID NO: 3513815 - RNA, 19 nt, Pseudomonas aeruginosa PA01
agcucuggccguccugcuu

SEQ ID NO: 3513816 - RNA, 13 nt, Pseudomonas aeruginosa PA01
agcucugucuccu

SEQ ID NO: 3513817 - RNA, 16 nt, Pseudomonas aeruginosa PA01
agcucuuccaggugau

SEQ ID NO: 3513818 - RNA, 19 nt, Pseudomonas aeruginosa PA01
agcugaagcugucgcccuc

SEQ ID NO: 3513819 - RNA, 14 nt, Pseudomonas aeruginosa PA01
agcugaccaccagg

SEQ ID NO: 3513820 - RNA, 19 nt, Pseudomonas aeruginosa PA01
agcugaccaccagggcgau

SEQ ID NO: 3513821 - RNA, 11 nt, Pseudomonas aeruginosa PA01
agcugaccacg

SEQ ID NO: 3513822 - RNA, 17 nt, Pseudomonas aeruginosa PA01
agcugacgaacaucgcc

SEQ ID NO: 3513823 - RNA, 14 nt, Pseudomonas aeruginosa PA01
agcugagcaggccg

SEQ ID NO: 3513824 - RNA, 17 nt, Pseudomonas aeruginosa PA01
agcugagcaggccgacg

SEQ ID NO: 3513825 - RNA, 16 nt, Pseudomonas aeruginosa PA01
agcugaggccguagcc

SEQ ID NO: 3513826 - RNA, 13 nt, Pseudomonas aeruginosa PA01
agcugagucgcuu

SEQ ID NO: 3513827 - RNA, 14 nt, Pseudomonas aeruginosa PA01
agcugaucgcgaau

SEQ ID NO: 3513828 - RNA, 22 nt, Pseudomonas aeruginosa PA01
agcugaucucggcgacuucgca

SEQ ID NO: 3513829 - RNA, 22 nt, Pseudomonas aeruginosa PA01
agcugcaaggcuucggcgguca

SEQ ID NO: 3513830 - RNA, 12 nt, Pseudomonas aeruginosa PA01
agcugcaccgcg

SEQ ID NO: 3513831 - RNA, 14 nt, Pseudomonas aeruginosa PA01
agcugcaccgcgcg

SEQ ID NO: 3513832 - RNA, 20 nt, Pseudomonas aeruginosa PA01
agcugcacggcgacccgcac

SEQ ID NO: 3513833 - RNA, 12 nt, Pseudomonas aeruginosa PA01
agcugcagcgcc

SEQ ID NO: 3513834 - RNA, 19 nt, Pseudomonas aeruginosa PA01
agcugcagcgccccagcac

SEQ ID NO: 3513835 - RNA, 20 nt, Pseudomonas aeruginosa PA01
agcugcagcgccccagcacc

SEQ ID NO: 3513836 - RNA, 15 nt, Pseudomonas aeruginosa PA01
agcugccagccccgc

SEQ ID NO: 3513837 - RNA, 18 nt, Pseudomonas aeruginosa PA01
agcugccccacaggcccu

SEQ ID NO: 3513838 - RNA, 20 nt, Pseudomonas aeruginosa PA01
agcugccccucguggcgcga

SEQ ID NO: 3513839 - RNA, 23 nt, Pseudomonas aeruginosa PA01
agcugccgaauugggucugcugg

SEQ ID NO: 3513840 - RNA, 19 nt, Pseudomonas aeruginosa PA01
agcugccgcaccgccucga

SEQ ID NO: 3513841 - RNA, 21 nt, Pseudomonas aeruginosa PA01
agcugccggcgucguccugcg

SEQ ID NO: 3513842 - RNA, 17 nt, Pseudomonas aeruginosa PA01
agcugccgggcgagcug

SEQ ID NO: 3513843 - RNA, 13 nt, Pseudomonas aeruginosa PA01
agcugccuuccag

SEQ ID NO: 3513844 - RNA, 15 nt, Pseudomonas aeruginosa PA01
agcugccuuccagca

SEQ ID NO: 3513845 - RNA, 16 nt, Pseudomonas aeruginosa PA01
agcugccuuccagcag

SEQ ID NO: 3513846 - RNA, 12 nt, Pseudomonas aeruginosa PA01
agcugcgaggga

SEQ ID NO: 3513847 - RNA, 13 nt, Pseudomonas aeruginosa PA01
agcugcgcagggc

SEQ ID NO: 3513848 - RNA, 20 nt, Pseudomonas aeruginosa PA01
agcugcgcagggcgccgucg

SEQ ID NO: 3513849 - RNA, 13 nt, Pseudomonas aeruginosa PA01
agcugcgccgccu

SEQ ID NO: 3513850 - RNA, 14 nt, Pseudomonas aeruginosa PA01
agcugcgccgccuu

SEQ ID NO: 3513851 - RNA, 23 nt, Pseudomonas aeruginosa PA01
agcugcgccgccuuucugcccgg

SEQ ID NO: 3513852 - RNA, 18 nt, Pseudomonas aeruginosa PA01
agcugcgcucggauucca

SEQ ID NO: 3513853 - RNA, 13 nt, Pseudomonas aeruginosa PA01
agcugcggcggca

SEQ ID NO: 3513854 - RNA, 16 nt, Pseudomonas aeruginosa PA01
agcugcuccagcccgg

SEQ ID NO: 3513855 - RNA, 17 nt, Pseudomonas aeruginosa PA01
agcugcuccagcccggc

SEQ ID NO: 3513856 - RNA, 14 nt, Pseudomonas aeruginosa PA01
agcugcucgauggc

SEQ ID NO: 3513857 - RNA, 17 nt, Pseudomonas aeruginosa PA01
agcugcucgauggcggc

SEQ ID NO: 3513858 - RNA, 15 nt, Pseudomonas aeruginosa PA01
agcugcucggcggug

SEQ ID NO: 3513859 - RNA, 16 nt, Pseudomonas aeruginosa PA01
agcugcucuaccgacu

SEQ ID NO: 3513860 - RNA, 12 nt, Pseudomonas aeruginosa PA01
agcugcugccgg

SEQ ID NO: 3513861 - RNA, 14 nt, Pseudomonas aeruginosa PA01
agcugcugccggcu

SEQ ID NO: 3513862 - RNA, 21 nt, Pseudomonas aeruginosa PA01
agcugcuggggaacugggcga

SEQ ID NO: 3513863 - RNA, 15 nt, Pseudomonas aeruginosa PA01
agcuggaccaccgug

SEQ ID NO: 3513864 - RNA, 18 nt, Pseudomonas aeruginosa PA01
agcuggaccaccguggcg

SEQ ID NO: 3513865 - RNA, 19 nt, Pseudomonas aeruginosa PA01
agcuggacgacgcuggccu

SEQ ID NO: 3513866 - RNA, 20 nt, Pseudomonas aeruginosa PA01
agcuggagcagcagcgccgc

SEQ ID NO: 3513867 - RNA, 21 nt, Pseudomonas aeruginosa PA01
agcuggagcagcagcgccgcg

SEQ ID NO: 3513868 - RNA, 16 nt, Pseudomonas aeruginosa PA01
agcuggauagaguacu

SEQ ID NO: 3513869 - RNA, 21 nt, Pseudomonas aeruginosa PA01
agcuggauccgugccaggcgc

SEQ ID NO: 3513870 - RNA, 16 nt, Pseudomonas aeruginosa PA01
agcuggaucggcaggc

SEQ ID NO: 3513871 - RNA, 20 nt, Pseudomonas aeruginosa PA01
agcuggaucggcaggcuggc

SEQ ID NO: 3513872 - RNA, 23 nt, Pseudomonas aeruginosa PA01
agcuggaucugguggaacagcau

SEQ ID NO: 3513873 - RNA, 13 nt, Pseudomonas aeruginosa PA01
agcuggccgagcg

SEQ ID NO: 3513874 - RNA, 15 nt, Pseudomonas aeruginosa PA01
agcuggccgagcgac

SEQ ID NO: 3513875 - RNA, 19 nt, Pseudomonas aeruginosa PA01
agcuggcgaucgaccugcc

SEQ ID NO: 3513876 - RNA, 22 nt, Pseudomonas aeruginosa PA01
agcuggcgauuuccucgcugcg

SEQ ID NO: 3513877 - RNA, 17 nt, Pseudomonas aeruginosa PA01
agcuggcgcacacgguc

SEQ ID NO: 3513878 - RNA, 21 nt, Pseudomonas aeruginosa PA01
agcuggcgcacacggucgaga

SEQ ID NO: 3513879 - RNA, 23 nt, Pseudomonas aeruginosa PA01
agcuggcgcagggcguucuucac

SEQ ID NO: 3513880 - RNA, 22 nt, Pseudomonas aeruginosa PA01
agcuggcgccgucaucgcugac

SEQ ID NO: 3513881 - RNA, 14 nt, Pseudomonas aeruginosa PA01
agcuggcgcgccuc

SEQ ID NO: 3513882 - RNA, 18 nt, Pseudomonas aeruginosa PA01
agcuggcgcgccuccugc

SEQ ID NO: 3513883 - RNA, 16 nt, Pseudomonas aeruginosa PA01
agcuggcgcgcgucga

SEQ ID NO: 3513884 - RNA, 19 nt, Pseudomonas aeruginosa PA01
agcuggcgcgucgcugccg

SEQ ID NO: 3513885 - RNA, 23 nt, Pseudomonas aeruginosa PA01
agcuggcgcgucgcugccgccgc

SEQ ID NO: 3513886 - RNA, 22 nt, Pseudomonas aeruginosa PA01
agcuggcgcguugugccgccac

SEQ ID NO: 3513887 - RNA, 23 nt, Pseudomonas aeruginosa PA01
agcuggcgcguugugccgccacc

SEQ ID NO: 3513888 - RNA, 14 nt, Pseudomonas aeruginosa PA01
agcugggcaggcug

SEQ ID NO: 3513889 - RNA, 21 nt, Pseudomonas aeruginosa PA01
agcuggggcuguugcugggcu

SEQ ID NO: 3513890 - RNA, 21 nt, Pseudomonas aeruginosa PA01
agcugguaggagccgucgccg

SEQ ID NO: 3513891 - RNA, 19 nt, Pseudomonas aeruginosa PA01
agcuggucaauaccacccu

SEQ ID NO: 3513892 - RNA, 22 nt, Pseudomonas aeruginosa PA01
agcugguggauguucgccgcca

SEQ ID NO: 3513893 - RNA, 17 nt, Pseudomonas aeruginosa PA01
agcuguagcggcuugca

SEQ ID NO: 3513894 - RNA, 19 nt, Pseudomonas aeruginosa PA01
agcuguccaucucgccgcg

SEQ ID NO: 3513895 - RNA, 14 nt, Pseudomonas aeruginosa PA01
agcuguccgcgccg

SEQ ID NO: 3513896 - RNA, 16 nt, Pseudomonas aeruginosa PA01
agcuguccgcgccgcg

SEQ ID NO: 3513897 - RNA, 17 nt, Pseudomonas aeruginosa PA01
agcuguccgcgccgcgu

SEQ ID NO: 3513898 - RNA, 15 nt, Pseudomonas aeruginosa PA01
agcuguccggcgcug

SEQ ID NO: 3513899 - RNA, 16 nt, Pseudomonas aeruginosa PA01
agcugucgagcacggc

SEQ ID NO: 3513900 - RNA, 19 nt, Pseudomonas aeruginosa PA01
aggaaucgaacccccgacc

SEQ ID NO: 3513901 - RNA, 19 nt, Pseudomonas aeruginosa PA01
aggaaucgacccagccgca

SEQ ID NO: 3513902 - RNA, 18 nt, Pseudomonas aeruginosa PA01
aggacaggccgacgucca

SEQ ID NO: 3513903 - RNA, 22 nt, Pseudomonas aeruginosa PA01
aggacagggccaggccgagcaa

SEQ ID NO: 3513904 - RNA, 17 nt, Pseudomonas aeruginosa PA01
aggacaggucgcggaag

SEQ ID NO: 3513905 - RNA, 19 nt, Pseudomonas aeruginosa PA01
aggacaggucgcggaagug

SEQ ID NO: 3513906 - RNA, 14 nt, Pseudomonas aeruginosa PA01
aggaccagcccguu

SEQ ID NO: 3513907 - RNA, 14 nt, Pseudomonas aeruginosa PA01
aggaccagcgccug

SEQ ID NO: 3513908 - RNA, 21 nt, Pseudomonas aeruginosa PA01
aggaccaggaucgaccccgcc

SEQ ID NO: 3513909 - RNA, 17 nt, Pseudomonas aeruginosa PA01
aggaccagggcgggccg

SEQ ID NO: 3513910 - RNA, 16 nt, Pseudomonas aeruginosa PA01
aggaccaucggcacca

SEQ ID NO: 3513911 - RNA, 14 nt, Pseudomonas aeruginosa PA01
aggacccagaugau

SEQ ID NO: 3513912 - RNA, 18 nt, Pseudomonas aeruginosa PA01
aggaccgacggcaacuga

SEQ ID NO: 3513913 - RNA, 17 nt, Pseudomonas aeruginosa PA01
aggaccucgaagcuggc

SEQ ID NO: 3513914 - RNA, 19 nt, Pseudomonas aeruginosa PA01
aggaccucgaagcuggcca

SEQ ID NO: 3513915 - RNA, 20 nt, Pseudomonas aeruginosa PA01
aggaccucgaagcuggccag

SEQ ID NO: 3513916 - RNA, 12 nt, Pseudomonas aeruginosa PA01
aggaccuggccg

SEQ ID NO: 3513917 - RNA, 16 nt, Pseudomonas aeruginosa PA01
aggaccuggcugaggc

SEQ ID NO: 3513918 - RNA, 16 nt, Pseudomonas aeruginosa PA01
aggaccuuccgccagc

SEQ ID NO: 3513919 - RNA, 20 nt, Pseudomonas aeruginosa PA01
aggaccuuccgccagcaggc

SEQ ID NO: 3513920 - RNA, 21 nt, Pseudomonas aeruginosa PA01
aggaccuuccgccagcaggcg

SEQ ID NO: 3513921 - RNA, 22 nt, Pseudomonas aeruginosa PA01
aggaccuuccgccagcaggcgc

SEQ ID NO: 3513922 - RNA, 16 nt, Pseudomonas aeruginosa PA01
aggaccuugucgcgca

SEQ ID NO: 3513923 - RNA, 18 nt, Pseudomonas aeruginosa PA01
aggaccuugucgcgcacc

SEQ ID NO: 3513924 - RNA, 19 nt, Pseudomonas aeruginosa PA01
aggaccuugucgcgcacca

SEQ ID NO: 3513925 - RNA, 19 nt, Pseudomonas aeruginosa PA01
aggacgaagucgccggcau

SEQ ID NO: 3513926 - RNA, 18 nt, Pseudomonas aeruginosa PA01
aggacgagacgccgagga

SEQ ID NO: 3513927 - RNA, 15 nt, Pseudomonas aeruginosa PA01
aggacgagcguccgc

SEQ ID NO: 3513928 - RNA, 19 nt, Pseudomonas aeruginosa PA01
aggacgaugaagaguucgc

SEQ ID NO: 3513929 - RNA, 18 nt, Pseudomonas aeruginosa PA01
aggaucuugcgcccggcg

SEQ ID NO: 3513930 - RNA, 16 nt, Pseudomonas aeruginosa PA01
aggaugaucagggcac

SEQ ID NO: 3513931 - RNA, 15 nt, Pseudomonas aeruginosa PA01
aggaugcagucggca

SEQ ID NO: 3513932 - RNA, 17 nt, Pseudomonas aeruginosa PA01
aggaugccgagguguag

SEQ ID NO: 3513933 - RNA, 13 nt, Pseudomonas aeruginosa PA01
aggaugccgccug

SEQ ID NO: 3513934 - RNA, 15 nt, Pseudomonas aeruginosa PA01
aggaugcgaugcugu

SEQ ID NO: 3513935 - RNA, 22 nt, Pseudomonas aeruginosa PA01
aggaugcgaugcugucagcgcc

SEQ ID NO: 3513936 - RNA, 21 nt, Pseudomonas aeruginosa PA01
aggaugcgccagcggcccggc

SEQ ID NO: 3513937 - RNA, 21 nt, Pseudomonas aeruginosa PA01
aggauggacagcuuggccagc

SEQ ID NO: 3513938 - RNA, 23 nt, Pseudomonas aeruginosa PA01
aggaugggcgaagccggcggcgc

SEQ ID NO: 3513939 - RNA, 16 nt, Pseudomonas aeruginosa PA01
aggauggucaggccgg

SEQ ID NO: 3513940 - RNA, 21 nt, Pseudomonas aeruginosa PA01
aggauggucaggccggcgcga

SEQ ID NO: 3513941 - RNA, 17 nt, Pseudomonas aeruginosa PA01
aggauguccgggugaug

SEQ ID NO: 3513942 - RNA, 15 nt, Pseudomonas aeruginosa PA01
aggauguccuuguuc

SEQ ID NO: 3513943 - RNA, 21 nt, Pseudomonas aeruginosa PA01
aggaugucgggaguucgaauc

SEQ ID NO: 3513944 - RNA, 20 nt, Pseudomonas aeruginosa PA01
aggauguggccgucgcgccg

SEQ ID NO: 3513945 - RNA, 16 nt, Pseudomonas aeruginosa PA01
aggauguucgccgagg

SEQ ID NO: 3513946 - RNA, 21 nt, Pseudomonas aeruginosa PA01
aggauguugacgauggcccag

SEQ ID NO: 3513947 - RNA, 22 nt, Pseudomonas aeruginosa PA01
aggauguugacgauggcccaga

SEQ ID NO: 3513948 - RNA, 13 nt, Pseudomonas aeruginosa PA01
aggauucagcagg

SEQ ID NO: 3513949 - RNA, 20 nt, Pseudomonas aeruginosa PA01
aggauucgccagccucggcg

SEQ ID NO: 3513950 - RNA, 19 nt, Pseudomonas aeruginosa PA01
aggauuuccgcgcccggcu

SEQ ID NO: 3513951 - RNA, 23 nt, Pseudomonas aeruginosa PA01
aggauuuccgcgcccggcuggcc

SEQ ID NO: 3513952 - RNA, 17 nt, Pseudomonas aeruginosa PA01
aggauuuccgcggccgg

SEQ ID NO: 3513953 - RNA, 19 nt, Pseudomonas aeruginosa PA01
aggauuuccucgcgcaccg

SEQ ID NO: 3513954 - RNA, 23 nt, Pseudomonas aeruginosa PA01
aggcaaaaaaaaggggcggggua

SEQ ID NO: 3513955 - RNA, 14 nt, Pseudomonas aeruginosa PA01
aggcaacagcccgc

SEQ ID NO: 3513956 - RNA, 18 nt, Pseudomonas aeruginosa PA01
aggcaacagcccgcgccg

SEQ ID NO: 3513957 - RNA, 13 nt, Pseudomonas aeruginosa PA01
aggcaaccgggua

SEQ ID NO: 3513958 - RNA, 16 nt, Pseudomonas aeruginosa PA01
aggcaaccggguaccu

SEQ ID NO: 3513959 - RNA, 18 nt, Pseudomonas aeruginosa PA01
aggcaaggucgucucaga

SEQ ID NO: 3513960 - RNA, 19 nt, Pseudomonas aeruginosa PA01
aggcaaggucgucucagac

SEQ ID NO: 3513961 - RNA, 16 nt, Pseudomonas aeruginosa PA01
aggcaaucugcccggc

SEQ ID NO: 3513962 - RNA, 17 nt, Pseudomonas aeruginosa PA01
aggcaaucugcccggca

SEQ ID NO: 3513963 - RNA, 18 nt, Pseudomonas aeruginosa PA01
aggcaaucugcccggcau

SEQ ID NO: 3513964 - RNA, 15 nt, Pseudomonas aeruginosa PA01
aggcaauggccggcg

SEQ ID NO: 3513965 - RNA, 14 nt, Pseudomonas aeruginosa PA01
aggcacaggacccu

SEQ ID NO: 3513966 - RNA, 15 nt, Pseudomonas aeruginosa PA01
aggcacaggacccuu

SEQ ID NO: 3513967 - RNA, 16 nt, Pseudomonas aeruginosa PA01
aggcacagggcgacua

SEQ ID NO: 3513968 - RNA, 14 nt, Pseudomonas aeruginosa PA01
aggcaccaccgccg

SEQ ID NO: 3513969 - RNA, 23 nt, Pseudomonas aeruginosa PA01
aggcaccaccgccgccagcaacg

SEQ ID NO: 3513970 - RNA, 19 nt, Pseudomonas aeruginosa PA01
aggcaccguaggccaggca

SEQ ID NO: 3513971 - RNA, 19 nt, Pseudomonas aeruginosa PA01
aggcacgaauuuccuggcg

SEQ ID NO: 3513972 - RNA, 16 nt, Pseudomonas aeruginosa PA01
aggcacgcugccagca

SEQ ID NO: 3513973 - RNA, 19 nt, Pseudomonas aeruginosa PA01
aggcacgcugccagcaggc

SEQ ID NO: 3513974 - RNA, 15 nt, Pseudomonas aeruginosa PA01
aggcacggaagcgcu

SEQ ID NO: 3513975 - RNA, 21 nt, Pseudomonas aeruginosa PA01
aggcacggaagcgcugcucga

SEQ ID NO: 3513976 - RNA, 19 nt, Pseudomonas aeruginosa PA01
aggcagaccagcgcaagcg

SEQ ID NO: 3513977 - RNA, 17 nt, Pseudomonas aeruginosa PA01
aggcagaccaggccgag

SEQ ID NO: 3513978 - RNA, 19 nt, Pseudomonas aeruginosa PA01
aggcagaccaggccgagca

SEQ ID NO: 3513979 - RNA, 22 nt, Pseudomonas aeruginosa PA01
aggcagaccaggccgagcagga

SEQ ID NO: 3513980 - RNA, 13 nt, Pseudomonas aeruginosa PA01
aggcagaccugca

SEQ ID NO: 3513981 - RNA, 21 nt, Pseudomonas aeruginosa PA01
aggcagaccugcagcaggauc

SEQ ID NO: 3513982 - RNA, 22 nt, Pseudomonas aeruginosa PA01
aggcagaccugcagcaggauca

SEQ ID NO: 3513983 - RNA, 15 nt, Pseudomonas aeruginosa PA01
aggcagaucgcgccg

SEQ ID NO: 3513984 - RNA, 20 nt, Pseudomonas aeruginosa PA01
aggcagccggccaugcuggc

SEQ ID NO: 3513985 - RNA, 13 nt, Pseudomonas aeruginosa PA01
aggcagcgaugcc

SEQ ID NO: 3513986 - RNA, 17 nt, Pseudomonas aeruginosa PA01
aggcagcgccgcccaca

SEQ ID NO: 3513987 - RNA, 17 nt, Pseudomonas aeruginosa PA01
aggcagcguccgaacgc

SEQ ID NO: 3513988 - RNA, 14 nt, Pseudomonas aeruginosa PA01
aggcaggccgggcu

SEQ ID NO: 3513989 - RNA, 16 nt, Pseudomonas aeruginosa PA01
aggcaggccgggcugg

SEQ ID NO: 3513990 - RNA, 19 nt, Pseudomonas aeruginosa PA01
aggcaggccgggcuggcca

SEQ ID NO: 3513991 - RNA, 22 nt, Pseudomonas aeruginosa PA01
aggcaggccgggcuggccaccg

SEQ ID NO: 3513992 - RNA, 23 nt, Pseudomonas aeruginosa PA01
aggcaggccugggcaagcugcac

SEQ ID NO: 3513993 - RNA, 11 nt, Pseudomonas aeruginosa PA01
aggcaggcgcg

SEQ ID NO: 3513994 - RNA, 15 nt, Pseudomonas aeruginosa PA01
aggcaggcgcggguc

SEQ ID NO: 3513995 - RNA, 19 nt, Pseudomonas aeruginosa PA01
aggcaggucgcugcccucg

SEQ ID NO: 3513996 - RNA, 20 nt, Pseudomonas aeruginosa PA01
aggcaguccuugagcgccag

SEQ ID NO: 3513997 - RNA, 22 nt, Pseudomonas aeruginosa PA01
aggcaguccuugagcgccagca

SEQ ID NO: 3513998 - RNA, 22 nt, Pseudomonas aeruginosa PA01
aggcagucguaggucugcccga

SEQ ID NO: 3513999 - RNA, 14 nt, Pseudomonas aeruginosa PA01
aggcagugccgggc

SEQ ID NO: 3514000 - RNA, 19 nt, Pseudomonas aeruginosa PA01
aggcaguggcgccagccag

SEQ ID NO: 3514001 - RNA, 21 nt, Pseudomonas aeruginosa PA01
aggcauauucuucaacagcgu

SEQ ID NO: 3514002 - RNA, 14 nt, Pseudomonas aeruginosa PA01
aggcauccagcacc

SEQ ID NO: 3514003 - RNA, 15 nt, Pseudomonas aeruginosa PA01
aggcauccagcaccg

SEQ ID NO: 3514004 - RNA, 12 nt, Pseudomonas aeruginosa PA01
aggcaugcccag

SEQ ID NO: 3514005 - RNA, 15 nt, Pseudomonas aeruginosa PA01
aggcaugcccaggcu

SEQ ID NO: 3514006 - RNA, 22 nt, Pseudomonas aeruginosa PA01
aggcaugguggaucgacugcau

SEQ ID NO: 3514007 - RNA, 14 nt, Pseudomonas aeruginosa PA01
aggcauucucgcga

SEQ ID NO: 3514008 - RNA, 14 nt, Pseudomonas aeruginosa PA01
aggccaagcaugaa

SEQ ID NO: 3514009 - RNA, 17 nt, Pseudomonas aeruginosa PA01
aggccaagucggccgcc

SEQ ID NO: 3514010 - RNA, 20 nt, Pseudomonas aeruginosa PA01
aggccaccagagccagccgc

SEQ ID NO: 3514011 - RNA, 21 nt, Pseudomonas aeruginosa PA01
aggccaccagagccagccgcg

SEQ ID NO: 3514012 - RNA, 19 nt, Pseudomonas aeruginosa PA01
aggccaccaucgcggcgau

SEQ ID NO: 3514013 - RNA, 21 nt, Pseudomonas aeruginosa PA01
aggccaccggauugucgaugu

SEQ ID NO: 3514014 - RNA, 17 nt, Pseudomonas aeruginosa PA01
aggccaccugcgggugg

SEQ ID NO: 3514015 - RNA, 21 nt, Pseudomonas aeruginosa PA01
aggccaccugcggguggccuu

SEQ ID NO: 3514016 - RNA, 14 nt, Pseudomonas aeruginosa PA01
aggccacgccgacg

SEQ ID NO: 3514017 - RNA, 14 nt, Pseudomonas aeruginosa PA01
aggccacgccgccg

SEQ ID NO: 3514018 - RNA, 13 nt, Pseudomonas aeruginosa PA01
aggccacggccgg

SEQ ID NO: 3514019 - RNA, 15 nt, Pseudomonas aeruginosa PA01
aggccacuucccggc

SEQ ID NO: 3514020 - RNA, 16 nt, Pseudomonas aeruginosa PA01
aggccagcaggccgug

SEQ ID NO: 3514021 - RNA, 23 nt, Pseudomonas aeruginosa PA01
aggccagccaacugcuucaggcg

SEQ ID NO: 3514022 - RNA, 15 nt, Pseudomonas aeruginosa PA01
aggccagcgccaggu

SEQ ID NO: 3514023 - RNA, 12 nt, Pseudomonas aeruginosa PA01
aggccagcggca

SEQ ID NO: 3514024 - RNA, 18 nt, Pseudomonas aeruginosa PA01
aggccagcggcauccgcc

SEQ ID NO: 3514025 - RNA, 23 nt, Pseudomonas aeruginosa PA01
aggccagcgggcugucguccugg

SEQ ID NO: 3514026 - RNA, 14 nt, Pseudomonas aeruginosa PA01
aggccagcucgccc

SEQ ID NO: 3514027 - RNA, 17 nt, Pseudomonas aeruginosa PA01
aggccagcucgucgccc

SEQ ID NO: 3514028 - RNA, 20 nt, Pseudomonas aeruginosa PA01
aggccagcuugucggccuug

SEQ ID NO: 3514029 - RNA, 22 nt, Pseudomonas aeruginosa PA01
aggccaggaucgucggcccgca

SEQ ID NO: 3514030 - RNA, 20 nt, Pseudomonas aeruginosa PA01
aggccaggcagaccagcgca

SEQ ID NO: 3514031 - RNA, 21 nt, Pseudomonas aeruginosa PA01
aggccaggccccagggccggc

SEQ ID NO: 3514032 - RNA, 15 nt, Pseudomonas aeruginosa PA01
aggccaggccgagcg

SEQ ID NO: 3514033 - RNA, 16 nt, Pseudomonas aeruginosa PA01
aggccaggccgagcgc

SEQ ID NO: 3514034 - RNA, 17 nt, Pseudomonas aeruginosa PA01
aggccaggccggcgccu

SEQ ID NO: 3514035 - RNA, 20 nt, Pseudomonas aeruginosa PA01
aggccaggcgauacgcggcc

SEQ ID NO: 3514036 - RNA, 21 nt, Pseudomonas aeruginosa PA01
aggccaggcgauacgcggccc

SEQ ID NO: 3514037 - RNA, 12 nt, Pseudomonas aeruginosa PA01
aggccaggcgca

SEQ ID NO: 3514038 - RNA, 23 nt, Pseudomonas aeruginosa PA01
aggccaggcucgguucugcgcac

SEQ ID NO: 3514039 - RNA, 14 nt, Pseudomonas aeruginosa PA01
aggccagggcauug

SEQ ID NO: 3514040 - RNA, 16 nt, Pseudomonas aeruginosa PA01
aggccagggcauugac

SEQ ID NO: 3514041 - RNA, 15 nt, Pseudomonas aeruginosa PA01
aggccagggcggcgc

SEQ ID NO: 3514042 - RNA, 16 nt, Pseudomonas aeruginosa PA01
aggccagggcggcgcc

SEQ ID NO: 3514043 - RNA, 17 nt, Pseudomonas aeruginosa PA01
aggccagggcggcgccg

SEQ ID NO: 3514044 - RNA, 18 nt, Pseudomonas aeruginosa PA01
aggccagggcggcgccga

SEQ ID NO: 3514045 - RNA, 16 nt, Pseudomonas aeruginosa PA01
aggccagguggucgau

SEQ ID NO: 3514046 - RNA, 17 nt, Pseudomonas aeruginosa PA01
aggccaguccggcaccg

SEQ ID NO: 3514047 - RNA, 22 nt, Pseudomonas aeruginosa PA01
aggccaguucgcugacccagcg

SEQ ID NO: 3514048 - RNA, 16 nt, Pseudomonas aeruginosa PA01
aggccauagcgcgccg

SEQ ID NO: 3514049 - RNA, 17 nt, Pseudomonas aeruginosa PA01
aggccauagcgcgccgg

SEQ ID NO: 3514050 - RNA, 20 nt, Pseudomonas aeruginosa PA01
aggccauagcgcgccggguu

SEQ ID NO: 3514051 - RNA, 20 nt, Pseudomonas aeruginosa PA01
aggccaucgaaaucgcccac

SEQ ID NO: 3514052 - RNA, 14 nt, Pseudomonas aeruginosa PA01
aggccaugaucauc

SEQ ID NO: 3514053 - RNA, 21 nt, Pseudomonas aeruginosa PA01
aggccaugaucaucgccugcu

SEQ ID NO: 3514054 - RNA, 16 nt, Pseudomonas aeruginosa PA01
aggccaugggugucgg

SEQ ID NO: 3514055 - RNA, 18 nt, Pseudomonas aeruginosa PA01
aggccaugggugucggcg

SEQ ID NO: 3514056 - RNA, 20 nt, Pseudomonas aeruginosa PA01
aggccaugggugucggcgau

SEQ ID NO: 3514057 - RNA, 19 nt, Pseudomonas aeruginosa PA01
aggccauucuucuccagaa

SEQ ID NO: 3514058 - RNA, 15 nt, Pseudomonas aeruginosa PA01
aggcccauccuggcg

SEQ ID NO: 3514059 - RNA, 20 nt, Pseudomonas aeruginosa PA01
aggcccaugauggucggcac

SEQ ID NO: 3514060 - RNA, 22 nt, Pseudomonas aeruginosa PA01
aggcccauuucguagcccaggc

SEQ ID NO: 3514061 - RNA, 14 nt, Pseudomonas aeruginosa PA01
aggccccaggccgc

SEQ ID NO: 3514062 - RNA, 17 nt, Pseudomonas aeruginosa PA01
aggcccgcaaucagcgg

SEQ ID NO: 3514063 - RNA, 17 nt, Pseudomonas aeruginosa PA01
aggcccgcgagccgcgc

SEQ ID NO: 3514064 - RNA, 18 nt, Pseudomonas aeruginosa PA01
aggcccgcgccgccggua

SEQ ID NO: 3514065 - RNA, 18 nt, Pseudomonas aeruginosa PA01
aggcccggccgccugccu

SEQ ID NO: 3514066 - RNA, 23 nt, Pseudomonas aeruginosa PA01
aggcccggcgcugcuucuugucg

SEQ ID NO: 3514067 - RNA, 17 nt, Pseudomonas aeruginosa PA01
aggcccggcguccucgc

SEQ ID NO: 3514068 - RNA, 23 nt, Pseudomonas aeruginosa PA01
aggcccgguugagauccuggccg

SEQ ID NO: 3514069 - RNA, 23 nt, Pseudomonas aeruginosa PA01
aggcccguauggcgggccuugcg

SEQ ID NO: 3514070 - RNA, 18 nt, Pseudomonas aeruginosa PA01
aggcccuacaaugauggc

SEQ ID NO: 3514071 - RNA, 24 nt, Pseudomonas aeruginosa PA01
aggcccucagcggcggugcgccgg

SEQ ID NO: 3514072 - RNA, 15 nt, Pseudomonas aeruginosa PA01
aggcccucggcgacc

SEQ ID NO: 3514073 - RNA, 13 nt, Pseudomonas aeruginosa PA01
aggcccucggcgc

SEQ ID NO: 3514074 - RNA, 16 nt, Pseudomonas aeruginosa PA01
aggcccucggcgccga

SEQ ID NO: 3514075 - RNA, 17 nt, Pseudomonas aeruginosa PA01
aggcccucggcgccgag

SEQ ID NO: 3514076 - RNA, 19 nt, Pseudomonas aeruginosa PA01
aggcccucggcgccgagca

SEQ ID NO: 3514077 - RNA, 21 nt, Pseudomonas aeruginosa PA01
aggcccugcuccuccaggcuc

SEQ ID NO: 3514078 - RNA, 16 nt, Pseudomonas aeruginosa PA01
aggcccugcugcaggg

SEQ ID NO: 3514079 - RNA, 19 nt, Pseudomonas aeruginosa PA01
aggcccugcugcagggccu

SEQ ID NO: 3514080 - RNA, 22 nt, Pseudomonas aeruginosa PA01
aggcccugcugcagggccucgc

SEQ ID NO: 3514081 - RNA, 21 nt, Pseudomonas aeruginosa PA01
aggcccuggaucaccgcggcg

SEQ ID NO: 3514082 - RNA, 16 nt, Pseudomonas aeruginosa PA01
aggcccuugaacaggc

SEQ ID NO: 3514083 - RNA, 17 nt, Pseudomonas aeruginosa PA01
aggcccuugagggccuc

SEQ ID NO: 3514084 - RNA, 22 nt, Pseudomonas aeruginosa PA01
aggcccuugagggccucggcga

SEQ ID NO: 3514085 - RNA, 19 nt, Pseudomonas aeruginosa PA01
aggcccuuuuccaccggcc

SEQ ID NO: 3514086 - RNA, 19 nt, Pseudomonas aeruginosa PA01
aggccgaacgguagguagc

SEQ ID NO: 3514087 - RNA, 22 nt, Pseudomonas aeruginosa PA01
aggccgaacgguagguagcguu

SEQ ID NO: 3514088 - RNA, 15 nt, Pseudomonas aeruginosa PA01
aggccgaacucacgg

SEQ ID NO: 3514089 - RNA, 19 nt, Pseudomonas aeruginosa PA01
aggccgaagaggcccucgg

SEQ ID NO: 3514090 - RNA, 16 nt, Pseudomonas aeruginosa PA01
aggccgaagccgccgg

SEQ ID NO: 3514091 - RNA, 18 nt, Pseudomonas aeruginosa PA01
aggccgaagccgccggga

SEQ ID NO: 3514092 - RNA, 18 nt, Pseudomonas aeruginosa PA01
aggccgaagcgugggcgg

SEQ ID NO: 3514093 - RNA, 16 nt, Pseudomonas aeruginosa PA01
aggccgaaggccagga

SEQ ID NO: 3514094 - RNA, 18 nt, Pseudomonas aeruginosa PA01
aggccgaauccgccggcg

SEQ ID NO: 3514095 - RNA, 13 nt, Pseudomonas aeruginosa PA01
aggccgacagcgg

SEQ ID NO: 3514096 - RNA, 15 nt, Pseudomonas aeruginosa PA01
aggccgacagcggcu

SEQ ID NO: 3514097 - RNA, 17 nt, Pseudomonas aeruginosa PA01
aggccgaccagcagggc

SEQ ID NO: 3514098 - RNA, 19 nt, Pseudomonas aeruginosa PA01
aggccgaccagcagggcca

SEQ ID NO: 3514099 - RNA, 22 nt, Pseudomonas aeruginosa PA01
aggccgaccagcagggccagca

SEQ ID NO: 3514100 - RNA, 22 nt, Pseudomonas aeruginosa PA01
aggccgacccgcaggccggcca

SEQ ID NO: 3514101 - RNA, 18 nt, Pseudomonas aeruginosa PA01
aggccgacgaacagccag

SEQ ID NO: 3514102 - RNA, 19 nt, Pseudomonas aeruginosa PA01
aggccgacgaacagccaga

SEQ ID NO: 3514103 - RNA, 20 nt, Pseudomonas aeruginosa PA01
aggccgacgaagaccuugaa

SEQ ID NO: 3514104 - RNA, 15 nt, Pseudomonas aeruginosa PA01
aggccgacggcgcgc

SEQ ID NO: 3514105 - RNA, 17 nt, Pseudomonas aeruginosa PA01
aggccgacggcgcgcug

SEQ ID NO: 3514106 - RNA, 19 nt, Pseudomonas aeruginosa PA01
aggccgagaccgcagccca

SEQ ID NO: 3514107 - RNA, 16 nt, Pseudomonas aeruginosa PA01
aggccgagcagcgcca

SEQ ID NO: 3514108 - RNA, 18 nt, Pseudomonas aeruginosa PA01
aggccgagcagcgccagc

SEQ ID NO: 3514109 - RNA, 20 nt, Pseudomonas aeruginosa PA01
aggccgagcagcgccagcca

SEQ ID NO: 3514110 - RNA, 13 nt, Pseudomonas aeruginosa PA01
aggccgagcagga

SEQ ID NO: 3514111 - RNA, 20 nt, Pseudomonas aeruginosa PA01
aggccgagcccaccgggaag

SEQ ID NO: 3514112 - RNA, 19 nt, Pseudomonas aeruginosa PA01
aggccgagcccgagugcgc

SEQ ID NO: 3514113 - RNA, 15 nt, Pseudomonas aeruginosa PA01
aggccgagcgcgccg

SEQ ID NO: 3514114 - RNA, 17 nt, Pseudomonas aeruginosa PA01
aggccgagcgcgccgcc

SEQ ID NO: 3514115 - RNA, 19 nt, Pseudomonas aeruginosa PA01
aggccgagcgcgccgccga

SEQ ID NO: 3514116 - RNA, 15 nt, Pseudomonas aeruginosa PA01
aggccgagcgugcgc

SEQ ID NO: 3514117 - RNA, 16 nt, Pseudomonas aeruginosa PA01
aggccgagcugcucga

SEQ ID NO: 3514118 - RNA, 19 nt, Pseudomonas aeruginosa PA01
aggccgagcugcucgaagc

SEQ ID NO: 3514119 - RNA, 20 nt, Pseudomonas aeruginosa PA01
aggccgagcugcucgaagca

SEQ ID NO: 3514120 - RNA, 21 nt, Pseudomonas aeruginosa PA01
aggccgaggaggacgucgcgg

SEQ ID NO: 3514121 - RNA, 18 nt, Pseudomonas aeruginosa PA01
aggccgaggaugcucgcc

SEQ ID NO: 3514122 - RNA, 21 nt, Pseudomonas aeruginosa PA01
aggccgaggaugcucgccugg

SEQ ID NO: 3514123 - RNA, 16 nt, Pseudomonas aeruginosa PA01
aggccgaggucggcgg

SEQ ID NO: 3514124 - RNA, 18 nt, Pseudomonas aeruginosa PA01
aggccgaggucggcggcg

SEQ ID NO: 3514125 - RNA, 22 nt, Pseudomonas aeruginosa PA01
aggccgaucaccaccagcgccg

SEQ ID NO: 3514126 - RNA, 14 nt, Pseudomonas aeruginosa PA01
aggccgaucagcgg

SEQ ID NO: 3514127 - RNA, 16 nt, Pseudomonas aeruginosa PA01
aggccgaucagcggcg

SEQ ID NO: 3514128 - RNA, 14 nt, Pseudomonas aeruginosa PA01
aggccgaucaggaa

SEQ ID NO: 3514129 - RNA, 21 nt, Pseudomonas aeruginosa PA01
aggccgaucucgugggccagc

SEQ ID NO: 3514130 - RNA, 18 nt, Pseudomonas aeruginosa PA01
aggccgaugaacgccgcg

SEQ ID NO: 3514131 - RNA, 12 nt, Pseudomonas aeruginosa PA01
aggccgauggcc

SEQ ID NO: 3514132 - RNA, 16 nt, Pseudomonas aeruginosa PA01
aggccgauguccucga

SEQ ID NO: 3514133 - RNA, 22 nt, Pseudomonas aeruginosa PA01
aggccuucgacgguucgcgaac

SEQ ID NO: 3514134 - RNA, 14 nt, Pseudomonas aeruginosa PA01
aggccuucgacuuc

SEQ ID NO: 3514135 - RNA, 14 nt, Pseudomonas aeruginosa PA01
aggccuucgccgac

SEQ ID NO: 3514136 - RNA, 23 nt, Pseudomonas aeruginosa PA01
aggccuucggcgccggagcuggu

SEQ ID NO: 3514137 - RNA, 13 nt, Pseudomonas aeruginosa PA01
aggccuugcaggg

SEQ ID NO: 3514138 - RNA, 17 nt, Pseudomonas aeruginosa PA01
aggccuugcagggccgc

SEQ ID NO: 3514139 - RNA, 23 nt, Pseudomonas aeruginosa PA01
aggccuugcagggccgccagccg

SEQ ID NO: 3514140 - RNA, 21 nt, Pseudomonas aeruginosa PA01
aggccuugccuucguuggccu

SEQ ID NO: 3514141 - RNA, 15 nt, Pseudomonas aeruginosa PA01
aggccuugcgcggcg

SEQ ID NO: 3514142 - RNA, 22 nt, Pseudomonas aeruginosa PA01
aggccuuggcccgguuggccag

SEQ ID NO: 3514143 - RNA, 21 nt, Pseudomonas aeruginosa PA01
aggccuuucuucugcugugcg

SEQ ID NO: 3514144 - RNA, 16 nt, Pseudomonas aeruginosa PA01
aggcgaaaaaaagccc

SEQ ID NO: 3514145 - RNA, 16 nt, Pseudomonas aeruginosa PA01
aggcgaaagucggcgc

SEQ ID NO: 3514146 - RNA, 16 nt, Pseudomonas aeruginosa PA01
aggcgaacacgucggc

SEQ ID NO: 3514147 - RNA, 19 nt, Pseudomonas aeruginosa PA01
aggcgaaccacaccagguc

SEQ ID NO: 3514148 - RNA, 22 nt, Pseudomonas aeruginosa PA01
aggcgaaccacaccaggucgcc

SEQ ID NO: 3514149 - RNA, 16 nt, Pseudomonas aeruginosa PA01
aggcgaacugccgacg

SEQ ID NO: 3514150 - RNA, 18 nt, Pseudomonas aeruginosa PA01
aggcgaacugccgacggc

SEQ ID NO: 3514151 - RNA, 16 nt, Pseudomonas aeruginosa PA01
aggcgaagcccagcga

SEQ ID NO: 3514152 - RNA, 23 nt, Pseudomonas aeruginosa PA01
aggcgaagccguuguagaucggc

SEQ ID NO: 3514153 - RNA, 19 nt, Pseudomonas aeruginosa PA01
aggcgaagcggcucggcca

SEQ ID NO: 3514154 - RNA, 18 nt, Pseudomonas aeruginosa PA01
aggcgaagcggcuggccg

SEQ ID NO: 3514155 - RNA, 22 nt, Pseudomonas aeruginosa PA01
aggcgaaguaucugggucuggc

SEQ ID NO: 3514156 - RNA, 14 nt, Pseudomonas aeruginosa PA01
aggcgaauggaggg

SEQ ID NO: 3514157 - RNA, 17 nt, Pseudomonas aeruginosa PA01
aggcgacaaaucggcau

SEQ ID NO: 3514158 - RNA, 14 nt, Pseudomonas aeruginosa PA01
aggcgacccggcau

SEQ ID NO: 3514159 - RNA, 17 nt, Pseudomonas aeruginosa PA01
aggcgacgaucagcccg

SEQ ID NO: 3514160 - RNA, 18 nt, Pseudomonas aeruginosa PA01
aggcgacgaucagcccgc

SEQ ID NO: 3514161 - RNA, 20 nt, Pseudomonas aeruginosa PA01
aggcgacgaucagcccgccg

SEQ ID NO: 3514162 - RNA, 22 nt, Pseudomonas aeruginosa PA01
aggcgacgaucagcccgccggc

SEQ ID NO: 3514163 - RNA, 13 nt, Pseudomonas aeruginosa PA01
aggcgacgcccug

SEQ ID NO: 3514164 - RNA, 21 nt, Pseudomonas aeruginosa PA01
aggcgacgcccuguucggcgg

SEQ ID NO: 3514165 - RNA, 12 nt, Pseudomonas aeruginosa PA01
aggcgacgccgc

SEQ ID NO: 3514166 - RNA, 21 nt, Pseudomonas aeruginosa PA01
aggcgacggucaggccgagca

SEQ ID NO: 3514167 - RNA, 14 nt, Pseudomonas aeruginosa PA01
aggcgacguuuuuc

SEQ ID NO: 3514168 - RNA, 21 nt, Pseudomonas aeruginosa PA01
aggcgacguuuuucccguggg

SEQ ID NO: 3514169 - RNA, 15 nt, Pseudomonas aeruginosa PA01
aggcgagcagcggca

SEQ ID NO: 3514170 - RNA, 23 nt, Pseudomonas aeruginosa PA01
aggcgagggugaacuggccgucg

SEQ ID NO: 3514171 - RNA, 16 nt, Pseudomonas aeruginosa PA01
aggcgaggguggcgcc

SEQ ID NO: 3514172 - RNA, 16 nt, Pseudomonas aeruginosa PA01
aggcgaggucgccggg

SEQ ID NO: 3514173 - RNA, 15 nt, Pseudomonas aeruginosa PA01
aggcgauagccgacc

SEQ ID NO: 3514174 - RNA, 22 nt, Pseudomonas aeruginosa PA01
aggcgauagccgaccaggccga

SEQ ID NO: 3514175 - RNA, 15 nt, Pseudomonas aeruginosa PA01
aggcgauaucccgcc

SEQ ID NO: 3514176 - RNA, 18 nt, Pseudomonas aeruginosa PA01
aggcgauaucccgccgcc

SEQ ID NO: 3514177 - RNA, 19 nt, Pseudomonas aeruginosa PA01
aggcgauaucccgccgccg

SEQ ID NO: 3514178 - RNA, 18 nt, Pseudomonas aeruginosa PA01
aggcgaucaucgccaccg

SEQ ID NO: 3514179 - RNA, 21 nt, Pseudomonas aeruginosa PA01
aggcgaucaucgccaccggua

SEQ ID NO: 3514180 - RNA, 13 nt, Pseudomonas aeruginosa PA01
aggcgauccagcg

SEQ ID NO: 3514181 - RNA, 22 nt, Pseudomonas aeruginosa PA01
aggcgaucccguagaccggcuc

SEQ ID NO: 3514182 - RNA, 14 nt, Pseudomonas aeruginosa PA01
aggcgaucgacgcc

SEQ ID NO: 3514183 - RNA, 14 nt, Pseudomonas aeruginosa PA01
aggcgaucgccgcg

SEQ ID NO: 3514184 - RNA, 17 nt, Pseudomonas aeruginosa PA01
aggcgaucgccgcggcg

SEQ ID NO: 3514185 - RNA, 18 nt, Pseudomonas aeruginosa PA01
aggcgaucgccgcggcga

SEQ ID NO: 3514186 - RNA, 14 nt, Pseudomonas aeruginosa PA01
aggcgaucuggcga

SEQ ID NO: 3514187 - RNA, 17 nt, Pseudomonas aeruginosa PA01
aggcgaugaacggcguc

SEQ ID NO: 3514188 - RNA, 14 nt, Pseudomonas aeruginosa PA01
aggcgaugaccgcc

SEQ ID NO: 3514189 - RNA, 15 nt, Pseudomonas aeruginosa PA01
aggcgaugaccgccc

SEQ ID NO: 3514190 - RNA, 14 nt, Pseudomonas aeruginosa PA01
aggcgaugccgacg

SEQ ID NO: 3514191 - RNA, 16 nt, Pseudomonas aeruginosa PA01
aggcgaugcgccggau

SEQ ID NO: 3514192 - RNA, 18 nt, Pseudomonas aeruginosa PA01
aggcgauggccuggucgg

SEQ ID NO: 3514193 - RNA, 15 nt, Pseudomonas aeruginosa PA01
aggcgauggugcgcu

SEQ ID NO: 3514194 - RNA, 20 nt, Pseudomonas aeruginosa PA01
aggcgauguaggucaccgcg

SEQ ID NO: 3514195 - RNA, 21 nt, Pseudomonas aeruginosa PA01
aggcgauguugacgauggcgc

SEQ ID NO: 3514196 - RNA, 22 nt, Pseudomonas aeruginosa PA01
aggcgauguugacgauggcgcc

SEQ ID NO: 3514197 - RNA, 18 nt, Pseudomonas aeruginosa PA01
aggcgcaaccagaccagc

SEQ ID NO: 3514198 - RNA, 14 nt, Pseudomonas aeruginosa PA01
aggcgcacaucacc

SEQ ID NO: 3514199 - RNA, 13 nt, Pseudomonas aeruginosa PA01
aggcgcaccagca

SEQ ID NO: 3514200 - RNA, 16 nt, Pseudomonas aeruginosa PA01
aggcgcaccagcaggc

SEQ ID NO: 3514201 - RNA, 15 nt, Pseudomonas aeruginosa PA01
aggcgcaccuccucg

SEQ ID NO: 3514202 - RNA, 18 nt, Pseudomonas aeruginosa PA01
aggcgcacuacgccguuc

SEQ ID NO: 3514203 - RNA, 19 nt, Pseudomonas aeruginosa PA01
aggcgcagcagcaugaugc

SEQ ID NO: 3514204 - RNA, 13 nt, Pseudomonas aeruginosa PA01
aggcgcagcagcg

SEQ ID NO: 3514205 - RNA, 15 nt, Pseudomonas aeruginosa PA01
aggcgcagcagcgac

SEQ ID NO: 3514206 - RNA, 16 nt, Pseudomonas aeruginosa PA01
aggcgcagcagcgcca

SEQ ID NO: 3514207 - RNA, 15 nt, Pseudomonas aeruginosa PA01
aggcgcagcuguuca

SEQ ID NO: 3514208 - RNA, 14 nt, Pseudomonas aeruginosa PA01
aggcgcaggcgaac

SEQ ID NO: 3514209 - RNA, 15 nt, Pseudomonas aeruginosa PA01
aggcgcaggcgagga

SEQ ID NO: 3514210 - RNA, 14 nt, Pseudomonas aeruginosa PA01
aggcgcaggucggc

SEQ ID NO: 3514211 - RNA, 18 nt, Pseudomonas aeruginosa PA01
aggcgcaggucggccucg

SEQ ID NO: 3514212 - RNA, 22 nt, Pseudomonas aeruginosa PA01
aggcgcaggucggccucggcga

SEQ ID NO: 3514213 - RNA, 14 nt, Pseudomonas aeruginosa PA01
aggcgcagugccug

SEQ ID NO: 3514214 - RNA, 18 nt, Pseudomonas aeruginosa PA01
aggcgcaucaggccaaag

SEQ ID NO: 3514215 - RNA, 20 nt, Pseudomonas aeruginosa PA01
aggcgcaugcccagggccag

SEQ ID NO: 3514216 - RNA, 21 nt, Pseudomonas aeruginosa PA01
aggcgcaugcccagggccagc

SEQ ID NO: 3514217 - RNA, 11 nt, Pseudomonas aeruginosa PA01
aggcgccagag

SEQ ID NO: 3514218 - RNA, 12 nt, Pseudomonas aeruginosa PA01
aggcgccaggcc

SEQ ID NO: 3514219 - RNA, 20 nt, Pseudomonas aeruginosa PA01
aggcgccagggacgcgcagc

SEQ ID NO: 3514220 - RNA, 11 nt, Pseudomonas aeruginosa PA01
aggcgccaguc

SEQ ID NO: 3514221 - RNA, 22 nt, Pseudomonas aeruginosa PA01
aggcgccagucauugcgcuccg

SEQ ID NO: 3514222 - RNA, 13 nt, Pseudomonas aeruginosa PA01
aggcgcccaggca

SEQ ID NO: 3514223 - RNA, 15 nt, Pseudomonas aeruginosa PA01
aggcgcccaggcagc

SEQ ID NO: 3514224 - RNA, 16 nt, Pseudomonas aeruginosa PA01
aggcgcccaggcagca

SEQ ID NO: 3514225 - RNA, 16 nt, Pseudomonas aeruginosa PA01
aggcgcccgccggccg

SEQ ID NO: 3514226 - RNA, 14 nt, Pseudomonas aeruginosa PA01
aggcgccgaccacg

SEQ ID NO: 3514227 - RNA, 24 nt, Pseudomonas aeruginosa PA01
aggcgccgaccgcaccgccagcgu

SEQ ID NO: 3514228 - RNA, 22 nt, Pseudomonas aeruginosa PA01
aggcgccgaugcccaggccgau

SEQ ID NO: 3514229 - RNA, 14 nt, Pseudomonas aeruginosa PA01
aggcgccgcccccg

SEQ ID NO: 3514230 - RNA, 12 nt, Pseudomonas aeruginosa PA01
aggcgccgccgu

SEQ ID NO: 3514231 - RNA, 13 nt, Pseudomonas aeruginosa PA01
aggcgccgccguc

SEQ ID NO: 3514232 - RNA, 20 nt, Pseudomonas aeruginosa PA01
aggcgccgcgcauccucggc

SEQ ID NO: 3514233 - RNA, 14 nt, Pseudomonas aeruginosa PA01
aggcgccgcgccag

SEQ ID NO: 3514234 - RNA, 22 nt, Pseudomonas aeruginosa PA01
aggcgccgcuugagaccuucgc

SEQ ID NO: 3514235 - RNA, 22 nt, Pseudomonas aeruginosa PA01
aggcgccggaccaacugcgaac

SEQ ID NO: 3514236 - RNA, 23 nt, Pseudomonas aeruginosa PA01
aggcggcucccuuuuuucauggg

SEQ ID NO: 3514237 - RNA, 14 nt, Pseudomonas aeruginosa PA01
aggcggcuggcgcg

SEQ ID NO: 3514238 - RNA, 14 nt, Pseudomonas aeruginosa PA01
aggcggcuguugcc

SEQ ID NO: 3514239 - RNA, 13 nt, Pseudomonas aeruginosa PA01
aggcgggccagca

SEQ ID NO: 3514240 - RNA, 17 nt, Pseudomonas aeruginosa PA01
aggcgggccagcagggu

SEQ ID NO: 3514241 - RNA, 18 nt, Pseudomonas aeruginosa PA01
aggcgggccagcuggcga

SEQ ID NO: 3514242 - RNA, 19 nt, Pseudomonas aeruginosa PA01
aggcgggccagcuggcgac

SEQ ID NO: 3514243 - RNA, 12 nt, Pseudomonas aeruginosa PA01
aggcgggcggcg

SEQ ID NO: 3514244 - RNA, 17 nt, Pseudomonas aeruginosa PA01
aggcgggcuccgccgcc

SEQ ID NO: 3514245 - RNA, 13 nt, Pseudomonas aeruginosa PA01
aggcgggcuggaa

SEQ ID NO: 3514246 - RNA, 14 nt, Pseudomonas aeruginosa PA01
aggcgggcuuugaa

SEQ ID NO: 3514247 - RNA, 16 nt, Pseudomonas aeruginosa PA01
aggcggggucagaggg

SEQ ID NO: 3514248 - RNA, 16 nt, Pseudomonas aeruginosa PA01
aggcgguacaccgcca

SEQ ID NO: 3514249 - RNA, 16 nt, Pseudomonas aeruginosa PA01
aggcgguagcgccgcg

SEQ ID NO: 3514250 - RNA, 19 nt, Pseudomonas aeruginosa PA01
aggcgguaguaggguucgc

SEQ ID NO: 3514251 - RNA, 22 nt, Pseudomonas aeruginosa PA01
aggcgguaguaggguucgccga

SEQ ID NO: 3514252 - RNA, 15 nt, Pseudomonas aeruginosa PA01
aggcggucagcaguu

SEQ ID NO: 3514253 - RNA, 22 nt, Pseudomonas aeruginosa PA01
aggcggucagcaguugccgggu

SEQ ID NO: 3514254 - RNA, 15 nt, Pseudomonas aeruginosa PA01
aggcggucaugcgcc

SEQ ID NO: 3514255 - RNA, 21 nt, Pseudomonas aeruginosa PA01
aggcggucgccgaacagccgc

SEQ ID NO: 3514256 - RNA, 12 nt, Pseudomonas aeruginosa PA01
aggcggucgcgg

SEQ ID NO: 3514257 - RNA, 21 nt, Pseudomonas aeruginosa PA01
aggcggucggaaagcagggcg

SEQ ID NO: 3514258 - RNA, 17 nt, Pseudomonas aeruginosa PA01
aggcggucggccaucug

SEQ ID NO: 3514259 - RNA, 16 nt, Pseudomonas aeruginosa PA01
aggcggugaccagcgg

SEQ ID NO: 3514260 - RNA, 17 nt, Pseudomonas aeruginosa PA01
aggcggugaccagcggc

SEQ ID NO: 3514261 - RNA, 19 nt, Pseudomonas aeruginosa PA01
aggcggugcagcggaagcc

SEQ ID NO: 3514262 - RNA, 20 nt, Pseudomonas aeruginosa PA01
aggcgguggccacgucgccc

SEQ ID NO: 3514263 - RNA, 21 nt, Pseudomonas aeruginosa PA01
aggcgguggcgaucagcgaaa

SEQ ID NO: 3514264 - RNA, 21 nt, Pseudomonas aeruginosa PA01
aggcgguguagaccaccagca

SEQ ID NO: 3514265 - RNA, 21 nt, Pseudomonas aeruginosa PA01
aggcggugucgcgguugcgcu

SEQ ID NO: 3514266 - RNA, 16 nt, Pseudomonas aeruginosa PA01
aggcgguucucgucga

SEQ ID NO: 3514267 - RNA, 17 nt, Pseudomonas aeruginosa PA01
aggcgguuggcccgcgc

SEQ ID NO: 3514268 - RNA, 19 nt, Pseudomonas aeruginosa PA01
aggcguagaaacgcgccuc

SEQ ID NO: 3514269 - RNA, 21 nt, Pseudomonas aeruginosa PA01
aggcguagaaacgcgccuccg

SEQ ID NO: 3514270 - RNA, 16 nt, Pseudomonas aeruginosa PA01
aggcguauucggcgac

SEQ ID NO: 3514271 - RNA, 23 nt, Pseudomonas aeruginosa PA01
aggcguauucggcgaccagcccg

SEQ ID NO: 3514272 - RNA, 21 nt, Pseudomonas aeruginosa PA01
aggcgucauagcagcgccgcg

SEQ ID NO: 3514273 - RNA, 15 nt, Pseudomonas aeruginosa PA01
aggcgucauccgcca

SEQ ID NO: 3514274 - RNA, 15 nt, Pseudomonas aeruginosa PA01
aggcguccaccggcg

SEQ ID NO: 3514275 - RNA, 17 nt, Pseudomonas aeruginosa PA01
aggcgucccauggcgcc

SEQ ID NO: 3514276 - RNA, 18 nt, Pseudomonas aeruginosa PA01
aggcgucccauggcgcca

SEQ ID NO: 3514277 - RNA, 18 nt, Pseudomonas aeruginosa PA01
aggcgucccgcuccagcc

SEQ ID NO: 3514278 - RNA, 19 nt, Pseudomonas aeruginosa PA01
aggcgucccuggagcaggg

SEQ ID NO: 3514279 - RNA, 20 nt, Pseudomonas aeruginosa PA01
aggcgucccuggagcagggc

SEQ ID NO: 3514280 - RNA, 14 nt, Pseudomonas aeruginosa PA01
aggcguccuggcga

SEQ ID NO: 3514281 - RNA, 18 nt, Pseudomonas aeruginosa PA01
aggcgucgaaacgggcgc

SEQ ID NO: 3514282 - RNA, 22 nt, Pseudomonas aeruginosa PA01
aggcgucgaaacgggcgcucug

SEQ ID NO: 3514283 - RNA, 13 nt, Pseudomonas aeruginosa PA01
aggcgucgccguc

SEQ ID NO: 3514284 - RNA, 14 nt, Pseudomonas aeruginosa PA01
aggcgucgccgucg

SEQ ID NO: 3514285 - RNA, 14 nt, Pseudomonas aeruginosa PA01
aggcgucgcgccag

SEQ ID NO: 3514286 - RNA, 16 nt, Pseudomonas aeruginosa PA01
aggcgucgcgccagca

SEQ ID NO: 3514287 - RNA, 18 nt, Pseudomonas aeruginosa PA01
aggcgucgcgccagcacc

SEQ ID NO: 3514288 - RNA, 13 nt, Pseudomonas aeruginosa PA01
aggcgucggcggg

SEQ ID NO: 3514289 - RNA, 11 nt, Pseudomonas aeruginosa PA01
aggcgucggcu

SEQ ID NO: 3514290 - RNA, 22 nt, Pseudomonas aeruginosa PA01
aggcgucguccucgaaagccgc

SEQ ID NO: 3514291 - RNA, 14 nt, Pseudomonas aeruginosa PA01
aggcgucguugccg

SEQ ID NO: 3514292 - RNA, 20 nt, Pseudomonas aeruginosa PA01
aggcgucguuguugcgggcg

SEQ ID NO: 3514293 - RNA, 15 nt, Pseudomonas aeruginosa PA01
aggcgugccgcuggc

SEQ ID NO: 3514294 - RNA, 17 nt, Pseudomonas aeruginosa PA01
aggcgugccgcuggccg

SEQ ID NO: 3514295 - RNA, 18 nt, Pseudomonas aeruginosa PA01
aggcgugccgcuggccga

SEQ ID NO: 3514296 - RNA, 19 nt, Pseudomonas aeruginosa PA01
aggcgugccgcuggccgac

SEQ ID NO: 3514297 - RNA, 21 nt, Pseudomonas aeruginosa PA01
aggcgugccuguuccuccgcc

SEQ ID NO: 3514298 - RNA, 13 nt, Pseudomonas aeruginosa PA01
aggcgugcugcac

SEQ ID NO: 3514299 - RNA, 13 nt, Pseudomonas aeruginosa PA01
aggcgugcuggcu

SEQ ID NO: 3514300 - RNA, 13 nt, Pseudomonas aeruginosa PA01
aggcgugggccag

SEQ ID NO: 3514301 - RNA, 16 nt, Pseudomonas aeruginosa PA01
aggcgugggccagccc

SEQ ID NO: 3514302 - RNA, 17 nt, Pseudomonas aeruginosa PA01
aggcgugggccagccca

SEQ ID NO: 3514303 - RNA, 16 nt, Pseudomonas aeruginosa PA01
aggcgugggcgccggc

SEQ ID NO: 3514304 - RNA, 18 nt, Pseudomonas aeruginosa PA01
aggcguggggcgaauaac

SEQ ID NO: 3514305 - RNA, 14 nt, Pseudomonas aeruginosa PA01
aggcguuauccgcc

SEQ ID NO: 3514306 - RNA, 17 nt, Pseudomonas aeruginosa PA01
aggcguuauccgccgcc

SEQ ID NO: 3514307 - RNA, 20 nt, Pseudomonas aeruginosa PA01
aggcguucaugaaagccagc

SEQ ID NO: 3514308 - RNA, 15 nt, Pseudomonas aeruginosa PA01
aggcguuccaccagg

SEQ ID NO: 3514309 - RNA, 14 nt, Pseudomonas aeruginosa PA01
aggcguuccagcuc

SEQ ID NO: 3514310 - RNA, 19 nt, Pseudomonas aeruginosa PA01
aggcguuccagcucggcga

SEQ ID NO: 3514311 - RNA, 20 nt, Pseudomonas aeruginosa PA01
aggcguuccagcucggcgag

SEQ ID NO: 3514312 - RNA, 22 nt, Pseudomonas aeruginosa PA01
aggcguuccaggugguggcgga

SEQ ID NO: 3514313 - RNA, 16 nt, Pseudomonas aeruginosa PA01
aggcguuccaguucgg

SEQ ID NO: 3514314 - RNA, 14 nt, Pseudomonas aeruginosa PA01
aggcguucgucgac

SEQ ID NO: 3514315 - RNA, 15 nt, Pseudomonas aeruginosa PA01
aggcguucgucgacc

SEQ ID NO: 3514316 - RNA, 18 nt, Pseudomonas aeruginosa PA01
aggcguucgucgaccugc

SEQ ID NO: 3514317 - RNA, 15 nt, Pseudomonas aeruginosa PA01
aggcuaacgccgagg

SEQ ID NO: 3514318 - RNA, 17 nt, Pseudomonas aeruginosa PA01
aggcucaaucaaucggu

SEQ ID NO: 3514319 - RNA, 19 nt, Pseudomonas aeruginosa PA01
aggcucacgcguucggcga

SEQ ID NO: 3514320 - RNA, 17 nt, Pseudomonas aeruginosa PA01
aggcucagcucggcgau

SEQ ID NO: 3514321 - RNA, 13 nt, Pseudomonas aeruginosa PA01
aggcucaggccgg

SEQ ID NO: 3514322 - RNA, 16 nt, Pseudomonas aeruginosa PA01
aggcucaggccgggca

SEQ ID NO: 3514323 - RNA, 16 nt, Pseudomonas aeruginosa PA01
aggcucagggucucgc

SEQ ID NO: 3514324 - RNA, 17 nt, Pseudomonas aeruginosa PA01
aggcucaguucggccag

SEQ ID NO: 3514325 - RNA, 18 nt, Pseudomonas aeruginosa PA01
aggcucaucgcccgcccu

SEQ ID NO: 3514326 - RNA, 17 nt, Pseudomonas aeruginosa PA01
aggcucaugcccagcuu

SEQ ID NO: 3514327 - RNA, 16 nt, Pseudomonas aeruginosa PA01
aggcucccccgcgccg

SEQ ID NO: 3514328 - RNA, 19 nt, Pseudomonas aeruginosa PA01
aggcucgacaggucggcga

SEQ ID NO: 3514329 - RNA, 20 nt, Pseudomonas aeruginosa PA01
aggcucgacaggucggcgaa

SEQ ID NO: 3514330 - RNA, 20 nt, Pseudomonas aeruginosa PA01
aggcucgagccgaacuccgg

SEQ ID NO: 3514331 - RNA, 15 nt, Pseudomonas aeruginosa PA01
aggcucgaggccgag

SEQ ID NO: 3514332 - RNA, 12 nt, Pseudomonas aeruginosa PA01
aggcucgccccg

SEQ ID NO: 3514333 - RNA, 16 nt, Pseudomonas aeruginosa PA01
aggcucgccccggcgg

SEQ ID NO: 3514334 - RNA, 16 nt, Pseudomonas aeruginosa PA01
aggcucgccgccagca

SEQ ID NO: 3514335 - RNA, 22 nt, Pseudomonas aeruginosa PA01
aggcucgccggguuguccaggc

SEQ ID NO: 3514336 - RNA, 23 nt, Pseudomonas aeruginosa PA01
aggcucgcgaugcugugcaggga

SEQ ID NO: 3514337 - RNA, 13 nt, Pseudomonas aeruginosa PA01
aggcucggccugu

SEQ ID NO: 3514338 - RNA, 14 nt, Pseudomonas aeruginosa PA01
aggcucggcggcca

SEQ ID NO: 3514339 - RNA, 16 nt, Pseudomonas aeruginosa PA01
agggaucgcgcggcug

SEQ ID NO: 3514340 - RNA, 18 nt, Pseudomonas aeruginosa PA01
agggaucgcgcggcuggc

SEQ ID NO: 3514341 - RNA, 18 nt, Pseudomonas aeruginosa PA01
agggaucgucgccaagcc

SEQ ID NO: 3514342 - RNA, 23 nt, Pseudomonas aeruginosa PA01
agggaucgucgccaagcccggcg

SEQ ID NO: 3514343 - RNA, 15 nt, Pseudomonas aeruginosa PA01
agggaugccgccggc

SEQ ID NO: 3514344 - RNA, 21 nt, Pseudomonas aeruginosa PA01
agggaugccgccggcaucccu

SEQ ID NO: 3514345 - RNA, 22 nt, Pseudomonas aeruginosa PA01
agggaugccgccggcaucccuu

SEQ ID NO: 3514346 - RNA, 15 nt, Pseudomonas aeruginosa PA01
agggaugccggcggc

SEQ ID NO: 3514347 - RNA, 17 nt, Pseudomonas aeruginosa PA01
agggaugccggcggcau

SEQ ID NO: 3514348 - RNA, 22 nt, Pseudomonas aeruginosa PA01
agggaugccggcggcaucccuu

SEQ ID NO: 3514349 - RNA, 21 nt, Pseudomonas aeruginosa PA01
agggauguuccaggcccgccg

SEQ ID NO: 3514350 - RNA, 18 nt, Pseudomonas aeruginosa PA01
agggauuccgggucgagg

SEQ ID NO: 3514351 - RNA, 19 nt, Pseudomonas aeruginosa PA01
agggauuccgggucgaggc

SEQ ID NO: 3514352 - RNA, 14 nt, Pseudomonas aeruginosa PA01
agggcaaacagcuc

SEQ ID NO: 3514353 - RNA, 15 nt, Pseudomonas aeruginosa PA01
agggcaaaggcgcgc

SEQ ID NO: 3514354 - RNA, 16 nt, Pseudomonas aeruginosa PA01
agggcaaaggcgcgca

SEQ ID NO: 3514355 - RNA, 16 nt, Pseudomonas aeruginosa PA01
agggcaacgccaggcu

SEQ ID NO: 3514356 - RNA, 19 nt, Pseudomonas aeruginosa PA01
agggcaacgccaggcuguc

SEQ ID NO: 3514357 - RNA, 21 nt, Pseudomonas aeruginosa PA01
agggcaacgccaggcugucag

SEQ ID NO: 3514358 - RNA, 24 nt, Pseudomonas aeruginosa PA01
agggcaagguaguccaucaccgcg

SEQ ID NO: 3514359 - RNA, 21 nt, Pseudomonas aeruginosa PA01
agggcacccgguugaccccgc

SEQ ID NO: 3514360 - RNA, 16 nt, Pseudomonas aeruginosa PA01
agggcaccgccgagga

SEQ ID NO: 3514361 - RNA, 19 nt, Pseudomonas aeruginosa PA01
agggcaccgccgaggaaca

SEQ ID NO: 3514362 - RNA, 14 nt, Pseudomonas aeruginosa PA01
agggcacgccgcuc

SEQ ID NO: 3514363 - RNA, 23 nt, Pseudomonas aeruginosa PA01
agggcacgccgcucugcccgacc

SEQ ID NO: 3514364 - RNA, 15 nt, Pseudomonas aeruginosa PA01
agggcacgugcagcg

SEQ ID NO: 3514365 - RNA, 18 nt, Pseudomonas aeruginosa PA01
agggcacgugcagcggca

SEQ ID NO: 3514366 - RNA, 13 nt, Pseudomonas aeruginosa PA01
agggcagcagguc

SEQ ID NO: 3514367 - RNA, 16 nt, Pseudomonas aeruginosa PA01
agggcagccgccgcgg

SEQ ID NO: 3514368 - RNA, 20 nt, Pseudomonas aeruginosa PA01
agggcagccgccgcggcacc

SEQ ID NO: 3514369 - RNA, 22 nt, Pseudomonas aeruginosa PA01
agggcagggaguccgccagccg

SEQ ID NO: 3514370 - RNA, 17 nt, Pseudomonas aeruginosa PA01
agggcaguacguggcgc

SEQ ID NO: 3514371 - RNA, 21 nt, Pseudomonas aeruginosa PA01
agggcaguacguggcgcuuga

SEQ ID NO: 3514372 - RNA, 21 nt, Pseudomonas aeruginosa PA01
agggcauauucauagccguug

SEQ ID NO: 3514373 - RNA, 12 nt, Pseudomonas aeruginosa PA01
agggcaucagcc

SEQ ID NO: 3514374 - RNA, 14 nt, Pseudomonas aeruginosa PA01
agggcaucagcccc

SEQ ID NO: 3514375 - RNA, 15 nt, Pseudomonas aeruginosa PA01
agggcaucagccccu

SEQ ID NO: 3514376 - RNA, 22 nt, Pseudomonas aeruginosa PA01
agggcaucagccccucggccag

SEQ ID NO: 3514377 - RNA, 17 nt, Pseudomonas aeruginosa PA01
agggcauccagggucgc

SEQ ID NO: 3514378 - RNA, 15 nt, Pseudomonas aeruginosa PA01
agggcauccaucgcc

SEQ ID NO: 3514379 - RNA, 14 nt, Pseudomonas aeruginosa PA01
agggcaucgccgac

SEQ ID NO: 3514380 - RNA, 19 nt, Pseudomonas aeruginosa PA01
agggcaucgccgacagguc

SEQ ID NO: 3514381 - RNA, 19 nt, Pseudomonas aeruginosa PA01
agggcaugaccgauggcgc

SEQ ID NO: 3514382 - RNA, 20 nt, Pseudomonas aeruginosa PA01
agggcaugggucagcgccag

SEQ ID NO: 3514383 - RNA, 22 nt, Pseudomonas aeruginosa PA01
agggcaugggucagcgccagca

SEQ ID NO: 3514384 - RNA, 21 nt, Pseudomonas aeruginosa PA01
agggcauuggccaucagcgcc

SEQ ID NO: 3514385 - RNA, 18 nt, Pseudomonas aeruginosa PA01
agggcauuuccugggugc

SEQ ID NO: 3514386 - RNA, 12 nt, Pseudomonas aeruginosa PA01
agggccagcaac

SEQ ID NO: 3514387 - RNA, 15 nt, Pseudomonas aeruginosa PA01
agggccagcaacagg

SEQ ID NO: 3514388 - RNA, 13 nt, Pseudomonas aeruginosa PA01
agggccagcagcg

SEQ ID NO: 3514389 - RNA, 23 nt, Pseudomonas aeruginosa PA01
agggccagcagcggcggcgccgg

SEQ ID NO: 3514390 - RNA, 13 nt, Pseudomonas aeruginosa PA01
agggccagccaga

SEQ ID NO: 3514391 - RNA, 15 nt, Pseudomonas aeruginosa PA01
agggccagccagagc

SEQ ID NO: 3514392 - RNA, 20 nt, Pseudomonas aeruginosa PA01
agggccagccagagccaguc

SEQ ID NO: 3514393 - RNA, 12 nt, Pseudomonas aeruginosa PA01
agggccagcgcc

SEQ ID NO: 3514394 - RNA, 13 nt, Pseudomonas aeruginosa PA01
agggccagcgccu

SEQ ID NO: 3514395 - RNA, 19 nt, Pseudomonas aeruginosa PA01
agggccaggaaaucgagcg

SEQ ID NO: 3514396 - RNA, 18 nt, Pseudomonas aeruginosa PA01
agggccaggagcaucggc

SEQ ID NO: 3514397 - RNA, 19 nt, Pseudomonas aeruginosa PA01
agggccaggagcaucggcg

SEQ ID NO: 3514398 - RNA, 20 nt, Pseudomonas aeruginosa PA01
agggccaggagcaucggcgc

SEQ ID NO: 3514399 - RNA, 11 nt, Pseudomonas aeruginosa PA01
agggccaggcc

SEQ ID NO: 3514400 - RNA, 21 nt, Pseudomonas aeruginosa PA01
agggccaggccgagcgcgccg

SEQ ID NO: 3514401 - RNA, 18 nt, Pseudomonas aeruginosa PA01
agggccagggaggcgcug

SEQ ID NO: 3514402 - RNA, 22 nt, Pseudomonas aeruginosa PA01
agggccagggaggcgcuggcca

SEQ ID NO: 3514403 - RNA, 23 nt, Pseudomonas aeruginosa PA01
agggccagggaggcgcuggccag

SEQ ID NO: 3514404 - RNA, 19 nt, Pseudomonas aeruginosa PA01
agggccauuguucuuuggc

SEQ ID NO: 3514405 - RNA, 17 nt, Pseudomonas aeruginosa PA01
agggcccacagugccag

SEQ ID NO: 3514406 - RNA, 21 nt, Pseudomonas aeruginosa PA01
agggcccacagugccaggcuc

SEQ ID NO: 3514407 - RNA, 18 nt, Pseudomonas aeruginosa PA01
agggcccgaacgggcccu

SEQ ID NO: 3514408 - RNA, 14 nt, Pseudomonas aeruginosa PA01
agggccgagcgcag

SEQ ID NO: 3514409 - RNA, 19 nt, Pseudomonas aeruginosa PA01
agggccgagcgcagcgcca

SEQ ID NO: 3514410 - RNA, 21 nt, Pseudomonas aeruginosa PA01
agggccgagcgcagcgccacc

SEQ ID NO: 3514411 - RNA, 15 nt, Pseudomonas aeruginosa PA01
agggccgccagccgc

SEQ ID NO: 3514412 - RNA, 20 nt, Pseudomonas aeruginosa PA01
agggccgccagccgccagga

SEQ ID NO: 3514413 - RNA, 15 nt, Pseudomonas aeruginosa PA01
agggccgccgagguc

SEQ ID NO: 3514414 - RNA, 17 nt, Pseudomonas aeruginosa PA01
agggccgccgaggucag

SEQ ID NO: 3514415 - RNA, 16 nt, Pseudomonas aeruginosa PA01
agggccgcgagagguu

SEQ ID NO: 3514416 - RNA, 16 nt, Pseudomonas aeruginosa PA01
agggccgcgccgagcc

SEQ ID NO: 3514417 - RNA, 18 nt, Pseudomonas aeruginosa PA01
agggccgcggcggauaac

SEQ ID NO: 3514418 - RNA, 22 nt, Pseudomonas aeruginosa PA01
agggccgcggcguugucggcca

SEQ ID NO: 3514419 - RNA, 13 nt, Pseudomonas aeruginosa PA01
agggccgcucgag

SEQ ID NO: 3514420 - RNA, 20 nt, Pseudomonas aeruginosa PA01
agggccggaugccaccgcuc

SEQ ID NO: 3514421 - RNA, 14 nt, Pseudomonas aeruginosa PA01
agggccucgccacg

SEQ ID NO: 3514422 - RNA, 13 nt, Pseudomonas aeruginosa PA01
agggccucggcga

SEQ ID NO: 3514423 - RNA, 21 nt, Pseudomonas aeruginosa PA01
agggccucggcgaagucgccg

SEQ ID NO: 3514424 - RNA, 19 nt, Pseudomonas aeruginosa PA01
agggccucuucgcaacggc

SEQ ID NO: 3514425 - RNA, 22 nt, Pseudomonas aeruginosa PA01
agggccucuucgcaacggccgu

SEQ ID NO: 3514426 - RNA, 13 nt, Pseudomonas aeruginosa PA01
agggccugcucag

SEQ ID NO: 3514427 - RNA, 14 nt, Pseudomonas aeruginosa PA01
agggccugcuccag

SEQ ID NO: 3514428 - RNA, 19 nt, Pseudomonas aeruginosa PA01
agggccugcuccagcggag

SEQ ID NO: 3514429 - RNA, 15 nt, Pseudomonas aeruginosa PA01
agggccugggcgccg

SEQ ID NO: 3514430 - RNA, 22 nt, Pseudomonas aeruginosa PA01
agggccugggcgccgccagcca

SEQ ID NO: 3514431 - RNA, 20 nt, Pseudomonas aeruginosa PA01
agggccugguagaaacgcuu

SEQ ID NO: 3514432 - RNA, 21 nt, Pseudomonas aeruginosa PA01
agggccuuaccagaagccggc

SEQ ID NO: 3514433 - RNA, 17 nt, Pseudomonas aeruginosa PA01
agggccuugagcacggu

SEQ ID NO: 3514434 - RNA, 20 nt, Pseudomonas aeruginosa PA01
agggcgaacaaccgcucgcg

SEQ ID NO: 3514435 - RNA, 18 nt, Pseudomonas aeruginosa PA01
agggcgaacaacgccgcc

SEQ ID NO: 3514436 - RNA, 20 nt, Pseudomonas aeruginosa PA01
agggcgaacagcagcgguag

SEQ ID NO: 3514437 - RNA, 22 nt, Pseudomonas aeruginosa PA01
agggcgaacagcgccgcggcug

SEQ ID NO: 3514438 - RNA, 23 nt, Pseudomonas aeruginosa PA01
agggcgaacagcgccgcggcugg

SEQ ID NO: 3514439 - RNA, 21 nt, Pseudomonas aeruginosa PA01
agggcgaaccacucggcgcuu

SEQ ID NO: 3514440 - RNA, 14 nt, Pseudomonas aeruginosa PA01
agggcgaaggccac

SEQ ID NO: 3514441 - RNA, 19 nt, Pseudomonas aeruginosa PA01
aggggccgccguacaggcc

SEQ ID NO: 3514442 - RNA, 21 nt, Pseudomonas aeruginosa PA01
aggggcgagagacugaacucg

SEQ ID NO: 3514443 - RNA, 14 nt, Pseudomonas aeruginosa PA01
aggggcgcgccggc

SEQ ID NO: 3514444 - RNA, 18 nt, Pseudomonas aeruginosa PA01
aggggcggagcagccuca

SEQ ID NO: 3514445 - RNA, 14 nt, Pseudomonas aeruginosa PA01
aggggcuagucgcg

SEQ ID NO: 3514446 - RNA, 17 nt, Pseudomonas aeruginosa PA01
aggggcugaacagcgcc

SEQ ID NO: 3514447 - RNA, 18 nt, Pseudomonas aeruginosa PA01
aggggcugaacagcgcca

SEQ ID NO: 3514448 - RNA, 14 nt, Pseudomonas aeruginosa PA01
agggggaagugaag

SEQ ID NO: 3514449 - RNA, 17 nt, Pseudomonas aeruginosa PA01
agggggccucggccagc

SEQ ID NO: 3514450 - RNA, 21 nt, Pseudomonas aeruginosa PA01
agggggccucggccagcgccg

SEQ ID NO: 3514451 - RNA, 13 nt, Pseudomonas aeruginosa PA01
aggggucaggccg

SEQ ID NO: 3514452 - RNA, 17 nt, Pseudomonas aeruginosa PA01
aggggucgacgcagggc

SEQ ID NO: 3514453 - RNA, 17 nt, Pseudomonas aeruginosa PA01
aggggucggcaucgcgu

SEQ ID NO: 3514454 - RNA, 21 nt, Pseudomonas aeruginosa PA01
agggguggccaggcgcaccag

SEQ ID NO: 3514455 - RNA, 22 nt, Pseudomonas aeruginosa PA01
agggguggccaggcgcaccagc

SEQ ID NO: 3514456 - RNA, 19 nt, Pseudomonas aeruginosa PA01
aggguauagguggugcugg

SEQ ID NO: 3514457 - RNA, 21 nt, Pseudomonas aeruginosa PA01
aggguauugaggauccacuug

SEQ ID NO: 3514458 - RNA, 16 nt, Pseudomonas aeruginosa PA01
aggguauuuuccagca

SEQ ID NO: 3514459 - RNA, 17 nt, Pseudomonas aeruginosa PA01
aggguauuuuccagcag

SEQ ID NO: 3514460 - RNA, 18 nt, Pseudomonas aeruginosa PA01
aggguauuuuccagcagg

SEQ ID NO: 3514461 - RNA, 13 nt, Pseudomonas aeruginosa PA01
agggucacgcugg

SEQ ID NO: 3514462 - RNA, 14 nt, Pseudomonas aeruginosa PA01
agggucagaccagc

SEQ ID NO: 3514463 - RNA, 16 nt, Pseudomonas aeruginosa PA01
agggucagcaggcugc

SEQ ID NO: 3514464 - RNA, 13 nt, Pseudomonas aeruginosa PA01
agggucagccgau

SEQ ID NO: 3514465 - RNA, 20 nt, Pseudomonas aeruginosa PA01
agggucagccgcaggccguu

SEQ ID NO: 3514466 - RNA, 21 nt, Pseudomonas aeruginosa PA01
agggucagccgcaggccguuu

SEQ ID NO: 3514467 - RNA, 17 nt, Pseudomonas aeruginosa PA01
agggucagcuggcgcgc

SEQ ID NO: 3514468 - RNA, 20 nt, Pseudomonas aeruginosa PA01
agggucagcuggcgcgccuc

SEQ ID NO: 3514469 - RNA, 13 nt, Pseudomonas aeruginosa PA01
agggucaggccga

SEQ ID NO: 3514470 - RNA, 17 nt, Pseudomonas aeruginosa PA01
agggucaggccuugacg

SEQ ID NO: 3514471 - RNA, 19 nt, Pseudomonas aeruginosa PA01
agggucagguugccgguga

SEQ ID NO: 3514472 - RNA, 16 nt, Pseudomonas aeruginosa PA01
agggucagucgagcag

SEQ ID NO: 3514473 - RNA, 16 nt, Pseudomonas aeruginosa PA01
aggguccaguucaggg

SEQ ID NO: 3514474 - RNA, 15 nt, Pseudomonas aeruginosa PA01
agggucgcagcaggc

SEQ ID NO: 3514475 - RNA, 17 nt, Pseudomonas aeruginosa PA01
agggucgcagcaggccg

SEQ ID NO: 3514476 - RNA, 13 nt, Pseudomonas aeruginosa PA01
agggucgccaggg

SEQ ID NO: 3514477 - RNA, 17 nt, Pseudomonas aeruginosa PA01
agggucgcgccguccau

SEQ ID NO: 3514478 - RNA, 23 nt, Pseudomonas aeruginosa PA01
agggucgcguagaccaucgccgg

SEQ ID NO: 3514479 - RNA, 22 nt, Pseudomonas aeruginosa PA01
agggucgcguuggcgugcucgc

SEQ ID NO: 3514480 - RNA, 19 nt, Pseudomonas aeruginosa PA01
agggucggcccggagaccg

SEQ ID NO: 3514481 - RNA, 13 nt, Pseudomonas aeruginosa PA01
agggucuccagga

SEQ ID NO: 3514482 - RNA, 19 nt, Pseudomonas aeruginosa PA01
agggucuccaggaccaguu

SEQ ID NO: 3514483 - RNA, 13 nt, Pseudomonas aeruginosa PA01
agggucugcucga

SEQ ID NO: 3514484 - RNA, 15 nt, Pseudomonas aeruginosa PA01
agggucuucaggccg

SEQ ID NO: 3514485 - RNA, 16 nt, Pseudomonas aeruginosa PA01
agggucuucaggcgcc

SEQ ID NO: 3514486 - RNA, 21 nt, Pseudomonas aeruginosa PA01
agggucuucaggcgugggcca

SEQ ID NO: 3514487 - RNA, 23 nt, Pseudomonas aeruginosa PA01
agggucuugccgguaucgcgcuu

SEQ ID NO: 3514488 - RNA, 19 nt, Pseudomonas aeruginosa PA01
agggugacgucgaaaccga

SEQ ID NO: 3514489 - RNA, 16 nt, Pseudomonas aeruginosa PA01
agggugcgggcgcggg

SEQ ID NO: 3514490 - RNA, 23 nt, Pseudomonas aeruginosa PA01
agggugcucaggacguccuggcc

SEQ ID NO: 3514491 - RNA, 22 nt, Pseudomonas aeruginosa PA01
agggugcuguguucgaucucgu

SEQ ID NO: 3514492 - RNA, 17 nt, Pseudomonas aeruginosa PA01
aggguggcgaccgccgu

SEQ ID NO: 3514493 - RNA, 19 nt, Pseudomonas aeruginosa PA01
aggguggcgcccaugccgc

SEQ ID NO: 3514494 - RNA, 23 nt, Pseudomonas aeruginosa PA01
aggguggcgcccaugccgcccgg

SEQ ID NO: 3514495 - RNA, 22 nt, Pseudomonas aeruginosa PA01
aggguggcgcgcaccaccuggc

SEQ ID NO: 3514496 - RNA, 15 nt, Pseudomonas aeruginosa PA01
aggguggcgcugccu

SEQ ID NO: 3514497 - RNA, 14 nt, Pseudomonas aeruginosa PA01
aggguggcgcuggc

SEQ ID NO: 3514498 - RNA, 16 nt, Pseudomonas aeruginosa PA01
aggguggcgcuggcca

SEQ ID NO: 3514499 - RNA, 14 nt, Pseudomonas aeruginosa PA01
aggguggcggcggc

SEQ ID NO: 3514500 - RNA, 17 nt, Pseudomonas aeruginosa PA01
aggguggcgggcggccc

SEQ ID NO: 3514501 - RNA, 23 nt, Pseudomonas aeruginosa PA01
aggguggucagccagccgagcaa

SEQ ID NO: 3514502 - RNA, 17 nt, Pseudomonas aeruginosa PA01
aggguggucgcgcucug

SEQ ID NO: 3514503 - RNA, 20 nt, Pseudomonas aeruginosa PA01
aggguggugaaccagaacac

SEQ ID NO: 3514504 - RNA, 18 nt, Pseudomonas aeruginosa PA01
agggugguuuccaggcuc

SEQ ID NO: 3514505 - RNA, 23 nt, Pseudomonas aeruginosa PA01
aggguguacuugacggcgccgau

SEQ ID NO: 3514506 - RNA, 19 nt, Pseudomonas aeruginosa PA01
aggguguagguauccgccg

SEQ ID NO: 3514507 - RNA, 21 nt, Pseudomonas aeruginosa PA01
agggugucggggguucgaauc

SEQ ID NO: 3514508 - RNA, 16 nt, Pseudomonas aeruginosa PA01
aggguguugcgaugga

SEQ ID NO: 3514509 - RNA, 16 nt, Pseudomonas aeruginosa PA01
aggguuccggucggga

SEQ ID NO: 3514510 - RNA, 13 nt, Pseudomonas aeruginosa PA01
aggguucgccgac

SEQ ID NO: 3514511 - RNA, 23 nt, Pseudomonas aeruginosa PA01
aggguucggggaacagcgccagc

SEQ ID NO: 3514512 - RNA, 17 nt, Pseudomonas aeruginosa PA01
aggguuggccgcagcag

SEQ ID NO: 3514513 - RNA, 18 nt, Pseudomonas aeruginosa PA01
aggguuggccgcagcagc

SEQ ID NO: 3514514 - RNA, 19 nt, Pseudomonas aeruginosa PA01
aggguuggccgcagcagcg

SEQ ID NO: 3514515 - RNA, 19 nt, Pseudomonas aeruginosa PA01
aggguuggcggcaucgcgu

SEQ ID NO: 3514516 - RNA, 15 nt, Pseudomonas aeruginosa PA01
aggguuuccagcagc

SEQ ID NO: 3514517 - RNA, 20 nt, Pseudomonas aeruginosa PA01
aggguuucgugaaacgccag

SEQ ID NO: 3514518 - RNA, 22 nt, Pseudomonas aeruginosa PA01
aggguuucucgcuccccugccg

SEQ ID NO: 3514519 - RNA, 13 nt, Pseudomonas aeruginosa PA01
agguaagcggcgu

SEQ ID NO: 3514520 - RNA, 14 nt, Pseudomonas aeruginosa PA01
agguaauaucaccc

SEQ ID NO: 3514521 - RNA, 18 nt, Pseudomonas aeruginosa PA01
agguacaacggcaucggc

SEQ ID NO: 3514522 - RNA, 17 nt, Pseudomonas aeruginosa PA01
agguaccagucuggaag

SEQ ID NO: 3514523 - RNA, 21 nt, Pseudomonas aeruginosa PA01
agguaccggccaggcggucca

SEQ ID NO: 3514524 - RNA, 13 nt, Pseudomonas aeruginosa PA01
agguacggcgccg

SEQ ID NO: 3514525 - RNA, 13 nt, Pseudomonas aeruginosa PA01
agguacugggcga

SEQ ID NO: 3514526 - RNA, 20 nt, Pseudomonas aeruginosa PA01
agguacugggcgauguccug

SEQ ID NO: 3514527 - RNA, 20 nt, Pseudomonas aeruginosa PA01
agguagaagaacaucggcgc

SEQ ID NO: 3514528 - RNA, 19 nt, Pseudomonas aeruginosa PA01
agguagagaugcagcaggu

SEQ ID NO: 3514529 - RNA, 18 nt, Pseudomonas aeruginosa PA01
agguagagcacgccgucg

SEQ ID NO: 3514530 - RNA, 17 nt, Pseudomonas aeruginosa PA01
agguagagcuuggcucg

SEQ ID NO: 3514531 - RNA, 16 nt, Pseudomonas aeruginosa PA01
agguagcagccgucca

SEQ ID NO: 3514532 - RNA, 14 nt, Pseudomonas aeruginosa PA01
agguagccgcgccg

SEQ ID NO: 3514533 - RNA, 16 nt, Pseudomonas aeruginosa PA01
agguagccgcgccggc

SEQ ID NO: 3514534 - RNA, 18 nt, Pseudomonas aeruginosa PA01
agguagccgcgccggccg

SEQ ID NO: 3514535 - RNA, 15 nt, Pseudomonas aeruginosa PA01
agguagccugcggcc

SEQ ID NO: 3514536 - RNA, 21 nt, Pseudomonas aeruginosa PA01
agguagccugcggccagcgcc

SEQ ID NO: 3514537 - RNA, 22 nt, Pseudomonas aeruginosa PA01
agguagccugcggccagcgcca

SEQ ID NO: 3514538 - RNA, 16 nt, Pseudomonas aeruginosa PA01
agguagcgcugcgcca

SEQ ID NO: 3514539 - RNA, 12 nt, Pseudomonas aeruginosa PA01
agguagcggcgu

SEQ ID NO: 3514540 - RNA, 16 nt, Pseudomonas aeruginosa PA01
agguagcugagcaggc

SEQ ID NO: 3514541 - RNA, 19 nt, Pseudomonas aeruginosa PA01
agguagcugagcaggccga

SEQ ID NO: 3514542 - RNA, 17 nt, Pseudomonas aeruginosa PA01
agguagcugcgccgccu

SEQ ID NO: 3514543 - RNA, 13 nt, Pseudomonas aeruginosa PA01
agguuggacaggu

SEQ ID NO: 3514544 - RNA, 15 nt, Pseudomonas aeruginosa PA01
agguuggccccgccg

SEQ ID NO: 3514545 - RNA, 19 nt, Pseudomonas aeruginosa PA01
agguuggccuggcccggcg

SEQ ID NO: 3514546 - RNA, 16 nt, Pseudomonas aeruginosa PA01
agguuggcgccgggcg

SEQ ID NO: 3514547 - RNA, 21 nt, Pseudomonas aeruginosa PA01
agguuggcgccgggcgcgaug

SEQ ID NO: 3514548 - RNA, 19 nt, Pseudomonas aeruginosa PA01
agguuggucugcucggcga

SEQ ID NO: 3514549 - RNA, 19 nt, Pseudomonas aeruginosa PA01
agguugugcucgaucacca

SEQ ID NO: 3514550 - RNA, 15 nt, Pseudomonas aeruginosa PA01
aguaaaugcuugaaa

SEQ ID NO: 3514551 - RNA, 21 nt, Pseudomonas aeruginosa PA01
aguaaaugcuugaaaaucaag

SEQ ID NO: 3514552 - RNA, 15 nt, Pseudomonas aeruginosa PA01
aguaauuuuguggag

SEQ ID NO: 3514553 - RNA, 15 nt, Pseudomonas aeruginosa PA01
aguacagcucggcgc

SEQ ID NO: 3514554 - RNA, 12 nt, Pseudomonas aeruginosa PA01
aguaccagcaau

SEQ ID NO: 3514555 - RNA, 18 nt, Pseudomonas aeruginosa PA01
aguaccagcaaugcccag

SEQ ID NO: 3514556 - RNA, 14 nt, Pseudomonas aeruginosa PA01
aguaccgcugcggc

SEQ ID NO: 3514557 - RNA, 18 nt, Pseudomonas aeruginosa PA01
aguaccgcugcggccggc

SEQ ID NO: 3514558 - RNA, 21 nt, Pseudomonas aeruginosa PA01
aguaccgcugcggccggcgcg

SEQ ID NO: 3514559 - RNA, 16 nt, Pseudomonas aeruginosa PA01
aguaccggcagcgccg

SEQ ID NO: 3514560 - RNA, 22 nt, Pseudomonas aeruginosa PA01
aguaccucgaagcccagcgccu

SEQ ID NO: 3514561 - RNA, 19 nt, Pseudomonas aeruginosa PA01
aguaccugcucacggccga

SEQ ID NO: 3514562 - RNA, 22 nt, Pseudomonas aeruginosa PA01
aguaccuggcgguacagccccc

SEQ ID NO: 3514563 - RNA, 18 nt, Pseudomonas aeruginosa PA01
aguacgaucagccagggc

SEQ ID NO: 3514564 - RNA, 21 nt, Pseudomonas aeruginosa PA01
aguacgaucagccagggcaac

SEQ ID NO: 3514565 - RNA, 14 nt, Pseudomonas aeruginosa PA01
aguacggcgcggug

SEQ ID NO: 3514566 - RNA, 18 nt, Pseudomonas aeruginosa PA01
aguacggcgcggugaggg

SEQ ID NO: 3514567 - RNA, 15 nt, Pseudomonas aeruginosa PA01
aguacuccgagggcc

SEQ ID NO: 3514568 - RNA, 13 nt, Pseudomonas aeruginosa PA01
aguacucuggcca

SEQ ID NO: 3514569 - RNA, 19 nt, Pseudomonas aeruginosa PA01
aguacuugaacagcaggau

SEQ ID NO: 3514570 - RNA, 15 nt, Pseudomonas aeruginosa PA01
aguacuuggccagca

SEQ ID NO: 3514571 - RNA, 15 nt, Pseudomonas aeruginosa PA01
aguagaugcggcugu

SEQ ID NO: 3514572 - RNA, 21 nt, Pseudomonas aeruginosa PA01
aguagccgccgggacccuggu

SEQ ID NO: 3514573 - RNA, 19 nt, Pseudomonas aeruginosa PA01
aguagcgacggaagcccuc

SEQ ID NO: 3514574 - RNA, 14 nt, Pseudomonas aeruginosa PA01
aguagcucgccgag

SEQ ID NO: 3514575 - RNA, 19 nt, Pseudomonas aeruginosa PA01
aguagcuggaucugguuga

SEQ ID NO: 3514576 - RNA, 14 nt, Pseudomonas aeruginosa PA01
aguaggcgcugcaa

SEQ ID NO: 3514577 - RNA, 14 nt, Pseudomonas aeruginosa PA01
aguaggcgcugccg

SEQ ID NO: 3514578 - RNA, 21 nt, Pseudomonas aeruginosa PA01
aguaggggaauuucacgccga

SEQ ID NO: 3514579 - RNA, 17 nt, Pseudomonas aeruginosa PA01
aguaggguucgccgacg

SEQ ID NO: 3514580 - RNA, 13 nt, Pseudomonas aeruginosa PA01
aguagguccaggc

SEQ ID NO: 3514581 - RNA, 16 nt, Pseudomonas aeruginosa PA01
aguagguccaggcguc

SEQ ID NO: 3514582 - RNA, 16 nt, Pseudomonas aeruginosa PA01
aguaggucgguucgcc

SEQ ID NO: 3514583 - RNA, 23 nt, Pseudomonas aeruginosa PA01
aguaggucugguaguaggcgcuc

SEQ ID NO: 3514584 - RNA, 18 nt, Pseudomonas aeruginosa PA01
aguaggucuugucgaaga

SEQ ID NO: 3514585 - RNA, 20 nt, Pseudomonas aeruginosa PA01
aguagguuuucguugggugg

SEQ ID NO: 3514586 - RNA, 22 nt, Pseudomonas aeruginosa PA01
aguagguuuucguuggguggcu

SEQ ID NO: 3514587 - RNA, 20 nt, Pseudomonas aeruginosa PA01
aguaucgcuuagcgccagaa

SEQ ID NO: 3514588 - RNA, 23 nt, Pseudomonas aeruginosa PA01
aguauugcuccacccgcagccgc

SEQ ID NO: 3514589 - RNA, 15 nt, Pseudomonas aeruginosa PA01
agucaacgccuggcc

SEQ ID NO: 3514590 - RNA, 20 nt, Pseudomonas aeruginosa PA01
agucaccaggucgcggauca

SEQ ID NO: 3514591 - RNA, 14 nt, Pseudomonas aeruginosa PA01
agucaggaucggcg

SEQ ID NO: 3514592 - RNA, 16 nt, Pseudomonas aeruginosa PA01
agucaggcgccggccu

SEQ ID NO: 3514593 - RNA, 14 nt, Pseudomonas aeruginosa PA01
agucagguccuugu

SEQ ID NO: 3514594 - RNA, 13 nt, Pseudomonas aeruginosa PA01
agucauaggucac

SEQ ID NO: 3514595 - RNA, 15 nt, Pseudomonas aeruginosa PA01
agucauggccaguca

SEQ ID NO: 3514596 - RNA, 14 nt, Pseudomonas aeruginosa PA01
agucauugcgcugu

SEQ ID NO: 3514597 - RNA, 20 nt, Pseudomonas aeruginosa PA01
aguccaccaggcgccggguc

SEQ ID NO: 3514598 - RNA, 16 nt, Pseudomonas aeruginosa PA01
aguccacugucucgcc

SEQ ID NO: 3514599 - RNA, 15 nt, Pseudomonas aeruginosa PA01
aguccagccagugca

SEQ ID NO: 3514600 - RNA, 23 nt, Pseudomonas aeruginosa PA01
aguccagccagugcaugcgugca

SEQ ID NO: 3514601 - RNA, 12 nt, Pseudomonas aeruginosa PA01
aguccagcgccg

SEQ ID NO: 3514602 - RNA, 20 nt, Pseudomonas aeruginosa PA01
aguccagcgccgcgcugcgu

SEQ ID NO: 3514603 - RNA, 19 nt, Pseudomonas aeruginosa PA01
aguccagcgguaccagcag

SEQ ID NO: 3514604 - RNA, 21 nt, Pseudomonas aeruginosa PA01
aguccagcgguaccagcagcg

SEQ ID NO: 3514605 - RNA, 14 nt, Pseudomonas aeruginosa PA01
aguccaggcgggcc

SEQ ID NO: 3514606 - RNA, 23 nt, Pseudomonas aeruginosa PA01
aguccagggcgguuaccaggucu

SEQ ID NO: 3514607 - RNA, 20 nt, Pseudomonas aeruginosa PA01
aguccaggucgcggagccaa

SEQ ID NO: 3514608 - RNA, 15 nt, Pseudomonas aeruginosa PA01
aguccaucaccgcgg

SEQ ID NO: 3514609 - RNA, 11 nt, Pseudomonas aeruginosa PA01
aguccaugcuc

SEQ ID NO: 3514610 - RNA, 18 nt, Pseudomonas aeruginosa PA01
aguccaugcucaggucga

SEQ ID NO: 3514611 - RNA, 23 nt, Pseudomonas aeruginosa PA01
aguccaugcucaggucgaacugc

SEQ ID NO: 3514612 - RNA, 18 nt, Pseudomonas aeruginosa PA01
agucccagaccacccggc

SEQ ID NO: 3514613 - RNA, 14 nt, Pseudomonas aeruginosa PA01
agucccagcgagug

SEQ ID NO: 3514614 - RNA, 23 nt, Pseudomonas aeruginosa PA01
agucccgcaaagcccgcuccgca

SEQ ID NO: 3514615 - RNA, 13 nt, Pseudomonas aeruginosa PA01
agucccgccaggc

SEQ ID NO: 3514616 - RNA, 14 nt, Pseudomonas aeruginosa PA01
agucccgccaggcg

SEQ ID NO: 3514617 - RNA, 15 nt, Pseudomonas aeruginosa PA01
agucccgcgcggccc

SEQ ID NO: 3514618 - RNA, 16 nt, Pseudomonas aeruginosa PA01
agucccguccgcugcg

SEQ ID NO: 3514619 - RNA, 17 nt, Pseudomonas aeruginosa PA01
agucccuggccggcgau

SEQ ID NO: 3514620 - RNA, 12 nt, Pseudomonas aeruginosa PA01
aguccgccagcc

SEQ ID NO: 3514621 - RNA, 14 nt, Pseudomonas aeruginosa PA01
aguccgccagccgg

SEQ ID NO: 3514622 - RNA, 15 nt, Pseudomonas aeruginosa PA01
aguccgccagccggc

SEQ ID NO: 3514623 - RNA, 16 nt, Pseudomonas aeruginosa PA01
aguccgccagccggcu

SEQ ID NO: 3514624 - RNA, 22 nt, Pseudomonas aeruginosa PA01
aguccgcgcgcgcgcuccucga

SEQ ID NO: 3514625 - RNA, 18 nt, Pseudomonas aeruginosa PA01
aguccgcugcgagcaggu

SEQ ID NO: 3514626 - RNA, 16 nt, Pseudomonas aeruginosa PA01
aguccggcagcacggc

SEQ ID NO: 3514627 - RNA, 22 nt, Pseudomonas aeruginosa PA01
aguccggguugacccagagccg

SEQ ID NO: 3514628 - RNA, 19 nt, Pseudomonas aeruginosa PA01
aguccggguugagcacccc

SEQ ID NO: 3514629 - RNA, 14 nt, Pseudomonas aeruginosa PA01
aguccugcaacagg

SEQ ID NO: 3514630 - RNA, 14 nt, Pseudomonas aeruginosa PA01
aguccugcaggauc

SEQ ID NO: 3514631 - RNA, 16 nt, Pseudomonas aeruginosa PA01
aguccugcaggaucga

SEQ ID NO: 3514632 - RNA, 12 nt, Pseudomonas aeruginosa PA01
aguccugcugcg

SEQ ID NO: 3514633 - RNA, 15 nt, Pseudomonas aeruginosa PA01
aguccugcugcgaca

SEQ ID NO: 3514634 - RNA, 22 nt, Pseudomonas aeruginosa PA01
aguccugcugcgacaguucgcg

SEQ ID NO: 3514635 - RNA, 16 nt, Pseudomonas aeruginosa PA01
aguccuggccgagcau

SEQ ID NO: 3514636 - RNA, 17 nt, Pseudomonas aeruginosa PA01
aguccuggcgguagccc

SEQ ID NO: 3514637 - RNA, 21 nt, Pseudomonas aeruginosa PA01
aguccuggcgguagcccggca

SEQ ID NO: 3514638 - RNA, 15 nt, Pseudomonas aeruginosa PA01
agucgaacaggcccu

SEQ ID NO: 3514639 - RNA, 14 nt, Pseudomonas aeruginosa PA01
agucgaagcagccc

SEQ ID NO: 3514640 - RNA, 16 nt, Pseudomonas aeruginosa PA01
agucgaagcagcccag

SEQ ID NO: 3514641 - RNA, 23 nt, Pseudomonas aeruginosa PA01
agucgaaguacaccuuggcgcga

SEQ ID NO: 3514642 - RNA, 17 nt, Pseudomonas aeruginosa PA01
agucgacccaggcccag

SEQ ID NO: 3514643 - RNA, 21 nt, Pseudomonas aeruginosa PA01
agucgaccggaaucacgucga

SEQ ID NO: 3514644 - RNA, 16 nt, Pseudomonas aeruginosa PA01
agucgaccgucgccac

SEQ ID NO: 3514645 - RNA, 13 nt, Pseudomonas aeruginosa PA01
agucgacgccggu

SEQ ID NO: 3514646 - RNA, 21 nt, Pseudomonas aeruginosa PA01
agugcuggguggaggcccaga

SEQ ID NO: 3514647 - RNA, 13 nt, Pseudomonas aeruginosa PA01
agugcuugagcgg

SEQ ID NO: 3514648 - RNA, 14 nt, Pseudomonas aeruginosa PA01
aguggaucggcccu

SEQ ID NO: 3514649 - RNA, 16 nt, Pseudomonas aeruginosa PA01
aguggaucggcccuuc

SEQ ID NO: 3514650 - RNA, 14 nt, Pseudomonas aeruginosa PA01
aguggaugugcugg

SEQ ID NO: 3514651 - RNA, 19 nt, Pseudomonas aeruginosa PA01
aguggcagcgccguugccg

SEQ ID NO: 3514652 - RNA, 22 nt, Pseudomonas aeruginosa PA01
aguggccgaaggcgcuccccug

SEQ ID NO: 3514653 - RNA, 19 nt, Pseudomonas aeruginosa PA01
aguggccggugugcgacug

SEQ ID NO: 3514654 - RNA, 23 nt, Pseudomonas aeruginosa PA01
aguggcgcagcgcccgauaggcg

SEQ ID NO: 3514655 - RNA, 13 nt, Pseudomonas aeruginosa PA01
aguggcgccgcca

SEQ ID NO: 3514656 - RNA, 14 nt, Pseudomonas aeruginosa PA01
aguggcgccgccau

SEQ ID NO: 3514657 - RNA, 23 nt, Pseudomonas aeruginosa PA01
aguggcuugugcgaauguccggc

SEQ ID NO: 3514658 - RNA, 18 nt, Pseudomonas aeruginosa PA01
agugguauuggucgcgau

SEQ ID NO: 3514659 - RNA, 19 nt, Pseudomonas aeruginosa PA01
aguggucgcagcuccagcg

SEQ ID NO: 3514660 - RNA, 17 nt, Pseudomonas aeruginosa PA01
aguggugaugcguugca

SEQ ID NO: 3514661 - RNA, 17 nt, Pseudomonas aeruginosa PA01
agugguuccaggagggc

SEQ ID NO: 3514662 - RNA, 19 nt, Pseudomonas aeruginosa PA01
agugguuccaggagggcug

SEQ ID NO: 3514663 - RNA, 21 nt, Pseudomonas aeruginosa PA01
agugguuccaggagggcugcu

SEQ ID NO: 3514664 - RNA, 16 nt, Pseudomonas aeruginosa PA01
agugguugcgcacgcu

SEQ ID NO: 3514665 - RNA, 16 nt, Pseudomonas aeruginosa PA01
aguguccgagccguug

SEQ ID NO: 3514666 - RNA, 13 nt, Pseudomonas aeruginosa PA01
aguguggcggcgu

SEQ ID NO: 3514667 - RNA, 17 nt, Pseudomonas aeruginosa PA01
aguguuugcgcagggcg

SEQ ID NO: 3514668 - RNA, 23 nt, Pseudomonas aeruginosa PA01
aguuacgcgcagcgguaguucag

SEQ ID NO: 3514669 - RNA, 20 nt, Pseudomonas aeruginosa PA01
aguuacuuaaauucaccgag

SEQ ID NO: 3514670 - RNA, 13 nt, Pseudomonas aeruginosa PA01
aguuaucacaacc

SEQ ID NO: 3514671 - RNA, 20 nt, Pseudomonas aeruginosa PA01
aguuaucggggccaggucgg

SEQ ID NO: 3514672 - RNA, 18 nt, Pseudomonas aeruginosa PA01
aguucacauuggcuuccg

SEQ ID NO: 3514673 - RNA, 17 nt, Pseudomonas aeruginosa PA01
aguucaccguccacugg

SEQ ID NO: 3514674 - RNA, 19 nt, Pseudomonas aeruginosa PA01
aguucacguaggagccggc

SEQ ID NO: 3514675 - RNA, 14 nt, Pseudomonas aeruginosa PA01
aguucagcgcgcuc

SEQ ID NO: 3514676 - RNA, 14 nt, Pseudomonas aeruginosa PA01
aguucagggccacg

SEQ ID NO: 3514677 - RNA, 19 nt, Pseudomonas aeruginosa PA01
aguucaguagcggcagggu

SEQ ID NO: 3514678 - RNA, 19 nt, Pseudomonas aeruginosa PA01
aguucaucgagcagguagc

SEQ ID NO: 3514679 - RNA, 15 nt, Pseudomonas aeruginosa PA01
aguuccacgaagaac

SEQ ID NO: 3514680 - RNA, 16 nt, Pseudomonas aeruginosa PA01
aguuccaugucgcugg

SEQ ID NO: 3514681 - RNA, 23 nt, Pseudomonas aeruginosa PA01
aguucccgccgcucugcuggccg

SEQ ID NO: 3514682 - RNA, 18 nt, Pseudomonas aeruginosa PA01
aguuccgcaucggccacc

SEQ ID NO: 3514683 - RNA, 21 nt, Pseudomonas aeruginosa PA01
aguuccgcaucggccaccuuc

SEQ ID NO: 3514684 - RNA, 16 nt, Pseudomonas aeruginosa PA01
aguuccgccagaugcg

SEQ ID NO: 3514685 - RNA, 12 nt, Pseudomonas aeruginosa PA01
aguuccgcgcaa

SEQ ID NO: 3514686 - RNA, 20 nt, Pseudomonas aeruginosa PA01
aguuccucgcggaagcguug

SEQ ID NO: 3514687 - RNA, 23 nt, Pseudomonas aeruginosa PA01
aguuccuucuugacccgcugcac

SEQ ID NO: 3514688 - RNA, 14 nt, Pseudomonas aeruginosa PA01
aguucgaaccgugg

SEQ ID NO: 3514689 - RNA, 16 nt, Pseudomonas aeruginosa PA01
aguucgaaccguggcg

SEQ ID NO: 3514690 - RNA, 20 nt, Pseudomonas aeruginosa PA01
aguucgaaccguggcggccg

SEQ ID NO: 3514691 - RNA, 18 nt, Pseudomonas aeruginosa PA01
aguucgaagcgccaggcg

SEQ ID NO: 3514692 - RNA, 22 nt, Pseudomonas aeruginosa PA01
aguucgaagcgccaggcgugca

SEQ ID NO: 3514693 - RNA, 19 nt, Pseudomonas aeruginosa PA01
aguucgaccuccaggccga

SEQ ID NO: 3514694 - RNA, 20 nt, Pseudomonas aeruginosa PA01
aguucgaccuccaggccgaa

SEQ ID NO: 3514695 - RNA, 20 nt, Pseudomonas aeruginosa PA01
aguucgcauaggcggccagc

SEQ ID NO: 3514696 - RNA, 23 nt, Pseudomonas aeruginosa PA01
aguucgccaaaaaaagccccggc

SEQ ID NO: 3514697 - RNA, 16 nt, Pseudomonas aeruginosa PA01
aguucgcccagcucgc

SEQ ID NO: 3514698 - RNA, 14 nt, Pseudomonas aeruginosa PA01
aguucgccgccgag

SEQ ID NO: 3514699 - RNA, 17 nt, Pseudomonas aeruginosa PA01
aguucgcgcaggcgcug

SEQ ID NO: 3514700 - RNA, 16 nt, Pseudomonas aeruginosa PA01
aguucgcgcggagugc

SEQ ID NO: 3514701 - RNA, 16 nt, Pseudomonas aeruginosa PA01
aguucgcgggccgcgg

SEQ ID NO: 3514702 - RNA, 14 nt, Pseudomonas aeruginosa PA01
aguucgcugccgcc

SEQ ID NO: 3514703 - RNA, 16 nt, Pseudomonas aeruginosa PA01
aguucgcugccgccgc

SEQ ID NO: 3514704 - RNA, 14 nt, Pseudomonas aeruginosa PA01
aguucggccagcgg

SEQ ID NO: 3514705 - RNA, 17 nt, Pseudomonas aeruginosa PA01
aguucggccagcggcag

SEQ ID NO: 3514706 - RNA, 17 nt, Pseudomonas aeruginosa PA01
aguucggccaucagcac

SEQ ID NO: 3514707 - RNA, 14 nt, Pseudomonas aeruginosa PA01
aguucggcccagca

SEQ ID NO: 3514708 - RNA, 16 nt, Pseudomonas aeruginosa PA01
aguucggccgcggcug

SEQ ID NO: 3514709 - RNA, 17 nt, Pseudomonas aeruginosa PA01
aguucggccgcggcugg

SEQ ID NO: 3514710 - RNA, 14 nt, Pseudomonas aeruginosa PA01
aguucggcgaugac

SEQ ID NO: 3514711 - RNA, 23 nt, Pseudomonas aeruginosa PA01
aguucggcgaugaccagcucggc

SEQ ID NO: 3514712 - RNA, 24 nt, Pseudomonas aeruginosa PA01
aguucggcgaugaccagcucggcg

SEQ ID NO: 3514713 - RNA, 19 nt, Pseudomonas aeruginosa PA01
aguucggcguuguccaggc

SEQ ID NO: 3514714 - RNA, 15 nt, Pseudomonas aeruginosa PA01
aguucggugccgccg

SEQ ID NO: 3514715 - RNA, 16 nt, Pseudomonas aeruginosa PA01
aguucggugccgccgg

SEQ ID NO: 3514716 - RNA, 17 nt, Pseudomonas aeruginosa PA01
aguucggugccgccggc

SEQ ID NO: 3514717 - RNA, 21 nt, Pseudomonas aeruginosa PA01
aguucgucgaugaugccgucu

SEQ ID NO: 3514718 - RNA, 22 nt, Pseudomonas aeruginosa PA01
aguucguugggccggaacggcu

SEQ ID NO: 3514719 - RNA, 14 nt, Pseudomonas aeruginosa PA01
aguucuccagcaag

SEQ ID NO: 3514720 - RNA, 15 nt, Pseudomonas aeruginosa PA01
aguucuccagcaagc

SEQ ID NO: 3514721 - RNA, 14 nt, Pseudomonas aeruginosa PA01
aguucucgcagcag

SEQ ID NO: 3514722 - RNA, 14 nt, Pseudomonas aeruginosa PA01
aguucugggcggcc

SEQ ID NO: 3514723 - RNA, 21 nt, Pseudomonas aeruginosa PA01
aguucugggcggccagguuga

SEQ ID NO: 3514724 - RNA, 14 nt, Pseudomonas aeruginosa PA01
aguucuucagcagc

SEQ ID NO: 3514725 - RNA, 16 nt, Pseudomonas aeruginosa PA01
aguucuugcgcauuuu

SEQ ID NO: 3514726 - RNA, 17 nt, Pseudomonas aeruginosa PA01
aguugacccgccccugc

SEQ ID NO: 3514727 - RNA, 18 nt, Pseudomonas aeruginosa PA01
aguugacccgccccugcu

SEQ ID NO: 3514728 - RNA, 14 nt, Pseudomonas aeruginosa PA01
aguugacgucgccg

SEQ ID NO: 3514729 - RNA, 16 nt, Pseudomonas aeruginosa PA01
aguugacgucgccgau

SEQ ID NO: 3514730 - RNA, 19 nt, Pseudomonas aeruginosa PA01
aguugagccccagguaggc

SEQ ID NO: 3514731 - RNA, 15 nt, Pseudomonas aeruginosa PA01
aguugauggucaggc

SEQ ID NO: 3514732 - RNA, 14 nt, Pseudomonas aeruginosa PA01
aguugcaacagcgc

SEQ ID NO: 3514733 - RNA, 16 nt, Pseudomonas aeruginosa PA01
aguugcaacagcgcgg

SEQ ID NO: 3514734 - RNA, 13 nt, Pseudomonas aeruginosa PA01
aguugcagcaccc

SEQ ID NO: 3514735 - RNA, 14 nt, Pseudomonas aeruginosa PA01
aguugcaggccggc

SEQ ID NO: 3514736 - RNA, 22 nt, Pseudomonas aeruginosa PA01
aguugcagggauuccgggucga

SEQ ID NO: 3514737 - RNA, 14 nt, Pseudomonas aeruginosa PA01
aguugcccggccug

SEQ ID NO: 3514738 - RNA, 13 nt, Pseudomonas aeruginosa PA01
aguugccgagcuu

SEQ ID NO: 3514739 - RNA, 23 nt, Pseudomonas aeruginosa PA01
aguugccgagcuugaccuugccg

SEQ ID NO: 3514740 - RNA, 16 nt, Pseudomonas aeruginosa PA01
aguugccgcagcagcg

SEQ ID NO: 3514741 - RNA, 18 nt, Pseudomonas aeruginosa PA01
aguugccgcagcagcggc

SEQ ID NO: 3514742 - RNA, 17 nt, Pseudomonas aeruginosa PA01
aguugccgccagcgcgg

SEQ ID NO: 3514743 - RNA, 18 nt, Pseudomonas aeruginosa PA01
aguugccgccagcgcggc

SEQ ID NO: 3514744 - RNA, 13 nt, Pseudomonas aeruginosa PA01
aguugccgccgcu

SEQ ID NO: 3514745 - RNA, 14 nt, Pseudomonas aeruginosa PA01
aguugccuggcagg

SEQ ID NO: 3514746 - RNA, 23 nt, Pseudomonas aeruginosa PA01
aguugcgauagaccaggaaggcc

SEQ ID NO: 3514747 - RNA, 15 nt, Pseudomonas aeruginosa PA01
aguugcgccgccugc

SEQ ID NO: 3514748 - RNA, 21 nt, Pseudomonas aeruginosa PA01
aguugcugaucaggccgagga

SEQ ID NO: 3514749 - RNA, 13 nt, Pseudomonas aeruginosa PA01
aucaacgccgguc

SEQ ID NO: 3514750 - RNA, 18 nt, Pseudomonas aeruginosa PA01
aucaacgcggccagcagc

SEQ ID NO: 3514751 - RNA, 19 nt, Pseudomonas aeruginosa PA01
aucaacgcggccagcagca

SEQ ID NO: 3514752 - RNA, 22 nt, Pseudomonas aeruginosa PA01
aucaaggauuuacggauucucu

SEQ ID NO: 3514753 - RNA, 14 nt, Pseudomonas aeruginosa PA01
aucaaucgcuggcg

SEQ ID NO: 3514754 - RNA, 22 nt, Pseudomonas aeruginosa PA01
aucaauugccgguagccggcga

SEQ ID NO: 3514755 - RNA, 13 nt, Pseudomonas aeruginosa PA01
aucacaacggaag

SEQ ID NO: 3514756 - RNA, 20 nt, Pseudomonas aeruginosa PA01
aucacaacggaagauggcua

SEQ ID NO: 3514757 - RNA, 21 nt, Pseudomonas aeruginosa PA01
aucacaacggaagauggcuaa

SEQ ID NO: 3514758 - RNA, 20 nt, Pseudomonas aeruginosa PA01
aucacaccgaagucgcccgc

SEQ ID NO: 3514759 - RNA, 15 nt, Pseudomonas aeruginosa PA01
aucacaucgcccggc

SEQ ID NO: 3514760 - RNA, 22 nt, Pseudomonas aeruginosa PA01
aucaccaccaccgucuggcgca

SEQ ID NO: 3514761 - RNA, 13 nt, Pseudomonas aeruginosa PA01
aucaccaccagca

SEQ ID NO: 3514762 - RNA, 15 nt, Pseudomonas aeruginosa PA01
aucaccaccagcauc

SEQ ID NO: 3514763 - RNA, 16 nt, Pseudomonas aeruginosa PA01
aucaccaccagcgccg

SEQ ID NO: 3514764 - RNA, 17 nt, Pseudomonas aeruginosa PA01
aucaccaccggcuggcg

SEQ ID NO: 3514765 - RNA, 16 nt, Pseudomonas aeruginosa PA01
aucaccaccuggaugg

SEQ ID NO: 3514766 - RNA, 17 nt, Pseudomonas aeruginosa PA01
aucaccaccuggauggu

SEQ ID NO: 3514767 - RNA, 20 nt, Pseudomonas aeruginosa PA01
aucaccacguaaucgccauu

SEQ ID NO: 3514768 - RNA, 16 nt, Pseudomonas aeruginosa PA01
aucaccagaccgucau

SEQ ID NO: 3514769 - RNA, 14 nt, Pseudomonas aeruginosa PA01
aucaccagccacug

SEQ ID NO: 3514770 - RNA, 19 nt, Pseudomonas aeruginosa PA01
aucaccagccacugcuugg

SEQ ID NO: 3514771 - RNA, 16 nt, Pseudomonas aeruginosa PA01
aucaccagcgccaggc

SEQ ID NO: 3514772 - RNA, 19 nt, Pseudomonas aeruginosa PA01
aucaccagcgccaggccgc

SEQ ID NO: 3514773 - RNA, 21 nt, Pseudomonas aeruginosa PA01
aucaccagcggcgagcaggcg

SEQ ID NO: 3514774 - RNA, 20 nt, Pseudomonas aeruginosa PA01
aucaccaggacccagaugau

SEQ ID NO: 3514775 - RNA, 13 nt, Pseudomonas aeruginosa PA01
aucaccaggucgc

SEQ ID NO: 3514776 - RNA, 18 nt, Pseudomonas aeruginosa PA01
aucaccgacagucccagg

SEQ ID NO: 3514777 - RNA, 15 nt, Pseudomonas aeruginosa PA01
aucaccgccaccuug

SEQ ID NO: 3514778 - RNA, 12 nt, Pseudomonas aeruginosa PA01
aucaccgccuug

SEQ ID NO: 3514779 - RNA, 13 nt, Pseudomonas aeruginosa PA01
aucaccgcggcgc

SEQ ID NO: 3514780 - RNA, 13 nt, Pseudomonas aeruginosa PA01
aucaccgcggugc

SEQ ID NO: 3514781 - RNA, 20 nt, Pseudomonas aeruginosa PA01
aucaccgcgguggaggcggc

SEQ ID NO: 3514782 - RNA, 22 nt, Pseudomonas aeruginosa PA01
aucaccgcgguggaggcggcgg

SEQ ID NO: 3514783 - RNA, 13 nt, Pseudomonas aeruginosa PA01
aucaccgcggugu

SEQ ID NO: 3514784 - RNA, 20 nt, Pseudomonas aeruginosa PA01
aucaccgcguccauccccgc

SEQ ID NO: 3514785 - RNA, 22 nt, Pseudomonas aeruginosa PA01
aucaccggaucgaugcccggcu

SEQ ID NO: 3514786 - RNA, 16 nt, Pseudomonas aeruginosa PA01
aucaccggcagcagcg

SEQ ID NO: 3514787 - RNA, 17 nt, Pseudomonas aeruginosa PA01
aucaccggcagcagcgg

SEQ ID NO: 3514788 - RNA, 12 nt, Pseudomonas aeruginosa PA01
aucaccggcugg

SEQ ID NO: 3514789 - RNA, 20 nt, Pseudomonas aeruginosa PA01
aucaccggcuggcccuccau

SEQ ID NO: 3514790 - RNA, 21 nt, Pseudomonas aeruginosa PA01
aucaccuccuguucgcgcgcc

SEQ ID NO: 3514791 - RNA, 22 nt, Pseudomonas aeruginosa PA01
aucaccucgaaccccuggcgcu

SEQ ID NO: 3514792 - RNA, 19 nt, Pseudomonas aeruginosa PA01
aucaccuggaucgccaggc

SEQ ID NO: 3514793 - RNA, 13 nt, Pseudomonas aeruginosa PA01
aucaccuggccgg

SEQ ID NO: 3514794 - RNA, 15 nt, Pseudomonas aeruginosa PA01
aucaccuggccggug

SEQ ID NO: 3514795 - RNA, 20 nt, Pseudomonas aeruginosa PA01
aucaccuuaguuaucacaac

SEQ ID NO: 3514796 - RNA, 13 nt, Pseudomonas aeruginosa PA01
aucaccuuccucg

SEQ ID NO: 3514797 - RNA, 15 nt, Pseudomonas aeruginosa PA01
aucaccuucgccagc

SEQ ID NO: 3514798 - RNA, 20 nt, Pseudomonas aeruginosa PA01
aucaccuugccaucaucgga

SEQ ID NO: 3514799 - RNA, 19 nt, Pseudomonas aeruginosa PA01
aucaccuugucgcaccagc

SEQ ID NO: 3514800 - RNA, 18 nt, Pseudomonas aeruginosa PA01
aucacgaacagcuugccg

SEQ ID NO: 3514801 - RNA, 21 nt, Pseudomonas aeruginosa PA01
aucacgaagcggucgccggcg

SEQ ID NO: 3514802 - RNA, 15 nt, Pseudomonas aeruginosa PA01
aucacgauggccggc

SEQ ID NO: 3514803 - RNA, 22 nt, Pseudomonas aeruginosa PA01
aucacgauggccggcagcagcg

SEQ ID NO: 3514804 - RNA, 14 nt, Pseudomonas aeruginosa PA01
aucacgcagcaggc

SEQ ID NO: 3514805 - RNA, 12 nt, Pseudomonas aeruginosa PA01
aucacgccccuc

SEQ ID NO: 3514806 - RNA, 14 nt, Pseudomonas aeruginosa PA01
aucacggcgccccg

SEQ ID NO: 3514807 - RNA, 23 nt, Pseudomonas aeruginosa PA01
aucacggugguaccgugcuucau

SEQ ID NO: 3514808 - RNA, 17 nt, Pseudomonas aeruginosa PA01
aucacguacggcgccuc

SEQ ID NO: 3514809 - RNA, 19 nt, Pseudomonas aeruginosa PA01
aucacguacggcgccucga

SEQ ID NO: 3514810 - RNA, 21 nt, Pseudomonas aeruginosa PA01
aucacgucgcgcaccuggcgg

SEQ ID NO: 3514811 - RNA, 20 nt, Pseudomonas aeruginosa PA01
aucacguugaacacaucgac

SEQ ID NO: 3514812 - RNA, 12 nt, Pseudomonas aeruginosa PA01
aucacucccugc

SEQ ID NO: 3514813 - RNA, 16 nt, Pseudomonas aeruginosa PA01
aucacucgccgccguc

SEQ ID NO: 3514814 - RNA, 13 nt, Pseudomonas aeruginosa PA01
aucagaacgaugc

SEQ ID NO: 3514815 - RNA, 17 nt, Pseudomonas aeruginosa PA01
aucagcaauuccgcagc

SEQ ID NO: 3514816 - RNA, 14 nt, Pseudomonas aeruginosa PA01
aucagcacccgguc

SEQ ID NO: 3514817 - RNA, 17 nt, Pseudomonas aeruginosa PA01
aucagcacccggucggc

SEQ ID NO: 3514818 - RNA, 13 nt, Pseudomonas aeruginosa PA01
aucagcaccgcca

SEQ ID NO: 3514819 - RNA, 18 nt, Pseudomonas aeruginosa PA01
aucagcaccgccaccagc

SEQ ID NO: 3514820 - RNA, 21 nt, Pseudomonas aeruginosa PA01
aucagcacgaaagccaugccc

SEQ ID NO: 3514821 - RNA, 15 nt, Pseudomonas aeruginosa PA01
aucagcagcagcgcc

SEQ ID NO: 3514822 - RNA, 16 nt, Pseudomonas aeruginosa PA01
aucagcagcagcgcca

SEQ ID NO: 3514823 - RNA, 22 nt, Pseudomonas aeruginosa PA01
aucagcagcagcgccaugcugu

SEQ ID NO: 3514824 - RNA, 19 nt, Pseudomonas aeruginosa PA01
aucagcaggaagcugacga

SEQ ID NO: 3514825 - RNA, 19 nt, Pseudomonas aeruginosa PA01
aucagcaggaugcagucgg

SEQ ID NO: 3514826 - RNA, 15 nt, Pseudomonas aeruginosa PA01
aucagcaguccgcca

SEQ ID NO: 3514827 - RNA, 12 nt, Pseudomonas aeruginosa PA01
aucagccagccc

SEQ ID NO: 3514828 - RNA, 19 nt, Pseudomonas aeruginosa PA01
aucagccccucggccagga

SEQ ID NO: 3514829 - RNA, 21 nt, Pseudomonas aeruginosa PA01
aucagcccgucggccucgccg

SEQ ID NO: 3514830 - RNA, 19 nt, Pseudomonas aeruginosa PA01
aucagcccuucgcgcucga

SEQ ID NO: 3514831 - RNA, 21 nt, Pseudomonas aeruginosa PA01
aucagcccuucgcgcucgacg

SEQ ID NO: 3514832 - RNA, 14 nt, Pseudomonas aeruginosa PA01
aucagccgcaggca

SEQ ID NO: 3514833 - RNA, 15 nt, Pseudomonas aeruginosa PA01
aucagccgcaggcag

SEQ ID NO: 3514834 - RNA, 16 nt, Pseudomonas aeruginosa PA01
aucagccgcaggcaga

SEQ ID NO: 3514835 - RNA, 21 nt, Pseudomonas aeruginosa PA01
aucagccgcgacgacugcggc

SEQ ID NO: 3514836 - RNA, 17 nt, Pseudomonas aeruginosa PA01
aucagccgcgcgcugga

SEQ ID NO: 3514837 - RNA, 18 nt, Pseudomonas aeruginosa PA01
aucagccgcuccaggauc

SEQ ID NO: 3514838 - RNA, 22 nt, Pseudomonas aeruginosa PA01
aucagccggcccauccgccgca

SEQ ID NO: 3514839 - RNA, 20 nt, Pseudomonas aeruginosa PA01
aucagcgaaauggucaccau

SEQ ID NO: 3514840 - RNA, 19 nt, Pseudomonas aeruginosa PA01
aucagcgagcuucgccgcg

SEQ ID NO: 3514841 - RNA, 15 nt, Pseudomonas aeruginosa PA01
aucagcgccagggca

SEQ ID NO: 3514842 - RNA, 14 nt, Pseudomonas aeruginosa PA01
aucagcgccgccuc

SEQ ID NO: 3514843 - RNA, 12 nt, Pseudomonas aeruginosa PA01
aucagcgccggg

SEQ ID NO: 3514844 - RNA, 22 nt, Pseudomonas aeruginosa PA01
aucagcgcgcguuccaggucgc

SEQ ID NO: 3514845 - RNA, 19 nt, Pseudomonas aeruginosa PA01
aucagcgcggugagcaggg

SEQ ID NO: 3514846 - RNA, 18 nt, Pseudomonas aeruginosa PA01
aucagcgcuccagaugcu

SEQ ID NO: 3514847 - RNA, 12 nt, Pseudomonas aeruginosa PA01
aucagcggcggg

SEQ ID NO: 3514848 - RNA, 18 nt, Pseudomonas aeruginosa PA01
aucagcgggccuuuucuu

SEQ ID NO: 3514849 - RNA, 22 nt, Pseudomonas aeruginosa PA01
aucagcgucugcagcuugcgcg

SEQ ID NO: 3514850 - RNA, 17 nt, Pseudomonas aeruginosa PA01
aucagcuccacgucggc

SEQ ID NO: 3514851 - RNA, 17 nt, Pseudomonas aeruginosa PA01
aucagcucgaucagccc

SEQ ID NO: 3514852 - RNA, 21 nt, Pseudomonas aeruginosa PA01
aucccggcgguuucgccgagg

SEQ ID NO: 3514853 - RNA, 23 nt, Pseudomonas aeruginosa PA01
aucccggcugagcgccaggcgca

SEQ ID NO: 3514854 - RNA, 21 nt, Pseudomonas aeruginosa PA01
aucccgggguugcccagcagg

SEQ ID NO: 3514855 - RNA, 23 nt, Pseudomonas aeruginosa PA01
aucccgggguugcccagcaggcu

SEQ ID NO: 3514856 - RNA, 18 nt, Pseudomonas aeruginosa PA01
aucccgguuuccgcagcg

SEQ ID NO: 3514857 - RNA, 17 nt, Pseudomonas aeruginosa PA01
aucccguagaccggcuc

SEQ ID NO: 3514858 - RNA, 14 nt, Pseudomonas aeruginosa PA01
aucccgugccgggc

SEQ ID NO: 3514859 - RNA, 21 nt, Pseudomonas aeruginosa PA01
aucccugcuucgaccagggca

SEQ ID NO: 3514860 - RNA, 22 nt, Pseudomonas aeruginosa PA01
aucccugcuucgaccagggcau

SEQ ID NO: 3514861 - RNA, 18 nt, Pseudomonas aeruginosa PA01
aucccugugcgguaacga

SEQ ID NO: 3514862 - RNA, 22 nt, Pseudomonas aeruginosa PA01
aucccuucguccucguggcgcg

SEQ ID NO: 3514863 - RNA, 17 nt, Pseudomonas aeruginosa PA01
aucccuucgugcuggcg

SEQ ID NO: 3514864 - RNA, 18 nt, Pseudomonas aeruginosa PA01
aucccuucgugcuggcgg

SEQ ID NO: 3514865 - RNA, 19 nt, Pseudomonas aeruginosa PA01
auccgaccuggggcggccu

SEQ ID NO: 3514866 - RNA, 19 nt, Pseudomonas aeruginosa PA01
auccgcaccauccgccgca

SEQ ID NO: 3514867 - RNA, 13 nt, Pseudomonas aeruginosa PA01
auccgccagggag

SEQ ID NO: 3514868 - RNA, 18 nt, Pseudomonas aeruginosa PA01
auccgcccgaucgccucg

SEQ ID NO: 3514869 - RNA, 20 nt, Pseudomonas aeruginosa PA01
auccgcccgaucgccucguc

SEQ ID NO: 3514870 - RNA, 22 nt, Pseudomonas aeruginosa PA01
auccgcccugcgucgcagagac

SEQ ID NO: 3514871 - RNA, 20 nt, Pseudomonas aeruginosa PA01
auccgccgauacagcgcgcg

SEQ ID NO: 3514872 - RNA, 21 nt, Pseudomonas aeruginosa PA01
auccgccgauugugcagggcc

SEQ ID NO: 3514873 - RNA, 12 nt, Pseudomonas aeruginosa PA01
auccgccgcaga

SEQ ID NO: 3514874 - RNA, 14 nt, Pseudomonas aeruginosa PA01
auccgccgcagacc

SEQ ID NO: 3514875 - RNA, 17 nt, Pseudomonas aeruginosa PA01
auccgccgcagaccagc

SEQ ID NO: 3514876 - RNA, 13 nt, Pseudomonas aeruginosa PA01
auccgccgcagga

SEQ ID NO: 3514877 - RNA, 14 nt, Pseudomonas aeruginosa PA01
auccgccgcaggaa

SEQ ID NO: 3514878 - RNA, 21 nt, Pseudomonas aeruginosa PA01
auccgccgcaggaaggcgaag

SEQ ID NO: 3514879 - RNA, 13 nt, Pseudomonas aeruginosa PA01
auccgccgccgac

SEQ ID NO: 3514880 - RNA, 12 nt, Pseudomonas aeruginosa PA01
auccgccgccgg

SEQ ID NO: 3514881 - RNA, 16 nt, Pseudomonas aeruginosa PA01
auccgccgccgggcuu

SEQ ID NO: 3514882 - RNA, 21 nt, Pseudomonas aeruginosa PA01
auccgccgccgggcuucggug

SEQ ID NO: 3514883 - RNA, 12 nt, Pseudomonas aeruginosa PA01
auccgccgccua

SEQ ID NO: 3514884 - RNA, 12 nt, Pseudomonas aeruginosa PA01
auccgccgcgca

SEQ ID NO: 3514885 - RNA, 21 nt, Pseudomonas aeruginosa PA01
auccgccgcuacugcgcgggc

SEQ ID NO: 3514886 - RNA, 16 nt, Pseudomonas aeruginosa PA01
auccgccgcucccggc

SEQ ID NO: 3514887 - RNA, 18 nt, Pseudomonas aeruginosa PA01
auccgccgcugugcaggg

SEQ ID NO: 3514888 - RNA, 19 nt, Pseudomonas aeruginosa PA01
auccgccgcugugcagggu

SEQ ID NO: 3514889 - RNA, 12 nt, Pseudomonas aeruginosa PA01
auccgccggccg

SEQ ID NO: 3514890 - RNA, 22 nt, Pseudomonas aeruginosa PA01
auccgccggccggggcgcgccc

SEQ ID NO: 3514891 - RNA, 13 nt, Pseudomonas aeruginosa PA01
auccgccggcgcg

SEQ ID NO: 3514892 - RNA, 19 nt, Pseudomonas aeruginosa PA01
auccgccggcugugcaggg

SEQ ID NO: 3514893 - RNA, 12 nt, Pseudomonas aeruginosa PA01
auccgccgggcc

SEQ ID NO: 3514894 - RNA, 17 nt, Pseudomonas aeruginosa PA01
auccgccgggccgccuu

SEQ ID NO: 3514895 - RNA, 12 nt, Pseudomonas aeruginosa PA01
auccgccgucgg

SEQ ID NO: 3514896 - RNA, 19 nt, Pseudomonas aeruginosa PA01
auccgccgugaggcgcgcg

SEQ ID NO: 3514897 - RNA, 22 nt, Pseudomonas aeruginosa PA01
auccgccgugaggcgcgcgccg

SEQ ID NO: 3514898 - RNA, 22 nt, Pseudomonas aeruginosa PA01
auccgccguuccuccucgccgc

SEQ ID NO: 3514899 - RNA, 23 nt, Pseudomonas aeruginosa PA01
auccgccuuuuuugugcccggcg

SEQ ID NO: 3514900 - RNA, 22 nt, Pseudomonas aeruginosa PA01
auccgcgaauagggcggcgcca

SEQ ID NO: 3514901 - RNA, 19 nt, Pseudomonas aeruginosa PA01
auccgcgacaguucgccgc

SEQ ID NO: 3514902 - RNA, 21 nt, Pseudomonas aeruginosa PA01
auccgcgacaguucgccgccc

SEQ ID NO: 3514903 - RNA, 13 nt, Pseudomonas aeruginosa PA01
auccgcgccgacc

SEQ ID NO: 3514904 - RNA, 14 nt, Pseudomonas aeruginosa PA01
auccgcgccgacca

SEQ ID NO: 3514905 - RNA, 16 nt, Pseudomonas aeruginosa PA01
auccgcgccgaccagc

SEQ ID NO: 3514906 - RNA, 20 nt, Pseudomonas aeruginosa PA01
auccgcgccgaccagccgca

SEQ ID NO: 3514907 - RNA, 20 nt, Pseudomonas aeruginosa PA01
auccgcgccgguggccagga

SEQ ID NO: 3514908 - RNA, 15 nt, Pseudomonas aeruginosa PA01
auccgcgccugcuug

SEQ ID NO: 3514909 - RNA, 17 nt, Pseudomonas aeruginosa PA01
auccgcguggcgaugcc

SEQ ID NO: 3514910 - RNA, 16 nt, Pseudomonas aeruginosa PA01
auccgcguggcgugcu

SEQ ID NO: 3514911 - RNA, 20 nt, Pseudomonas aeruginosa PA01
auccgcguggcgugcucggc

SEQ ID NO: 3514912 - RNA, 23 nt, Pseudomonas aeruginosa PA01
auccgcguggcgugcucggcgau

SEQ ID NO: 3514913 - RNA, 20 nt, Pseudomonas aeruginosa PA01
auccgcguuaccguccgcgc

SEQ ID NO: 3514914 - RNA, 13 nt, Pseudomonas aeruginosa PA01
auccgcuccagca

SEQ ID NO: 3514915 - RNA, 17 nt, Pseudomonas aeruginosa PA01
auccgcuccagcaguuc

SEQ ID NO: 3514916 - RNA, 23 nt, Pseudomonas aeruginosa PA01
auccgcuccagcaguucgucgcc

SEQ ID NO: 3514917 - RNA, 16 nt, Pseudomonas aeruginosa PA01
auccgcuccagcgccu

SEQ ID NO: 3514918 - RNA, 17 nt, Pseudomonas aeruginosa PA01
auccgcuccagcgccuc

SEQ ID NO: 3514919 - RNA, 22 nt, Pseudomonas aeruginosa PA01
auccgcuccaggcugugggcga

SEQ ID NO: 3514920 - RNA, 23 nt, Pseudomonas aeruginosa PA01
auccgcucuguagggucgcagca

SEQ ID NO: 3514921 - RNA, 15 nt, Pseudomonas aeruginosa PA01
auccgcugggccuug

SEQ ID NO: 3514922 - RNA, 23 nt, Pseudomonas aeruginosa PA01
auccgcugguagcccaggccgaa

SEQ ID NO: 3514923 - RNA, 18 nt, Pseudomonas aeruginosa PA01
auccggaguucgcccgcc

SEQ ID NO: 3514924 - RNA, 15 nt, Pseudomonas aeruginosa PA01
auccggcgcugccga

SEQ ID NO: 3514925 - RNA, 18 nt, Pseudomonas aeruginosa PA01
auccggcuggcgccggug

SEQ ID NO: 3514926 - RNA, 20 nt, Pseudomonas aeruginosa PA01
auccgggcacuugucgacgu

SEQ ID NO: 3514927 - RNA, 20 nt, Pseudomonas aeruginosa PA01
auccgggcccaggcuggcgg

SEQ ID NO: 3514928 - RNA, 13 nt, Pseudomonas aeruginosa PA01
auccgggcggcgg

SEQ ID NO: 3514929 - RNA, 19 nt, Pseudomonas aeruginosa PA01
auccgggcguagggcgaau

SEQ ID NO: 3514930 - RNA, 22 nt, Pseudomonas aeruginosa PA01
auccgggcguggggcgaauaac

SEQ ID NO: 3514931 - RNA, 12 nt, Pseudomonas aeruginosa PA01
auccggguggag

SEQ ID NO: 3514932 - RNA, 20 nt, Pseudomonas aeruginosa PA01
auccggguggagaggcgugc

SEQ ID NO: 3514933 - RNA, 20 nt, Pseudomonas aeruginosa PA01
auccgguugauuuccgcacc

SEQ ID NO: 3514934 - RNA, 20 nt, Pseudomonas aeruginosa PA01
auccguaaaauggcgcgccu

SEQ ID NO: 3514935 - RNA, 17 nt, Pseudomonas aeruginosa PA01
auccgucauacaacugu

SEQ ID NO: 3514936 - RNA, 21 nt, Pseudomonas aeruginosa PA01
auccgucauacaacuguugcu

SEQ ID NO: 3514937 - RNA, 19 nt, Pseudomonas aeruginosa PA01
auccguccuacgcgaccgg

SEQ ID NO: 3514938 - RNA, 21 nt, Pseudomonas aeruginosa PA01
auccgugacgucggcggcgga

SEQ ID NO: 3514939 - RNA, 14 nt, Pseudomonas aeruginosa PA01
auccgugccaggcg

SEQ ID NO: 3514940 - RNA, 14 nt, Pseudomonas aeruginosa PA01
auccgugcgccggg

SEQ ID NO: 3514941 - RNA, 15 nt, Pseudomonas aeruginosa PA01
auccgugcgccgggc

SEQ ID NO: 3514942 - RNA, 16 nt, Pseudomonas aeruginosa PA01
auccguuaccgcgggc

SEQ ID NO: 3514943 - RNA, 22 nt, Pseudomonas aeruginosa PA01
auccuccaccguuccgacccgg

SEQ ID NO: 3514944 - RNA, 13 nt, Pseudomonas aeruginosa PA01
auccuccagcacu

SEQ ID NO: 3514945 - RNA, 14 nt, Pseudomonas aeruginosa PA01
auccucccugcccg

SEQ ID NO: 3514946 - RNA, 18 nt, Pseudomonas aeruginosa PA01
auccucccugcccgcucg

SEQ ID NO: 3514947 - RNA, 17 nt, Pseudomonas aeruginosa PA01
auccuccgccagcccca

SEQ ID NO: 3514948 - RNA, 13 nt, Pseudomonas aeruginosa PA01
auccuccugggga

SEQ ID NO: 3514949 - RNA, 16 nt, Pseudomonas aeruginosa PA01
auccucgccucgcgcc

SEQ ID NO: 3514950 - RNA, 20 nt, Pseudomonas aeruginosa PA01
auccucggcauccaguucgu

SEQ ID NO: 3514951 - RNA, 16 nt, Pseudomonas aeruginosa PA01
auccucggccauaccu

SEQ ID NO: 3514952 - RNA, 21 nt, Pseudomonas aeruginosa PA01
auccucggccauaccuccagc

SEQ ID NO: 3514953 - RNA, 17 nt, Pseudomonas aeruginosa PA01
auccugaccguccuggc

SEQ ID NO: 3514954 - RNA, 20 nt, Pseudomonas aeruginosa PA01
aucgccagcucgccgcgcuc

SEQ ID NO: 3514955 - RNA, 11 nt, Pseudomonas aeruginosa PA01
aucgccaggcg

SEQ ID NO: 3514956 - RNA, 12 nt, Pseudomonas aeruginosa PA01
aucgccaggcga

SEQ ID NO: 3514957 - RNA, 18 nt, Pseudomonas aeruginosa PA01
aucgccaggcugauccgc

SEQ ID NO: 3514958 - RNA, 18 nt, Pseudomonas aeruginosa PA01
aucgccagggucuugccg

SEQ ID NO: 3514959 - RNA, 21 nt, Pseudomonas aeruginosa PA01
aucgccagguggaagcgcgcg

SEQ ID NO: 3514960 - RNA, 16 nt, Pseudomonas aeruginosa PA01
aucgccauuggccagg

SEQ ID NO: 3514961 - RNA, 17 nt, Pseudomonas aeruginosa PA01
aucgccauuggccaggg

SEQ ID NO: 3514962 - RNA, 21 nt, Pseudomonas aeruginosa PA01
aucgccauuggccagggucac

SEQ ID NO: 3514963 - RNA, 19 nt, Pseudomonas aeruginosa PA01
aucgcccagcggcuggcgg

SEQ ID NO: 3514964 - RNA, 21 nt, Pseudomonas aeruginosa PA01
aucgcccagggccagcggguu

SEQ ID NO: 3514965 - RNA, 16 nt, Pseudomonas aeruginosa PA01
aucgcccgaacgccga

SEQ ID NO: 3514966 - RNA, 13 nt, Pseudomonas aeruginosa PA01
aucgcccgcagcc

SEQ ID NO: 3514967 - RNA, 20 nt, Pseudomonas aeruginosa PA01
aucgcccgcagccacaggcg

SEQ ID NO: 3514968 - RNA, 13 nt, Pseudomonas aeruginosa PA01
aucgcccgcgccu

SEQ ID NO: 3514969 - RNA, 23 nt, Pseudomonas aeruginosa PA01
aucgcccggcagcaggccgccgc

SEQ ID NO: 3514970 - RNA, 23 nt, Pseudomonas aeruginosa PA01
aucgcccggcgcuccaacagcag

SEQ ID NO: 3514971 - RNA, 13 nt, Pseudomonas aeruginosa PA01
aucgcccuggccu

SEQ ID NO: 3514972 - RNA, 18 nt, Pseudomonas aeruginosa PA01
aucgcccuggccucggcg

SEQ ID NO: 3514973 - RNA, 19 nt, Pseudomonas aeruginosa PA01
aucgcccuggccucggcgu

SEQ ID NO: 3514974 - RNA, 15 nt, Pseudomonas aeruginosa PA01
aucgcccuggcgcca

SEQ ID NO: 3514975 - RNA, 16 nt, Pseudomonas aeruginosa PA01
aucgccgacaggucgg

SEQ ID NO: 3514976 - RNA, 20 nt, Pseudomonas aeruginosa PA01
aucgccgacaggucggccgg

SEQ ID NO: 3514977 - RNA, 23 nt, Pseudomonas aeruginosa PA01
aucgccgagggcgaagaucucgc

SEQ ID NO: 3514978 - RNA, 13 nt, Pseudomonas aeruginosa PA01
aucgccgccaggc

SEQ ID NO: 3514979 - RNA, 14 nt, Pseudomonas aeruginosa PA01
aucgccgccaggca

SEQ ID NO: 3514980 - RNA, 15 nt, Pseudomonas aeruginosa PA01
aucgccgccaggcag

SEQ ID NO: 3514981 - RNA, 16 nt, Pseudomonas aeruginosa PA01
aucgccgccaggcaga

SEQ ID NO: 3514982 - RNA, 19 nt, Pseudomonas aeruginosa PA01
aucgccgccaggcagaccu

SEQ ID NO: 3514983 - RNA, 17 nt, Pseudomonas aeruginosa PA01
aucgccgccauugacga

SEQ ID NO: 3514984 - RNA, 14 nt, Pseudomonas aeruginosa PA01
aucgccgccuugcg

SEQ ID NO: 3514985 - RNA, 13 nt, Pseudomonas aeruginosa PA01
aucgccgcgccgc

SEQ ID NO: 3514986 - RNA, 16 nt, Pseudomonas aeruginosa PA01
aucgccgcgccgccga

SEQ ID NO: 3514987 - RNA, 23 nt, Pseudomonas aeruginosa PA01
aucgccgcggcgaagcgcucgac

SEQ ID NO: 3514988 - RNA, 17 nt, Pseudomonas aeruginosa PA01
aucgccggcagcgccgc

SEQ ID NO: 3514989 - RNA, 20 nt, Pseudomonas aeruginosa PA01
aucgccggcccgcgcggcaa

SEQ ID NO: 3514990 - RNA, 14 nt, Pseudomonas aeruginosa PA01
aucgccggcgagcc

SEQ ID NO: 3514991 - RNA, 15 nt, Pseudomonas aeruginosa PA01
aucgccggcgagccg

SEQ ID NO: 3514992 - RNA, 22 nt, Pseudomonas aeruginosa PA01
aucgccggcgagccgcuggcau

SEQ ID NO: 3514993 - RNA, 19 nt, Pseudomonas aeruginosa PA01
aucgccggguugccgcugg

SEQ ID NO: 3514994 - RNA, 20 nt, Pseudomonas aeruginosa PA01
aucgccggguugccgcuggc

SEQ ID NO: 3514995 - RNA, 22 nt, Pseudomonas aeruginosa PA01
aucgccggguugccgcuggccu

SEQ ID NO: 3514996 - RNA, 15 nt, Pseudomonas aeruginosa PA01
aucgccgguccucga

SEQ ID NO: 3514997 - RNA, 16 nt, Pseudomonas aeruginosa PA01
aucgccgguccucgac

SEQ ID NO: 3514998 - RNA, 14 nt, Pseudomonas aeruginosa PA01
aucgccgucaccgc

SEQ ID NO: 3514999 - RNA, 18 nt, Pseudomonas aeruginosa PA01
aucgccguccuggagaac

SEQ ID NO: 3515000 - RNA, 18 nt, Pseudomonas aeruginosa PA01
aucgccguucucgaucaa

SEQ ID NO: 3515001 - RNA, 22 nt, Pseudomonas aeruginosa PA01
aucgccguugccuucgccgucg

SEQ ID NO: 3515002 - RNA, 12 nt, Pseudomonas aeruginosa PA01
aucgccuccacc

SEQ ID NO: 3515003 - RNA, 15 nt, Pseudomonas aeruginosa PA01
aucgccuccaccagc

SEQ ID NO: 3515004 - RNA, 19 nt, Pseudomonas aeruginosa PA01
aucgccuccaccagcgccg

SEQ ID NO: 3515005 - RNA, 22 nt, Pseudomonas aeruginosa PA01
aucgccuccaccagcgccggcg

SEQ ID NO: 3515006 - RNA, 15 nt, Pseudomonas aeruginosa PA01
aucgccuccacggcg

SEQ ID NO: 3515007 - RNA, 20 nt, Pseudomonas aeruginosa PA01
aucgccuccacggcggccuc

SEQ ID NO: 3515008 - RNA, 23 nt, Pseudomonas aeruginosa PA01
aucgccuccggcacgcugccgcc

SEQ ID NO: 3515009 - RNA, 15 nt, Pseudomonas aeruginosa PA01
aucgccucgccggcc

SEQ ID NO: 3515010 - RNA, 16 nt, Pseudomonas aeruginosa PA01
aucgccucgccggcca

SEQ ID NO: 3515011 - RNA, 22 nt, Pseudomonas aeruginosa PA01
aucgccucgcggaccucgggca

SEQ ID NO: 3515012 - RNA, 18 nt, Pseudomonas aeruginosa PA01
aucgccucggccaucgag

SEQ ID NO: 3515013 - RNA, 21 nt, Pseudomonas aeruginosa PA01
aucgccucggccaucgagcgc

SEQ ID NO: 3515014 - RNA, 13 nt, Pseudomonas aeruginosa PA01
aucgccucgggcg

SEQ ID NO: 3515015 - RNA, 14 nt, Pseudomonas aeruginosa PA01
aucgccucgucgag

SEQ ID NO: 3515016 - RNA, 22 nt, Pseudomonas aeruginosa PA01
aucgccucguucgucgccgacu

SEQ ID NO: 3515017 - RNA, 23 nt, Pseudomonas aeruginosa PA01
aucgccucguucgucgccgacug

SEQ ID NO: 3515018 - RNA, 19 nt, Pseudomonas aeruginosa PA01
aucgccugcuuggcggcgg

SEQ ID NO: 3515019 - RNA, 15 nt, Pseudomonas aeruginosa PA01
aucgccugggccggc

SEQ ID NO: 3515020 - RNA, 16 nt, Pseudomonas aeruginosa PA01
aucgccugggccggcg

SEQ ID NO: 3515021 - RNA, 15 nt, Pseudomonas aeruginosa PA01
aucgccuuccucggc

SEQ ID NO: 3515022 - RNA, 17 nt, Pseudomonas aeruginosa PA01
aucgccuuccucggcga

SEQ ID NO: 3515023 - RNA, 21 nt, Pseudomonas aeruginosa PA01
aucgccuuccucggcgaucac

SEQ ID NO: 3515024 - RNA, 13 nt, Pseudomonas aeruginosa PA01
aucgccuugcgcg

SEQ ID NO: 3515025 - RNA, 20 nt, Pseudomonas aeruginosa PA01
aucgcgaagaacacgcccca

SEQ ID NO: 3515026 - RNA, 23 nt, Pseudomonas aeruginosa PA01
aucgcgaagaacacgccccagaa

SEQ ID NO: 3515027 - RNA, 15 nt, Pseudomonas aeruginosa PA01
aucgcgaagcgcagc

SEQ ID NO: 3515028 - RNA, 16 nt, Pseudomonas aeruginosa PA01
aucgcgcaacggcagc

SEQ ID NO: 3515029 - RNA, 23 nt, Pseudomonas aeruginosa PA01
aucgcgcaacggcagcgcuucgu

SEQ ID NO: 3515030 - RNA, 18 nt, Pseudomonas aeruginosa PA01
aucgcgcacaugccgagc

SEQ ID NO: 3515031 - RNA, 19 nt, Pseudomonas aeruginosa PA01
aucgcgcacaugccgagcg

SEQ ID NO: 3515032 - RNA, 17 nt, Pseudomonas aeruginosa PA01
aucgcgcagaucgccgc

SEQ ID NO: 3515033 - RNA, 13 nt, Pseudomonas aeruginosa PA01
aucgcgccaggcc

SEQ ID NO: 3515034 - RNA, 16 nt, Pseudomonas aeruginosa PA01
aucgcgccaggccgca

SEQ ID NO: 3515035 - RNA, 19 nt, Pseudomonas aeruginosa PA01
aucgcgccgagcuggcgcg

SEQ ID NO: 3515036 - RNA, 21 nt, Pseudomonas aeruginosa PA01
aucgcgccgagcuggcgcgcg

SEQ ID NO: 3515037 - RNA, 22 nt, Pseudomonas aeruginosa PA01
aucgcgccgccgaagccgacgc

SEQ ID NO: 3515038 - RNA, 21 nt, Pseudomonas aeruginosa PA01
aucgcgccggaugggcgagcu

SEQ ID NO: 3515039 - RNA, 16 nt, Pseudomonas aeruginosa PA01
aucgcgccgucgcugg

SEQ ID NO: 3515040 - RNA, 17 nt, Pseudomonas aeruginosa PA01
aucgcgccgucgcuggc

SEQ ID NO: 3515041 - RNA, 13 nt, Pseudomonas aeruginosa PA01
aucgcgcuggcca

SEQ ID NO: 3515042 - RNA, 15 nt, Pseudomonas aeruginosa PA01
aucgcgcugggcgca

SEQ ID NO: 3515043 - RNA, 23 nt, Pseudomonas aeruginosa PA01
aucgcggaaacccuuccagccgc

SEQ ID NO: 3515044 - RNA, 16 nt, Pseudomonas aeruginosa PA01
aucgcggacaccgcgg

SEQ ID NO: 3515045 - RNA, 15 nt, Pseudomonas aeruginosa PA01
aucgcggcgauggcc

SEQ ID NO: 3515046 - RNA, 18 nt, Pseudomonas aeruginosa PA01
aucgcggcgauggccgcc

SEQ ID NO: 3515047 - RNA, 19 nt, Pseudomonas aeruginosa PA01
aucgcggcgauggccgcca

SEQ ID NO: 3515048 - RNA, 21 nt, Pseudomonas aeruginosa PA01
aucgcggcgauggccgccagc

SEQ ID NO: 3515049 - RNA, 14 nt, Pseudomonas aeruginosa PA01
aucgcggcgcaggc

SEQ ID NO: 3515050 - RNA, 22 nt, Pseudomonas aeruginosa PA01
aucgcgggcgugcuccagcacc

SEQ ID NO: 3515051 - RNA, 19 nt, Pseudomonas aeruginosa PA01
aucgcgguuauccgccggc

SEQ ID NO: 3515052 - RNA, 22 nt, Pseudomonas aeruginosa PA01
aucgcguagggcgcauaaccgc

SEQ ID NO: 3515053 - RNA, 22 nt, Pseudomonas aeruginosa PA01
aucgcguagggcguauaaccgc

SEQ ID NO: 3515054 - RNA, 14 nt, Pseudomonas aeruginosa PA01
aucgcguagguggc

SEQ ID NO: 3515055 - RNA, 15 nt, Pseudomonas aeruginosa PA01
aucgcguagguggcg

SEQ ID NO: 3515056 - RNA, 15 nt, Pseudomonas aeruginosa PA01
aucgguugccgcgcc

SEQ ID NO: 3515057 - RNA, 22 nt, Pseudomonas aeruginosa PA01
aucgguuggggaggugcggcgg

SEQ ID NO: 3515058 - RNA, 21 nt, Pseudomonas aeruginosa PA01
aucguccugccggugcucggc

SEQ ID NO: 3515059 - RNA, 18 nt, Pseudomonas aeruginosa PA01
aucgucgaaacgcuggcg

SEQ ID NO: 3515060 - RNA, 16 nt, Pseudomonas aeruginosa PA01
aucgucgaagcucggc

SEQ ID NO: 3515061 - RNA, 17 nt, Pseudomonas aeruginosa PA01
aucgucgaagcucggcg

SEQ ID NO: 3515062 - RNA, 22 nt, Pseudomonas aeruginosa PA01
aucgucgaagcugaggucguug

SEQ ID NO: 3515063 - RNA, 19 nt, Pseudomonas aeruginosa PA01
aucgucgaagggccauugu

SEQ ID NO: 3515064 - RNA, 17 nt, Pseudomonas aeruginosa PA01
aucgucgaugaggucgc

SEQ ID NO: 3515065 - RNA, 11 nt, Pseudomonas aeruginosa PA01
aucgucgccaa

SEQ ID NO: 3515066 - RNA, 19 nt, Pseudomonas aeruginosa PA01
aucgucgccaagcccggcg

SEQ ID NO: 3515067 - RNA, 12 nt, Pseudomonas aeruginosa PA01
aucgucgccgga

SEQ ID NO: 3515068 - RNA, 13 nt, Pseudomonas aeruginosa PA01
aucgucgccggag

SEQ ID NO: 3515069 - RNA, 14 nt, Pseudomonas aeruginosa PA01
aucgucgcggcgcg

SEQ ID NO: 3515070 - RNA, 11 nt, Pseudomonas aeruginosa PA01
aucgucggccc

SEQ ID NO: 3515071 - RNA, 14 nt, Pseudomonas aeruginosa PA01
aucgucggcccgca

SEQ ID NO: 3515072 - RNA, 16 nt, Pseudomonas aeruginosa PA01
aucgucucgcgacacg

SEQ ID NO: 3515073 - RNA, 18 nt, Pseudomonas aeruginosa PA01
aucgucucgcgacacgug

SEQ ID NO: 3515074 - RNA, 18 nt, Pseudomonas aeruginosa PA01
aucgucucggugcucagg

SEQ ID NO: 3515075 - RNA, 14 nt, Pseudomonas aeruginosa PA01
aucguugaucggcu

SEQ ID NO: 3515076 - RNA, 14 nt, Pseudomonas aeruginosa PA01
aucguugccagccg

SEQ ID NO: 3515077 - RNA, 18 nt, Pseudomonas aeruginosa PA01
aucguugccagccggccu

SEQ ID NO: 3515078 - RNA, 15 nt, Pseudomonas aeruginosa PA01
aucguuggcgaaguu

SEQ ID NO: 3515079 - RNA, 23 nt, Pseudomonas aeruginosa PA01
aucguuggcgaaguucccgccgc

SEQ ID NO: 3515080 - RNA, 17 nt, Pseudomonas aeruginosa PA01
aucguuggcgccguccu

SEQ ID NO: 3515081 - RNA, 20 nt, Pseudomonas aeruginosa PA01
aucuacuuaggcucacacgc

SEQ ID NO: 3515082 - RNA, 21 nt, Pseudomonas aeruginosa PA01
aucuacuuaggcucacacgcc

SEQ ID NO: 3515083 - RNA, 15 nt, Pseudomonas aeruginosa PA01
aucuauaaugcgccc

SEQ ID NO: 3515084 - RNA, 21 nt, Pseudomonas aeruginosa PA01
aucucaggaccuuccgccagc

SEQ ID NO: 3515085 - RNA, 23 nt, Pseudomonas aeruginosa PA01
aucucaggaccuuccgccagcag

SEQ ID NO: 3515086 - RNA, 22 nt, Pseudomonas aeruginosa PA01
aucucaucgcccaugaaaaagc

SEQ ID NO: 3515087 - RNA, 18 nt, Pseudomonas aeruginosa PA01
aucuccaacuggcggcug

SEQ ID NO: 3515088 - RNA, 20 nt, Pseudomonas aeruginosa PA01
aucuccacccguucgccggc

SEQ ID NO: 3515089 - RNA, 21 nt, Pseudomonas aeruginosa PA01
aucuccacccguucgccggcc

SEQ ID NO: 3515090 - RNA, 16 nt, Pseudomonas aeruginosa PA01
aucuccgccaggcggc

SEQ ID NO: 3515091 - RNA, 18 nt, Pseudomonas aeruginosa PA01
aucuccgccaggcggccg

SEQ ID NO: 3515092 - RNA, 13 nt, Pseudomonas aeruginosa PA01
aucuccgcgccac

SEQ ID NO: 3515093 - RNA, 15 nt, Pseudomonas aeruginosa PA01
aucuccgcgccacgc

SEQ ID NO: 3515094 - RNA, 17 nt, Pseudomonas aeruginosa PA01
aucuccgcgccacgcgc

SEQ ID NO: 3515095 - RNA, 18 nt, Pseudomonas aeruginosa PA01
aucuccgcgccacgcgca

SEQ ID NO: 3515096 - RNA, 14 nt, Pseudomonas aeruginosa PA01
aucuccgcgccggg

SEQ ID NO: 3515097 - RNA, 17 nt, Pseudomonas aeruginosa PA01
aucuccgcgccgggcug

SEQ ID NO: 3515098 - RNA, 17 nt, Pseudomonas aeruginosa PA01
aucuccgcggagaggau

SEQ ID NO: 3515099 - RNA, 13 nt, Pseudomonas aeruginosa PA01
aucuccuccucgg

SEQ ID NO: 3515100 - RNA, 17 nt, Pseudomonas aeruginosa PA01
aucuccuccucggcggc

SEQ ID NO: 3515101 - RNA, 14 nt, Pseudomonas aeruginosa PA01
aucuccucgacggc

SEQ ID NO: 3515102 - RNA, 21 nt, Pseudomonas aeruginosa PA01
aucuccucgauccgcugggcc

SEQ ID NO: 3515103 - RNA, 14 nt, Pseudomonas aeruginosa PA01
aucuccucgcugau

SEQ ID NO: 3515104 - RNA, 17 nt, Pseudomonas aeruginosa PA01
aucuccugccgcggcga

SEQ ID NO: 3515105 - RNA, 14 nt, Pseudomonas aeruginosa PA01
aucuccugcuggac

SEQ ID NO: 3515106 - RNA, 16 nt, Pseudomonas aeruginosa PA01
aucuccugcugggcgu

SEQ ID NO: 3515107 - RNA, 19 nt, Pseudomonas aeruginosa PA01
aucuccugcugggcgucga

SEQ ID NO: 3515108 - RNA, 13 nt, Pseudomonas aeruginosa PA01
aucuccuggcgcg

SEQ ID NO: 3515109 - RNA, 15 nt, Pseudomonas aeruginosa PA01
aucuccuggcgggug

SEQ ID NO: 3515110 - RNA, 15 nt, Pseudomonas aeruginosa PA01
aucucgaagaccagc

SEQ ID NO: 3515111 - RNA, 14 nt, Pseudomonas aeruginosa PA01
aucucgauggugaa

SEQ ID NO: 3515112 - RNA, 20 nt, Pseudomonas aeruginosa PA01
aucucgauggugaacgccag

SEQ ID NO: 3515113 - RNA, 22 nt, Pseudomonas aeruginosa PA01
aucucgauggugaacgccaggc

SEQ ID NO: 3515114 - RNA, 23 nt, Pseudomonas aeruginosa PA01
aucucgauggugaacgccaggca

SEQ ID NO: 3515115 - RNA, 18 nt, Pseudomonas aeruginosa PA01
aucucgcccagggcgugg

SEQ ID NO: 3515116 - RNA, 20 nt, Pseudomonas aeruginosa PA01
aucucgcccaguaccgccac

SEQ ID NO: 3515117 - RNA, 18 nt, Pseudomonas aeruginosa PA01
aucucgccgaaggugcag

SEQ ID NO: 3515118 - RNA, 19 nt, Pseudomonas aeruginosa PA01
aucucgccgcgcacgucga

SEQ ID NO: 3515119 - RNA, 14 nt, Pseudomonas aeruginosa PA01
aucucgcggcgcgg

SEQ ID NO: 3515120 - RNA, 16 nt, Pseudomonas aeruginosa PA01
aucucgcguuccagca

SEQ ID NO: 3515121 - RNA, 17 nt, Pseudomonas aeruginosa PA01
aucucgcguuccagcac

SEQ ID NO: 3515122 - RNA, 20 nt, Pseudomonas aeruginosa PA01
aucucggccaccugcuccgg

SEQ ID NO: 3515123 - RNA, 13 nt, Pseudomonas aeruginosa PA01
aucucggccaggc

SEQ ID NO: 3515124 - RNA, 16 nt, Pseudomonas aeruginosa PA01
aucucgguaucgcuuc

SEQ ID NO: 3515125 - RNA, 15 nt, Pseudomonas aeruginosa PA01
aucucggucgcaagc

SEQ ID NO: 3515126 - RNA, 16 nt, Pseudomonas aeruginosa PA01
aucucggugcgcccca

SEQ ID NO: 3515127 - RNA, 21 nt, Pseudomonas aeruginosa PA01
aucucggugcgccccaggugc

SEQ ID NO: 3515128 - RNA, 22 nt, Pseudomonas aeruginosa PA01
aucucggugcgccccaggugca

SEQ ID NO: 3515129 - RNA, 21 nt, Pseudomonas aeruginosa PA01
aucucgguguccaccaccagc

SEQ ID NO: 3515130 - RNA, 23 nt, Pseudomonas aeruginosa PA01
aucucgguguccaccaccagcag

SEQ ID NO: 3515131 - RNA, 16 nt, Pseudomonas aeruginosa PA01
aucucgguuuccagga

SEQ ID NO: 3515132 - RNA, 16 nt, Pseudomonas aeruginosa PA01
aucucguccucggcgu

SEQ ID NO: 3515133 - RNA, 11 nt, Pseudomonas aeruginosa PA01
aucucgucgcc

SEQ ID NO: 3515134 - RNA, 14 nt, Pseudomonas aeruginosa PA01
aucucgucgccgac

SEQ ID NO: 3515135 - RNA, 18 nt, Pseudomonas aeruginosa PA01
aucucgugggccagcagg

SEQ ID NO: 3515136 - RNA, 19 nt, Pseudomonas aeruginosa PA01
aucucgugguugaggcgcu

SEQ ID NO: 3515137 - RNA, 18 nt, Pseudomonas aeruginosa PA01
aucucuuccucgcugccu

SEQ ID NO: 3515138 - RNA, 20 nt, Pseudomonas aeruginosa PA01
aucucuuccucgcugccuac

SEQ ID NO: 3515139 - RNA, 17 nt, Pseudomonas aeruginosa PA01
aucugcaccgcccagcc

SEQ ID NO: 3515140 - RNA, 22 nt, Pseudomonas aeruginosa PA01
aucugcacgucguagcccuucu

SEQ ID NO: 3515141 - RNA, 14 nt, Pseudomonas aeruginosa PA01
aucugcagguuggc

SEQ ID NO: 3515142 - RNA, 16 nt, Pseudomonas aeruginosa PA01
aucugcccggccaugc

SEQ ID NO: 3515143 - RNA, 21 nt, Pseudomonas aeruginosa PA01
aucugcccggccaugccgccg

SEQ ID NO: 3515144 - RNA, 19 nt, Pseudomonas aeruginosa PA01
aucugccggccaccaucac

SEQ ID NO: 3515145 - RNA, 14 nt, Pseudomonas aeruginosa PA01
aucugccgggcgcg

SEQ ID NO: 3515146 - RNA, 18 nt, Pseudomonas aeruginosa PA01
aucugccgggcgcgcugg

SEQ ID NO: 3515147 - RNA, 19 nt, Pseudomonas aeruginosa PA01
aucugccgggcgcgcuggu

SEQ ID NO: 3515148 - RNA, 23 nt, Pseudomonas aeruginosa PA01
aucugccgguaauuggccaggcu

SEQ ID NO: 3515149 - RNA, 13 nt, Pseudomonas aeruginosa PA01
aucugcgccgcaa

SEQ ID NO: 3515150 - RNA, 16 nt, Pseudomonas aeruginosa PA01
aucugcucguccaggc

SEQ ID NO: 3515151 - RNA, 22 nt, Pseudomonas aeruginosa PA01
aucugcugcagcaucaggcgcu

SEQ ID NO: 3515152 - RNA, 23 nt, Pseudomonas aeruginosa PA01
aucugcugcagcaucaggcgcuc

SEQ ID NO: 3515153 - RNA, 19 nt, Pseudomonas aeruginosa PA01
aucugcugguccuggcgcg

SEQ ID NO: 3515154 - RNA, 16 nt, Pseudomonas aeruginosa PA01
aucugcuugcgcgccg

SEQ ID NO: 3515155 - RNA, 20 nt, Pseudomonas aeruginosa PA01
aucuggaauucgccgcgcgc

SEQ ID NO: 3515156 - RNA, 15 nt, Pseudomonas aeruginosa PA01
aucuggccgaugccg

SEQ ID NO: 3515157 - RNA, 14 nt, Pseudomonas aeruginosa PA01
aucuggcugcgcgc

SEQ ID NO: 3515158 - RNA, 16 nt, Pseudomonas aeruginosa PA01
aucuggcugucgccga

SEQ ID NO: 3515159 - RNA, 15 nt, Pseudomonas aeruginosa PA01
augcaggcucucgcg

SEQ ID NO: 3515160 - RNA, 20 nt, Pseudomonas aeruginosa PA01
augcaggcucucgcgcagca

SEQ ID NO: 3515161 - RNA, 14 nt, Pseudomonas aeruginosa PA01
augcaggcugccgg

SEQ ID NO: 3515162 - RNA, 12 nt, Pseudomonas aeruginosa PA01
augcagguggcg

SEQ ID NO: 3515163 - RNA, 15 nt, Pseudomonas aeruginosa PA01
augcagguggcgcuc

SEQ ID NO: 3515164 - RNA, 18 nt, Pseudomonas aeruginosa PA01
augcagguggcgcucacg

SEQ ID NO: 3515165 - RNA, 16 nt, Pseudomonas aeruginosa PA01
augcagucccgccagg

SEQ ID NO: 3515166 - RNA, 17 nt, Pseudomonas aeruginosa PA01
augcagucccgccaggc

SEQ ID NO: 3515167 - RNA, 13 nt, Pseudomonas aeruginosa PA01
augcagucggcac

SEQ ID NO: 3515168 - RNA, 18 nt, Pseudomonas aeruginosa PA01
augcaguucguugagcag

SEQ ID NO: 3515169 - RNA, 20 nt, Pseudomonas aeruginosa PA01
augcaguugagucgcgcgcg

SEQ ID NO: 3515170 - RNA, 21 nt, Pseudomonas aeruginosa PA01
augcaugauuucguuggccca

SEQ ID NO: 3515171 - RNA, 23 nt, Pseudomonas aeruginosa PA01
augcaugauuucguuggcccaga

SEQ ID NO: 3515172 - RNA, 17 nt, Pseudomonas aeruginosa PA01
augccaaguugccuggc

SEQ ID NO: 3515173 - RNA, 20 nt, Pseudomonas aeruginosa PA01
augccaaguugccuggcagg

SEQ ID NO: 3515174 - RNA, 21 nt, Pseudomonas aeruginosa PA01
augccaaguugccuggcaggu

SEQ ID NO: 3515175 - RNA, 19 nt, Pseudomonas aeruginosa PA01
augccacucgucccagaag

SEQ ID NO: 3515176 - RNA, 16 nt, Pseudomonas aeruginosa PA01
augccacugacgcgca

SEQ ID NO: 3515177 - RNA, 12 nt, Pseudomonas aeruginosa PA01
augccagcgcca

SEQ ID NO: 3515178 - RNA, 16 nt, Pseudomonas aeruginosa PA01
augccagugccucgcg

SEQ ID NO: 3515179 - RNA, 19 nt, Pseudomonas aeruginosa PA01
augccaucgaggccaggcc

SEQ ID NO: 3515180 - RNA, 15 nt, Pseudomonas aeruginosa PA01
augccaucuuccugu

SEQ ID NO: 3515181 - RNA, 23 nt, Pseudomonas aeruginosa PA01
augccauuuuuuaacgauauaca

SEQ ID NO: 3515182 - RNA, 17 nt, Pseudomonas aeruginosa PA01
augcccaauacccacag

SEQ ID NO: 3515183 - RNA, 12 nt, Pseudomonas aeruginosa PA01
augcccaccuga

SEQ ID NO: 3515184 - RNA, 18 nt, Pseudomonas aeruginosa PA01
augcccaccugaacgcgc

SEQ ID NO: 3515185 - RNA, 20 nt, Pseudomonas aeruginosa PA01
augcccaccugaacgcgccc

SEQ ID NO: 3515186 - RNA, 17 nt, Pseudomonas aeruginosa PA01
augcccagacgccgcuc

SEQ ID NO: 3515187 - RNA, 15 nt, Pseudomonas aeruginosa PA01
augcccagcguggcc

SEQ ID NO: 3515188 - RNA, 15 nt, Pseudomonas aeruginosa PA01
augcccaggccgccg

SEQ ID NO: 3515189 - RNA, 12 nt, Pseudomonas aeruginosa PA01
augcccaggcuc

SEQ ID NO: 3515190 - RNA, 16 nt, Pseudomonas aeruginosa PA01
augcccagggccagca

SEQ ID NO: 3515191 - RNA, 18 nt, Pseudomonas aeruginosa PA01
augcccagggccagcagc

SEQ ID NO: 3515192 - RNA, 20 nt, Pseudomonas aeruginosa PA01
augcccagggccagcagcgg

SEQ ID NO: 3515193 - RNA, 19 nt, Pseudomonas aeruginosa PA01
augccccauccgacgccgg

SEQ ID NO: 3515194 - RNA, 13 nt, Pseudomonas aeruginosa PA01
augccccgccgac

SEQ ID NO: 3515195 - RNA, 13 nt, Pseudomonas aeruginosa PA01
augcccgccagca

SEQ ID NO: 3515196 - RNA, 19 nt, Pseudomonas aeruginosa PA01
augcccgccagcaggcgcc

SEQ ID NO: 3515197 - RNA, 22 nt, Pseudomonas aeruginosa PA01
augcccgccagcaggcgccggc

SEQ ID NO: 3515198 - RNA, 23 nt, Pseudomonas aeruginosa PA01
augcccgccagcaggcgccggcg

SEQ ID NO: 3515199 - RNA, 13 nt, Pseudomonas aeruginosa PA01
augcccgccccgc

SEQ ID NO: 3515200 - RNA, 15 nt, Pseudomonas aeruginosa PA01
augcccgcgccuggg

SEQ ID NO: 3515201 - RNA, 20 nt, Pseudomonas aeruginosa PA01
augcccggcagcgccgggca

SEQ ID NO: 3515202 - RNA, 15 nt, Pseudomonas aeruginosa PA01
augcccggccuggcg

SEQ ID NO: 3515203 - RNA, 21 nt, Pseudomonas aeruginosa PA01
augcccggcugguugccagca

SEQ ID NO: 3515204 - RNA, 23 nt, Pseudomonas aeruginosa PA01
augcccggcugguugccagcagc

SEQ ID NO: 3515205 - RNA, 19 nt, Pseudomonas aeruginosa PA01
augcccgucaggccuugcg

SEQ ID NO: 3515206 - RNA, 22 nt, Pseudomonas aeruginosa PA01
augcccgucgaccaucaccagc

SEQ ID NO: 3515207 - RNA, 16 nt, Pseudomonas aeruginosa PA01
augcccuccugggccu

SEQ ID NO: 3515208 - RNA, 17 nt, Pseudomonas aeruginosa PA01
augcccuggucggcggu

SEQ ID NO: 3515209 - RNA, 17 nt, Pseudomonas aeruginosa PA01
augcccuugccgggaag

SEQ ID NO: 3515210 - RNA, 21 nt, Pseudomonas aeruginosa PA01
augcccuuggccagcgcggcg

SEQ ID NO: 3515211 - RNA, 20 nt, Pseudomonas aeruginosa PA01
augcccuuggcuuccuggcg

SEQ ID NO: 3515212 - RNA, 22 nt, Pseudomonas aeruginosa PA01
augcccuuggcuuccuggcgcc

SEQ ID NO: 3515213 - RNA, 15 nt, Pseudomonas aeruginosa PA01
augccgaacaccugc

SEQ ID NO: 3515214 - RNA, 21 nt, Pseudomonas aeruginosa PA01
augccgaacuucuccgccacc

SEQ ID NO: 3515215 - RNA, 15 nt, Pseudomonas aeruginosa PA01
aaaaagaagaaaaac

SEQ ID NO: 3515216 - RNA, 14 nt, Pseudomonas aeruginosa PA01
aaaaagcaggacgg

SEQ ID NO: 3515217 - RNA, 13 nt, Pseudomonas aeruginosa PA01
aaaaagccccgcu

SEQ ID NO: 3515218 - RNA, 13 nt, Pseudomonas aeruginosa PA01
aaaaagcccggca

SEQ ID NO: 3515219 - RNA, 23 nt, Pseudomonas aeruginosa PA01
aaaaauggccgcuucaagcggcc

SEQ ID NO: 3515220 - RNA, 12 nt, Pseudomonas aeruginosa PA01
aaaaauucagcg

SEQ ID NO: 3515221 - RNA, 23 nt, Pseudomonas aeruginosa PA01
aaaaccagccuugagccuugccc

SEQ ID NO: 3515222 - RNA, 17 nt, Pseudomonas aeruginosa PA01
aaaacccgcgucccuug

SEQ ID NO: 3515223 - RNA, 21 nt, Pseudomonas aeruginosa PA01
aaaacccuguuccgggcccag

SEQ ID NO: 3515224 - RNA, 13 nt, Pseudomonas aeruginosa PA01
aaaaccgccccgg

SEQ ID NO: 3515225 - RNA, 15 nt, Pseudomonas aeruginosa PA01
aaaaccggucccucg

SEQ ID NO: 3515226 - RNA, 19 nt, Pseudomonas aeruginosa PA01
aaaaccuuagacccacuga

SEQ ID NO: 3515227 - RNA, 14 nt, Pseudomonas aeruginosa PA01
aaaacgcauccguu

SEQ ID NO: 3515228 - RNA, 20 nt, Pseudomonas aeruginosa PA01
aaaacgccgcgaagcccagc

SEQ ID NO: 3515229 - RNA, 12 nt, Pseudomonas aeruginosa PA01
aaaacggcgccc

SEQ ID NO: 3515230 - RNA, 22 nt, Pseudomonas aeruginosa PA01
aaaagccgcccacgggcggcuu

SEQ ID NO: 3515231 - RNA, 17 nt, Pseudomonas aeruginosa PA01
aaaagccggaagcgcuc

SEQ ID NO: 3515232 - RNA, 21 nt, Pseudomonas aeruginosa PA01
aaaagccggaagcgcucgcgc

SEQ ID NO: 3515233 - RNA, 22 nt, Pseudomonas aeruginosa PA01
aaaaggccgcguaagcggccuu

SEQ ID NO: 3515234 - RNA, 21 nt, Pseudomonas aeruginosa PA01
aaaaggcgaucgaaggaucgc

SEQ ID NO: 3515235 - RNA, 16 nt, Pseudomonas aeruginosa PA01
aaaagggagccaggcg

SEQ ID NO: 3515236 - RNA, 19 nt, Pseudomonas aeruginosa PA01
aaaagggaugccgccggca

SEQ ID NO: 3515237 - RNA, 21 nt, Pseudomonas aeruginosa PA01
aaaagggaugccggcggcauc

SEQ ID NO: 3515238 - RNA, 19 nt, Pseudomonas aeruginosa PA01
aaaaggggaugccauggca

SEQ ID NO: 3515239 - RNA, 15 nt, Pseudomonas aeruginosa PA01
aaaauggcugccgaa

SEQ ID NO: 3515240 - RNA, 21 nt, Pseudomonas aeruginosa PA01
aaacagccguuugugaaagga

SEQ ID NO: 3515241 - RNA, 15 nt, Pseudomonas aeruginosa PA01
aaacaguuggacugc

SEQ ID NO: 3515242 - RNA, 20 nt, Pseudomonas aeruginosa PA01
aaaccccggccuggcgccgg

SEQ ID NO: 3515243 - RNA, 21 nt, Pseudomonas aeruginosa PA01
aaaccgggaugaagaucaucu

SEQ ID NO: 3515244 - RNA, 18 nt, Pseudomonas aeruginosa PA01
aaacgaaaaagcccggcg

SEQ ID NO: 3515245 - RNA, 20 nt, Pseudomonas aeruginosa PA01
aaacgcauguucaugcgcug

SEQ ID NO: 3515246 - RNA, 20 nt, Pseudomonas aeruginosa PA01
aaacgccagcccucgcccag

SEQ ID NO: 3515247 - RNA, 13 nt, Pseudomonas aeruginosa PA01
aaacgcccggcau

SEQ ID NO: 3515248 - RNA, 20 nt, Pseudomonas aeruginosa PA01
aaacgccggcgaucgccggc

SEQ ID NO: 3515249 - RNA, 16 nt, Pseudomonas aeruginosa PA01
aaacgcgcgcucucgc

SEQ ID NO: 3515250 - RNA, 19 nt, Pseudomonas aeruginosa PA01
aaacgcuuggcgaucacgg

SEQ ID NO: 3515251 - RNA, 19 nt, Pseudomonas aeruginosa PA01
aaacggcucugcuucuguc

SEQ ID NO: 3515252 - RNA, 15 nt, Pseudomonas aeruginosa PA01
aaacgggcgaucugc

SEQ ID NO: 3515253 - RNA, 23 nt, Pseudomonas aeruginosa PA01
aaacucaucaggcugccgagcag

SEQ ID NO: 3515254 - RNA, 15 nt, Pseudomonas aeruginosa PA01
aaacucgcgggcgcg

SEQ ID NO: 3515255 - RNA, 18 nt, Pseudomonas aeruginosa PA01
aaacucgugcuccaccuc

SEQ ID NO: 3515256 - RNA, 18 nt, Pseudomonas aeruginosa PA01
aaagaaaacgcccggcau

SEQ ID NO: 3515257 - RNA, 11 nt, Pseudomonas aeruginosa PA01
aaagaagaaaa

SEQ ID NO: 3515258 - RNA, 17 nt, Pseudomonas aeruginosa PA01
aaagaagccgcacuucc

SEQ ID NO: 3515259 - RNA, 17 nt, Pseudomonas aeruginosa PA01
aaagacgcugcgaccug

SEQ ID NO: 3515260 - RNA, 14 nt, Pseudomonas aeruginosa PA01
aaagagccgcgccu

SEQ ID NO: 3515261 - RNA, 18 nt, Pseudomonas aeruginosa PA01
aaagcaguucgcccggcu

SEQ ID NO: 3515262 - RNA, 22 nt, Pseudomonas aeruginosa PA01
aaagcauuucuucaccacccca

SEQ ID NO: 3515263 - RNA, 14 nt, Pseudomonas aeruginosa PA01
aaagcccagguggc

SEQ ID NO: 3515264 - RNA, 21 nt, Pseudomonas aeruginosa PA01
aaagccccgcaucgcggggcu

SEQ ID NO: 3515265 - RNA, 17 nt, Pseudomonas aeruginosa PA01
aaagccccgccaaggcg

SEQ ID NO: 3515266 - RNA, 22 nt, Pseudomonas aeruginosa PA01
aaagccccgccaaggcggggcu

SEQ ID NO: 3515267 - RNA, 22 nt, Pseudomonas aeruginosa PA01
aaagccccgcgaacgcggggcu

SEQ ID NO: 3515268 - RNA, 18 nt, Pseudomonas aeruginosa PA01
aaagccccugccgcggau

SEQ ID NO: 3515269 - RNA, 18 nt, Pseudomonas aeruginosa PA01
aaagccccugcgaccgug

SEQ ID NO: 3515270 - RNA, 22 nt, Pseudomonas aeruginosa PA01
aaagccgccccgaggggcggcu

SEQ ID NO: 3515271 - RNA, 21 nt, Pseudomonas aeruginosa PA01
aaagccgccgccgcgccggcg

SEQ ID NO: 3515272 - RNA, 15 nt, Pseudomonas aeruginosa PA01
aaagcgauagccggg

SEQ ID NO: 3515273 - RNA, 16 nt, Pseudomonas aeruginosa PA01
aaagcgcggaggguaa

SEQ ID NO: 3515274 - RNA, 13 nt, Pseudomonas aeruginosa PA01
aaagcgcugcgga

SEQ ID NO: 3515275 - RNA, 22 nt, Pseudomonas aeruginosa PA01
aaagcgguaccgggccaggcaa

SEQ ID NO: 3515276 - RNA, 13 nt, Pseudomonas aeruginosa PA01
aacaugaagccgc

SEQ ID NO: 3515277 - RNA, 21 nt, Pseudomonas aeruginosa PA01
aacauggcgucggcgaucacg

SEQ ID NO: 3515278 - RNA, 17 nt, Pseudomonas aeruginosa PA01
aacaugguguugggcag

SEQ ID NO: 3515279 - RNA, 15 nt, Pseudomonas aeruginosa PA01
aaccaccgcucucga

SEQ ID NO: 3515280 - RNA, 20 nt, Pseudomonas aeruginosa PA01
aaccacgacgaagcgccggc

SEQ ID NO: 3515281 - RNA, 15 nt, Pseudomonas aeruginosa PA01
aaccacgggaauggc

SEQ ID NO: 3515282 - RNA, 18 nt, Pseudomonas aeruginosa PA01
aaccacgggaauggcgga

SEQ ID NO: 3515283 - RNA, 17 nt, Pseudomonas aeruginosa PA01
aaccacuccagcggggu

SEQ ID NO: 3515284 - RNA, 18 nt, Pseudomonas aeruginosa PA01
aaccacuccgccacccgc

SEQ ID NO: 3515285 - RNA, 21 nt, Pseudomonas aeruginosa PA01
aaccacuccgccacccgcucc

SEQ ID NO: 3515286 - RNA, 14 nt, Pseudomonas aeruginosa PA01
aaccagaccagcag

SEQ ID NO: 3515287 - RNA, 17 nt, Pseudomonas aeruginosa PA01
aaccagaccagcaggaa

SEQ ID NO: 3515288 - RNA, 18 nt, Pseudomonas aeruginosa PA01
aaccagaccagcaggaaa

SEQ ID NO: 3515289 - RNA, 14 nt, Pseudomonas aeruginosa PA01
aaccagacgcucgg

SEQ ID NO: 3515290 - RNA, 23 nt, Pseudomonas aeruginosa PA01
aaccagacuuccgggcugcgcuc

SEQ ID NO: 3515291 - RNA, 22 nt, Pseudomonas aeruginosa PA01
aaccaggaaggaaugcugccac

SEQ ID NO: 3515292 - RNA, 22 nt, Pseudomonas aeruginosa PA01
aaccaggaaggcguagaccucg

SEQ ID NO: 3515293 - RNA, 21 nt, Pseudomonas aeruginosa PA01
aaccaggaucgaacuggccag

SEQ ID NO: 3515294 - RNA, 22 nt, Pseudomonas aeruginosa PA01
aaccaggcgccgaugcccaggc

SEQ ID NO: 3515295 - RNA, 13 nt, Pseudomonas aeruginosa PA01
aaccaggcggccg

SEQ ID NO: 3515296 - RNA, 14 nt, Pseudomonas aeruginosa PA01
aacccaaucacaac

SEQ ID NO: 3515297 - RNA, 16 nt, Pseudomonas aeruginosa PA01
aacccaggccgcgcag

SEQ ID NO: 3515298 - RNA, 23 nt, Pseudomonas aeruginosa PA01
aacccaggcgcugcguuccuguu

SEQ ID NO: 3515299 - RNA, 13 nt, Pseudomonas aeruginosa PA01
aacccagggcgcu

SEQ ID NO: 3515300 - RNA, 16 nt, Pseudomonas aeruginosa PA01
aacccagggugcggua

SEQ ID NO: 3515301 - RNA, 16 nt, Pseudomonas aeruginosa PA01
aaccccggccuggcgc

SEQ ID NO: 3515302 - RNA, 12 nt, Pseudomonas aeruginosa PA01
aaccccucggcu

SEQ ID NO: 3515303 - RNA, 16 nt, Pseudomonas aeruginosa PA01
aaccccuggaucuccu

SEQ ID NO: 3515304 - RNA, 17 nt, Pseudomonas aeruginosa PA01
aaccccuggaucuccug

SEQ ID NO: 3515305 - RNA, 13 nt, Pseudomonas aeruginosa PA01
aacccgcccggcu

SEQ ID NO: 3515306 - RNA, 22 nt, Pseudomonas aeruginosa PA01
aacccgcccggcucaacugcuu

SEQ ID NO: 3515307 - RNA, 16 nt, Pseudomonas aeruginosa PA01
aacccgcggcgcgccu

SEQ ID NO: 3515308 - RNA, 17 nt, Pseudomonas aeruginosa PA01
aacccgcgucccuugcg

SEQ ID NO: 3515309 - RNA, 23 nt, Pseudomonas aeruginosa PA01
aacccgcuccgucgcuucgcccg

SEQ ID NO: 3515310 - RNA, 18 nt, Pseudomonas aeruginosa PA01
aacccggccagcccggcc

SEQ ID NO: 3515311 - RNA, 15 nt, Pseudomonas aeruginosa PA01
aacccggcgcuggcc

SEQ ID NO: 3515312 - RNA, 20 nt, Pseudomonas aeruginosa PA01
aacccgggcccaagccgagc

SEQ ID NO: 3515313 - RNA, 22 nt, Pseudomonas aeruginosa PA01
aacccgugguccgccagcaggc

SEQ ID NO: 3515314 - RNA, 21 nt, Pseudomonas aeruginosa PA01
aacccucggugcggccgagga

SEQ ID NO: 3515315 - RNA, 22 nt, Pseudomonas aeruginosa PA01
aacccucggugcggccgaggaa

SEQ ID NO: 3515316 - RNA, 20 nt, Pseudomonas aeruginosa PA01
aacccugcccagugggccac

SEQ ID NO: 3515317 - RNA, 15 nt, Pseudomonas aeruginosa PA01
aacccugggaauggc

SEQ ID NO: 3515318 - RNA, 18 nt, Pseudomonas aeruginosa PA01
aacccugggaauggcgga

SEQ ID NO: 3515319 - RNA, 17 nt, Pseudomonas aeruginosa PA01
aaccgaaguagucgccc

SEQ ID NO: 3515320 - RNA, 18 nt, Pseudomonas aeruginosa PA01
aaccgacgcgcaggagug

SEQ ID NO: 3515321 - RNA, 17 nt, Pseudomonas aeruginosa PA01
aaccgagacccuggcgc

SEQ ID NO: 3515322 - RNA, 18 nt, Pseudomonas aeruginosa PA01
aaccgagacccuggcgcu

SEQ ID NO: 3515323 - RNA, 19 nt, Pseudomonas aeruginosa PA01
aaccgaguuucccggcgcg

SEQ ID NO: 3515324 - RNA, 22 nt, Pseudomonas aeruginosa PA01
aaccgauauaggcgacgaucag

SEQ ID NO: 3515325 - RNA, 16 nt, Pseudomonas aeruginosa PA01
aaccgaucagcaccgc

SEQ ID NO: 3515326 - RNA, 23 nt, Pseudomonas aeruginosa PA01
aaccgaucagcaccgccaccagc

SEQ ID NO: 3515327 - RNA, 15 nt, Pseudomonas aeruginosa PA01
aaccgauggccaggg

SEQ ID NO: 3515328 - RNA, 10 nt, Pseudomonas aeruginosa PA01
aaccgcaagc

SEQ ID NO: 3515329 - RNA, 21 nt, Pseudomonas aeruginosa PA01
aaccgccaucgauggucaggc

SEQ ID NO: 3515330 - RNA, 12 nt, Pseudomonas aeruginosa PA01
aaccgcgagcgg

SEQ ID NO: 3515331 - RNA, 10 nt, Pseudomonas aeruginosa PA01
aaccgcggcg

SEQ ID NO: 3515332 - RNA, 13 nt, Pseudomonas aeruginosa PA01
aaccgcggcgccc

SEQ ID NO: 3515333 - RNA, 18 nt, Pseudomonas aeruginosa PA01
aaccgcguugcgguuauu

SEQ ID NO: 3515334 - RNA, 13 nt, Pseudomonas aeruginosa PA01
aaccgcugccgcc

SEQ ID NO: 3515335 - RNA, 14 nt, Pseudomonas aeruginosa PA01
aaccgcugccgccg

SEQ ID NO: 3515336 - RNA, 15 nt, Pseudomonas aeruginosa PA01
aaccgcugccgccgu

SEQ ID NO: 3515337 - RNA, 23 nt, Pseudomonas aeruginosa PA01
aaccgcugccgccgucuccgccg

SEQ ID NO: 3515338 - RNA, 20 nt, Pseudomonas aeruginosa PA01
aaccggccauuacgccgagc

SEQ ID NO: 3515339 - RNA, 21 nt, Pseudomonas aeruginosa PA01
aaccggcgaugcucagcgccg

SEQ ID NO: 3515340 - RNA, 14 nt, Pseudomonas aeruginosa PA01
aaccggcguccggg

SEQ ID NO: 3515341 - RNA, 13 nt, Pseudomonas aeruginosa PA01
aaccgggcagcag

SEQ ID NO: 3515342 - RNA, 17 nt, Pseudomonas aeruginosa PA01
aaccggggcguuacagu

SEQ ID NO: 3515343 - RNA, 14 nt, Pseudomonas aeruginosa PA01
aaccgucgcccugg

SEQ ID NO: 3515344 - RNA, 19 nt, Pseudomonas aeruginosa PA01
aaccgucgcuggagcugcg

SEQ ID NO: 3515345 - RNA, 24 nt, Pseudomonas aeruginosa PA01
aaccgucggcaauucuucaagguc

SEQ ID NO: 3515346 - RNA, 13 nt, Pseudomonas aeruginosa PA01
aaccguuccagcg

SEQ ID NO: 3515347 - RNA, 17 nt, Pseudomonas aeruginosa PA01
aaccguuccagcgccuc

SEQ ID NO: 3515348 - RNA, 15 nt, Pseudomonas aeruginosa PA01
aaccguucugccgca

SEQ ID NO: 3515349 - RNA, 19 nt, Pseudomonas aeruginosa PA01
aaccguucugccgcagcgc

SEQ ID NO: 3515350 - RNA, 17 nt, Pseudomonas aeruginosa PA01
aaccucgccgaucuccu

SEQ ID NO: 3515351 - RNA, 20 nt, Pseudomonas aeruginosa PA01
aaccucgccggucagguagg

SEQ ID NO: 3515352 - RNA, 11 nt, Pseudomonas aeruginosa PA01
aaccucucccc

SEQ ID NO: 3515353 - RNA, 22 nt, Pseudomonas aeruginosa PA01
aaccucuccccagacccucucc

SEQ ID NO: 3515354 - RNA, 13 nt, Pseudomonas aeruginosa PA01
aaccugcauguca

SEQ ID NO: 3515355 - RNA, 17 nt, Pseudomonas aeruginosa PA01
aaccugccagaaaaccc

SEQ ID NO: 3515356 - RNA, 19 nt, Pseudomonas aeruginosa PA01
aaccugccagaaaacccag

SEQ ID NO: 3515357 - RNA, 21 nt, Pseudomonas aeruginosa PA01
aaccugccgaucgccgcgcgg

SEQ ID NO: 3515358 - RNA, 20 nt, Pseudomonas aeruginosa PA01
aaccugugcugcgcgccgca

SEQ ID NO: 3515359 - RNA, 22 nt, Pseudomonas aeruginosa PA01
aaccuguggaauguccugccgc

SEQ ID NO: 3515360 - RNA, 15 nt, Pseudomonas aeruginosa PA01
aaccuucgguggcga

SEQ ID NO: 3515361 - RNA, 12 nt, Pseudomonas aeruginosa PA01
aaccuucucccu

SEQ ID NO: 3515362 - RNA, 18 nt, Pseudomonas aeruginosa PA01
aacgaaaaaggcgcgccg

SEQ ID NO: 3515363 - RNA, 22 nt, Pseudomonas aeruginosa PA01
aacgaagacccccugcggcccg

SEQ ID NO: 3515364 - RNA, 19 nt, Pseudomonas aeruginosa PA01
aacgacagccccggcccgg

SEQ ID NO: 3515365 - RNA, 22 nt, Pseudomonas aeruginosa PA01
aacgacagccccggcccgguca

SEQ ID NO: 3515366 - RNA, 18 nt, Pseudomonas aeruginosa PA01
aacgaccacgccugccau

SEQ ID NO: 3515367 - RNA, 19 nt, Pseudomonas aeruginosa PA01
aacgaccgcccaggcugcc

SEQ ID NO: 3515368 - RNA, 13 nt, Pseudomonas aeruginosa PA01
aacgacuccagcu

SEQ ID NO: 3515369 - RNA, 14 nt, Pseudomonas aeruginosa PA01
aacgagagguugcu

SEQ ID NO: 3515370 - RNA, 21 nt, Pseudomonas aeruginosa PA01
aacgagagguugcuguagaau

SEQ ID NO: 3515371 - RNA, 19 nt, Pseudomonas aeruginosa PA01
aacgaguugggcgaccugc

SEQ ID NO: 3515372 - RNA, 23 nt, Pseudomonas aeruginosa PA01
aacgaguugggcgaccugcucga

SEQ ID NO: 3515373 - RNA, 18 nt, Pseudomonas aeruginosa PA01
aacgauaccgccgccggc

SEQ ID NO: 3515374 - RNA, 18 nt, Pseudomonas aeruginosa PA01
aacgaugguggucggcag

SEQ ID NO: 3515375 - RNA, 19 nt, Pseudomonas aeruginosa PA01
aacgcacuucguccgccac

SEQ ID NO: 3515376 - RNA, 20 nt, Pseudomonas aeruginosa PA01
aacgcacuucguccgccacc

SEQ ID NO: 3515377 - RNA, 22 nt, Pseudomonas aeruginosa PA01
aacgcacuucguccgccaccac

SEQ ID NO: 3515378 - RNA, 18 nt, Pseudomonas aeruginosa PA01
aacugcuuaccuugccgg

SEQ ID NO: 3515379 - RNA, 17 nt, Pseudomonas aeruginosa PA01
aacugcuucaggcgcgc

SEQ ID NO: 3515380 - RNA, 18 nt, Pseudomonas aeruginosa PA01
aacugcuucaggcgcgcg

SEQ ID NO: 3515381 - RNA, 20 nt, Pseudomonas aeruginosa PA01
aacugcuucaggcgcgcggc

SEQ ID NO: 3515382 - RNA, 11 nt, Pseudomonas aeruginosa PA01
aacugcuugcc

SEQ ID NO: 3515383 - RNA, 14 nt, Pseudomonas aeruginosa PA01
aacuggaagccugc

SEQ ID NO: 3515384 - RNA, 20 nt, Pseudomonas aeruginosa PA01
aacuggaagccugccagacc

SEQ ID NO: 3515385 - RNA, 17 nt, Pseudomonas aeruginosa PA01
aacuggauacgcuuggc

SEQ ID NO: 3515386 - RNA, 15 nt, Pseudomonas aeruginosa PA01
aacuggaucggcccc

SEQ ID NO: 3515387 - RNA, 19 nt, Pseudomonas aeruginosa PA01
aacuggaugaugguaucca

SEQ ID NO: 3515388 - RNA, 22 nt, Pseudomonas aeruginosa PA01
aacuggaugaugguauccaggc

SEQ ID NO: 3515389 - RNA, 21 nt, Pseudomonas aeruginosa PA01
aacuggaugucgcuggccagc

SEQ ID NO: 3515390 - RNA, 21 nt, Pseudomonas aeruginosa PA01
aacugggcgagcaucuucuuc

SEQ ID NO: 3515391 - RNA, 12 nt, Pseudomonas aeruginosa PA01
aacuggucgccg

SEQ ID NO: 3515392 - RNA, 14 nt, Pseudomonas aeruginosa PA01
aacuggucgccgca

SEQ ID NO: 3515393 - RNA, 19 nt, Pseudomonas aeruginosa PA01
aacuggucgccgcaggucc

SEQ ID NO: 3515394 - RNA, 20 nt, Pseudomonas aeruginosa PA01
aacuggucgccgcagguccg

SEQ ID NO: 3515395 - RNA, 20 nt, Pseudomonas aeruginosa PA01
aacuggucgcggcugcgcgc

SEQ ID NO: 3515396 - RNA, 17 nt, Pseudomonas aeruginosa PA01
aacuggucgcuccagcc

SEQ ID NO: 3515397 - RNA, 16 nt, Pseudomonas aeruginosa PA01
aacuggucggggcgca

SEQ ID NO: 3515398 - RNA, 18 nt, Pseudomonas aeruginosa PA01
aacugguuggccgccugg

SEQ ID NO: 3515399 - RNA, 22 nt, Pseudomonas aeruginosa PA01
aacugguuggccgccuggcgca

SEQ ID NO: 3515400 - RNA, 12 nt, Pseudomonas aeruginosa PA01
aacugucggcgg

SEQ ID NO: 3515401 - RNA, 16 nt, Pseudomonas aeruginosa PA01
aacuuccacucgccga

SEQ ID NO: 3515402 - RNA, 15 nt, Pseudomonas aeruginosa PA01
aacuugccggcgcca

SEQ ID NO: 3515403 - RNA, 20 nt, Pseudomonas aeruginosa PA01
aacuugcgccgaccgcgcgc

SEQ ID NO: 3515404 - RNA, 21 nt, Pseudomonas aeruginosa PA01
aacuuguagggcucguugaug

SEQ ID NO: 3515405 - RNA, 15 nt, Pseudomonas aeruginosa PA01
aacuugucgccgcug

SEQ ID NO: 3515406 - RNA, 22 nt, Pseudomonas aeruginosa PA01
aacuuuaggucugccucgccga

SEQ ID NO: 3515407 - RNA, 14 nt, Pseudomonas aeruginosa PA01
aagaaaagaaggcg

SEQ ID NO: 3515408 - RNA, 23 nt, Pseudomonas aeruginosa PA01
aagaaaaggccgcguaagcggcc

SEQ ID NO: 3515409 - RNA, 22 nt, Pseudomonas aeruginosa PA01
aagaacaucgccugcuuggcgg

SEQ ID NO: 3515410 - RNA, 14 nt, Pseudomonas aeruginosa PA01
aagaacgccccgca

SEQ ID NO: 3515411 - RNA, 14 nt, Pseudomonas aeruginosa PA01
aagaacggcccgcu

SEQ ID NO: 3515412 - RNA, 23 nt, Pseudomonas aeruginosa PA01
aagaacguauuuccccaacauca

SEQ ID NO: 3515413 - RNA, 20 nt, Pseudomonas aeruginosa PA01
aagaagccccgcagccgcgg

SEQ ID NO: 3515414 - RNA, 20 nt, Pseudomonas aeruginosa PA01
aagaagccgaucaccaccag

SEQ ID NO: 3515415 - RNA, 14 nt, Pseudomonas aeruginosa PA01
aagaagccgcacuu

SEQ ID NO: 3515416 - RNA, 14 nt, Pseudomonas aeruginosa PA01
aagaagccgcgcaa

SEQ ID NO: 3515417 - RNA, 23 nt, Pseudomonas aeruginosa PA01
aagaagcugccccacaggcccug

SEQ ID NO: 3515418 - RNA, 16 nt, Pseudomonas aeruginosa PA01
aagaagcugccggcau

SEQ ID NO: 3515419 - RNA, 19 nt, Pseudomonas aeruginosa PA01
aagaaguaaucaccuuccu

SEQ ID NO: 3515420 - RNA, 19 nt, Pseudomonas aeruginosa PA01
aagacaaaauucucccgcu

SEQ ID NO: 3515421 - RNA, 19 nt, Pseudomonas aeruginosa PA01
aagaccagcggagcgucgg

SEQ ID NO: 3515422 - RNA, 16 nt, Pseudomonas aeruginosa PA01
aagaccagggugggga

SEQ ID NO: 3515423 - RNA, 15 nt, Pseudomonas aeruginosa PA01
aagaccagucggccg

SEQ ID NO: 3515424 - RNA, 17 nt, Pseudomonas aeruginosa PA01
aagacccccugcggccc

SEQ ID NO: 3515425 - RNA, 19 nt, Pseudomonas aeruginosa PA01
aagacccggcguucgccgg

SEQ ID NO: 3515426 - RNA, 20 nt, Pseudomonas aeruginosa PA01
aagaccgaacaucagcagca

SEQ ID NO: 3515427 - RNA, 23 nt, Pseudomonas aeruginosa PA01
aagaccgaacaucagcagcagga

SEQ ID NO: 3515428 - RNA, 20 nt, Pseudomonas aeruginosa PA01
aagaccgaccaguaccagca

SEQ ID NO: 3515429 - RNA, 23 nt, Pseudomonas aeruginosa PA01
aagaccugguccaacgggcucgu

SEQ ID NO: 3515430 - RNA, 15 nt, Pseudomonas aeruginosa PA01
aagacgcccagcagg

SEQ ID NO: 3515431 - RNA, 20 nt, Pseudomonas aeruginosa PA01
aagacgcugcgaccuggcgc

SEQ ID NO: 3515432 - RNA, 15 nt, Pseudomonas aeruginosa PA01
aagacguuccgcgau

SEQ ID NO: 3515433 - RNA, 13 nt, Pseudomonas aeruginosa PA01
aagagagcgccag

SEQ ID NO: 3515434 - RNA, 18 nt, Pseudomonas aeruginosa PA01
aagagcagacacaaaaaa

SEQ ID NO: 3515435 - RNA, 13 nt, Pseudomonas aeruginosa PA01
aagagcagcgcgg

SEQ ID NO: 3515436 - RNA, 18 nt, Pseudomonas aeruginosa PA01
aagaggcgcucaacgccu

SEQ ID NO: 3515437 - RNA, 20 nt, Pseudomonas aeruginosa PA01
aagaguguucccucaggaua

SEQ ID NO: 3515438 - RNA, 13 nt, Pseudomonas aeruginosa PA01
aagauaucgccuu

SEQ ID NO: 3515439 - RNA, 18 nt, Pseudomonas aeruginosa PA01
aagauccgcuccaggcug

SEQ ID NO: 3515440 - RNA, 13 nt, Pseudomonas aeruginosa PA01
aagauccuguagu

SEQ ID NO: 3515441 - RNA, 22 nt, Pseudomonas aeruginosa PA01
aagauggcuaaacaagccaccu

SEQ ID NO: 3515442 - RNA, 18 nt, Pseudomonas aeruginosa PA01
aagcaccgacacgcacuc

SEQ ID NO: 3515443 - RNA, 16 nt, Pseudomonas aeruginosa PA01
aagcacggcucggcga

SEQ ID NO: 3515444 - RNA, 17 nt, Pseudomonas aeruginosa PA01
aagcacggugacacccu

SEQ ID NO: 3515445 - RNA, 14 nt, Pseudomonas aeruginosa PA01
aagcagccauggcu

SEQ ID NO: 3515446 - RNA, 23 nt, Pseudomonas aeruginosa PA01
aagcagggcgauggccagcgcgu

SEQ ID NO: 3515447 - RNA, 16 nt, Pseudomonas aeruginosa PA01
aagcaguaguaccaau

SEQ ID NO: 3515448 - RNA, 14 nt, Pseudomonas aeruginosa PA01
aagcauggccggcu

SEQ ID NO: 3515449 - RNA, 15 nt, Pseudomonas aeruginosa PA01
aagcauucagcgcgc

SEQ ID NO: 3515450 - RNA, 11 nt, Pseudomonas aeruginosa PA01
aagccagccag

SEQ ID NO: 3515451 - RNA, 15 nt, Pseudomonas aeruginosa PA01
aagccagccaggucg

SEQ ID NO: 3515452 - RNA, 18 nt, Pseudomonas aeruginosa PA01
aagccaugcccagacgcc

SEQ ID NO: 3515453 - RNA, 12 nt, Pseudomonas aeruginosa PA01
aagcccagcagg

SEQ ID NO: 3515454 - RNA, 23 nt, Pseudomonas aeruginosa PA01
aagcccagcgagccgaucaccag

SEQ ID NO: 3515455 - RNA, 13 nt, Pseudomonas aeruginosa PA01
aagcccagcgccg

SEQ ID NO: 3515456 - RNA, 19 nt, Pseudomonas aeruginosa PA01
aagcccaggcgcucggcgg

SEQ ID NO: 3515457 - RNA, 17 nt, Pseudomonas aeruginosa PA01
aagcccaggcugacccg

SEQ ID NO: 3515458 - RNA, 19 nt, Pseudomonas aeruginosa PA01
aagcccagguacugggcga

SEQ ID NO: 3515459 - RNA, 20 nt, Pseudomonas aeruginosa PA01
aagcccagguggcaggccug

SEQ ID NO: 3515460 - RNA, 16 nt, Pseudomonas aeruginosa PA01
aagcccaucgacugca

SEQ ID NO: 3515461 - RNA, 15 nt, Pseudomonas aeruginosa PA01
aagccccugcgccuc

SEQ ID NO: 3515462 - RNA, 21 nt, Pseudomonas aeruginosa PA01
aagcccgccuugauggcgggc

SEQ ID NO: 3515463 - RNA, 13 nt, Pseudomonas aeruginosa PA01
aagcccgcuccgu

SEQ ID NO: 3515464 - RNA, 21 nt, Pseudomonas aeruginosa PA01
aagcccggcaauagccgggcu

SEQ ID NO: 3515465 - RNA, 15 nt, Pseudomonas aeruginosa PA01
aagcccggccgcugc

SEQ ID NO: 3515466 - RNA, 21 nt, Pseudomonas aeruginosa PA01
aagcccggccgcugccgggcu

SEQ ID NO: 3515467 - RNA, 16 nt, Pseudomonas aeruginosa PA01
aagcccggccuggugc

SEQ ID NO: 3515468 - RNA, 17 nt, Pseudomonas aeruginosa PA01
aagcccggcgagagcgu

SEQ ID NO: 3515469 - RNA, 19 nt, Pseudomonas aeruginosa PA01
aagcccgugggaucgccac

SEQ ID NO: 3515470 - RNA, 14 nt, Pseudomonas aeruginosa PA01
aagcccgugucgcc

SEQ ID NO: 3515471 - RNA, 17 nt, Pseudomonas aeruginosa PA01
aagcccucgcgacggca

SEQ ID NO: 3515472 - RNA, 20 nt, Pseudomonas aeruginosa PA01
aagcccugcaaagcggcgac

SEQ ID NO: 3515473 - RNA, 19 nt, Pseudomonas aeruginosa PA01
aagcccuucugucuugucc

SEQ ID NO: 3515474 - RNA, 21 nt, Pseudomonas aeruginosa PA01
aagcccuuguucgggucgcgg

SEQ ID NO: 3515475 - RNA, 15 nt, Pseudomonas aeruginosa PA01
aagccgaccggcgcc

SEQ ID NO: 3515476 - RNA, 17 nt, Pseudomonas aeruginosa PA01
aagccgaccggcgccgg

SEQ ID NO: 3515477 - RNA, 18 nt, Pseudomonas aeruginosa PA01
aagccgaccggcgccggg

SEQ ID NO: 3515478 - RNA, 19 nt, Pseudomonas aeruginosa PA01
aagccgacgccgagcagca

SEQ ID NO: 3515479 - RNA, 14 nt, Pseudomonas aeruginosa PA01
aagccgagcggcaa

SEQ ID NO: 3515480 - RNA, 19 nt, Pseudomonas aeruginosa PA01
aaggaccugcugcccggca

SEQ ID NO: 3515481 - RNA, 14 nt, Pseudomonas aeruginosa PA01
aaggagcgcgagcg

SEQ ID NO: 3515482 - RNA, 18 nt, Pseudomonas aeruginosa PA01
aaggagcgcgagcggcag

SEQ ID NO: 3515483 - RNA, 14 nt, Pseudomonas aeruginosa PA01
aaggaucgagccag

SEQ ID NO: 3515484 - RNA, 14 nt, Pseudomonas aeruginosa PA01
aaggauguccgggu

SEQ ID NO: 3515485 - RNA, 21 nt, Pseudomonas aeruginosa PA01
aaggcaccaccgccgccagca

SEQ ID NO: 3515486 - RNA, 23 nt, Pseudomonas aeruginosa PA01
aaggcaccaccgccgccagcaac

SEQ ID NO: 3515487 - RNA, 12 nt, Pseudomonas aeruginosa PA01
aaggcacgcccc

SEQ ID NO: 3515488 - RNA, 13 nt, Pseudomonas aeruginosa PA01
aaggcagcguccg

SEQ ID NO: 3515489 - RNA, 18 nt, Pseudomonas aeruginosa PA01
aaggcauauccccucuca

SEQ ID NO: 3515490 - RNA, 13 nt, Pseudomonas aeruginosa PA01
aaggcaugcccag

SEQ ID NO: 3515491 - RNA, 15 nt, Pseudomonas aeruginosa PA01
aaggcaugcccaggc

SEQ ID NO: 3515492 - RNA, 17 nt, Pseudomonas aeruginosa PA01
aaggcaugcccaggcuc

SEQ ID NO: 3515493 - RNA, 20 nt, Pseudomonas aeruginosa PA01
aaggccaccagagccagccg

SEQ ID NO: 3515494 - RNA, 15 nt, Pseudomonas aeruginosa PA01
aaggccacgccgccg

SEQ ID NO: 3515495 - RNA, 24 nt, Pseudomonas aeruginosa PA01
aaggccagcggcauccgccgcugg

SEQ ID NO: 3515496 - RNA, 14 nt, Pseudomonas aeruginosa PA01
aaggccaggaccgc

SEQ ID NO: 3515497 - RNA, 11 nt, Pseudomonas aeruginosa PA01
aaggccaggcc

SEQ ID NO: 3515498 - RNA, 13 nt, Pseudomonas aeruginosa PA01
aaggccaggccgg

SEQ ID NO: 3515499 - RNA, 17 nt, Pseudomonas aeruginosa PA01
aaggccaggccggcgcc

SEQ ID NO: 3515500 - RNA, 11 nt, Pseudomonas aeruginosa PA01
aaggccaggcu

SEQ ID NO: 3515501 - RNA, 10 nt, Pseudomonas aeruginosa PA01
aaggccaggg

SEQ ID NO: 3515502 - RNA, 13 nt, Pseudomonas aeruginosa PA01
aaggccaggucgc

SEQ ID NO: 3515503 - RNA, 18 nt, Pseudomonas aeruginosa PA01
aaggccaggucgcccacc

SEQ ID NO: 3515504 - RNA, 17 nt, Pseudomonas aeruginosa PA01
aaggccaguccggcacc

SEQ ID NO: 3515505 - RNA, 18 nt, Pseudomonas aeruginosa PA01
aaggcccgcgagccgcgc

SEQ ID NO: 3515506 - RNA, 20 nt, Pseudomonas aeruginosa PA01
aaggcccgcgagccgcgcag

SEQ ID NO: 3515507 - RNA, 11 nt, Pseudomonas aeruginosa PA01
aaggcccggag

SEQ ID NO: 3515508 - RNA, 20 nt, Pseudomonas aeruginosa PA01
aaggcccggcguccucgcga

SEQ ID NO: 3515509 - RNA, 21 nt, Pseudomonas aeruginosa PA01
aaggcccggucuagccgggcc

SEQ ID NO: 3515510 - RNA, 15 nt, Pseudomonas aeruginosa PA01
aaggcccugcugcag

SEQ ID NO: 3515511 - RNA, 17 nt, Pseudomonas aeruginosa PA01
aaggccgaacgguaggu

SEQ ID NO: 3515512 - RNA, 17 nt, Pseudomonas aeruginosa PA01
aaggccgaagaggcccu

SEQ ID NO: 3515513 - RNA, 18 nt, Pseudomonas aeruginosa PA01
aaggccgaagaggcccuc

SEQ ID NO: 3515514 - RNA, 18 nt, Pseudomonas aeruginosa PA01
aaggccgccacggcgguu

SEQ ID NO: 3515515 - RNA, 13 nt, Pseudomonas aeruginosa PA01
aaggccgcgccgg

SEQ ID NO: 3515516 - RNA, 14 nt, Pseudomonas aeruginosa PA01
aaggccgcgccgga

SEQ ID NO: 3515517 - RNA, 18 nt, Pseudomonas aeruginosa PA01
aaggccgcguaagcggcc

SEQ ID NO: 3515518 - RNA, 21 nt, Pseudomonas aeruginosa PA01
aaggccgcuucgccgcccucg

SEQ ID NO: 3515519 - RNA, 19 nt, Pseudomonas aeruginosa PA01
aaggccguuguagagacag

SEQ ID NO: 3515520 - RNA, 23 nt, Pseudomonas aeruginosa PA01
aaggccuccucguaggcguccug

SEQ ID NO: 3515521 - RNA, 13 nt, Pseudomonas aeruginosa PA01
aaggccucgucgc

SEQ ID NO: 3515522 - RNA, 15 nt, Pseudomonas aeruginosa PA01
aaggccucgucgccc

SEQ ID NO: 3515523 - RNA, 21 nt, Pseudomonas aeruginosa PA01
aaggccucgucgcccggauag

SEQ ID NO: 3515524 - RNA, 22 nt, Pseudomonas aeruginosa PA01
aaggccugacgcaagcgcucgg

SEQ ID NO: 3515525 - RNA, 21 nt, Pseudomonas aeruginosa PA01
aaggccugcgcuuccggcagc

SEQ ID NO: 3515526 - RNA, 19 nt, Pseudomonas aeruginosa PA01
aaggcgaaacguccggcgu

SEQ ID NO: 3515527 - RNA, 21 nt, Pseudomonas aeruginosa PA01
aaggcgagggugaacuggccg

SEQ ID NO: 3515528 - RNA, 17 nt, Pseudomonas aeruginosa PA01
aaggcgaucaucgccac

SEQ ID NO: 3515529 - RNA, 18 nt, Pseudomonas aeruginosa PA01
aaggcgaucaucgccacc

SEQ ID NO: 3515530 - RNA, 21 nt, Pseudomonas aeruginosa PA01
aaggcgaucgaaggaucgccu

SEQ ID NO: 3515531 - RNA, 22 nt, Pseudomonas aeruginosa PA01
aaggcgauguaggucaccgcgc

SEQ ID NO: 3515532 - RNA, 13 nt, Pseudomonas aeruginosa PA01
aaggcgccggcau

SEQ ID NO: 3515533 - RNA, 19 nt, Pseudomonas aeruginosa PA01
aaggcgcgcaccagcgggu

SEQ ID NO: 3515534 - RNA, 21 nt, Pseudomonas aeruginosa PA01
aaggcgcgcagggccgcggcg

SEQ ID NO: 3515535 - RNA, 20 nt, Pseudomonas aeruginosa PA01
aaggcgcggcggaagaauac

SEQ ID NO: 3515536 - RNA, 19 nt, Pseudomonas aeruginosa PA01
aaggcgcggggcgaggucg

SEQ ID NO: 3515537 - RNA, 17 nt, Pseudomonas aeruginosa PA01
aaggcgcuccggaacgc

SEQ ID NO: 3515538 - RNA, 15 nt, Pseudomonas aeruginosa PA01
aaggcgcugaagcgg

SEQ ID NO: 3515539 - RNA, 11 nt, Pseudomonas aeruginosa PA01
aaggcgcuggc

SEQ ID NO: 3515540 - RNA, 13 nt, Pseudomonas aeruginosa PA01
aaggcgcuggcgc

SEQ ID NO: 3515541 - RNA, 21 nt, Pseudomonas aeruginosa PA01
aaggcgcugggcggcuggccg

SEQ ID NO: 3515542 - RNA, 18 nt, Pseudomonas aeruginosa PA01
aaggcggcgaagucugcc

SEQ ID NO: 3515543 - RNA, 14 nt, Pseudomonas aeruginosa PA01
aaggcggcgcggcg

SEQ ID NO: 3515544 - RNA, 21 nt, Pseudomonas aeruginosa PA01
aaggcggucagcaguugccgg

SEQ ID NO: 3515545 - RNA, 20 nt, Pseudomonas aeruginosa PA01
aaggcggugaccagcggcac

SEQ ID NO: 3515546 - RNA, 13 nt, Pseudomonas aeruginosa PA01
aaggcguccaggg

SEQ ID NO: 3515547 - RNA, 12 nt, Pseudomonas aeruginosa PA01
aaggcgucgccg

SEQ ID NO: 3515548 - RNA, 18 nt, Pseudomonas aeruginosa PA01
aaggcgugggcgccggcg

SEQ ID NO: 3515549 - RNA, 22 nt, Pseudomonas aeruginosa PA01
aaggcguucucguccucggcgu

SEQ ID NO: 3515550 - RNA, 17 nt, Pseudomonas aeruginosa PA01
aaggcuccgcugcucag

SEQ ID NO: 3515551 - RNA, 21 nt, Pseudomonas aeruginosa PA01
aaggcucguucguagaucccu

SEQ ID NO: 3515552 - RNA, 17 nt, Pseudomonas aeruginosa PA01
aaggcugcuucggcagc

SEQ ID NO: 3515553 - RNA, 12 nt, Pseudomonas aeruginosa PA01
aaggcuugccac

SEQ ID NO: 3515554 - RNA, 22 nt, Pseudomonas aeruginosa PA01
aaggcuugccacugcgcgccag

SEQ ID NO: 3515555 - RNA, 17 nt, Pseudomonas aeruginosa PA01
aagggaaacaccaggcc

SEQ ID NO: 3515556 - RNA, 15 nt, Pseudomonas aeruginosa PA01
aagggacgucgccag

SEQ ID NO: 3515557 - RNA, 23 nt, Pseudomonas aeruginosa PA01
aagggacgucgccagggaggcga

SEQ ID NO: 3515558 - RNA, 13 nt, Pseudomonas aeruginosa PA01
aagggagccaggc

SEQ ID NO: 3515559 - RNA, 14 nt, Pseudomonas aeruginosa PA01
aagggagccaggcg

SEQ ID NO: 3515560 - RNA, 15 nt, Pseudomonas aeruginosa PA01
aagggaugccgccgg

SEQ ID NO: 3515561 - RNA, 15 nt, Pseudomonas aeruginosa PA01
aagggaugccggcgg

SEQ ID NO: 3515562 - RNA, 12 nt, Pseudomonas aeruginosa PA01
aagggccagagc

SEQ ID NO: 3515563 - RNA, 17 nt, Pseudomonas aeruginosa PA01
aagggcccgaacgggcc

SEQ ID NO: 3515564 - RNA, 12 nt, Pseudomonas aeruginosa PA01
aagggccgcagg

SEQ ID NO: 3515565 - RNA, 15 nt, Pseudomonas aeruginosa PA01
aagggccugcucagc

SEQ ID NO: 3515566 - RNA, 12 nt, Pseudomonas aeruginosa PA01
aagggcgccgcc

SEQ ID NO: 3515567 - RNA, 17 nt, Pseudomonas aeruginosa PA01
aagggcgccgccgagga

SEQ ID NO: 3515568 - RNA, 12 nt, Pseudomonas aeruginosa PA01
aagggcgcgccc

SEQ ID NO: 3515569 - RNA, 19 nt, Pseudomonas aeruginosa PA01
aagggcggcagcacgauga

SEQ ID NO: 3515570 - RNA, 15 nt, Pseudomonas aeruginosa PA01
aaggggaugccaugg

SEQ ID NO: 3515571 - RNA, 12 nt, Pseudomonas aeruginosa PA01
aaggggccgcgc

SEQ ID NO: 3515572 - RNA, 14 nt, Pseudomonas aeruginosa PA01
aaggggcggcucgg

SEQ ID NO: 3515573 - RNA, 20 nt, Pseudomonas aeruginosa PA01
aaggggcggcucggcuccag

SEQ ID NO: 3515574 - RNA, 22 nt, Pseudomonas aeruginosa PA01
aagggucugcuugcgcuggccg

SEQ ID NO: 3515575 - RNA, 20 nt, Pseudomonas aeruginosa PA01
aaggguuggccgcagcagcg

SEQ ID NO: 3515576 - RNA, 22 nt, Pseudomonas aeruginosa PA01
aaggguuggccgcagcagcggc

SEQ ID NO: 3515577 - RNA, 19 nt, Pseudomonas aeruginosa PA01
aagguaaggauguccgggu

SEQ ID NO: 3515578 - RNA, 19 nt, Pseudomonas aeruginosa PA01
aagguacggggcugcggcc

SEQ ID NO: 3515579 - RNA, 16 nt, Pseudomonas aeruginosa PA01
aagguagcggucgggu

SEQ ID NO: 3515580 - RNA, 22 nt, Pseudomonas aeruginosa PA01
aaggucaccgaaaggcucuugg

SEQ ID NO: 3515581 - RNA, 16 nt, Pseudomonas aeruginosa PA01
aagguccgcgccaugc

SEQ ID NO: 3515582 - RNA, 17 nt, Pseudomonas aeruginosa PA01
aaggucgccgggcucac

SEQ ID NO: 3515583 - RNA, 17 nt, Pseudomonas aeruginosa PA01
aauggcagaacaucgcc

SEQ ID NO: 3515584 - RNA, 20 nt, Pseudomonas aeruginosa PA01
aauggccgcuucaagcggcc

SEQ ID NO: 3515585 - RNA, 16 nt, Pseudomonas aeruginosa PA01
aauggcgcuccagggc

SEQ ID NO: 3515586 - RNA, 17 nt, Pseudomonas aeruginosa PA01
aauggcgcuccagggcg

SEQ ID NO: 3515587 - RNA, 17 nt, Pseudomonas aeruginosa PA01
aauggcggacgaucacu

SEQ ID NO: 3515588 - RNA, 20 nt, Pseudomonas aeruginosa PA01
aauggcggauaaccgcaagc

SEQ ID NO: 3515589 - RNA, 18 nt, Pseudomonas aeruginosa PA01
aauggcguggcuuggccc

SEQ ID NO: 3515590 - RNA, 19 nt, Pseudomonas aeruginosa PA01
aauggcguggcuuggcccu

SEQ ID NO: 3515591 - RNA, 20 nt, Pseudomonas aeruginosa PA01
aauggcguggcuuggcccug

SEQ ID NO: 3515592 - RNA, 14 nt, Pseudomonas aeruginosa PA01
aauggcuugcgacc

SEQ ID NO: 3515593 - RNA, 18 nt, Pseudomonas aeruginosa PA01
aauggguucccagcagca

SEQ ID NO: 3515594 - RNA, 16 nt, Pseudomonas aeruginosa PA01
aaugguggaccagcgc

SEQ ID NO: 3515595 - RNA, 17 nt, Pseudomonas aeruginosa PA01
aaugguggaccagcgcc

SEQ ID NO: 3515596 - RNA, 15 nt, Pseudomonas aeruginosa PA01
aauguccgagcaggu

SEQ ID NO: 3515597 - RNA, 18 nt, Pseudomonas aeruginosa PA01
aauguccugccgcaggcg

SEQ ID NO: 3515598 - RNA, 14 nt, Pseudomonas aeruginosa PA01
aauguucuccuccc

SEQ ID NO: 3515599 - RNA, 22 nt, Pseudomonas aeruginosa PA01
aauucgcagagaucggcggcgc

SEQ ID NO: 3515600 - RNA, 15 nt, Pseudomonas aeruginosa PA01
aauucgcggacgccg

SEQ ID NO: 3515601 - RNA, 15 nt, Pseudomonas aeruginosa PA01
aauucgcguccacca

SEQ ID NO: 3515602 - RNA, 13 nt, Pseudomonas aeruginosa PA01
aauucgucgccgc

SEQ ID NO: 3515603 - RNA, 18 nt, Pseudomonas aeruginosa PA01
aauucgucgccgccgagg

SEQ ID NO: 3515604 - RNA, 22 nt, Pseudomonas aeruginosa PA01
aauugcaccgcuugccagccgc

SEQ ID NO: 3515605 - RNA, 15 nt, Pseudomonas aeruginosa PA01
aauugcaggcccggc

SEQ ID NO: 3515606 - RNA, 24 nt, Pseudomonas aeruginosa PA01
aauugcaggcccggccgccugccu

SEQ ID NO: 3515607 - RNA, 14 nt, Pseudomonas aeruginosa PA01
aauugcccguaggg

SEQ ID NO: 3515608 - RNA, 15 nt, Pseudomonas aeruginosa PA01
aauugccgguagccg

SEQ ID NO: 3515609 - RNA, 20 nt, Pseudomonas aeruginosa PA01
aauugccgguagccggcgau

SEQ ID NO: 3515610 - RNA, 22 nt, Pseudomonas aeruginosa PA01
aauugccuccgcucugcuggcc

SEQ ID NO: 3515611 - RNA, 19 nt, Pseudomonas aeruginosa PA01
aauugcgagcgagcuugca

SEQ ID NO: 3515612 - RNA, 20 nt, Pseudomonas aeruginosa PA01
aauugcgcacgcaauagugc

SEQ ID NO: 3515613 - RNA, 23 nt, Pseudomonas aeruginosa PA01
aauugcuccgguucggcaaggcg

SEQ ID NO: 3515614 - RNA, 13 nt, Pseudomonas aeruginosa PA01
aauuucuuccauc

SEQ ID NO: 3515615 - RNA, 20 nt, Pseudomonas aeruginosa PA01
aauuugaacgcuguagaaug

SEQ ID NO: 3515616 - RNA, 17 nt, Pseudomonas aeruginosa PA01
aauuuucccuuugcaaa

SEQ ID NO: 3515617 - RNA, 16 nt, Pseudomonas aeruginosa PA01
aauuuucgaaaauaac

SEQ ID NO: 3515618 - RNA, 21 nt, Pseudomonas aeruginosa PA01
acaaaaaagcccgccaggugg

SEQ ID NO: 3515619 - RNA, 13 nt, Pseudomonas aeruginosa PA01
acaacaggccggg

SEQ ID NO: 3515620 - RNA, 21 nt, Pseudomonas aeruginosa PA01
acaaccagccaugcaggcugc

SEQ ID NO: 3515621 - RNA, 13 nt, Pseudomonas aeruginosa PA01
acaacccgccagc

SEQ ID NO: 3515622 - RNA, 22 nt, Pseudomonas aeruginosa PA01
acaacccgccagcaagacgguc

SEQ ID NO: 3515623 - RNA, 20 nt, Pseudomonas aeruginosa PA01
acaacccggcgcuggccgcg

SEQ ID NO: 3515624 - RNA, 21 nt, Pseudomonas aeruginosa PA01
acaacccggcgcuggccgcgc

SEQ ID NO: 3515625 - RNA, 20 nt, Pseudomonas aeruginosa PA01
acaaccgcucgcgguuaucc

SEQ ID NO: 3515626 - RNA, 21 nt, Pseudomonas aeruginosa PA01
acaaccgcuugucgccuuccc

SEQ ID NO: 3515627 - RNA, 15 nt, Pseudomonas aeruginosa PA01
acaacgacagccccg

SEQ ID NO: 3515628 - RNA, 16 nt, Pseudomonas aeruginosa PA01
acaacggcaucggcca

SEQ ID NO: 3515629 - RNA, 13 nt, Pseudomonas aeruginosa PA01
acaagaauaggaa

SEQ ID NO: 3515630 - RNA, 22 nt, Pseudomonas aeruginosa PA01
acaagccaccuucgaucaccuu

SEQ ID NO: 3515631 - RNA, 12 nt, Pseudomonas aeruginosa PA01
acaagcccagcu

SEQ ID NO: 3515632 - RNA, 13 nt, Pseudomonas aeruginosa PA01
acaagcccagcuc

SEQ ID NO: 3515633 - RNA, 14 nt, Pseudomonas aeruginosa PA01
acaagccuccagcg

SEQ ID NO: 3515634 - RNA, 18 nt, Pseudomonas aeruginosa PA01
acaagccuccagcgccgc

SEQ ID NO: 3515635 - RNA, 17 nt, Pseudomonas aeruginosa PA01
acaagcgcaacgcgcgc

SEQ ID NO: 3515636 - RNA, 23 nt, Pseudomonas aeruginosa PA01
acaagcguuaccggcagguggcc

SEQ ID NO: 3515637 - RNA, 14 nt, Pseudomonas aeruginosa PA01
acaagggccagagc

SEQ ID NO: 3515638 - RNA, 14 nt, Pseudomonas aeruginosa PA01
acaaucagcggcgg

SEQ ID NO: 3515639 - RNA, 19 nt, Pseudomonas aeruginosa PA01
acaaucccagcucgccgaa

SEQ ID NO: 3515640 - RNA, 23 nt, Pseudomonas aeruginosa PA01
acaaucuugucguucggcccgac

SEQ ID NO: 3515641 - RNA, 18 nt, Pseudomonas aeruginosa PA01
acacaaaaaaaccgcccc

SEQ ID NO: 3515642 - RNA, 13 nt, Pseudomonas aeruginosa PA01
acacaaaaaaccc

SEQ ID NO: 3515643 - RNA, 14 nt, Pseudomonas aeruginosa PA01
acacaaaaaacccg

SEQ ID NO: 3515644 - RNA, 17 nt, Pseudomonas aeruginosa PA01
acacacccugcgcaagg

SEQ ID NO: 3515645 - RNA, 18 nt, Pseudomonas aeruginosa PA01
acacacgcuucugcuggc

SEQ ID NO: 3515646 - RNA, 20 nt, Pseudomonas aeruginosa PA01
acacacgcuucugcuggccg

SEQ ID NO: 3515647 - RNA, 22 nt, Pseudomonas aeruginosa PA01
acacacgcuucugcuggccgcg

SEQ ID NO: 3515648 - RNA, 18 nt, Pseudomonas aeruginosa PA01
acacaggacgagacgccg

SEQ ID NO: 3515649 - RNA, 22 nt, Pseudomonas aeruginosa PA01
acacaucgaccaggucgccaug

SEQ ID NO: 3515650 - RNA, 18 nt, Pseudomonas aeruginosa PA01
acaccagauggcugguca

SEQ ID NO: 3515651 - RNA, 12 nt, Pseudomonas aeruginosa PA01
acaccagcaaac

SEQ ID NO: 3515652 - RNA, 17 nt, Pseudomonas aeruginosa PA01
acaccagcgccgccagg

SEQ ID NO: 3515653 - RNA, 16 nt, Pseudomonas aeruginosa PA01
acaccaggagcgccag

SEQ ID NO: 3515654 - RNA, 22 nt, Pseudomonas aeruginosa PA01
acaccaggagcgccagcaccag

SEQ ID NO: 3515655 - RNA, 14 nt, Pseudomonas aeruginosa PA01
acaccaggccggcg

SEQ ID NO: 3515656 - RNA, 18 nt, Pseudomonas aeruginosa PA01
acaccaggccggcggccg

SEQ ID NO: 3515657 - RNA, 13 nt, Pseudomonas aeruginosa PA01
acaccaggcgcca

SEQ ID NO: 3515658 - RNA, 16 nt, Pseudomonas aeruginosa PA01
acaccaggcgccaggg

SEQ ID NO: 3515659 - RNA, 21 nt, Pseudomonas aeruginosa PA01
acaccaggguggcgcgcacca

SEQ ID NO: 3515660 - RNA, 13 nt, Pseudomonas aeruginosa PA01
acaccagguuggc

SEQ ID NO: 3515661 - RNA, 17 nt, Pseudomonas aeruginosa PA01
acacccagaagccgacc

SEQ ID NO: 3515662 - RNA, 21 nt, Pseudomonas aeruginosa PA01
acacccaggccuggguguugu

SEQ ID NO: 3515663 - RNA, 13 nt, Pseudomonas aeruginosa PA01
acacccagggcag

SEQ ID NO: 3515664 - RNA, 20 nt, Pseudomonas aeruginosa PA01
acaccccgaaguagcgacgg

SEQ ID NO: 3515665 - RNA, 16 nt, Pseudomonas aeruginosa PA01
acaccccgucaacccu

SEQ ID NO: 3515666 - RNA, 14 nt, Pseudomonas aeruginosa PA01
acaccccgucucgc

SEQ ID NO: 3515667 - RNA, 16 nt, Pseudomonas aeruginosa PA01
acacccgcgccgccgc

SEQ ID NO: 3515668 - RNA, 15 nt, Pseudomonas aeruginosa PA01
acacccgguccugca

SEQ ID NO: 3515669 - RNA, 18 nt, Pseudomonas aeruginosa PA01
acacccgguccugcaacu

SEQ ID NO: 3515670 - RNA, 23 nt, Pseudomonas aeruginosa PA01
acacccgguccugcaacuggaag

SEQ ID NO: 3515671 - RNA, 22 nt, Pseudomonas aeruginosa PA01
acacccggucgcgcuggaccug

SEQ ID NO: 3515672 - RNA, 17 nt, Pseudomonas aeruginosa PA01
acacccugccgcgccgg

SEQ ID NO: 3515673 - RNA, 23 nt, Pseudomonas aeruginosa PA01
acacccugcgcaaggaacuggaa

SEQ ID NO: 3515674 - RNA, 22 nt, Pseudomonas aeruginosa PA01
acaccgaagucgcccgccggcg

SEQ ID NO: 3515675 - RNA, 14 nt, Pseudomonas aeruginosa PA01
acaccgacaaucgc

SEQ ID NO: 3515676 - RNA, 14 nt, Pseudomonas aeruginosa PA01
acaccgaccgcgag

SEQ ID NO: 3515677 - RNA, 15 nt, Pseudomonas aeruginosa PA01
acaccgaccgcgagu

SEQ ID NO: 3515678 - RNA, 21 nt, Pseudomonas aeruginosa PA01
acaccgaucaccuggccggug

SEQ ID NO: 3515679 - RNA, 15 nt, Pseudomonas aeruginosa PA01
acaccgccagcaccu

SEQ ID NO: 3515680 - RNA, 23 nt, Pseudomonas aeruginosa PA01
acaccgcgcagaugaucgccacc

SEQ ID NO: 3515681 - RNA, 15 nt, Pseudomonas aeruginosa PA01
acaccgcgcgcgccu

SEQ ID NO: 3515682 - RNA, 23 nt, Pseudomonas aeruginosa PA01
acaccgcgcggcacagcguggcc

SEQ ID NO: 3515683 - RNA, 13 nt, Pseudomonas aeruginosa PA01
acaccgcugcgcc

SEQ ID NO: 3515684 - RNA, 16 nt, Pseudomonas aeruginosa PA01
acaccgcugcgccgcc

SEQ ID NO: 3515685 - RNA, 20 nt, Pseudomonas aeruginosa PA01
acagcucggucucgaucggc

SEQ ID NO: 3515686 - RNA, 22 nt, Pseudomonas aeruginosa PA01
acagcucggucucgaucggccc

SEQ ID NO: 3515687 - RNA, 19 nt, Pseudomonas aeruginosa PA01
acagcucguggcuggcgcc

SEQ ID NO: 3515688 - RNA, 20 nt, Pseudomonas aeruginosa PA01
acagcucguggcuggcgccg

SEQ ID NO: 3515689 - RNA, 22 nt, Pseudomonas aeruginosa PA01
acagcucuggggucaguucguu

SEQ ID NO: 3515690 - RNA, 13 nt, Pseudomonas aeruginosa PA01
acagcugcaccgc

SEQ ID NO: 3515691 - RNA, 14 nt, Pseudomonas aeruginosa PA01
acagcugcaccgcg

SEQ ID NO: 3515692 - RNA, 14 nt, Pseudomonas aeruginosa PA01
acagcugccagccc

SEQ ID NO: 3515693 - RNA, 16 nt, Pseudomonas aeruginosa PA01
acagcugccagccccg

SEQ ID NO: 3515694 - RNA, 17 nt, Pseudomonas aeruginosa PA01
acagcuguccgcgccgc

SEQ ID NO: 3515695 - RNA, 20 nt, Pseudomonas aeruginosa PA01
acagcuguccgcgccgcguc

SEQ ID NO: 3515696 - RNA, 22 nt, Pseudomonas aeruginosa PA01
acagcuugacccguugcgccuc

SEQ ID NO: 3515697 - RNA, 14 nt, Pseudomonas aeruginosa PA01
acaggaagcgguag

SEQ ID NO: 3515698 - RNA, 15 nt, Pseudomonas aeruginosa PA01
acaggacugugcuua

SEQ ID NO: 3515699 - RNA, 18 nt, Pseudomonas aeruginosa PA01
acaggaucuccucggcca

SEQ ID NO: 3515700 - RNA, 14 nt, Pseudomonas aeruginosa PA01
acaggauggacagc

SEQ ID NO: 3515701 - RNA, 20 nt, Pseudomonas aeruginosa PA01
acaggaugggcgaagccggc

SEQ ID NO: 3515702 - RNA, 18 nt, Pseudomonas aeruginosa PA01
acaggcaaagaccgacca

SEQ ID NO: 3515703 - RNA, 15 nt, Pseudomonas aeruginosa PA01
acaggcagccggcca

SEQ ID NO: 3515704 - RNA, 13 nt, Pseudomonas aeruginosa PA01
acaggcagcgccg

SEQ ID NO: 3515705 - RNA, 18 nt, Pseudomonas aeruginosa PA01
acaggcagcgggccaggc

SEQ ID NO: 3515706 - RNA, 18 nt, Pseudomonas aeruginosa PA01
acaggcauugccguccgu

SEQ ID NO: 3515707 - RNA, 16 nt, Pseudomonas aeruginosa PA01
acaggccacccgccuc

SEQ ID NO: 3515708 - RNA, 16 nt, Pseudomonas aeruginosa PA01
acaggccaccgcgcag

SEQ ID NO: 3515709 - RNA, 15 nt, Pseudomonas aeruginosa PA01
acaggccagcucgcc

SEQ ID NO: 3515710 - RNA, 18 nt, Pseudomonas aeruginosa PA01
acaggccauucuucucca

SEQ ID NO: 3515711 - RNA, 16 nt, Pseudomonas aeruginosa PA01
acaggcccugcagcgc

SEQ ID NO: 3515712 - RNA, 19 nt, Pseudomonas aeruginosa PA01
acaggcccugcagcgccau

SEQ ID NO: 3515713 - RNA, 21 nt, Pseudomonas aeruginosa PA01
acaggcccuggaucaccgcgg

SEQ ID NO: 3515714 - RNA, 18 nt, Pseudomonas aeruginosa PA01
acaggcccuugaacaggc

SEQ ID NO: 3515715 - RNA, 22 nt, Pseudomonas aeruginosa PA01
acaggcccuugaacaggcuggc

SEQ ID NO: 3515716 - RNA, 16 nt, Pseudomonas aeruginosa PA01
acaggccgaccagcag

SEQ ID NO: 3515717 - RNA, 17 nt, Pseudomonas aeruginosa PA01
acaggccgaccagcagg

SEQ ID NO: 3515718 - RNA, 23 nt, Pseudomonas aeruginosa PA01
acaggccgauuuucugccgcgac

SEQ ID NO: 3515719 - RNA, 19 nt, Pseudomonas aeruginosa PA01
acaggccgccguagaguuc

SEQ ID NO: 3515720 - RNA, 21 nt, Pseudomonas aeruginosa PA01
acaggccuccagcaacgccgc

SEQ ID NO: 3515721 - RNA, 15 nt, Pseudomonas aeruginosa PA01
acaggccuguggaua

SEQ ID NO: 3515722 - RNA, 16 nt, Pseudomonas aeruginosa PA01
acaggccuguggauag

SEQ ID NO: 3515723 - RNA, 18 nt, Pseudomonas aeruginosa PA01
acaggcgauagccgacca

SEQ ID NO: 3515724 - RNA, 16 nt, Pseudomonas aeruginosa PA01
acaggcgcagcagcau

SEQ ID NO: 3515725 - RNA, 11 nt, Pseudomonas aeruginosa PA01
acaggcgccag

SEQ ID NO: 3515726 - RNA, 15 nt, Pseudomonas aeruginosa PA01
acaggcgccagucau

SEQ ID NO: 3515727 - RNA, 19 nt, Pseudomonas aeruginosa PA01
acaggcgccagucauugcg

SEQ ID NO: 3515728 - RNA, 16 nt, Pseudomonas aeruginosa PA01
acaggcgcuucagcuc

SEQ ID NO: 3515729 - RNA, 15 nt, Pseudomonas aeruginosa PA01
acaggcggaucucgg

SEQ ID NO: 3515730 - RNA, 17 nt, Pseudomonas aeruginosa PA01
acaggcggcgggccggc

SEQ ID NO: 3515731 - RNA, 22 nt, Pseudomonas aeruginosa PA01
acaggcgucccuggagcagggc

SEQ ID NO: 3515732 - RNA, 18 nt, Pseudomonas aeruginosa PA01
acaggcguuauccgccga

SEQ ID NO: 3515733 - RNA, 14 nt, Pseudomonas aeruginosa PA01
acaggcucgaggcc

SEQ ID NO: 3515734 - RNA, 19 nt, Pseudomonas aeruginosa PA01
acaggcugugcgccaggcc

SEQ ID NO: 3515735 - RNA, 22 nt, Pseudomonas aeruginosa PA01
acaggcugugcgccaggccggu

SEQ ID NO: 3515736 - RNA, 12 nt, Pseudomonas aeruginosa PA01
acagggccaggc

SEQ ID NO: 3515737 - RNA, 13 nt, Pseudomonas aeruginosa PA01
acagggccaggcc

SEQ ID NO: 3515738 - RNA, 15 nt, Pseudomonas aeruginosa PA01
acagggcgagcaggg

SEQ ID NO: 3515739 - RNA, 16 nt, Pseudomonas aeruginosa PA01
acagggcgagcagggc

SEQ ID NO: 3515740 - RNA, 17 nt, Pseudomonas aeruginosa PA01
acagggcgagcagggcg

SEQ ID NO: 3515741 - RNA, 18 nt, Pseudomonas aeruginosa PA01
acagggcgagcagggcgc

SEQ ID NO: 3515742 - RNA, 22 nt, Pseudomonas aeruginosa PA01
acagguacucggcccgggccug

SEQ ID NO: 3515743 - RNA, 14 nt, Pseudomonas aeruginosa PA01
acagguagccccgg

SEQ ID NO: 3515744 - RNA, 15 nt, Pseudomonas aeruginosa PA01
acagguagcuggaaa

SEQ ID NO: 3515745 - RNA, 16 nt, Pseudomonas aeruginosa PA01
acagguagcuggaaag

SEQ ID NO: 3515746 - RNA, 18 nt, Pseudomonas aeruginosa PA01
acagguccuggaacagga

SEQ ID NO: 3515747 - RNA, 15 nt, Pseudomonas aeruginosa PA01
acaggucgacgccau

SEQ ID NO: 3515748 - RNA, 18 nt, Pseudomonas aeruginosa PA01
acaggucgacgccauggc

SEQ ID NO: 3515749 - RNA, 16 nt, Pseudomonas aeruginosa PA01
acaggucgacggcuuc

SEQ ID NO: 3515750 - RNA, 22 nt, Pseudomonas aeruginosa PA01
acaggucgacggcuuccagggu

SEQ ID NO: 3515751 - RNA, 16 nt, Pseudomonas aeruginosa PA01
acaggucggccggcag

SEQ ID NO: 3515752 - RNA, 17 nt, Pseudomonas aeruginosa PA01
acaggucggcgaaaucc

SEQ ID NO: 3515753 - RNA, 20 nt, Pseudomonas aeruginosa PA01
acagguggcuuuccagcauu

SEQ ID NO: 3515754 - RNA, 13 nt, Pseudomonas aeruginosa PA01
acagguucagguc

SEQ ID NO: 3515755 - RNA, 20 nt, Pseudomonas aeruginosa PA01
acagguucaggucgaugccc

SEQ ID NO: 3515756 - RNA, 19 nt, Pseudomonas aeruginosa PA01
acagguucggcaggccuuc

SEQ ID NO: 3515757 - RNA, 16 nt, Pseudomonas aeruginosa PA01
acagguuguucggcga

SEQ ID NO: 3515758 - RNA, 23 nt, Pseudomonas aeruginosa PA01
acagguuguucggcgaguuggcc

SEQ ID NO: 3515759 - RNA, 14 nt, Pseudomonas aeruginosa PA01
acagucgaugacga

SEQ ID NO: 3515760 - RNA, 17 nt, Pseudomonas aeruginosa PA01
acagucgaugacgaggc

SEQ ID NO: 3515761 - RNA, 22 nt, Pseudomonas aeruginosa PA01
acagucgucgcgcagcuccucg

SEQ ID NO: 3515762 - RNA, 14 nt, Pseudomonas aeruginosa PA01
acagugccaggcuc

SEQ ID NO: 3515763 - RNA, 18 nt, Pseudomonas aeruginosa PA01
acaguggguaggccaggc

SEQ ID NO: 3515764 - RNA, 19 nt, Pseudomonas aeruginosa PA01
acaguggguaggccaggca

SEQ ID NO: 3515765 - RNA, 15 nt, Pseudomonas aeruginosa PA01
acaguucaggcuggg

SEQ ID NO: 3515766 - RNA, 17 nt, Pseudomonas aeruginosa PA01
acaguucaggcugggcc

SEQ ID NO: 3515767 - RNA, 13 nt, Pseudomonas aeruginosa PA01
acaguugagcugu

SEQ ID NO: 3515768 - RNA, 16 nt, Pseudomonas aeruginosa PA01
acaguugccgcagcag

SEQ ID NO: 3515769 - RNA, 19 nt, Pseudomonas aeruginosa PA01
acaguuggacugcgaggcg

SEQ ID NO: 3515770 - RNA, 15 nt, Pseudomonas aeruginosa PA01
acaguuucauggugc

SEQ ID NO: 3515771 - RNA, 22 nt, Pseudomonas aeruginosa PA01
acaguuucauggugcccagcag

SEQ ID NO: 3515772 - RNA, 17 nt, Pseudomonas aeruginosa PA01
acauagcggcugcuguc

SEQ ID NO: 3515773 - RNA, 23 nt, Pseudomonas aeruginosa PA01
acaucaccacgcgauauccgcca

SEQ ID NO: 3515774 - RNA, 20 nt, Pseudomonas aeruginosa PA01
acaucaccuucgcccucagc

SEQ ID NO: 3515775 - RNA, 13 nt, Pseudomonas aeruginosa PA01
acaucccgccgau

SEQ ID NO: 3515776 - RNA, 19 nt, Pseudomonas aeruginosa PA01
acauccggccaugucccgg

SEQ ID NO: 3515777 - RNA, 16 nt, Pseudomonas aeruginosa PA01
acauccggguccagcg

SEQ ID NO: 3515778 - RNA, 21 nt, Pseudomonas aeruginosa PA01
acauccucccugcccgcucgg

SEQ ID NO: 3515779 - RNA, 16 nt, Pseudomonas aeruginosa PA01
acaucgaccaggucgc

SEQ ID NO: 3515780 - RNA, 14 nt, Pseudomonas aeruginosa PA01
acaucgcccggcag

SEQ ID NO: 3515781 - RNA, 22 nt, Pseudomonas aeruginosa PA01
acaucggccaguccggucagca

SEQ ID NO: 3515782 - RNA, 18 nt, Pseudomonas aeruginosa PA01
acaucggcgcuccgccga

SEQ ID NO: 3515783 - RNA, 16 nt, Pseudomonas aeruginosa PA01
acaucgucugcgcggc

SEQ ID NO: 3515784 - RNA, 17 nt, Pseudomonas aeruginosa PA01
acaucuuggcaaucauc

SEQ ID NO: 3515785 - RNA, 14 nt, Pseudomonas aeruginosa PA01
acaugcaccaccug

SEQ ID NO: 3515786 - RNA, 13 nt, Pseudomonas aeruginosa PA01
acaugcaccaggc

SEQ ID NO: 3515787 - RNA, 14 nt, Pseudomonas aeruginosa PA01
acaugcaccaggcc

SEQ ID NO: 3515788 - RNA, 19 nt, Pseudomonas aeruginosa PA01
accacguaguaggcgcggg

SEQ ID NO: 3515789 - RNA, 16 nt, Pseudomonas aeruginosa PA01
accacguggccggcgc

SEQ ID NO: 3515790 - RNA, 20 nt, Pseudomonas aeruginosa PA01
accacuaucuucgauugcua

SEQ ID NO: 3515791 - RNA, 14 nt, Pseudomonas aeruginosa PA01
accacucgccagcg

SEQ ID NO: 3515792 - RNA, 15 nt, Pseudomonas aeruginosa PA01
accacucgccagcgc

SEQ ID NO: 3515793 - RNA, 22 nt, Pseudomonas aeruginosa PA01
accacucgccagcgcgcgccga

SEQ ID NO: 3515794 - RNA, 19 nt, Pseudomonas aeruginosa PA01
accacucgcgagcuggcgc

SEQ ID NO: 3515795 - RNA, 17 nt, Pseudomonas aeruginosa PA01
accacuuccagguagcc

SEQ ID NO: 3515796 - RNA, 22 nt, Pseudomonas aeruginosa PA01
accacuuccagguagcccaccu

SEQ ID NO: 3515797 - RNA, 17 nt, Pseudomonas aeruginosa PA01
accacuucggcgguggg

SEQ ID NO: 3515798 - RNA, 21 nt, Pseudomonas aeruginosa PA01
accacuucggcgguggggccg

SEQ ID NO: 3515799 - RNA, 21 nt, Pseudomonas aeruginosa PA01
accagaacgaaaaaggcgcgc

SEQ ID NO: 3515800 - RNA, 15 nt, Pseudomonas aeruginosa PA01
accagaagccggccg

SEQ ID NO: 3515801 - RNA, 18 nt, Pseudomonas aeruginosa PA01
accagaagccggccgggu

SEQ ID NO: 3515802 - RNA, 14 nt, Pseudomonas aeruginosa PA01
accagaccagcagg

SEQ ID NO: 3515803 - RNA, 13 nt, Pseudomonas aeruginosa PA01
accagaccgcagc

SEQ ID NO: 3515804 - RNA, 17 nt, Pseudomonas aeruginosa PA01
accagaccgcagccggc

SEQ ID NO: 3515805 - RNA, 22 nt, Pseudomonas aeruginosa PA01
accagacgcagcagcucgucca

SEQ ID NO: 3515806 - RNA, 14 nt, Pseudomonas aeruginosa PA01
accagacgcagcau

SEQ ID NO: 3515807 - RNA, 16 nt, Pseudomonas aeruginosa PA01
accagacgcucggcca

SEQ ID NO: 3515808 - RNA, 18 nt, Pseudomonas aeruginosa PA01
accagacgcucggccagc

SEQ ID NO: 3515809 - RNA, 13 nt, Pseudomonas aeruginosa PA01
accagagccagcc

SEQ ID NO: 3515810 - RNA, 14 nt, Pseudomonas aeruginosa PA01
accagagccgccga

SEQ ID NO: 3515811 - RNA, 15 nt, Pseudomonas aeruginosa PA01
accagaggcugaccu

SEQ ID NO: 3515812 - RNA, 17 nt, Pseudomonas aeruginosa PA01
accagauagaccaaggc

SEQ ID NO: 3515813 - RNA, 12 nt, Pseudomonas aeruginosa PA01
accagaucacca

SEQ ID NO: 3515814 - RNA, 16 nt, Pseudomonas aeruginosa PA01
accagaucaccaccac

SEQ ID NO: 3515815 - RNA, 22 nt, Pseudomonas aeruginosa PA01
accagaucggcgcgcagggcca

SEQ ID NO: 3515816 - RNA, 22 nt, Pseudomonas aeruginosa PA01
accagauggcuggucaggcuga

SEQ ID NO: 3515817 - RNA, 14 nt, Pseudomonas aeruginosa PA01
accagcaaacggga

SEQ ID NO: 3515818 - RNA, 15 nt, Pseudomonas aeruginosa PA01
accagcaaugcccag

SEQ ID NO: 3515819 - RNA, 18 nt, Pseudomonas aeruginosa PA01
accagcaaugcccagcgc

SEQ ID NO: 3515820 - RNA, 13 nt, Pseudomonas aeruginosa PA01
accagcaccaccc

SEQ ID NO: 3515821 - RNA, 14 nt, Pseudomonas aeruginosa PA01
accagcaccgcaag

SEQ ID NO: 3515822 - RNA, 12 nt, Pseudomonas aeruginosa PA01
accagcaccgcc

SEQ ID NO: 3515823 - RNA, 14 nt, Pseudomonas aeruginosa PA01
accagcaccgccug

SEQ ID NO: 3515824 - RNA, 18 nt, Pseudomonas aeruginosa PA01
accagcaccgccugcaac

SEQ ID NO: 3515825 - RNA, 16 nt, Pseudomonas aeruginosa PA01
accagcaccugcgggc

SEQ ID NO: 3515826 - RNA, 18 nt, Pseudomonas aeruginosa PA01
accagcaccugcgggcug

SEQ ID NO: 3515827 - RNA, 19 nt, Pseudomonas aeruginosa PA01
accagcacguagccgcccu

SEQ ID NO: 3515828 - RNA, 15 nt, Pseudomonas aeruginosa PA01
accagcacguugcca

SEQ ID NO: 3515829 - RNA, 14 nt, Pseudomonas aeruginosa PA01
accagcagcagcgg

SEQ ID NO: 3515830 - RNA, 20 nt, Pseudomonas aeruginosa PA01
accagcagcaggucgucggc

SEQ ID NO: 3515831 - RNA, 13 nt, Pseudomonas aeruginosa PA01
accagcagcgccg

SEQ ID NO: 3515832 - RNA, 18 nt, Pseudomonas aeruginosa PA01
accagcagcggcagccac

SEQ ID NO: 3515833 - RNA, 19 nt, Pseudomonas aeruginosa PA01
accagcagcggcucacgcc

SEQ ID NO: 3515834 - RNA, 19 nt, Pseudomonas aeruginosa PA01
accagcaggaagccgacca

SEQ ID NO: 3515835 - RNA, 12 nt, Pseudomonas aeruginosa PA01
accagcaggccc

SEQ ID NO: 3515836 - RNA, 19 nt, Pseudomonas aeruginosa PA01
accagcaggccgaucacca

SEQ ID NO: 3515837 - RNA, 16 nt, Pseudomonas aeruginosa PA01
accagcagggccagca

SEQ ID NO: 3515838 - RNA, 18 nt, Pseudomonas aeruginosa PA01
accagcagggccagcagc

SEQ ID NO: 3515839 - RNA, 17 nt, Pseudomonas aeruginosa PA01
accagcagggccaggcc

SEQ ID NO: 3515840 - RNA, 16 nt, Pseudomonas aeruginosa PA01
accagcaggucgaggu

SEQ ID NO: 3515841 - RNA, 12 nt, Pseudomonas aeruginosa PA01
accagcaucacc

SEQ ID NO: 3515842 - RNA, 15 nt, Pseudomonas aeruginosa PA01
accagcaucagcagg

SEQ ID NO: 3515843 - RNA, 16 nt, Pseudomonas aeruginosa PA01
accagcaucagcagga

SEQ ID NO: 3515844 - RNA, 18 nt, Pseudomonas aeruginosa PA01
accagcaucagcaggaag

SEQ ID NO: 3515845 - RNA, 14 nt, Pseudomonas aeruginosa PA01
accagcaugcccag

SEQ ID NO: 3515846 - RNA, 15 nt, Pseudomonas aeruginosa PA01
accagcaugcccagc

SEQ ID NO: 3515847 - RNA, 20 nt, Pseudomonas aeruginosa PA01
accagcaugcccagcguggc

SEQ ID NO: 3515848 - RNA, 18 nt, Pseudomonas aeruginosa PA01
accagcauguccugcagg

SEQ ID NO: 3515849 - RNA, 12 nt, Pseudomonas aeruginosa PA01
accagccagccc

SEQ ID NO: 3515850 - RNA, 19 nt, Pseudomonas aeruginosa PA01
accagccaggcggccacca

SEQ ID NO: 3515851 - RNA, 16 nt, Pseudomonas aeruginosa PA01
accagccaguccggca

SEQ ID NO: 3515852 - RNA, 17 nt, Pseudomonas aeruginosa PA01
accagccagucgagacg

SEQ ID NO: 3515853 - RNA, 22 nt, Pseudomonas aeruginosa PA01
accagccagucgagacgccagc

SEQ ID NO: 3515854 - RNA, 15 nt, Pseudomonas aeruginosa PA01
accagccagucggcg

SEQ ID NO: 3515855 - RNA, 21 nt, Pseudomonas aeruginosa PA01
accagccaugcaggcugccgg

SEQ ID NO: 3515856 - RNA, 10 nt, Pseudomonas aeruginosa PA01
accagcccgc

SEQ ID NO: 3515857 - RNA, 15 nt, Pseudomonas aeruginosa PA01
accagcccgcgcgac

SEQ ID NO: 3515858 - RNA, 21 nt, Pseudomonas aeruginosa PA01
accagcccgcgcgacagcucu

SEQ ID NO: 3515859 - RNA, 15 nt, Pseudomonas aeruginosa PA01
accagcccuggcgcg

SEQ ID NO: 3515860 - RNA, 18 nt, Pseudomonas aeruginosa PA01
accagcccuggcgcggca

SEQ ID NO: 3515861 - RNA, 12 nt, Pseudomonas aeruginosa PA01
accagccgcagg

SEQ ID NO: 3515862 - RNA, 22 nt, Pseudomonas aeruginosa PA01
accagccgcguugcauguccuc

SEQ ID NO: 3515863 - RNA, 16 nt, Pseudomonas aeruginosa PA01
accagccggccgcguc

SEQ ID NO: 3515864 - RNA, 15 nt, Pseudomonas aeruginosa PA01
accagccggcgcucg

SEQ ID NO: 3515865 - RNA, 19 nt, Pseudomonas aeruginosa PA01
accagccggcgcucggcca

SEQ ID NO: 3515866 - RNA, 17 nt, Pseudomonas aeruginosa PA01
accagccuugagccuug

SEQ ID NO: 3515867 - RNA, 18 nt, Pseudomonas aeruginosa PA01
accagccuugagccuugc

SEQ ID NO: 3515868 - RNA, 19 nt, Pseudomonas aeruginosa PA01
accagccuugagccuugcc

SEQ ID NO: 3515869 - RNA, 20 nt, Pseudomonas aeruginosa PA01
accagccuugagccuugccc

SEQ ID NO: 3515870 - RNA, 20 nt, Pseudomonas aeruginosa PA01
accagcgaaagcgucagcgc

SEQ ID NO: 3515871 - RNA, 15 nt, Pseudomonas aeruginosa PA01
accagcgaaccgccg

SEQ ID NO: 3515872 - RNA, 21 nt, Pseudomonas aeruginosa PA01
accagcgacgcgacauccucc

SEQ ID NO: 3515873 - RNA, 17 nt, Pseudomonas aeruginosa PA01
accagcgagucgaccca

SEQ ID NO: 3515874 - RNA, 19 nt, Pseudomonas aeruginosa PA01
accagcgagucgacccagg

SEQ ID NO: 3515875 - RNA, 23 nt, Pseudomonas aeruginosa PA01
accagcgagucgacccaggccca

SEQ ID NO: 3515876 - RNA, 17 nt, Pseudomonas aeruginosa PA01
accagcgcaccaggguc

SEQ ID NO: 3515877 - RNA, 14 nt, Pseudomonas aeruginosa PA01
accagcgccaggcc

SEQ ID NO: 3515878 - RNA, 19 nt, Pseudomonas aeruginosa PA01
accagcgccaggccgccga

SEQ ID NO: 3515879 - RNA, 20 nt, Pseudomonas aeruginosa PA01
accagcgccaggccgccgaa

SEQ ID NO: 3515880 - RNA, 15 nt, Pseudomonas aeruginosa PA01
accagcgccaggcgc

SEQ ID NO: 3515881 - RNA, 11 nt, Pseudomonas aeruginosa PA01
accagcgccgc

SEQ ID NO: 3515882 - RNA, 14 nt, Pseudomonas aeruginosa PA01
accagcgccgccac

SEQ ID NO: 3515883 - RNA, 16 nt, Pseudomonas aeruginosa PA01
accagcgccgccaggc

SEQ ID NO: 3515884 - RNA, 16 nt, Pseudomonas aeruginosa PA01
accagcgccgcggcga

SEQ ID NO: 3515885 - RNA, 23 nt, Pseudomonas aeruginosa PA01
accagcgccgcggcgaccagcgc

SEQ ID NO: 3515886 - RNA, 13 nt, Pseudomonas aeruginosa PA01
accagcgccggcg

SEQ ID NO: 3515887 - RNA, 16 nt, Pseudomonas aeruginosa PA01
accagcgccggcggcg

SEQ ID NO: 3515888 - RNA, 22 nt, Pseudomonas aeruginosa PA01
accagcgccggguucaucgaca

SEQ ID NO: 3515889 - RNA, 17 nt, Pseudomonas aeruginosa PA01
accagcgccgucaccag

SEQ ID NO: 3515890 - RNA, 21 nt, Pseudomonas aeruginosa PA01
accagcgccgucaccagcagc

SEQ ID NO: 3515891 - RNA, 11 nt, Pseudomonas aeruginosa PA01
accauaaagcc

SEQ ID NO: 3515892 - RNA, 23 nt, Pseudomonas aeruginosa PA01
accauaaagcccacacgcaugau

SEQ ID NO: 3515893 - RNA, 19 nt, Pseudomonas aeruginosa PA01
accauagcgagccgcgcug

SEQ ID NO: 3515894 - RNA, 12 nt, Pseudomonas aeruginosa PA01
accaucaccgcc

SEQ ID NO: 3515895 - RNA, 15 nt, Pseudomonas aeruginosa PA01
accaucaccgccauc

SEQ ID NO: 3515896 - RNA, 18 nt, Pseudomonas aeruginosa PA01
accaucacgucgcgcacc

SEQ ID NO: 3515897 - RNA, 22 nt, Pseudomonas aeruginosa PA01
accaucacgucgcgcaccuggc

SEQ ID NO: 3515898 - RNA, 15 nt, Pseudomonas aeruginosa PA01
accaucagccagccc

SEQ ID NO: 3515899 - RNA, 13 nt, Pseudomonas aeruginosa PA01
accaucgcggcga

SEQ ID NO: 3515900 - RNA, 17 nt, Pseudomonas aeruginosa PA01
accaucggccccaccgc

SEQ ID NO: 3515901 - RNA, 21 nt, Pseudomonas aeruginosa PA01
accaucggguugaucgacgcc

SEQ ID NO: 3515902 - RNA, 22 nt, Pseudomonas aeruginosa PA01
accaucgucgcuuccggcgcca

SEQ ID NO: 3515903 - RNA, 14 nt, Pseudomonas aeruginosa PA01
accaucuuuuccug

SEQ ID NO: 3515904 - RNA, 16 nt, Pseudomonas aeruginosa PA01
accaucuuuuccugcu

SEQ ID NO: 3515905 - RNA, 16 nt, Pseudomonas aeruginosa PA01
accaugaaacaguugg

SEQ ID NO: 3515906 - RNA, 12 nt, Pseudomonas aeruginosa PA01
accaugaucauc

SEQ ID NO: 3515907 - RNA, 13 nt, Pseudomonas aeruginosa PA01
accaugaucaucg

SEQ ID NO: 3515908 - RNA, 22 nt, Pseudomonas aeruginosa PA01
accaugaucaucggcuggccga

SEQ ID NO: 3515909 - RNA, 23 nt, Pseudomonas aeruginosa PA01
accaugaucaucggcuggccgag

SEQ ID NO: 3515910 - RNA, 14 nt, Pseudomonas aeruginosa PA01
accaugcagcggca

SEQ ID NO: 3515911 - RNA, 17 nt, Pseudomonas aeruginosa PA01
accaugcccgcugggca

SEQ ID NO: 3515912 - RNA, 19 nt, Pseudomonas aeruginosa PA01
accaugccuuccaccggcg

SEQ ID NO: 3515913 - RNA, 18 nt, Pseudomonas aeruginosa PA01
accaugcgguucggcguc

SEQ ID NO: 3515914 - RNA, 13 nt, Pseudomonas aeruginosa PA01
accaugcuccgcc

SEQ ID NO: 3515915 - RNA, 19 nt, Pseudomonas aeruginosa PA01
accaugcuccgccuggcgg

SEQ ID NO: 3515916 - RNA, 13 nt, Pseudomonas aeruginosa PA01
accauggccggcg

SEQ ID NO: 3515917 - RNA, 21 nt, Pseudomonas aeruginosa PA01
accaugguguuggcggccugg

SEQ ID NO: 3515918 - RNA, 17 nt, Pseudomonas aeruginosa PA01
accauguucaccagcgc

SEQ ID NO: 3515919 - RNA, 19 nt, Pseudomonas aeruginosa PA01
accauguucaccagcgcug

SEQ ID NO: 3515920 - RNA, 23 nt, Pseudomonas aeruginosa PA01
accauuagaggaacccaaucaca

SEQ ID NO: 3515921 - RNA, 13 nt, Pseudomonas aeruginosa PA01
accauugcgcggg

SEQ ID NO: 3515922 - RNA, 18 nt, Pseudomonas aeruginosa PA01
accauugcggcccgccac

SEQ ID NO: 3515923 - RNA, 23 nt, Pseudomonas aeruginosa PA01
acccaacuuguuggcauccggcu

SEQ ID NO: 3515924 - RNA, 18 nt, Pseudomonas aeruginosa PA01
acccaccgaccaccauca

SEQ ID NO: 3515925 - RNA, 16 nt, Pseudomonas aeruginosa PA01
acccacuccggcaggc

SEQ ID NO: 3515926 - RNA, 21 nt, Pseudomonas aeruginosa PA01
acccagacaggccuguggaua

SEQ ID NO: 3515927 - RNA, 23 nt, Pseudomonas aeruginosa PA01
acccagacaggccuguggauaga

SEQ ID NO: 3515928 - RNA, 15 nt, Pseudomonas aeruginosa PA01
acccagaccugccgc

SEQ ID NO: 3515929 - RNA, 19 nt, Pseudomonas aeruginosa PA01
acccagaccuuccagccgc

SEQ ID NO: 3515930 - RNA, 23 nt, Pseudomonas aeruginosa PA01
acccagaccuuccagccgcgcgc

SEQ ID NO: 3515931 - RNA, 14 nt, Pseudomonas aeruginosa PA01
acccagagccgcuc

SEQ ID NO: 3515932 - RNA, 20 nt, Pseudomonas aeruginosa PA01
acccagagccgcucggcggg

SEQ ID NO: 3515933 - RNA, 13 nt, Pseudomonas aeruginosa PA01
acccagagcgcgc

SEQ ID NO: 3515934 - RNA, 15 nt, Pseudomonas aeruginosa PA01
acccagagcgcgccc

SEQ ID NO: 3515935 - RNA, 23 nt, Pseudomonas aeruginosa PA01
acccagagcgcgcccugcaggcc

SEQ ID NO: 3515936 - RNA, 14 nt, Pseudomonas aeruginosa PA01
acccagccgcggcc

SEQ ID NO: 3515937 - RNA, 18 nt, Pseudomonas aeruginosa PA01
acccagccgcggccguug

SEQ ID NO: 3515938 - RNA, 16 nt, Pseudomonas aeruginosa PA01
acccagcuugcuggcg

SEQ ID NO: 3515939 - RNA, 14 nt, Pseudomonas aeruginosa PA01
acccaggccacgcc

SEQ ID NO: 3515940 - RNA, 15 nt, Pseudomonas aeruginosa PA01
acccaggcccagccg

SEQ ID NO: 3515941 - RNA, 20 nt, Pseudomonas aeruginosa PA01
acccaggccgacagcggcug

SEQ ID NO: 3515942 - RNA, 24 nt, Pseudomonas aeruginosa PA01
acccaggccgcgcagcaacggcgc

SEQ ID NO: 3515943 - RNA, 19 nt, Pseudomonas aeruginosa PA01
acccaggccgucgagggca

SEQ ID NO: 3515944 - RNA, 18 nt, Pseudomonas aeruginosa PA01
acccaggcuucggcgcgc

SEQ ID NO: 3515945 - RNA, 18 nt, Pseudomonas aeruginosa PA01
acccagggcgcugccgau

SEQ ID NO: 3515946 - RNA, 18 nt, Pseudomonas aeruginosa PA01
acccaggugcgcaggcgc

SEQ ID NO: 3515947 - RNA, 19 nt, Pseudomonas aeruginosa PA01
acccaggugcgcaggcgcu

SEQ ID NO: 3515948 - RNA, 20 nt, Pseudomonas aeruginosa PA01
acccagguggucgaccaggc

SEQ ID NO: 3515949 - RNA, 22 nt, Pseudomonas aeruginosa PA01
acccagguggucgaccaggcgu

SEQ ID NO: 3515950 - RNA, 20 nt, Pseudomonas aeruginosa PA01
acccagguucuggucgccga

SEQ ID NO: 3515951 - RNA, 22 nt, Pseudomonas aeruginosa PA01
acccagguucuggucgccgaca

SEQ ID NO: 3515952 - RNA, 17 nt, Pseudomonas aeruginosa PA01
acccaguagggcccgug

SEQ ID NO: 3515953 - RNA, 18 nt, Pseudomonas aeruginosa PA01
acccagucuucgcuggcg

SEQ ID NO: 3515954 - RNA, 19 nt, Pseudomonas aeruginosa PA01
acccagucuucgcuggcga

SEQ ID NO: 3515955 - RNA, 14 nt, Pseudomonas aeruginosa PA01
acccaucgaugcuc

SEQ ID NO: 3515956 - RNA, 16 nt, Pseudomonas aeruginosa PA01
acccaucgaugcucau

SEQ ID NO: 3515957 - RNA, 24 nt, Pseudomonas aeruginosa PA01
acccaucgccgaagacgccugucg

SEQ ID NO: 3515958 - RNA, 14 nt, Pseudomonas aeruginosa PA01
acccaucugccggc

SEQ ID NO: 3515959 - RNA, 17 nt, Pseudomonas aeruginosa PA01
acccaucugccggccac

SEQ ID NO: 3515960 - RNA, 15 nt, Pseudomonas aeruginosa PA01
acccaugccgcuagc

SEQ ID NO: 3515961 - RNA, 18 nt, Pseudomonas aeruginosa PA01
acccaugccgcuagcccu

SEQ ID NO: 3515962 - RNA, 21 nt, Pseudomonas aeruginosa PA01
acccaugccgcuagcccugcu

SEQ ID NO: 3515963 - RNA, 23 nt, Pseudomonas aeruginosa PA01
acccaugccgcuagcccugcugc

SEQ ID NO: 3515964 - RNA, 12 nt, Pseudomonas aeruginosa PA01
acccauggcgcg

SEQ ID NO: 3515965 - RNA, 18 nt, Pseudomonas aeruginosa PA01
acccauggcgcgaugcuc

SEQ ID NO: 3515966 - RNA, 16 nt, Pseudomonas aeruginosa PA01
acccauguggcgcagc

SEQ ID NO: 3515967 - RNA, 14 nt, Pseudomonas aeruginosa PA01
acccauucgaugcc

SEQ ID NO: 3515968 - RNA, 18 nt, Pseudomonas aeruginosa PA01
accccaccggucuuggcg

SEQ ID NO: 3515969 - RNA, 15 nt, Pseudomonas aeruginosa PA01
accccacgcgaccca

SEQ ID NO: 3515970 - RNA, 22 nt, Pseudomonas aeruginosa PA01
accccaggaaaacaucacggca

SEQ ID NO: 3515971 - RNA, 13 nt, Pseudomonas aeruginosa PA01
caauccgccgcuc

SEQ ID NO: 3515972 - RNA, 14 nt, Pseudomonas aeruginosa PA01
caauccgcgccggu

SEQ ID NO: 3515973 - RNA, 14 nt, Pseudomonas aeruginosa PA01
caauccggcgcugc

SEQ ID NO: 3515974 - RNA, 18 nt, Pseudomonas aeruginosa PA01
caauccggcgcugccgaa

SEQ ID NO: 3515975 - RNA, 23 nt, Pseudomonas aeruginosa PA01
caauccggcuggacacgguccag

SEQ ID NO: 3515976 - RNA, 16 nt, Pseudomonas aeruginosa PA01
caauccguuaccgcgg

SEQ ID NO: 3515977 - RNA, 19 nt, Pseudomonas aeruginosa PA01
caaucgcgcaacggcagcg

SEQ ID NO: 3515978 - RNA, 14 nt, Pseudomonas aeruginosa PA01
caaucggcgagccg

SEQ ID NO: 3515979 - RNA, 22 nt, Pseudomonas aeruginosa PA01
caaucggcgagccgcagcggcu

SEQ ID NO: 3515980 - RNA, 19 nt, Pseudomonas aeruginosa PA01
caaucggugaacgagccca

SEQ ID NO: 3515981 - RNA, 22 nt, Pseudomonas aeruginosa PA01
caaucggugaacgagcccaggc

SEQ ID NO: 3515982 - RNA, 16 nt, Pseudomonas aeruginosa PA01
caaucugcccggcauc

SEQ ID NO: 3515983 - RNA, 19 nt, Pseudomonas aeruginosa PA01
caaugaaaaacgccggcga

SEQ ID NO: 3515984 - RNA, 20 nt, Pseudomonas aeruginosa PA01
caaugaaaaacgccggcgau

SEQ ID NO: 3515985 - RNA, 16 nt, Pseudomonas aeruginosa PA01
caaugaaaaaggcgau

SEQ ID NO: 3515986 - RNA, 15 nt, Pseudomonas aeruginosa PA01
caaugaaaaagggau

SEQ ID NO: 3515987 - RNA, 21 nt, Pseudomonas aeruginosa PA01
caaugaaaaagggaugccgcc

SEQ ID NO: 3515988 - RNA, 18 nt, Pseudomonas aeruginosa PA01
caaugagaggugggccgu

SEQ ID NO: 3515989 - RNA, 12 nt, Pseudomonas aeruginosa PA01
caaugccagcgc

SEQ ID NO: 3515990 - RNA, 15 nt, Pseudomonas aeruginosa PA01
caaugccagcgccac

SEQ ID NO: 3515991 - RNA, 17 nt, Pseudomonas aeruginosa PA01
caaugccagcgccacgc

SEQ ID NO: 3515992 - RNA, 22 nt, Pseudomonas aeruginosa PA01
caaugccagcgccacgccgcug

SEQ ID NO: 3515993 - RNA, 19 nt, Pseudomonas aeruginosa PA01
caaugccagugccucgcgc

SEQ ID NO: 3515994 - RNA, 16 nt, Pseudomonas aeruginosa PA01
caaugcccgcgccugg

SEQ ID NO: 3515995 - RNA, 16 nt, Pseudomonas aeruginosa PA01
caaugcccggaccugg

SEQ ID NO: 3515996 - RNA, 19 nt, Pseudomonas aeruginosa PA01
caaugcccggaccugggca

SEQ ID NO: 3515997 - RNA, 21 nt, Pseudomonas aeruginosa PA01
caaugcccggaccugggcacc

SEQ ID NO: 3515998 - RNA, 18 nt, Pseudomonas aeruginosa PA01
caaugccgcccuccauca

SEQ ID NO: 3515999 - RNA, 22 nt, Pseudomonas aeruginosa PA01
caaugccgcccuccaucagcgc

SEQ ID NO: 3516000 - RNA, 18 nt, Pseudomonas aeruginosa PA01
caaugccuuccgacgccg

SEQ ID NO: 3516001 - RNA, 14 nt, Pseudomonas aeruginosa PA01
caaugcggccugca

SEQ ID NO: 3516002 - RNA, 20 nt, Pseudomonas aeruginosa PA01
caaugcggccugcaacgccg

SEQ ID NO: 3516003 - RNA, 14 nt, Pseudomonas aeruginosa PA01
caaugcggcgaugg

SEQ ID NO: 3516004 - RNA, 20 nt, Pseudomonas aeruginosa PA01
caaugcguggguccacgccg

SEQ ID NO: 3516005 - RNA, 22 nt, Pseudomonas aeruginosa PA01
caaugcguggguccacgccggg

SEQ ID NO: 3516006 - RNA, 22 nt, Pseudomonas aeruginosa PA01
caaugcguuccuguccauuucc

SEQ ID NO: 3516007 - RNA, 23 nt, Pseudomonas aeruginosa PA01
caaugcguuccuguccauuucca

SEQ ID NO: 3516008 - RNA, 22 nt, Pseudomonas aeruginosa PA01
caauggauguugccgccgccga

SEQ ID NO: 3516009 - RNA, 19 nt, Pseudomonas aeruginosa PA01
caauggccgggcuucuuca

SEQ ID NO: 3516010 - RNA, 16 nt, Pseudomonas aeruginosa PA01
caauggcgcagccgcu

SEQ ID NO: 3516011 - RNA, 14 nt, Pseudomonas aeruginosa PA01
caauggggcggccg

SEQ ID NO: 3516012 - RNA, 17 nt, Pseudomonas aeruginosa PA01
caauguccgagcagguc

SEQ ID NO: 3516013 - RNA, 13 nt, Pseudomonas aeruginosa PA01
caauucuucaagg

SEQ ID NO: 3516014 - RNA, 15 nt, Pseudomonas aeruginosa PA01
caauugcaggcccgg

SEQ ID NO: 3516015 - RNA, 20 nt, Pseudomonas aeruginosa PA01
caauugcaggcccggccgcc

SEQ ID NO: 3516016 - RNA, 21 nt, Pseudomonas aeruginosa PA01
caauugcaggcccggccgccu

SEQ ID NO: 3516017 - RNA, 13 nt, Pseudomonas aeruginosa PA01
cacaaaaaacccg

SEQ ID NO: 3516018 - RNA, 16 nt, Pseudomonas aeruginosa PA01
cacaaaaaacccggcg

SEQ ID NO: 3516019 - RNA, 13 nt, Pseudomonas aeruginosa PA01
cacaaaaaagccc

SEQ ID NO: 3516020 - RNA, 16 nt, Pseudomonas aeruginosa PA01
cacaaacacuguggag

SEQ ID NO: 3516021 - RNA, 22 nt, Pseudomonas aeruginosa PA01
cacaaacucaggguggucgaug

SEQ ID NO: 3516022 - RNA, 19 nt, Pseudomonas aeruginosa PA01
cacaaagccuugacccgca

SEQ ID NO: 3516023 - RNA, 21 nt, Pseudomonas aeruginosa PA01
cacaaccugccgaucgccgcg

SEQ ID NO: 3516024 - RNA, 22 nt, Pseudomonas aeruginosa PA01
cacaaccugccgaucgccgcgc

SEQ ID NO: 3516025 - RNA, 23 nt, Pseudomonas aeruginosa PA01
cacaagccguuacgacaucgacg

SEQ ID NO: 3516026 - RNA, 19 nt, Pseudomonas aeruginosa PA01
cacaaggugggcagcagcg

SEQ ID NO: 3516027 - RNA, 19 nt, Pseudomonas aeruginosa PA01
cacaaugaaaaacgccggc

SEQ ID NO: 3516028 - RNA, 16 nt, Pseudomonas aeruginosa PA01
cacaaugaaaaaggga

SEQ ID NO: 3516029 - RNA, 16 nt, Pseudomonas aeruginosa PA01
cacaaugaucgcgccg

SEQ ID NO: 3516030 - RNA, 17 nt, Pseudomonas aeruginosa PA01
cacaaugaucgcgccgg

SEQ ID NO: 3516031 - RNA, 14 nt, Pseudomonas aeruginosa PA01
cacacaugcagguc

SEQ ID NO: 3516032 - RNA, 13 nt, Pseudomonas aeruginosa PA01
cacaccaccagca

SEQ ID NO: 3516033 - RNA, 17 nt, Pseudomonas aeruginosa PA01
cacaccacgcauugucg

SEQ ID NO: 3516034 - RNA, 13 nt, Pseudomonas aeruginosa PA01
cacaccaggucgc

SEQ ID NO: 3516035 - RNA, 18 nt, Pseudomonas aeruginosa PA01
cacaccaggucgccgcac

SEQ ID NO: 3516036 - RNA, 19 nt, Pseudomonas aeruginosa PA01
cacaccgaacuuccgccga

SEQ ID NO: 3516037 - RNA, 18 nt, Pseudomonas aeruginosa PA01
cacaccgaagucgcccgc

SEQ ID NO: 3516038 - RNA, 21 nt, Pseudomonas aeruginosa PA01
cacaccgaagucgcccgccgg

SEQ ID NO: 3516039 - RNA, 22 nt, Pseudomonas aeruginosa PA01
cacaccgaagucgcccgccggc

SEQ ID NO: 3516040 - RNA, 23 nt, Pseudomonas aeruginosa PA01
cacaccgaagucgcccgccggcg

SEQ ID NO: 3516041 - RNA, 18 nt, Pseudomonas aeruginosa PA01
cacaccgcgcgcgccugc

SEQ ID NO: 3516042 - RNA, 15 nt, Pseudomonas aeruginosa PA01
cacaccugcaacacg

SEQ ID NO: 3516043 - RNA, 19 nt, Pseudomonas aeruginosa PA01
cacacgaauggcuucuuga

SEQ ID NO: 3516044 - RNA, 22 nt, Pseudomonas aeruginosa PA01
cacacgcuucugcuggccgcgc

SEQ ID NO: 3516045 - RNA, 20 nt, Pseudomonas aeruginosa PA01
cacacggucgagacccgcaa

SEQ ID NO: 3516046 - RNA, 21 nt, Pseudomonas aeruginosa PA01
cacacggucgagacccgcaac

SEQ ID NO: 3516047 - RNA, 12 nt, Pseudomonas aeruginosa PA01
cacacgucggca

SEQ ID NO: 3516048 - RNA, 16 nt, Pseudomonas aeruginosa PA01
cacacgucggcaucga

SEQ ID NO: 3516049 - RNA, 14 nt, Pseudomonas aeruginosa PA01
cacagacgcagccg

SEQ ID NO: 3516050 - RNA, 18 nt, Pseudomonas aeruginosa PA01
cacagaggucgcugacca

SEQ ID NO: 3516051 - RNA, 21 nt, Pseudomonas aeruginosa PA01
cacagaggucgcugaccaccc

SEQ ID NO: 3516052 - RNA, 17 nt, Pseudomonas aeruginosa PA01
cacagaucgccagcucg

SEQ ID NO: 3516053 - RNA, 16 nt, Pseudomonas aeruginosa PA01
cacagcaccacgcucc

SEQ ID NO: 3516054 - RNA, 19 nt, Pseudomonas aeruginosa PA01
cacagcacgagcuuggcca

SEQ ID NO: 3516055 - RNA, 12 nt, Pseudomonas aeruginosa PA01
cacagccagggg

SEQ ID NO: 3516056 - RNA, 15 nt, Pseudomonas aeruginosa PA01
cacagccauagcgcc

SEQ ID NO: 3516057 - RNA, 19 nt, Pseudomonas aeruginosa PA01
cacagccauagcgccggca

SEQ ID NO: 3516058 - RNA, 16 nt, Pseudomonas aeruginosa PA01
cacagccauagugcug

SEQ ID NO: 3516059 - RNA, 18 nt, Pseudomonas aeruginosa PA01
cacagccauuucugcugu

SEQ ID NO: 3516060 - RNA, 15 nt, Pseudomonas aeruginosa PA01
cacagccccagccuc

SEQ ID NO: 3516061 - RNA, 13 nt, Pseudomonas aeruginosa PA01
cacagcgcccaga

SEQ ID NO: 3516062 - RNA, 14 nt, Pseudomonas aeruginosa PA01
cacagcgcccagac

SEQ ID NO: 3516063 - RNA, 17 nt, Pseudomonas aeruginosa PA01
cacagcgugcagaccag

SEQ ID NO: 3516064 - RNA, 17 nt, Pseudomonas aeruginosa PA01
cacagcguggccagcgc

SEQ ID NO: 3516065 - RNA, 14 nt, Pseudomonas aeruginosa PA01
cacagcugccagcc

SEQ ID NO: 3516066 - RNA, 17 nt, Pseudomonas aeruginosa PA01
cacaggacgagacgccg

SEQ ID NO: 3516067 - RNA, 19 nt, Pseudomonas aeruginosa PA01
cacaggacgagacgccgag

SEQ ID NO: 3516068 - RNA, 21 nt, Pseudomonas aeruginosa PA01
cacaggacgagacgccgagga

SEQ ID NO: 3516069 - RNA, 19 nt, Pseudomonas aeruginosa PA01
cacaggcccugcagcgcca

SEQ ID NO: 3516070 - RNA, 13 nt, Pseudomonas aeruginosa PA01
cacaggcccugga

SEQ ID NO: 3516071 - RNA, 21 nt, Pseudomonas aeruginosa PA01
cacaggccggcuaaccgcgaa

SEQ ID NO: 3516072 - RNA, 23 nt, Pseudomonas aeruginosa PA01
cacaggccggcuaaccgcgaagc

SEQ ID NO: 3516073 - RNA, 17 nt, Pseudomonas aeruginosa PA01
cacaggcggcggaagaa

SEQ ID NO: 3516074 - RNA, 19 nt, Pseudomonas aeruginosa PA01
cacaggcggcggaagaagc

SEQ ID NO: 3516075 - RNA, 17 nt, Pseudomonas aeruginosa PA01
cacaggcggcuguugcc

SEQ ID NO: 3516076 - RNA, 19 nt, Pseudomonas aeruginosa PA01
cacaggcguuauccgccga

SEQ ID NO: 3516077 - RNA, 16 nt, Pseudomonas aeruginosa PA01
cacaggcucuucucga

SEQ ID NO: 3516078 - RNA, 14 nt, Pseudomonas aeruginosa PA01
cacagggacgcggc

SEQ ID NO: 3516079 - RNA, 19 nt, Pseudomonas aeruginosa PA01
cacagggucggcaggaccg

SEQ ID NO: 3516080 - RNA, 13 nt, Pseudomonas aeruginosa PA01
cacagguccagca

SEQ ID NO: 3516081 - RNA, 16 nt, Pseudomonas aeruginosa PA01
cacagguccagcaagg

SEQ ID NO: 3516082 - RNA, 13 nt, Pseudomonas aeruginosa PA01
cacagugccaggc

SEQ ID NO: 3516083 - RNA, 16 nt, Pseudomonas aeruginosa PA01
cacagugccaggcucg

SEQ ID NO: 3516084 - RNA, 19 nt, Pseudomonas aeruginosa PA01
cacagugccaggcucgccg

SEQ ID NO: 3516085 - RNA, 22 nt, Pseudomonas aeruginosa PA01
cacagugccaggcucgccgcca

SEQ ID NO: 3516086 - RNA, 12 nt, Pseudomonas aeruginosa PA01
cacaguuccugu

SEQ ID NO: 3516087 - RNA, 15 nt, Pseudomonas aeruginosa PA01
cacaguugcgcgccg

SEQ ID NO: 3516088 - RNA, 15 nt, Pseudomonas aeruginosa PA01
cacauccagcccugg

SEQ ID NO: 3516089 - RNA, 19 nt, Pseudomonas aeruginosa PA01
cacauccaguguggcggcg

SEQ ID NO: 3516090 - RNA, 15 nt, Pseudomonas aeruginosa PA01
cacauccuugccgua

SEQ ID NO: 3516091 - RNA, 22 nt, Pseudomonas aeruginosa PA01
cacaucgaccaggucgccaugc

SEQ ID NO: 3516092 - RNA, 13 nt, Pseudomonas aeruginosa PA01
cacaucgcccggc

SEQ ID NO: 3516093 - RNA, 23 nt, Pseudomonas aeruginosa PA01
cacaucgcccggcagcaggccgc

SEQ ID NO: 3516094 - RNA, 13 nt, Pseudomonas aeruginosa PA01
cacaugcaccacc

SEQ ID NO: 3516095 - RNA, 15 nt, Pseudomonas aeruginosa PA01
cacaugcaccaccug

SEQ ID NO: 3516096 - RNA, 19 nt, Pseudomonas aeruginosa PA01
cacaugcaccaccugcuug

SEQ ID NO: 3516097 - RNA, 16 nt, Pseudomonas aeruginosa PA01
cacaugcaccaggccc

SEQ ID NO: 3516098 - RNA, 13 nt, Pseudomonas aeruginosa PA01
cacaugcaggcuc

SEQ ID NO: 3516099 - RNA, 14 nt, Pseudomonas aeruginosa PA01
cacaugcaggucgu

SEQ ID NO: 3516100 - RNA, 21 nt, Pseudomonas aeruginosa PA01
cacaugccacgcaccaccagg

SEQ ID NO: 3516101 - RNA, 16 nt, Pseudomonas aeruginosa PA01
cacaugggcgaccggu

SEQ ID NO: 3516102 - RNA, 13 nt, Pseudomonas aeruginosa PA01
cacauggucggcc

SEQ ID NO: 3516103 - RNA, 18 nt, Pseudomonas aeruginosa PA01
cacauggucuucccagac

SEQ ID NO: 3516104 - RNA, 16 nt, Pseudomonas aeruginosa PA01
cacauggugggcgccg

SEQ ID NO: 3516105 - RNA, 19 nt, Pseudomonas aeruginosa PA01
cacauggugggcgccgcug

SEQ ID NO: 3516106 - RNA, 20 nt, Pseudomonas aeruginosa PA01
cacauggugggcgccgcugu

SEQ ID NO: 3516107 - RNA, 15 nt, Pseudomonas aeruginosa PA01
cacauuggcuuccga

SEQ ID NO: 3516108 - RNA, 21 nt, Pseudomonas aeruginosa PA01
caccaacucagucgagguaga

SEQ ID NO: 3516109 - RNA, 17 nt, Pseudomonas aeruginosa PA01
caccaaugccagugccu

SEQ ID NO: 3516110 - RNA, 12 nt, Pseudomonas aeruginosa PA01
caccaccaccga

SEQ ID NO: 3516111 - RNA, 16 nt, Pseudomonas aeruginosa PA01
caccaccaccgacgcc

SEQ ID NO: 3516112 - RNA, 13 nt, Pseudomonas aeruginosa PA01
caccaccaccgcg

SEQ ID NO: 3516113 - RNA, 14 nt, Pseudomonas aeruginosa PA01
caccaccaccgcgc

SEQ ID NO: 3516114 - RNA, 16 nt, Pseudomonas aeruginosa PA01
caccaccaccgcgccg

SEQ ID NO: 3516115 - RNA, 17 nt, Pseudomonas aeruginosa PA01
caccaccaccgucuggc

SEQ ID NO: 3516116 - RNA, 13 nt, Pseudomonas aeruginosa PA01
caccaccacgccg

SEQ ID NO: 3516117 - RNA, 18 nt, Pseudomonas aeruginosa PA01
caccaccacgccgucgcc

SEQ ID NO: 3516118 - RNA, 13 nt, Pseudomonas aeruginosa PA01
caccaccagcagg

SEQ ID NO: 3516119 - RNA, 14 nt, Pseudomonas aeruginosa PA01
caccaccagcaggc

SEQ ID NO: 3516120 - RNA, 16 nt, Pseudomonas aeruginosa PA01
caccaccagcaggccc

SEQ ID NO: 3516121 - RNA, 23 nt, Pseudomonas aeruginosa PA01
caccaccagcaucagcaggaagc

SEQ ID NO: 3516122 - RNA, 14 nt, Pseudomonas aeruginosa PA01
caccaccagcgccg

SEQ ID NO: 3516123 - RNA, 15 nt, Pseudomonas aeruginosa PA01
caccaccagcgccgc

SEQ ID NO: 3516124 - RNA, 17 nt, Pseudomonas aeruginosa PA01
caccaccagcgccgcca

SEQ ID NO: 3516125 - RNA, 18 nt, Pseudomonas aeruginosa PA01
caccaccagcgccgccac

SEQ ID NO: 3516126 - RNA, 20 nt, Pseudomonas aeruginosa PA01
caccaccagcgccgccaccg

SEQ ID NO: 3516127 - RNA, 14 nt, Pseudomonas aeruginosa PA01
caccaccagcgcgc

SEQ ID NO: 3516128 - RNA, 17 nt, Pseudomonas aeruginosa PA01
caccaccagcgcgcgcu

SEQ ID NO: 3516129 - RNA, 14 nt, Pseudomonas aeruginosa PA01
caccaccagggucu

SEQ ID NO: 3516130 - RNA, 16 nt, Pseudomonas aeruginosa PA01
caccaccaggucggcg

SEQ ID NO: 3516131 - RNA, 23 nt, Pseudomonas aeruginosa PA01
caccaccagguugaagaacggcc

SEQ ID NO: 3516132 - RNA, 14 nt, Pseudomonas aeruginosa PA01
caccacccagccgc

SEQ ID NO: 3516133 - RNA, 14 nt, Pseudomonas aeruginosa PA01
caccacccgcugca

SEQ ID NO: 3516134 - RNA, 14 nt, Pseudomonas aeruginosa PA01
caccacccggccgc

SEQ ID NO: 3516135 - RNA, 16 nt, Pseudomonas aeruginosa PA01
caccacccggccgcgc

SEQ ID NO: 3516136 - RNA, 17 nt, Pseudomonas aeruginosa PA01
caccacccggccgcgcu

SEQ ID NO: 3516137 - RNA, 14 nt, Pseudomonas aeruginosa PA01
caccacccggcgca

SEQ ID NO: 3516138 - RNA, 15 nt, Pseudomonas aeruginosa PA01
caccacccggcgcac

SEQ ID NO: 3516139 - RNA, 20 nt, Pseudomonas aeruginosa PA01
caccacccggcgcacgccgg

SEQ ID NO: 3516140 - RNA, 21 nt, Pseudomonas aeruginosa PA01
caccacccggcgcacgccggc

SEQ ID NO: 3516141 - RNA, 14 nt, Pseudomonas aeruginosa PA01
caccaccgacgccg

SEQ ID NO: 3516142 - RNA, 15 nt, Pseudomonas aeruginosa PA01
caccaccgacgccgg

SEQ ID NO: 3516143 - RNA, 16 nt, Pseudomonas aeruginosa PA01
caccaccgacgccgga

SEQ ID NO: 3516144 - RNA, 20 nt, Pseudomonas aeruginosa PA01
caccaccgacgccggacgca

SEQ ID NO: 3516145 - RNA, 19 nt, Pseudomonas aeruginosa PA01
caccaccgagagcggcgcc

SEQ ID NO: 3516146 - RNA, 20 nt, Pseudomonas aeruginosa PA01
caccaccgagagcggcgcca

SEQ ID NO: 3516147 - RNA, 22 nt, Pseudomonas aeruginosa PA01
caccaccgagagcggcgccagg

SEQ ID NO: 3516148 - RNA, 13 nt, Pseudomonas aeruginosa PA01
caccaccgccgcc

SEQ ID NO: 3516149 - RNA, 14 nt, Pseudomonas aeruginosa PA01
caccaccgccgcca

SEQ ID NO: 3516150 - RNA, 15 nt, Pseudomonas aeruginosa PA01
caccaccgccgccag

SEQ ID NO: 3516151 - RNA, 14 nt, Pseudomonas aeruginosa PA01
caccaccgcgccga

SEQ ID NO: 3516152 - RNA, 16 nt, Pseudomonas aeruginosa PA01
caccaccgcgccgaug

SEQ ID NO: 3516153 - RNA, 19 nt, Pseudomonas aeruginosa PA01
caccaccggaccgggcgcc

SEQ ID NO: 3516154 - RNA, 21 nt, Pseudomonas aeruginosa PA01
caccaccgggaugaacugcag

SEQ ID NO: 3516155 - RNA, 17 nt, Pseudomonas aeruginosa PA01
caccaccgucuggcgca

SEQ ID NO: 3516156 - RNA, 17 nt, Pseudomonas aeruginosa PA01
caccaccgugaccagca

SEQ ID NO: 3516157 - RNA, 17 nt, Pseudomonas aeruginosa PA01
caccaccucgccaagcu

SEQ ID NO: 3516158 - RNA, 14 nt, Pseudomonas aeruginosa PA01
caccaccugcaugc

SEQ ID NO: 3516159 - RNA, 23 nt, Pseudomonas aeruginosa PA01
caccaccugcuugggcgccucgc

SEQ ID NO: 3516160 - RNA, 13 nt, Pseudomonas aeruginosa PA01
caccaccuggaug

SEQ ID NO: 3516161 - RNA, 22 nt, Pseudomonas aeruginosa PA01
caccaccuggauggugcccggg

SEQ ID NO: 3516162 - RNA, 18 nt, Pseudomonas aeruginosa PA01
caccaccuggcagguauc

SEQ ID NO: 3516163 - RNA, 16 nt, Pseudomonas aeruginosa PA01
caccacgacguugccc

SEQ ID NO: 3516164 - RNA, 16 nt, Pseudomonas aeruginosa PA01
caccacgaucaggccc

SEQ ID NO: 3516165 - RNA, 21 nt, Pseudomonas aeruginosa PA01
caccacgaugcugaucuucug

SEQ ID NO: 3516166 - RNA, 16 nt, Pseudomonas aeruginosa PA01
caccacgcaggcgcgu

SEQ ID NO: 3516167 - RNA, 15 nt, Pseudomonas aeruginosa PA01
caccacgcauugucg

SEQ ID NO: 3516168 - RNA, 15 nt, Pseudomonas aeruginosa PA01
caccacgccgucgcc

SEQ ID NO: 3516169 - RNA, 20 nt, Pseudomonas aeruginosa PA01
caccacgccgucgccgcuga

SEQ ID NO: 3516170 - RNA, 18 nt, Pseudomonas aeruginosa PA01
caccacgcgauauccgcc

SEQ ID NO: 3516171 - RNA, 21 nt, Pseudomonas aeruginosa PA01
caccacgcgauauccgccagg

SEQ ID NO: 3516172 - RNA, 15 nt, Pseudomonas aeruginosa PA01
caccacgcuccugga

SEQ ID NO: 3516173 - RNA, 19 nt, Pseudomonas aeruginosa PA01
caccacggcgaagccgcgc

SEQ ID NO: 3516174 - RNA, 21 nt, Pseudomonas aeruginosa PA01
caccacggcgaagccgcgccc

SEQ ID NO: 3516175 - RNA, 13 nt, Pseudomonas aeruginosa PA01
caccacggcgaug

SEQ ID NO: 3516176 - RNA, 19 nt, Pseudomonas aeruginosa PA01
caccacguagccggcgucc

SEQ ID NO: 3516177 - RNA, 19 nt, Pseudomonas aeruginosa PA01
caccacguucggcgcgggu

SEQ ID NO: 3516178 - RNA, 17 nt, Pseudomonas aeruginosa PA01
caccacguugcgccgca

SEQ ID NO: 3516179 - RNA, 21 nt, Pseudomonas aeruginosa PA01
caccacguugcgccgcagcaa

SEQ ID NO: 3516180 - RNA, 23 nt, Pseudomonas aeruginosa PA01
caccacucccggcgacgacgaag

SEQ ID NO: 3516181 - RNA, 14 nt, Pseudomonas aeruginosa PA01
caccacucgccagc

SEQ ID NO: 3516182 - RNA, 15 nt, Pseudomonas aeruginosa PA01
caccacucgccagcg

SEQ ID NO: 3516183 - RNA, 18 nt, Pseudomonas aeruginosa PA01
caccacucgccagcgcgc

SEQ ID NO: 3516184 - RNA, 22 nt, Pseudomonas aeruginosa PA01
caccacucgccagcgcgcgccg

SEQ ID NO: 3516185 - RNA, 20 nt, Pseudomonas aeruginosa PA01
caccacugcaacacuuccuu

SEQ ID NO: 3516186 - RNA, 16 nt, Pseudomonas aeruginosa PA01
caccacuggaaacgcc

SEQ ID NO: 3516187 - RNA, 14 nt, Pseudomonas aeruginosa PA01
caccagacgcagca

SEQ ID NO: 3516188 - RNA, 16 nt, Pseudomonas aeruginosa PA01
caccagacgcagcaug

SEQ ID NO: 3516189 - RNA, 18 nt, Pseudomonas aeruginosa PA01
caccagacgcagcauguc

SEQ ID NO: 3516190 - RNA, 21 nt, Pseudomonas aeruginosa PA01
caccagacgcagcaugucguc

SEQ ID NO: 3516191 - RNA, 16 nt, Pseudomonas aeruginosa PA01
caccagaggcugaccu

SEQ ID NO: 3516192 - RNA, 18 nt, Pseudomonas aeruginosa PA01
caccagauggcuggucag

SEQ ID NO: 3516193 - RNA, 23 nt, Pseudomonas aeruginosa PA01
caccagauggcuggucaggcuga

SEQ ID NO: 3516194 - RNA, 20 nt, Pseudomonas aeruginosa PA01
caccagcaaacgggacaggu

SEQ ID NO: 3516195 - RNA, 20 nt, Pseudomonas aeruginosa PA01
caccagcaauugccggcgug

SEQ ID NO: 3516196 - RNA, 14 nt, Pseudomonas aeruginosa PA01
caccagcaccagcg

SEQ ID NO: 3516197 - RNA, 20 nt, Pseudomonas aeruginosa PA01
caccagcaccagcgggaugu

SEQ ID NO: 3516198 - RNA, 14 nt, Pseudomonas aeruginosa PA01
caccagcaccugcg

SEQ ID NO: 3516199 - RNA, 13 nt, Pseudomonas aeruginosa PA01
caccagcacgccc

SEQ ID NO: 3516200 - RNA, 14 nt, Pseudomonas aeruginosa PA01
caccagcacgcccu

SEQ ID NO: 3516201 - RNA, 15 nt, Pseudomonas aeruginosa PA01
caccagcacgcccuu

SEQ ID NO: 3516202 - RNA, 15 nt, Pseudomonas aeruginosa PA01
caccagcagccccga

SEQ ID NO: 3516203 - RNA, 23 nt, Pseudomonas aeruginosa PA01
caccagcagccccgaggccagca

SEQ ID NO: 3516204 - RNA, 11 nt, Pseudomonas aeruginosa PA01
caccagcagga

SEQ ID NO: 3516205 - RNA, 16 nt, Pseudomonas aeruginosa PA01
caccagcaggaagccg

SEQ ID NO: 3516206 - RNA, 14 nt, Pseudomonas aeruginosa PA01
caccagcaggaucg

SEQ ID NO: 3516207 - RNA, 18 nt, Pseudomonas aeruginosa PA01
caccagcaggaucgagcc

SEQ ID NO: 3516208 - RNA, 22 nt, Pseudomonas aeruginosa PA01
caccagcaggaucgagcccugg

SEQ ID NO: 3516209 - RNA, 13 nt, Pseudomonas aeruginosa PA01
caccagcaggccc

SEQ ID NO: 3516210 - RNA, 23 nt, Pseudomonas aeruginosa PA01
caccagcaggccgaucaccagcg

SEQ ID NO: 3516211 - RNA, 20 nt, Pseudomonas aeruginosa PA01
caccagcagggccaggccga

SEQ ID NO: 3516212 - RNA, 11 nt, Pseudomonas aeruginosa PA01
caccagcaggu

SEQ ID NO: 3516213 - RNA, 18 nt, Pseudomonas aeruginosa PA01
caccagcaggucggcgcg

SEQ ID NO: 3516214 - RNA, 21 nt, Pseudomonas aeruginosa PA01
caccagcaggucggcgcgacg

SEQ ID NO: 3516215 - RNA, 14 nt, Pseudomonas aeruginosa PA01
caccagcaucacca

SEQ ID NO: 3516216 - RNA, 17 nt, Pseudomonas aeruginosa PA01
caccagcaucaccaccg

SEQ ID NO: 3516217 - RNA, 19 nt, Pseudomonas aeruginosa PA01
caccagcaugcccagcgug

SEQ ID NO: 3516218 - RNA, 13 nt, Pseudomonas aeruginosa PA01
caccagccacugc

SEQ ID NO: 3516219 - RNA, 20 nt, Pseudomonas aeruginosa PA01
caccagccacugcuuggcga

SEQ ID NO: 3516220 - RNA, 12 nt, Pseudomonas aeruginosa PA01
caccagccagcu

SEQ ID NO: 3516221 - RNA, 21 nt, Pseudomonas aeruginosa PA01
caccagccagguguucggccc

SEQ ID NO: 3516222 - RNA, 17 nt, Pseudomonas aeruginosa PA01
caccagccagucgagac

SEQ ID NO: 3516223 - RNA, 18 nt, Pseudomonas aeruginosa PA01
caccagcccgcagggucc

SEQ ID NO: 3516224 - RNA, 20 nt, Pseudomonas aeruginosa PA01
caccagccgaacaguucggc

SEQ ID NO: 3516225 - RNA, 13 nt, Pseudomonas aeruginosa PA01
caccagccggccg

SEQ ID NO: 3516226 - RNA, 15 nt, Pseudomonas aeruginosa PA01
caccagccggccgcg

SEQ ID NO: 3516227 - RNA, 20 nt, Pseudomonas aeruginosa PA01
caccagccggccgcgucgcc

SEQ ID NO: 3516228 - RNA, 20 nt, Pseudomonas aeruginosa PA01
caccagccggcgcucggcca

SEQ ID NO: 3516229 - RNA, 18 nt, Pseudomonas aeruginosa PA01
caccagccuuccggcacc

SEQ ID NO: 3516230 - RNA, 20 nt, Pseudomonas aeruginosa PA01
caccagcgaaagcgucagcg

SEQ ID NO: 3516231 - RNA, 22 nt, Pseudomonas aeruginosa PA01
caccagcgaaagcgucagcgcg

SEQ ID NO: 3516232 - RNA, 15 nt, Pseudomonas aeruginosa PA01
caccagcgaagugcg

SEQ ID NO: 3516233 - RNA, 19 nt, Pseudomonas aeruginosa PA01
caccagcgaagugcgcugc

SEQ ID NO: 3516234 - RNA, 20 nt, Pseudomonas aeruginosa PA01
caccagcgacgacuugccca

SEQ ID NO: 3516235 - RNA, 23 nt, Pseudomonas aeruginosa PA01
caccagcgacgcgacauccucca

SEQ ID NO: 3516236 - RNA, 14 nt, Pseudomonas aeruginosa PA01
caccagcgccaggc

SEQ ID NO: 3516237 - RNA, 17 nt, Pseudomonas aeruginosa PA01
caccagcgccaggccgc

SEQ ID NO: 3516238 - RNA, 19 nt, Pseudomonas aeruginosa PA01
caccagcgccaggccgccg

SEQ ID NO: 3516239 - RNA, 23 nt, Pseudomonas aeruginosa PA01
caccagcgccaggccgccgaaga

SEQ ID NO: 3516240 - RNA, 13 nt, Pseudomonas aeruginosa PA01
caccagcgccgcc

SEQ ID NO: 3516241 - RNA, 15 nt, Pseudomonas aeruginosa PA01
caccagcgccgccac

SEQ ID NO: 3516242 - RNA, 17 nt, Pseudomonas aeruginosa PA01
caccagcgccgccaccg

SEQ ID NO: 3516243 - RNA, 18 nt, Pseudomonas aeruginosa PA01
caccagcgccgccaggca

SEQ ID NO: 3516244 - RNA, 13 nt, Pseudomonas aeruginosa PA01
caccagcgccggc

SEQ ID NO: 3516245 - RNA, 19 nt, Pseudomonas aeruginosa PA01
caccagcgccggcggcgcg

SEQ ID NO: 3516246 - RNA, 23 nt, Pseudomonas aeruginosa PA01
caccagcgccggcggcgcgucca

SEQ ID NO: 3516247 - RNA, 12 nt, Pseudomonas aeruginosa PA01
caccagcgccgu

SEQ ID NO: 3516248 - RNA, 13 nt, Pseudomonas aeruginosa PA01
caccagcgccguc

SEQ ID NO: 3516249 - RNA, 14 nt, Pseudomonas aeruginosa PA01
caccagcgccguca

SEQ ID NO: 3516250 - RNA, 23 nt, Pseudomonas aeruginosa PA01
caccagcgccgucaccagcagcc

SEQ ID NO: 3516251 - RNA, 18 nt, Pseudomonas aeruginosa PA01
caccagcgcgcgcuggcg

SEQ ID NO: 3516252 - RNA, 16 nt, Pseudomonas aeruginosa PA01
caccagcgcugccucg

SEQ ID NO: 3516253 - RNA, 14 nt, Pseudomonas aeruginosa PA01
caccagcggcgagc

SEQ ID NO: 3516254 - RNA, 18 nt, Pseudomonas aeruginosa PA01
caccagcggcgagcaggc

SEQ ID NO: 3516255 - RNA, 20 nt, Pseudomonas aeruginosa PA01
caccagcggcgagcaggcga

SEQ ID NO: 3516256 - RNA, 21 nt, Pseudomonas aeruginosa PA01
caccagcgggucgucgaagcg

SEQ ID NO: 3516257 - RNA, 22 nt, Pseudomonas aeruginosa PA01
caccagcgguacguagcgcggu

SEQ ID NO: 3516258 - RNA, 14 nt, Pseudomonas aeruginosa PA01
caccagcgucgcca

SEQ ID NO: 3516259 - RNA, 17 nt, Pseudomonas aeruginosa PA01
caccagcgucgccaggc

SEQ ID NO: 3516260 - RNA, 17 nt, Pseudomonas aeruginosa PA01
caccagcguggcgcgca

SEQ ID NO: 3516261 - RNA, 23 nt, Pseudomonas aeruginosa PA01
caccagcgugggcaacaggccga

SEQ ID NO: 3516262 - RNA, 12 nt, Pseudomonas aeruginosa PA01
caccagcguggu

SEQ ID NO: 3516263 - RNA, 22 nt, Pseudomonas aeruginosa PA01
caccagcgugguaccgcugcgu

SEQ ID NO: 3516264 - RNA, 16 nt, Pseudomonas aeruginosa PA01
caccagcuccccgucc

SEQ ID NO: 3516265 - RNA, 16 nt, Pseudomonas aeruginosa PA01
caccagcucccggcuc

SEQ ID NO: 3516266 - RNA, 16 nt, Pseudomonas aeruginosa PA01
caccaggaagccccag

SEQ ID NO: 3516267 - RNA, 15 nt, Pseudomonas aeruginosa PA01
caccaggaaggcguc

SEQ ID NO: 3516268 - RNA, 17 nt, Pseudomonas aeruginosa PA01
caccaggaaggcgucgc

SEQ ID NO: 3516269 - RNA, 12 nt, Pseudomonas aeruginosa PA01
caccaggagcgc

SEQ ID NO: 3516270 - RNA, 17 nt, Pseudomonas aeruginosa PA01
caccaggagcgccagca

SEQ ID NO: 3516271 - RNA, 20 nt, Pseudomonas aeruginosa PA01
caccaggagcgccagcacca

SEQ ID NO: 3516272 - RNA, 16 nt, Pseudomonas aeruginosa PA01
caccaggaucgccggg

SEQ ID NO: 3516273 - RNA, 19 nt, Pseudomonas aeruginosa PA01
caccaggaucgccgggcuu

SEQ ID NO: 3516274 - RNA, 16 nt, Pseudomonas aeruginosa PA01
caccaggccaggcugc

SEQ ID NO: 3516275 - RNA, 17 nt, Pseudomonas aeruginosa PA01
caccaggccaggcugcg

SEQ ID NO: 3516276 - RNA, 13 nt, Pseudomonas aeruginosa PA01
caccaggccaggu

SEQ ID NO: 3516277 - RNA, 22 nt, Pseudomonas aeruginosa PA01
caccaggccagguggucgaucu

SEQ ID NO: 3516278 - RNA, 20 nt, Pseudomonas aeruginosa PA01
caccaggccauagcgcgccg

SEQ ID NO: 3516279 - RNA, 15 nt, Pseudomonas aeruginosa PA01
caccaggcccgccgg

SEQ ID NO: 3516280 - RNA, 13 nt, Pseudomonas aeruginosa PA01
caccaggcccugc

SEQ ID NO: 3516281 - RNA, 11 nt, Pseudomonas aeruginosa PA01
caccaggccga

SEQ ID NO: 3516282 - RNA, 22 nt, Pseudomonas aeruginosa PA01
caccaggccgaugaacgccgcg

SEQ ID NO: 3516283 - RNA, 15 nt, Pseudomonas aeruginosa PA01
caccaggccgcugcc

SEQ ID NO: 3516284 - RNA, 20 nt, Pseudomonas aeruginosa PA01
caccaggccgcugccgccgc

SEQ ID NO: 3516285 - RNA, 18 nt, Pseudomonas aeruginosa PA01
caccaggccggcggccga

SEQ ID NO: 3516286 - RNA, 14 nt, Pseudomonas aeruginosa PA01
caccaggccuccca

SEQ ID NO: 3516287 - RNA, 15 nt, Pseudomonas aeruginosa PA01
caccaggccucccag

SEQ ID NO: 3516288 - RNA, 12 nt, Pseudomonas aeruginosa PA01
caccaggcgcca

SEQ ID NO: 3516289 - RNA, 14 nt, Pseudomonas aeruginosa PA01
caccaggcgccggg

SEQ ID NO: 3516290 - RNA, 17 nt, Pseudomonas aeruginosa PA01
caccaggcgccgggucg

SEQ ID NO: 3516291 - RNA, 15 nt, Pseudomonas aeruginosa PA01
caccaggcgucgcac

SEQ ID NO: 3516292 - RNA, 16 nt, Pseudomonas aeruginosa PA01
caccaggcgucgcacc

SEQ ID NO: 3516293 - RNA, 20 nt, Pseudomonas aeruginosa PA01
caccaggcgucgcaccuggg

SEQ ID NO: 3516294 - RNA, 15 nt, Pseudomonas aeruginosa PA01
caccaggcucgcccc

SEQ ID NO: 3516295 - RNA, 18 nt, Pseudomonas aeruginosa PA01
caccaggcucgccccggc

SEQ ID NO: 3516296 - RNA, 15 nt, Pseudomonas aeruginosa PA01
caccaggcucggacu

SEQ ID NO: 3516297 - RNA, 16 nt, Pseudomonas aeruginosa PA01
caccaggcugccgccg

SEQ ID NO: 3516298 - RNA, 13 nt, Pseudomonas aeruginosa PA01
caccagggccagg

SEQ ID NO: 3516299 - RNA, 14 nt, Pseudomonas aeruginosa PA01
caccagggccaggg

SEQ ID NO: 3516300 - RNA, 19 nt, Pseudomonas aeruginosa PA01
caccagggccucggggccg

SEQ ID NO: 3516301 - RNA, 13 nt, Pseudomonas aeruginosa PA01
caccagggcgaug

SEQ ID NO: 3516302 - RNA, 14 nt, Pseudomonas aeruginosa PA01
caccagggcgaugg

SEQ ID NO: 3516303 - RNA, 21 nt, Pseudomonas aeruginosa PA01
caccaggguaccgaaacaggg

SEQ ID NO: 3516304 - RNA, 20 nt, Pseudomonas aeruginosa PA01
caccagggucacgccgcggc

SEQ ID NO: 3516305 - RNA, 14 nt, Pseudomonas aeruginosa PA01
caccagggucgcca

SEQ ID NO: 3516306 - RNA, 17 nt, Pseudomonas aeruginosa PA01
caccagggucgccaggg

SEQ ID NO: 3516307 - RNA, 18 nt, Pseudomonas aeruginosa PA01
caccagggucgccagggg

SEQ ID NO: 3516308 - RNA, 16 nt, Pseudomonas aeruginosa PA01
caccagggucggcacc

SEQ ID NO: 3516309 - RNA, 15 nt, Pseudomonas aeruginosa PA01
caccagggucgggcc

SEQ ID NO: 3516310 - RNA, 22 nt, Pseudomonas aeruginosa PA01
caccagggucgggccgcgcucg

SEQ ID NO: 3516311 - RNA, 23 nt, Pseudomonas aeruginosa PA01
caccagggucgggccgcgcucgg

SEQ ID NO: 3516312 - RNA, 23 nt, Pseudomonas aeruginosa PA01
caccagggucgguucgcggcgca

SEQ ID NO: 3516313 - RNA, 18 nt, Pseudomonas aeruginosa PA01
caccagggucuccaggac

SEQ ID NO: 3516314 - RNA, 21 nt, Pseudomonas aeruginosa PA01
caccagggucuccaggaccag

SEQ ID NO: 3516315 - RNA, 14 nt, Pseudomonas aeruginosa PA01
caccagggugcgcu

SEQ ID NO: 3516316 - RNA, 21 nt, Pseudomonas aeruginosa PA01
caccagggugcgcucguugau

SEQ ID NO: 3516317 - RNA, 19 nt, Pseudomonas aeruginosa PA01
caccaggguggcgcgcacc

SEQ ID NO: 3516318 - RNA, 20 nt, Pseudomonas aeruginosa PA01
caccaggguggcgcgcacca

SEQ ID NO: 3516319 - RNA, 22 nt, Pseudomonas aeruginosa PA01
caccaggguggcgcgcaccacc

SEQ ID NO: 3516320 - RNA, 22 nt, Pseudomonas aeruginosa PA01
caccaggucgauccugaccccg

SEQ ID NO: 3516321 - RNA, 20 nt, Pseudomonas aeruginosa PA01
caccaggucgccgcacaccg

SEQ ID NO: 3516322 - RNA, 15 nt, Pseudomonas aeruginosa PA01
caccaggucgcgcuu

SEQ ID NO: 3516323 - RNA, 20 nt, Pseudomonas aeruginosa PA01
caccaggucgcggaucaggc

SEQ ID NO: 3516324 - RNA, 23 nt, Pseudomonas aeruginosa PA01
caccaggucgcggaucaggcugg

SEQ ID NO: 3516325 - RNA, 13 nt, Pseudomonas aeruginosa PA01
caccaggucggcg

SEQ ID NO: 3516326 - RNA, 17 nt, Pseudomonas aeruginosa PA01
caccaggucggcgcgcg

SEQ ID NO: 3516327 - RNA, 18 nt, Pseudomonas aeruginosa PA01
caccaggucgucgucacg

SEQ ID NO: 3516328 - RNA, 23 nt, Pseudomonas aeruginosa PA01
caccaggucgucgucacgcaggc

SEQ ID NO: 3516329 - RNA, 21 nt, Pseudomonas aeruginosa PA01
caccaggugcuuggcuucgag

SEQ ID NO: 3516330 - RNA, 17 nt, Pseudomonas aeruginosa PA01
caccagguugcccggcu

SEQ ID NO: 3516331 - RNA, 22 nt, Pseudomonas aeruginosa PA01
caccagguuggccaguuggccc

SEQ ID NO: 3516332 - RNA, 18 nt, Pseudomonas aeruginosa PA01
caccagucccuggccggc

SEQ ID NO: 3516333 - RNA, 19 nt, Pseudomonas aeruginosa PA01
caccagucccuggccggcg

SEQ ID NO: 3516334 - RNA, 22 nt, Pseudomonas aeruginosa PA01
caccagucccuggccggcgaug

SEQ ID NO: 3516335 - RNA, 13 nt, Pseudomonas aeruginosa PA01
caccaguggcgcc

SEQ ID NO: 3516336 - RNA, 17 nt, Pseudomonas aeruginosa PA01
caccaguggcgccgcca

SEQ ID NO: 3516337 - RNA, 21 nt, Pseudomonas aeruginosa PA01
caccaguggcgccgccauggu

SEQ ID NO: 3516338 - RNA, 18 nt, Pseudomonas aeruginosa PA01
caccauagcgagccgcgc

SEQ ID NO: 3516339 - RNA, 19 nt, Pseudomonas aeruginosa PA01
caccauagcgagccgcgcu

SEQ ID NO: 3516340 - RNA, 14 nt, Pseudomonas aeruginosa PA01
caccaucaccgcca

SEQ ID NO: 3516341 - RNA, 16 nt, Pseudomonas aeruginosa PA01
caccaucacgucgcgc

SEQ ID NO: 3516342 - RNA, 18 nt, Pseudomonas aeruginosa PA01
caccaucacgucgcgcac

SEQ ID NO: 3516343 - RNA, 22 nt, Pseudomonas aeruginosa PA01
caccaucacgucgcgcaccugg

SEQ ID NO: 3516344 - RNA, 14 nt, Pseudomonas aeruginosa PA01
caccauccgccgca

SEQ ID NO: 3516345 - RNA, 17 nt, Pseudomonas aeruginosa PA01
caccaucgcggcgaugg

SEQ ID NO: 3516346 - RNA, 20 nt, Pseudomonas aeruginosa PA01
caccaucgcggcgauggccg

SEQ ID NO: 3516347 - RNA, 14 nt, Pseudomonas aeruginosa PA01
caccaugaucaucg

SEQ ID NO: 3516348 - RNA, 20 nt, Pseudomonas aeruginosa PA01
caccaugccgaugacaugga

SEQ ID NO: 3516349 - RNA, 21 nt, Pseudomonas aeruginosa PA01
caccaugccuuccaccggcgu

SEQ ID NO: 3516350 - RNA, 17 nt, Pseudomonas aeruginosa PA01
caccaugcuccgccugg

SEQ ID NO: 3516351 - RNA, 19 nt, Pseudomonas aeruginosa PA01
caccauggucuuuccuuuc

SEQ ID NO: 3516352 - RNA, 21 nt, Pseudomonas aeruginosa PA01
cacccaacuuguuggcauccg

SEQ ID NO: 3516353 - RNA, 18 nt, Pseudomonas aeruginosa PA01
cacccagaagccgaccuu

SEQ ID NO: 3516354 - RNA, 21 nt, Pseudomonas aeruginosa PA01
cacccagaagccgaccuugcg

SEQ ID NO: 3516355 - RNA, 14 nt, Pseudomonas aeruginosa PA01
cacccagaccuucc

SEQ ID NO: 3516356 - RNA, 22 nt, Pseudomonas aeruginosa PA01
cacccagaccuuccagccgcgc

SEQ ID NO: 3516357 - RNA, 23 nt, Pseudomonas aeruginosa PA01
cacccagcagcaacuccagagcc

SEQ ID NO: 3516358 - RNA, 13 nt, Pseudomonas aeruginosa PA01
cacccagccgcgg

SEQ ID NO: 3516359 - RNA, 21 nt, Pseudomonas aeruginosa PA01
cacccaggauuuguccgcgcc

SEQ ID NO: 3516360 - RNA, 22 nt, Pseudomonas aeruginosa PA01
cacccaggauuuguccgcgcca

SEQ ID NO: 3516361 - RNA, 13 nt, Pseudomonas aeruginosa PA01
cacccaggcgccg

SEQ ID NO: 3516362 - RNA, 14 nt, Pseudomonas aeruginosa PA01
cacccaggcgccga

SEQ ID NO: 3516363 - RNA, 22 nt, Pseudomonas aeruginosa PA01
cacccagggcaguacguggcgc

SEQ ID NO: 3516364 - RNA, 23 nt, Pseudomonas aeruginosa PA01
cacccagggcaguacguggcgcu

SEQ ID NO: 3516365 - RNA, 18 nt, Pseudomonas aeruginosa PA01
cacccagucuucgcuggc

SEQ ID NO: 3516366 - RNA, 19 nt, Pseudomonas aeruginosa PA01
cacccagucuucgcuggcg

SEQ ID NO: 3516367 - RNA, 18 nt, Pseudomonas aeruginosa PA01
cacccauucgaugccgcg

SEQ ID NO: 3516368 - RNA, 18 nt, Pseudomonas aeruginosa PA01
caccccacgggcgaccca

SEQ ID NO: 3516369 - RNA, 12 nt, Pseudomonas aeruginosa PA01
caccccaggguu

SEQ ID NO: 3516370 - RNA, 17 nt, Pseudomonas aeruginosa PA01
caccccauccucgccgg

SEQ ID NO: 3516371 - RNA, 15 nt, Pseudomonas aeruginosa PA01
cacccccagcaggcc

SEQ ID NO: 3516372 - RNA, 16 nt, Pseudomonas aeruginosa PA01
cacccccagcaggcca

SEQ ID NO: 3516373 - RNA, 22 nt, Pseudomonas aeruginosa PA01
cacccccagcaggccagccaac

SEQ ID NO: 3516374 - RNA, 16 nt, Pseudomonas aeruginosa PA01
cacccccagcccggcc

SEQ ID NO: 3516375 - RNA, 17 nt, Pseudomonas aeruginosa PA01
cacccccagcccggcca

SEQ ID NO: 3516376 - RNA, 18 nt, Pseudomonas aeruginosa PA01
cacccccagcccggccau

SEQ ID NO: 3516377 - RNA, 17 nt, Pseudomonas aeruginosa PA01
cacccccagcgagccga

SEQ ID NO: 3516378 - RNA, 20 nt, Pseudomonas aeruginosa PA01
cacccccagcgagccgagca

SEQ ID NO: 3516379 - RNA, 17 nt, Pseudomonas aeruginosa PA01
cacccccaucgcccgca

SEQ ID NO: 3516380 - RNA, 21 nt, Pseudomonas aeruginosa PA01
cacccccaucgcccgcagcca

SEQ ID NO: 3516381 - RNA, 19 nt, Pseudomonas aeruginosa PA01
cacccccgcaaccgcugcc

SEQ ID NO: 3516382 - RNA, 23 nt, Pseudomonas aeruginosa PA01
cacccccgcaaccgcugccgccg

SEQ ID NO: 3516383 - RNA, 18 nt, Pseudomonas aeruginosa PA01
cacccccggcccggccau

SEQ ID NO: 3516384 - RNA, 22 nt, Pseudomonas aeruginosa PA01
caccccgaaacgguccaccagg

SEQ ID NO: 3516385 - RNA, 14 nt, Pseudomonas aeruginosa PA01
caccccgagcccgg

SEQ ID NO: 3516386 - RNA, 17 nt, Pseudomonas aeruginosa PA01
caccccgagcggcgcga

SEQ ID NO: 3516387 - RNA, 21 nt, Pseudomonas aeruginosa PA01
caccccgcccuuggcggcgcc

SEQ ID NO: 3516388 - RNA, 12 nt, Pseudomonas aeruginosa PA01
caccccgccgcg

SEQ ID NO: 3516389 - RNA, 14 nt, Pseudomonas aeruginosa PA01
caccccgccgcgca

SEQ ID NO: 3516390 - RNA, 21 nt, Pseudomonas aeruginosa PA01
caccccgccgcgcaucacccc

SEQ ID NO: 3516391 - RNA, 22 nt, Pseudomonas aeruginosa PA01
caccccgccgcgcaucaccccg

SEQ ID NO: 3516392 - RNA, 15 nt, Pseudomonas aeruginosa PA01
caccccgccgcuggc

SEQ ID NO: 3516393 - RNA, 12 nt, Pseudomonas aeruginosa PA01
caccccgccggc

SEQ ID NO: 3516394 - RNA, 13 nt, Pseudomonas aeruginosa PA01
caccccgccggcg

SEQ ID NO: 3516395 - RNA, 20 nt, Pseudomonas aeruginosa PA01
caccccgucgacgcccuggg

SEQ ID NO: 3516396 - RNA, 20 nt, Pseudomonas aeruginosa PA01
cacccgaaagccgaagcgcg

SEQ ID NO: 3516397 - RNA, 23 nt, Pseudomonas aeruginosa PA01
cacccgaggaaaugauguugcgc

SEQ ID NO: 3516398 - RNA, 21 nt, Pseudomonas aeruginosa PA01
cacccgcaccagccggcgcuc

SEQ ID NO: 3516399 - RNA, 13 nt, Pseudomonas aeruginosa PA01
cacccgcagcccc

SEQ ID NO: 3516400 - RNA, 15 nt, Pseudomonas aeruginosa PA01
cacccgcagccccgc

SEQ ID NO: 3516401 - RNA, 15 nt, Pseudomonas aeruginosa PA01
cacccgcagccgcgu

SEQ ID NO: 3516402 - RNA, 16 nt, Pseudomonas aeruginosa PA01
cacccgcagcggcagc

SEQ ID NO: 3516403 - RNA, 15 nt, Pseudomonas aeruginosa PA01
cacccgcaucgaggc

SEQ ID NO: 3516404 - RNA, 20 nt, Pseudomonas aeruginosa PA01
cacccgcaucgaggccgccc

SEQ ID NO: 3516405 - RNA, 22 nt, Pseudomonas aeruginosa PA01
cacccgcaucgaggccgcccag

SEQ ID NO: 3516406 - RNA, 17 nt, Pseudomonas aeruginosa PA01
cacccgcccgccgucgc

SEQ ID NO: 3516407 - RNA, 14 nt, Pseudomonas aeruginosa PA01
cacccgccucgucg

SEQ ID NO: 3516408 - RNA, 16 nt, Pseudomonas aeruginosa PA01
cacccgccucgucgcc

SEQ ID NO: 3516409 - RNA, 17 nt, Pseudomonas aeruginosa PA01
cacccgcgaaugcuccg

SEQ ID NO: 3516410 - RNA, 16 nt, Pseudomonas aeruginosa PA01
cacccgcgaggccggc

SEQ ID NO: 3516411 - RNA, 18 nt, Pseudomonas aeruginosa PA01
cacccgcgaggccggccc

SEQ ID NO: 3516412 - RNA, 20 nt, Pseudomonas aeruginosa PA01
cacccgcgaggccggcccca

SEQ ID NO: 3516413 - RNA, 13 nt, Pseudomonas aeruginosa PA01
cacccgcgccgcc

SEQ ID NO: 3516414 - RNA, 17 nt, Pseudomonas aeruginosa PA01
cacccgcgccgccgcgg

SEQ ID NO: 3516415 - RNA, 15 nt, Pseudomonas aeruginosa PA01
cacccgcuccgcggc

SEQ ID NO: 3516416 - RNA, 13 nt, Pseudomonas aeruginosa PA01
cacccgcuccggc

SEQ ID NO: 3516417 - RNA, 17 nt, Pseudomonas aeruginosa PA01
cacccgcuccggcucuc

SEQ ID NO: 3516418 - RNA, 15 nt, Pseudomonas aeruginosa PA01
cacccgcucggccuu

SEQ ID NO: 3516419 - RNA, 21 nt, Pseudomonas aeruginosa PA01
cacccggaccuuguccagggu

SEQ ID NO: 3516420 - RNA, 15 nt, Pseudomonas aeruginosa PA01
cacccggccauggcg

SEQ ID NO: 3516421 - RNA, 17 nt, Pseudomonas aeruginosa PA01
cacccggcccauggcga

SEQ ID NO: 3516422 - RNA, 13 nt, Pseudomonas aeruginosa PA01
cacccggccgcgc

SEQ ID NO: 3516423 - RNA, 14 nt, Pseudomonas aeruginosa PA01
cacccggcgcacgc

SEQ ID NO: 3516424 - RNA, 18 nt, Pseudomonas aeruginosa PA01
cacccggcgcacgccggc

SEQ ID NO: 3516425 - RNA, 19 nt, Pseudomonas aeruginosa PA01
cacccggcgcacgccggcc

SEQ ID NO: 3516426 - RNA, 17 nt, Pseudomonas aeruginosa PA01
cacccggcgcccggcgc

SEQ ID NO: 3516427 - RNA, 17 nt, Pseudomonas aeruginosa PA01
cacccggcgguccgccg

SEQ ID NO: 3516428 - RNA, 20 nt, Pseudomonas aeruginosa PA01
cacccggcgguccgccgcgg

SEQ ID NO: 3516429 - RNA, 12 nt, Pseudomonas aeruginosa PA01
cacccggcucgg

SEQ ID NO: 3516430 - RNA, 17 nt, Pseudomonas aeruginosa PA01
cacccggcugcaugccg

SEQ ID NO: 3516431 - RNA, 21 nt, Pseudomonas aeruginosa PA01
cacccggcuggguucggcgag

SEQ ID NO: 3516432 - RNA, 24 nt, Pseudomonas aeruginosa PA01
cacccggcuggguucggcgaggau

SEQ ID NO: 3516433 - RNA, 18 nt, Pseudomonas aeruginosa PA01
cacccgggcgaccugcuc

SEQ ID NO: 3516434 - RNA, 19 nt, Pseudomonas aeruginosa PA01
cacccgggcgaccugcucg

SEQ ID NO: 3516435 - RNA, 14 nt, Pseudomonas aeruginosa PA01
cacccgguagccga

SEQ ID NO: 3516436 - RNA, 16 nt, Pseudomonas aeruginosa PA01
cacccgguccugcaac

SEQ ID NO: 3516437 - RNA, 16 nt, Pseudomonas aeruginosa PA01
cacccggucgcgcugg

SEQ ID NO: 3516438 - RNA, 23 nt, Pseudomonas aeruginosa PA01
cacccggucgcgcuggaccuggc

SEQ ID NO: 3516439 - RNA, 15 nt, Pseudomonas aeruginosa PA01
cacccggucggccug

SEQ ID NO: 3516440 - RNA, 20 nt, Pseudomonas aeruginosa PA01
cacccggugcaggaacaggu

SEQ ID NO: 3516441 - RNA, 17 nt, Pseudomonas aeruginosa PA01
cacccgguucucgcccc

SEQ ID NO: 3516442 - RNA, 14 nt, Pseudomonas aeruginosa PA01
cacccgucccgcgc

SEQ ID NO: 3516443 - RNA, 20 nt, Pseudomonas aeruginosa PA01
cacccguuccuugcgcggca

SEQ ID NO: 3516444 - RNA, 22 nt, Pseudomonas aeruginosa PA01
cacccguuccuugcgcggcagg

SEQ ID NO: 3516445 - RNA, 15 nt, Pseudomonas aeruginosa PA01
cacccguucgccggc

SEQ ID NO: 3516446 - RNA, 19 nt, Pseudomonas aeruginosa PA01
cacccguucgccggccucc

SEQ ID NO: 3516447 - RNA, 22 nt, Pseudomonas aeruginosa PA01
cacccguucgccggccuccagc

SEQ ID NO: 3516448 - RNA, 23 nt, Pseudomonas aeruginosa PA01
cacccucggcuucguccugcugc

SEQ ID NO: 3516449 - RNA, 12 nt, Pseudomonas aeruginosa PA01
cacccucuuccg

SEQ ID NO: 3516450 - RNA, 18 nt, Pseudomonas aeruginosa PA01
cacccucuuccgcgcuga

SEQ ID NO: 3516451 - RNA, 14 nt, Pseudomonas aeruginosa PA01
cacccugaccgcga

SEQ ID NO: 3516452 - RNA, 13 nt, Pseudomonas aeruginosa PA01
cacccugccgcgc

SEQ ID NO: 3516453 - RNA, 12 nt, Pseudomonas aeruginosa PA01
cacccugcgcga

SEQ ID NO: 3516454 - RNA, 20 nt, Pseudomonas aeruginosa PA01
cacccugcugcugcucagcg

SEQ ID NO: 3516455 - RNA, 23 nt, Pseudomonas aeruginosa PA01
cacccugcugcugcucagcgcgc

SEQ ID NO: 3516456 - RNA, 15 nt, Pseudomonas aeruginosa PA01
cacccugcugggcgg

SEQ ID NO: 3516457 - RNA, 15 nt, Pseudomonas aeruginosa PA01
cacccuggacccggg

SEQ ID NO: 3516458 - RNA, 18 nt, Pseudomonas aeruginosa PA01
cacccuggacccgggccu

SEQ ID NO: 3516459 - RNA, 23 nt, Pseudomonas aeruginosa PA01
cacccugucccaucacggccccg

SEQ ID NO: 3516460 - RNA, 18 nt, Pseudomonas aeruginosa PA01
cacccuugcgcccggcuu

SEQ ID NO: 3516461 - RNA, 19 nt, Pseudomonas aeruginosa PA01
cacccuugcgcccggcuuc

SEQ ID NO: 3516462 - RNA, 17 nt, Pseudomonas aeruginosa PA01
cacccuuggagccgccc

SEQ ID NO: 3516463 - RNA, 20 nt, Pseudomonas aeruginosa PA01
cacccuuggagccgcccucg

SEQ ID NO: 3516464 - RNA, 17 nt, Pseudomonas aeruginosa PA01
cacccuuggcgcaggua

SEQ ID NO: 3516465 - RNA, 16 nt, Pseudomonas aeruginosa PA01
caccgaacggugcagc

SEQ ID NO: 3516466 - RNA, 14 nt, Pseudomonas aeruginosa PA01
caccgaacuuccgc

SEQ ID NO: 3516467 - RNA, 19 nt, Pseudomonas aeruginosa PA01
caccgaagcugaggccggu

SEQ ID NO: 3516468 - RNA, 17 nt, Pseudomonas aeruginosa PA01
caccgaagucgcccgcc

SEQ ID NO: 3516469 - RNA, 17 nt, Pseudomonas aeruginosa PA01
caccgaauaccagggcu

SEQ ID NO: 3516470 - RNA, 23 nt, Pseudomonas aeruginosa PA01
caccgaauccuugaucaccuugc

SEQ ID NO: 3516471 - RNA, 17 nt, Pseudomonas aeruginosa PA01
caccgaaucgaugcugu

SEQ ID NO: 3516472 - RNA, 16 nt, Pseudomonas aeruginosa PA01
caccgacaaucgccga

SEQ ID NO: 3516473 - RNA, 17 nt, Pseudomonas aeruginosa PA01
caccgacaaucgccgag

SEQ ID NO: 3516474 - RNA, 20 nt, Pseudomonas aeruginosa PA01
caccgacaaucgccgagaaa

SEQ ID NO: 3516475 - RNA, 17 nt, Pseudomonas aeruginosa PA01
caccgacacgcacucau

SEQ ID NO: 3516476 - RNA, 16 nt, Pseudomonas aeruginosa PA01
caccgacaggccgacc

SEQ ID NO: 3516477 - RNA, 20 nt, Pseudomonas aeruginosa PA01
caccgacaggccgaccagca

SEQ ID NO: 3516478 - RNA, 21 nt, Pseudomonas aeruginosa PA01
caccgaccaccaucaccgcca

SEQ ID NO: 3516479 - RNA, 16 nt, Pseudomonas aeruginosa PA01
caccgacccucggcga

SEQ ID NO: 3516480 - RNA, 22 nt, Pseudomonas aeruginosa PA01
caccgaccgcgaguucgccggc

SEQ ID NO: 3516481 - RNA, 23 nt, Pseudomonas aeruginosa PA01
caccgaccgcgaguucgccggcc

SEQ ID NO: 3516482 - RNA, 16 nt, Pseudomonas aeruginosa PA01
caccgacgccgccugc

SEQ ID NO: 3516483 - RNA, 17 nt, Pseudomonas aeruginosa PA01
caccgacgccgccugcg

SEQ ID NO: 3516484 - RNA, 19 nt, Pseudomonas aeruginosa PA01
caccgacgccgccugcgcc

SEQ ID NO: 3516485 - RNA, 22 nt, Pseudomonas aeruginosa PA01
caccgacgccgccugcgccucg

SEQ ID NO: 3516486 - RNA, 13 nt, Pseudomonas aeruginosa PA01
caccgacgccgga

SEQ ID NO: 3516487 - RNA, 16 nt, Pseudomonas aeruginosa PA01
caccgacggcuccgga

SEQ ID NO: 3516488 - RNA, 15 nt, Pseudomonas aeruginosa PA01
caccgagacgcccug

SEQ ID NO: 3516489 - RNA, 17 nt, Pseudomonas aeruginosa PA01
caccgagagcggcgcca

SEQ ID NO: 3516490 - RNA, 16 nt, Pseudomonas aeruginosa PA01
caccgagagcugcaag

SEQ ID NO: 3516491 - RNA, 13 nt, Pseudomonas aeruginosa PA01
caccgagcaggca

SEQ ID NO: 3516492 - RNA, 20 nt, Pseudomonas aeruginosa PA01
caccgagcaggcacccgcgg

SEQ ID NO: 3516493 - RNA, 14 nt, Pseudomonas aeruginosa PA01
caccgagccguugu

SEQ ID NO: 3516494 - RNA, 19 nt, Pseudomonas aeruginosa PA01
caccgagcgcaguucgucg

SEQ ID NO: 3516495 - RNA, 17 nt, Pseudomonas aeruginosa PA01
caccgagcugaucgcgc

SEQ ID NO: 3516496 - RNA, 12 nt, Pseudomonas aeruginosa PA01
caccgaggcgcg

SEQ ID NO: 3516497 - RNA, 13 nt, Pseudomonas aeruginosa PA01
caccgaggcgcgc

SEQ ID NO: 3516498 - RNA, 14 nt, Pseudomonas aeruginosa PA01
caccgaggcgcgcc

SEQ ID NO: 3516499 - RNA, 15 nt, Pseudomonas aeruginosa PA01
caccgaggcgcgccg

SEQ ID NO: 3516500 - RNA, 17 nt, Pseudomonas aeruginosa PA01
caccgaggcgcgccgac

SEQ ID NO: 3516501 - RNA, 15 nt, Pseudomonas aeruginosa PA01
caccgagucggcaac

SEQ ID NO: 3516502 - RNA, 16 nt, Pseudomonas aeruginosa PA01
caccgagucggcaacg

SEQ ID NO: 3516503 - RNA, 14 nt, Pseudomonas aeruginosa PA01
caccgaguggcgca

SEQ ID NO: 3516504 - RNA, 16 nt, Pseudomonas aeruginosa PA01
caccgaguggcgcagc

SEQ ID NO: 3516505 - RNA, 18 nt, Pseudomonas aeruginosa PA01
caccgaguggcgcagcgc

SEQ ID NO: 3516506 - RNA, 17 nt, Pseudomonas aeruginosa PA01
caccgaguugaccagca

SEQ ID NO: 3516507 - RNA, 19 nt, Pseudomonas aeruginosa PA01
caccgaguugaccagcaug

SEQ ID NO: 3516508 - RNA, 21 nt, Pseudomonas aeruginosa PA01
caccgaucgcccgcgccucga

SEQ ID NO: 3516509 - RNA, 17 nt, Pseudomonas aeruginosa PA01
caccgaugccgaaggcg

SEQ ID NO: 3516510 - RNA, 16 nt, Pseudomonas aeruginosa PA01
caccgauggcgcgcuu

SEQ ID NO: 3516511 - RNA, 22 nt, Pseudomonas aeruginosa PA01
caccgauggcguguucauagaa

SEQ ID NO: 3516512 - RNA, 14 nt, Pseudomonas aeruginosa PA01
caccgauuucccca

SEQ ID NO: 3516513 - RNA, 17 nt, Pseudomonas aeruginosa PA01
caccgcaagggugcuca

SEQ ID NO: 3516514 - RNA, 15 nt, Pseudomonas aeruginosa PA01
caccgcacugguggc

SEQ ID NO: 3516515 - RNA, 18 nt, Pseudomonas aeruginosa PA01
caccgcauaggucaugcc

SEQ ID NO: 3516516 - RNA, 19 nt, Pseudomonas aeruginosa PA01
caccgcaucgaaggcgccg

SEQ ID NO: 3516517 - RNA, 20 nt, Pseudomonas aeruginosa PA01
caccgcaucgaaggcgccgg

SEQ ID NO: 3516518 - RNA, 19 nt, Pseudomonas aeruginosa PA01
caccgccaccccgccggcg

SEQ ID NO: 3516519 - RNA, 16 nt, Pseudomonas aeruginosa PA01
caccgccaccgccgga

SEQ ID NO: 3516520 - RNA, 14 nt, Pseudomonas aeruginosa PA01
caccgccaccugcc

SEQ ID NO: 3516521 - RNA, 14 nt, Pseudomonas aeruginosa PA01
caccgccaccuugc

SEQ ID NO: 3516522 - RNA, 13 nt, Pseudomonas aeruginosa PA01
caccgccagcacc

SEQ ID NO: 3516523 - RNA, 14 nt, Pseudomonas aeruginosa PA01
caccgccagcaccu

SEQ ID NO: 3516524 - RNA, 15 nt, Pseudomonas aeruginosa PA01
caccgccagcaccug

SEQ ID NO: 3516525 - RNA, 17 nt, Pseudomonas aeruginosa PA01
caccgccagcaccuggc

SEQ ID NO: 3516526 - RNA, 22 nt, Pseudomonas aeruginosa PA01
caccgccagcaguugcaacagc

SEQ ID NO: 3516527 - RNA, 23 nt, Pseudomonas aeruginosa PA01
caccgccagcaguugcaacagcg

SEQ ID NO: 3516528 - RNA, 16 nt, Pseudomonas aeruginosa PA01
caccgccagcccgcca

SEQ ID NO: 3516529 - RNA, 14 nt, Pseudomonas aeruginosa PA01
caccgccagcgucg

SEQ ID NO: 3516530 - RNA, 16 nt, Pseudomonas aeruginosa PA01
caccgccagcgucgcc

SEQ ID NO: 3516531 - RNA, 22 nt, Pseudomonas aeruginosa PA01
caccgccagcgucgccgccgcg

SEQ ID NO: 3516532 - RNA, 17 nt, Pseudomonas aeruginosa PA01
caccgccaggaccucga

SEQ ID NO: 3516533 - RNA, 14 nt, Pseudomonas aeruginosa PA01
caccgccagggcgc

SEQ ID NO: 3516534 - RNA, 17 nt, Pseudomonas aeruginosa PA01
caccgccagggcgcuca

SEQ ID NO: 3516535 - RNA, 14 nt, Pseudomonas aeruginosa PA01
caccgccaucagca

SEQ ID NO: 3516536 - RNA, 17 nt, Pseudomonas aeruginosa PA01
caccgccaucagcacga

SEQ ID NO: 3516537 - RNA, 12 nt, Pseudomonas aeruginosa PA01
caccgcccagcc

SEQ ID NO: 3516538 - RNA, 12 nt, Pseudomonas aeruginosa PA01
caccgcccccgc

SEQ ID NO: 3516539 - RNA, 19 nt, Pseudomonas aeruginosa PA01
caccgcccccgcauccucc

SEQ ID NO: 3516540 - RNA, 17 nt, Pseudomonas aeruginosa PA01
caccgcccccggcgcca

SEQ ID NO: 3516541 - RNA, 15 nt, Pseudomonas aeruginosa PA01
caccgcccugcgcga

SEQ ID NO: 3516542 - RNA, 22 nt, Pseudomonas aeruginosa PA01
caccgccgaggaacauccgcgg

SEQ ID NO: 3516543 - RNA, 17 nt, Pseudomonas aeruginosa PA01
caccgccgccagcaaca

SEQ ID NO: 3516544 - RNA, 13 nt, Pseudomonas aeruginosa PA01
caccgccgggacc

SEQ ID NO: 3516545 - RNA, 20 nt, Pseudomonas aeruginosa PA01
caccgccggguacagcgcca

SEQ ID NO: 3516546 - RNA, 13 nt, Pseudomonas aeruginosa PA01
caccgccucgacc

SEQ ID NO: 3516547 - RNA, 14 nt, Pseudomonas aeruginosa PA01
caccgccucgaccc

SEQ ID NO: 3516548 - RNA, 22 nt, Pseudomonas aeruginosa PA01
caccgccucggagaacagcagc

SEQ ID NO: 3516549 - RNA, 16 nt, Pseudomonas aeruginosa PA01
caccgccucgugcagc

SEQ ID NO: 3516550 - RNA, 16 nt, Pseudomonas aeruginosa PA01
caccgccugcagcacc

SEQ ID NO: 3516551 - RNA, 17 nt, Pseudomonas aeruginosa PA01
caccgccugcagcacca

SEQ ID NO: 3516552 - RNA, 18 nt, Pseudomonas aeruginosa PA01
caccgccuggaccagguc

SEQ ID NO: 3516553 - RNA, 13 nt, Pseudomonas aeruginosa PA01
caccgccuggcgc

SEQ ID NO: 3516554 - RNA, 18 nt, Pseudomonas aeruginosa PA01
caccgccuuggcaucgcc

SEQ ID NO: 3516555 - RNA, 16 nt, Pseudomonas aeruginosa PA01
caccgcgaauccgcgg

SEQ ID NO: 3516556 - RNA, 14 nt, Pseudomonas aeruginosa PA01
caccgcgacgcgcu

SEQ ID NO: 3516557 - RNA, 16 nt, Pseudomonas aeruginosa PA01
caccgcgacgcgcugg

SEQ ID NO: 3516558 - RNA, 18 nt, Pseudomonas aeruginosa PA01
caccgcgacgcgcuggac

SEQ ID NO: 3516559 - RNA, 19 nt, Pseudomonas aeruginosa PA01
caccgcgcaaaccggcagc

SEQ ID NO: 3516560 - RNA, 20 nt, Pseudomonas aeruginosa PA01
caccgcgcagaccaucagcu

SEQ ID NO: 3516561 - RNA, 15 nt, Pseudomonas aeruginosa PA01
caccgcgcagaugau

SEQ ID NO: 3516562 - RNA, 14 nt, Pseudomonas aeruginosa PA01
caccgcgcagcguc

SEQ ID NO: 3516563 - RNA, 15 nt, Pseudomonas aeruginosa PA01
caccgcgcagcguca

SEQ ID NO: 3516564 - RNA, 17 nt, Pseudomonas aeruginosa PA01
caccgcgcagcgucacc

SEQ ID NO: 3516565 - RNA, 13 nt, Pseudomonas aeruginosa PA01
caccgcgccgcgc

SEQ ID NO: 3516566 - RNA, 14 nt, Pseudomonas aeruginosa PA01
caccgcgccgcgcu

SEQ ID NO: 3516567 - RNA, 15 nt, Pseudomonas aeruginosa PA01
caccgcgccgcgcuu

SEQ ID NO: 3516568 - RNA, 12 nt, Pseudomonas aeruginosa PA01
caccgcgccggg

SEQ ID NO: 3516569 - RNA, 13 nt, Pseudomonas aeruginosa PA01
caccgcgccggga

SEQ ID NO: 3516570 - RNA, 15 nt, Pseudomonas aeruginosa PA01
caccgcgccuuccag

SEQ ID NO: 3516571 - RNA, 16 nt, Pseudomonas aeruginosa PA01
caccgcgcgcgccugc

SEQ ID NO: 3516572 - RNA, 13 nt, Pseudomonas aeruginosa PA01
caccgcgcggcac

SEQ ID NO: 3516573 - RNA, 16 nt, Pseudomonas aeruginosa PA01
caccgcgcggcacagc

SEQ ID NO: 3516574 - RNA, 14 nt, Pseudomonas aeruginosa PA01
caccgcgcuccgcu

SEQ ID NO: 3516575 - RNA, 17 nt, Pseudomonas aeruginosa PA01
caccgcggauccacgcc

SEQ ID NO: 3516576 - RNA, 19 nt, Pseudomonas aeruginosa PA01
caccgcggauccacgccug

SEQ ID NO: 3516577 - RNA, 21 nt, Pseudomonas aeruginosa PA01
caccgcggauccacgccuggc

SEQ ID NO: 3516578 - RNA, 23 nt, Pseudomonas aeruginosa PA01
caccgcggauccacgccuggccc

SEQ ID NO: 3516579 - RNA, 20 nt, Pseudomonas aeruginosa PA01
caccgcggccucgcuggcga

SEQ ID NO: 3516580 - RNA, 14 nt, Pseudomonas aeruginosa PA01
caccgcggccuugg

SEQ ID NO: 3516581 - RNA, 20 nt, Pseudomonas aeruginosa PA01
caccgcggccuuggucucga

SEQ ID NO: 3516582 - RNA, 15 nt, Pseudomonas aeruginosa PA01
caccgcggcgagccg

SEQ ID NO: 3516583 - RNA, 15 nt, Pseudomonas aeruginosa PA01
caccgcggcguccgc

SEQ ID NO: 3516584 - RNA, 19 nt, Pseudomonas aeruginosa PA01
caccgcgguggaggcggcg

SEQ ID NO: 3516585 - RNA, 20 nt, Pseudomonas aeruginosa PA01
caccgcgguggaggcggcgg

SEQ ID NO: 3516586 - RNA, 19 nt, Pseudomonas aeruginosa PA01
caccgcggugucggugccc

SEQ ID NO: 3516587 - RNA, 18 nt, Pseudomonas aeruginosa PA01
caccgcguaauaggcgaa

SEQ ID NO: 3516588 - RNA, 18 nt, Pseudomonas aeruginosa PA01
caccgcguccauccccgc

SEQ ID NO: 3516589 - RNA, 18 nt, Pseudomonas aeruginosa PA01
caccgcgucgaguaccgc

SEQ ID NO: 3516590 - RNA, 16 nt, Pseudomonas aeruginosa PA01
caccgcguggugcugc

SEQ ID NO: 3516591 - RNA, 17 nt, Pseudomonas aeruginosa PA01
caccgcguggugcugca

SEQ ID NO: 3516592 - RNA, 20 nt, Pseudomonas aeruginosa PA01
caccgcucaagacggcccgc

SEQ ID NO: 3516593 - RNA, 15 nt, Pseudomonas aeruginosa PA01
caccgcuccggcgcc

SEQ ID NO: 3516594 - RNA, 17 nt, Pseudomonas aeruginosa PA01
caccgcuccggcgccga

SEQ ID NO: 3516595 - RNA, 18 nt, Pseudomonas aeruginosa PA01
caccgcuccggcgccgag

SEQ ID NO: 3516596 - RNA, 20 nt, Pseudomonas aeruginosa PA01
caccgcucgaguucgcgcgg

SEQ ID NO: 3516597 - RNA, 22 nt, Pseudomonas aeruginosa PA01
caccgcucgaguucgcgcgggu

SEQ ID NO: 3516598 - RNA, 23 nt, Pseudomonas aeruginosa PA01
caccgcucgaguucgcgcggguc

SEQ ID NO: 3516599 - RNA, 12 nt, Pseudomonas aeruginosa PA01
caccgcucgcca

SEQ ID NO: 3516600 - RNA, 13 nt, Pseudomonas aeruginosa PA01
caccgcucgccag

SEQ ID NO: 3516601 - RNA, 14 nt, Pseudomonas aeruginosa PA01
caccgcucgccaga

SEQ ID NO: 3516602 - RNA, 12 nt, Pseudomonas aeruginosa PA01
caccgcucucga

SEQ ID NO: 3516603 - RNA, 17 nt, Pseudomonas aeruginosa PA01
caccgcugcgcaggugc

SEQ ID NO: 3516604 - RNA, 13 nt, Pseudomonas aeruginosa PA01
caccgcugcgccg

SEQ ID NO: 3516605 - RNA, 14 nt, Pseudomonas aeruginosa PA01
caccgcugcgccgc

SEQ ID NO: 3516606 - RNA, 16 nt, Pseudomonas aeruginosa PA01
caccgcugcgccgccg

SEQ ID NO: 3516607 - RNA, 18 nt, Pseudomonas aeruginosa PA01
caccgcugcgccgccguc

SEQ ID NO: 3516608 - RNA, 18 nt, Pseudomonas aeruginosa PA01
caccgcuucgagcacccc

SEQ ID NO: 3516609 - RNA, 15 nt, Pseudomonas aeruginosa PA01
caccgcuugccagcc

SEQ ID NO: 3516610 - RNA, 15 nt, Pseudomonas aeruginosa PA01
caccgcuuucaccag

SEQ ID NO: 3516611 - RNA, 16 nt, Pseudomonas aeruginosa PA01
caccgcuuucagcgcc

SEQ ID NO: 3516612 - RNA, 19 nt, Pseudomonas aeruginosa PA01
caccgcuuucagcgccgcu

SEQ ID NO: 3516613 - RNA, 15 nt, Pseudomonas aeruginosa PA01
caccgcuuucguagg

SEQ ID NO: 3516614 - RNA, 21 nt, Pseudomonas aeruginosa PA01
caccggaccgggcgccucguc

SEQ ID NO: 3516615 - RNA, 14 nt, Pseudomonas aeruginosa PA01
caccggacggcuga

SEQ ID NO: 3516616 - RNA, 14 nt, Pseudomonas aeruginosa PA01
caccggaucgaugc

SEQ ID NO: 3516617 - RNA, 16 nt, Pseudomonas aeruginosa PA01
caccggaucgaugccc

SEQ ID NO: 3516618 - RNA, 23 nt, Pseudomonas aeruginosa PA01
caccggaucgcccuggcgccagc

SEQ ID NO: 3516619 - RNA, 14 nt, Pseudomonas aeruginosa PA01
caccggcacgccau

SEQ ID NO: 3516620 - RNA, 19 nt, Pseudomonas aeruginosa PA01
caccggcacgcccuguuuc

SEQ ID NO: 3516621 - RNA, 13 nt, Pseudomonas aeruginosa PA01
caccggcagcagc

SEQ ID NO: 3516622 - RNA, 14 nt, Pseudomonas aeruginosa PA01
caccggcagcagcg

SEQ ID NO: 3516623 - RNA, 17 nt, Pseudomonas aeruginosa PA01
caccggcagcagcggau

SEQ ID NO: 3516624 - RNA, 18 nt, Pseudomonas aeruginosa PA01
caccggcagcagcggauc

SEQ ID NO: 3516625 - RNA, 20 nt, Pseudomonas aeruginosa PA01
caccggcaggaucggcgcgg

SEQ ID NO: 3516626 - RNA, 14 nt, Pseudomonas aeruginosa PA01
caccggcagggcga

SEQ ID NO: 3516627 - RNA, 20 nt, Pseudomonas aeruginosa PA01
caccggcauguagcgcgccg

SEQ ID NO: 3516628 - RNA, 21 nt, Pseudomonas aeruginosa PA01
caccggcauguagcgcgccga

SEQ ID NO: 3516629 - RNA, 23 nt, Pseudomonas aeruginosa PA01
caccggcauguagcgcgccgagg

SEQ ID NO: 3516630 - RNA, 16 nt, Pseudomonas aeruginosa PA01
caccggccacucgcag

SEQ ID NO: 3516631 - RNA, 21 nt, Pseudomonas aeruginosa PA01
caccggccacucgcagccgcg

SEQ ID NO: 3516632 - RNA, 14 nt, Pseudomonas aeruginosa PA01
caccggccaggcgc

SEQ ID NO: 3516633 - RNA, 16 nt, Pseudomonas aeruginosa PA01
caccggccucaagcaa

SEQ ID NO: 3516634 - RNA, 21 nt, Pseudomonas aeruginosa PA01
caccggcgacgaaagacgcug

SEQ ID NO: 3516635 - RNA, 17 nt, Pseudomonas aeruginosa PA01
caccggcgauggccggc

SEQ ID NO: 3516636 - RNA, 18 nt, Pseudomonas aeruginosa PA01
caccggcgauggccggca

SEQ ID NO: 3516637 - RNA, 20 nt, Pseudomonas aeruginosa PA01
caccggcgauggccggcacc

SEQ ID NO: 3516638 - RNA, 14 nt, Pseudomonas aeruginosa PA01
caccggcgccaccc

SEQ ID NO: 3516639 - RNA, 18 nt, Pseudomonas aeruginosa PA01
caccggcgccacccucgg

SEQ ID NO: 3516640 - RNA, 22 nt, Pseudomonas aeruginosa PA01
caccggcgccacccucggcuuc

SEQ ID NO: 3516641 - RNA, 13 nt, Pseudomonas aeruginosa PA01
caccggcgcgccg

SEQ ID NO: 3516642 - RNA, 14 nt, Pseudomonas aeruginosa PA01
caccggcgcgccgg

SEQ ID NO: 3516643 - RNA, 22 nt, Pseudomonas aeruginosa PA01
caccggcgcgccggacaggcca

SEQ ID NO: 3516644 - RNA, 15 nt, Pseudomonas aeruginosa PA01
caccggcggaugacg

SEQ ID NO: 3516645 - RNA, 22 nt, Pseudomonas aeruginosa PA01
caccggcggauuacuccgccgg

SEQ ID NO: 3516646 - RNA, 18 nt, Pseudomonas aeruginosa PA01
caccggcggcgccaggcc

SEQ ID NO: 3516647 - RNA, 20 nt, Pseudomonas aeruginosa PA01
caccggcgggauguacgcca

SEQ ID NO: 3516648 - RNA, 18 nt, Pseudomonas aeruginosa PA01
caccggcguuauccgccg

SEQ ID NO: 3516649 - RNA, 13 nt, Pseudomonas aeruginosa PA01
caccggcuggccc

SEQ ID NO: 3516650 - RNA, 14 nt, Pseudomonas aeruginosa PA01
caccggcuggcccu

SEQ ID NO: 3516651 - RNA, 15 nt, Pseudomonas aeruginosa PA01
caccggcuggcccuc

SEQ ID NO: 3516652 - RNA, 17 nt, Pseudomonas aeruginosa PA01
caccggcuggcccucca

SEQ ID NO: 3516653 - RNA, 15 nt, Pseudomonas aeruginosa PA01
caccggcuggccgcg

SEQ ID NO: 3516654 - RNA, 16 nt, Pseudomonas aeruginosa PA01
caccggcuggccgcga

SEQ ID NO: 3516655 - RNA, 13 nt, Pseudomonas aeruginosa PA01
caccggcuggcgg

SEQ ID NO: 3516656 - RNA, 14 nt, Pseudomonas aeruginosa PA01
caccggcuggcggc

SEQ ID NO: 3516657 - RNA, 15 nt, Pseudomonas aeruginosa PA01
caccggcuggcggcu

SEQ ID NO: 3516658 - RNA, 20 nt, Pseudomonas aeruginosa PA01
caccggcuggcggcucggcu

SEQ ID NO: 3516659 - RNA, 20 nt, Pseudomonas aeruginosa PA01
caccggcuuguugcgcucca

SEQ ID NO: 3516660 - RNA, 16 nt, Pseudomonas aeruginosa PA01
caccgggaagcagguc

SEQ ID NO: 3516661 - RNA, 21 nt, Pseudomonas aeruginosa PA01
caccgggacgaagcggaagcc

SEQ ID NO: 3516662 - RNA, 17 nt, Pseudomonas aeruginosa PA01
caccgggaggcgccgcg

SEQ ID NO: 3516663 - RNA, 19 nt, Pseudomonas aeruginosa PA01
caccgggaggcgccgcgcc

SEQ ID NO: 3516664 - RNA, 19 nt, Pseudomonas aeruginosa PA01
caccgggaucagcggcggg

SEQ ID NO: 3516665 - RNA, 23 nt, Pseudomonas aeruginosa PA01
caccgggaucagcggcggggcca

SEQ ID NO: 3516666 - RNA, 23 nt, Pseudomonas aeruginosa PA01
caccgggaucgcuaccgacagga

SEQ ID NO: 3516667 - RNA, 15 nt, Pseudomonas aeruginosa PA01
caccgggaucugccg

SEQ ID NO: 3516668 - RNA, 19 nt, Pseudomonas aeruginosa PA01
caccgggaucuggcccugc

SEQ ID NO: 3516669 - RNA, 23 nt, Pseudomonas aeruginosa PA01
caccgggaucuggcccugcaaca

SEQ ID NO: 3516670 - RNA, 20 nt, Pseudomonas aeruginosa PA01
caccgggaugaacugcagcu

SEQ ID NO: 3516671 - RNA, 20 nt, Pseudomonas aeruginosa PA01
caccgggauggucgagggcg

SEQ ID NO: 3516672 - RNA, 23 nt, Pseudomonas aeruginosa PA01
caccgggauggucgagggcgcgu

SEQ ID NO: 3516673 - RNA, 14 nt, Pseudomonas aeruginosa PA01
caccgggccgaccu

SEQ ID NO: 3516674 - RNA, 12 nt, Pseudomonas aeruginosa PA01
caccgggccgcc

SEQ ID NO: 3516675 - RNA, 14 nt, Pseudomonas aeruginosa PA01
caccgggccgccgg

SEQ ID NO: 3516676 - RNA, 17 nt, Pseudomonas aeruginosa PA01
caccgggccgccggcga

SEQ ID NO: 3516677 - RNA, 23 nt, Pseudomonas aeruginosa PA01
caccgggccgccggcgacgaggu

SEQ ID NO: 3516678 - RNA, 15 nt, Pseudomonas aeruginosa PA01
caccgggccgucggg

SEQ ID NO: 3516679 - RNA, 16 nt, Pseudomonas aeruginosa PA01
caccggggccuucagg

SEQ ID NO: 3516680 - RNA, 18 nt, Pseudomonas aeruginosa PA01
caccggggccuucaggcg

SEQ ID NO: 3516681 - RNA, 18 nt, Pseudomonas aeruginosa PA01
caccggggugauccagcu

SEQ ID NO: 3516682 - RNA, 19 nt, Pseudomonas aeruginosa PA01
caccggggugauccagcug

SEQ ID NO: 3516683 - RNA, 22 nt, Pseudomonas aeruginosa PA01
caccggggugauccagcuggcg

SEQ ID NO: 3516684 - RNA, 22 nt, Pseudomonas aeruginosa PA01
caccgggugcagguucaccgcc

SEQ ID NO: 3516685 - RNA, 16 nt, Pseudomonas aeruginosa PA01
caccgguaccacgggc

SEQ ID NO: 3516686 - RNA, 20 nt, Pseudomonas aeruginosa PA01
caccggucuuggcgcgcgac

SEQ ID NO: 3516687 - RNA, 13 nt, Pseudomonas aeruginosa PA01
caccggugccggg

SEQ ID NO: 3516688 - RNA, 23 nt, Pseudomonas aeruginosa PA01
caccgguggcgacgcgcaggccg

SEQ ID NO: 3516689 - RNA, 14 nt, Pseudomonas aeruginosa PA01
caccgguucgacac

SEQ ID NO: 3516690 - RNA, 15 nt, Pseudomonas aeruginosa PA01
caccgguuucgccag

SEQ ID NO: 3516691 - RNA, 20 nt, Pseudomonas aeruginosa PA01
caccguagcggcugcgguag

SEQ ID NO: 3516692 - RNA, 14 nt, Pseudomonas aeruginosa PA01
caccguaggccagg

SEQ ID NO: 3516693 - RNA, 21 nt, Pseudomonas aeruginosa PA01
caccguaggccaggcagacca

SEQ ID NO: 3516694 - RNA, 23 nt, Pseudomonas aeruginosa PA01
caccguaggccaggcagaccagc

SEQ ID NO: 3516695 - RNA, 15 nt, Pseudomonas aeruginosa PA01
caccgucaccuguuc

SEQ ID NO: 3516696 - RNA, 17 nt, Pseudomonas aeruginosa PA01
caccguccuucggccgc

SEQ ID NO: 3516697 - RNA, 20 nt, Pseudomonas aeruginosa PA01
caccguccuucggccgcacc

SEQ ID NO: 3516698 - RNA, 20 nt, Pseudomonas aeruginosa PA01
caccgucgaaccagccgcgu

SEQ ID NO: 3516699 - RNA, 20 nt, Pseudomonas aeruginosa PA01
caccgucgagcaccaggcgg

SEQ ID NO: 3516700 - RNA, 20 nt, Pseudomonas aeruginosa PA01
caccgucgcggucaucgccg

SEQ ID NO: 3516701 - RNA, 19 nt, Pseudomonas aeruginosa PA01
caccgucggauggccgucc

SEQ ID NO: 3516702 - RNA, 14 nt, Pseudomonas aeruginosa PA01
caccgugcccgccg

SEQ ID NO: 3516703 - RNA, 16 nt, Pseudomonas aeruginosa PA01
caccgugcccgccggc

SEQ ID NO: 3516704 - RNA, 21 nt, Pseudomonas aeruginosa PA01
caccgugcccgccggcgcgcc

SEQ ID NO: 3516705 - RNA, 16 nt, Pseudomonas aeruginosa PA01
caccgugcgcgcggcc

SEQ ID NO: 3516706 - RNA, 20 nt, Pseudomonas aeruginosa PA01
caccguggaaaccucgccga

SEQ ID NO: 3516707 - RNA, 22 nt, Pseudomonas aeruginosa PA01
caccguggaaaccucgccgauc

SEQ ID NO: 3516708 - RNA, 15 nt, Pseudomonas aeruginosa PA01
caccguggagagguc

SEQ ID NO: 3516709 - RNA, 17 nt, Pseudomonas aeruginosa PA01
caccguggcgacgaugc

SEQ ID NO: 3516710 - RNA, 19 nt, Pseudomonas aeruginosa PA01
caccguggcgacgaugcgc

SEQ ID NO: 3516711 - RNA, 20 nt, Pseudomonas aeruginosa PA01
caccguggcgacgaugcgcc

SEQ ID NO: 3516712 - RNA, 22 nt, Pseudomonas aeruginosa PA01
caccguggcgacgaugcgcccc

SEQ ID NO: 3516713 - RNA, 14 nt, Pseudomonas aeruginosa PA01
caccguggcgccau

SEQ ID NO: 3516714 - RNA, 19 nt, Pseudomonas aeruginosa PA01
caccguggcgccggcgcgc

SEQ ID NO: 3516715 - RNA, 22 nt, Pseudomonas aeruginosa PA01
caccguggcgccggcgcgcuug

SEQ ID NO: 3516716 - RNA, 13 nt, Pseudomonas aeruginosa PA01
caccguggcgcug

SEQ ID NO: 3516717 - RNA, 16 nt, Pseudomonas aeruginosa PA01
caccguggucagcacc

SEQ ID NO: 3516718 - RNA, 19 nt, Pseudomonas aeruginosa PA01
caccguggucagcaccagg

SEQ ID NO: 3516719 - RNA, 20 nt, Pseudomonas aeruginosa PA01
caccguggucagcaccaggg

SEQ ID NO: 3516720 - RNA, 16 nt, Pseudomonas aeruginosa PA01
caccguggugcccggg

SEQ ID NO: 3516721 - RNA, 19 nt, Pseudomonas aeruginosa PA01
caccguguugaucgccgcg

SEQ ID NO: 3516722 - RNA, 20 nt, Pseudomonas aeruginosa PA01
caccguguugaucgccgcgc

SEQ ID NO: 3516723 - RNA, 22 nt, Pseudomonas aeruginosa PA01
caccguguugaucgccgcgccg

SEQ ID NO: 3516724 - RNA, 17 nt, Pseudomonas aeruginosa PA01
caccguuccgacccggc

SEQ ID NO: 3516725 - RNA, 18 nt, Pseudomonas aeruginosa PA01
caccguuccgacccggcc

SEQ ID NO: 3516726 - RNA, 21 nt, Pseudomonas aeruginosa PA01
caccguuccgacccggccgac

SEQ ID NO: 3516727 - RNA, 20 nt, Pseudomonas aeruginosa PA01
caccguucuugaucaccgcg

SEQ ID NO: 3516728 - RNA, 14 nt, Pseudomonas aeruginosa PA01
caccuacccgagca

SEQ ID NO: 3516729 - RNA, 13 nt, Pseudomonas aeruginosa PA01
caccuacuaccgc

SEQ ID NO: 3516730 - RNA, 15 nt, Pseudomonas aeruginosa PA01
caccuacuaccgcug

SEQ ID NO: 3516731 - RNA, 16 nt, Pseudomonas aeruginosa PA01
caccucauacuugggu

SEQ ID NO: 3516732 - RNA, 12 nt, Pseudomonas aeruginosa PA01
caccucaugcug

SEQ ID NO: 3516733 - RNA, 16 nt, Pseudomonas aeruginosa PA01
caccucaugcugcgcg

SEQ ID NO: 3516734 - RNA, 21 nt, Pseudomonas aeruginosa PA01
caccucccccagcgggcgguc

SEQ ID NO: 3516735 - RNA, 22 nt, Pseudomonas aeruginosa PA01
caccucccgggccagcuccgcc

SEQ ID NO: 3516736 - RNA, 23 nt, Pseudomonas aeruginosa PA01
caccuccggaugcagauccagcg

SEQ ID NO: 3516737 - RNA, 17 nt, Pseudomonas aeruginosa PA01
caccucgaaccccuggc

SEQ ID NO: 3516738 - RNA, 22 nt, Pseudomonas aeruginosa PA01
caccucgacccuggcgccgacc

SEQ ID NO: 3516739 - RNA, 18 nt, Pseudomonas aeruginosa PA01
caccucgaccgcgccggc

SEQ ID NO: 3516740 - RNA, 11 nt, Pseudomonas aeruginosa PA01
caccucgaccu

SEQ ID NO: 3516741 - RNA, 12 nt, Pseudomonas aeruginosa PA01
caccucgaccug

SEQ ID NO: 3516742 - RNA, 16 nt, Pseudomonas aeruginosa PA01
caccucgacggcgauc

SEQ ID NO: 3516743 - RNA, 15 nt, Pseudomonas aeruginosa PA01
caccucgaucagcgg

SEQ ID NO: 3516744 - RNA, 17 nt, Pseudomonas aeruginosa PA01
caccucgaucagcgggu

SEQ ID NO: 3516745 - RNA, 20 nt, Pseudomonas aeruginosa PA01
caccucgaugaacagugcgc

SEQ ID NO: 3516746 - RNA, 17 nt, Pseudomonas aeruginosa PA01
caccucgauggcggcgg

SEQ ID NO: 3516747 - RNA, 17 nt, Pseudomonas aeruginosa PA01
caccucgcccucgcucc

SEQ ID NO: 3516748 - RNA, 16 nt, Pseudomonas aeruginosa PA01
caccucgcgggaacgg

SEQ ID NO: 3516749 - RNA, 18 nt, Pseudomonas aeruginosa PA01
caccucgcgggaacggcg

SEQ ID NO: 3516750 - RNA, 14 nt, Pseudomonas aeruginosa PA01
caccucggaccaga

SEQ ID NO: 3516751 - RNA, 13 nt, Pseudomonas aeruginosa PA01
caccucggccagg

SEQ ID NO: 3516752 - RNA, 13 nt, Pseudomonas aeruginosa PA01
caccucggcgcca

SEQ ID NO: 3516753 - RNA, 22 nt, Pseudomonas aeruginosa PA01
caccucggcgccauaggccagc

SEQ ID NO: 3516754 - RNA, 19 nt, Pseudomonas aeruginosa PA01
caccucguccagcaggacg

SEQ ID NO: 3516755 - RNA, 20 nt, Pseudomonas aeruginosa PA01
caccucgucgagcagcgcgc

SEQ ID NO: 3516756 - RNA, 13 nt, Pseudomonas aeruginosa PA01
caccucuucgcca

SEQ ID NO: 3516757 - RNA, 16 nt, Pseudomonas aeruginosa PA01
caccucuucgccaucc

SEQ ID NO: 3516758 - RNA, 20 nt, Pseudomonas aeruginosa PA01
caccugaacgcgcccggcca

SEQ ID NO: 3516759 - RNA, 23 nt, Pseudomonas aeruginosa PA01
caccugaacgcgcccggccaggc

SEQ ID NO: 3516760 - RNA, 16 nt, Pseudomonas aeruginosa PA01
caccugcaacacgucg

SEQ ID NO: 3516761 - RNA, 15 nt, Pseudomonas aeruginosa PA01
caccugcaacgcccg

SEQ ID NO: 3516762 - RNA, 17 nt, Pseudomonas aeruginosa PA01
caccugcaacucggcgu

SEQ ID NO: 3516763 - RNA, 22 nt, Pseudomonas aeruginosa PA01
caccugcaacucggcgucgcgc

SEQ ID NO: 3516764 - RNA, 22 nt, Pseudomonas aeruginosa PA01
caccugcagacgguucagcagc

SEQ ID NO: 3516765 - RNA, 22 nt, Pseudomonas aeruginosa PA01
caccugcaucaccaggcugccg

SEQ ID NO: 3516766 - RNA, 19 nt, Pseudomonas aeruginosa PA01
caccugcaucacguacggc

SEQ ID NO: 3516767 - RNA, 20 nt, Pseudomonas aeruginosa PA01
caccugccccgggcgccggg

SEQ ID NO: 3516768 - RNA, 20 nt, Pseudomonas aeruginosa PA01
caccugcgccgaaggcguca

SEQ ID NO: 3516769 - RNA, 20 nt, Pseudomonas aeruginosa PA01
caccugcgggcugcgugcca

SEQ ID NO: 3516770 - RNA, 17 nt, Pseudomonas aeruginosa PA01
caccugcguggcgaacg

SEQ ID NO: 3516771 - RNA, 22 nt, Pseudomonas aeruginosa PA01
caccugcuucugguugcucacc

SEQ ID NO: 3516772 - RNA, 23 nt, Pseudomonas aeruginosa PA01
caccugcuucugguugcucacca

SEQ ID NO: 3516773 - RNA, 22 nt, Pseudomonas aeruginosa PA01
caccugcuugggcgccucgccg

SEQ ID NO: 3516774 - RNA, 22 nt, Pseudomonas aeruginosa PA01
caccuggaacuugcuguugccg

SEQ ID NO: 3516775 - RNA, 20 nt, Pseudomonas aeruginosa PA01
caccuggaucgccaggcuga

SEQ ID NO: 3516776 - RNA, 15 nt, Pseudomonas aeruginosa PA01
caccuggcagugcgc

SEQ ID NO: 3516777 - RNA, 21 nt, Pseudomonas aeruginosa PA01
caccuggcagugcgccggcau

SEQ ID NO: 3516778 - RNA, 14 nt, Pseudomonas aeruginosa PA01
caccuggccgguga

SEQ ID NO: 3516779 - RNA, 15 nt, Pseudomonas aeruginosa PA01
caccuggccgugcuc

SEQ ID NO: 3516780 - RNA, 17 nt, Pseudomonas aeruginosa PA01
caccuggcgacaggcga

SEQ ID NO: 3516781 - RNA, 18 nt, Pseudomonas aeruginosa PA01
caccuggcgaugcccugg

SEQ ID NO: 3516782 - RNA, 19 nt, Pseudomonas aeruginosa PA01
caccuggcgaugcccuggc

SEQ ID NO: 3516783 - RNA, 13 nt, Pseudomonas aeruginosa PA01
caccuggcgcucg

SEQ ID NO: 3516784 - RNA, 18 nt, Pseudomonas aeruginosa PA01
caccuggcggcugagcug

SEQ ID NO: 3516785 - RNA, 20 nt, Pseudomonas aeruginosa PA01
caccuggcggcugagcuguu

SEQ ID NO: 3516786 - RNA, 18 nt, Pseudomonas aeruginosa PA01
caccuggcggucgccgcc

SEQ ID NO: 3516787 - RNA, 22 nt, Pseudomonas aeruginosa PA01
caccuggcggucgccgccggcg

SEQ ID NO: 3516788 - RNA, 22 nt, Pseudomonas aeruginosa PA01
caccugggcguuggccagcgcc

SEQ ID NO: 3516789 - RNA, 17 nt, Pseudomonas aeruginosa PA01
caccugggugcuuuccu

SEQ ID NO: 3516790 - RNA, 14 nt, Pseudomonas aeruginosa PA01
caccuggucgccga

SEQ ID NO: 3516791 - RNA, 16 nt, Pseudomonas aeruginosa PA01
caccuggucgccgaag

SEQ ID NO: 3516792 - RNA, 23 nt, Pseudomonas aeruginosa PA01
caccuggucuucgguggcggcga

SEQ ID NO: 3516793 - RNA, 21 nt, Pseudomonas aeruginosa PA01
caccugguggacacccugcug

SEQ ID NO: 3516794 - RNA, 22 nt, Pseudomonas aeruginosa PA01
caccugguggacacccugcugc

SEQ ID NO: 3516795 - RNA, 24 nt, Pseudomonas aeruginosa PA01
caccugguggacacccugcugcug

SEQ ID NO: 3516796 - RNA, 22 nt, Pseudomonas aeruginosa PA01
caccugguucaucgagcggcgg

SEQ ID NO: 3516797 - RNA, 23 nt, Pseudomonas aeruginosa PA01
caccugguucaucgagcggcggc

SEQ ID NO: 3516798 - RNA, 14 nt, Pseudomonas aeruginosa PA01
caccuguagcaggg

SEQ ID NO: 3516799 - RNA, 17 nt, Pseudomonas aeruginosa PA01
caccuguagcagggugc

SEQ ID NO: 3516800 - RNA, 19 nt, Pseudomonas aeruginosa PA01
caccuguuccagcaacgcc

SEQ ID NO: 3516801 - RNA, 20 nt, Pseudomonas aeruginosa PA01
caccuguuccagcaacgccu

SEQ ID NO: 3516802 - RNA, 17 nt, Pseudomonas aeruginosa PA01
caccuguuucagcgggu

SEQ ID NO: 3516803 - RNA, 17 nt, Pseudomonas aeruginosa PA01
caccuucaggcugcuca

SEQ ID NO: 3516804 - RNA, 20 nt, Pseudomonas aeruginosa PA01
caccuucaucaccaggucgc

SEQ ID NO: 3516805 - RNA, 16 nt, Pseudomonas aeruginosa PA01
caccuucgccagcagg

SEQ ID NO: 3516806 - RNA, 23 nt, Pseudomonas aeruginosa PA01
caccuucgcccgcugcgcugcca

SEQ ID NO: 3516807 - RNA, 13 nt, Pseudomonas aeruginosa PA01
caccuucgcccuc

SEQ ID NO: 3516808 - RNA, 13 nt, Pseudomonas aeruginosa PA01
caccuugaccuug

SEQ ID NO: 3516809 - RNA, 22 nt, Pseudomonas aeruginosa PA01
caccuugaccuugucggccgac

SEQ ID NO: 3516810 - RNA, 13 nt, Pseudomonas aeruginosa PA01
caccuugauccgc

SEQ ID NO: 3516811 - RNA, 21 nt, Pseudomonas aeruginosa PA01
caccuugauccgcgacgaggg

SEQ ID NO: 3516812 - RNA, 14 nt, Pseudomonas aeruginosa PA01
caccuugccgcgcc

SEQ ID NO: 3516813 - RNA, 18 nt, Pseudomonas aeruginosa PA01
caccuugccgcgcccggc

SEQ ID NO: 3516814 - RNA, 16 nt, Pseudomonas aeruginosa PA01
caccuugcgcaccgcc

SEQ ID NO: 3516815 - RNA, 17 nt, Pseudomonas aeruginosa PA01
caccuugcgcaccgccu

SEQ ID NO: 3516816 - RNA, 14 nt, Pseudomonas aeruginosa PA01
caccuuggcgcgac

SEQ ID NO: 3516817 - RNA, 17 nt, Pseudomonas aeruginosa PA01
caccuuggugccgaccu

SEQ ID NO: 3516818 - RNA, 17 nt, Pseudomonas aeruginosa PA01
caccuuguacggcagcg

SEQ ID NO: 3516819 - RNA, 19 nt, Pseudomonas aeruginosa PA01
caccuuguacggcagcggc

SEQ ID NO: 3516820 - RNA, 20 nt, Pseudomonas aeruginosa PA01
caccuugucgcaccagccuu

SEQ ID NO: 3516821 - RNA, 23 nt, Pseudomonas aeruginosa PA01
caccuugucgcaccagccuuccg

SEQ ID NO: 3516822 - RNA, 15 nt, Pseudomonas aeruginosa PA01
caccuugucgcugac

SEQ ID NO: 3516823 - RNA, 15 nt, Pseudomonas aeruginosa PA01
caccuugugcugccu

SEQ ID NO: 3516824 - RNA, 13 nt, Pseudomonas aeruginosa PA01
cacgaaaaagccg

SEQ ID NO: 3516825 - RNA, 18 nt, Pseudomonas aeruginosa PA01
cacgaaaaagccggcgca

SEQ ID NO: 3516826 - RNA, 16 nt, Pseudomonas aeruginosa PA01
cacgaaagccaugccc

SEQ ID NO: 3516827 - RNA, 22 nt, Pseudomonas aeruginosa PA01
cacgaaagccaugcccagacgc

SEQ ID NO: 3516828 - RNA, 18 nt, Pseudomonas aeruginosa PA01
cacgaacagggucuucag

SEQ ID NO: 3516829 - RNA, 19 nt, Pseudomonas aeruginosa PA01
cacgaacagggucuucagg

SEQ ID NO: 3516830 - RNA, 23 nt, Pseudomonas aeruginosa PA01
cacgaaccauugcggcccgccac

SEQ ID NO: 3516831 - RNA, 15 nt, Pseudomonas aeruginosa PA01
cacgaacccaggcgc

SEQ ID NO: 3516832 - RNA, 19 nt, Pseudomonas aeruginosa PA01
cacgaaccguccgcagcgc

SEQ ID NO: 3516833 - RNA, 24 nt, Pseudomonas aeruginosa PA01
cacgaacgaggcucggucgcgcgg

SEQ ID NO: 3516834 - RNA, 16 nt, Pseudomonas aeruginosa PA01
cacgaacugcauggcc

SEQ ID NO: 3516835 - RNA, 22 nt, Pseudomonas aeruginosa PA01
cacgaacugcauggccuuguga

SEQ ID NO: 3516836 - RNA, 17 nt, Pseudomonas aeruginosa PA01
cacgaagagcaccuugu

SEQ ID NO: 3516837 - RNA, 15 nt, Pseudomonas aeruginosa PA01
cacgaagcggucgcc

SEQ ID NO: 3516838 - RNA, 23 nt, Pseudomonas aeruginosa PA01
cacgaagcggucgccggcgcgca

SEQ ID NO: 3516839 - RNA, 15 nt, Pseudomonas aeruginosa PA01
cacgacaggcggcgg

SEQ ID NO: 3516840 - RNA, 17 nt, Pseudomonas aeruginosa PA01
cacgaccacaucggcca

SEQ ID NO: 3516841 - RNA, 21 nt, Pseudomonas aeruginosa PA01
cacgacccgcucuuccuuguc

SEQ ID NO: 3516842 - RNA, 22 nt, Pseudomonas aeruginosa PA01
cacgacccgcucuuccuugucg

SEQ ID NO: 3516843 - RNA, 14 nt, Pseudomonas aeruginosa PA01
cacgacccugcugg

SEQ ID NO: 3516844 - RNA, 18 nt, Pseudomonas aeruginosa PA01
cacgacccugcuggccgg

SEQ ID NO: 3516845 - RNA, 22 nt, Pseudomonas aeruginosa PA01
cacgacccugcuggccggugcc

SEQ ID NO: 3516846 - RNA, 22 nt, Pseudomonas aeruginosa PA01
cacgacgaacucaacgaaguga

SEQ ID NO: 3516847 - RNA, 18 nt, Pseudomonas aeruginosa PA01
cacgacgaagcgccggcg

SEQ ID NO: 3516848 - RNA, 23 nt, Pseudomonas aeruginosa PA01
cacgacgaagcgccggcggccug

SEQ ID NO: 3516849 - RNA, 22 nt, Pseudomonas aeruginosa PA01
cacgacgccggugccaggacca

SEQ ID NO: 3516850 - RNA, 14 nt, Pseudomonas aeruginosa PA01
cacgacgucggcgg

SEQ ID NO: 3516851 - RNA, 14 nt, Pseudomonas aeruginosa PA01
cacgacguugcccu

SEQ ID NO: 3516852 - RNA, 22 nt, Pseudomonas aeruginosa PA01
cacgacucacccgcugcggaag

SEQ ID NO: 3516853 - RNA, 14 nt, Pseudomonas aeruginosa PA01
cacgagaccaccga

SEQ ID NO: 3516854 - RNA, 22 nt, Pseudomonas aeruginosa PA01
cacgaggauuuccgcgcccggc

SEQ ID NO: 3516855 - RNA, 13 nt, Pseudomonas aeruginosa PA01
cacgagucgaggc

SEQ ID NO: 3516856 - RNA, 16 nt, Pseudomonas aeruginosa PA01
cacgagucgaggcgau

SEQ ID NO: 3516857 - RNA, 22 nt, Pseudomonas aeruginosa PA01
cacgaucagcucguugcccggc

SEQ ID NO: 3516858 - RNA, 13 nt, Pseudomonas aeruginosa PA01
cacgaucaggccc

SEQ ID NO: 3516859 - RNA, 16 nt, Pseudomonas aeruginosa PA01
cacgaucgcggcgacg

SEQ ID NO: 3516860 - RNA, 17 nt, Pseudomonas aeruginosa PA01
cacgaucggcaccauca

SEQ ID NO: 3516861 - RNA, 21 nt, Pseudomonas aeruginosa PA01
cacgaucggcaccaucaccga

SEQ ID NO: 3516862 - RNA, 16 nt, Pseudomonas aeruginosa PA01
cacgaucugcgccgca

SEQ ID NO: 3516863 - RNA, 13 nt, Pseudomonas aeruginosa PA01
cacgaugcugaac

SEQ ID NO: 3516864 - RNA, 15 nt, Pseudomonas aeruginosa PA01
cacgauggccggcag

SEQ ID NO: 3516865 - RNA, 16 nt, Pseudomonas aeruginosa PA01
cacgauggccggcagc

SEQ ID NO: 3516866 - RNA, 15 nt, Pseudomonas aeruginosa PA01
cacgaugucgcgggu

SEQ ID NO: 3516867 - RNA, 18 nt, Pseudomonas aeruginosa PA01
cacgcaaacccauuuccc

SEQ ID NO: 3516868 - RNA, 17 nt, Pseudomonas aeruginosa PA01
cacgcaagugcccuggg

SEQ ID NO: 3516869 - RNA, 18 nt, Pseudomonas aeruginosa PA01
cacgcaagugcccugggc

SEQ ID NO: 3516870 - RNA, 19 nt, Pseudomonas aeruginosa PA01
cacgcaagugcccugggcg

SEQ ID NO: 3516871 - RNA, 20 nt, Pseudomonas aeruginosa PA01
cacgcaauagugcagcucca

SEQ ID NO: 3516872 - RNA, 22 nt, Pseudomonas aeruginosa PA01
cacgcaauggcgcagccgcugg

SEQ ID NO: 3516873 - RNA, 14 nt, Pseudomonas aeruginosa PA01
cacgcaccaccagg

SEQ ID NO: 3516874 - RNA, 14 nt, Pseudomonas aeruginosa PA01
cacgcaccagcucc

SEQ ID NO: 3516875 - RNA, 14 nt, Pseudomonas aeruginosa PA01
cacgcacgcgccug

SEQ ID NO: 3516876 - RNA, 15 nt, Pseudomonas aeruginosa PA01
cacgcacgcgccugc

SEQ ID NO: 3516877 - RNA, 20 nt, Pseudomonas aeruginosa PA01
cacgcagaaggcgcuuucgu

SEQ ID NO: 3516878 - RNA, 15 nt, Pseudomonas aeruginosa PA01
cacgcagagcggcag

SEQ ID NO: 3516879 - RNA, 17 nt, Pseudomonas aeruginosa PA01
cacgcagagcggcaggc

SEQ ID NO: 3516880 - RNA, 23 nt, Pseudomonas aeruginosa PA01
cacgcagagcggcaggccgccga

SEQ ID NO: 3516881 - RNA, 15 nt, Pseudomonas aeruginosa PA01
cacgcagcaggcgac

SEQ ID NO: 3516882 - RNA, 16 nt, Pseudomonas aeruginosa PA01
cacgcagcaggcgacg

SEQ ID NO: 3516883 - RNA, 17 nt, Pseudomonas aeruginosa PA01
cacgcagcaggcgacgg

SEQ ID NO: 3516884 - RNA, 22 nt, Pseudomonas aeruginosa PA01
cacgcagcaggcgacggucagg

SEQ ID NO: 3516885 - RNA, 14 nt, Pseudomonas aeruginosa PA01
cacgcagccacccg

SEQ ID NO: 3516886 - RNA, 15 nt, Pseudomonas aeruginosa PA01
cacgcagcgccgcgu

SEQ ID NO: 3516887 - RNA, 14 nt, Pseudomonas aeruginosa PA01
cacgcaggaacagc

SEQ ID NO: 3516888 - RNA, 15 nt, Pseudomonas aeruginosa PA01
cacgcaggccagcgc

SEQ ID NO: 3516889 - RNA, 21 nt, Pseudomonas aeruginosa PA01
cacgcaggccagcgccagggg

SEQ ID NO: 3516890 - RNA, 12 nt, Pseudomonas aeruginosa PA01
cacgcaggccgc

SEQ ID NO: 3516891 - RNA, 11 nt, Pseudomonas aeruginosa PA01
cacgcaggcgc

SEQ ID NO: 3516892 - RNA, 13 nt, Pseudomonas aeruginosa PA01
cacgcaggcgcgu

SEQ ID NO: 3516893 - RNA, 16 nt, Pseudomonas aeruginosa PA01
cacgcaggcgcuggcc

SEQ ID NO: 3516894 - RNA, 19 nt, Pseudomonas aeruginosa PA01
cacgcaguacagcugcacc

SEQ ID NO: 3516895 - RNA, 21 nt, Pseudomonas aeruginosa PA01
cacgcaguacagcugcaccgc

SEQ ID NO: 3516896 - RNA, 22 nt, Pseudomonas aeruginosa PA01
cacgcaguacagcugcaccgcg

SEQ ID NO: 3516897 - RNA, 23 nt, Pseudomonas aeruginosa PA01
cacgcaguacagcugcaccgcgc

SEQ ID NO: 3516898 - RNA, 20 nt, Pseudomonas aeruginosa PA01
cacgcaguucgcgggccgcg

SEQ ID NO: 3516899 - RNA, 21 nt, Pseudomonas aeruginosa PA01
cacgcaguucgcgggccgcgg

SEQ ID NO: 3516900 - RNA, 23 nt, Pseudomonas aeruginosa PA01
cacgcauagcgcgcuguagccgg

SEQ ID NO: 3516901 - RNA, 17 nt, Pseudomonas aeruginosa PA01
cacgcauugucgggcgu

SEQ ID NO: 3516902 - RNA, 18 nt, Pseudomonas aeruginosa PA01
cacgccauaggcggcgca

SEQ ID NO: 3516903 - RNA, 15 nt, Pseudomonas aeruginosa PA01
cacgccauccuccga

SEQ ID NO: 3516904 - RNA, 18 nt, Pseudomonas aeruginosa PA01
cacgcccaggcgcucggc

SEQ ID NO: 3516905 - RNA, 18 nt, Pseudomonas aeruginosa PA01
cacgcccaguugcgccgc

SEQ ID NO: 3516906 - RNA, 19 nt, Pseudomonas aeruginosa PA01
cacgcccaguugcgccgcc

SEQ ID NO: 3516907 - RNA, 20 nt, Pseudomonas aeruginosa PA01
cacgcccaguugcgccgccu

SEQ ID NO: 3516908 - RNA, 23 nt, Pseudomonas aeruginosa PA01
cacgcccaucgccaccagcagga

SEQ ID NO: 3516909 - RNA, 20 nt, Pseudomonas aeruginosa PA01
cacgcccaucggcgucggcu

SEQ ID NO: 3516910 - RNA, 17 nt, Pseudomonas aeruginosa PA01
cacgcccaugccuugca

SEQ ID NO: 3516911 - RNA, 21 nt, Pseudomonas aeruginosa PA01
cacgcccaugccuugcagcgc

SEQ ID NO: 3516912 - RNA, 13 nt, Pseudomonas aeruginosa PA01
cacgccccagaag

SEQ ID NO: 3516913 - RNA, 13 nt, Pseudomonas aeruginosa PA01
cacgccccauccg

SEQ ID NO: 3516914 - RNA, 16 nt, Pseudomonas aeruginosa PA01
cacgccccuccuucga

SEQ ID NO: 3516915 - RNA, 18 nt, Pseudomonas aeruginosa PA01
cacgccccuccuucgagc

SEQ ID NO: 3516916 - RNA, 22 nt, Pseudomonas aeruginosa PA01
cacgccccuccuucgagccugg

SEQ ID NO: 3516917 - RNA, 15 nt, Pseudomonas aeruginosa PA01
cacgcccgccguggc

SEQ ID NO: 3516918 - RNA, 23 nt, Pseudomonas aeruginosa PA01
cacgcccgcgguauucuccagca

SEQ ID NO: 3516919 - RNA, 15 nt, Pseudomonas aeruginosa PA01
cacgcccggcacucg

SEQ ID NO: 3516920 - RNA, 17 nt, Pseudomonas aeruginosa PA01
cacgcccggcacucgcc

SEQ ID NO: 3516921 - RNA, 12 nt, Pseudomonas aeruginosa PA01
cacgcccugcgc

SEQ ID NO: 3516922 - RNA, 16 nt, Pseudomonas aeruginosa PA01
cacgcccugggacagg

SEQ ID NO: 3516923 - RNA, 22 nt, Pseudomonas aeruginosa PA01
cacgccgaacuuguagggcucg

SEQ ID NO: 3516924 - RNA, 19 nt, Pseudomonas aeruginosa PA01
cacgccgaaguccugcaac

SEQ ID NO: 3516925 - RNA, 20 nt, Pseudomonas aeruginosa PA01
cacgccgaaguccugcaaca

SEQ ID NO: 3516926 - RNA, 24 nt, Pseudomonas aeruginosa PA01
cacgccgaaguccugcaacagggc

SEQ ID NO: 3516927 - RNA, 17 nt, Pseudomonas aeruginosa PA01
cacgccgaagucggcga

SEQ ID NO: 3516928 - RNA, 22 nt, Pseudomonas aeruginosa PA01
cacgccgaagucggcgagccgg

SEQ ID NO: 3516929 - RNA, 15 nt, Pseudomonas aeruginosa PA01
cacgccgaaguucuu

SEQ ID NO: 3516930 - RNA, 12 nt, Pseudomonas aeruginosa PA01
cacgccgagggc

SEQ ID NO: 3516931 - RNA, 17 nt, Pseudomonas aeruginosa PA01
cacgccgagggcgcggc

SEQ ID NO: 3516932 - RNA, 18 nt, Pseudomonas aeruginosa PA01
cacgccgagggcgcggcg

SEQ ID NO: 3516933 - RNA, 21 nt, Pseudomonas aeruginosa PA01
cacgccgagggcgcggcgcca

SEQ ID NO: 3516934 - RNA, 16 nt, Pseudomonas aeruginosa PA01
cacgccgauaccggcc

SEQ ID NO: 3516935 - RNA, 20 nt, Pseudomonas aeruginosa PA01
cacgccgauaccggccucga

SEQ ID NO: 3516936 - RNA, 18 nt, Pseudomonas aeruginosa PA01
cacgccgaucaccccgcc

SEQ ID NO: 3516937 - RNA, 17 nt, Pseudomonas aeruginosa PA01
cacgccgaucccgaucg

SEQ ID NO: 3516938 - RNA, 18 nt, Pseudomonas aeruginosa PA01
cacgccgaucccggcggc

SEQ ID NO: 3516939 - RNA, 22 nt, Pseudomonas aeruginosa PA01
cacgccgaucccggcggcgacc

SEQ ID NO: 3516940 - RNA, 20 nt, Pseudomonas aeruginosa PA01
cacgccgcgaccgaagccgc

SEQ ID NO: 3516941 - RNA, 23 nt, Pseudomonas aeruginosa PA01
cacgccgcgaccgaagccgcgca

SEQ ID NO: 3516942 - RNA, 17 nt, Pseudomonas aeruginosa PA01
cacgccgcgcaccagca

SEQ ID NO: 3516943 - RNA, 20 nt, Pseudomonas aeruginosa PA01
cacgccgcggaaggcccgcg

SEQ ID NO: 3516944 - RNA, 15 nt, Pseudomonas aeruginosa PA01
cacgccgcucugccc

SEQ ID NO: 3516945 - RNA, 23 nt, Pseudomonas aeruginosa PA01
cacgccgcucugcccgaccgggu

SEQ ID NO: 3516946 - RNA, 17 nt, Pseudomonas aeruginosa PA01
cacgccgggaaucccca

SEQ ID NO: 3516947 - RNA, 17 nt, Pseudomonas aeruginosa PA01
cacgccgggcacaaaaa

SEQ ID NO: 3516948 - RNA, 16 nt, Pseudomonas aeruginosa PA01
cacgccgguggccagg

SEQ ID NO: 3516949 - RNA, 19 nt, Pseudomonas aeruginosa PA01
cacgccgguggccaggcuc

SEQ ID NO: 3516950 - RNA, 22 nt, Pseudomonas aeruginosa PA01
cacgccgugcaucaccggcagc

SEQ ID NO: 3516951 - RNA, 23 nt, Pseudomonas aeruginosa PA01
cacgccguucagggucagguugc

SEQ ID NO: 3516952 - RNA, 15 nt, Pseudomonas aeruginosa PA01
cacgccugccaucga

SEQ ID NO: 3516953 - RNA, 12 nt, Pseudomonas aeruginosa PA01
cacgccuggcgg

SEQ ID NO: 3516954 - RNA, 15 nt, Pseudomonas aeruginosa PA01
cacgccuggcggcug

SEQ ID NO: 3516955 - RNA, 16 nt, Pseudomonas aeruginosa PA01
cacgccuggcggcugg

SEQ ID NO: 3516956 - RNA, 13 nt, Pseudomonas aeruginosa PA01
cacgccuuccggg

SEQ ID NO: 3516957 - RNA, 21 nt, Pseudomonas aeruginosa PA01
cacgccuuccggguugaaggc

SEQ ID NO: 3516958 - RNA, 15 nt, Pseudomonas aeruginosa PA01
cacgccuucgcggcc

SEQ ID NO: 3516959 - RNA, 16 nt, Pseudomonas aeruginosa PA01
cacgccuucgcggccg

SEQ ID NO: 3516960 - RNA, 17 nt, Pseudomonas aeruginosa PA01
cacgccuucgcggccga

SEQ ID NO: 3516961 - RNA, 15 nt, Pseudomonas aeruginosa PA01
cacgccuucgggcga

SEQ ID NO: 3516962 - RNA, 19 nt, Pseudomonas aeruginosa PA01
cacgccuucgggcgaugcg

SEQ ID NO: 3516963 - RNA, 20 nt, Pseudomonas aeruginosa PA01
cacgccuugcagcaccgccu

SEQ ID NO: 3516964 - RNA, 23 nt, Pseudomonas aeruginosa PA01
cacgccuugcagcaccgccuggu

SEQ ID NO: 3516965 - RNA, 18 nt, Pseudomonas aeruginosa PA01
cacgcgaccaccuucuac

SEQ ID NO: 3516966 - RNA, 13 nt, Pseudomonas aeruginosa PA01
cacgcgaccagcg

SEQ ID NO: 3516967 - RNA, 14 nt, Pseudomonas aeruginosa PA01
cacgcgaccagcgc

SEQ ID NO: 3516968 - RNA, 18 nt, Pseudomonas aeruginosa PA01
cacgcgaccagcgccagg

SEQ ID NO: 3516969 - RNA, 20 nt, Pseudomonas aeruginosa PA01
cacgcgaccagcgccaggcg

SEQ ID NO: 3516970 - RNA, 17 nt, Pseudomonas aeruginosa PA01
cacgcgacccaucgccg

SEQ ID NO: 3516971 - RNA, 15 nt, Pseudomonas aeruginosa PA01
cacgcgauauccgcc

SEQ ID NO: 3516972 - RNA, 20 nt, Pseudomonas aeruginosa PA01
cacgcgauauccgccaggcg

SEQ ID NO: 3516973 - RNA, 13 nt, Pseudomonas aeruginosa PA01
cacgcgcaguacg

SEQ ID NO: 3516974 - RNA, 15 nt, Pseudomonas aeruginosa PA01
cacgcgcaguacgau

SEQ ID NO: 3516975 - RNA, 12 nt, Pseudomonas aeruginosa PA01
cacgcgccgggu

SEQ ID NO: 3516976 - RNA, 13 nt, Pseudomonas aeruginosa PA01
cacgcgcuggagu

SEQ ID NO: 3516977 - RNA, 14 nt, Pseudomonas aeruginosa PA01
cacgcgcuggagua

SEQ ID NO: 3516978 - RNA, 22 nt, Pseudomonas aeruginosa PA01
cacgcggaccuugucgccggug

SEQ ID NO: 3516979 - RNA, 23 nt, Pseudomonas aeruginosa PA01
cacgcggaccuugucgccgguga

SEQ ID NO: 3516980 - RNA, 16 nt, Pseudomonas aeruginosa PA01
cacgcgguuccacucc

SEQ ID NO: 3516981 - RNA, 16 nt, Pseudomonas aeruginosa PA01
cacgcguugcgagggc

SEQ ID NO: 3516982 - RNA, 18 nt, Pseudomonas aeruginosa PA01
cacgcucaccggucgaga

SEQ ID NO: 3516983 - RNA, 17 nt, Pseudomonas aeruginosa PA01
cacgcucagccguggca

SEQ ID NO: 3516984 - RNA, 17 nt, Pseudomonas aeruginosa PA01
cacgcucagugcgccgg

SEQ ID NO: 3516985 - RNA, 16 nt, Pseudomonas aeruginosa PA01
cacgcuccagaucgcc

SEQ ID NO: 3516986 - RNA, 20 nt, Pseudomonas aeruginosa PA01
cacgcuccagaucgccguuc

SEQ ID NO: 3516987 - RNA, 12 nt, Pseudomonas aeruginosa PA01
cacgcucccaac

SEQ ID NO: 3516988 - RNA, 20 nt, Pseudomonas aeruginosa PA01
cacgcucucgaacagcagca

SEQ ID NO: 3516989 - RNA, 23 nt, Pseudomonas aeruginosa PA01
cacgcucucgaacagcagcaagc

SEQ ID NO: 3516990 - RNA, 20 nt, Pseudomonas aeruginosa PA01
cacgcucuggccguucucca

SEQ ID NO: 3516991 - RNA, 20 nt, Pseudomonas aeruginosa PA01
cacgcucuguuucgggucgc

SEQ ID NO: 3516992 - RNA, 22 nt, Pseudomonas aeruginosa PA01
cacgcucuguuucgggucgccc

SEQ ID NO: 3516993 - RNA, 17 nt, Pseudomonas aeruginosa PA01
cacgcugaagaucgcca

SEQ ID NO: 3516994 - RNA, 19 nt, Pseudomonas aeruginosa PA01
cacgcugaggcucagcgcg

SEQ ID NO: 3516995 - RNA, 20 nt, Pseudomonas aeruginosa PA01
cacgcugaucaucagcaggg

SEQ ID NO: 3516996 - RNA, 22 nt, Pseudomonas aeruginosa PA01
cacgcugaucaucagcaggguc

SEQ ID NO: 3516997 - RNA, 16 nt, Pseudomonas aeruginosa PA01
cacgcugccagcaggc

SEQ ID NO: 3516998 - RNA, 19 nt, Pseudomonas aeruginosa PA01
cacgcugccagcaggccga

SEQ ID NO: 3516999 - RNA, 14 nt, Pseudomonas aeruginosa PA01
cacgcugccgccga

SEQ ID NO: 3517000 - RNA, 13 nt, Pseudomonas aeruginosa PA01
cacgcugcgccgg

SEQ ID NO: 3517001 - RNA, 15 nt, Pseudomonas aeruginosa PA01
cacgcugcgccggcg

SEQ ID NO: 3517002 - RNA, 16 nt, Pseudomonas aeruginosa PA01
cacgcugcucgcagcc

SEQ ID NO: 3517003 - RNA, 18 nt, Pseudomonas aeruginosa PA01
cacgcugcucgcagccgg

SEQ ID NO: 3517004 - RNA, 14 nt, Pseudomonas aeruginosa PA01
cacgcuggcgagga

SEQ ID NO: 3517005 - RNA, 18 nt, Pseudomonas aeruginosa PA01
cacgcuggcgaggacgcc

SEQ ID NO: 3517006 - RNA, 20 nt, Pseudomonas aeruginosa PA01
cacgcuggcgaggacgccgg

SEQ ID NO: 3517007 - RNA, 15 nt, Pseudomonas aeruginosa PA01
cacgcuggcgucggg

SEQ ID NO: 3517008 - RNA, 22 nt, Pseudomonas aeruginosa PA01
cacgcugggcagguguucgcaa

SEQ ID NO: 3517009 - RNA, 20 nt, Pseudomonas aeruginosa PA01
cacgcuggucaccgucugca

SEQ ID NO: 3517010 - RNA, 20 nt, Pseudomonas aeruginosa PA01
cacgcuggugaugucgcggc

SEQ ID NO: 3517011 - RNA, 15 nt, Pseudomonas aeruginosa PA01
cacgcugugcggcag

SEQ ID NO: 3517012 - RNA, 17 nt, Pseudomonas aeruginosa PA01
cacgcugugcggcagca

SEQ ID NO: 3517013 - RNA, 13 nt, Pseudomonas aeruginosa PA01
cacgcuucugcug

SEQ ID NO: 3517014 - RNA, 14 nt, Pseudomonas aeruginosa PA01
cacgcuucugcugg

SEQ ID NO: 3517015 - RNA, 17 nt, Pseudomonas aeruginosa PA01
cacgcuucugcuggccg

SEQ ID NO: 3517016 - RNA, 19 nt, Pseudomonas aeruginosa PA01
cacgcuucugcuggccgcg

SEQ ID NO: 3517017 - RNA, 22 nt, Pseudomonas aeruginosa PA01
cacgcuucugcuggccgcgcag

SEQ ID NO: 3517018 - RNA, 24 nt, Pseudomonas aeruginosa PA01
cacgcuucugcuggccgcgcagga

SEQ ID NO: 3517019 - RNA, 20 nt, Pseudomonas aeruginosa PA01
cacgcuugucguggcgggcu

SEQ ID NO: 3517020 - RNA, 13 nt, Pseudomonas aeruginosa PA01
cacggaagcgcug

SEQ ID NO: 3517021 - RNA, 19 nt, Pseudomonas aeruginosa PA01
cacggaagcgcugcucgac

SEQ ID NO: 3517022 - RNA, 22 nt, Pseudomonas aeruginosa PA01
cacggaagcgcugcucgaccac

SEQ ID NO: 3517023 - RNA, 24 nt, Pseudomonas aeruginosa PA01
cacggaagcgcugcucgaccaccu

SEQ ID NO: 3517024 - RNA, 16 nt, Pseudomonas aeruginosa PA01
cacggaaggccacgcc

SEQ ID NO: 3517025 - RNA, 20 nt, Pseudomonas aeruginosa PA01
cacggaaggccacgccgccg

SEQ ID NO: 3517026 - RNA, 23 nt, Pseudomonas aeruginosa PA01
cacggaggccuucgccgaccagg

SEQ ID NO: 3517027 - RNA, 14 nt, Pseudomonas aeruginosa PA01
cacggagugggccg

SEQ ID NO: 3517028 - RNA, 17 nt, Pseudomonas aeruginosa PA01
cacggauaugcgccgcc

SEQ ID NO: 3517029 - RNA, 19 nt, Pseudomonas aeruginosa PA01
cacggauaugcgccgccac

SEQ ID NO: 3517030 - RNA, 20 nt, Pseudomonas aeruginosa PA01
cacggaucgcgcugggcgca

SEQ ID NO: 3517031 - RNA, 22 nt, Pseudomonas aeruginosa PA01
cacggaugcagucccgccaggc

SEQ ID NO: 3517032 - RNA, 18 nt, Pseudomonas aeruginosa PA01
cacggcaacgucgcggau

SEQ ID NO: 3517033 - RNA, 15 nt, Pseudomonas aeruginosa PA01
cacggcacacgucgg

SEQ ID NO: 3517034 - RNA, 18 nt, Pseudomonas aeruginosa PA01
cacggcacacgucggcau

SEQ ID NO: 3517035 - RNA, 21 nt, Pseudomonas aeruginosa PA01
cacggcacacgucggcaucga

SEQ ID NO: 3517036 - RNA, 14 nt, Pseudomonas aeruginosa PA01
cacggcaucgaucc

SEQ ID NO: 3517037 - RNA, 20 nt, Pseudomonas aeruginosa PA01
cacggcauucucucuucagc

SEQ ID NO: 3517038 - RNA, 14 nt, Pseudomonas aeruginosa PA01
cacggccagcagga

SEQ ID NO: 3517039 - RNA, 11 nt, Pseudomonas aeruginosa PA01
cacggccaggc

SEQ ID NO: 3517040 - RNA, 13 nt, Pseudomonas aeruginosa PA01
cacggccaggcca

SEQ ID NO: 3517041 - RNA, 14 nt, Pseudomonas aeruginosa PA01
cacggccaggccac

SEQ ID NO: 3517042 - RNA, 15 nt, Pseudomonas aeruginosa PA01
cacggccaggccacg

SEQ ID NO: 3517043 - RNA, 20 nt, Pseudomonas aeruginosa PA01
cacggccaggccacggccgg

SEQ ID NO: 3517044 - RNA, 22 nt, Pseudomonas aeruginosa PA01
cacggccaggccacggccggcg

SEQ ID NO: 3517045 - RNA, 14 nt, Pseudomonas aeruginosa PA01
cacggccaggccca

SEQ ID NO: 3517046 - RNA, 16 nt, Pseudomonas aeruginosa PA01
cacggccccgagaaaa

SEQ ID NO: 3517047 - RNA, 12 nt, Pseudomonas aeruginosa PA01
cacggccgaaca

SEQ ID NO: 3517048 - RNA, 21 nt, Pseudomonas aeruginosa PA01
cacggccgaacagacgcaggc

SEQ ID NO: 3517049 - RNA, 22 nt, Pseudomonas aeruginosa PA01
cacggccgaacagacgcaggca

SEQ ID NO: 3517050 - RNA, 24 nt, Pseudomonas aeruginosa PA01
cacggccgaacagacgcaggcagg

SEQ ID NO: 3517051 - RNA, 17 nt, Pseudomonas aeruginosa PA01
cacggccgcugcgcagg

SEQ ID NO: 3517052 - RNA, 19 nt, Pseudomonas aeruginosa PA01
cacggccgcugcgcaggcc

SEQ ID NO: 3517053 - RNA, 20 nt, Pseudomonas aeruginosa PA01
cacggccgcugcgcaggccg

SEQ ID NO: 3517054 - RNA, 21 nt, Pseudomonas aeruginosa PA01
cacggccgcugcgcaggccga

SEQ ID NO: 3517055 - RNA, 14 nt, Pseudomonas aeruginosa PA01
cacggccggcgagg

SEQ ID NO: 3517056 - RNA, 21 nt, Pseudomonas aeruginosa PA01
cacggccgucacggccuccgg

SEQ ID NO: 3517057 - RNA, 17 nt, Pseudomonas aeruginosa PA01
cacggccuccgguggcg

SEQ ID NO: 3517058 - RNA, 13 nt, Pseudomonas aeruginosa PA01
cacggcgaaaccg

SEQ ID NO: 3517059 - RNA, 17 nt, Pseudomonas aeruginosa PA01
cacggcgaaaccggcca

SEQ ID NO: 3517060 - RNA, 19 nt, Pseudomonas aeruginosa PA01
cacggcgaacaccgggccg

SEQ ID NO: 3517061 - RNA, 20 nt, Pseudomonas aeruginosa PA01
cacggcgaacaccgggccgc

SEQ ID NO: 3517062 - RNA, 23 nt, Pseudomonas aeruginosa PA01
cacggcgaagaacagcgggucgc

SEQ ID NO: 3517063 - RNA, 22 nt, Pseudomonas aeruginosa PA01
cacggcgaagccgcgcccggcc

SEQ ID NO: 3517064 - RNA, 19 nt, Pseudomonas aeruginosa PA01
cacggcgaauucgucgccg

SEQ ID NO: 3517065 - RNA, 21 nt, Pseudomonas aeruginosa PA01
cacggcgaauucgucgccgcc

SEQ ID NO: 3517066 - RNA, 22 nt, Pseudomonas aeruginosa PA01
cacggcgaauucgucgccgccg

SEQ ID NO: 3517067 - RNA, 23 nt, Pseudomonas aeruginosa PA01
cacggcgaauucgucgccgccga

SEQ ID NO: 3517068 - RNA, 14 nt, Pseudomonas aeruginosa PA01
cacggcgacccgca

SEQ ID NO: 3517069 - RNA, 14 nt, Pseudomonas aeruginosa PA01
cacggcgacggugc

SEQ ID NO: 3517070 - RNA, 16 nt, Pseudomonas aeruginosa PA01
cacggcgagagcgccg

SEQ ID NO: 3517071 - RNA, 17 nt, Pseudomonas aeruginosa PA01
cacggcgauacccaggc

SEQ ID NO: 3517072 - RNA, 18 nt, Pseudomonas aeruginosa PA01
cacggcgauacccaggcc

SEQ ID NO: 3517073 - RNA, 22 nt, Pseudomonas aeruginosa PA01
cacggcgauacccaggccgucg

SEQ ID NO: 3517074 - RNA, 14 nt, Pseudomonas aeruginosa PA01
cacggcgaucgccg

SEQ ID NO: 3517075 - RNA, 15 nt, Pseudomonas aeruginosa PA01
cacggcgaucgccgg

SEQ ID NO: 3517076 - RNA, 19 nt, Pseudomonas aeruginosa PA01
cacggcgauggucaggacg

SEQ ID NO: 3517077 - RNA, 13 nt, Pseudomonas aeruginosa PA01
cacggcgcagccg

SEQ ID NO: 3517078 - RNA, 14 nt, Pseudomonas aeruginosa PA01
cacggcgcagccgc

SEQ ID NO: 3517079 - RNA, 15 nt, Pseudomonas aeruginosa PA01
cacggcgcagccgca

SEQ ID NO: 3517080 - RNA, 16 nt, Pseudomonas aeruginosa PA01
cacggcgcagccgcaa

SEQ ID NO: 3517081 - RNA, 20 nt, Pseudomonas aeruginosa PA01
cacggcgcagccgcaaggcc

SEQ ID NO: 3517082 - RNA, 18 nt, Pseudomonas aeruginosa PA01
cacggcgcagggcaucga

SEQ ID NO: 3517083 - RNA, 20 nt, Pseudomonas aeruginosa PA01
cacggcgcagggcaucgacg

SEQ ID NO: 3517084 - RNA, 16 nt, Pseudomonas aeruginosa PA01
cacggcgccuucccag

SEQ ID NO: 3517085 - RNA, 22 nt, Pseudomonas aeruginosa PA01
cacggcgccuucccagauaccg

SEQ ID NO: 3517086 - RNA, 15 nt, Pseudomonas aeruginosa PA01
cacggcgcgagaaaa

SEQ ID NO: 3517087 - RNA, 17 nt, Pseudomonas aeruginosa PA01
cacggcgcgcuccggcg

SEQ ID NO: 3517088 - RNA, 13 nt, Pseudomonas aeruginosa PA01
cacggcgcggaac

SEQ ID NO: 3517089 - RNA, 15 nt, Pseudomonas aeruginosa PA01
cacggcgcggccgug

SEQ ID NO: 3517090 - RNA, 18 nt, Pseudomonas aeruginosa PA01
cacggcgcggccgugccu

SEQ ID NO: 3517091 - RNA, 23 nt, Pseudomonas aeruginosa PA01
cacggcgcggccgugccucagag

SEQ ID NO: 3517092 - RNA, 18 nt, Pseudomonas aeruginosa PA01
cacggcgcgucggcggug

SEQ ID NO: 3517093 - RNA, 18 nt, Pseudomonas aeruginosa PA01
cacggcggauugacgaug

SEQ ID NO: 3517094 - RNA, 22 nt, Pseudomonas aeruginosa PA01
cacggcgggacaggaacgcccu

SEQ ID NO: 3517095 - RNA, 20 nt, Pseudomonas aeruginosa PA01
cacggcgugccgcaggccgc

SEQ ID NO: 3517096 - RNA, 12 nt, Pseudomonas aeruginosa PA01
cacggcucggcg

SEQ ID NO: 3517097 - RNA, 15 nt, Pseudomonas aeruginosa PA01
cacggcuucagcgcc

SEQ ID NO: 3517098 - RNA, 18 nt, Pseudomonas aeruginosa PA01
cacggcuucagcgccagg

SEQ ID NO: 3517099 - RNA, 22 nt, Pseudomonas aeruginosa PA01
cacggcuucagcgccaggccga

SEQ ID NO: 3517100 - RNA, 12 nt, Pseudomonas aeruginosa PA01
cacgggaauggc

SEQ ID NO: 3517101 - RNA, 15 nt, Pseudomonas aeruginosa PA01
cacgggaauggcgga

SEQ ID NO: 3517102 - RNA, 16 nt, Pseudomonas aeruginosa PA01
cacgggaauggcggau

SEQ ID NO: 3517103 - RNA, 23 nt, Pseudomonas aeruginosa PA01
cacgggcagaccuucgaagaccc

SEQ ID NO: 3517104 - RNA, 14 nt, Pseudomonas aeruginosa PA01
cacgggcgacccag

SEQ ID NO: 3517105 - RNA, 20 nt, Pseudomonas aeruginosa PA01
cacgggcgccagcgguucag

SEQ ID NO: 3517106 - RNA, 12 nt, Pseudomonas aeruginosa PA01
cacgggcggcuu

SEQ ID NO: 3517107 - RNA, 19 nt, Pseudomonas aeruginosa PA01
cacgggcuuccagaggcau

SEQ ID NO: 3517108 - RNA, 20 nt, Pseudomonas aeruginosa PA01
cacggggccccucgccguga

SEQ ID NO: 3517109 - RNA, 17 nt, Pseudomonas aeruginosa PA01
cacgggucgcagccgag

SEQ ID NO: 3517110 - RNA, 21 nt, Pseudomonas aeruginosa PA01
cacgggugccggagaacgccg

SEQ ID NO: 3517111 - RNA, 22 nt, Pseudomonas aeruginosa PA01
cacggguguuucggccgcugcc

SEQ ID NO: 3517112 - RNA, 14 nt, Pseudomonas aeruginosa PA01
cacgguacacgccg

SEQ ID NO: 3517113 - RNA, 22 nt, Pseudomonas aeruginosa PA01
cacggucauggccagcucgacc

SEQ ID NO: 3517114 - RNA, 14 nt, Pseudomonas aeruginosa PA01
cacgguccgcgaac

SEQ ID NO: 3517115 - RNA, 17 nt, Pseudomonas aeruginosa PA01
cacgguccgcgaaccgc

SEQ ID NO: 3517116 - RNA, 13 nt, Pseudomonas aeruginosa PA01
cacggucgagacc

SEQ ID NO: 3517117 - RNA, 15 nt, Pseudomonas aeruginosa PA01
cacggucgagacccg

SEQ ID NO: 3517118 - RNA, 19 nt, Pseudomonas aeruginosa PA01
cacggucgagacccgcaac

SEQ ID NO: 3517119 - RNA, 19 nt, Pseudomonas aeruginosa PA01
cacggucgugcuugcaguc

SEQ ID NO: 3517120 - RNA, 18 nt, Pseudomonas aeruginosa PA01
cacggucuccggggagau

SEQ ID NO: 3517121 - RNA, 14 nt, Pseudomonas aeruginosa PA01
cacggucugcucgg

SEQ ID NO: 3517122 - RNA, 19 nt, Pseudomonas aeruginosa PA01
cacggugaaccaggcgccg

SEQ ID NO: 3517123 - RNA, 23 nt, Pseudomonas aeruginosa PA01
cacggugaaccaggcgccgaugc

SEQ ID NO: 3517124 - RNA, 19 nt, Pseudomonas aeruginosa PA01
cacggugacacccugccgc

SEQ ID NO: 3517125 - RNA, 16 nt, Pseudomonas aeruginosa PA01
cacgguguugccgugg

SEQ ID NO: 3517126 - RNA, 20 nt, Pseudomonas aeruginosa PA01
cacgguguuguggcuggccu

SEQ ID NO: 3517127 - RNA, 13 nt, Pseudomonas aeruginosa PA01
cacguacggcgcc

SEQ ID NO: 3517128 - RNA, 19 nt, Pseudomonas aeruginosa PA01
cacguacuccagcaacggc

SEQ ID NO: 3517129 - RNA, 16 nt, Pseudomonas aeruginosa PA01
cacguagaugccggug

SEQ ID NO: 3517130 - RNA, 17 nt, Pseudomonas aeruginosa PA01
cacguagccggcguccg

SEQ ID NO: 3517131 - RNA, 23 nt, Pseudomonas aeruginosa PA01
cacguagccggcguccgccgggu

SEQ ID NO: 3517132 - RNA, 17 nt, Pseudomonas aeruginosa PA01
cacguagcgcaggucgc

SEQ ID NO: 3517133 - RNA, 14 nt, Pseudomonas aeruginosa PA01
cacguaggacaggu

SEQ ID NO: 3517134 - RNA, 18 nt, Pseudomonas aeruginosa PA01
cacguaggacaggucggu

SEQ ID NO: 3517135 - RNA, 17 nt, Pseudomonas aeruginosa PA01
cacguaggagccggcca

SEQ ID NO: 3517136 - RNA, 15 nt, Pseudomonas aeruginosa PA01
cacguagggcguggu

SEQ ID NO: 3517137 - RNA, 19 nt, Pseudomonas aeruginosa PA01
cacguagggcgugguguag

SEQ ID NO: 3517138 - RNA, 17 nt, Pseudomonas aeruginosa PA01
cacguaguaggcgcggg

SEQ ID NO: 3517139 - RNA, 22 nt, Pseudomonas aeruginosa PA01
cacgucaccguccuucggccgc

SEQ ID NO: 3517140 - RNA, 22 nt, Pseudomonas aeruginosa PA01
cacguccagaugaaacugcccg

SEQ ID NO: 3517141 - RNA, 15 nt, Pseudomonas aeruginosa PA01
cacguccagcggcau

SEQ ID NO: 3517142 - RNA, 20 nt, Pseudomonas aeruginosa PA01
cacguccagguugugcucga

SEQ ID NO: 3517143 - RNA, 23 nt, Pseudomonas aeruginosa PA01
cacguccuugguguagccgaccc

SEQ ID NO: 3517144 - RNA, 19 nt, Pseudomonas aeruginosa PA01
cacgucgagcacgccgucc

SEQ ID NO: 3517145 - RNA, 19 nt, Pseudomonas aeruginosa PA01
cacgucgauauccagcggc

SEQ ID NO: 3517146 - RNA, 20 nt, Pseudomonas aeruginosa PA01
cacgucgauauccagcggca

SEQ ID NO: 3517147 - RNA, 22 nt, Pseudomonas aeruginosa PA01
cacgucgauauccagcggcagc

SEQ ID NO: 3517148 - RNA, 23 nt, Pseudomonas aeruginosa PA01
cacgucgauauccagcggcagcc

SEQ ID NO: 3517149 - RNA, 24 nt, Pseudomonas aeruginosa PA01
cacgucgauauccagcggcagccc

SEQ ID NO: 3517150 - RNA, 23 nt, Pseudomonas aeruginosa PA01
cacgucgaucugcucguccaggc

SEQ ID NO: 3517151 - RNA, 14 nt, Pseudomonas aeruginosa PA01
cacgucgccccagg

SEQ ID NO: 3517152 - RNA, 15 nt, Pseudomonas aeruginosa PA01
cacgucgccccaggg

SEQ ID NO: 3517153 - RNA, 19 nt, Pseudomonas aeruginosa PA01
cacgucgccgaccaggcgg

SEQ ID NO: 3517154 - RNA, 14 nt, Pseudomonas aeruginosa PA01
cacgucgcgcaccu

SEQ ID NO: 3517155 - RNA, 17 nt, Pseudomonas aeruginosa PA01
cacgucgcgcaccuggc

SEQ ID NO: 3517156 - RNA, 12 nt, Pseudomonas aeruginosa PA01
cacgucggcauc

SEQ ID NO: 3517157 - RNA, 12 nt, Pseudomonas aeruginosa PA01
cacgucggcccg

SEQ ID NO: 3517158 - RNA, 14 nt, Pseudomonas aeruginosa PA01
cacgucggcgucca

SEQ ID NO: 3517159 - RNA, 17 nt, Pseudomonas aeruginosa PA01
cacgucggcguccaugg

SEQ ID NO: 3517160 - RNA, 22 nt, Pseudomonas aeruginosa PA01
cacgucguagcccuucuccgcc

SEQ ID NO: 3517161 - RNA, 16 nt, Pseudomonas aeruginosa PA01
cacgucguaggccgag

SEQ ID NO: 3517162 - RNA, 20 nt, Pseudomonas aeruginosa PA01
cacgucguccggcgccaacu

SEQ ID NO: 3517163 - RNA, 16 nt, Pseudomonas aeruginosa PA01
cacgucguuucucggc

SEQ ID NO: 3517164 - RNA, 18 nt, Pseudomonas aeruginosa PA01
cacgucguuucucggcga

SEQ ID NO: 3517165 - RNA, 18 nt, Pseudomonas aeruginosa PA01
cacgucugugccgaggcc

SEQ ID NO: 3517166 - RNA, 20 nt, Pseudomonas aeruginosa PA01
cacgucugugccgaggccgc

SEQ ID NO: 3517167 - RNA, 22 nt, Pseudomonas aeruginosa PA01
cacgucugugccgaggccgccg

SEQ ID NO: 3517168 - RNA, 14 nt, Pseudomonas aeruginosa PA01
cacgucuugcaggc

SEQ ID NO: 3517169 - RNA, 22 nt, Pseudomonas aeruginosa PA01
cacgugaccguccagcgcgccg

SEQ ID NO: 3517170 - RNA, 23 nt, Pseudomonas aeruginosa PA01
cacgugaccguccagcgcgccgc

SEQ ID NO: 3517171 - RNA, 14 nt, Pseudomonas aeruginosa PA01
cacgugcacgccgu

SEQ ID NO: 3517172 - RNA, 20 nt, Pseudomonas aeruginosa PA01
cacgugcagcggcagcgucu

SEQ ID NO: 3517173 - RNA, 17 nt, Pseudomonas aeruginosa PA01
cacgugcagcucggcac

SEQ ID NO: 3517174 - RNA, 19 nt, Pseudomonas aeruginosa PA01
cacgugcagcucggcacgc

SEQ ID NO: 3517175 - RNA, 23 nt, Pseudomonas aeruginosa PA01
cacgugcagcucggcacgcagca

SEQ ID NO: 3517176 - RNA, 14 nt, Pseudomonas aeruginosa PA01
cacgugccccaggc

SEQ ID NO: 3517177 - RNA, 17 nt, Pseudomonas aeruginosa PA01
cacgugccccaggccga

SEQ ID NO: 3517178 - RNA, 17 nt, Pseudomonas aeruginosa PA01
cacgugcggggugcgcu

SEQ ID NO: 3517179 - RNA, 13 nt, Pseudomonas aeruginosa PA01
cacguggccgccc

SEQ ID NO: 3517180 - RNA, 14 nt, Pseudomonas aeruginosa PA01
cacguggccgccca

SEQ ID NO: 3517181 - RNA, 18 nt, Pseudomonas aeruginosa PA01
cacgugugucgacaccug

SEQ ID NO: 3517182 - RNA, 19 nt, Pseudomonas aeruginosa PA01
cacgugugucgacaccugg

SEQ ID NO: 3517183 - RNA, 23 nt, Pseudomonas aeruginosa PA01
cacguucuugaccuucugcaccg

SEQ ID NO: 3517184 - RNA, 18 nt, Pseudomonas aeruginosa PA01
cacguugaacacaucgac

SEQ ID NO: 3517185 - RNA, 22 nt, Pseudomonas aeruginosa PA01
cacguugaacacaucgaccagg

SEQ ID NO: 3517186 - RNA, 21 nt, Pseudomonas aeruginosa PA01
cacguugaccugcgaggcguc

SEQ ID NO: 3517187 - RNA, 20 nt, Pseudomonas aeruginosa PA01
cacguugagcaucaccgcgg

SEQ ID NO: 3517188 - RNA, 17 nt, Pseudomonas aeruginosa PA01
cacguugaggucgaaga

SEQ ID NO: 3517189 - RNA, 18 nt, Pseudomonas aeruginosa PA01
cacguugaggucgaagac

SEQ ID NO: 3517190 - RNA, 14 nt, Pseudomonas aeruginosa PA01
cacguugcgccgca

SEQ ID NO: 3517191 - RNA, 15 nt, Pseudomonas aeruginosa PA01
cacguuguucaccgu

SEQ ID NO: 3517192 - RNA, 14 nt, Pseudomonas aeruginosa PA01
cacguuguugccca

SEQ ID NO: 3517193 - RNA, 14 nt, Pseudomonas aeruginosa PA01
cacuaccgccgagg

SEQ ID NO: 3517194 - RNA, 16 nt, Pseudomonas aeruginosa PA01
cacuacgcccauggcg

SEQ ID NO: 3517195 - RNA, 23 nt, Pseudomonas aeruginosa PA01
cacucaggaaaaaacgccgguca

SEQ ID NO: 3517196 - RNA, 16 nt, Pseudomonas aeruginosa PA01
cacucauagcucagcu

SEQ ID NO: 3517197 - RNA, 17 nt, Pseudomonas aeruginosa PA01
cacucauagcucagcug

SEQ ID NO: 3517198 - RNA, 21 nt, Pseudomonas aeruginosa PA01
cacucauccucgccgcuggcg

SEQ ID NO: 3517199 - RNA, 21 nt, Pseudomonas aeruginosa PA01
cacuccagauagugcggccag

SEQ ID NO: 3517200 - RNA, 22 nt, Pseudomonas aeruginosa PA01
cacuccagauagugcggccagg

SEQ ID NO: 3517201 - RNA, 23 nt, Pseudomonas aeruginosa PA01
cacuccagauagugcggccaggc

SEQ ID NO: 3517202 - RNA, 12 nt, Pseudomonas aeruginosa PA01
cacuccagcgcg

SEQ ID NO: 3517203 - RNA, 13 nt, Pseudomonas aeruginosa PA01
cacuccaggcggc

SEQ ID NO: 3517204 - RNA, 18 nt, Pseudomonas aeruginosa PA01
cacuccccagcaggcagg

SEQ ID NO: 3517205 - RNA, 15 nt, Pseudomonas aeruginosa PA01
cacucccguccagcg

SEQ ID NO: 3517206 - RNA, 15 nt, Pseudomonas aeruginosa PA01
cacucccugcucgcg

SEQ ID NO: 3517207 - RNA, 19 nt, Pseudomonas aeruginosa PA01
cacuccgccacccgcuccg

SEQ ID NO: 3517208 - RNA, 13 nt, Pseudomonas aeruginosa PA01
cacuccggcagca

SEQ ID NO: 3517209 - RNA, 16 nt, Pseudomonas aeruginosa PA01
cacuccggcaggcgcu

SEQ ID NO: 3517210 - RNA, 22 nt, Pseudomonas aeruginosa PA01
cacuccgggcagaccagcagcg

SEQ ID NO: 3517211 - RNA, 18 nt, Pseudomonas aeruginosa PA01
cacuccguccagugcggc

SEQ ID NO: 3517212 - RNA, 20 nt, Pseudomonas aeruginosa PA01
cacuccguccagugcggcag

SEQ ID NO: 3517213 - RNA, 15 nt, Pseudomonas aeruginosa PA01
cacuccgucuccagc

SEQ ID NO: 3517214 - RNA, 18 nt, Pseudomonas aeruginosa PA01
cacuccgucuccagcaac

SEQ ID NO: 3517215 - RNA, 15 nt, Pseudomonas aeruginosa PA01
cacuccuccgccugc

SEQ ID NO: 3517216 - RNA, 14 nt, Pseudomonas aeruginosa PA01
cacucgacaggcca

SEQ ID NO: 3517217 - RNA, 19 nt, Pseudomonas aeruginosa PA01
cacucgaugaacagcgcga

SEQ ID NO: 3517218 - RNA, 21 nt, Pseudomonas aeruginosa PA01
cacucgaugaacagcgcgaac

SEQ ID NO: 3517219 - RNA, 14 nt, Pseudomonas aeruginosa PA01
cacucgcagccgcg

SEQ ID NO: 3517220 - RNA, 21 nt, Pseudomonas aeruginosa PA01
cacucgcagccgcgcucggcc

SEQ ID NO: 3517221 - RNA, 22 nt, Pseudomonas aeruginosa PA01
cacucgcagccgcgcucggcca

SEQ ID NO: 3517222 - RNA, 15 nt, Pseudomonas aeruginosa PA01
cacucgccagcgcgc

SEQ ID NO: 3517223 - RNA, 19 nt, Pseudomonas aeruginosa PA01
cacucgccagcgcgcgccg

SEQ ID NO: 3517224 - RNA, 12 nt, Pseudomonas aeruginosa PA01
cacucgccgccg

SEQ ID NO: 3517225 - RNA, 18 nt, Pseudomonas aeruginosa PA01
cacucgcgagauggcguc

SEQ ID NO: 3517226 - RNA, 17 nt, Pseudomonas aeruginosa PA01
cacucgcgagcuggcgc

SEQ ID NO: 3517227 - RNA, 17 nt, Pseudomonas aeruginosa PA01
cacucgcuccuccgggc

SEQ ID NO: 3517228 - RNA, 14 nt, Pseudomonas aeruginosa PA01
cacucggccaggcg

SEQ ID NO: 3517229 - RNA, 16 nt, Pseudomonas aeruginosa PA01
cacucggccaggcgcc

SEQ ID NO: 3517230 - RNA, 17 nt, Pseudomonas aeruginosa PA01
cacucggccaggcgcca

SEQ ID NO: 3517231 - RNA, 19 nt, Pseudomonas aeruginosa PA01
cacucggcgaccacccggc

SEQ ID NO: 3517232 - RNA, 20 nt, Pseudomonas aeruginosa PA01
cacucggcgaccacccggcg

SEQ ID NO: 3517233 - RNA, 16 nt, Pseudomonas aeruginosa PA01
cacucggcgugccggg

SEQ ID NO: 3517234 - RNA, 23 nt, Pseudomonas aeruginosa PA01
cacucggcgugccgggccggcca

SEQ ID NO: 3517235 - RNA, 17 nt, Pseudomonas aeruginosa PA01
cacucgugcaacggcac

SEQ ID NO: 3517236 - RNA, 19 nt, Pseudomonas aeruginosa PA01
cacucguuaaccugccugc

SEQ ID NO: 3517237 - RNA, 22 nt, Pseudomonas aeruginosa PA01
cacucuagugaaaguccuucuu

SEQ ID NO: 3517238 - RNA, 19 nt, Pseudomonas aeruginosa PA01
cacucugagggacacggcg

SEQ ID NO: 3517239 - RNA, 17 nt, Pseudomonas aeruginosa PA01
cacucugguagcugcgg

SEQ ID NO: 3517240 - RNA, 12 nt, Pseudomonas aeruginosa PA01
cacugacgcgca

SEQ ID NO: 3517241 - RNA, 14 nt, Pseudomonas aeruginosa PA01
cacugacgcgcagc

SEQ ID NO: 3517242 - RNA, 16 nt, Pseudomonas aeruginosa PA01
cacugacgcgcagcgc

SEQ ID NO: 3517243 - RNA, 17 nt, Pseudomonas aeruginosa PA01
cacugacgcgcagcgcc

SEQ ID NO: 3517244 - RNA, 19 nt, Pseudomonas aeruginosa PA01
cacugacgcgcagcgccgc

SEQ ID NO: 3517245 - RNA, 20 nt, Pseudomonas aeruginosa PA01
cacugacgcgcagcgccgcc

SEQ ID NO: 3517246 - RNA, 16 nt, Pseudomonas aeruginosa PA01
cacugccaggagcacg

SEQ ID NO: 3517247 - RNA, 19 nt, Pseudomonas aeruginosa PA01
cacugccaggagcacgccg

SEQ ID NO: 3517248 - RNA, 17 nt, Pseudomonas aeruginosa PA01
cacugcgagcaccaugc

SEQ ID NO: 3517249 - RNA, 21 nt, Pseudomonas aeruginosa PA01
cacugcgagcaccaugccgau

SEQ ID NO: 3517250 - RNA, 13 nt, Pseudomonas aeruginosa PA01
cacugcgccaugc

SEQ ID NO: 3517251 - RNA, 16 nt, Pseudomonas aeruginosa PA01
cacugcgccaugccgu

SEQ ID NO: 3517252 - RNA, 13 nt, Pseudomonas aeruginosa PA01
cacugcgggccgu

SEQ ID NO: 3517253 - RNA, 22 nt, Pseudomonas aeruginosa PA01
cacugcguggguagccauggcg

SEQ ID NO: 3517254 - RNA, 16 nt, Pseudomonas aeruginosa PA01
cacugcuuggccaggc

SEQ ID NO: 3517255 - RNA, 18 nt, Pseudomonas aeruginosa PA01
cacugcuuggccaggcgc

SEQ ID NO: 3517256 - RNA, 20 nt, Pseudomonas aeruginosa PA01
cacugcuuggccaggcgcuu

SEQ ID NO: 3517257 - RNA, 16 nt, Pseudomonas aeruginosa PA01
cacuggaacagcgcgu

SEQ ID NO: 3517258 - RNA, 17 nt, Pseudomonas aeruginosa PA01
cacuggcccacggcgcc

SEQ ID NO: 3517259 - RNA, 18 nt, Pseudomonas aeruginosa PA01
cacuggcccacggcgccu

SEQ ID NO: 3517260 - RNA, 15 nt, Pseudomonas aeruginosa PA01
cacuggcggaccgcc

SEQ ID NO: 3517261 - RNA, 22 nt, Pseudomonas aeruginosa PA01
cacuggcggaccgccucgacca

SEQ ID NO: 3517262 - RNA, 20 nt, Pseudomonas aeruginosa PA01
cacuggucggccaguuccuu

SEQ ID NO: 3517263 - RNA, 16 nt, Pseudomonas aeruginosa PA01
cacugguggcgaacag

SEQ ID NO: 3517264 - RNA, 20 nt, Pseudomonas aeruginosa PA01
cacugguggcgaacagcacc

SEQ ID NO: 3517265 - RNA, 15 nt, Pseudomonas aeruginosa PA01
cacugucucgccgau

SEQ ID NO: 3517266 - RNA, 22 nt, Pseudomonas aeruginosa PA01
cacugucucgccgaugcccggg

SEQ ID NO: 3517267 - RNA, 23 nt, Pseudomonas aeruginosa PA01
cacuguggagucgaaugugaaua

SEQ ID NO: 3517268 - RNA, 20 nt, Pseudomonas aeruginosa PA01
cacuguuuuccauggcgagu

SEQ ID NO: 3517269 - RNA, 17 nt, Pseudomonas aeruginosa PA01
cacuucaagcuggcgca

SEQ ID NO: 3517270 - RNA, 17 nt, Pseudomonas aeruginosa PA01
cacuucacgacaggcgg

SEQ ID NO: 3517271 - RNA, 19 nt, Pseudomonas aeruginosa PA01
cacuuccaccggcuugccg

SEQ ID NO: 3517272 - RNA, 14 nt, Pseudomonas aeruginosa PA01
cacuuccagcacgc

SEQ ID NO: 3517273 - RNA, 15 nt, Pseudomonas aeruginosa PA01
cacuuccagcacgcc

SEQ ID NO: 3517274 - RNA, 17 nt, Pseudomonas aeruginosa PA01
cacuuccagcacgccga

SEQ ID NO: 3517275 - RNA, 15 nt, Pseudomonas aeruginosa PA01
cacuuccagcugcca

SEQ ID NO: 3517276 - RNA, 21 nt, Pseudomonas aeruginosa PA01
cacuuccagcugccagugcuc

SEQ ID NO: 3517277 - RNA, 12 nt, Pseudomonas aeruginosa PA01
cacuuccagcuu

SEQ ID NO: 3517278 - RNA, 20 nt, Pseudomonas aeruginosa PA01
cacuuccaggcgccaauccg

SEQ ID NO: 3517279 - RNA, 12 nt, Pseudomonas aeruginosa PA01
cacuuccaggua

SEQ ID NO: 3517280 - RNA, 20 nt, Pseudomonas aeruginosa PA01
cacuuccaggugccaauccg

SEQ ID NO: 3517281 - RNA, 13 nt, Pseudomonas aeruginosa PA01
cacuucccggcgc

SEQ ID NO: 3517282 - RNA, 16 nt, Pseudomonas aeruginosa PA01
cacuuccggcccggcc

SEQ ID NO: 3517283 - RNA, 17 nt, Pseudomonas aeruginosa PA01
cacuuccggcccggcca

SEQ ID NO: 3517284 - RNA, 21 nt, Pseudomonas aeruginosa PA01
cacuuccggcccggccaggcg

SEQ ID NO: 3517285 - RNA, 17 nt, Pseudomonas aeruginosa PA01
cacuuccgucacgcccu

SEQ ID NO: 3517286 - RNA, 14 nt, Pseudomonas aeruginosa PA01
cacuuccucggcga

SEQ ID NO: 3517287 - RNA, 16 nt, Pseudomonas aeruginosa PA01
cacuuccucggcgacc

SEQ ID NO: 3517288 - RNA, 19 nt, Pseudomonas aeruginosa PA01
cacuuccucguggggccag

SEQ ID NO: 3517289 - RNA, 18 nt, Pseudomonas aeruginosa PA01
cacuuccugaaggcgcgg

SEQ ID NO: 3517290 - RNA, 23 nt, Pseudomonas aeruginosa PA01
cacuuccuucucccggcugguca

SEQ ID NO: 3517291 - RNA, 16 nt, Pseudomonas aeruginosa PA01
cacuuccuugcgaucg

SEQ ID NO: 3517292 - RNA, 23 nt, Pseudomonas aeruginosa PA01
cacuuccuuggugaucaccgccu

SEQ ID NO: 3517293 - RNA, 14 nt, Pseudomonas aeruginosa PA01
cacuucgaagccga

SEQ ID NO: 3517294 - RNA, 12 nt, Pseudomonas aeruginosa PA01
cacuucggcgcg

SEQ ID NO: 3517295 - RNA, 13 nt, Pseudomonas aeruginosa PA01
cacuucggcgcgc

SEQ ID NO: 3517296 - RNA, 14 nt, Pseudomonas aeruginosa PA01
cacuucggcgcgcg

SEQ ID NO: 3517297 - RNA, 23 nt, Pseudomonas aeruginosa PA01
cacuucguccgccaccacggcga

SEQ ID NO: 3517298 - RNA, 15 nt, Pseudomonas aeruginosa PA01
cacuucguccggccg

SEQ ID NO: 3517299 - RNA, 16 nt, Pseudomonas aeruginosa PA01
cacuucguccggccgc

SEQ ID NO: 3517300 - RNA, 18 nt, Pseudomonas aeruginosa PA01
cacuucguccggccgccc

SEQ ID NO: 3517301 - RNA, 18 nt, Pseudomonas aeruginosa PA01
cacuucucgaacagcucc

SEQ ID NO: 3517302 - RNA, 16 nt, Pseudomonas aeruginosa PA01
cacuugaacaccgugg

SEQ ID NO: 3517303 - RNA, 20 nt, Pseudomonas aeruginosa PA01
cacuugaccgucggcaagca

SEQ ID NO: 3517304 - RNA, 22 nt, Pseudomonas aeruginosa PA01
cacuugaggaagugcagggcgu

SEQ ID NO: 3517305 - RNA, 14 nt, Pseudomonas aeruginosa PA01
cacuugccgccgcc

SEQ ID NO: 3517306 - RNA, 15 nt, Pseudomonas aeruginosa PA01
cacuugcgccggcug

SEQ ID NO: 3517307 - RNA, 17 nt, Pseudomonas aeruginosa PA01
cacuugucgacguuguc

SEQ ID NO: 3517308 - RNA, 13 nt, Pseudomonas aeruginosa PA01
cacuugugguggg

SEQ ID NO: 3517309 - RNA, 15 nt, Pseudomonas aeruginosa PA01
cagaaagccucaggc

SEQ ID NO: 3517310 - RNA, 14 nt, Pseudomonas aeruginosa PA01
cagaacacccgggu

SEQ ID NO: 3517311 - RNA, 24 nt, Pseudomonas aeruginosa PA01
cagaaccagacgcucggccagcgu

SEQ ID NO: 3517312 - RNA, 15 nt, Pseudomonas aeruginosa PA01
cagaaccgccagcag

SEQ ID NO: 3517313 - RNA, 16 nt, Pseudomonas aeruginosa PA01
cagaaccgccagcagu

SEQ ID NO: 3517314 - RNA, 21 nt, Pseudomonas aeruginosa PA01
cagaacgaaaaaggcgcgccg

SEQ ID NO: 3517315 - RNA, 23 nt, Pseudomonas aeruginosa PA01
cagaacgaaaaaggcgcgccggu

SEQ ID NO: 3517316 - RNA, 14 nt, Pseudomonas aeruginosa PA01
cagaacgccgcgca

SEQ ID NO: 3517317 - RNA, 16 nt, Pseudomonas aeruginosa PA01
cagaacgccgcgcacc

SEQ ID NO: 3517318 - RNA, 17 nt, Pseudomonas aeruginosa PA01
cagaacgccgcgcaccu

SEQ ID NO: 3517319 - RNA, 20 nt, Pseudomonas aeruginosa PA01
cagaacgccgcgcaccucga

SEQ ID NO: 3517320 - RNA, 19 nt, Pseudomonas aeruginosa PA01
cagaacugccgggccagcu

SEQ ID NO: 3517321 - RNA, 23 nt, Pseudomonas aeruginosa PA01
cagaacugccgggccagcuccag

SEQ ID NO: 3517322 - RNA, 16 nt, Pseudomonas aeruginosa PA01
cagaacuugcgcaccg

SEQ ID NO: 3517323 - RNA, 21 nt, Pseudomonas aeruginosa PA01
cagaacuugcgcaccgcgccg

SEQ ID NO: 3517324 - RNA, 22 nt, Pseudomonas aeruginosa PA01
cagaacuugcgcaccgcgccgg

SEQ ID NO: 3517325 - RNA, 19 nt, Pseudomonas aeruginosa PA01
cagaagacgauggugaucu

SEQ ID NO: 3517326 - RNA, 13 nt, Pseudomonas aeruginosa PA01
cagaagacgccca

SEQ ID NO: 3517327 - RNA, 15 nt, Pseudomonas aeruginosa PA01
cagaagacgcccagc

SEQ ID NO: 3517328 - RNA, 22 nt, Pseudomonas aeruginosa PA01
cagaagacgcccagcagggcca

SEQ ID NO: 3517329 - RNA, 15 nt, Pseudomonas aeruginosa PA01
cagaagaucagcgcg

SEQ ID NO: 3517330 - RNA, 22 nt, Pseudomonas aeruginosa PA01
cagaagaucagcgcggugagca

SEQ ID NO: 3517331 - RNA, 22 nt, Pseudomonas aeruginosa PA01
cagaagaucgccugcuggccgg

SEQ ID NO: 3517332 - RNA, 14 nt, Pseudomonas aeruginosa PA01
cagaagccggccgg

SEQ ID NO: 3517333 - RNA, 16 nt, Pseudomonas aeruginosa PA01
cagaagcgacugucca

SEQ ID NO: 3517334 - RNA, 18 nt, Pseudomonas aeruginosa PA01
cagaagcgcucguagaga

SEQ ID NO: 3517335 - RNA, 19 nt, Pseudomonas aeruginosa PA01
cagaaggcgggcagccugg

SEQ ID NO: 3517336 - RNA, 18 nt, Pseudomonas aeruginosa PA01
cagaaguaguacuggucc

SEQ ID NO: 3517337 - RNA, 18 nt, Pseudomonas aeruginosa PA01
cagaaguaguaggggaau

SEQ ID NO: 3517338 - RNA, 20 nt, Pseudomonas aeruginosa PA01
cagaaguauuucaaccaggc

SEQ ID NO: 3517339 - RNA, 23 nt, Pseudomonas aeruginosa PA01
cagaaguauuucaaccaggcgau

SEQ ID NO: 3517340 - RNA, 22 nt, Pseudomonas aeruginosa PA01
cagaagucccagcgagugcuga

SEQ ID NO: 3517341 - RNA, 23 nt, Pseudomonas aeruginosa PA01
cagaagucccagcgagugcugaa

SEQ ID NO: 3517342 - RNA, 16 nt, Pseudomonas aeruginosa PA01
cagaaguugcuggcga

SEQ ID NO: 3517343 - RNA, 15 nt, Pseudomonas aeruginosa PA01
cagaauuccagcagg

SEQ ID NO: 3517344 - RNA, 17 nt, Pseudomonas aeruginosa PA01
cagaauuccagcagguc

SEQ ID NO: 3517345 - RNA, 18 nt, Pseudomonas aeruginosa PA01
cagaauuccagcaggucg

SEQ ID NO: 3517346 - RNA, 21 nt, Pseudomonas aeruginosa PA01
cagacacaaaaaacccggcga

SEQ ID NO: 3517347 - RNA, 15 nt, Pseudomonas aeruginosa PA01
cagacaccaccaggu

SEQ ID NO: 3517348 - RNA, 22 nt, Pseudomonas aeruginosa PA01
cagacacgaaaaagccggcgca

SEQ ID NO: 3517349 - RNA, 23 nt, Pseudomonas aeruginosa PA01
cagacacgaaaaagccggcgcau

SEQ ID NO: 3517350 - RNA, 24 nt, Pseudomonas aeruginosa PA01
cagacaggccagcucgcccgccuc

SEQ ID NO: 3517351 - RNA, 14 nt, Pseudomonas aeruginosa PA01
cagacaucgccgag

SEQ ID NO: 3517352 - RNA, 16 nt, Pseudomonas aeruginosa PA01
cagacaucgccgaggg

SEQ ID NO: 3517353 - RNA, 17 nt, Pseudomonas aeruginosa PA01
cagaccacccggcugca

SEQ ID NO: 3517354 - RNA, 16 nt, Pseudomonas aeruginosa PA01
cagaccacgcccugcg

SEQ ID NO: 3517355 - RNA, 12 nt, Pseudomonas aeruginosa PA01
cagaccagcagc

SEQ ID NO: 3517356 - RNA, 14 nt, Pseudomonas aeruginosa PA01
cagaccagcagcgg

SEQ ID NO: 3517357 - RNA, 16 nt, Pseudomonas aeruginosa PA01
cagaccagcagcggca

SEQ ID NO: 3517358 - RNA, 16 nt, Pseudomonas aeruginosa PA01
cagaccagcaggaaaa

SEQ ID NO: 3517359 - RNA, 13 nt, Pseudomonas aeruginosa PA01
cagaccagcccca

SEQ ID NO: 3517360 - RNA, 16 nt, Pseudomonas aeruginosa PA01
cagaccagccccaguc

SEQ ID NO: 3517361 - RNA, 13 nt, Pseudomonas aeruginosa PA01
cagaccagcccug

SEQ ID NO: 3517362 - RNA, 16 nt, Pseudomonas aeruginosa PA01
cagaccagcccuggcg

SEQ ID NO: 3517363 - RNA, 19 nt, Pseudomonas aeruginosa PA01
cagaccagcccuggcgcgg

SEQ ID NO: 3517364 - RNA, 21 nt, Pseudomonas aeruginosa PA01
cagaccagcccuggcgcggca

SEQ ID NO: 3517365 - RNA, 15 nt, Pseudomonas aeruginosa PA01
cagaccagcgaaccg

SEQ ID NO: 3517366 - RNA, 19 nt, Pseudomonas aeruginosa PA01
cagaccagcgaaccgccgg

SEQ ID NO: 3517367 - RNA, 21 nt, Pseudomonas aeruginosa PA01
cagaccagcgaaccgccggcc

SEQ ID NO: 3517368 - RNA, 14 nt, Pseudomonas aeruginosa PA01
cagaccaggccgag

SEQ ID NO: 3517369 - RNA, 16 nt, Pseudomonas aeruginosa PA01
cagaccaggccgagca

SEQ ID NO: 3517370 - RNA, 17 nt, Pseudomonas aeruginosa PA01
cagaccaggccgagcag

SEQ ID NO: 3517371 - RNA, 18 nt, Pseudomonas aeruginosa PA01
cagaccaggccgagcagg

SEQ ID NO: 3517372 - RNA, 21 nt, Pseudomonas aeruginosa PA01
cagaccaggccgagcaggaag

SEQ ID NO: 3517373 - RNA, 14 nt, Pseudomonas aeruginosa PA01
cagaccaucagcug

SEQ ID NO: 3517374 - RNA, 19 nt, Pseudomonas aeruginosa PA01
cagaccaucagcuggaucu

SEQ ID NO: 3517375 - RNA, 16 nt, Pseudomonas aeruginosa PA01
cagacccaggugcgca

SEQ ID NO: 3517376 - RNA, 20 nt, Pseudomonas aeruginosa PA01
cagacccaggugcgcaggcg

SEQ ID NO: 3517377 - RNA, 22 nt, Pseudomonas aeruginosa PA01
cagacccaggugcgcaggcgcu

SEQ ID NO: 3517378 - RNA, 23 nt, Pseudomonas aeruginosa PA01
cagacccaggugcgcaggcgcuc

SEQ ID NO: 3517379 - RNA, 12 nt, Pseudomonas aeruginosa PA01
cagacccucucc

SEQ ID NO: 3517380 - RNA, 14 nt, Pseudomonas aeruginosa PA01
cagaccgacccuca

SEQ ID NO: 3517381 - RNA, 18 nt, Pseudomonas aeruginosa PA01
cagaccgacccucaugga

SEQ ID NO: 3517382 - RNA, 20 nt, Pseudomonas aeruginosa PA01
cagaccgagauuggccgccu

SEQ ID NO: 3517383 - RNA, 14 nt, Pseudomonas aeruginosa PA01
cagaccgcagccgg

SEQ ID NO: 3517384 - RNA, 16 nt, Pseudomonas aeruginosa PA01
cagaccgcagccggcg

SEQ ID NO: 3517385 - RNA, 15 nt, Pseudomonas aeruginosa PA01
cagaccggcagcgcc

SEQ ID NO: 3517386 - RNA, 18 nt, Pseudomonas aeruginosa PA01
cagaccggcagcgccgcc

SEQ ID NO: 3517387 - RNA, 19 nt, Pseudomonas aeruginosa PA01
cagaccggcagcgccgcca

SEQ ID NO: 3517388 - RNA, 20 nt, Pseudomonas aeruginosa PA01
cagaccgucgaucucgagca

SEQ ID NO: 3517389 - RNA, 22 nt, Pseudomonas aeruginosa PA01
cagaccguggauuucagcaggc

SEQ ID NO: 3517390 - RNA, 12 nt, Pseudomonas aeruginosa PA01
cagaccuccagg

SEQ ID NO: 3517391 - RNA, 15 nt, Pseudomonas aeruginosa PA01
cagaccuccagguag

SEQ ID NO: 3517392 - RNA, 17 nt, Pseudomonas aeruginosa PA01
cagaccucgagcaggcc

SEQ ID NO: 3517393 - RNA, 19 nt, Pseudomonas aeruginosa PA01
cagaccucgagcaggccga

SEQ ID NO: 3517394 - RNA, 21 nt, Pseudomonas aeruginosa PA01
cagaccugcaauuccaccggc

SEQ ID NO: 3517395 - RNA, 13 nt, Pseudomonas aeruginosa PA01
cagaccugcagca

SEQ ID NO: 3517396 - RNA, 19 nt, Pseudomonas aeruginosa PA01
cagaccugcagcaggauca

SEQ ID NO: 3517397 - RNA, 20 nt, Pseudomonas aeruginosa PA01
cagaccugcagcaggaucag

SEQ ID NO: 3517398 - RNA, 14 nt, Pseudomonas aeruginosa PA01
cagaccugccgccc

SEQ ID NO: 3517399 - RNA, 16 nt, Pseudomonas aeruginosa PA01
cagaccugccgcccgg

SEQ ID NO: 3517400 - RNA, 21 nt, Pseudomonas aeruginosa PA01
cagaccugccgcccggccagg

SEQ ID NO: 3517401 - RNA, 22 nt, Pseudomonas aeruginosa PA01
cagaccugccgcccggccaggc

SEQ ID NO: 3517402 - RNA, 13 nt, Pseudomonas aeruginosa PA01
cagaccuggccgc

SEQ ID NO: 3517403 - RNA, 16 nt, Pseudomonas aeruginosa PA01
cagaccuggccgcugu

SEQ ID NO: 3517404 - RNA, 20 nt, Pseudomonas aeruginosa PA01
cagaccuggugggcggcggc

SEQ ID NO: 3517405 - RNA, 16 nt, Pseudomonas aeruginosa PA01
cagacgaucagcggcc

SEQ ID NO: 3517406 - RNA, 23 nt, Pseudomonas aeruginosa PA01
cagacgaucagcggcccgagcag

SEQ ID NO: 3517407 - RNA, 18 nt, Pseudomonas aeruginosa PA01
cagacgaucuggcagucg

SEQ ID NO: 3517408 - RNA, 23 nt, Pseudomonas aeruginosa PA01
cagacgauugaccucccgcgcca

SEQ ID NO: 3517409 - RNA, 13 nt, Pseudomonas aeruginosa PA01
cagacgcagcagc

SEQ ID NO: 3517410 - RNA, 14 nt, Pseudomonas aeruginosa PA01
cagacgcagcagcu

SEQ ID NO: 3517411 - RNA, 19 nt, Pseudomonas aeruginosa PA01
cagacgcagcagcucgucc

SEQ ID NO: 3517412 - RNA, 22 nt, Pseudomonas aeruginosa PA01
cagacgcagccguuggccagca

SEQ ID NO: 3517413 - RNA, 19 nt, Pseudomonas aeruginosa PA01
cagacgcggauuggccggg

SEQ ID NO: 3517414 - RNA, 13 nt, Pseudomonas aeruginosa PA01
cagacgcuccuug

SEQ ID NO: 3517415 - RNA, 14 nt, Pseudomonas aeruginosa PA01
cagacgcucggcca

SEQ ID NO: 3517416 - RNA, 19 nt, Pseudomonas aeruginosa PA01
cagacgcucggccagcguc

SEQ ID NO: 3517417 - RNA, 21 nt, Pseudomonas aeruginosa PA01
cagacgcucggccagcguccu

SEQ ID NO: 3517418 - RNA, 15 nt, Pseudomonas aeruginosa PA01
cagacgcucggcuuc

SEQ ID NO: 3517419 - RNA, 19 nt, Pseudomonas aeruginosa PA01
cagacgcucggcuucgcgu

SEQ ID NO: 3517420 - RNA, 20 nt, Pseudomonas aeruginosa PA01
cagacggggccucgcugccu

SEQ ID NO: 3517421 - RNA, 17 nt, Pseudomonas aeruginosa PA01
cagacgggugcugaaga

SEQ ID NO: 3517422 - RNA, 16 nt, Pseudomonas aeruginosa PA01
cagacgguucagcagc

SEQ ID NO: 3517423 - RNA, 17 nt, Pseudomonas aeruginosa PA01
cagacgguucagcagcg

SEQ ID NO: 3517424 - RNA, 18 nt, Pseudomonas aeruginosa PA01
cagacgguucagcagcgg

SEQ ID NO: 3517425 - RNA, 17 nt, Pseudomonas aeruginosa PA01
cagacuccggcgcagcc

SEQ ID NO: 3517426 - RNA, 19 nt, Pseudomonas aeruginosa PA01
cagacuccggcgcagccca

SEQ ID NO: 3517427 - RNA, 17 nt, Pseudomonas aeruginosa PA01
cagacucuccaggucgg

SEQ ID NO: 3517428 - RNA, 23 nt, Pseudomonas aeruginosa PA01
cagacucuccaggucggucggcg

SEQ ID NO: 3517429 - RNA, 20 nt, Pseudomonas aeruginosa PA01
cagacugagguucaugccgc

SEQ ID NO: 3517430 - RNA, 20 nt, Pseudomonas aeruginosa PA01
cagacuucgccgugcuccuc

SEQ ID NO: 3517431 - RNA, 15 nt, Pseudomonas aeruginosa PA01
cagagacauccggcc

SEQ ID NO: 3517432 - RNA, 19 nt, Pseudomonas aeruginosa PA01
cagagacauccggccaugu

SEQ ID NO: 3517433 - RNA, 17 nt, Pseudomonas aeruginosa PA01
cagagaggcuggcgcuc

SEQ ID NO: 3517434 - RNA, 18 nt, Pseudomonas aeruginosa PA01
cagagaucgcccagcggc

SEQ ID NO: 3517435 - RNA, 14 nt, Pseudomonas aeruginosa PA01
cagagaucggcggc

SEQ ID NO: 3517436 - RNA, 16 nt, Pseudomonas aeruginosa PA01
cagagcagcaccagca

SEQ ID NO: 3517437 - RNA, 18 nt, Pseudomonas aeruginosa PA01
cagagcagcaccagcacc

SEQ ID NO: 3517438 - RNA, 19 nt, Pseudomonas aeruginosa PA01
cagagcagcaccagcacca

SEQ ID NO: 3517439 - RNA, 13 nt, Pseudomonas aeruginosa PA01
cagagcaucaccc

SEQ ID NO: 3517440 - RNA, 14 nt, Pseudomonas aeruginosa PA01
cagagccagccgca

SEQ ID NO: 3517441 - RNA, 16 nt, Pseudomonas aeruginosa PA01
cagagccagccgcagc

SEQ ID NO: 3517442 - RNA, 19 nt, Pseudomonas aeruginosa PA01
cagagccagccgcagcccg

SEQ ID NO: 3517443 - RNA, 15 nt, Pseudomonas aeruginosa PA01
cagagccagccgcga

SEQ ID NO: 3517444 - RNA, 16 nt, Pseudomonas aeruginosa PA01
cagagccaugggccgg

SEQ ID NO: 3517445 - RNA, 19 nt, Pseudomonas aeruginosa PA01
cagagccaugggccggccg

SEQ ID NO: 3517446 - RNA, 20 nt, Pseudomonas aeruginosa PA01
cagagccaugggccggccga

SEQ ID NO: 3517447 - RNA, 21 nt, Pseudomonas aeruginosa PA01
cagagccaugggccggccgac

SEQ ID NO: 3517448 - RNA, 23 nt, Pseudomonas aeruginosa PA01
cagagcccgucgaagccaggcac

SEQ ID NO: 3517449 - RNA, 14 nt, Pseudomonas aeruginosa PA01
cagagccgccgaac

SEQ ID NO: 3517450 - RNA, 19 nt, Pseudomonas aeruginosa PA01
cagagccgcucggcgggua

SEQ ID NO: 3517451 - RNA, 12 nt, Pseudomonas aeruginosa PA01
cagagcgccacg

SEQ ID NO: 3517452 - RNA, 20 nt, Pseudomonas aeruginosa PA01
cagagcgccagccagcgcgg

SEQ ID NO: 3517453 - RNA, 19 nt, Pseudomonas aeruginosa PA01
cagagcgccaugacccgcg

SEQ ID NO: 3517454 - RNA, 22 nt, Pseudomonas aeruginosa PA01
cagagcgcgcccugcaggccga

SEQ ID NO: 3517455 - RNA, 20 nt, Pseudomonas aeruginosa PA01
cagagcgcugccugcaccgg

SEQ ID NO: 3517456 - RNA, 21 nt, Pseudomonas aeruginosa PA01
cagagcgcugccugcaccggg

SEQ ID NO: 3517457 - RNA, 13 nt, Pseudomonas aeruginosa PA01
cagagcggccagg

SEQ ID NO: 3517458 - RNA, 19 nt, Pseudomonas aeruginosa PA01
cagagcggccggcgcggcg

SEQ ID NO: 3517459 - RNA, 20 nt, Pseudomonas aeruginosa PA01
cagagcggugaaaccggcaa

SEQ ID NO: 3517460 - RNA, 16 nt, Pseudomonas aeruginosa PA01
cagagcuccagggcug

SEQ ID NO: 3517461 - RNA, 20 nt, Pseudomonas aeruginosa PA01
cagagcuccagggcugccac

SEQ ID NO: 3517462 - RNA, 22 nt, Pseudomonas aeruginosa PA01
cagagcuggacgacgcuggccu

SEQ ID NO: 3517463 - RNA, 21 nt, Pseudomonas aeruginosa PA01
cagaggaacaguucggcgagu

SEQ ID NO: 3517464 - RNA, 15 nt, Pseudomonas aeruginosa PA01
cagaggaaggcgccg

SEQ ID NO: 3517465 - RNA, 17 nt, Pseudomonas aeruginosa PA01
cagaggcaacaccaucg

SEQ ID NO: 3517466 - RNA, 16 nt, Pseudomonas aeruginosa PA01
cagaggcauucaucac

SEQ ID NO: 3517467 - RNA, 21 nt, Pseudomonas aeruginosa PA01
cagaggcauucaucaccagcu

SEQ ID NO: 3517468 - RNA, 24 nt, Pseudomonas aeruginosa PA01
cagaggcauucaucaccagcucgc

SEQ ID NO: 3517469 - RNA, 19 nt, Pseudomonas aeruginosa PA01
cagaggcgcuccaccaggg

SEQ ID NO: 3517470 - RNA, 19 nt, Pseudomonas aeruginosa PA01
cagaggcugacccgcuguc

SEQ ID NO: 3517471 - RNA, 21 nt, Pseudomonas aeruginosa PA01
cagaggcugcgcuccaggcgg

SEQ ID NO: 3517472 - RNA, 15 nt, Pseudomonas aeruginosa PA01
cagagggcguccugc

SEQ ID NO: 3517473 - RNA, 15 nt, Pseudomonas aeruginosa PA01
cagagggucgccagc

SEQ ID NO: 3517474 - RNA, 14 nt, Pseudomonas aeruginosa PA01
cagagggugaggcg

SEQ ID NO: 3517475 - RNA, 16 nt, Pseudomonas aeruginosa PA01
cagagggugaggcgca

SEQ ID NO: 3517476 - RNA, 13 nt, Pseudomonas aeruginosa PA01
cagaggucgcuga

SEQ ID NO: 3517477 - RNA, 21 nt, Pseudomonas aeruginosa PA01
cagagguuaacaguugagcug

SEQ ID NO: 3517478 - RNA, 12 nt, Pseudomonas aeruginosa PA01
cagaguccaugc

SEQ ID NO: 3517479 - RNA, 16 nt, Pseudomonas aeruginosa PA01
cagaguccaugcucag

SEQ ID NO: 3517480 - RNA, 14 nt, Pseudomonas aeruginosa PA01
cagagucgcaccgg

SEQ ID NO: 3517481 - RNA, 12 nt, Pseudomonas aeruginosa PA01
cagagucgccgg

SEQ ID NO: 3517482 - RNA, 17 nt, Pseudomonas aeruginosa PA01
cagagugcgcagcagcg

SEQ ID NO: 3517483 - RNA, 19 nt, Pseudomonas aeruginosa PA01
cagaguugccuguccagcu

SEQ ID NO: 3517484 - RNA, 13 nt, Pseudomonas aeruginosa PA01
cagauaacgucgc

SEQ ID NO: 3517485 - RNA, 14 nt, Pseudomonas aeruginosa PA01
cagauacuccagca

SEQ ID NO: 3517486 - RNA, 17 nt, Pseudomonas aeruginosa PA01
cagauacuccagcagcg

SEQ ID NO: 3517487 - RNA, 21 nt, Pseudomonas aeruginosa PA01
cagauacuccagcagcgcacg

SEQ ID NO: 3517488 - RNA, 15 nt, Pseudomonas aeruginosa PA01
cagauagaccaaggc

SEQ ID NO: 3517489 - RNA, 20 nt, Pseudomonas aeruginosa PA01
cagauagugcggccaggcgu

SEQ ID NO: 3517490 - RNA, 19 nt, Pseudomonas aeruginosa PA01
cagauauccagggccagga

SEQ ID NO: 3517491 - RNA, 17 nt, Pseudomonas aeruginosa PA01
cagaucaccaccaccgu

SEQ ID NO: 3517492 - RNA, 20 nt, Pseudomonas aeruginosa PA01
cagaucaucgcacggucguc

SEQ ID NO: 3517493 - RNA, 17 nt, Pseudomonas aeruginosa PA01
cagaucauguagagcag

SEQ ID NO: 3517494 - RNA, 19 nt, Pseudomonas aeruginosa PA01
cagaucauguagagcaggc

SEQ ID NO: 3517495 - RNA, 22 nt, Pseudomonas aeruginosa PA01
cagaucauguagagcaggcugc

SEQ ID NO: 3517496 - RNA, 14 nt, Pseudomonas aeruginosa PA01
cagaucccaucgcc

SEQ ID NO: 3517497 - RNA, 19 nt, Pseudomonas aeruginosa PA01
cagauccccugcaggaccc

SEQ ID NO: 3517498 - RNA, 16 nt, Pseudomonas aeruginosa PA01
cagauccgggaaggcc

SEQ ID NO: 3517499 - RNA, 19 nt, Pseudomonas aeruginosa PA01
cagauccgggaaggccuga

SEQ ID NO: 3517500 - RNA, 23 nt, Pseudomonas aeruginosa PA01
cagauccgggaaggccugacgca

SEQ ID NO: 3517501 - RNA, 23 nt, Pseudomonas aeruginosa PA01
cagaucgcauuguugcggucgcg

SEQ ID NO: 3517502 - RNA, 19 nt, Pseudomonas aeruginosa PA01
cagaucgccaccccgccgc

SEQ ID NO: 3517503 - RNA, 20 nt, Pseudomonas aeruginosa PA01
cagaucgccaccccgccgcu

SEQ ID NO: 3517504 - RNA, 22 nt, Pseudomonas aeruginosa PA01
cagaucgccaccccgccgcugg

SEQ ID NO: 3517505 - RNA, 16 nt, Pseudomonas aeruginosa PA01
cagaucgccagcgcca

SEQ ID NO: 3517506 - RNA, 21 nt, Pseudomonas aeruginosa PA01
cagaucgccagcgccagcagg

SEQ ID NO: 3517507 - RNA, 22 nt, Pseudomonas aeruginosa PA01
cagaucgccagcgccagcaggu

SEQ ID NO: 3517508 - RNA, 19 nt, Pseudomonas aeruginosa PA01
cagaucgccagcucgccgc

SEQ ID NO: 3517509 - RNA, 20 nt, Pseudomonas aeruginosa PA01
cagaucgccagcucgccgcg

SEQ ID NO: 3517510 - RNA, 14 nt, Pseudomonas aeruginosa PA01
cagaucgcggcgca

SEQ ID NO: 3517511 - RNA, 17 nt, Pseudomonas aeruginosa PA01
cagaucggcgcgcaggg

SEQ ID NO: 3517512 - RNA, 23 nt, Pseudomonas aeruginosa PA01
cagaucggcgcgcagggccagca

SEQ ID NO: 3517513 - RNA, 16 nt, Pseudomonas aeruginosa PA01
cagaucgucuuucucg

SEQ ID NO: 3517514 - RNA, 20 nt, Pseudomonas aeruginosa PA01
cagaucuuccccguugccga

SEQ ID NO: 3517515 - RNA, 14 nt, Pseudomonas aeruginosa PA01
cagaugaaacugcc

SEQ ID NO: 3517516 - RNA, 15 nt, Pseudomonas aeruginosa PA01
cagaugaaacugccc

SEQ ID NO: 3517517 - RNA, 21 nt, Pseudomonas aeruginosa PA01
cagaugaccagcgcaucggcg

SEQ ID NO: 3517518 - RNA, 20 nt, Pseudomonas aeruginosa PA01
cagaugacgauggccgccgc

SEQ ID NO: 3517519 - RNA, 12 nt, Pseudomonas aeruginosa PA01
cagaugaucagg

SEQ ID NO: 3517520 - RNA, 17 nt, Pseudomonas aeruginosa PA01
cagaugaucaggccgag

SEQ ID NO: 3517521 - RNA, 16 nt, Pseudomonas aeruginosa PA01
cagaugaucgccaccg

SEQ ID NO: 3517522 - RNA, 16 nt, Pseudomonas aeruginosa PA01
cagaugcgcgucgccg

SEQ ID NO: 3517523 - RNA, 20 nt, Pseudomonas aeruginosa PA01
cagaugcuugcacaccuggu

SEQ ID NO: 3517524 - RNA, 20 nt, Pseudomonas aeruginosa PA01
cagauggcuggucaggcuga

SEQ ID NO: 3517525 - RNA, 13 nt, Pseudomonas aeruginosa PA01
cagauguccaggc

SEQ ID NO: 3517526 - RNA, 14 nt, Pseudomonas aeruginosa PA01
cagauguccaggca

SEQ ID NO: 3517527 - RNA, 16 nt, Pseudomonas aeruginosa PA01
cagauguccaggcagg

SEQ ID NO: 3517528 - RNA, 13 nt, Pseudomonas aeruginosa PA01
cagcaaacccggg

SEQ ID NO: 3517529 - RNA, 17 nt, Pseudomonas aeruginosa PA01
cagcaaacgggacaggu

SEQ ID NO: 3517530 - RNA, 12 nt, Pseudomonas aeruginosa PA01
cagcaacaccgc

SEQ ID NO: 3517531 - RNA, 13 nt, Pseudomonas aeruginosa PA01
cagcaacaccgcg

SEQ ID NO: 3517532 - RNA, 14 nt, Pseudomonas aeruginosa PA01
cagcaacagcgccg

SEQ ID NO: 3517533 - RNA, 16 nt, Pseudomonas aeruginosa PA01
cagcaacagcgccgcg

SEQ ID NO: 3517534 - RNA, 23 nt, Pseudomonas aeruginosa PA01
cagcaacaggcaaagaccgacca

SEQ ID NO: 3517535 - RNA, 17 nt, Pseudomonas aeruginosa PA01
cagcaacaguugccgca

SEQ ID NO: 3517536 - RNA, 19 nt, Pseudomonas aeruginosa PA01
cagcaacccaugccgcaag

SEQ ID NO: 3517537 - RNA, 21 nt, Pseudomonas aeruginosa PA01
cagcaacccgcccuugcucgc

SEQ ID NO: 3517538 - RNA, 16 nt, Pseudomonas aeruginosa PA01
cagcaacccgcuccgu

SEQ ID NO: 3517539 - RNA, 13 nt, Pseudomonas aeruginosa PA01
cagcaacccggcc

SEQ ID NO: 3517540 - RNA, 19 nt, Pseudomonas aeruginosa PA01
cagcaacgccgcccccagc

SEQ ID NO: 3517541 - RNA, 20 nt, Pseudomonas aeruginosa PA01
cagcaacgccgcccccagcg

SEQ ID NO: 3517542 - RNA, 14 nt, Pseudomonas aeruginosa PA01
cagcaacgccucga

SEQ ID NO: 3517543 - RNA, 18 nt, Pseudomonas aeruginosa PA01
cagcaacgccuucugcaa

SEQ ID NO: 3517544 - RNA, 22 nt, Pseudomonas aeruginosa PA01
cagcaacggacguuccaccugg

SEQ ID NO: 3517545 - RNA, 15 nt, Pseudomonas aeruginosa PA01
cagcaacggcaucgc

SEQ ID NO: 3517546 - RNA, 17 nt, Pseudomonas aeruginosa PA01
cagcaacggcaucgcuc

SEQ ID NO: 3517547 - RNA, 17 nt, Pseudomonas aeruginosa PA01
cagcaacggcgcaucgu

SEQ ID NO: 3517548 - RNA, 21 nt, Pseudomonas aeruginosa PA01
cagcaacggcgcaucgucgau

SEQ ID NO: 3517549 - RNA, 13 nt, Pseudomonas aeruginosa PA01
cagcaacggcucc

SEQ ID NO: 3517550 - RNA, 17 nt, Pseudomonas aeruginosa PA01
cagcaacggcuccuuga

SEQ ID NO: 3517551 - RNA, 15 nt, Pseudomonas aeruginosa PA01
cagcaacucgccgcc

SEQ ID NO: 3517552 - RNA, 21 nt, Pseudomonas aeruginosa PA01
cagcaacucgccgccgacacc

SEQ ID NO: 3517553 - RNA, 23 nt, Pseudomonas aeruginosa PA01
cagcaacucuuccagggucggca

SEQ ID NO: 3517554 - RNA, 20 nt, Pseudomonas aeruginosa PA01
cagcaacuggucgccgcagg

SEQ ID NO: 3517555 - RNA, 21 nt, Pseudomonas aeruginosa PA01
cagcaacuggucgccgcaggu

SEQ ID NO: 3517556 - RNA, 23 nt, Pseudomonas aeruginosa PA01
cagcaacuggucgccgcaggucc

SEQ ID NO: 3517557 - RNA, 15 nt, Pseudomonas aeruginosa PA01
cagcaagccgcagcg

SEQ ID NO: 3517558 - RNA, 16 nt, Pseudomonas aeruginosa PA01
cagcaagccgcagcgc

SEQ ID NO: 3517559 - RNA, 18 nt, Pseudomonas aeruginosa PA01
cagcaagccgcagcgccc

SEQ ID NO: 3517560 - RNA, 22 nt, Pseudomonas aeruginosa PA01
cagcaagccguagaacgccagg

SEQ ID NO: 3517561 - RNA, 19 nt, Pseudomonas aeruginosa PA01
cagcaagucgaacaggccc

SEQ ID NO: 3517562 - RNA, 23 nt, Pseudomonas aeruginosa PA01
cagcaagucgaacaggcccuuga

SEQ ID NO: 3517563 - RNA, 20 nt, Pseudomonas aeruginosa PA01
cagcaauacccgccgcuggc

SEQ ID NO: 3517564 - RNA, 14 nt, Pseudomonas aeruginosa PA01
cagcaaugccagcg

SEQ ID NO: 3517565 - RNA, 15 nt, Pseudomonas aeruginosa PA01
cagcaaugccagcgc

SEQ ID NO: 3517566 - RNA, 17 nt, Pseudomonas aeruginosa PA01
cagcaaugccagcgcca

SEQ ID NO: 3517567 - RNA, 15 nt, Pseudomonas aeruginosa PA01
cagcaaugcccagcg

SEQ ID NO: 3517568 - RNA, 20 nt, Pseudomonas aeruginosa PA01
cagcaaugcccagcgcaggc

SEQ ID NO: 3517569 - RNA, 14 nt, Pseudomonas aeruginosa PA01
cagcaauugccggc

SEQ ID NO: 3517570 - RNA, 17 nt, Pseudomonas aeruginosa PA01
cagcacagccccagccu

SEQ ID NO: 3517571 - RNA, 15 nt, Pseudomonas aeruginosa PA01
cagcacauagagggu

SEQ ID NO: 3517572 - RNA, 12 nt, Pseudomonas aeruginosa PA01
cagcaccacagc

SEQ ID NO: 3517573 - RNA, 16 nt, Pseudomonas aeruginosa PA01
cagcaccacccggccg

SEQ ID NO: 3517574 - RNA, 20 nt, Pseudomonas aeruginosa PA01
cagcaccacccggccgcgcu

SEQ ID NO: 3517575 - RNA, 23 nt, Pseudomonas aeruginosa PA01
cagcaccacccggccgcgcucga

SEQ ID NO: 3517576 - RNA, 16 nt, Pseudomonas aeruginosa PA01
cagcaccacccggcgc

SEQ ID NO: 3517577 - RNA, 12 nt, Pseudomonas aeruginosa PA01
cagcaccaccuc

SEQ ID NO: 3517578 - RNA, 15 nt, Pseudomonas aeruginosa PA01
cagcaccacgccgcu

SEQ ID NO: 3517579 - RNA, 14 nt, Pseudomonas aeruginosa PA01
cagcaccacgcucc

SEQ ID NO: 3517580 - RNA, 13 nt, Pseudomonas aeruginosa PA01
cagcaccacggcg

SEQ ID NO: 3517581 - RNA, 16 nt, Pseudomonas aeruginosa PA01
cagcaccacggcgaug

SEQ ID NO: 3517582 - RNA, 16 nt, Pseudomonas aeruginosa PA01
cagcaccagcacgccc

SEQ ID NO: 3517583 - RNA, 14 nt, Pseudomonas aeruginosa PA01
cagcaccagcagga

SEQ ID NO: 3517584 - RNA, 16 nt, Pseudomonas aeruginosa PA01
cagcaccagcggaccg

SEQ ID NO: 3517585 - RNA, 14 nt, Pseudomonas aeruginosa PA01
cagcaccaggaagc

SEQ ID NO: 3517586 - RNA, 16 nt, Pseudomonas aeruginosa PA01
cagcaccaggccaucg

SEQ ID NO: 3517587 - RNA, 17 nt, Pseudomonas aeruginosa PA01
cagcaccaggccaucga

SEQ ID NO: 3517588 - RNA, 18 nt, Pseudomonas aeruginosa PA01
cagcaccaggccaucgaa

SEQ ID NO: 3517589 - RNA, 19 nt, Pseudomonas aeruginosa PA01
cagcaccagggccagggcg

SEQ ID NO: 3517590 - RNA, 13 nt, Pseudomonas aeruginosa PA01
cagcaccaguccc

SEQ ID NO: 3517591 - RNA, 19 nt, Pseudomonas aeruginosa PA01
cagcaccagucccuggccg

SEQ ID NO: 3517592 - RNA, 20 nt, Pseudomonas aeruginosa PA01
cagcaccagucccuggccgg

SEQ ID NO: 3517593 - RNA, 22 nt, Pseudomonas aeruginosa PA01
cagcaccagucccuggccggcg

SEQ ID NO: 3517594 - RNA, 23 nt, Pseudomonas aeruginosa PA01
cagcaccagucccuggccggcga

SEQ ID NO: 3517595 - RNA, 14 nt, Pseudomonas aeruginosa PA01
cagcaccaucagcc

SEQ ID NO: 3517596 - RNA, 19 nt, Pseudomonas aeruginosa PA01
cagcaccaucagccagccc

SEQ ID NO: 3517597 - RNA, 22 nt, Pseudomonas aeruginosa PA01
cagcaccaucggguugaucgac

SEQ ID NO: 3517598 - RNA, 12 nt, Pseudomonas aeruginosa PA01
cagcacccagga

SEQ ID NO: 3517599 - RNA, 20 nt, Pseudomonas aeruginosa PA01
cagcacccaggauuuguccg

SEQ ID NO: 3517600 - RNA, 13 nt, Pseudomonas aeruginosa PA01
cagcacccccagc

SEQ ID NO: 3517601 - RNA, 20 nt, Pseudomonas aeruginosa PA01
cagcacccccagcaggccag

SEQ ID NO: 3517602 - RNA, 14 nt, Pseudomonas aeruginosa PA01
cagcacccgcaccg

SEQ ID NO: 3517603 - RNA, 17 nt, Pseudomonas aeruginosa PA01
cagcacccgguagccga

SEQ ID NO: 3517604 - RNA, 14 nt, Pseudomonas aeruginosa PA01
cagcacccggucga

SEQ ID NO: 3517605 - RNA, 17 nt, Pseudomonas aeruginosa PA01
cagcaccgagacgcccu

SEQ ID NO: 3517606 - RNA, 20 nt, Pseudomonas aeruginosa PA01
cagcaccgagacgcccugga

SEQ ID NO: 3517607 - RNA, 14 nt, Pseudomonas aeruginosa PA01
cagcaccgagcagg

SEQ ID NO: 3517608 - RNA, 16 nt, Pseudomonas aeruginosa PA01
cagcaccgagcaggca

SEQ ID NO: 3517609 - RNA, 22 nt, Pseudomonas aeruginosa PA01
cagcaccgcaagggugcucagg

SEQ ID NO: 3517610 - RNA, 14 nt, Pseudomonas aeruginosa PA01
cagcaccgccuggu

SEQ ID NO: 3517611 - RNA, 20 nt, Pseudomonas aeruginosa PA01
cagcaccgcuuucaccaggg

SEQ ID NO: 3517612 - RNA, 17 nt, Pseudomonas aeruginosa PA01
cagcaccggcggcgcca

SEQ ID NO: 3517613 - RNA, 11 nt, Pseudomonas aeruginosa PA01
cagcaccggcu

SEQ ID NO: 3517614 - RNA, 22 nt, Pseudomonas aeruginosa PA01
cagcaccggcuuguugcgcucc

SEQ ID NO: 3517615 - RNA, 22 nt, Pseudomonas aeruginosa PA01
cagcaccgggauggucgagggc

SEQ ID NO: 3517616 - RNA, 14 nt, Pseudomonas aeruginosa PA01
cagcaccguggcgc

SEQ ID NO: 3517617 - RNA, 22 nt, Pseudomonas aeruginosa PA01
cagcaccguggcgccauccucc

SEQ ID NO: 3517618 - RNA, 23 nt, Pseudomonas aeruginosa PA01
cagcaccguggcgccauccucca

SEQ ID NO: 3517619 - RNA, 21 nt, Pseudomonas aeruginosa PA01
cagcaccguggucagcaccag

SEQ ID NO: 3517620 - RNA, 22 nt, Pseudomonas aeruginosa PA01
cagcaccguggucagcaccagg

SEQ ID NO: 3517621 - RNA, 16 nt, Pseudomonas aeruginosa PA01
cagcaccucccccagc

SEQ ID NO: 3517622 - RNA, 17 nt, Pseudomonas aeruginosa PA01
cagcaccucccccagcg

SEQ ID NO: 3517623 - RNA, 14 nt, Pseudomonas aeruginosa PA01
cagcaccucgacgc

SEQ ID NO: 3517624 - RNA, 17 nt, Pseudomonas aeruginosa PA01
cagcaccucgccgucgu

SEQ ID NO: 3517625 - RNA, 19 nt, Pseudomonas aeruginosa PA01
cagcaccucguaggccgac

SEQ ID NO: 3517626 - RNA, 20 nt, Pseudomonas aeruginosa PA01
cagcaccucguaggccgacu

SEQ ID NO: 3517627 - RNA, 14 nt, Pseudomonas aeruginosa PA01
cagcaccugcgccg

SEQ ID NO: 3517628 - RNA, 15 nt, Pseudomonas aeruginosa PA01
cagcaccugcgccga

SEQ ID NO: 3517629 - RNA, 19 nt, Pseudomonas aeruginosa PA01
cagcaccugcgccgaaggc

SEQ ID NO: 3517630 - RNA, 15 nt, Pseudomonas aeruginosa PA01
cagcaccugcgggcu

SEQ ID NO: 3517631 - RNA, 16 nt, Pseudomonas aeruginosa PA01
cagcaccugcgggcug

SEQ ID NO: 3517632 - RNA, 13 nt, Pseudomonas aeruginosa PA01
cagcaccuggacg

SEQ ID NO: 3517633 - RNA, 14 nt, Pseudomonas aeruginosa PA01
cagcaccuggacga

SEQ ID NO: 3517634 - RNA, 21 nt, Pseudomonas aeruginosa PA01
cagcaccuggcagugcgccgg

SEQ ID NO: 3517635 - RNA, 22 nt, Pseudomonas aeruginosa PA01
cagcaccuggcagugcgccggc

SEQ ID NO: 3517636 - RNA, 19 nt, Pseudomonas aeruginosa PA01
cagcaccuucaucaccagg

SEQ ID NO: 3517637 - RNA, 13 nt, Pseudomonas aeruginosa PA01
cagcaccuugugc

SEQ ID NO: 3517638 - RNA, 16 nt, Pseudomonas aeruginosa PA01
cagcaccuugugcugc

SEQ ID NO: 3517639 - RNA, 17 nt, Pseudomonas aeruginosa PA01
cagcaccuugugcugcc

SEQ ID NO: 3517640 - RNA, 19 nt, Pseudomonas aeruginosa PA01
cagcaccuugugcugccug

SEQ ID NO: 3517641 - RNA, 20 nt, Pseudomonas aeruginosa PA01
cagcaccuugugcugccugc

SEQ ID NO: 3517642 - RNA, 17 nt, Pseudomonas aeruginosa PA01
cagcacgaaagccaugc

SEQ ID NO: 3517643 - RNA, 22 nt, Pseudomonas aeruginosa PA01
cagcacgaaagccaugcccaga

SEQ ID NO: 3517644 - RNA, 19 nt, Pseudomonas aeruginosa PA01
cagcacgagcuuggccacu

SEQ ID NO: 3517645 - RNA, 22 nt, Pseudomonas aeruginosa PA01
cagcacgauggcgaggaugauc

SEQ ID NO: 3517646 - RNA, 22 nt, Pseudomonas aeruginosa PA01
cagcacgcccaguugcgccgcc

SEQ ID NO: 3517647 - RNA, 13 nt, Pseudomonas aeruginosa PA01
cagcacgcggagg

SEQ ID NO: 3517648 - RNA, 17 nt, Pseudomonas aeruginosa PA01
cagcacgcguccgacca

SEQ ID NO: 3517649 - RNA, 19 nt, Pseudomonas aeruginosa PA01
cagcacgcguccgaccauu

SEQ ID NO: 3517650 - RNA, 14 nt, Pseudomonas aeruginosa PA01
cagcacgcucaggc

SEQ ID NO: 3517651 - RNA, 17 nt, Pseudomonas aeruginosa PA01
cagcacgcucaggcagc

SEQ ID NO: 3517652 - RNA, 19 nt, Pseudomonas aeruginosa PA01
cagcacgcugacgccggca

SEQ ID NO: 3517653 - RNA, 22 nt, Pseudomonas aeruginosa PA01
cagcacgcugacgccggcaccg

SEQ ID NO: 3517654 - RNA, 14 nt, Pseudomonas aeruginosa PA01
cagcacgcuggcgu

SEQ ID NO: 3517655 - RNA, 12 nt, Pseudomonas aeruginosa PA01
cagcacggccuc

SEQ ID NO: 3517656 - RNA, 13 nt, Pseudomonas aeruginosa PA01
cagcacggccucg

SEQ ID NO: 3517657 - RNA, 15 nt, Pseudomonas aeruginosa PA01
cagcacggcgaauuc

SEQ ID NO: 3517658 - RNA, 21 nt, Pseudomonas aeruginosa PA01
cagcacggcgaauucgucgcc

SEQ ID NO: 3517659 - RNA, 14 nt, Pseudomonas aeruginosa PA01
cagcacggcgacga

SEQ ID NO: 3517660 - RNA, 22 nt, Pseudomonas aeruginosa PA01
cagcacggcgacgaaggccugg

SEQ ID NO: 3517661 - RNA, 23 nt, Pseudomonas aeruginosa PA01
cagcacggcgcggguguccucga

SEQ ID NO: 3517662 - RNA, 13 nt, Pseudomonas aeruginosa PA01
cagcacggcggcu

SEQ ID NO: 3517663 - RNA, 20 nt, Pseudomonas aeruginosa PA01
cagcacggugaaccaggcgc

SEQ ID NO: 3517664 - RNA, 22 nt, Pseudomonas aeruginosa PA01
cagcacggugaaccaggcgccg

SEQ ID NO: 3517665 - RNA, 20 nt, Pseudomonas aeruginosa PA01
cagcacggugcuggcgucgc

SEQ ID NO: 3517666 - RNA, 19 nt, Pseudomonas aeruginosa PA01
cagcacgguguuguggcug

SEQ ID NO: 3517667 - RNA, 17 nt, Pseudomonas aeruginosa PA01
cagcacguagccgcccu

SEQ ID NO: 3517668 - RNA, 18 nt, Pseudomonas aeruginosa PA01
cagcacguagccgcccuu

SEQ ID NO: 3517669 - RNA, 21 nt, Pseudomonas aeruginosa PA01
cagcacgucgauauccagcgg

SEQ ID NO: 3517670 - RNA, 20 nt, Pseudomonas aeruginosa PA01
cagcacgucguccagcgccg

SEQ ID NO: 3517671 - RNA, 21 nt, Pseudomonas aeruginosa PA01
cagcacgucguccagcgccga

SEQ ID NO: 3517672 - RNA, 22 nt, Pseudomonas aeruginosa PA01
cagcacguugccauccagcgcc

SEQ ID NO: 3517673 - RNA, 23 nt, Pseudomonas aeruginosa PA01
cagcacguugccauccagcgccu

SEQ ID NO: 3517674 - RNA, 23 nt, Pseudomonas aeruginosa PA01
cagcacuacgcccauggcgguga

SEQ ID NO: 3517675 - RNA, 15 nt, Pseudomonas aeruginosa PA01
cagcacuuccggcgc

SEQ ID NO: 3517676 - RNA, 15 nt, Pseudomonas aeruginosa PA01
cagcacuuccugaag

SEQ ID NO: 3517677 - RNA, 17 nt, Pseudomonas aeruginosa PA01
cagcagcaacagcgccg

SEQ ID NO: 3517678 - RNA, 19 nt, Pseudomonas aeruginosa PA01
cagcagcaccaucagccag

SEQ ID NO: 3517679 - RNA, 22 nt, Pseudomonas aeruginosa PA01
cagcagcaccaucagccagccc

SEQ ID NO: 3517680 - RNA, 16 nt, Pseudomonas aeruginosa PA01
cagcagcacccggacc

SEQ ID NO: 3517681 - RNA, 13 nt, Pseudomonas aeruginosa PA01
cagcagcaccgcg

SEQ ID NO: 3517682 - RNA, 14 nt, Pseudomonas aeruginosa PA01
cagcagcaccgcgc

SEQ ID NO: 3517683 - RNA, 16 nt, Pseudomonas aeruginosa PA01
cagcagcaccgcgcgc

SEQ ID NO: 3517684 - RNA, 17 nt, Pseudomonas aeruginosa PA01
cagcagcaccgcgcgcu

SEQ ID NO: 3517685 - RNA, 14 nt, Pseudomonas aeruginosa PA01
cagcagcacgcccu

SEQ ID NO: 3517686 - RNA, 17 nt, Pseudomonas aeruginosa PA01
cagcagcacgcccuggg

SEQ ID NO: 3517687 - RNA, 17 nt, Pseudomonas aeruginosa PA01
cagcagcacggcgacga

SEQ ID NO: 3517688 - RNA, 17 nt, Pseudomonas aeruginosa PA01
cagcagcagaagggcgg

SEQ ID NO: 3517689 - RNA, 14 nt, Pseudomonas aeruginosa PA01
cagcagcagcgcca

SEQ ID NO: 3517690 - RNA, 17 nt, Pseudomonas aeruginosa PA01
cagcagcagcgccaugc

SEQ ID NO: 3517691 - RNA, 12 nt, Pseudomonas aeruginosa PA01
cagcagcaggcc

SEQ ID NO: 3517692 - RNA, 13 nt, Pseudomonas aeruginosa PA01
cagcagcaggccg

SEQ ID NO: 3517693 - RNA, 15 nt, Pseudomonas aeruginosa PA01
cagcagcaggccggc

SEQ ID NO: 3517694 - RNA, 16 nt, Pseudomonas aeruginosa PA01
cagcagcaggccggcg

SEQ ID NO: 3517695 - RNA, 23 nt, Pseudomonas aeruginosa PA01
cagcagcaggccggcgaccagcg

SEQ ID NO: 3517696 - RNA, 13 nt, Pseudomonas aeruginosa PA01
cagcagcaggcgc

SEQ ID NO: 3517697 - RNA, 16 nt, Pseudomonas aeruginosa PA01
cagcagcaggcgcucg

SEQ ID NO: 3517698 - RNA, 17 nt, Pseudomonas aeruginosa PA01
cagcagcaggcgcucgg

SEQ ID NO: 3517699 - RNA, 21 nt, Pseudomonas aeruginosa PA01
cagcagcaugaugccgaggcg

SEQ ID NO: 3517700 - RNA, 19 nt, Pseudomonas aeruginosa PA01
cagcagcaugccgcucugc

SEQ ID NO: 3517701 - RNA, 22 nt, Pseudomonas aeruginosa PA01
cagcagcaugccgcucugccag

SEQ ID NO: 3517702 - RNA, 21 nt, Pseudomonas aeruginosa PA01
cagcagcaugggauggcgcgg

SEQ ID NO: 3517703 - RNA, 16 nt, Pseudomonas aeruginosa PA01
cagcagccaaggaugc

SEQ ID NO: 3517704 - RNA, 18 nt, Pseudomonas aeruginosa PA01
cagcagccaaggaugcgc

SEQ ID NO: 3517705 - RNA, 22 nt, Pseudomonas aeruginosa PA01
cagcagccaaggaugcgccagc

SEQ ID NO: 3517706 - RNA, 12 nt, Pseudomonas aeruginosa PA01
cagcagccaggc

SEQ ID NO: 3517707 - RNA, 13 nt, Pseudomonas aeruginosa PA01
cagcagccaggcc

SEQ ID NO: 3517708 - RNA, 14 nt, Pseudomonas aeruginosa PA01
cagcagccaggcga

SEQ ID NO: 3517709 - RNA, 22 nt, Pseudomonas aeruginosa PA01
cagcagccccgaggccagcagg

SEQ ID NO: 3517710 - RNA, 16 nt, Pseudomonas aeruginosa PA01
cagcagcccggccugg

SEQ ID NO: 3517711 - RNA, 13 nt, Pseudomonas aeruginosa PA01
cagcagcgaacgc

SEQ ID NO: 3517712 - RNA, 14 nt, Pseudomonas aeruginosa PA01
cagcagcgaacgcc

SEQ ID NO: 3517713 - RNA, 23 nt, Pseudomonas aeruginosa PA01
cagcagcgaacgccgcagcucgg

SEQ ID NO: 3517714 - RNA, 12 nt, Pseudomonas aeruginosa PA01
cagcagcgaccu

SEQ ID NO: 3517715 - RNA, 16 nt, Pseudomonas aeruginosa PA01
cagcagcgagcaggcg

SEQ ID NO: 3517716 - RNA, 16 nt, Pseudomonas aeruginosa PA01
cagcagcgcaccaucc

SEQ ID NO: 3517717 - RNA, 13 nt, Pseudomonas aeruginosa PA01
cagcagcgccagg

SEQ ID NO: 3517718 - RNA, 16 nt, Pseudomonas aeruginosa PA01
cagcagcgccaggaag

SEQ ID NO: 3517719 - RNA, 14 nt, Pseudomonas aeruginosa PA01
cagcagcgccaggg

SEQ ID NO: 3517720 - RNA, 14 nt, Pseudomonas aeruginosa PA01
cagcagcgccagua

SEQ ID NO: 3517721 - RNA, 12 nt, Pseudomonas aeruginosa PA01
cagcagcgccga

SEQ ID NO: 3517722 - RNA, 13 nt, Pseudomonas aeruginosa PA01
cagcagcgccgcg

SEQ ID NO: 3517723 - RNA, 15 nt, Pseudomonas aeruginosa PA01
cagcagcgccgcgaa

SEQ ID NO: 3517724 - RNA, 15 nt, Pseudomonas aeruginosa PA01
cagcagcgcugauca

SEQ ID NO: 3517725 - RNA, 16 nt, Pseudomonas aeruginosa PA01
cagcagcgcugaucac

SEQ ID NO: 3517726 - RNA, 21 nt, Pseudomonas aeruginosa PA01
cagcagcggaucggcggugcc

SEQ ID NO: 3517727 - RNA, 20 nt, Pseudomonas aeruginosa PA01
cagcagcggcaaaggcccgg

SEQ ID NO: 3517728 - RNA, 13 nt, Pseudomonas aeruginosa PA01
cagcagcggcacc

SEQ ID NO: 3517729 - RNA, 16 nt, Pseudomonas aeruginosa PA01
cagcagcggcaccagc

SEQ ID NO: 3517730 - RNA, 17 nt, Pseudomonas aeruginosa PA01
cagcagcggcaccagca

SEQ ID NO: 3517731 - RNA, 14 nt, Pseudomonas aeruginosa PA01
cagcagcggcagcc

SEQ ID NO: 3517732 - RNA, 13 nt, Pseudomonas aeruginosa PA01
cagcagcggcagg

SEQ ID NO: 3517733 - RNA, 14 nt, Pseudomonas aeruginosa PA01
cagcagcggcagga

SEQ ID NO: 3517734 - RNA, 21 nt, Pseudomonas aeruginosa PA01
cagcagcggcgacaccgccag

SEQ ID NO: 3517735 - RNA, 14 nt, Pseudomonas aeruginosa PA01
cagcagcggcggcg

SEQ ID NO: 3517736 - RNA, 18 nt, Pseudomonas aeruginosa PA01
cagcagcgggcguccggc

SEQ ID NO: 3517737 - RNA, 17 nt, Pseudomonas aeruginosa PA01
cagcagcgguacggucg

SEQ ID NO: 3517738 - RNA, 16 nt, Pseudomonas aeruginosa PA01
cagcagcgguaggcgc

SEQ ID NO: 3517739 - RNA, 19 nt, Pseudomonas aeruginosa PA01
cagcagcgucgcgucggcc

SEQ ID NO: 3517740 - RNA, 20 nt, Pseudomonas aeruginosa PA01
cagcagcgucgcgucggccu

SEQ ID NO: 3517741 - RNA, 14 nt, Pseudomonas aeruginosa PA01
cagcagcucgccgc

SEQ ID NO: 3517742 - RNA, 21 nt, Pseudomonas aeruginosa PA01
cagcagcuucaguagguagag

SEQ ID NO: 3517743 - RNA, 15 nt, Pseudomonas aeruginosa PA01
cagcagcuucggcgc

SEQ ID NO: 3517744 - RNA, 17 nt, Pseudomonas aeruginosa PA01
cagcagcuucggcgcga

SEQ ID NO: 3517745 - RNA, 21 nt, Pseudomonas aeruginosa PA01
cagcaggaaaacgcucaggcc

SEQ ID NO: 3517746 - RNA, 22 nt, Pseudomonas aeruginosa PA01
cagcaggaaaacgcucaggcca

SEQ ID NO: 3517747 - RNA, 17 nt, Pseudomonas aeruginosa PA01
cagcaggaaaagcggaa

SEQ ID NO: 3517748 - RNA, 14 nt, Pseudomonas aeruginosa PA01
cagcaggaagccga

SEQ ID NO: 3517749 - RNA, 20 nt, Pseudomonas aeruginosa PA01
cagcaggaagcugacgaaca

SEQ ID NO: 3517750 - RNA, 14 nt, Pseudomonas aeruginosa PA01
cagcaggacgucga

SEQ ID NO: 3517751 - RNA, 16 nt, Pseudomonas aeruginosa PA01
cagcaggacgucgagg

SEQ ID NO: 3517752 - RNA, 17 nt, Pseudomonas aeruginosa PA01
cagcaggagaagcgccu

SEQ ID NO: 3517753 - RNA, 22 nt, Pseudomonas aeruginosa PA01
cagcaggagaagcgccucgccu

SEQ ID NO: 3517754 - RNA, 18 nt, Pseudomonas aeruginosa PA01
cagcaggagcagcuugcg

SEQ ID NO: 3517755 - RNA, 14 nt, Pseudomonas aeruginosa PA01
cagcaggagcaugu

SEQ ID NO: 3517756 - RNA, 15 nt, Pseudomonas aeruginosa PA01
cagcaggagcgccau

SEQ ID NO: 3517757 - RNA, 20 nt, Pseudomonas aeruginosa PA01
cagcaggagcgccaucagcg

SEQ ID NO: 3517758 - RNA, 22 nt, Pseudomonas aeruginosa PA01
cagcaggagcgccaucagcgac

SEQ ID NO: 3517759 - RNA, 17 nt, Pseudomonas aeruginosa PA01
cagcaggaucagcgcau

SEQ ID NO: 3517760 - RNA, 17 nt, Pseudomonas aeruginosa PA01
cagcaggauccaggugc

SEQ ID NO: 3517761 - RNA, 17 nt, Pseudomonas aeruginosa PA01
cagcaggaucgacagca

SEQ ID NO: 3517762 - RNA, 20 nt, Pseudomonas aeruginosa PA01
cagcaggaucgacagcagcg

SEQ ID NO: 3517763 - RNA, 23 nt, Pseudomonas aeruginosa PA01
cagcaggaucgacagcagcgcca

SEQ ID NO: 3517764 - RNA, 17 nt, Pseudomonas aeruginosa PA01
cagcaggaugcagucgg

SEQ ID NO: 3517765 - RNA, 20 nt, Pseudomonas aeruginosa PA01
cagcaggaugcagucggcac

SEQ ID NO: 3517766 - RNA, 18 nt, Pseudomonas aeruginosa PA01
cagcaggaugcugcacag

SEQ ID NO: 3517767 - RNA, 19 nt, Pseudomonas aeruginosa PA01
cagcaggaugcugcacagc

SEQ ID NO: 3517768 - RNA, 22 nt, Pseudomonas aeruginosa PA01
cagcaggaugcugcacagccau

SEQ ID NO: 3517769 - RNA, 14 nt, Pseudomonas aeruginosa PA01
cagcaggcacaggg

SEQ ID NO: 3517770 - RNA, 16 nt, Pseudomonas aeruginosa PA01
cagcaggcacagggcg

SEQ ID NO: 3517771 - RNA, 18 nt, Pseudomonas aeruginosa PA01
cagcaggcacagggcgac

SEQ ID NO: 3517772 - RNA, 13 nt, Pseudomonas aeruginosa PA01
cagcaggcaggca

SEQ ID NO: 3517773 - RNA, 15 nt, Pseudomonas aeruginosa PA01
cagcaggcaggcaug

SEQ ID NO: 3517774 - RNA, 22 nt, Pseudomonas aeruginosa PA01
cagcaggcaggcgcgggucauc

SEQ ID NO: 3517775 - RNA, 14 nt, Pseudomonas aeruginosa PA01
cagcaggccagcca

SEQ ID NO: 3517776 - RNA, 15 nt, Pseudomonas aeruginosa PA01
cagcaggcccagcca

SEQ ID NO: 3517777 - RNA, 14 nt, Pseudomonas aeruginosa PA01
cagcaggcccgagc

SEQ ID NO: 3517778 - RNA, 19 nt, Pseudomonas aeruginosa PA01
cagcaggcccgagccggac

SEQ ID NO: 3517779 - RNA, 12 nt, Pseudomonas aeruginosa PA01
cagcaggccgaa

SEQ ID NO: 3517780 - RNA, 13 nt, Pseudomonas aeruginosa PA01
cagcaggccgaag

SEQ ID NO: 3517781 - RNA, 16 nt, Pseudomonas aeruginosa PA01
cagcaggccgaaggcc

SEQ ID NO: 3517782 - RNA, 23 nt, Pseudomonas aeruginosa PA01
cagcaggccgaaggccaggaccg

SEQ ID NO: 3517783 - RNA, 12 nt, Pseudomonas aeruginosa PA01
cagcaggccgag

SEQ ID NO: 3517784 - RNA, 21 nt, Pseudomonas aeruginosa PA01
cagcaggccgagcccgagugc

SEQ ID NO: 3517785 - RNA, 18 nt, Pseudomonas aeruginosa PA01
cagcaggccgaggucggc

SEQ ID NO: 3517786 - RNA, 15 nt, Pseudomonas aeruginosa PA01
cagcaggccgaucac

SEQ ID NO: 3517787 - RNA, 20 nt, Pseudomonas aeruginosa PA01
cagcaggccgaucagcggcg

SEQ ID NO: 3517788 - RNA, 13 nt, Pseudomonas aeruginosa PA01
cagcaggccgccg

SEQ ID NO: 3517789 - RNA, 13 nt, Pseudomonas aeruginosa PA01
cagcaggccggcc

SEQ ID NO: 3517790 - RNA, 17 nt, Pseudomonas aeruginosa PA01
cagcaggccggccagcc

SEQ ID NO: 3517791 - RNA, 18 nt, Pseudomonas aeruginosa PA01
cagcaggccgugggccgg

SEQ ID NO: 3517792 - RNA, 21 nt, Pseudomonas aeruginosa PA01
cagcaggccgugggccggcgc

SEQ ID NO: 3517793 - RNA, 22 nt, Pseudomonas aeruginosa PA01
cagcaggcgacggucaggccga

SEQ ID NO: 3517794 - RNA, 24 nt, Pseudomonas aeruginosa PA01
cagcaggcgacggucaggccgagc

SEQ ID NO: 3517795 - RNA, 11 nt, Pseudomonas aeruginosa PA01
cagcaggcgau

SEQ ID NO: 3517796 - RNA, 22 nt, Pseudomonas aeruginosa PA01
cagcaggcgcaaccagaccagc

SEQ ID NO: 3517797 - RNA, 17 nt, Pseudomonas aeruginosa PA01
cagcaggcgcagcagcg

SEQ ID NO: 3517798 - RNA, 18 nt, Pseudomonas aeruginosa PA01
cagcaggcgcagcagcga

SEQ ID NO: 3517799 - RNA, 14 nt, Pseudomonas aeruginosa PA01
cagcaggcgccgcg

SEQ ID NO: 3517800 - RNA, 16 nt, Pseudomonas aeruginosa PA01
cagcaggcgccgcgca

SEQ ID NO: 3517801 - RNA, 13 nt, Pseudomonas aeruginosa PA01
cagcaggcgccgg

SEQ ID NO: 3517802 - RNA, 14 nt, Pseudomonas aeruginosa PA01
cagcaggcgccggc

SEQ ID NO: 3517803 - RNA, 18 nt, Pseudomonas aeruginosa PA01
cagcaggcgccggcggau

SEQ ID NO: 3517804 - RNA, 23 nt, Pseudomonas aeruginosa PA01
cagcaggcgccggcggaucagcc

SEQ ID NO: 3517805 - RNA, 13 nt, Pseudomonas aeruginosa PA01
cagcaggcgcgcc

SEQ ID NO: 3517806 - RNA, 14 nt, Pseudomonas aeruginosa PA01
cagcaggcgcgccc

SEQ ID NO: 3517807 - RNA, 15 nt, Pseudomonas aeruginosa PA01
cagcaggcgcgcccu

SEQ ID NO: 3517808 - RNA, 19 nt, Pseudomonas aeruginosa PA01
cagcaggcgcucgcugcgu

SEQ ID NO: 3517809 - RNA, 14 nt, Pseudomonas aeruginosa PA01
cagcaggcgcucgg

SEQ ID NO: 3517810 - RNA, 16 nt, Pseudomonas aeruginosa PA01
cagcaggcgcucggcg

SEQ ID NO: 3517811 - RNA, 17 nt, Pseudomonas aeruginosa PA01
cagcaggcgcucggcga

SEQ ID NO: 3517812 - RNA, 17 nt, Pseudomonas aeruginosa PA01
cagcaggcgggcgaagu

SEQ ID NO: 3517813 - RNA, 15 nt, Pseudomonas aeruginosa PA01
cagcaggcucaucgc

SEQ ID NO: 3517814 - RNA, 16 nt, Pseudomonas aeruginosa PA01
cagcaggcucaucgcc

SEQ ID NO: 3517815 - RNA, 21 nt, Pseudomonas aeruginosa PA01
cagcaggcucaucgcccgccc

SEQ ID NO: 3517816 - RNA, 11 nt, Pseudomonas aeruginosa PA01
cagcaggcugc

SEQ ID NO: 3517817 - RNA, 12 nt, Pseudomonas aeruginosa PA01
cagcaggcugcc

SEQ ID NO: 3517818 - RNA, 21 nt, Pseudomonas aeruginosa PA01
cagcaggcugccguugcggcc

SEQ ID NO: 3517819 - RNA, 19 nt, Pseudomonas aeruginosa PA01
cagcaggcugcugcugcgg

SEQ ID NO: 3517820 - RNA, 20 nt, Pseudomonas aeruginosa PA01
cagcaggcugcugcugcggc

SEQ ID NO: 3517821 - RNA, 14 nt, Pseudomonas aeruginosa PA01
cagcaggcuggcgg

SEQ ID NO: 3517822 - RNA, 22 nt, Pseudomonas aeruginosa PA01
cagcaggcuggcggcaucggcg

SEQ ID NO: 3517823 - RNA, 11 nt, Pseudomonas aeruginosa PA01
cagcaggcugu

SEQ ID NO: 3517824 - RNA, 17 nt, Pseudomonas aeruginosa PA01
cagcaggcuguacagca

SEQ ID NO: 3517825 - RNA, 19 nt, Pseudomonas aeruginosa PA01
cagcaggcuguacagcagg

SEQ ID NO: 3517826 - RNA, 21 nt, Pseudomonas aeruginosa PA01
cagcaggcuguacagcaggag

SEQ ID NO: 3517827 - RNA, 21 nt, Pseudomonas aeruginosa PA01
cagcagggaggcgcacaucac

SEQ ID NO: 3517828 - RNA, 13 nt, Pseudomonas aeruginosa PA01
cagcagggccagc

SEQ ID NO: 3517829 - RNA, 19 nt, Pseudomonas aeruginosa PA01
cagcagggccagcagcgcu

SEQ ID NO: 3517830 - RNA, 16 nt, Pseudomonas aeruginosa PA01
cagcagggccagccag

SEQ ID NO: 3517831 - RNA, 17 nt, Pseudomonas aeruginosa PA01
cagcagggccagccaga

SEQ ID NO: 3517832 - RNA, 19 nt, Pseudomonas aeruginosa PA01
cagcagggccagccagagc

SEQ ID NO: 3517833 - RNA, 14 nt, Pseudomonas aeruginosa PA01
cagcagggccagcg

SEQ ID NO: 3517834 - RNA, 16 nt, Pseudomonas aeruginosa PA01
cagcagggccagcgcc

SEQ ID NO: 3517835 - RNA, 19 nt, Pseudomonas aeruginosa PA01
cagcagggccagcgccugg

SEQ ID NO: 3517836 - RNA, 21 nt, Pseudomonas aeruginosa PA01
cagcagggccagcgccuggcg

SEQ ID NO: 3517837 - RNA, 14 nt, Pseudomonas aeruginosa PA01
cagcagggccaggc

SEQ ID NO: 3517838 - RNA, 22 nt, Pseudomonas aeruginosa PA01
cagcagggccaggccgagcgcg

SEQ ID NO: 3517839 - RNA, 15 nt, Pseudomonas aeruginosa PA01
cagcagggccgccga

SEQ ID NO: 3517840 - RNA, 20 nt, Pseudomonas aeruginosa PA01
cagcagggccgccgagguca

SEQ ID NO: 3517841 - RNA, 12 nt, Pseudomonas aeruginosa PA01
cagcagggcguc

SEQ ID NO: 3517842 - RNA, 15 nt, Pseudomonas aeruginosa PA01
cagcagggcgucggc

SEQ ID NO: 3517843 - RNA, 17 nt, Pseudomonas aeruginosa PA01
cagcagggcgucggcgu

SEQ ID NO: 3517844 - RNA, 14 nt, Pseudomonas aeruginosa PA01
cagcaggguaccgc

SEQ ID NO: 3517845 - RNA, 19 nt, Pseudomonas aeruginosa PA01
cagcaggguaccgcuggcg

SEQ ID NO: 3517846 - RNA, 17 nt, Pseudomonas aeruginosa PA01
cagcagggucagcagcg

SEQ ID NO: 3517847 - RNA, 18 nt, Pseudomonas aeruginosa PA01
cagcagggucagcagcgc

SEQ ID NO: 3517848 - RNA, 21 nt, Pseudomonas aeruginosa PA01
cagcagggucagcagcgccag

SEQ ID NO: 3517849 - RNA, 13 nt, Pseudomonas aeruginosa PA01
cagcagggucagg

SEQ ID NO: 3517850 - RNA, 15 nt, Pseudomonas aeruginosa PA01
cagcagggucgccug

SEQ ID NO: 3517851 - RNA, 17 nt, Pseudomonas aeruginosa PA01
cagcagggucgccuggg

SEQ ID NO: 3517852 - RNA, 14 nt, Pseudomonas aeruginosa PA01
cagcagggucgcgc

SEQ ID NO: 3517853 - RNA, 16 nt, Pseudomonas aeruginosa PA01
cagcagggucgcgccg

SEQ ID NO: 3517854 - RNA, 11 nt, Pseudomonas aeruginosa PA01
cagcagggucu

SEQ ID NO: 3517855 - RNA, 22 nt, Pseudomonas aeruginosa PA01
cagcagggucuucaggcgccgu

SEQ ID NO: 3517856 - RNA, 23 nt, Pseudomonas aeruginosa PA01
cagcagggugcggauggcgaucg

SEQ ID NO: 3517857 - RNA, 24 nt, Pseudomonas aeruginosa PA01
cagcagggugcggauggcgaucga

SEQ ID NO: 3517858 - RNA, 17 nt, Pseudomonas aeruginosa PA01
cagcaggguggccaggg

SEQ ID NO: 3517859 - RNA, 14 nt, Pseudomonas aeruginosa PA01
cagcagguacagca

SEQ ID NO: 3517860 - RNA, 17 nt, Pseudomonas aeruginosa PA01
cagcagguacagcagcu

SEQ ID NO: 3517861 - RNA, 12 nt, Pseudomonas aeruginosa PA01
cagcagguagaa

SEQ ID NO: 3517862 - RNA, 23 nt, Pseudomonas aeruginosa PA01
cagcagguagaccacgcaggcca

SEQ ID NO: 3517863 - RNA, 13 nt, Pseudomonas aeruginosa PA01
cagcagguagacg

SEQ ID NO: 3517864 - RNA, 20 nt, Pseudomonas aeruginosa PA01
cagcagguagacgcaggugc

SEQ ID NO: 3517865 - RNA, 19 nt, Pseudomonas aeruginosa PA01
cagcagguagccagggguc

SEQ ID NO: 3517866 - RNA, 15 nt, Pseudomonas aeruginosa PA01
cagcagguagccugc

SEQ ID NO: 3517867 - RNA, 20 nt, Pseudomonas aeruginosa PA01
cagcagguagccugcggcca

SEQ ID NO: 3517868 - RNA, 23 nt, Pseudomonas aeruginosa PA01
cagcagguagccugcggccagcg

SEQ ID NO: 3517869 - RNA, 19 nt, Pseudomonas aeruginosa PA01
cagcagguagugcggcggg

SEQ ID NO: 3517870 - RNA, 17 nt, Pseudomonas aeruginosa PA01
cagcagguagugcucgg

SEQ ID NO: 3517871 - RNA, 22 nt, Pseudomonas aeruginosa PA01
cagcagguagugcucggccagu

SEQ ID NO: 3517872 - RNA, 14 nt, Pseudomonas aeruginosa PA01
cagcaggucgaggg

SEQ ID NO: 3517873 - RNA, 18 nt, Pseudomonas aeruginosa PA01
cagcaggucgagggcguc

SEQ ID NO: 3517874 - RNA, 14 nt, Pseudomonas aeruginosa PA01
cagcaggucgcgca

SEQ ID NO: 3517875 - RNA, 16 nt, Pseudomonas aeruginosa PA01
cagcaggucgcggccc

SEQ ID NO: 3517876 - RNA, 17 nt, Pseudomonas aeruginosa PA01
cagcaggucgcggcccc

SEQ ID NO: 3517877 - RNA, 22 nt, Pseudomonas aeruginosa PA01
cagcaggucgcggccccagcac

SEQ ID NO: 3517878 - RNA, 13 nt, Pseudomonas aeruginosa PA01
cagcaggucggcc

SEQ ID NO: 3517879 - RNA, 16 nt, Pseudomonas aeruginosa PA01
cagcaggucggccugc

SEQ ID NO: 3517880 - RNA, 19 nt, Pseudomonas aeruginosa PA01
cagcaggucggccugcugc

SEQ ID NO: 3517881 - RNA, 14 nt, Pseudomonas aeruginosa PA01
cagcaggucggcgc

SEQ ID NO: 3517882 - RNA, 21 nt, Pseudomonas aeruginosa PA01
cagcaggucggcgcgacggcc

SEQ ID NO: 3517883 - RNA, 15 nt, Pseudomonas aeruginosa PA01
cagcaggucgucggc

SEQ ID NO: 3517884 - RNA, 18 nt, Pseudomonas aeruginosa PA01
cagcaggucgucggcgaa

SEQ ID NO: 3517885 - RNA, 20 nt, Pseudomonas aeruginosa PA01
cagcaggucgucggcgaaag

SEQ ID NO: 3517886 - RNA, 15 nt, Pseudomonas aeruginosa PA01
cagcaggucucaccg

SEQ ID NO: 3517887 - RNA, 17 nt, Pseudomonas aeruginosa PA01
cagcaggucucaccgcc

SEQ ID NO: 3517888 - RNA, 19 nt, Pseudomonas aeruginosa PA01
cagcaggucuuccaccgcg

SEQ ID NO: 3517889 - RNA, 20 nt, Pseudomonas aeruginosa PA01
cagcagguggcaagccucgc

SEQ ID NO: 3517890 - RNA, 14 nt, Pseudomonas aeruginosa PA01
cagcagguggcgca

SEQ ID NO: 3517891 - RNA, 16 nt, Pseudomonas aeruginosa PA01
cagcagguggucgaug

SEQ ID NO: 3517892 - RNA, 20 nt, Pseudomonas aeruginosa PA01
cagcagguggucgaugggcg

SEQ ID NO: 3517893 - RNA, 21 nt, Pseudomonas aeruginosa PA01
cagcagguucggcgguagcgc

SEQ ID NO: 3517894 - RNA, 21 nt, Pseudomonas aeruginosa PA01
cagcagguugaccccgcggcc

SEQ ID NO: 3517895 - RNA, 16 nt, Pseudomonas aeruginosa PA01
cagcaguaccuggcgg

SEQ ID NO: 3517896 - RNA, 21 nt, Pseudomonas aeruginosa PA01
cagcaguagugcgacgcagca

SEQ ID NO: 3517897 - RNA, 16 nt, Pseudomonas aeruginosa PA01
cagcagucgcagcucg

SEQ ID NO: 3517898 - RNA, 15 nt, Pseudomonas aeruginosa PA01
cagcagucgcggccc

SEQ ID NO: 3517899 - RNA, 18 nt, Pseudomonas aeruginosa PA01
cagcagucgcggcccugg

SEQ ID NO: 3517900 - RNA, 14 nt, Pseudomonas aeruginosa PA01
cagcagugcggggc

SEQ ID NO: 3517901 - RNA, 20 nt, Pseudomonas aeruginosa PA01
cagcagugcggggcgcucgc

SEQ ID NO: 3517902 - RNA, 23 nt, Pseudomonas aeruginosa PA01
cagcagugcggggcgcucgcccu

SEQ ID NO: 3517903 - RNA, 18 nt, Pseudomonas aeruginosa PA01
cagcaguggcuccgcgcg

SEQ ID NO: 3517904 - RNA, 19 nt, Pseudomonas aeruginosa PA01
cagcaguugcaacagcgcg

SEQ ID NO: 3517905 - RNA, 15 nt, Pseudomonas aeruginosa PA01
cagcaguugccgggu

SEQ ID NO: 3517906 - RNA, 21 nt, Pseudomonas aeruginosa PA01
cagcaucaccuugcggaaccc

SEQ ID NO: 3517907 - RNA, 13 nt, Pseudomonas aeruginosa PA01
cagcaucagcagg

SEQ ID NO: 3517908 - RNA, 14 nt, Pseudomonas aeruginosa PA01
cagcaucagcagga

SEQ ID NO: 3517909 - RNA, 16 nt, Pseudomonas aeruginosa PA01
cagcaucagcaggaag

SEQ ID NO: 3517910 - RNA, 14 nt, Pseudomonas aeruginosa PA01
cagcaucaggcgcu

SEQ ID NO: 3517911 - RNA, 16 nt, Pseudomonas aeruginosa PA01
cagcaucaggcgcucc

SEQ ID NO: 3517912 - RNA, 16 nt, Pseudomonas aeruginosa PA01
cagcaucaggucggcg

SEQ ID NO: 3517913 - RNA, 17 nt, Pseudomonas aeruginosa PA01
cagcaucaggucggcgc

SEQ ID NO: 3517914 - RNA, 20 nt, Pseudomonas aeruginosa PA01
cagcaucaggucggcgcgca

SEQ ID NO: 3517915 - RNA, 19 nt, Pseudomonas aeruginosa PA01
cagcaucagugcucaucau

SEQ ID NO: 3517916 - RNA, 20 nt, Pseudomonas aeruginosa PA01
cagcaucaucuccgcggaga

SEQ ID NO: 3517917 - RNA, 22 nt, Pseudomonas aeruginosa PA01
cagcaucaugaucugguagacc

SEQ ID NO: 3517918 - RNA, 18 nt, Pseudomonas aeruginosa PA01
cagcauccgugcgaacac

SEQ ID NO: 3517919 - RNA, 17 nt, Pseudomonas aeruginosa PA01
cagcaucgcaucggcga

SEQ ID NO: 3517920 - RNA, 16 nt, Pseudomonas aeruginosa PA01
cagcaucgccggcagc

SEQ ID NO: 3517921 - RNA, 17 nt, Pseudomonas aeruginosa PA01
cagcaucgccggcagcg

SEQ ID NO: 3517922 - RNA, 18 nt, Pseudomonas aeruginosa PA01
cagcaucgccggcagcgc

SEQ ID NO: 3517923 - RNA, 20 nt, Pseudomonas aeruginosa PA01
cagcaucgccggcagcgccg

SEQ ID NO: 3517924 - RNA, 21 nt, Pseudomonas aeruginosa PA01
cagcaucgccggcagcgccgc

SEQ ID NO: 3517925 - RNA, 22 nt, Pseudomonas aeruginosa PA01
cagcaucgccggcagcgccgcg

SEQ ID NO: 3517926 - RNA, 13 nt, Pseudomonas aeruginosa PA01
cagcaucggaccg

SEQ ID NO: 3517927 - RNA, 20 nt, Pseudomonas aeruginosa PA01
cagcaucucggugcgcccca

SEQ ID NO: 3517928 - RNA, 12 nt, Pseudomonas aeruginosa PA01
cagcaugcccag

SEQ ID NO: 3517929 - RNA, 13 nt, Pseudomonas aeruginosa PA01
cagcaugcccagc

SEQ ID NO: 3517930 - RNA, 12 nt, Pseudomonas aeruginosa PA01
cagcaugccgcu

SEQ ID NO: 3517931 - RNA, 22 nt, Pseudomonas aeruginosa PA01
cagcauggccuugccggcaucg

SEQ ID NO: 3517932 - RNA, 22 nt, Pseudomonas aeruginosa PA01
cagcauggcgaagcucggccgc

SEQ ID NO: 3517933 - RNA, 15 nt, Pseudomonas aeruginosa PA01
cagcauggcgggcca

SEQ ID NO: 3517934 - RNA, 12 nt, Pseudomonas aeruginosa PA01
cagcauggugaa

SEQ ID NO: 3517935 - RNA, 18 nt, Pseudomonas aeruginosa PA01
cagcauguccugcaggcu

SEQ ID NO: 3517936 - RNA, 20 nt, Pseudomonas aeruginosa PA01
cagcauguuguuauggccga

SEQ ID NO: 3517937 - RNA, 14 nt, Pseudomonas aeruginosa PA01
cagcauuaccccga

SEQ ID NO: 3517938 - RNA, 23 nt, Pseudomonas aeruginosa PA01
cagccaacccucggaugccgcac

SEQ ID NO: 3517939 - RNA, 14 nt, Pseudomonas aeruginosa PA01
cagccaaccgucgc

SEQ ID NO: 3517940 - RNA, 17 nt, Pseudomonas aeruginosa PA01
cagccaaccgucgcccu

SEQ ID NO: 3517941 - RNA, 21 nt, Pseudomonas aeruginosa PA01
cagccaaccgucgcccuggug

SEQ ID NO: 3517942 - RNA, 24 nt, Pseudomonas aeruginosa PA01
cagccaaccgucgcccuggugcac

SEQ ID NO: 3517943 - RNA, 21 nt, Pseudomonas aeruginosa PA01
cagccaacugcuucaggcgcg

SEQ ID NO: 3517944 - RNA, 16 nt, Pseudomonas aeruginosa PA01
cagccaagccaccagc

SEQ ID NO: 3517945 - RNA, 19 nt, Pseudomonas aeruginosa PA01
cagccaaggaugcgccagc

SEQ ID NO: 3517946 - RNA, 22 nt, Pseudomonas aeruginosa PA01
cagccaaggaugcgccagcggc

SEQ ID NO: 3517947 - RNA, 23 nt, Pseudomonas aeruginosa PA01
cagccaaggaugcgccagcggcc

SEQ ID NO: 3517948 - RNA, 14 nt, Pseudomonas aeruginosa PA01
cagccacagagguc

SEQ ID NO: 3517949 - RNA, 16 nt, Pseudomonas aeruginosa PA01
cagccacagaggucgc

SEQ ID NO: 3517950 - RNA, 17 nt, Pseudomonas aeruginosa PA01
cagccacagaggucgcu

SEQ ID NO: 3517951 - RNA, 21 nt, Pseudomonas aeruginosa PA01
cagccacagaggucgcugacc

SEQ ID NO: 3517952 - RNA, 14 nt, Pseudomonas aeruginosa PA01
cagccacaggcgcc

SEQ ID NO: 3517953 - RNA, 15 nt, Pseudomonas aeruginosa PA01
cagccacaggcgcca

SEQ ID NO: 3517954 - RNA, 15 nt, Pseudomonas aeruginosa PA01
cagccacccgcgggc

SEQ ID NO: 3517955 - RNA, 24 nt, Pseudomonas aeruginosa PA01
cagccacccgcgggcagcagucgc

SEQ ID NO: 3517956 - RNA, 13 nt, Pseudomonas aeruginosa PA01
cagccacccgcuc

SEQ ID NO: 3517957 - RNA, 18 nt, Pseudomonas aeruginosa PA01
cagccacccgcucgaccu

SEQ ID NO: 3517958 - RNA, 23 nt, Pseudomonas aeruginosa PA01
cagccacccgcucgaccuugccg

SEQ ID NO: 3517959 - RNA, 13 nt, Pseudomonas aeruginosa PA01
cagccacgaagcc

SEQ ID NO: 3517960 - RNA, 18 nt, Pseudomonas aeruginosa PA01
cagccacgaagccucuuc

SEQ ID NO: 3517961 - RNA, 13 nt, Pseudomonas aeruginosa PA01
cagccacggacgc

SEQ ID NO: 3517962 - RNA, 18 nt, Pseudomonas aeruginosa PA01
cagccacggacgcgcagg

SEQ ID NO: 3517963 - RNA, 17 nt, Pseudomonas aeruginosa PA01
cagccacggcacacguc

SEQ ID NO: 3517964 - RNA, 21 nt, Pseudomonas aeruginosa PA01
cagccacggcacacgucggca

SEQ ID NO: 3517965 - RNA, 15 nt, Pseudomonas aeruginosa PA01
cagccacgggcgcca

SEQ ID NO: 3517966 - RNA, 15 nt, Pseudomonas aeruginosa PA01
cagccacucggccag

SEQ ID NO: 3517967 - RNA, 17 nt, Pseudomonas aeruginosa PA01
cagccacucggccaggc

SEQ ID NO: 3517968 - RNA, 18 nt, Pseudomonas aeruginosa PA01
cagccacucggccaggcg

SEQ ID NO: 3517969 - RNA, 19 nt, Pseudomonas aeruginosa PA01
cagccacucggccaggcgc

SEQ ID NO: 3517970 - RNA, 20 nt, Pseudomonas aeruginosa PA01
cagccacucggccaggcgcc

SEQ ID NO: 3517971 - RNA, 21 nt, Pseudomonas aeruginosa PA01
cagccacucggccaggcgcca

SEQ ID NO: 3517972 - RNA, 15 nt, Pseudomonas aeruginosa PA01
cagccacugccgccu

SEQ ID NO: 3517973 - RNA, 16 nt, Pseudomonas aeruginosa PA01
cagccacugccgccuc

SEQ ID NO: 3517974 - RNA, 17 nt, Pseudomonas aeruginosa PA01
cagccacugccgccuca

SEQ ID NO: 3517975 - RNA, 16 nt, Pseudomonas aeruginosa PA01
cagccacuggcggacc

SEQ ID NO: 3517976 - RNA, 14 nt, Pseudomonas aeruginosa PA01
cagccagaccggca

SEQ ID NO: 3517977 - RNA, 16 nt, Pseudomonas aeruginosa PA01
cagccagaccggcagc

SEQ ID NO: 3517978 - RNA, 18 nt, Pseudomonas aeruginosa PA01
cagccagaccggcagcgc

SEQ ID NO: 3517979 - RNA, 19 nt, Pseudomonas aeruginosa PA01
cagccagaccggcagcgcc

SEQ ID NO: 3517980 - RNA, 20 nt, Pseudomonas aeruginosa PA01
cagccagaccggcagcgccg

SEQ ID NO: 3517981 - RNA, 21 nt, Pseudomonas aeruginosa PA01
cagccagaccggcagcgccgc

SEQ ID NO: 3517982 - RNA, 19 nt, Pseudomonas aeruginosa PA01
cagccagacguccggcagg

SEQ ID NO: 3517983 - RNA, 20 nt, Pseudomonas aeruginosa PA01
cagccagacguccggcaggu

SEQ ID NO: 3517984 - RNA, 15 nt, Pseudomonas aeruginosa PA01
cagccagagcagcgu

SEQ ID NO: 3517985 - RNA, 19 nt, Pseudomonas aeruginosa PA01
cagccagagccagucgaga

SEQ ID NO: 3517986 - RNA, 12 nt, Pseudomonas aeruginosa PA01
cagccagagccc

SEQ ID NO: 3517987 - RNA, 14 nt, Pseudomonas aeruginosa PA01
cagccagagcccgu

SEQ ID NO: 3517988 - RNA, 22 nt, Pseudomonas aeruginosa PA01
cagccagagcguaucgaugcgc

SEQ ID NO: 3517989 - RNA, 16 nt, Pseudomonas aeruginosa PA01
cagccagagcuccagg

SEQ ID NO: 3517990 - RNA, 17 nt, Pseudomonas aeruginosa PA01
cagccagagcuccaggg

SEQ ID NO: 3517991 - RNA, 21 nt, Pseudomonas aeruginosa PA01
cagccagagcuccagggcugc

SEQ ID NO: 3517992 - RNA, 16 nt, Pseudomonas aeruginosa PA01
cagccagaggucgagc

SEQ ID NO: 3517993 - RNA, 19 nt, Pseudomonas aeruginosa PA01
cagccagaggucgagcugg

SEQ ID NO: 3517994 - RNA, 12 nt, Pseudomonas aeruginosa PA01
cagccagcagcc

SEQ ID NO: 3517995 - RNA, 13 nt, Pseudomonas aeruginosa PA01
cagccagcagccc

SEQ ID NO: 3517996 - RNA, 14 nt, Pseudomonas aeruginosa PA01
cagccagcagcccg

SEQ ID NO: 3517997 - RNA, 16 nt, Pseudomonas aeruginosa PA01
cagccagcagcccggc

SEQ ID NO: 3517998 - RNA, 17 nt, Pseudomonas aeruginosa PA01
cagccagcagcccggcc

SEQ ID NO: 3517999 - RNA, 12 nt, Pseudomonas aeruginosa PA01
cagccagcccag

SEQ ID NO: 3518000 - RNA, 22 nt, Pseudomonas aeruginosa PA01
cagccagcccgcaauccgaccg

SEQ ID NO: 3518001 - RNA, 12 nt, Pseudomonas aeruginosa PA01
cagccagcccgg

SEQ ID NO: 3518002 - RNA, 13 nt, Pseudomonas aeruginosa PA01
cagccagcccggc

SEQ ID NO: 3518003 - RNA, 17 nt, Pseudomonas aeruginosa PA01
cagccagcccggcggug

SEQ ID NO: 3518004 - RNA, 22 nt, Pseudomonas aeruginosa PA01
cagccagcccggcggugaugcc

SEQ ID NO: 3518005 - RNA, 14 nt, Pseudomonas aeruginosa PA01
cagccagccgagca

SEQ ID NO: 3518006 - RNA, 16 nt, Pseudomonas aeruginosa PA01
cagccagccgagcaac

SEQ ID NO: 3518007 - RNA, 11 nt, Pseudomonas aeruginosa PA01
cagccagccgc

SEQ ID NO: 3518008 - RNA, 13 nt, Pseudomonas aeruginosa PA01
cagccagccgccg

SEQ ID NO: 3518009 - RNA, 14 nt, Pseudomonas aeruginosa PA01
cagccagccgccga

SEQ ID NO: 3518010 - RNA, 23 nt, Pseudomonas aeruginosa PA01
cagccagccgccgaagggccgca

SEQ ID NO: 3518011 - RNA, 14 nt, Pseudomonas aeruginosa PA01
cagccagccgccuu

SEQ ID NO: 3518012 - RNA, 16 nt, Pseudomonas aeruginosa PA01
cagccagccgcgcgcc

SEQ ID NO: 3518013 - RNA, 17 nt, Pseudomonas aeruginosa PA01
cagccagccgcgcgccg

SEQ ID NO: 3518014 - RNA, 21 nt, Pseudomonas aeruginosa PA01
cagccagccggcgaagggcag

SEQ ID NO: 3518015 - RNA, 14 nt, Pseudomonas aeruginosa PA01
cagccagccgucgu

SEQ ID NO: 3518016 - RNA, 22 nt, Pseudomonas aeruginosa PA01
cagccagccgucgucguccacc

SEQ ID NO: 3518017 - RNA, 23 nt, Pseudomonas aeruginosa PA01
cagccagccgucgucguccaccg

SEQ ID NO: 3518018 - RNA, 22 nt, Pseudomonas aeruginosa PA01
cagccagcgcggcucgggcggc

SEQ ID NO: 3518019 - RNA, 21 nt, Pseudomonas aeruginosa PA01
cagccagcgguugagcagggc

SEQ ID NO: 3518020 - RNA, 14 nt, Pseudomonas aeruginosa PA01
cagccagcuucagc

SEQ ID NO: 3518021 - RNA, 18 nt, Pseudomonas aeruginosa PA01
cagccagcuucagccgac

SEQ ID NO: 3518022 - RNA, 21 nt, Pseudomonas aeruginosa PA01
cagccaggaagagcccgccac

SEQ ID NO: 3518023 - RNA, 13 nt, Pseudomonas aeruginosa PA01
cagccaggcccgg

SEQ ID NO: 3518024 - RNA, 16 nt, Pseudomonas aeruginosa PA01
cagccaggccuugugc

SEQ ID NO: 3518025 - RNA, 18 nt, Pseudomonas aeruginosa PA01
cagccaggccuugugcgc

SEQ ID NO: 3518026 - RNA, 23 nt, Pseudomonas aeruginosa PA01
cagccaggccuugugcgccagcu

SEQ ID NO: 3518027 - RNA, 13 nt, Pseudomonas aeruginosa PA01
cagccaggcgaag

SEQ ID NO: 3518028 - RNA, 14 nt, Pseudomonas aeruginosa PA01
cagccaggcgaagc

SEQ ID NO: 3518029 - RNA, 15 nt, Pseudomonas aeruginosa PA01
cagccaggcgaagcg

SEQ ID NO: 3518030 - RNA, 20 nt, Pseudomonas aeruginosa PA01
cagccaggcgaagcggcugg

SEQ ID NO: 3518031 - RNA, 21 nt, Pseudomonas aeruginosa PA01
cagccaggcgaagcggcuggc

SEQ ID NO: 3518032 - RNA, 18 nt, Pseudomonas aeruginosa PA01
cagccaggcgaaggcgau

SEQ ID NO: 3518033 - RNA, 21 nt, Pseudomonas aeruginosa PA01
cagccaggcgaaggcgauccc

SEQ ID NO: 3518034 - RNA, 20 nt, Pseudomonas aeruginosa PA01
cagccaggcgauggugcgcu

SEQ ID NO: 3518035 - RNA, 22 nt, Pseudomonas aeruginosa PA01
cagccaggcgcucucgccgccu

SEQ ID NO: 3518036 - RNA, 15 nt, Pseudomonas aeruginosa PA01
cagccaggcggccac

SEQ ID NO: 3518037 - RNA, 15 nt, Pseudomonas aeruginosa PA01
cagccaggcuggcug

SEQ ID NO: 3518038 - RNA, 17 nt, Pseudomonas aeruginosa PA01
cagccagggcagcaggu

SEQ ID NO: 3518039 - RNA, 15 nt, Pseudomonas aeruginosa PA01
cagccagggccgcga

SEQ ID NO: 3518040 - RNA, 16 nt, Pseudomonas aeruginosa PA01
cagccagggccgcgag

SEQ ID NO: 3518041 - RNA, 17 nt, Pseudomonas aeruginosa PA01
cagccagggccgcgaga

SEQ ID NO: 3518042 - RNA, 19 nt, Pseudomonas aeruginosa PA01
cagccaggggcacgcuggc

SEQ ID NO: 3518043 - RNA, 16 nt, Pseudomonas aeruginosa PA01
cagccagguguucggc

SEQ ID NO: 3518044 - RNA, 20 nt, Pseudomonas aeruginosa PA01
cagccagguguucggccccg

SEQ ID NO: 3518045 - RNA, 22 nt, Pseudomonas aeruginosa PA01
cagccagguguucggccccggc

SEQ ID NO: 3518046 - RNA, 13 nt, Pseudomonas aeruginosa PA01
cagccaguagucc

SEQ ID NO: 3518047 - RNA, 20 nt, Pseudomonas aeruginosa PA01
cagccaguaguccuccgcgc

SEQ ID NO: 3518048 - RNA, 16 nt, Pseudomonas aeruginosa PA01
cagccaguagucuucc

SEQ ID NO: 3518049 - RNA, 21 nt, Pseudomonas aeruginosa PA01
cagccaguagucuuccuggga

SEQ ID NO: 3518050 - RNA, 13 nt, Pseudomonas aeruginosa PA01
cagccaguccggc

SEQ ID NO: 3518051 - RNA, 21 nt, Pseudomonas aeruginosa PA01
cagccaguccggcagcacggc

SEQ ID NO: 3518052 - RNA, 21 nt, Pseudomonas aeruginosa PA01
cagccagucgagacgccagcc

SEQ ID NO: 3518053 - RNA, 16 nt, Pseudomonas aeruginosa PA01
cagccaguggcuggcg

SEQ ID NO: 3518054 - RNA, 19 nt, Pseudomonas aeruginosa PA01
cagccaguuggaaguugcc

SEQ ID NO: 3518055 - RNA, 17 nt, Pseudomonas aeruginosa PA01
cagccauagcgccggca

SEQ ID NO: 3518056 - RNA, 18 nt, Pseudomonas aeruginosa PA01
cagccauagcgccggcac

SEQ ID NO: 3518057 - RNA, 16 nt, Pseudomonas aeruginosa PA01
cagccauagugcuggg

SEQ ID NO: 3518058 - RNA, 18 nt, Pseudomonas aeruginosa PA01
cagccauagugcugggcg

SEQ ID NO: 3518059 - RNA, 20 nt, Pseudomonas aeruginosa PA01
cagccaucgcauagccggcg

SEQ ID NO: 3518060 - RNA, 23 nt, Pseudomonas aeruginosa PA01
cagccaucgcauagccggcgcgc

SEQ ID NO: 3518061 - RNA, 17 nt, Pseudomonas aeruginosa PA01
cagccauggcuggugcg

SEQ ID NO: 3518062 - RNA, 21 nt, Pseudomonas aeruginosa PA01
cagccauggcuggugcgggug

SEQ ID NO: 3518063 - RNA, 15 nt, Pseudomonas aeruginosa PA01
cagccaugugcuccu

SEQ ID NO: 3518064 - RNA, 21 nt, Pseudomonas aeruginosa PA01
cagccauugagcgcgcccagg

SEQ ID NO: 3518065 - RNA, 16 nt, Pseudomonas aeruginosa PA01
cagccauugcgccagg

SEQ ID NO: 3518066 - RNA, 17 nt, Pseudomonas aeruginosa PA01
cagccauuggccgacgc

SEQ ID NO: 3518067 - RNA, 15 nt, Pseudomonas aeruginosa PA01
cagccauuucugcug

SEQ ID NO: 3518068 - RNA, 15 nt, Pseudomonas aeruginosa PA01
cagcccacccccagc

SEQ ID NO: 3518069 - RNA, 17 nt, Pseudomonas aeruginosa PA01
cagcccacccccagccc

SEQ ID NO: 3518070 - RNA, 16 nt, Pseudomonas aeruginosa PA01
cagcccacccccggcc

SEQ ID NO: 3518071 - RNA, 15 nt, Pseudomonas aeruginosa PA01
cagcccacgcgccug

SEQ ID NO: 3518072 - RNA, 16 nt, Pseudomonas aeruginosa PA01
cagcccacgcgccugg

SEQ ID NO: 3518073 - RNA, 17 nt, Pseudomonas aeruginosa PA01
cagcccacgcgccuggc

SEQ ID NO: 3518074 - RNA, 18 nt, Pseudomonas aeruginosa PA01
cagcccacgcgccuggcc

SEQ ID NO: 3518075 - RNA, 21 nt, Pseudomonas aeruginosa PA01
cagcccagaacagcaaagcgc

SEQ ID NO: 3518076 - RNA, 14 nt, Pseudomonas aeruginosa PA01
cagcccagccgcuc

SEQ ID NO: 3518077 - RNA, 16 nt, Pseudomonas aeruginosa PA01
cagcccagccgcucgc

SEQ ID NO: 3518078 - RNA, 12 nt, Pseudomonas aeruginosa PA01
cagcccagcgcu

SEQ ID NO: 3518079 - RNA, 15 nt, Pseudomonas aeruginosa PA01
cagcccagcggcgcg

SEQ ID NO: 3518080 - RNA, 17 nt, Pseudomonas aeruginosa PA01
cagcccagcggcgcggc

SEQ ID NO: 3518081 - RNA, 18 nt, Pseudomonas aeruginosa PA01
cagcccagcggcgcggcg

SEQ ID NO: 3518082 - RNA, 14 nt, Pseudomonas aeruginosa PA01
cagcccaggcgccg

SEQ ID NO: 3518083 - RNA, 16 nt, Pseudomonas aeruginosa PA01
cagcccaggcgccgcu

SEQ ID NO: 3518084 - RNA, 12 nt, Pseudomonas aeruginosa PA01
cagcccagggcg

SEQ ID NO: 3518085 - RNA, 22 nt, Pseudomonas aeruginosa PA01
cagcccagggcgaucgucgaga

SEQ ID NO: 3518086 - RNA, 15 nt, Pseudomonas aeruginosa PA01
cagcccagugcuggc

SEQ ID NO: 3518087 - RNA, 12 nt, Pseudomonas aeruginosa PA01
cagcccauacac

SEQ ID NO: 3518088 - RNA, 18 nt, Pseudomonas aeruginosa PA01
cagcccauacaccaggcc

SEQ ID NO: 3518089 - RNA, 20 nt, Pseudomonas aeruginosa PA01
cagcccauacaccaggccgg

SEQ ID NO: 3518090 - RNA, 14 nt, Pseudomonas aeruginosa PA01
cagccccaccgcca

SEQ ID NO: 3518091 - RNA, 22 nt, Pseudomonas aeruginosa PA01
cagccccacuggaagaaggcga

SEQ ID NO: 3518092 - RNA, 12 nt, Pseudomonas aeruginosa PA01
cagccccagcac

SEQ ID NO: 3518093 - RNA, 14 nt, Pseudomonas aeruginosa PA01
cagccccagcacgc

SEQ ID NO: 3518094 - RNA, 16 nt, Pseudomonas aeruginosa PA01
cagccccagcacgccg

SEQ ID NO: 3518095 - RNA, 18 nt, Pseudomonas aeruginosa PA01
cagccccagcacgccgag

SEQ ID NO: 3518096 - RNA, 12 nt, Pseudomonas aeruginosa PA01
cagccccagccu

SEQ ID NO: 3518097 - RNA, 20 nt, Pseudomonas aeruginosa PA01
cagccccagccucggcaggg

SEQ ID NO: 3518098 - RNA, 14 nt, Pseudomonas aeruginosa PA01
cagccccaggcgcg

SEQ ID NO: 3518099 - RNA, 16 nt, Pseudomonas aeruginosa PA01
cagccccaggcgcggc

SEQ ID NO: 3518100 - RNA, 15 nt, Pseudomonas aeruginosa PA01
cagcccccccagcac

SEQ ID NO: 3518101 - RNA, 17 nt, Pseudomonas aeruginosa PA01
cagcccccccagcacgg

SEQ ID NO: 3518102 - RNA, 13 nt, Pseudomonas aeruginosa PA01
cagcccccgccgg

SEQ ID NO: 3518103 - RNA, 14 nt, Pseudomonas aeruginosa PA01
cagcccccgccggc

SEQ ID NO: 3518104 - RNA, 21 nt, Pseudomonas aeruginosa PA01
cagcccccucgcccucgaagc

SEQ ID NO: 3518105 - RNA, 14 nt, Pseudomonas aeruginosa PA01
cagccccgaggcca

SEQ ID NO: 3518106 - RNA, 13 nt, Pseudomonas aeruginosa PA01
cagccccgaucgc

SEQ ID NO: 3518107 - RNA, 13 nt, Pseudomonas aeruginosa PA01
cagccccgccgga

SEQ ID NO: 3518108 - RNA, 17 nt, Pseudomonas aeruginosa PA01
cagccccgccggaagac

SEQ ID NO: 3518109 - RNA, 12 nt, Pseudomonas aeruginosa PA01
cagccccggccc

SEQ ID NO: 3518110 - RNA, 13 nt, Pseudomonas aeruginosa PA01
cagccccggcccg

SEQ ID NO: 3518111 - RNA, 23 nt, Pseudomonas aeruginosa PA01
cagccccuccuggaaagaccggc

SEQ ID NO: 3518112 - RNA, 16 nt, Pseudomonas aeruginosa PA01
cagccccucggccagg

SEQ ID NO: 3518113 - RNA, 17 nt, Pseudomonas aeruginosa PA01
cagccccucggccagga

SEQ ID NO: 3518114 - RNA, 19 nt, Pseudomonas aeruginosa PA01
cagccccucggccaggacc

SEQ ID NO: 3518115 - RNA, 14 nt, Pseudomonas aeruginosa PA01
cagcccgccggcga

SEQ ID NO: 3518116 - RNA, 21 nt, Pseudomonas aeruginosa PA01
cagcccgccggcgaugcgcag

SEQ ID NO: 3518117 - RNA, 16 nt, Pseudomonas aeruginosa PA01
cagcccgccuuccagc

SEQ ID NO: 3518118 - RNA, 14 nt, Pseudomonas aeruginosa PA01
cagcccgcgccgcg

SEQ ID NO: 3518119 - RNA, 18 nt, Pseudomonas aeruginosa PA01
cagcccgcgccgcgaggg

SEQ ID NO: 3518120 - RNA, 16 nt, Pseudomonas aeruginosa PA01
cagcccgcgcgacagc

SEQ ID NO: 3518121 - RNA, 22 nt, Pseudomonas aeruginosa PA01
cagcccgcgcgacagcucuggg

SEQ ID NO: 3518122 - RNA, 17 nt, Pseudomonas aeruginosa PA01
cagcccgcgcucggccg

SEQ ID NO: 3518123 - RNA, 18 nt, Pseudomonas aeruginosa PA01
cagcccgcgcucggccgc

SEQ ID NO: 3518124 - RNA, 20 nt, Pseudomonas aeruginosa PA01
cagcccgcgcucggccgccu

SEQ ID NO: 3518125 - RNA, 23 nt, Pseudomonas aeruginosa PA01
cagcccgcgcucggccgccuggc

SEQ ID NO: 3518126 - RNA, 12 nt, Pseudomonas aeruginosa PA01
cagcccggagcc

SEQ ID NO: 3518127 - RNA, 12 nt, Pseudomonas aeruginosa PA01
cagcccggcacc

SEQ ID NO: 3518128 - RNA, 16 nt, Pseudomonas aeruginosa PA01
cagcccggcaccaggc

SEQ ID NO: 3518129 - RNA, 14 nt, Pseudomonas aeruginosa PA01
cagcccggccaucc

SEQ ID NO: 3518130 - RNA, 15 nt, Pseudomonas aeruginosa PA01
cagcccggccauccu

SEQ ID NO: 3518131 - RNA, 18 nt, Pseudomonas aeruginosa PA01
cagcccggccauccuggc

SEQ ID NO: 3518132 - RNA, 20 nt, Pseudomonas aeruginosa PA01
cagcccggccauccuggccg

SEQ ID NO: 3518133 - RNA, 20 nt, Pseudomonas aeruginosa PA01
cagcccggccucgccggucg

SEQ ID NO: 3518134 - RNA, 21 nt, Pseudomonas aeruginosa PA01
cagcccggccucgccggucgc

SEQ ID NO: 3518135 - RNA, 22 nt, Pseudomonas aeruginosa PA01
cagcccggccucgccggucgcg

SEQ ID NO: 3518136 - RNA, 18 nt, Pseudomonas aeruginosa PA01
cagcccggcggcggcacc

SEQ ID NO: 3518137 - RNA, 21 nt, Pseudomonas aeruginosa PA01
cagcccggcggcggcaccgac

SEQ ID NO: 3518138 - RNA, 21 nt, Pseudomonas aeruginosa PA01
cagcccggcgugggcggucgg

SEQ ID NO: 3518139 - RNA, 17 nt, Pseudomonas aeruginosa PA01
cagcccgggcaacugcc

SEQ ID NO: 3518140 - RNA, 18 nt, Pseudomonas aeruginosa PA01
cagcccgggcaacugccg

SEQ ID NO: 3518141 - RNA, 16 nt, Pseudomonas aeruginosa PA01
cagcccggucacgccg

SEQ ID NO: 3518142 - RNA, 21 nt, Pseudomonas aeruginosa PA01
cagcccgguccguccagcgcg

SEQ ID NO: 3518143 - RNA, 22 nt, Pseudomonas aeruginosa PA01
cagcccguagucguucagcgcc

SEQ ID NO: 3518144 - RNA, 14 nt, Pseudomonas aeruginosa PA01
cagcccgucgcgcg

SEQ ID NO: 3518145 - RNA, 15 nt, Pseudomonas aeruginosa PA01
cagcccgucgcgcgc

SEQ ID NO: 3518146 - RNA, 17 nt, Pseudomonas aeruginosa PA01
cagcccgucgcgcgccg

SEQ ID NO: 3518147 - RNA, 18 nt, Pseudomonas aeruginosa PA01
cagcccgucgcgcgccgg

SEQ ID NO: 3518148 - RNA, 22 nt, Pseudomonas aeruginosa PA01
cagcccgucgcgcgccggagcc

SEQ ID NO: 3518149 - RNA, 15 nt, Pseudomonas aeruginosa PA01
cagcccgucggccuc

SEQ ID NO: 3518150 - RNA, 16 nt, Pseudomonas aeruginosa PA01
cagcccgucggccucg

SEQ ID NO: 3518151 - RNA, 17 nt, Pseudomonas aeruginosa PA01
cagcccgucggccucgc

SEQ ID NO: 3518152 - RNA, 17 nt, Pseudomonas aeruginosa PA01
cagcccguguucggcca

SEQ ID NO: 3518153 - RNA, 21 nt, Pseudomonas aeruginosa PA01
cagcccguguucggccagccg

SEQ ID NO: 3518154 - RNA, 19 nt, Pseudomonas aeruginosa PA01
cagcccuaggcgacccggc

SEQ ID NO: 3518155 - RNA, 15 nt, Pseudomonas aeruginosa PA01
cagcccucgcccagg

SEQ ID NO: 3518156 - RNA, 16 nt, Pseudomonas aeruginosa PA01
cagcccucgcccaggu

SEQ ID NO: 3518157 - RNA, 13 nt, Pseudomonas aeruginosa PA01
cagcccucggccc

SEQ ID NO: 3518158 - RNA, 14 nt, Pseudomonas aeruginosa PA01
cagcccucggcccg

SEQ ID NO: 3518159 - RNA, 22 nt, Pseudomonas aeruginosa PA01
cagcccuggaaaggccucggcg

SEQ ID NO: 3518160 - RNA, 13 nt, Pseudomonas aeruginosa PA01
cagcccuggcgca

SEQ ID NO: 3518161 - RNA, 19 nt, Pseudomonas aeruginosa PA01
cagcccuggcgcagacagg

SEQ ID NO: 3518162 - RNA, 13 nt, Pseudomonas aeruginosa PA01
cagcccuggcgcg

SEQ ID NO: 3518163 - RNA, 14 nt, Pseudomonas aeruginosa PA01
cagcccuggcgcgg

SEQ ID NO: 3518164 - RNA, 19 nt, Pseudomonas aeruginosa PA01
cagcccuggcguggccggc

SEQ ID NO: 3518165 - RNA, 20 nt, Pseudomonas aeruginosa PA01
cagcccuggcguggccggcg

SEQ ID NO: 3518166 - RNA, 23 nt, Pseudomonas aeruginosa PA01
cagcccugguaggugcgcuggcg

SEQ ID NO: 3518167 - RNA, 16 nt, Pseudomonas aeruginosa PA01
cagcccuucgcgcucg

SEQ ID NO: 3518168 - RNA, 17 nt, Pseudomonas aeruginosa PA01
cagcccuucgcgcucga

SEQ ID NO: 3518169 - RNA, 21 nt, Pseudomonas aeruginosa PA01
cagcccuugcaaccgccgccg

SEQ ID NO: 3518170 - RNA, 18 nt, Pseudomonas aeruginosa PA01
cagcccuuucagcggcug

SEQ ID NO: 3518171 - RNA, 21 nt, Pseudomonas aeruginosa PA01
cagcccuuucagcggcugccc

SEQ ID NO: 3518172 - RNA, 16 nt, Pseudomonas aeruginosa PA01
cagccgaacaguucgg

SEQ ID NO: 3518173 - RNA, 15 nt, Pseudomonas aeruginosa PA01
cagccgaccaccuuc

SEQ ID NO: 3518174 - RNA, 22 nt, Pseudomonas aeruginosa PA01
cagccgacgauccggccgaucu

SEQ ID NO: 3518175 - RNA, 20 nt, Pseudomonas aeruginosa PA01
cagccgacguagggcaucgc

SEQ ID NO: 3518176 - RNA, 13 nt, Pseudomonas aeruginosa PA01
cagccgacuggcg

SEQ ID NO: 3518177 - RNA, 14 nt, Pseudomonas aeruginosa PA01
cagccgacuggcgg

SEQ ID NO: 3518178 - RNA, 22 nt, Pseudomonas aeruginosa PA01
cagccgacuggcgguacgcugc

SEQ ID NO: 3518179 - RNA, 19 nt, Pseudomonas aeruginosa PA01
cagccgagcaacucggcgg

SEQ ID NO: 3518180 - RNA, 21 nt, Pseudomonas aeruginosa PA01
cagccgagcaacucggcggcg

SEQ ID NO: 3518181 - RNA, 23 nt, Pseudomonas aeruginosa PA01
cagccgagcaacucggcggcgag

SEQ ID NO: 3518182 - RNA, 19 nt, Pseudomonas aeruginosa PA01
cagccgagcccccauaccg

SEQ ID NO: 3518183 - RNA, 15 nt, Pseudomonas aeruginosa PA01
cagccgaggcagccg

SEQ ID NO: 3518184 - RNA, 17 nt, Pseudomonas aeruginosa PA01
cagccgaggcagccguc

SEQ ID NO: 3518185 - RNA, 18 nt, Pseudomonas aeruginosa PA01
cagccgaggucgccgcca

SEQ ID NO: 3518186 - RNA, 19 nt, Pseudomonas aeruginosa PA01
cagccgaggucgccgccag

SEQ ID NO: 3518187 - RNA, 21 nt, Pseudomonas aeruginosa PA01
cagccgaggugguauugcagc

SEQ ID NO: 3518188 - RNA, 18 nt, Pseudomonas aeruginosa PA01
cagccgagguucuugccc

SEQ ID NO: 3518189 - RNA, 23 nt, Pseudomonas aeruginosa PA01
cagccgagguucuugcccagcaa

SEQ ID NO: 3518190 - RNA, 15 nt, Pseudomonas aeruginosa PA01
cagccgaugcucgcg

SEQ ID NO: 3518191 - RNA, 22 nt, Pseudomonas aeruginosa PA01
cagccgaugcucgcgccagccc

SEQ ID NO: 3518192 - RNA, 15 nt, Pseudomonas aeruginosa PA01
cagccgcaaggccag

SEQ ID NO: 3518193 - RNA, 20 nt, Pseudomonas aeruginosa PA01
cagccgcaaggccagggcgg

SEQ ID NO: 3518194 - RNA, 21 nt, Pseudomonas aeruginosa PA01
cagccgcaaggccagggcggc

SEQ ID NO: 3518195 - RNA, 14 nt, Pseudomonas aeruginosa PA01
cagccgcacccuca

SEQ ID NO: 3518196 - RNA, 17 nt, Pseudomonas aeruginosa PA01
cagccgcagaugcucca

SEQ ID NO: 3518197 - RNA, 13 nt, Pseudomonas aeruginosa PA01
cagccgcagcccg

SEQ ID NO: 3518198 - RNA, 14 nt, Pseudomonas aeruginosa PA01
cagccgcagcggca

SEQ ID NO: 3518199 - RNA, 20 nt, Pseudomonas aeruginosa PA01
cagccgcagcggcaugcccu

SEQ ID NO: 3518200 - RNA, 24 nt, Pseudomonas aeruginosa PA01
cagccgcagcggcaugcccugccg

SEQ ID NO: 3518201 - RNA, 13 nt, Pseudomonas aeruginosa PA01
cagccgcaggcag

SEQ ID NO: 3518202 - RNA, 14 nt, Pseudomonas aeruginosa PA01
cagccgcaggcaga

SEQ ID NO: 3518203 - RNA, 14 nt, Pseudomonas aeruginosa PA01
cagccgcaggccgu

SEQ ID NO: 3518204 - RNA, 16 nt, Pseudomonas aeruginosa PA01
cagccgcaggcugccg

SEQ ID NO: 3518205 - RNA, 23 nt, Pseudomonas aeruginosa PA01
cagccgcaggcugccguccaggc

SEQ ID NO: 3518206 - RNA, 13 nt, Pseudomonas aeruginosa PA01
cagccgccaggac

SEQ ID NO: 3518207 - RNA, 14 nt, Pseudomonas aeruginosa PA01
cagccgccaggacg

SEQ ID NO: 3518208 - RNA, 15 nt, Pseudomonas aeruginosa PA01
cagccgccaggacgg

SEQ ID NO: 3518209 - RNA, 16 nt, Pseudomonas aeruginosa PA01
cagccgccaggacggc

SEQ ID NO: 3518210 - RNA, 12 nt, Pseudomonas aeruginosa PA01
cagccgccauca

SEQ ID NO: 3518211 - RNA, 19 nt, Pseudomonas aeruginosa PA01
cagccgccccaccaccauc

SEQ ID NO: 3518212 - RNA, 23 nt, Pseudomonas aeruginosa PA01
cagccgccccaccaccaucgccg

SEQ ID NO: 3518213 - RNA, 16 nt, Pseudomonas aeruginosa PA01
cagccgcccuggcucu

SEQ ID NO: 3518214 - RNA, 18 nt, Pseudomonas aeruginosa PA01
cagccgcccuggcucugg

SEQ ID NO: 3518215 - RNA, 19 nt, Pseudomonas aeruginosa PA01
cagccgccgaagggccgca

SEQ ID NO: 3518216 - RNA, 22 nt, Pseudomonas aeruginosa PA01
cagccgccgaagggccgcaggu

SEQ ID NO: 3518217 - RNA, 14 nt, Pseudomonas aeruginosa PA01
cagccgccgcggca

SEQ ID NO: 3518218 - RNA, 20 nt, Pseudomonas aeruginosa PA01
cagccgccgcggcaccggcg

SEQ ID NO: 3518219 - RNA, 13 nt, Pseudomonas aeruginosa PA01
cagccgccgcugc

SEQ ID NO: 3518220 - RNA, 18 nt, Pseudomonas aeruginosa PA01
cagccgccgcugcaccga

SEQ ID NO: 3518221 - RNA, 21 nt, Pseudomonas aeruginosa PA01
cagccgccuugcucgacccgg

SEQ ID NO: 3518222 - RNA, 15 nt, Pseudomonas aeruginosa PA01
cagccgcgcaaccgu

SEQ ID NO: 3518223 - RNA, 15 nt, Pseudomonas aeruginosa PA01
cagccgcgccagugc

SEQ ID NO: 3518224 - RNA, 19 nt, Pseudomonas aeruginosa PA01
cagccgcgccagugccugc

SEQ ID NO: 3518225 - RNA, 20 nt, Pseudomonas aeruginosa PA01
cagccgcgccagugccugca

SEQ ID NO: 3518226 - RNA, 21 nt, Pseudomonas aeruginosa PA01
cagccgcgccggggcagcagg

SEQ ID NO: 3518227 - RNA, 15 nt, Pseudomonas aeruginosa PA01
cagccgcgcgccgca

SEQ ID NO: 3518228 - RNA, 21 nt, Pseudomonas aeruginosa PA01
cagccgcgcgccgcaucgcug

SEQ ID NO: 3518229 - RNA, 13 nt, Pseudomonas aeruginosa PA01
cagccgcgcgcgu

SEQ ID NO: 3518230 - RNA, 13 nt, Pseudomonas aeruginosa PA01
cagccgcgcgcug

SEQ ID NO: 3518231 - RNA, 16 nt, Pseudomonas aeruginosa PA01
cagccgcgcucggcca

SEQ ID NO: 3518232 - RNA, 13 nt, Pseudomonas aeruginosa PA01
cagccgcggauca

SEQ ID NO: 3518233 - RNA, 19 nt, Pseudomonas aeruginosa PA01
cagccgcggaucaccuggc

SEQ ID NO: 3518234 - RNA, 23 nt, Pseudomonas aeruginosa PA01
cagccgcggaucaccuggccgug

SEQ ID NO: 3518235 - RNA, 12 nt, Pseudomonas aeruginosa PA01
cagccgcggccg

SEQ ID NO: 3518236 - RNA, 13 nt, Pseudomonas aeruginosa PA01
cagccgcggccgg

SEQ ID NO: 3518237 - RNA, 20 nt, Pseudomonas aeruginosa PA01
cagccgcggccguuguccag

SEQ ID NO: 3518238 - RNA, 12 nt, Pseudomonas aeruginosa PA01
cagccgcggcgc

SEQ ID NO: 3518239 - RNA, 14 nt, Pseudomonas aeruginosa PA01
cagccgcggcgcca

SEQ ID NO: 3518240 - RNA, 22 nt, Pseudomonas aeruginosa PA01
cagccgcggcuguagccacggc

SEQ ID NO: 3518241 - RNA, 14 nt, Pseudomonas aeruginosa PA01
cagccgcgguccau

SEQ ID NO: 3518242 - RNA, 17 nt, Pseudomonas aeruginosa PA01
cagccgcgugcgcgccg

SEQ ID NO: 3518243 - RNA, 20 nt, Pseudomonas aeruginosa PA01
cagccgcguugucccugucc

SEQ ID NO: 3518244 - RNA, 22 nt, Pseudomonas aeruginosa PA01
cagccgcguugucccugucccg

SEQ ID NO: 3518245 - RNA, 16 nt, Pseudomonas aeruginosa PA01
cagccgcuagcgguag

SEQ ID NO: 3518246 - RNA, 13 nt, Pseudomonas aeruginosa PA01
cagccgcuccagg

SEQ ID NO: 3518247 - RNA, 17 nt, Pseudomonas aeruginosa PA01
cagccgcucgcguccgc

SEQ ID NO: 3518248 - RNA, 18 nt, Pseudomonas aeruginosa PA01
cagccgcucggccgccag

SEQ ID NO: 3518249 - RNA, 20 nt, Pseudomonas aeruginosa PA01
cagccgcucggccgccagca

SEQ ID NO: 3518250 - RNA, 13 nt, Pseudomonas aeruginosa PA01
cagccgcugcagg

SEQ ID NO: 3518251 - RNA, 14 nt, Pseudomonas aeruginosa PA01
cagccgcugcaggg

SEQ ID NO: 3518252 - RNA, 21 nt, Pseudomonas aeruginosa PA01
cagccgcugcagggcggcgcu

SEQ ID NO: 3518253 - RNA, 17 nt, Pseudomonas aeruginosa PA01
cagccgcugcugcaacc

SEQ ID NO: 3518254 - RNA, 16 nt, Pseudomonas aeruginosa PA01
cagccgcuggcgucga

SEQ ID NO: 3518255 - RNA, 19 nt, Pseudomonas aeruginosa PA01
cagccgcuuccggcgcucc

SEQ ID NO: 3518256 - RNA, 20 nt, Pseudomonas aeruginosa PA01
cagccgcuuccggcgcucca

SEQ ID NO: 3518257 - RNA, 14 nt, Pseudomonas aeruginosa PA01
cagccggaccagcc

SEQ ID NO: 3518258 - RNA, 13 nt, Pseudomonas aeruginosa PA01
cagccggagagau

SEQ ID NO: 3518259 - RNA, 16 nt, Pseudomonas aeruginosa PA01
cagccggcauccagca

SEQ ID NO: 3518260 - RNA, 15 nt, Pseudomonas aeruginosa PA01
cagccggccauccag

SEQ ID NO: 3518261 - RNA, 18 nt, Pseudomonas aeruginosa PA01
cagccggccauccagcca

SEQ ID NO: 3518262 - RNA, 19 nt, Pseudomonas aeruginosa PA01
cagccggccaugcuggcgc

SEQ ID NO: 3518263 - RNA, 16 nt, Pseudomonas aeruginosa PA01
cagccggcccauccgc

SEQ ID NO: 3518264 - RNA, 19 nt, Pseudomonas aeruginosa PA01
cagccggcccauccgccgc

SEQ ID NO: 3518265 - RNA, 20 nt, Pseudomonas aeruginosa PA01
cagccggcccauccgccgca

SEQ ID NO: 3518266 - RNA, 19 nt, Pseudomonas aeruginosa PA01
cagccggccgaucuucagc

SEQ ID NO: 3518267 - RNA, 23 nt, Pseudomonas aeruginosa PA01
cagccggccgcgucgcccaggcc

SEQ ID NO: 3518268 - RNA, 13 nt, Pseudomonas aeruginosa PA01
cagccggccuugc

SEQ ID NO: 3518269 - RNA, 18 nt, Pseudomonas aeruginosa PA01
cagccggcgaagggcagg

SEQ ID NO: 3518270 - RNA, 21 nt, Pseudomonas aeruginosa PA01
cagccggcgaagggcaggccg

SEQ ID NO: 3518271 - RNA, 22 nt, Pseudomonas aeruginosa PA01
cagccggcgaagggcaggccga

SEQ ID NO: 3518272 - RNA, 17 nt, Pseudomonas aeruginosa PA01
cagccggcgacgcagga

SEQ ID NO: 3518273 - RNA, 18 nt, Pseudomonas aeruginosa PA01
cagccggcgacgcaggac

SEQ ID NO: 3518274 - RNA, 22 nt, Pseudomonas aeruginosa PA01
cagccggcgacgcaggacgucg

SEQ ID NO: 3518275 - RNA, 12 nt, Pseudomonas aeruginosa PA01
cagccggcgccg

SEQ ID NO: 3518276 - RNA, 17 nt, Pseudomonas aeruginosa PA01
cagccggcgccgcaggg

SEQ ID NO: 3518277 - RNA, 15 nt, Pseudomonas aeruginosa PA01
cagccggcgcgcuuc

SEQ ID NO: 3518278 - RNA, 12 nt, Pseudomonas aeruginosa PA01
cagccggcgcua

SEQ ID NO: 3518279 - RNA, 17 nt, Pseudomonas aeruginosa PA01
cagccggcgcucggcca

SEQ ID NO: 3518280 - RNA, 13 nt, Pseudomonas aeruginosa PA01
cagccggcgcuuc

SEQ ID NO: 3518281 - RNA, 23 nt, Pseudomonas aeruginosa PA01
cagccggcgcuucugcgagccgc

SEQ ID NO: 3518282 - RNA, 15 nt, Pseudomonas aeruginosa PA01
cagccggcggcgaau

SEQ ID NO: 3518283 - RNA, 16 nt, Pseudomonas aeruginosa PA01
cagccgggaucuccuc

SEQ ID NO: 3518284 - RNA, 17 nt, Pseudomonas aeruginosa PA01
cagccgggaucuccucg

SEQ ID NO: 3518285 - RNA, 18 nt, Pseudomonas aeruginosa PA01
cagccgggaucuccucga

SEQ ID NO: 3518286 - RNA, 14 nt, Pseudomonas aeruginosa PA01
cagccgggcagccg

SEQ ID NO: 3518287 - RNA, 23 nt, Pseudomonas aeruginosa PA01
cagccgggcagccguuggcguca

SEQ ID NO: 3518288 - RNA, 16 nt, Pseudomonas aeruginosa PA01
cagccgggcuccgccg

SEQ ID NO: 3518289 - RNA, 17 nt, Pseudomonas aeruginosa PA01
cagccgggcuccgccgc

SEQ ID NO: 3518290 - RNA, 14 nt, Pseudomonas aeruginosa PA01
cagccggggcguag

SEQ ID NO: 3518291 - RNA, 16 nt, Pseudomonas aeruginosa PA01
cagccggguucccagu

SEQ ID NO: 3518292 - RNA, 17 nt, Pseudomonas aeruginosa PA01
cagccgguacugcgcca

SEQ ID NO: 3518293 - RNA, 19 nt, Pseudomonas aeruginosa PA01
cagccgguacugcgccagu

SEQ ID NO: 3518294 - RNA, 17 nt, Pseudomonas aeruginosa PA01
cagccgguaggggccga

SEQ ID NO: 3518295 - RNA, 16 nt, Pseudomonas aeruginosa PA01
cagccgguggucuuca

SEQ ID NO: 3518296 - RNA, 20 nt, Pseudomonas aeruginosa PA01
cagccgguggucuucagcac

SEQ ID NO: 3518297 - RNA, 21 nt, Pseudomonas aeruginosa PA01
cagccgguggucuucagcaca

SEQ ID NO: 3518298 - RNA, 22 nt, Pseudomonas aeruginosa PA01
cagccgguggucuucagcacau

SEQ ID NO: 3518299 - RNA, 18 nt, Pseudomonas aeruginosa PA01
cagccguauggccccucc

SEQ ID NO: 3518300 - RNA, 13 nt, Pseudomonas aeruginosa PA01
cagccguccgccc

SEQ ID NO: 3518301 - RNA, 15 nt, Pseudomonas aeruginosa PA01
cagccguccgcgggc

SEQ ID NO: 3518302 - RNA, 16 nt, Pseudomonas aeruginosa PA01
cagccguccgcgggcg

SEQ ID NO: 3518303 - RNA, 18 nt, Pseudomonas aeruginosa PA01
cagccgucggugaucgag

SEQ ID NO: 3518304 - RNA, 21 nt, Pseudomonas aeruginosa PA01
cagccgucgucguccaccgag

SEQ ID NO: 3518305 - RNA, 13 nt, Pseudomonas aeruginosa PA01
cagccguggcacc

SEQ ID NO: 3518306 - RNA, 19 nt, Pseudomonas aeruginosa PA01
cagccguggcacccaggcc

SEQ ID NO: 3518307 - RNA, 20 nt, Pseudomonas aeruginosa PA01
cagccguggcacccaggcca

SEQ ID NO: 3518308 - RNA, 17 nt, Pseudomonas aeruginosa PA01
cagccguggcaggcgcc

SEQ ID NO: 3518309 - RNA, 16 nt, Pseudomonas aeruginosa PA01
cagccgugggcguaga

SEQ ID NO: 3518310 - RNA, 17 nt, Pseudomonas aeruginosa PA01
cagccguucgcuggaca

SEQ ID NO: 3518311 - RNA, 21 nt, Pseudomonas aeruginosa PA01
cagccguucgcuggacaggcg

SEQ ID NO: 3518312 - RNA, 13 nt, Pseudomonas aeruginosa PA01
cagccguuggcca

SEQ ID NO: 3518313 - RNA, 18 nt, Pseudomonas aeruginosa PA01
cagccguuggccagcagg

SEQ ID NO: 3518314 - RNA, 19 nt, Pseudomonas aeruginosa PA01
cagccguuggccagcaggc

SEQ ID NO: 3518315 - RNA, 20 nt, Pseudomonas aeruginosa PA01
cagccguuggccagcaggcg

SEQ ID NO: 3518316 - RNA, 20 nt, Pseudomonas aeruginosa PA01
cagccuacugggcguggcgg

SEQ ID NO: 3518317 - RNA, 16 nt, Pseudomonas aeruginosa PA01
cagccucaagccucgc

SEQ ID NO: 3518318 - RNA, 15 nt, Pseudomonas aeruginosa PA01
cagccucacccugcu

SEQ ID NO: 3518319 - RNA, 16 nt, Pseudomonas aeruginosa PA01
cagccucacccugcug

SEQ ID NO: 3518320 - RNA, 18 nt, Pseudomonas aeruginosa PA01
cagccucacccugcuggg

SEQ ID NO: 3518321 - RNA, 20 nt, Pseudomonas aeruginosa PA01
cagccucacccugcugggcg

SEQ ID NO: 3518322 - RNA, 22 nt, Pseudomonas aeruginosa PA01
cagccucacccugcugggcggg

SEQ ID NO: 3518323 - RNA, 13 nt, Pseudomonas aeruginosa PA01
cagccucagccau

SEQ ID NO: 3518324 - RNA, 13 nt, Pseudomonas aeruginosa PA01
cagccucagcgac

SEQ ID NO: 3518325 - RNA, 18 nt, Pseudomonas aeruginosa PA01
cagccucagcgacauccc

SEQ ID NO: 3518326 - RNA, 17 nt, Pseudomonas aeruginosa PA01
cagccucgcgcucggcg

SEQ ID NO: 3518327 - RNA, 22 nt, Pseudomonas aeruginosa PA01
cagccucgcgcucggcggccuc

SEQ ID NO: 3518328 - RNA, 21 nt, Pseudomonas aeruginosa PA01
cagccucggcagggcgcccgc

SEQ ID NO: 3518329 - RNA, 20 nt, Pseudomonas aeruginosa PA01
cagccugacguugccgcgcg

SEQ ID NO: 3518330 - RNA, 21 nt, Pseudomonas aeruginosa PA01
cagccugacguugccgcgcgg

SEQ ID NO: 3518331 - RNA, 23 nt, Pseudomonas aeruginosa PA01
cagccugacguugccgcgcgggc

SEQ ID NO: 3518332 - RNA, 13 nt, Pseudomonas aeruginosa PA01
cagccugcgcugu

SEQ ID NO: 3518333 - RNA, 15 nt, Pseudomonas aeruginosa PA01
cagccugcuggccug

SEQ ID NO: 3518334 - RNA, 13 nt, Pseudomonas aeruginosa PA01
cagccuggccagc

SEQ ID NO: 3518335 - RNA, 19 nt, Pseudomonas aeruginosa PA01
cagccuggccagcgcuucg

SEQ ID NO: 3518336 - RNA, 16 nt, Pseudomonas aeruginosa PA01
cagccuggccagcguc

SEQ ID NO: 3518337 - RNA, 22 nt, Pseudomonas aeruginosa PA01
cagccuggcgucgcacugcugc

SEQ ID NO: 3518338 - RNA, 21 nt, Pseudomonas aeruginosa PA01
cagccuggcugcaacgagagg

SEQ ID NO: 3518339 - RNA, 20 nt, Pseudomonas aeruginosa PA01
cagccuggucauccuggccc

SEQ ID NO: 3518340 - RNA, 15 nt, Pseudomonas aeruginosa PA01
cagccuuccggcacc

SEQ ID NO: 3518341 - RNA, 22 nt, Pseudomonas aeruginosa PA01
cagccuucuccccagaugcccu

SEQ ID NO: 3518342 - RNA, 19 nt, Pseudomonas aeruginosa PA01
cagccuugcuggacuuccc

SEQ ID NO: 3518343 - RNA, 22 nt, Pseudomonas aeruginosa PA01
cagccuuggcaugaccgagcau

SEQ ID NO: 3518344 - RNA, 18 nt, Pseudomonas aeruginosa PA01
cagccuuggccacggcau

SEQ ID NO: 3518345 - RNA, 22 nt, Pseudomonas aeruginosa PA01
cagcgaaagcgucagcgcgcca

SEQ ID NO: 3518346 - RNA, 22 nt, Pseudomonas aeruginosa PA01
cagcgaaauggucaccaugauc

SEQ ID NO: 3518347 - RNA, 23 nt, Pseudomonas aeruginosa PA01
cagcgaaauggucaccaugauca

SEQ ID NO: 3518348 - RNA, 14 nt, Pseudomonas aeruginosa PA01
cagcgaacccaggc

SEQ ID NO: 3518349 - RNA, 20 nt, Pseudomonas aeruginosa PA01
cagcgaacccaggccgcgca

SEQ ID NO: 3518350 - RNA, 12 nt, Pseudomonas aeruginosa PA01
cagcgaacgccg

SEQ ID NO: 3518351 - RNA, 16 nt, Pseudomonas aeruginosa PA01
cagcgaacgccgcagc

SEQ ID NO: 3518352 - RNA, 22 nt, Pseudomonas aeruginosa PA01
cagcgaauagcguugacgcagu

SEQ ID NO: 3518353 - RNA, 17 nt, Pseudomonas aeruginosa PA01
cagcgaaugcuugccgg

SEQ ID NO: 3518354 - RNA, 14 nt, Pseudomonas aeruginosa PA01
cagcgaauggacag

SEQ ID NO: 3518355 - RNA, 16 nt, Pseudomonas aeruginosa PA01
cagcgacacaacgcug

SEQ ID NO: 3518356 - RNA, 18 nt, Pseudomonas aeruginosa PA01
cagcgaccgucgaaccag

SEQ ID NO: 3518357 - RNA, 15 nt, Pseudomonas aeruginosa PA01
cagcgacgacuugcc

SEQ ID NO: 3518358 - RNA, 14 nt, Pseudomonas aeruginosa PA01
cagcgacgcgacau

SEQ ID NO: 3518359 - RNA, 17 nt, Pseudomonas aeruginosa PA01
cagcgacgcgacauccu

SEQ ID NO: 3518360 - RNA, 23 nt, Pseudomonas aeruginosa PA01
cagcgacgcgacauccuccaccg

SEQ ID NO: 3518361 - RNA, 16 nt, Pseudomonas aeruginosa PA01
cagcgacuccagccag

SEQ ID NO: 3518362 - RNA, 15 nt, Pseudomonas aeruginosa PA01
cagcgacucgaugcg

SEQ ID NO: 3518363 - RNA, 19 nt, Pseudomonas aeruginosa PA01
cagcgacucgaugcgcagc

SEQ ID NO: 3518364 - RNA, 20 nt, Pseudomonas aeruginosa PA01
cagcgacucgcugccggcgc

SEQ ID NO: 3518365 - RNA, 21 nt, Pseudomonas aeruginosa PA01
cagcgacucgcugggcgccgg

SEQ ID NO: 3518366 - RNA, 16 nt, Pseudomonas aeruginosa PA01
cagcgacucuucaaca

SEQ ID NO: 3518367 - RNA, 13 nt, Pseudomonas aeruginosa PA01
cagcgacuggccc

SEQ ID NO: 3518368 - RNA, 16 nt, Pseudomonas aeruginosa PA01
cagcgacuggcccugg

SEQ ID NO: 3518369 - RNA, 20 nt, Pseudomonas aeruginosa PA01
cagcgacugguggucgaggg

SEQ ID NO: 3518370 - RNA, 20 nt, Pseudomonas aeruginosa PA01
cagcgagaacuugccggcgc

SEQ ID NO: 3518371 - RNA, 13 nt, Pseudomonas aeruginosa PA01
cagcgagacccgg

SEQ ID NO: 3518372 - RNA, 21 nt, Pseudomonas aeruginosa PA01
cagcgagaccucgcccaucgc

SEQ ID NO: 3518373 - RNA, 22 nt, Pseudomonas aeruginosa PA01
cagcgagaccucgcccaucgcc

SEQ ID NO: 3518374 - RNA, 14 nt, Pseudomonas aeruginosa PA01
cagcgagacgggcg

SEQ ID NO: 3518375 - RNA, 23 nt, Pseudomonas aeruginosa PA01
cagcgagacgggcgaggcuaacg

SEQ ID NO: 3518376 - RNA, 20 nt, Pseudomonas aeruginosa PA01
cagcgagagcuguccggcgc

SEQ ID NO: 3518377 - RNA, 16 nt, Pseudomonas aeruginosa PA01
cagcgagaggggcgcu

SEQ ID NO: 3518378 - RNA, 14 nt, Pseudomonas aeruginosa PA01
cagcgagccgagca

SEQ ID NO: 3518379 - RNA, 18 nt, Pseudomonas aeruginosa PA01
cagcgagcgggucagcag

SEQ ID NO: 3518380 - RNA, 21 nt, Pseudomonas aeruginosa PA01
cagcgagcuaucgccucccgc

SEQ ID NO: 3518381 - RNA, 16 nt, Pseudomonas aeruginosa PA01
cagcgagcuucgccgc

SEQ ID NO: 3518382 - RNA, 18 nt, Pseudomonas aeruginosa PA01
cagcgagcuucgccgcgc

SEQ ID NO: 3518383 - RNA, 19 nt, Pseudomonas aeruginosa PA01
cagcgagcuucgccgcgca

SEQ ID NO: 3518384 - RNA, 20 nt, Pseudomonas aeruginosa PA01
cagcgagcuucgccgcgcaa

SEQ ID NO: 3518385 - RNA, 18 nt, Pseudomonas aeruginosa PA01
cagcgaggagccuuucac

SEQ ID NO: 3518386 - RNA, 23 nt, Pseudomonas aeruginosa PA01
cagcgaggagccuuucacuuuca

SEQ ID NO: 3518387 - RNA, 16 nt, Pseudomonas aeruginosa PA01
cagcgaggcccgcgcc

SEQ ID NO: 3518388 - RNA, 18 nt, Pseudomonas aeruginosa PA01
cagcgaggcccgcgccgc

SEQ ID NO: 3518389 - RNA, 20 nt, Pseudomonas aeruginosa PA01
cagcgaggcccgcgccgccg

SEQ ID NO: 3518390 - RNA, 19 nt, Pseudomonas aeruginosa PA01
cagcgaggggaagaucucc

SEQ ID NO: 3518391 - RNA, 15 nt, Pseudomonas aeruginosa PA01
cagcgaguagucgcg

SEQ ID NO: 3518392 - RNA, 22 nt, Pseudomonas aeruginosa PA01
cagcgaguagucgcggggcgga

SEQ ID NO: 3518393 - RNA, 16 nt, Pseudomonas aeruginosa PA01
cagcgagucgacccag

SEQ ID NO: 3518394 - RNA, 19 nt, Pseudomonas aeruginosa PA01
cagcgagucgacccaggcc

SEQ ID NO: 3518395 - RNA, 14 nt, Pseudomonas aeruginosa PA01
cagcgagucgccgu

SEQ ID NO: 3518396 - RNA, 18 nt, Pseudomonas aeruginosa PA01
cagcgagucgucggacuu

SEQ ID NO: 3518397 - RNA, 23 nt, Pseudomonas aeruginosa PA01
cagcgagugcaggaaguggcgga

SEQ ID NO: 3518398 - RNA, 17 nt, Pseudomonas aeruginosa PA01
cagcgaguugaccuugg

SEQ ID NO: 3518399 - RNA, 20 nt, Pseudomonas aeruginosa PA01
cagcgaguugaccuuggcca

SEQ ID NO: 3518400 - RNA, 15 nt, Pseudomonas aeruginosa PA01
cagcgauacaccugc

SEQ ID NO: 3518401 - RNA, 18 nt, Pseudomonas aeruginosa PA01
cagcgaucagcaccagcg

SEQ ID NO: 3518402 - RNA, 14 nt, Pseudomonas aeruginosa PA01
cagcgaucgccgcc

SEQ ID NO: 3518403 - RNA, 15 nt, Pseudomonas aeruginosa PA01
cagcgaucgccgcca

SEQ ID NO: 3518404 - RNA, 16 nt, Pseudomonas aeruginosa PA01
cagcgaucgccgccau

SEQ ID NO: 3518405 - RNA, 19 nt, Pseudomonas aeruginosa PA01
cagcgaugccuccggcuuu

SEQ ID NO: 3518406 - RNA, 23 nt, Pseudomonas aeruginosa PA01
cagcgcaaccgguuucccucgag

SEQ ID NO: 3518407 - RNA, 23 nt, Pseudomonas aeruginosa PA01
cagcgcaacgaaaagccgccccg

SEQ ID NO: 3518408 - RNA, 14 nt, Pseudomonas aeruginosa PA01
cagcgcaagcggcg

SEQ ID NO: 3518409 - RNA, 15 nt, Pseudomonas aeruginosa PA01
cagcgcaagcggcgg

SEQ ID NO: 3518410 - RNA, 16 nt, Pseudomonas aeruginosa PA01
cagcgcaagcggcggc

SEQ ID NO: 3518411 - RNA, 13 nt, Pseudomonas aeruginosa PA01
cagcgcaagucgg

SEQ ID NO: 3518412 - RNA, 17 nt, Pseudomonas aeruginosa PA01
cagcgcaagucggccug

SEQ ID NO: 3518413 - RNA, 18 nt, Pseudomonas aeruginosa PA01
cagcgcaagucggccugc

SEQ ID NO: 3518414 - RNA, 16 nt, Pseudomonas aeruginosa PA01
cagcgcaccagggucg

SEQ ID NO: 3518415 - RNA, 17 nt, Pseudomonas aeruginosa PA01
cagcgcaccgcccugca

SEQ ID NO: 3518416 - RNA, 19 nt, Pseudomonas aeruginosa PA01
cagcgcaccuacuaccgcu

SEQ ID NO: 3518417 - RNA, 22 nt, Pseudomonas aeruginosa PA01
cagcgcaccuacuaccgcuggg

SEQ ID NO: 3518418 - RNA, 16 nt, Pseudomonas aeruginosa PA01
cagcgcacgccgugga

SEQ ID NO: 3518419 - RNA, 19 nt, Pseudomonas aeruginosa PA01
cagcgcagccugcuggccu

SEQ ID NO: 3518420 - RNA, 13 nt, Pseudomonas aeruginosa PA01
cagcgcaggccga

SEQ ID NO: 3518421 - RNA, 16 nt, Pseudomonas aeruginosa PA01
cagcgcaggccgaucu

SEQ ID NO: 3518422 - RNA, 19 nt, Pseudomonas aeruginosa PA01
cagcgcauaggccugggcg

SEQ ID NO: 3518423 - RNA, 14 nt, Pseudomonas aeruginosa PA01
cagcgcaugcggaa

SEQ ID NO: 3518424 - RNA, 17 nt, Pseudomonas aeruginosa PA01
cagcgcaugcggaaggc

SEQ ID NO: 3518425 - RNA, 21 nt, Pseudomonas aeruginosa PA01
cagcgcaugcggaaggcuucc

SEQ ID NO: 3518426 - RNA, 12 nt, Pseudomonas aeruginosa PA01
cagcgccaccag

SEQ ID NO: 3518427 - RNA, 13 nt, Pseudomonas aeruginosa PA01
cagcgccaccagc

SEQ ID NO: 3518428 - RNA, 14 nt, Pseudomonas aeruginosa PA01
cagcgccaccagca

SEQ ID NO: 3518429 - RNA, 16 nt, Pseudomonas aeruginosa PA01
cagcgccaccagcagg

SEQ ID NO: 3518430 - RNA, 23 nt, Pseudomonas aeruginosa PA01
cagcgccaccagcagggccaggc

SEQ ID NO: 3518431 - RNA, 17 nt, Pseudomonas aeruginosa PA01
cagcgccaccagcaugc

SEQ ID NO: 3518432 - RNA, 19 nt, Pseudomonas aeruginosa PA01
cagcgccaccaggaaaucg

SEQ ID NO: 3518433 - RNA, 16 nt, Pseudomonas aeruginosa PA01
cagcgccacggccagc

SEQ ID NO: 3518434 - RNA, 14 nt, Pseudomonas aeruginosa PA01
cagcgccacggcga

SEQ ID NO: 3518435 - RNA, 22 nt, Pseudomonas aeruginosa PA01
cagcgccacggcgaucgccggg

SEQ ID NO: 3518436 - RNA, 19 nt, Pseudomonas aeruginosa PA01
cagcgccacggcgcggaac

SEQ ID NO: 3518437 - RNA, 18 nt, Pseudomonas aeruginosa PA01
cagcgccacuuccagcuu

SEQ ID NO: 3518438 - RNA, 23 nt, Pseudomonas aeruginosa PA01
cagcgccacuuccagcuugcgcu

SEQ ID NO: 3518439 - RNA, 14 nt, Pseudomonas aeruginosa PA01
cagcgccagcaacc

SEQ ID NO: 3518440 - RNA, 14 nt, Pseudomonas aeruginosa PA01
cagcgccagcaggu

SEQ ID NO: 3518441 - RNA, 17 nt, Pseudomonas aeruginosa PA01
cagcgccagcaggucgc

SEQ ID NO: 3518442 - RNA, 14 nt, Pseudomonas aeruginosa PA01
cagcgccagccagg

SEQ ID NO: 3518443 - RNA, 15 nt, Pseudomonas aeruginosa PA01
cagcgccagccaggg

SEQ ID NO: 3518444 - RNA, 16 nt, Pseudomonas aeruginosa PA01
cagcgccagcggcagc

SEQ ID NO: 3518445 - RNA, 17 nt, Pseudomonas aeruginosa PA01
cagcgccaggaagccgc

SEQ ID NO: 3518446 - RNA, 20 nt, Pseudomonas aeruginosa PA01
cagcgccaggaagccgcgcc

SEQ ID NO: 3518447 - RNA, 15 nt, Pseudomonas aeruginosa PA01
cagcgccaggagcag

SEQ ID NO: 3518448 - RNA, 16 nt, Pseudomonas aeruginosa PA01
cagcgccaggagcagg

SEQ ID NO: 3518449 - RNA, 19 nt, Pseudomonas aeruginosa PA01
cagcgccaggagcagggcg

SEQ ID NO: 3518450 - RNA, 12 nt, Pseudomonas aeruginosa PA01
cagcgccaggcc

SEQ ID NO: 3518451 - RNA, 14 nt, Pseudomonas aeruginosa PA01
cagcgccaggccgc

SEQ ID NO: 3518452 - RNA, 17 nt, Pseudomonas aeruginosa PA01
cagcgccaggccgccga

SEQ ID NO: 3518453 - RNA, 15 nt, Pseudomonas aeruginosa PA01
cagcgccaggcgcgg

SEQ ID NO: 3518454 - RNA, 16 nt, Pseudomonas aeruginosa PA01
cagcgccaggcgcggu

SEQ ID NO: 3518455 - RNA, 15 nt, Pseudomonas aeruginosa PA01
cagcgccagggccca

SEQ ID NO: 3518456 - RNA, 17 nt, Pseudomonas aeruginosa PA01
cagcgccagggcccaca

SEQ ID NO: 3518457 - RNA, 20 nt, Pseudomonas aeruginosa PA01
cagcgccagguuggccuggc

SEQ ID NO: 3518458 - RNA, 21 nt, Pseudomonas aeruginosa PA01
cagcgccaguacuccgagggc

SEQ ID NO: 3518459 - RNA, 21 nt, Pseudomonas aeruginosa PA01
cagcgccaguuggacgcggcc

SEQ ID NO: 3518460 - RNA, 17 nt, Pseudomonas aeruginosa PA01
cagcgccaucaggcccu

SEQ ID NO: 3518461 - RNA, 17 nt, Pseudomonas aeruginosa PA01
cagcgccaugcucuuca

SEQ ID NO: 3518462 - RNA, 24 nt, Pseudomonas aeruginosa PA01
cagcgccaugcuguugccguggcg

SEQ ID NO: 3518463 - RNA, 22 nt, Pseudomonas aeruginosa PA01
cagcgccauggggaucaccgga

SEQ ID NO: 3518464 - RNA, 18 nt, Pseudomonas aeruginosa PA01
cagcgcccagacacgccu

SEQ ID NO: 3518465 - RNA, 12 nt, Pseudomonas aeruginosa PA01
cagcgcccaggc

SEQ ID NO: 3518466 - RNA, 16 nt, Pseudomonas aeruginosa PA01
cagcgcccaggccggg

SEQ ID NO: 3518467 - RNA, 14 nt, Pseudomonas aeruginosa PA01
cagcgcccaggugc

SEQ ID NO: 3518468 - RNA, 16 nt, Pseudomonas aeruginosa PA01
cagcgccccaccaggc

SEQ ID NO: 3518469 - RNA, 14 nt, Pseudomonas aeruginosa PA01
cagcgccccagcac

SEQ ID NO: 3518470 - RNA, 16 nt, Pseudomonas aeruginosa PA01
cagcgccccagcaccu

SEQ ID NO: 3518471 - RNA, 15 nt, Pseudomonas aeruginosa PA01
cagcgccccgccuac

SEQ ID NO: 3518472 - RNA, 21 nt, Pseudomonas aeruginosa PA01
cagcgccccgccuaccggggc

SEQ ID NO: 3518473 - RNA, 15 nt, Pseudomonas aeruginosa PA01
cagcgccccucccag

SEQ ID NO: 3518474 - RNA, 20 nt, Pseudomonas aeruginosa PA01
cagcgccccucccagccaca

SEQ ID NO: 3518475 - RNA, 22 nt, Pseudomonas aeruginosa PA01
cagcgcccgauaggcgccggcg

SEQ ID NO: 3518476 - RNA, 23 nt, Pseudomonas aeruginosa PA01
cagcgcccgauaggcgccggcgc

SEQ ID NO: 3518477 - RNA, 15 nt, Pseudomonas aeruginosa PA01
cagcgcccggcacgc

SEQ ID NO: 3518478 - RNA, 20 nt, Pseudomonas aeruginosa PA01
cagcgcccggcacgcuccag

SEQ ID NO: 3518479 - RNA, 18 nt, Pseudomonas aeruginosa PA01
cagcgcccggcugugcuc

SEQ ID NO: 3518480 - RNA, 14 nt, Pseudomonas aeruginosa PA01
cagcgccgagacga

SEQ ID NO: 3518481 - RNA, 22 nt, Pseudomonas aeruginosa PA01
cagcgccgagacgaucagcagg

SEQ ID NO: 3518482 - RNA, 21 nt, Pseudomonas aeruginosa PA01
cagcgccgcauuggccaggcc

SEQ ID NO: 3518483 - RNA, 13 nt, Pseudomonas aeruginosa PA01
cagcgccgccaac

SEQ ID NO: 3518484 - RNA, 13 nt, Pseudomonas aeruginosa PA01
cagcgccgccagc

SEQ ID NO: 3518485 - RNA, 17 nt, Pseudomonas aeruginosa PA01
cagcgccgccagcagga

SEQ ID NO: 3518486 - RNA, 16 nt, Pseudomonas aeruginosa PA01
cagcgccgccaggcag

SEQ ID NO: 3518487 - RNA, 20 nt, Pseudomonas aeruginosa PA01
cagcgccgccaggcagacca

SEQ ID NO: 3518488 - RNA, 15 nt, Pseudomonas aeruginosa PA01
cagcgccgccaggcc

SEQ ID NO: 3518489 - RNA, 20 nt, Pseudomonas aeruginosa PA01
cagcgccgccaggcgcgucu

SEQ ID NO: 3518490 - RNA, 13 nt, Pseudomonas aeruginosa PA01
cagcgccgccagu

SEQ ID NO: 3518491 - RNA, 17 nt, Pseudomonas aeruginosa PA01
cagcgccgccaguucgc

SEQ ID NO: 3518492 - RNA, 14 nt, Pseudomonas aeruginosa PA01
cagcgccgcccugu

SEQ ID NO: 3518493 - RNA, 13 nt, Pseudomonas aeruginosa PA01
cagcgccgccgcg

SEQ ID NO: 3518494 - RNA, 14 nt, Pseudomonas aeruginosa PA01
cagcgccgccgcgu

SEQ ID NO: 3518495 - RNA, 14 nt, Pseudomonas aeruginosa PA01
cagcgccgccgcug

SEQ ID NO: 3518496 - RNA, 15 nt, Pseudomonas aeruginosa PA01
cagcgccgccgggcg

SEQ ID NO: 3518497 - RNA, 18 nt, Pseudomonas aeruginosa PA01
cagcgccgccucgaaggc

SEQ ID NO: 3518498 - RNA, 18 nt, Pseudomonas aeruginosa PA01
cagcgccgccucgcuggg

SEQ ID NO: 3518499 - RNA, 20 nt, Pseudomonas aeruginosa PA01
cagcgccgccucgcugggcg

SEQ ID NO: 3518500 - RNA, 22 nt, Pseudomonas aeruginosa PA01
cagcgccgccugcuggcugccc

SEQ ID NO: 3518501 - RNA, 17 nt, Pseudomonas aeruginosa PA01
cagcgccgcgcggcaac

SEQ ID NO: 3518502 - RNA, 13 nt, Pseudomonas aeruginosa PA01
cagcgccgcgcug

SEQ ID NO: 3518503 - RNA, 14 nt, Pseudomonas aeruginosa PA01
cagcgccgcgcugc

SEQ ID NO: 3518504 - RNA, 17 nt, Pseudomonas aeruginosa PA01
cagcgccgcgcugcgug

SEQ ID NO: 3518505 - RNA, 12 nt, Pseudomonas aeruginosa PA01
cagcgccgcggc

SEQ ID NO: 3518506 - RNA, 20 nt, Pseudomonas aeruginosa PA01
cagcgccgcggcgaccagcg

SEQ ID NO: 3518507 - RNA, 13 nt, Pseudomonas aeruginosa PA01
cagcgccgcggcu

SEQ ID NO: 3518508 - RNA, 14 nt, Pseudomonas aeruginosa PA01
cagcgccgcggcug

SEQ ID NO: 3518509 - RNA, 15 nt, Pseudomonas aeruginosa PA01
cagcgccgcggcugg

SEQ ID NO: 3518510 - RNA, 19 nt, Pseudomonas aeruginosa PA01
cagcgccgcuccuccucgc

SEQ ID NO: 3518511 - RNA, 22 nt, Pseudomonas aeruginosa PA01
cagcgccgcuccuccucgcucu

SEQ ID NO: 3518512 - RNA, 19 nt, Pseudomonas aeruginosa PA01
cagcgccgcucggcgagcc

SEQ ID NO: 3518513 - RNA, 23 nt, Pseudomonas aeruginosa PA01
cagcgccgcucggcgagccgccg

SEQ ID NO: 3518514 - RNA, 18 nt, Pseudomonas aeruginosa PA01
cagcgccggaaucgacgg

SEQ ID NO: 3518515 - RNA, 15 nt, Pseudomonas aeruginosa PA01
cagcgccggccaggg

SEQ ID NO: 3518516 - RNA, 21 nt, Pseudomonas aeruginosa PA01
cagcgccggccauugccgcca

SEQ ID NO: 3518517 - RNA, 16 nt, Pseudomonas aeruginosa PA01
cagcgccggcggcgcg

SEQ ID NO: 3518518 - RNA, 20 nt, Pseudomonas aeruginosa PA01
cagcgccggcggcgcgucca

SEQ ID NO: 3518519 - RNA, 18 nt, Pseudomonas aeruginosa PA01
cagcgccgggcauucgca

SEQ ID NO: 3518520 - RNA, 23 nt, Pseudomonas aeruginosa PA01
cagcgccgggucgaccuugccga

SEQ ID NO: 3518521 - RNA, 21 nt, Pseudomonas aeruginosa PA01
cagcgccgguagcggcgcacc

SEQ ID NO: 3518522 - RNA, 19 nt, Pseudomonas aeruginosa PA01
cagcgccguacgcaccgcg

SEQ ID NO: 3518523 - RNA, 20 nt, Pseudomonas aeruginosa PA01
cagcgccguacgcaccgcgu

SEQ ID NO: 3518524 - RNA, 20 nt, Pseudomonas aeruginosa PA01
cagcgccgucaccagcagcc

SEQ ID NO: 3518525 - RNA, 22 nt, Pseudomonas aeruginosa PA01
cagcgccgucaccagcagcccc

SEQ ID NO: 3518526 - RNA, 23 nt, Pseudomonas aeruginosa PA01
cagcgccgucaccagcagccccg

SEQ ID NO: 3518527 - RNA, 15 nt, Pseudomonas aeruginosa PA01
cagcgccuccagcac

SEQ ID NO: 3518528 - RNA, 18 nt, Pseudomonas aeruginosa PA01
cagcgccuccagcaccgg

SEQ ID NO: 3518529 - RNA, 20 nt, Pseudomonas aeruginosa PA01
cagcgccuccagcaccggga

SEQ ID NO: 3518530 - RNA, 14 nt, Pseudomonas aeruginosa PA01
cagcgccuccagcg

SEQ ID NO: 3518531 - RNA, 15 nt, Pseudomonas aeruginosa PA01
cagcgccuccagcgu

SEQ ID NO: 3518532 - RNA, 22 nt, Pseudomonas aeruginosa PA01
cagcgccuccagcgucugccgc

SEQ ID NO: 3518533 - RNA, 23 nt, Pseudomonas aeruginosa PA01
cagcgccuccagcgucugccgcu

SEQ ID NO: 3518534 - RNA, 14 nt, Pseudomonas aeruginosa PA01
cagcgccucccggg

SEQ ID NO: 3518535 - RNA, 22 nt, Pseudomonas aeruginosa PA01
cagcgccucccgggccucucga

SEQ ID NO: 3518536 - RNA, 22 nt, Pseudomonas aeruginosa PA01
cagcgccuccucuaccaggcgg

SEQ ID NO: 3518537 - RNA, 17 nt, Pseudomonas aeruginosa PA01
cagcgccucgaccagau

SEQ ID NO: 3518538 - RNA, 22 nt, Pseudomonas aeruginosa PA01
cagcgccucgaccagaucggca

SEQ ID NO: 3518539 - RNA, 21 nt, Pseudomonas aeruginosa PA01
cagcgccucgaccucggccgc

SEQ ID NO: 3518540 - RNA, 14 nt, Pseudomonas aeruginosa PA01
cagcgccucgccga

SEQ ID NO: 3518541 - RNA, 17 nt, Pseudomonas aeruginosa PA01
cagcgccucgccgagca

SEQ ID NO: 3518542 - RNA, 23 nt, Pseudomonas aeruginosa PA01
cagcgccucgccgagcauccagg

SEQ ID NO: 3518543 - RNA, 13 nt, Pseudomonas aeruginosa PA01
cagcgccucgcgg

SEQ ID NO: 3518544 - RNA, 22 nt, Pseudomonas aeruginosa PA01
cagcgccucgcgggucugcgcc

SEQ ID NO: 3518545 - RNA, 20 nt, Pseudomonas aeruginosa PA01
cagcgccucggcaucgacca

SEQ ID NO: 3518546 - RNA, 16 nt, Pseudomonas aeruginosa PA01
cagcgccucguggaac

SEQ ID NO: 3518547 - RNA, 17 nt, Pseudomonas aeruginosa PA01
cagcgccucguggaaca

SEQ ID NO: 3518548 - RNA, 18 nt, Pseudomonas aeruginosa PA01
cagcgccuggaugaucgc

SEQ ID NO: 3518549 - RNA, 11 nt, Pseudomonas aeruginosa PA01
cagcgccuggc

SEQ ID NO: 3518550 - RNA, 12 nt, Pseudomonas aeruginosa PA01
cagcgccuggcg

SEQ ID NO: 3518551 - RNA, 13 nt, Pseudomonas aeruginosa PA01
cagcgccuggcgc

SEQ ID NO: 3518552 - RNA, 14 nt, Pseudomonas aeruginosa PA01
cagcgccuggcgca

SEQ ID NO: 3518553 - RNA, 18 nt, Pseudomonas aeruginosa PA01
cagcgccuggcgcaacgc

SEQ ID NO: 3518554 - RNA, 23 nt, Pseudomonas aeruginosa PA01
cagcgccuggcgcaacgccggca

SEQ ID NO: 3518555 - RNA, 22 nt, Pseudomonas aeruginosa PA01
cagcgccuggcgcaguucaucg

SEQ ID NO: 3518556 - RNA, 15 nt, Pseudomonas aeruginosa PA01
cagcgccugggccgc

SEQ ID NO: 3518557 - RNA, 16 nt, Pseudomonas aeruginosa PA01
cagcgccugggccgcg

SEQ ID NO: 3518558 - RNA, 19 nt, Pseudomonas aeruginosa PA01
cagcgccuggucggcggcc

SEQ ID NO: 3518559 - RNA, 15 nt, Pseudomonas aeruginosa PA01
cagcgccuguuccag

SEQ ID NO: 3518560 - RNA, 19 nt, Pseudomonas aeruginosa PA01
cagcgccuguuccagggcc

SEQ ID NO: 3518561 - RNA, 21 nt, Pseudomonas aeruginosa PA01
cagcgccuguuccagggccug

SEQ ID NO: 3518562 - RNA, 22 nt, Pseudomonas aeruginosa PA01
cagcgccuguuccagggccugc

SEQ ID NO: 3518563 - RNA, 15 nt, Pseudomonas aeruginosa PA01
cagcgccuugaccuc

SEQ ID NO: 3518564 - RNA, 16 nt, Pseudomonas aeruginosa PA01
cagcgccuugaccucg

SEQ ID NO: 3518565 - RNA, 20 nt, Pseudomonas aeruginosa PA01
cagcgccuuuuccgcaucuc

SEQ ID NO: 3518566 - RNA, 21 nt, Pseudomonas aeruginosa PA01
cagcgccuuuucggcacucag

SEQ ID NO: 3518567 - RNA, 22 nt, Pseudomonas aeruginosa PA01
cagcgcgaacaguuccgacugc

SEQ ID NO: 3518568 - RNA, 22 nt, Pseudomonas aeruginosa PA01
cagcgcgaaggccacgccgacg

SEQ ID NO: 3518569 - RNA, 17 nt, Pseudomonas aeruginosa PA01
cagcgcgacaucggcga

SEQ ID NO: 3518570 - RNA, 21 nt, Pseudomonas aeruginosa PA01
cagcgcgauacccuggccggc

SEQ ID NO: 3518571 - RNA, 19 nt, Pseudomonas aeruginosa PA01
cagcgcgauaucgcaggcc

SEQ ID NO: 3518572 - RNA, 22 nt, Pseudomonas aeruginosa PA01
cagcgcgauaucgcaggccagg

SEQ ID NO: 3518573 - RNA, 13 nt, Pseudomonas aeruginosa PA01
cagcgcgcagcgg

SEQ ID NO: 3518574 - RNA, 14 nt, Pseudomonas aeruginosa PA01
cagcgcgccccggc

SEQ ID NO: 3518575 - RNA, 16 nt, Pseudomonas aeruginosa PA01
cagcgcgcccggcgcc

SEQ ID NO: 3518576 - RNA, 17 nt, Pseudomonas aeruginosa PA01
cagcgcgcccggcgcca

SEQ ID NO: 3518577 - RNA, 19 nt, Pseudomonas aeruginosa PA01
cagcgcgcccggcgccacc

SEQ ID NO: 3518578 - RNA, 21 nt, Pseudomonas aeruginosa PA01
cagcgcgcccggcgccacccc

SEQ ID NO: 3518579 - RNA, 16 nt, Pseudomonas aeruginosa PA01
cagcgcgccgagccag

SEQ ID NO: 3518580 - RNA, 17 nt, Pseudomonas aeruginosa PA01
cagcgcgccgagccagg

SEQ ID NO: 3518581 - RNA, 18 nt, Pseudomonas aeruginosa PA01
cagcgcgccgagccaggu

SEQ ID NO: 3518582 - RNA, 13 nt, Pseudomonas aeruginosa PA01
cagcgcgccgagu

SEQ ID NO: 3518583 - RNA, 22 nt, Pseudomonas aeruginosa PA01
cagcgcgccgaguucgccgcga

SEQ ID NO: 3518584 - RNA, 11 nt, Pseudomonas aeruginosa PA01
cagcgcgccgc

SEQ ID NO: 3518585 - RNA, 21 nt, Pseudomonas aeruginosa PA01
cagcgcgccgccgaggugcgg

SEQ ID NO: 3518586 - RNA, 23 nt, Pseudomonas aeruginosa PA01
cagcgcgccgccgaggugcggcu

SEQ ID NO: 3518587 - RNA, 13 nt, Pseudomonas aeruginosa PA01
cagcgcgccgcgc

SEQ ID NO: 3518588 - RNA, 14 nt, Pseudomonas aeruginosa PA01
cagcgcgccuucga

SEQ ID NO: 3518589 - RNA, 15 nt, Pseudomonas aeruginosa PA01
cagcgcgcgccgagc

SEQ ID NO: 3518590 - RNA, 16 nt, Pseudomonas aeruginosa PA01
cagcgcgcgccgagca

SEQ ID NO: 3518591 - RNA, 17 nt, Pseudomonas aeruginosa PA01
cagcgcgcgccgagcaa

SEQ ID NO: 3518592 - RNA, 18 nt, Pseudomonas aeruginosa PA01
cagcgcgcgccgagcaac

SEQ ID NO: 3518593 - RNA, 12 nt, Pseudomonas aeruginosa PA01
cagcgcgcgcug

SEQ ID NO: 3518594 - RNA, 16 nt, Pseudomonas aeruginosa PA01
cagcgcgcgcuggcgc

SEQ ID NO: 3518595 - RNA, 16 nt, Pseudomonas aeruginosa PA01
cagcgcgcgcuggucg

SEQ ID NO: 3518596 - RNA, 13 nt, Pseudomonas aeruginosa PA01
cagcgcgcggacc

SEQ ID NO: 3518597 - RNA, 12 nt, Pseudomonas aeruginosa PA01
cagcgcgcggcc

SEQ ID NO: 3518598 - RNA, 13 nt, Pseudomonas aeruginosa PA01
cagcgcgcggcuc

SEQ ID NO: 3518599 - RNA, 14 nt, Pseudomonas aeruginosa PA01
cagcgcgcggcucg

SEQ ID NO: 3518600 - RNA, 18 nt, Pseudomonas aeruginosa PA01
cagcgcgcggcucggcgg

SEQ ID NO: 3518601 - RNA, 23 nt, Pseudomonas aeruginosa PA01
cagcgcgcguagcgugccgccau

SEQ ID NO: 3518602 - RNA, 21 nt, Pseudomonas aeruginosa PA01
cagcgcgcgucggucaggaca

SEQ ID NO: 3518603 - RNA, 15 nt, Pseudomonas aeruginosa PA01
cagcgcgcucgcugu

SEQ ID NO: 3518604 - RNA, 21 nt, Pseudomonas aeruginosa PA01
cagcgcgcucggccuggugca

SEQ ID NO: 3518605 - RNA, 22 nt, Pseudomonas aeruginosa PA01
cagcgcgcucggccuggugcac

SEQ ID NO: 3518606 - RNA, 18 nt, Pseudomonas aeruginosa PA01
cagcgcgcucuucgccgc

SEQ ID NO: 3518607 - RNA, 19 nt, Pseudomonas aeruginosa PA01
cagcgcgcucuucgccgcg

SEQ ID NO: 3518608 - RNA, 22 nt, Pseudomonas aeruginosa PA01
cagcgcgcucuucgccgcggcg

SEQ ID NO: 3518609 - RNA, 20 nt, Pseudomonas aeruginosa PA01
cagcgcggagcguccaccag

SEQ ID NO: 3518610 - RNA, 19 nt, Pseudomonas aeruginosa PA01
cagcgcggaucagucagga

SEQ ID NO: 3518611 - RNA, 23 nt, Pseudomonas aeruginosa PA01
cagcgcggaucagucaggaucgg

SEQ ID NO: 3518612 - RNA, 12 nt, Pseudomonas aeruginosa PA01
cagcgcggccac

SEQ ID NO: 3518613 - RNA, 15 nt, Pseudomonas aeruginosa PA01
cagcgcggccgccgc

SEQ ID NO: 3518614 - RNA, 18 nt, Pseudomonas aeruginosa PA01
cagcgcggccgccgccga

SEQ ID NO: 3518615 - RNA, 19 nt, Pseudomonas aeruginosa PA01
cagcgcggccgccgccgac

SEQ ID NO: 3518616 - RNA, 13 nt, Pseudomonas aeruginosa PA01
cagcgcggcgccc

SEQ ID NO: 3518617 - RNA, 15 nt, Pseudomonas aeruginosa PA01
cagcgcggcgcccca

SEQ ID NO: 3518618 - RNA, 16 nt, Pseudomonas aeruginosa PA01
cagcgcggcgcgcuga

SEQ ID NO: 3518619 - RNA, 13 nt, Pseudomonas aeruginosa PA01
cagcgcggcgcgg

SEQ ID NO: 3518620 - RNA, 14 nt, Pseudomonas aeruginosa PA01
cagcgcggcgcugg

SEQ ID NO: 3518621 - RNA, 19 nt, Pseudomonas aeruginosa PA01
cagcgcggcgcuuggcgaa

SEQ ID NO: 3518622 - RNA, 11 nt, Pseudomonas aeruginosa PA01
cagcgcggcgg

SEQ ID NO: 3518623 - RNA, 12 nt, Pseudomonas aeruginosa PA01
cagcgcggcggc

SEQ ID NO: 3518624 - RNA, 13 nt, Pseudomonas aeruginosa PA01
cagcgcggcggcg

SEQ ID NO: 3518625 - RNA, 14 nt, Pseudomonas aeruginosa PA01
cagcgcggcggcgg

SEQ ID NO: 3518626 - RNA, 23 nt, Pseudomonas aeruginosa PA01
cagcgcggcggcggccagcagca

SEQ ID NO: 3518627 - RNA, 17 nt, Pseudomonas aeruginosa PA01
cagcgcggcggcggccg

SEQ ID NO: 3518628 - RNA, 20 nt, Pseudomonas aeruginosa PA01
cagcgcgggggcucggucga

SEQ ID NO: 3518629 - RNA, 17 nt, Pseudomonas aeruginosa PA01
cagcgcggugagcaggg

SEQ ID NO: 3518630 - RNA, 21 nt, Pseudomonas aeruginosa PA01
cagcgcguagaccaccucgac

SEQ ID NO: 3518631 - RNA, 23 nt, Pseudomonas aeruginosa PA01
cagcgcguagcuuuccgcggcgu

SEQ ID NO: 3518632 - RNA, 16 nt, Pseudomonas aeruginosa PA01
cagcgcgucacucgac

SEQ ID NO: 3518633 - RNA, 22 nt, Pseudomonas aeruginosa PA01
cagcgcgucacucgacaggcca

SEQ ID NO: 3518634 - RNA, 19 nt, Pseudomonas aeruginosa PA01
cagcgcgucgaccaccgcg

SEQ ID NO: 3518635 - RNA, 16 nt, Pseudomonas aeruginosa PA01
cagcgcgucggcacgc

SEQ ID NO: 3518636 - RNA, 17 nt, Pseudomonas aeruginosa PA01
cagcgcgucggcacgcc

SEQ ID NO: 3518637 - RNA, 18 nt, Pseudomonas aeruginosa PA01
cagcgcgucggcacgccg

SEQ ID NO: 3518638 - RNA, 14 nt, Pseudomonas aeruginosa PA01
cagcgcgugcaggc

SEQ ID NO: 3518639 - RNA, 16 nt, Pseudomonas aeruginosa PA01
cagcgcgugcaggcgc

SEQ ID NO: 3518640 - RNA, 19 nt, Pseudomonas aeruginosa PA01
cagcgcgugcaggcgcccu

SEQ ID NO: 3518641 - RNA, 21 nt, Pseudomonas aeruginosa PA01
cagcgcgugcaggcgcccugg

SEQ ID NO: 3518642 - RNA, 16 nt, Pseudomonas aeruginosa PA01
cagcgcguucaccccg

SEQ ID NO: 3518643 - RNA, 17 nt, Pseudomonas aeruginosa PA01
cagcgcguucaccccgc

SEQ ID NO: 3518644 - RNA, 18 nt, Pseudomonas aeruginosa PA01
cagcgcguucaccccgcc

SEQ ID NO: 3518645 - RNA, 19 nt, Pseudomonas aeruginosa PA01
cagcgcguucaccccgccc

SEQ ID NO: 3518646 - RNA, 16 nt, Pseudomonas aeruginosa PA01
cagcgcuacgcaggcc

SEQ ID NO: 3518647 - RNA, 20 nt, Pseudomonas aeruginosa PA01
cagcgcuacgcaggcccuug

SEQ ID NO: 3518648 - RNA, 17 nt, Pseudomonas aeruginosa PA01
cagcgcucacgcaccuc

SEQ ID NO: 3518649 - RNA, 22 nt, Pseudomonas aeruginosa PA01
cagcgcucacgcaccucgucga

SEQ ID NO: 3518650 - RNA, 19 nt, Pseudomonas aeruginosa PA01
cagcgcuccuugcgccagg

SEQ ID NO: 3518651 - RNA, 20 nt, Pseudomonas aeruginosa PA01
cagcgcuccuugcgccaggc

SEQ ID NO: 3518652 - RNA, 19 nt, Pseudomonas aeruginosa PA01
cagcgcuccuuucccagcg

SEQ ID NO: 3518653 - RNA, 16 nt, Pseudomonas aeruginosa PA01
cagcgcucguagccgg

SEQ ID NO: 3518654 - RNA, 18 nt, Pseudomonas aeruginosa PA01
cagcgcucguagccggcg

SEQ ID NO: 3518655 - RNA, 19 nt, Pseudomonas aeruginosa PA01
cagcgcucguagccggcgc

SEQ ID NO: 3518656 - RNA, 21 nt, Pseudomonas aeruginosa PA01
cagcgcucguagccggcgcgg

SEQ ID NO: 3518657 - RNA, 23 nt, Pseudomonas aeruginosa PA01
cagcgcucguagccggcgcggcg

SEQ ID NO: 3518658 - RNA, 13 nt, Pseudomonas aeruginosa PA01
cagcgcugaucac

SEQ ID NO: 3518659 - RNA, 16 nt, Pseudomonas aeruginosa PA01
cagcgcugaucacgau

SEQ ID NO: 3518660 - RNA, 21 nt, Pseudomonas aeruginosa PA01
cagcgcugaucacgaucggca

SEQ ID NO: 3518661 - RNA, 24 nt, Pseudomonas aeruginosa PA01
cagcgcuggcagguugcacggccg

SEQ ID NO: 3518662 - RNA, 12 nt, Pseudomonas aeruginosa PA01
cagcgcuggcga

SEQ ID NO: 3518663 - RNA, 17 nt, Pseudomonas aeruginosa PA01
cagcgcuggcgaucacc

SEQ ID NO: 3518664 - RNA, 20 nt, Pseudomonas aeruginosa PA01
cagcgcuggcgaucaccagg

SEQ ID NO: 3518665 - RNA, 15 nt, Pseudomonas aeruginosa PA01
cagcgcuuccaccgc

SEQ ID NO: 3518666 - RNA, 18 nt, Pseudomonas aeruginosa PA01
cagcgcuuccaccgccug

SEQ ID NO: 3518667 - RNA, 19 nt, Pseudomonas aeruginosa PA01
cagcgcuuccucgggcagc

SEQ ID NO: 3518668 - RNA, 16 nt, Pseudomonas aeruginosa PA01
cagcgcuuccuugccc

SEQ ID NO: 3518669 - RNA, 15 nt, Pseudomonas aeruginosa PA01
cagcgcuucggcggc

SEQ ID NO: 3518670 - RNA, 16 nt, Pseudomonas aeruginosa PA01
cagcgcuucggcggcu

SEQ ID NO: 3518671 - RNA, 21 nt, Pseudomonas aeruginosa PA01
cagcgcuucguugcuccugcg

SEQ ID NO: 3518672 - RNA, 18 nt, Pseudomonas aeruginosa PA01
cagcgcuucucggcagcg

SEQ ID NO: 3518673 - RNA, 22 nt, Pseudomonas aeruginosa PA01
cagcgcuugaacgcgcgccuga

SEQ ID NO: 3518674 - RNA, 18 nt, Pseudomonas aeruginosa PA01
cagcgcuugcuggcgcga

SEQ ID NO: 3518675 - RNA, 23 nt, Pseudomonas aeruginosa PA01
cagcgcuuguagcagccgcagga

SEQ ID NO: 3518676 - RNA, 22 nt, Pseudomonas aeruginosa PA01
cagcggaaaugcucgccguccg

SEQ ID NO: 3518677 - RNA, 18 nt, Pseudomonas aeruginosa PA01
cagcggaacgaaggacag

SEQ ID NO: 3518678 - RNA, 20 nt, Pseudomonas aeruginosa PA01
cagcggaacgaaggacaggu

SEQ ID NO: 3518679 - RNA, 20 nt, Pseudomonas aeruginosa PA01
cagcggaacuugcgccgacc

SEQ ID NO: 3518680 - RNA, 19 nt, Pseudomonas aeruginosa PA01
cagcggaagcccagcaggu

SEQ ID NO: 3518681 - RNA, 22 nt, Pseudomonas aeruginosa PA01
cagcggaagcccagcaggucga

SEQ ID NO: 3518682 - RNA, 21 nt, Pseudomonas aeruginosa PA01
cagcggaagcccugcuggcgc

SEQ ID NO: 3518683 - RNA, 17 nt, Pseudomonas aeruginosa PA01
cagcggaaucgcgcccu

SEQ ID NO: 3518684 - RNA, 22 nt, Pseudomonas aeruginosa PA01
cagcggaaugcuuccguaggug

SEQ ID NO: 3518685 - RNA, 17 nt, Pseudomonas aeruginosa PA01
cagcggacaaccgccgu

SEQ ID NO: 3518686 - RNA, 20 nt, Pseudomonas aeruginosa PA01
cagcggacaaccgccguagc

SEQ ID NO: 3518687 - RNA, 17 nt, Pseudomonas aeruginosa PA01
cagcggaccggugagau

SEQ ID NO: 3518688 - RNA, 15 nt, Pseudomonas aeruginosa PA01
cagcggaccgucggg

SEQ ID NO: 3518689 - RNA, 17 nt, Pseudomonas aeruginosa PA01
cagcggaccgucgggca

SEQ ID NO: 3518690 - RNA, 22 nt, Pseudomonas aeruginosa PA01
cagcggaccgucgggcaguucc

SEQ ID NO: 3518691 - RNA, 14 nt, Pseudomonas aeruginosa PA01
cagcggacgcagcg

SEQ ID NO: 3518692 - RNA, 19 nt, Pseudomonas aeruginosa PA01
cagcggaggauucagcagg

SEQ ID NO: 3518693 - RNA, 20 nt, Pseudomonas aeruginosa PA01
cagcggaggauucagcagga

SEQ ID NO: 3518694 - RNA, 22 nt, Pseudomonas aeruginosa PA01
cagcggauauucgacgcgcggc

SEQ ID NO: 3518695 - RNA, 19 nt, Pseudomonas aeruginosa PA01
cagcggauccggguggaga

SEQ ID NO: 3518696 - RNA, 21 nt, Pseudomonas aeruginosa PA01
cagcggauccggguggagagg

SEQ ID NO: 3518697 - RNA, 12 nt, Pseudomonas aeruginosa PA01
cagcggaucggc

SEQ ID NO: 3518698 - RNA, 13 nt, Pseudomonas aeruginosa PA01
cagcggaucggcg

SEQ ID NO: 3518699 - RNA, 16 nt, Pseudomonas aeruginosa PA01
cagcggaugcuggcgg

SEQ ID NO: 3518700 - RNA, 17 nt, Pseudomonas aeruginosa PA01
cagcggaugcuggcgga

SEQ ID NO: 3518701 - RNA, 19 nt, Pseudomonas aeruginosa PA01
cagcggcaaaggcccggcg

SEQ ID NO: 3518702 - RNA, 13 nt, Pseudomonas aeruginosa PA01
cagcggcaccagc

SEQ ID NO: 3518703 - RNA, 22 nt, Pseudomonas aeruginosa PA01
cagcggcaccagcacguugcca

SEQ ID NO: 3518704 - RNA, 23 nt, Pseudomonas aeruginosa PA01
cagcggcaccagcacguugccau

SEQ ID NO: 3518705 - RNA, 12 nt, Pseudomonas aeruginosa PA01
cagcggcacccg

SEQ ID NO: 3518706 - RNA, 17 nt, Pseudomonas aeruginosa PA01
cagcggcacccggcugg

SEQ ID NO: 3518707 - RNA, 18 nt, Pseudomonas aeruginosa PA01
cagcggcacccggcuggg

SEQ ID NO: 3518708 - RNA, 20 nt, Pseudomonas aeruginosa PA01
cagcggcacccggcuggguu

SEQ ID NO: 3518709 - RNA, 22 nt, Pseudomonas aeruginosa PA01
cagcggcacggucauggccagc

SEQ ID NO: 3518710 - RNA, 23 nt, Pseudomonas aeruginosa PA01
cagcggcacggucauggccagcu

SEQ ID NO: 3518711 - RNA, 22 nt, Pseudomonas aeruginosa PA01
cagcggcacuucccgcccccuc

SEQ ID NO: 3518712 - RNA, 22 nt, Pseudomonas aeruginosa PA01
cagcggcagaucggugcgggca

SEQ ID NO: 3518713 - RNA, 20 nt, Pseudomonas aeruginosa PA01
cagcggcagccacucggcca

SEQ ID NO: 3518714 - RNA, 14 nt, Pseudomonas aeruginosa PA01
cagcggcagcgcca

SEQ ID NO: 3518715 - RNA, 16 nt, Pseudomonas aeruginosa PA01
cagcggcagcgccagg

SEQ ID NO: 3518716 - RNA, 17 nt, Pseudomonas aeruginosa PA01
cagcggcagcgccaggu

SEQ ID NO: 3518717 - RNA, 14 nt, Pseudomonas aeruginosa PA01
cagcggcagcggcu

SEQ ID NO: 3518718 - RNA, 13 nt, Pseudomonas aeruginosa PA01
cagcggcagcggu

SEQ ID NO: 3518719 - RNA, 20 nt, Pseudomonas aeruginosa PA01
cagcggcagcgucucggcug

SEQ ID NO: 3518720 - RNA, 16 nt, Pseudomonas aeruginosa PA01
cagcggcagcucggcg

SEQ ID NO: 3518721 - RNA, 17 nt, Pseudomonas aeruginosa PA01
cagcggcagcucggcga

SEQ ID NO: 3518722 - RNA, 22 nt, Pseudomonas aeruginosa PA01
cagcggcaggagcguugcgggc

SEQ ID NO: 3518723 - RNA, 19 nt, Pseudomonas aeruginosa PA01
cagcggcaggcacgcugcc

SEQ ID NO: 3518724 - RNA, 14 nt, Pseudomonas aeruginosa PA01
cagcggcaggccac

SEQ ID NO: 3518725 - RNA, 20 nt, Pseudomonas aeruginosa PA01
cagcggcaggccacggccgc

SEQ ID NO: 3518726 - RNA, 21 nt, Pseudomonas aeruginosa PA01
cagcggcaggccacggccgcu

SEQ ID NO: 3518727 - RNA, 22 nt, Pseudomonas aeruginosa PA01
cagcggcaggccacggccgcug

SEQ ID NO: 3518728 - RNA, 17 nt, Pseudomonas aeruginosa PA01
cagcggcauccgccgcu

SEQ ID NO: 3518729 - RNA, 19 nt, Pseudomonas aeruginosa PA01
cagcggcauccgccgcugg

SEQ ID NO: 3518730 - RNA, 13 nt, Pseudomonas aeruginosa PA01
cagcggcaugccc

SEQ ID NO: 3518731 - RNA, 17 nt, Pseudomonas aeruginosa PA01
cagcggcaugcccugcc

SEQ ID NO: 3518732 - RNA, 18 nt, Pseudomonas aeruginosa PA01
cagcggcaugcccugccg

SEQ ID NO: 3518733 - RNA, 21 nt, Pseudomonas aeruginosa PA01
cagcggcauucgaacggcuca

SEQ ID NO: 3518734 - RNA, 15 nt, Pseudomonas aeruginosa PA01
cagcggcccagcgcc

SEQ ID NO: 3518735 - RNA, 16 nt, Pseudomonas aeruginosa PA01
cagcggcccagcgccc

SEQ ID NO: 3518736 - RNA, 17 nt, Pseudomonas aeruginosa PA01
cagcggcccagcgcccc

SEQ ID NO: 3518737 - RNA, 18 nt, Pseudomonas aeruginosa PA01
cagcggcccagcgccccg

SEQ ID NO: 3518738 - RNA, 12 nt, Pseudomonas aeruginosa PA01
cagcggccccga

SEQ ID NO: 3518739 - RNA, 14 nt, Pseudomonas aeruginosa PA01
cagcggccccgagc

SEQ ID NO: 3518740 - RNA, 21 nt, Pseudomonas aeruginosa PA01
cagcggccccgagcgggccga

SEQ ID NO: 3518741 - RNA, 16 nt, Pseudomonas aeruginosa PA01
cagcggcccgagcagg

SEQ ID NO: 3518742 - RNA, 19 nt, Pseudomonas aeruginosa PA01
cagcggcccgagcaggcug

SEQ ID NO: 3518743 - RNA, 21 nt, Pseudomonas aeruginosa PA01
cagcggcccgagggucgccuu

SEQ ID NO: 3518744 - RNA, 18 nt, Pseudomonas aeruginosa PA01
cagcggcccggcaggcgc

SEQ ID NO: 3518745 - RNA, 13 nt, Pseudomonas aeruginosa PA01
cagcggcccggcg

SEQ ID NO: 3518746 - RNA, 16 nt, Pseudomonas aeruginosa PA01
cagcggccgagcaggc

SEQ ID NO: 3518747 - RNA, 13 nt, Pseudomonas aeruginosa PA01
cagcggccgcgcc

SEQ ID NO: 3518748 - RNA, 13 nt, Pseudomonas aeruginosa PA01
cagcggccuucga

SEQ ID NO: 3518749 - RNA, 14 nt, Pseudomonas aeruginosa PA01
cagcggccuucgac

SEQ ID NO: 3518750 - RNA, 20 nt, Pseudomonas aeruginosa PA01
cagcggccuucgacgaugcg

SEQ ID NO: 3518751 - RNA, 18 nt, Pseudomonas aeruginosa PA01
cagcggcgaacccucggu

SEQ ID NO: 3518752 - RNA, 15 nt, Pseudomonas aeruginosa PA01
cagcggcgacaccgc

SEQ ID NO: 3518753 - RNA, 16 nt, Pseudomonas aeruginosa PA01
cagcggcgacaccgcc

SEQ ID NO: 3518754 - RNA, 17 nt, Pseudomonas aeruginosa PA01
cagcggcgacaccgcca

SEQ ID NO: 3518755 - RNA, 19 nt, Pseudomonas aeruginosa PA01
cagcggcgacaccgccagc

SEQ ID NO: 3518756 - RNA, 23 nt, Pseudomonas aeruginosa PA01
cagcggcgacaccgccagcaccu

SEQ ID NO: 3518757 - RNA, 15 nt, Pseudomonas aeruginosa PA01
cagcggcgagcaggc

SEQ ID NO: 3518758 - RNA, 17 nt, Pseudomonas aeruginosa PA01
cagcggcgagcaggcga

SEQ ID NO: 3518759 - RNA, 13 nt, Pseudomonas aeruginosa PA01
cagcggcgaucgc

SEQ ID NO: 3518760 - RNA, 15 nt, Pseudomonas aeruginosa PA01
cagcggcgaucgccu

SEQ ID NO: 3518761 - RNA, 14 nt, Pseudomonas aeruginosa PA01
cagcggcgccagcu

SEQ ID NO: 3518762 - RNA, 14 nt, Pseudomonas aeruginosa PA01
cagcggcgccgagg

SEQ ID NO: 3518763 - RNA, 15 nt, Pseudomonas aeruginosa PA01
cagcggcgccgaggg

SEQ ID NO: 3518764 - RNA, 13 nt, Pseudomonas aeruginosa PA01
cagcggcgcggcg

SEQ ID NO: 3518765 - RNA, 23 nt, Pseudomonas aeruginosa PA01
cagcggcgcggcguaccagccgc

SEQ ID NO: 3518766 - RNA, 14 nt, Pseudomonas aeruginosa PA01
cagcggcgcgucga

SEQ ID NO: 3518767 - RNA, 22 nt, Pseudomonas aeruginosa PA01
cagcggcgcgucgaccacgaag

SEQ ID NO: 3518768 - RNA, 14 nt, Pseudomonas aeruginosa PA01
cagcggcgcgucgc

SEQ ID NO: 3518769 - RNA, 15 nt, Pseudomonas aeruginosa PA01
cagcggcgcgucgcu

SEQ ID NO: 3518770 - RNA, 22 nt, Pseudomonas aeruginosa PA01
cagcggcgcuugcgggcgcgcc

SEQ ID NO: 3518771 - RNA, 17 nt, Pseudomonas aeruginosa PA01
cagcggcggcgccggca

SEQ ID NO: 3518772 - RNA, 20 nt, Pseudomonas aeruginosa PA01
cagcggcgguagcuccaggc

SEQ ID NO: 3518773 - RNA, 12 nt, Pseudomonas aeruginosa PA01
cagcggcggucc

SEQ ID NO: 3518774 - RNA, 21 nt, Pseudomonas aeruginosa PA01
cagcggcguauccucggccau

SEQ ID NO: 3518775 - RNA, 20 nt, Pseudomonas aeruginosa PA01
cagcggcguaugcgccucca

SEQ ID NO: 3518776 - RNA, 18 nt, Pseudomonas aeruginosa PA01
cagcggcucacgccccag

SEQ ID NO: 3518777 - RNA, 20 nt, Pseudomonas aeruginosa PA01
cagcggcucacgccccagcg

SEQ ID NO: 3518778 - RNA, 20 nt, Pseudomonas aeruginosa PA01
cagcggcuccucggccuggg

SEQ ID NO: 3518779 - RNA, 21 nt, Pseudomonas aeruginosa PA01
cagcggcuccucggccugggc

SEQ ID NO: 3518780 - RNA, 22 nt, Pseudomonas aeruginosa PA01
cagcggcuccucggccugggcg

SEQ ID NO: 3518781 - RNA, 21 nt, Pseudomonas aeruginosa PA01
cagcggcucgucaucguccag

SEQ ID NO: 3518782 - RNA, 15 nt, Pseudomonas aeruginosa PA01
cagcggcugcccggg

SEQ ID NO: 3518783 - RNA, 15 nt, Pseudomonas aeruginosa PA01
cagcggcuggcccuc

SEQ ID NO: 3518784 - RNA, 19 nt, Pseudomonas aeruginosa PA01
cagcggcuggcccucggcg

SEQ ID NO: 3518785 - RNA, 23 nt, Pseudomonas aeruginosa PA01
cagcggcuggcccucggcguuca

SEQ ID NO: 3518786 - RNA, 13 nt, Pseudomonas aeruginosa PA01
cagcggcuggccg

SEQ ID NO: 3518787 - RNA, 19 nt, Pseudomonas aeruginosa PA01
cagcggcuggcgaugcuga

SEQ ID NO: 3518788 - RNA, 23 nt, Pseudomonas aeruginosa PA01
cagcggcuggcgaugcugaccca

SEQ ID NO: 3518789 - RNA, 13 nt, Pseudomonas aeruginosa PA01
cagcggcuggcgc

SEQ ID NO: 3518790 - RNA, 14 nt, Pseudomonas aeruginosa PA01
cagcggcuggcgcu

SEQ ID NO: 3518791 - RNA, 15 nt, Pseudomonas aeruginosa PA01
cagcggcuggcgggc

SEQ ID NO: 3518792 - RNA, 23 nt, Pseudomonas aeruginosa PA01
cagcggcuggcugaagccgggca

SEQ ID NO: 3518793 - RNA, 17 nt, Pseudomonas aeruginosa PA01
cagcggcuuguccuggc

SEQ ID NO: 3518794 - RNA, 18 nt, Pseudomonas aeruginosa PA01
cagcggcuuguccuggcg

SEQ ID NO: 3518795 - RNA, 20 nt, Pseudomonas aeruginosa PA01
cagcggcuuguccuggcgca

SEQ ID NO: 3518796 - RNA, 17 nt, Pseudomonas aeruginosa PA01
cagcgggaaggucggca

SEQ ID NO: 3518797 - RNA, 22 nt, Pseudomonas aeruginosa PA01
cagcgggacagcuugccgucca

SEQ ID NO: 3518798 - RNA, 17 nt, Pseudomonas aeruginosa PA01
cagcgggaugugcacca

SEQ ID NO: 3518799 - RNA, 20 nt, Pseudomonas aeruginosa PA01
cagcgggaugugcaccagca

SEQ ID NO: 3518800 - RNA, 22 nt, Pseudomonas aeruginosa PA01
cagcgggaugugcaccagcaac

SEQ ID NO: 3518801 - RNA, 23 nt, Pseudomonas aeruginosa PA01
cagcgggcauauggaucggccuc

SEQ ID NO: 3518802 - RNA, 13 nt, Pseudomonas aeruginosa PA01
cagcgggccaggc

SEQ ID NO: 3518803 - RNA, 18 nt, Pseudomonas aeruginosa PA01
cagcgggccaggcgguau

SEQ ID NO: 3518804 - RNA, 14 nt, Pseudomonas aeruginosa PA01
cagcgggcccaugg

SEQ ID NO: 3518805 - RNA, 19 nt, Pseudomonas aeruginosa PA01
cagcgggcccauggcggua

SEQ ID NO: 3518806 - RNA, 15 nt, Pseudomonas aeruginosa PA01
cagcgggccgauccg

SEQ ID NO: 3518807 - RNA, 18 nt, Pseudomonas aeruginosa PA01
cagcgggccgauccgcga

SEQ ID NO: 3518808 - RNA, 13 nt, Pseudomonas aeruginosa PA01
cagcgggccgggg

SEQ ID NO: 3518809 - RNA, 14 nt, Pseudomonas aeruginosa PA01
cagcgggcgccgcc

SEQ ID NO: 3518810 - RNA, 13 nt, Pseudomonas aeruginosa PA01
cagcgggcgcggu

SEQ ID NO: 3518811 - RNA, 14 nt, Pseudomonas aeruginosa PA01
cagcgggcgcggua

SEQ ID NO: 3518812 - RNA, 22 nt, Pseudomonas aeruginosa PA01
cagcgggcgcuugaagccggcg

SEQ ID NO: 3518813 - RNA, 14 nt, Pseudomonas aeruginosa PA01
cagcgggcggauca

SEQ ID NO: 3518814 - RNA, 20 nt, Pseudomonas aeruginosa PA01
cagcgggcggucgcggaccu

SEQ ID NO: 3518815 - RNA, 23 nt, Pseudomonas aeruginosa PA01
cagcgggcggucgcggaccucca

SEQ ID NO: 3518816 - RNA, 19 nt, Pseudomonas aeruginosa PA01
cagcgggcguccggcgagc

SEQ ID NO: 3518817 - RNA, 15 nt, Pseudomonas aeruginosa PA01
cagcgggcugaagug

SEQ ID NO: 3518818 - RNA, 16 nt, Pseudomonas aeruginosa PA01
cagcgggguggcgcgg

SEQ ID NO: 3518819 - RNA, 17 nt, Pseudomonas aeruginosa PA01
cagcgggguggcgcgga

SEQ ID NO: 3518820 - RNA, 18 nt, Pseudomonas aeruginosa PA01
cagcggguagcugcuggg

SEQ ID NO: 3518821 - RNA, 14 nt, Pseudomonas aeruginosa PA01
cagcgggucgauca

SEQ ID NO: 3518822 - RNA, 20 nt, Pseudomonas aeruginosa PA01
cagcgggucgaucaggcgca

SEQ ID NO: 3518823 - RNA, 15 nt, Pseudomonas aeruginosa PA01
cagcgggucgcggcu

SEQ ID NO: 3518824 - RNA, 20 nt, Pseudomonas aeruginosa PA01
cagcgggucgcggcuggccg

SEQ ID NO: 3518825 - RNA, 19 nt, Pseudomonas aeruginosa PA01
cagcgggucgucgaagcgc

SEQ ID NO: 3518826 - RNA, 20 nt, Pseudomonas aeruginosa PA01
cagcgggucgucgaagcgca

SEQ ID NO: 3518827 - RNA, 16 nt, Pseudomonas aeruginosa PA01
cagcgggugccgaaga

SEQ ID NO: 3518828 - RNA, 17 nt, Pseudomonas aeruginosa PA01
cagcgguacaggcggau

SEQ ID NO: 3518829 - RNA, 18 nt, Pseudomonas aeruginosa PA01
cagcgguaccagcagcgc

SEQ ID NO: 3518830 - RNA, 20 nt, Pseudomonas aeruginosa PA01
cagcgguaccagcagcgccg

SEQ ID NO: 3518831 - RNA, 17 nt, Pseudomonas aeruginosa PA01
cagcgguacccgccggc

SEQ ID NO: 3518832 - RNA, 20 nt, Pseudomonas aeruginosa PA01
cagcgguacccgccggccau

SEQ ID NO: 3518833 - RNA, 17 nt, Pseudomonas aeruginosa PA01
cagcgguacguagcgcg

SEQ ID NO: 3518834 - RNA, 18 nt, Pseudomonas aeruginosa PA01
cagcgguacguagcgcgg

SEQ ID NO: 3518835 - RNA, 19 nt, Pseudomonas aeruginosa PA01
cagcgguacguagcgcggu

SEQ ID NO: 3518836 - RNA, 18 nt, Pseudomonas aeruginosa PA01
cagcgguacuaucccggu

SEQ ID NO: 3518837 - RNA, 23 nt, Pseudomonas aeruginosa PA01
cagcgguacuaucccggucgggu

SEQ ID NO: 3518838 - RNA, 16 nt, Pseudomonas aeruginosa PA01
cagcgguagaacaggc

SEQ ID NO: 3518839 - RNA, 18 nt, Pseudomonas aeruginosa PA01
cagcgguagaacaggcga

SEQ ID NO: 3518840 - RNA, 15 nt, Pseudomonas aeruginosa PA01
cagcgguaggcgcgu

SEQ ID NO: 3518841 - RNA, 14 nt, Pseudomonas aeruginosa PA01
cagcgguaguucag

SEQ ID NO: 3518842 - RNA, 15 nt, Pseudomonas aeruginosa PA01
cagcgguaguucagu

SEQ ID NO: 3518843 - RNA, 19 nt, Pseudomonas aeruginosa PA01
cagcgguaugccgcaggca

SEQ ID NO: 3518844 - RNA, 14 nt, Pseudomonas aeruginosa PA01
cagcggucgccggu

SEQ ID NO: 3518845 - RNA, 17 nt, Pseudomonas aeruginosa PA01
cagcggugugcucaggc

SEQ ID NO: 3518846 - RNA, 18 nt, Pseudomonas aeruginosa PA01
cagcggugugcucaggcg

SEQ ID NO: 3518847 - RNA, 16 nt, Pseudomonas aeruginosa PA01
cagcgguucaggucga

SEQ ID NO: 3518848 - RNA, 15 nt, Pseudomonas aeruginosa PA01
cagcgguucgcccgc

SEQ ID NO: 3518849 - RNA, 20 nt, Pseudomonas aeruginosa PA01
cagcgguucgcccgcgggca

SEQ ID NO: 3518850 - RNA, 18 nt, Pseudomonas aeruginosa PA01
cagcgguugagcagggcg

SEQ ID NO: 3518851 - RNA, 14 nt, Pseudomonas aeruginosa PA01
cagcgucaccgcgu

SEQ ID NO: 3518852 - RNA, 16 nt, Pseudomonas aeruginosa PA01
cagcguccgaacgcgc

SEQ ID NO: 3518853 - RNA, 19 nt, Pseudomonas aeruginosa PA01
cagcguccgaacgcgcuga

SEQ ID NO: 3518854 - RNA, 13 nt, Pseudomonas aeruginosa PA01
cagcguccucagc

SEQ ID NO: 3518855 - RNA, 20 nt, Pseudomonas aeruginosa PA01
cagcguccucagccucaccc

SEQ ID NO: 3518856 - RNA, 21 nt, Pseudomonas aeruginosa PA01
cagcguccugcccuccugcuc

SEQ ID NO: 3518857 - RNA, 23 nt, Pseudomonas aeruginosa PA01
cagcguccugcccuccugcucga

SEQ ID NO: 3518858 - RNA, 19 nt, Pseudomonas aeruginosa PA01
cagcguccuucggcgcucu

SEQ ID NO: 3518859 - RNA, 16 nt, Pseudomonas aeruginosa PA01
cagcgucgacgccgag

SEQ ID NO: 3518860 - RNA, 17 nt, Pseudomonas aeruginosa PA01
cagcgucgacgccgagc

SEQ ID NO: 3518861 - RNA, 18 nt, Pseudomonas aeruginosa PA01
cagcgucgacgccgagcu

SEQ ID NO: 3518862 - RNA, 20 nt, Pseudomonas aeruginosa PA01
cagcgucgacgccgagcuga

SEQ ID NO: 3518863 - RNA, 18 nt, Pseudomonas aeruginosa PA01
cagcgucgagcuggcgca

SEQ ID NO: 3518864 - RNA, 15 nt, Pseudomonas aeruginosa PA01
cagcgucgccaacgc

SEQ ID NO: 3518865 - RNA, 18 nt, Pseudomonas aeruginosa PA01
cagcgucgccaacgcgcc

SEQ ID NO: 3518866 - RNA, 14 nt, Pseudomonas aeruginosa PA01
cagcgucgccaggc

SEQ ID NO: 3518867 - RNA, 15 nt, Pseudomonas aeruginosa PA01
cagcgucgccaggcc

SEQ ID NO: 3518868 - RNA, 17 nt, Pseudomonas aeruginosa PA01
cagcgucgccaggccgu

SEQ ID NO: 3518869 - RNA, 12 nt, Pseudomonas aeruginosa PA01
cagcgucgccgc

SEQ ID NO: 3518870 - RNA, 15 nt, Pseudomonas aeruginosa PA01
cagcgucgccgggcg

SEQ ID NO: 3518871 - RNA, 23 nt, Pseudomonas aeruginosa PA01
cagcgucgcgucggccuggcgca

SEQ ID NO: 3518872 - RNA, 14 nt, Pseudomonas aeruginosa PA01
cagcgucucggcug

SEQ ID NO: 3518873 - RNA, 17 nt, Pseudomonas aeruginosa PA01
cagcgucucggcugccg

SEQ ID NO: 3518874 - RNA, 24 nt, Pseudomonas aeruginosa PA01
cagcgucucggcugccgccagcuc

SEQ ID NO: 3518875 - RNA, 19 nt, Pseudomonas aeruginosa PA01
cagcgucugccgcuggcgg

SEQ ID NO: 3518876 - RNA, 20 nt, Pseudomonas aeruginosa PA01
cagcgucugggugaccagca

SEQ ID NO: 3518877 - RNA, 18 nt, Pseudomonas aeruginosa PA01
cagcgugaagaccugguc

SEQ ID NO: 3518878 - RNA, 19 nt, Pseudomonas aeruginosa PA01
cagcgugaagaccuggucc

SEQ ID NO: 3518879 - RNA, 13 nt, Pseudomonas aeruginosa PA01
cagcgugcccgcu

SEQ ID NO: 3518880 - RNA, 14 nt, Pseudomonas aeruginosa PA01
cagcgugcccgcug

SEQ ID NO: 3518881 - RNA, 16 nt, Pseudomonas aeruginosa PA01
cagcgugcggcccuug

SEQ ID NO: 3518882 - RNA, 15 nt, Pseudomonas aeruginosa PA01
cagcguggccagcgc

SEQ ID NO: 3518883 - RNA, 18 nt, Pseudomonas aeruginosa PA01
cagcguggccagcgccca

SEQ ID NO: 3518884 - RNA, 18 nt, Pseudomonas aeruginosa PA01
cagcguggcgcgcaucgg

SEQ ID NO: 3518885 - RNA, 12 nt, Pseudomonas aeruginosa PA01
cagcguggcgga

SEQ ID NO: 3518886 - RNA, 23 nt, Pseudomonas aeruginosa PA01
cagcgugguaccgcugcgugcca

SEQ ID NO: 3518887 - RNA, 22 nt, Pseudomonas aeruginosa PA01
cagcguguggcgaaacuccagc

SEQ ID NO: 3518888 - RNA, 23 nt, Pseudomonas aeruginosa PA01
cagcguguggcgaaacuccagca

SEQ ID NO: 3518889 - RNA, 13 nt, Pseudomonas aeruginosa PA01
cagcguuccagcg

SEQ ID NO: 3518890 - RNA, 14 nt, Pseudomonas aeruginosa PA01
cagcguuccagcgc

SEQ ID NO: 3518891 - RNA, 17 nt, Pseudomonas aeruginosa PA01
cagcguuccagcgcugg

SEQ ID NO: 3518892 - RNA, 14 nt, Pseudomonas aeruginosa PA01
cagcguucggcgcu

SEQ ID NO: 3518893 - RNA, 15 nt, Pseudomonas aeruginosa PA01
cagcguucggcgcug

SEQ ID NO: 3518894 - RNA, 16 nt, Pseudomonas aeruginosa PA01
cagcguucggcgcugg

SEQ ID NO: 3518895 - RNA, 19 nt, Pseudomonas aeruginosa PA01
cagcguuguccucggcggc

SEQ ID NO: 3518896 - RNA, 20 nt, Pseudomonas aeruginosa PA01
cagcguuucgaagccgccgc

SEQ ID NO: 3518897 - RNA, 14 nt, Pseudomonas aeruginosa PA01
cagcucaccccagg

SEQ ID NO: 3518898 - RNA, 15 nt, Pseudomonas aeruginosa PA01
cagcucagcuccagg

SEQ ID NO: 3518899 - RNA, 19 nt, Pseudomonas aeruginosa PA01
cagcucagcuccaggccgc

SEQ ID NO: 3518900 - RNA, 20 nt, Pseudomonas aeruginosa PA01
cagcucauggagcaacagcg

SEQ ID NO: 3518901 - RNA, 14 nt, Pseudomonas aeruginosa PA01
cagcuccaccaggc

SEQ ID NO: 3518902 - RNA, 21 nt, Pseudomonas aeruginosa PA01
cagcuccaccgauggcgcgcu

SEQ ID NO: 3518903 - RNA, 17 nt, Pseudomonas aeruginosa PA01
cagcuccacgucggccc

SEQ ID NO: 3518904 - RNA, 14 nt, Pseudomonas aeruginosa PA01
cagcuccagcaccg

SEQ ID NO: 3518905 - RNA, 19 nt, Pseudomonas aeruginosa PA01
cagcuccagcaccggcggc

SEQ ID NO: 3518906 - RNA, 12 nt, Pseudomonas aeruginosa PA01
cagcuccagcag

SEQ ID NO: 3518907 - RNA, 17 nt, Pseudomonas aeruginosa PA01
cagcuccagcagucgca

SEQ ID NO: 3518908 - RNA, 17 nt, Pseudomonas aeruginosa PA01
cagcuccagcgcccagg

SEQ ID NO: 3518909 - RNA, 18 nt, Pseudomonas aeruginosa PA01
cagcuccagcgcccaggu

SEQ ID NO: 3518910 - RNA, 20 nt, Pseudomonas aeruginosa PA01
cagcuccagcgcccaggugc

SEQ ID NO: 3518911 - RNA, 12 nt, Pseudomonas aeruginosa PA01
cagcuccagcgg

SEQ ID NO: 3518912 - RNA, 22 nt, Pseudomonas aeruginosa PA01
cagcuccagcggaaucgcgccc

SEQ ID NO: 3518913 - RNA, 17 nt, Pseudomonas aeruginosa PA01
cagcuccaggccgcggg

SEQ ID NO: 3518914 - RNA, 18 nt, Pseudomonas aeruginosa PA01
cagcuccaggccgcgggu

SEQ ID NO: 3518915 - RNA, 19 nt, Pseudomonas aeruginosa PA01
cagcuccaggccgcggguc

SEQ ID NO: 3518916 - RNA, 18 nt, Pseudomonas aeruginosa PA01
cagcuccauguccgaacg

SEQ ID NO: 3518917 - RNA, 22 nt, Pseudomonas aeruginosa PA01
cagcucccaggcgucgccgacu

SEQ ID NO: 3518918 - RNA, 22 nt, Pseudomonas aeruginosa PA01
cagcucccccacguacuccagc

SEQ ID NO: 3518919 - RNA, 14 nt, Pseudomonas aeruginosa PA01
cagcuccccguccc

SEQ ID NO: 3518920 - RNA, 17 nt, Pseudomonas aeruginosa PA01
cagcucccuugccgccg

SEQ ID NO: 3518921 - RNA, 18 nt, Pseudomonas aeruginosa PA01
cagcucccuugccgccgg

SEQ ID NO: 3518922 - RNA, 16 nt, Pseudomonas aeruginosa PA01
cagcuccgagccacgg

SEQ ID NO: 3518923 - RNA, 13 nt, Pseudomonas aeruginosa PA01
cagcuccgccucg

SEQ ID NO: 3518924 - RNA, 14 nt, Pseudomonas aeruginosa PA01
cagcuccgccugac

SEQ ID NO: 3518925 - RNA, 16 nt, Pseudomonas aeruginosa PA01
cagcuccggcagcagg

SEQ ID NO: 3518926 - RNA, 21 nt, Pseudomonas aeruginosa PA01
cagcuccggcagcagggucag

SEQ ID NO: 3518927 - RNA, 23 nt, Pseudomonas aeruginosa PA01
cagcuccggcagcagggucagca

SEQ ID NO: 3518928 - RNA, 11 nt, Pseudomonas aeruginosa PA01
cagcuccggcg

SEQ ID NO: 3518929 - RNA, 13 nt, Pseudomonas aeruginosa PA01
cagcuccggcggg

SEQ ID NO: 3518930 - RNA, 17 nt, Pseudomonas aeruginosa PA01
cagcuccgggcuggcca

SEQ ID NO: 3518931 - RNA, 17 nt, Pseudomonas aeruginosa PA01
cagcuccgucuguucgg

SEQ ID NO: 3518932 - RNA, 20 nt, Pseudomonas aeruginosa PA01
cagcuccgucuguucggcca

SEQ ID NO: 3518933 - RNA, 23 nt, Pseudomonas aeruginosa PA01
cagcuccgucuguucggccaggg

SEQ ID NO: 3518934 - RNA, 12 nt, Pseudomonas aeruginosa PA01
cagcuccuccag

SEQ ID NO: 3518935 - RNA, 13 nt, Pseudomonas aeruginosa PA01
cagcuccuccagc

SEQ ID NO: 3518936 - RNA, 16 nt, Pseudomonas aeruginosa PA01
cagcuccuccagcagg

SEQ ID NO: 3518937 - RNA, 14 nt, Pseudomonas aeruginosa PA01
cagcuccuccagcg

SEQ ID NO: 3518938 - RNA, 13 nt, Pseudomonas aeruginosa PA01
cagcuccuggucg

SEQ ID NO: 3518939 - RNA, 15 nt, Pseudomonas aeruginosa PA01
cagcuccuugcgcuc

SEQ ID NO: 3518940 - RNA, 23 nt, Pseudomonas aeruginosa PA01
cagcuccuugcgcuccuuggcug

SEQ ID NO: 3518941 - RNA, 24 nt, Pseudomonas aeruginosa PA01
cagcuccuugcucucgcgcacgcu

SEQ ID NO: 3518942 - RNA, 15 nt, Pseudomonas aeruginosa PA01
cagcucgaacagcac

SEQ ID NO: 3518943 - RNA, 14 nt, Pseudomonas aeruginosa PA01
cagcucgacccgcc

SEQ ID NO: 3518944 - RNA, 18 nt, Pseudomonas aeruginosa PA01
cagcucgacccgcccgcc

SEQ ID NO: 3518945 - RNA, 12 nt, Pseudomonas aeruginosa PA01
cagcucgaccuu

SEQ ID NO: 3518946 - RNA, 16 nt, Pseudomonas aeruginosa PA01
cagcucgaccuugccc

SEQ ID NO: 3518947 - RNA, 13 nt, Pseudomonas aeruginosa PA01
cagcucgaggcca

SEQ ID NO: 3518948 - RNA, 14 nt, Pseudomonas aeruginosa PA01
cagcucgaggccag

SEQ ID NO: 3518949 - RNA, 13 nt, Pseudomonas aeruginosa PA01
cagcucgaucagc

SEQ ID NO: 3518950 - RNA, 17 nt, Pseudomonas aeruginosa PA01
cagcucgaucagcccgc

SEQ ID NO: 3518951 - RNA, 18 nt, Pseudomonas aeruginosa PA01
cagcucgaucagcccgcc

SEQ ID NO: 3518952 - RNA, 19 nt, Pseudomonas aeruginosa PA01
cagcucgaucagcccgcca

SEQ ID NO: 3518953 - RNA, 19 nt, Pseudomonas aeruginosa PA01
cagcucgaucucauggucg

SEQ ID NO: 3518954 - RNA, 22 nt, Pseudomonas aeruginosa PA01
cagcucgaucucauggucgggc

SEQ ID NO: 3518955 - RNA, 13 nt, Pseudomonas aeruginosa PA01
cagcucgcccgcc

SEQ ID NO: 3518956 - RNA, 15 nt, Pseudomonas aeruginosa PA01
cagcucgcccgccuc

SEQ ID NO: 3518957 - RNA, 16 nt, Pseudomonas aeruginosa PA01
cagcucgcccgccucg

SEQ ID NO: 3518958 - RNA, 16 nt, Pseudomonas aeruginosa PA01
cagcucgccgcgcucc

SEQ ID NO: 3518959 - RNA, 14 nt, Pseudomonas aeruginosa PA01
cagcucgccggcgu

SEQ ID NO: 3518960 - RNA, 20 nt, Pseudomonas aeruginosa PA01
cagcucgcgcaaccagccgg

SEQ ID NO: 3518961 - RNA, 19 nt, Pseudomonas aeruginosa PA01
cagcucgcgggacagcuug

SEQ ID NO: 3518962 - RNA, 23 nt, Pseudomonas aeruginosa PA01
cagcucgcuaugcagcagguagu

SEQ ID NO: 3518963 - RNA, 17 nt, Pseudomonas aeruginosa PA01
cagcucgcuguccagca

SEQ ID NO: 3518964 - RNA, 15 nt, Pseudomonas aeruginosa PA01
cagcucgcugucgcc

SEQ ID NO: 3518965 - RNA, 20 nt, Pseudomonas aeruginosa PA01
cagcucgcugucgccgagca

SEQ ID NO: 3518966 - RNA, 20 nt, Pseudomonas aeruginosa PA01
cagcucggacaagggccaga

SEQ ID NO: 3518967 - RNA, 21 nt, Pseudomonas aeruginosa PA01
cagcucggacaagggccagag

SEQ ID NO: 3518968 - RNA, 22 nt, Pseudomonas aeruginosa PA01
cagcucggacaagggccagagc

SEQ ID NO: 3518969 - RNA, 19 nt, Pseudomonas aeruginosa PA01
cagcucggcacgcagcagc

SEQ ID NO: 3518970 - RNA, 23 nt, Pseudomonas aeruginosa PA01
cagcucggccaucagcgccaggg

SEQ ID NO: 3518971 - RNA, 23 nt, Pseudomonas aeruginosa PA01
cagcucggccgagggcagccuca

SEQ ID NO: 3518972 - RNA, 24 nt, Pseudomonas aeruginosa PA01
cagcucggccggcaggcugugcca

SEQ ID NO: 3518973 - RNA, 21 nt, Pseudomonas aeruginosa PA01
cagcucggccugguccggcac

SEQ ID NO: 3518974 - RNA, 22 nt, Pseudomonas aeruginosa PA01
cagcucggcgaguaaccaccgc

SEQ ID NO: 3518975 - RNA, 23 nt, Pseudomonas aeruginosa PA01
cagcucggcgaguaaccaccgcu

SEQ ID NO: 3518976 - RNA, 15 nt, Pseudomonas aeruginosa PA01
cagcucggcgauccg

SEQ ID NO: 3518977 - RNA, 18 nt, Pseudomonas aeruginosa PA01
cagcucggcgauccgcgc

SEQ ID NO: 3518978 - RNA, 19 nt, Pseudomonas aeruginosa PA01
cagcucggcgaugccgccg

SEQ ID NO: 3518979 - RNA, 20 nt, Pseudomonas aeruginosa PA01
cagcucggcgaugccgccgg

SEQ ID NO: 3518980 - RNA, 21 nt, Pseudomonas aeruginosa PA01
cagcucggcgaugccgccggg

SEQ ID NO: 3518981 - RNA, 22 nt, Pseudomonas aeruginosa PA01
cagcucggcgaugccgccgggc

SEQ ID NO: 3518982 - RNA, 15 nt, Pseudomonas aeruginosa PA01
cagcucggcgcccug

SEQ ID NO: 3518983 - RNA, 17 nt, Pseudomonas aeruginosa PA01
cagcucggcgcccuggc

SEQ ID NO: 3518984 - RNA, 21 nt, Pseudomonas aeruginosa PA01
cagcucggcgcccuggccgcc

SEQ ID NO: 3518985 - RNA, 18 nt, Pseudomonas aeruginosa PA01
cagcucggcgggacggcg

SEQ ID NO: 3518986 - RNA, 19 nt, Pseudomonas aeruginosa PA01
cagcucggcguagcgcugg

SEQ ID NO: 3518987 - RNA, 16 nt, Pseudomonas aeruginosa PA01
cagcucggucagcggc

SEQ ID NO: 3518988 - RNA, 21 nt, Pseudomonas aeruginosa PA01
cagcucggucucgaucggccc

SEQ ID NO: 3518989 - RNA, 19 nt, Pseudomonas aeruginosa PA01
cagcucggugagcaggcgc

SEQ ID NO: 3518990 - RNA, 17 nt, Pseudomonas aeruginosa PA01
cagcucggugaggaacu

SEQ ID NO: 3518991 - RNA, 20 nt, Pseudomonas aeruginosa PA01
cagcucguccaggcaagcgc

SEQ ID NO: 3518992 - RNA, 17 nt, Pseudomonas aeruginosa PA01
cagcucgucgagcugcu

SEQ ID NO: 3518993 - RNA, 21 nt, Pseudomonas aeruginosa PA01
cagcucgucgagcugcucggc

SEQ ID NO: 3518994 - RNA, 23 nt, Pseudomonas aeruginosa PA01
cagcucgucgagcugcucggcgg

SEQ ID NO: 3518995 - RNA, 14 nt, Pseudomonas aeruginosa PA01
cagcucgucgauga

SEQ ID NO: 3518996 - RNA, 19 nt, Pseudomonas aeruginosa PA01
cagcucgucgcccuucagg

SEQ ID NO: 3518997 - RNA, 15 nt, Pseudomonas aeruginosa PA01
cagcucguggcuggc

SEQ ID NO: 3518998 - RNA, 22 nt, Pseudomonas aeruginosa PA01
cagcucguggcuggcgccgcgg

SEQ ID NO: 3518999 - RNA, 23 nt, Pseudomonas aeruginosa PA01
cagcucguucgcccagaccugca

SEQ ID NO: 3519000 - RNA, 20 nt, Pseudomonas aeruginosa PA01
cagcucguugcacagcgccc

SEQ ID NO: 3519001 - RNA, 21 nt, Pseudomonas aeruginosa PA01
cagcucguugcacagcgccca

SEQ ID NO: 3519002 - RNA, 16 nt, Pseudomonas aeruginosa PA01
cagcucguugcccggc

SEQ ID NO: 3519003 - RNA, 23 nt, Pseudomonas aeruginosa PA01
cagcucguugcccggcuugccgu

SEQ ID NO: 3519004 - RNA, 21 nt, Pseudomonas aeruginosa PA01
cagcucguuggccaccugcau

SEQ ID NO: 3519005 - RNA, 23 nt, Pseudomonas aeruginosa PA01
cagcucguuggccaccugcauca

SEQ ID NO: 3519006 - RNA, 18 nt, Pseudomonas aeruginosa PA01
cagcucuaccgagaucac

SEQ ID NO: 3519007 - RNA, 21 nt, Pseudomonas aeruginosa PA01
cagcucuaccgagaucaccuu

SEQ ID NO: 3519008 - RNA, 15 nt, Pseudomonas aeruginosa PA01
cagcucucccgaggc

SEQ ID NO: 3519009 - RNA, 15 nt, Pseudomonas aeruginosa PA01
cagcucugcgacugg

SEQ ID NO: 3519010 - RNA, 14 nt, Pseudomonas aeruginosa PA01
cagcucugcgauca

SEQ ID NO: 3519011 - RNA, 15 nt, Pseudomonas aeruginosa PA01
cagcucuggccgucc

SEQ ID NO: 3519012 - RNA, 14 nt, Pseudomonas aeruginosa PA01
cagcugcaccgcgc

SEQ ID NO: 3519013 - RNA, 15 nt, Pseudomonas aeruginosa PA01
cagcugcaccgcgcg

SEQ ID NO: 3519014 - RNA, 18 nt, Pseudomonas aeruginosa PA01
cagcugcaccgcgcggau

SEQ ID NO: 3519015 - RNA, 13 nt, Pseudomonas aeruginosa PA01
cagcugccagccc

SEQ ID NO: 3519016 - RNA, 14 nt, Pseudomonas aeruginosa PA01
cagcugccagcccc

SEQ ID NO: 3519017 - RNA, 17 nt, Pseudomonas aeruginosa PA01
cagcugccagccccgcu

SEQ ID NO: 3519018 - RNA, 22 nt, Pseudomonas aeruginosa PA01
cagcugccagccccgcucguca

SEQ ID NO: 3519019 - RNA, 23 nt, Pseudomonas aeruginosa PA01
cagcugccagccccgcucgucau

SEQ ID NO: 3519020 - RNA, 15 nt, Pseudomonas aeruginosa PA01
cagcugccagugcuc

SEQ ID NO: 3519021 - RNA, 23 nt, Pseudomonas aeruginosa PA01
cagcugcgccugcagcucgguga

SEQ ID NO: 3519022 - RNA, 13 nt, Pseudomonas aeruginosa PA01
cagcugcggcggc

SEQ ID NO: 3519023 - RNA, 14 nt, Pseudomonas aeruginosa PA01
cagcugcggcggca

SEQ ID NO: 3519024 - RNA, 16 nt, Pseudomonas aeruginosa PA01
cagcugcggcggcacc

SEQ ID NO: 3519025 - RNA, 21 nt, Pseudomonas aeruginosa PA01
cagcuggauagaguacucggc

SEQ ID NO: 3519026 - RNA, 24 nt, Pseudomonas aeruginosa PA01
cagcuggauccgugccaggcgcuc

SEQ ID NO: 3519027 - RNA, 14 nt, Pseudomonas aeruginosa PA01
cagcuggcgcgccu

SEQ ID NO: 3519028 - RNA, 15 nt, Pseudomonas aeruginosa PA01
cagcuggcgcgucgc

SEQ ID NO: 3519029 - RNA, 22 nt, Pseudomonas aeruginosa PA01
cagcuggcgcgucgcugccgcc

SEQ ID NO: 3519030 - RNA, 13 nt, Pseudomonas aeruginosa PA01
cagcugguuccag

SEQ ID NO: 3519031 - RNA, 21 nt, Pseudomonas aeruginosa PA01
cagcuucagccgaccguccgc

SEQ ID NO: 3519032 - RNA, 17 nt, Pseudomonas aeruginosa PA01
cagcuuccaggcgcgcu

SEQ ID NO: 3519033 - RNA, 13 nt, Pseudomonas aeruginosa PA01
cagcuucgccgcc

SEQ ID NO: 3519034 - RNA, 18 nt, Pseudomonas aeruginosa PA01
cagcuucgccgcccugga

SEQ ID NO: 3519035 - RNA, 16 nt, Pseudomonas aeruginosa PA01
cagcuucuccagcagg

SEQ ID NO: 3519036 - RNA, 19 nt, Pseudomonas aeruginosa PA01
cagcuucuccagcaggguc

SEQ ID NO: 3519037 - RNA, 23 nt, Pseudomonas aeruginosa PA01
cagcuucucuuucaccuggucgc

SEQ ID NO: 3519038 - RNA, 20 nt, Pseudomonas aeruginosa PA01
cagcuugaaccgcgagaccc

SEQ ID NO: 3519039 - RNA, 23 nt, Pseudomonas aeruginosa PA01
cagcuugauguaggacaggccga

SEQ ID NO: 3519040 - RNA, 22 nt, Pseudomonas aeruginosa PA01
cagcuugccgcaggucuugucg

SEQ ID NO: 3519041 - RNA, 15 nt, Pseudomonas aeruginosa PA01
cagcuugccgcugcg

SEQ ID NO: 3519042 - RNA, 13 nt, Pseudomonas aeruginosa PA01
cagcuugccguug

SEQ ID NO: 3519043 - RNA, 15 nt, Pseudomonas aeruginosa PA01
cagcuugccuuccag

SEQ ID NO: 3519044 - RNA, 18 nt, Pseudomonas aeruginosa PA01
cagcuugccuuccaggcu

SEQ ID NO: 3519045 - RNA, 20 nt, Pseudomonas aeruginosa PA01
cagcuugccuuccaggcugu

SEQ ID NO: 3519046 - RNA, 23 nt, Pseudomonas aeruginosa PA01
cagcuugcgccagagcaggcgga

SEQ ID NO: 3519047 - RNA, 22 nt, Pseudomonas aeruginosa PA01
cagcuugcgcucagggacaccc

SEQ ID NO: 3519048 - RNA, 23 nt, Pseudomonas aeruginosa PA01
cagcuugcgucccuuggcgucgc

SEQ ID NO: 3519049 - RNA, 21 nt, Pseudomonas aeruginosa PA01
cagcuugcucgaugccaucga

SEQ ID NO: 3519050 - RNA, 16 nt, Pseudomonas aeruginosa PA01
cagcuugcuggcguag

SEQ ID NO: 3519051 - RNA, 20 nt, Pseudomonas aeruginosa PA01
cagcuugcuggcguagaagu

SEQ ID NO: 3519052 - RNA, 21 nt, Pseudomonas aeruginosa PA01
cagcuugcuggcguucucggc

SEQ ID NO: 3519053 - RNA, 22 nt, Pseudomonas aeruginosa PA01
cagcuuggcacggccggcggug

SEQ ID NO: 3519054 - RNA, 20 nt, Pseudomonas aeruginosa PA01
cagcuuggccagcaggccga

SEQ ID NO: 3519055 - RNA, 13 nt, Pseudomonas aeruginosa PA01
cagcuuggccuug

SEQ ID NO: 3519056 - RNA, 21 nt, Pseudomonas aeruginosa PA01
cagcuuggcgacguccugcgg

SEQ ID NO: 3519057 - RNA, 19 nt, Pseudomonas aeruginosa PA01
cagcuugggauggccagcc

SEQ ID NO: 3519058 - RNA, 21 nt, Pseudomonas aeruginosa PA01
cagcuugggauggccagccag

SEQ ID NO: 3519059 - RNA, 20 nt, Pseudomonas aeruginosa PA01
cagcuugguauccaccucgc

SEQ ID NO: 3519060 - RNA, 17 nt, Pseudomonas aeruginosa PA01
cagcuugguggugaucc

SEQ ID NO: 3519061 - RNA, 18 nt, Pseudomonas aeruginosa PA01
cagcuugguggugaucca

SEQ ID NO: 3519062 - RNA, 14 nt, Pseudomonas aeruginosa PA01
cagcuuguccacgc

SEQ ID NO: 3519063 - RNA, 17 nt, Pseudomonas aeruginosa PA01
cagcuuguccacgccau

SEQ ID NO: 3519064 - RNA, 13 nt, Pseudomonas aeruginosa PA01
cagcuugucgccu

SEQ ID NO: 3519065 - RNA, 16 nt, Pseudomonas aeruginosa PA01
cagcuugucgccuucc

SEQ ID NO: 3519066 - RNA, 15 nt, Pseudomonas aeruginosa PA01
cagcuuguggccggu

SEQ ID NO: 3519067 - RNA, 23 nt, Pseudomonas aeruginosa PA01
cagcuugugggcaugcucggcca

SEQ ID NO: 3519068 - RNA, 15 nt, Pseudomonas aeruginosa PA01
caggaaaaagcccgc

SEQ ID NO: 3519069 - RNA, 16 nt, Pseudomonas aeruginosa PA01
caggaaaaagcccgcg

SEQ ID NO: 3519070 - RNA, 21 nt, Pseudomonas aeruginosa PA01
caggaaaacgcucaggccaag

SEQ ID NO: 3519071 - RNA, 22 nt, Pseudomonas aeruginosa PA01
caggaaaagcggaagggccgag

SEQ ID NO: 3519072 - RNA, 15 nt, Pseudomonas aeruginosa PA01
caggaaauccgccgc

SEQ ID NO: 3519073 - RNA, 16 nt, Pseudomonas aeruginosa PA01
caggaaauccgccgcg

SEQ ID NO: 3519074 - RNA, 17 nt, Pseudomonas aeruginosa PA01
caggaaauccgccgcgc

SEQ ID NO: 3519075 - RNA, 15 nt, Pseudomonas aeruginosa PA01
caggaaaucgagcgc

SEQ ID NO: 3519076 - RNA, 19 nt, Pseudomonas aeruginosa PA01
caggaaaucgagcgccagg

SEQ ID NO: 3519077 - RNA, 20 nt, Pseudomonas aeruginosa PA01
caggaacagcuccuccagcg

SEQ ID NO: 3519078 - RNA, 21 nt, Pseudomonas aeruginosa PA01
caggaacagguucggcaggcc

SEQ ID NO: 3519079 - RNA, 16 nt, Pseudomonas aeruginosa PA01
caggaaccgacgcgca

SEQ ID NO: 3519080 - RNA, 19 nt, Pseudomonas aeruginosa PA01
caggaaccgacgcgcagga

SEQ ID NO: 3519081 - RNA, 13 nt, Pseudomonas aeruginosa PA01
caggaaccggcca

SEQ ID NO: 3519082 - RNA, 21 nt, Pseudomonas aeruginosa PA01
caggaacgcccgcggcagcag

SEQ ID NO: 3519083 - RNA, 22 nt, Pseudomonas aeruginosa PA01
caggaacgcccgcggcagcagc

SEQ ID NO: 3519084 - RNA, 16 nt, Pseudomonas aeruginosa PA01
caggaacgccucugcg

SEQ ID NO: 3519085 - RNA, 23 nt, Pseudomonas aeruginosa PA01
caggaacucgaucagcgcggcca

SEQ ID NO: 3519086 - RNA, 14 nt, Pseudomonas aeruginosa PA01
caggaagagcaggc

SEQ ID NO: 3519087 - RNA, 16 nt, Pseudomonas aeruginosa PA01
caggaagagcaggcgg

SEQ ID NO: 3519088 - RNA, 19 nt, Pseudomonas aeruginosa PA01
caggaagagcccgccacgc

SEQ ID NO: 3519089 - RNA, 22 nt, Pseudomonas aeruginosa PA01
caggaagccccagaagaucgcc

SEQ ID NO: 3519090 - RNA, 22 nt, Pseudomonas aeruginosa PA01
caggaagccgcgccccagcggc

SEQ ID NO: 3519091 - RNA, 14 nt, Pseudomonas aeruginosa PA01
caggaagcgccggg

SEQ ID NO: 3519092 - RNA, 15 nt, Pseudomonas aeruginosa PA01
caggaagcgccgggc

SEQ ID NO: 3519093 - RNA, 19 nt, Pseudomonas aeruginosa PA01
caggaagcgccgggccgca

SEQ ID NO: 3519094 - RNA, 19 nt, Pseudomonas aeruginosa PA01
caggaagcgggccucggcg

SEQ ID NO: 3519095 - RNA, 17 nt, Pseudomonas aeruginosa PA01
caggaagcgucgugcgc

SEQ ID NO: 3519096 - RNA, 19 nt, Pseudomonas aeruginosa PA01
caggaagcgucgugcgccg

SEQ ID NO: 3519097 - RNA, 21 nt, Pseudomonas aeruginosa PA01
caggaagcgucgugcgccggc

SEQ ID NO: 3519098 - RNA, 16 nt, Pseudomonas aeruginosa PA01
caggaagcucggcagc

SEQ ID NO: 3519099 - RNA, 20 nt, Pseudomonas aeruginosa PA01
caggaagcucggcagcacgc

SEQ ID NO: 3519100 - RNA, 21 nt, Pseudomonas aeruginosa PA01
caggaaggaaugcugccaccc

SEQ ID NO: 3519101 - RNA, 13 nt, Pseudomonas aeruginosa PA01
caggaaggccggg

SEQ ID NO: 3519102 - RNA, 23 nt, Pseudomonas aeruginosa PA01
caggaaggccuggaacaccaggc

SEQ ID NO: 3519103 - RNA, 15 nt, Pseudomonas aeruginosa PA01
caggaaggcuuccgg

SEQ ID NO: 3519104 - RNA, 22 nt, Pseudomonas aeruginosa PA01
caggaaguucacguaggagccg

SEQ ID NO: 3519105 - RNA, 17 nt, Pseudomonas aeruginosa PA01
caggaauccuccgccag

SEQ ID NO: 3519106 - RNA, 18 nt, Pseudomonas aeruginosa PA01
caggaauccuccgccagc

SEQ ID NO: 3519107 - RNA, 18 nt, Pseudomonas aeruginosa PA01
caggaauuccuggccggu

SEQ ID NO: 3519108 - RNA, 18 nt, Pseudomonas aeruginosa PA01
caggacaacgacagcccc

SEQ ID NO: 3519109 - RNA, 20 nt, Pseudomonas aeruginosa PA01
caggacaacgacagccccgg

SEQ ID NO: 3519110 - RNA, 21 nt, Pseudomonas aeruginosa PA01
caggacaacgacagccccggc

SEQ ID NO: 3519111 - RNA, 17 nt, Pseudomonas aeruginosa PA01
caggacacuuccaguuc

SEQ ID NO: 3519112 - RNA, 23 nt, Pseudomonas aeruginosa PA01
caggacagcacgcucaggcagcg

SEQ ID NO: 3519113 - RNA, 17 nt, Pseudomonas aeruginosa PA01
caggacagcgugcggcc

SEQ ID NO: 3519114 - RNA, 18 nt, Pseudomonas aeruginosa PA01
caggaccacgcuggucac

SEQ ID NO: 3519115 - RNA, 19 nt, Pseudomonas aeruginosa PA01
caggaccacgcuggucacc

SEQ ID NO: 3519116 - RNA, 22 nt, Pseudomonas aeruginosa PA01
caggaccagacgcggauuggcc

SEQ ID NO: 3519117 - RNA, 23 nt, Pseudomonas aeruginosa PA01
caggaccagacgcggauuggccg

SEQ ID NO: 3519118 - RNA, 14 nt, Pseudomonas aeruginosa PA01
caggaccagcgccu

SEQ ID NO: 3519119 - RNA, 19 nt, Pseudomonas aeruginosa PA01
caggaccagggcgggccgc

SEQ ID NO: 3519120 - RNA, 21 nt, Pseudomonas aeruginosa PA01
caggaccaguucgccgccgcg

SEQ ID NO: 3519121 - RNA, 22 nt, Pseudomonas aeruginosa PA01
caggaccaguucgccgccgcgc

SEQ ID NO: 3519122 - RNA, 23 nt, Pseudomonas aeruginosa PA01
caggaccaugucgcacuggucgg

SEQ ID NO: 3519123 - RNA, 16 nt, Pseudomonas aeruginosa PA01
caggacccagaugauc

SEQ ID NO: 3519124 - RNA, 17 nt, Pseudomonas aeruginosa PA01
caggacccaucgaugcu

SEQ ID NO: 3519125 - RNA, 16 nt, Pseudomonas aeruginosa PA01
caggacccgcgacucg

SEQ ID NO: 3519126 - RNA, 14 nt, Pseudomonas aeruginosa PA01
caggacccuuccag

SEQ ID NO: 3519127 - RNA, 16 nt, Pseudomonas aeruginosa PA01
caggaccgccauggcg

SEQ ID NO: 3519128 - RNA, 18 nt, Pseudomonas aeruginosa PA01
caggaccggcaggucggg

SEQ ID NO: 3519129 - RNA, 21 nt, Pseudomonas aeruginosa PA01
caggaccuccugcacauagug

SEQ ID NO: 3519130 - RNA, 21 nt, Pseudomonas aeruginosa PA01
caggaccucgaagcuggccag

SEQ ID NO: 3519131 - RNA, 16 nt, Pseudomonas aeruginosa PA01
caggaccucgggcgag

SEQ ID NO: 3519132 - RNA, 13 nt, Pseudomonas aeruginosa PA01
caggaccuggccg

SEQ ID NO: 3519133 - RNA, 19 nt, Pseudomonas aeruginosa PA01
caggaccuggccguuggcg

SEQ ID NO: 3519134 - RNA, 18 nt, Pseudomonas aeruginosa PA01
caggaccuucagauacuc

SEQ ID NO: 3519135 - RNA, 23 nt, Pseudomonas aeruginosa PA01
caggaccuucagauacuccagca

SEQ ID NO: 3519136 - RNA, 14 nt, Pseudomonas aeruginosa PA01
caggaccuuccgcc

SEQ ID NO: 3519137 - RNA, 16 nt, Pseudomonas aeruginosa PA01
caggaccuuccgccag

SEQ ID NO: 3519138 - RNA, 19 nt, Pseudomonas aeruginosa PA01
caggaccuuccgccagcag

SEQ ID NO: 3519139 - RNA, 17 nt, Pseudomonas aeruginosa PA01
caggaccuugucgcgca

SEQ ID NO: 3519140 - RNA, 17 nt, Pseudomonas aeruginosa PA01
caggacgaagucgccgg

SEQ ID NO: 3519141 - RNA, 18 nt, Pseudomonas aeruginosa PA01
caggacgaagucgccggc

SEQ ID NO: 3519142 - RNA, 19 nt, Pseudomonas aeruginosa PA01
caggacgaagucgccggca

SEQ ID NO: 3519143 - RNA, 22 nt, Pseudomonas aeruginosa PA01
caggacgaagucgccggcaucg

SEQ ID NO: 3519144 - RNA, 18 nt, Pseudomonas aeruginosa PA01
caggacgagacgccgagg

SEQ ID NO: 3519145 - RNA, 16 nt, Pseudomonas aeruginosa PA01
caggacgagcguccgc

SEQ ID NO: 3519146 - RNA, 17 nt, Pseudomonas aeruginosa PA01
caggacgagcguccgcc

SEQ ID NO: 3519147 - RNA, 22 nt, Pseudomonas aeruginosa PA01
caggacgagcguccgccgccgu

SEQ ID NO: 3519148 - RNA, 19 nt, Pseudomonas aeruginosa PA01
caggacgaggaaggcgcgc

SEQ ID NO: 3519149 - RNA, 14 nt, Pseudomonas aeruginosa PA01
caggacgaugauca

SEQ ID NO: 3519150 - RNA, 23 nt, Pseudomonas aeruginosa PA01
caggacgaugaucaccaggaccc

SEQ ID NO: 3519151 - RNA, 17 nt, Pseudomonas aeruginosa PA01
caggacgccaccaggcc

SEQ ID NO: 3519152 - RNA, 19 nt, Pseudomonas aeruginosa PA01
caggacgccaccaggccgc

SEQ ID NO: 3519153 - RNA, 14 nt, Pseudomonas aeruginosa PA01
caggacgcuacgcu

SEQ ID NO: 3519154 - RNA, 15 nt, Pseudomonas aeruginosa PA01
caggacgcuccugcg

SEQ ID NO: 3519155 - RNA, 18 nt, Pseudomonas aeruginosa PA01
caggacgcuccugcgccg

SEQ ID NO: 3519156 - RNA, 20 nt, Pseudomonas aeruginosa PA01
caggacgcuccugcgccggc

SEQ ID NO: 3519157 - RNA, 23 nt, Pseudomonas aeruginosa PA01
caggacggauaacggcagccgcg

SEQ ID NO: 3519158 - RNA, 13 nt, Pseudomonas aeruginosa PA01
caggacggcaggg

SEQ ID NO: 3519159 - RNA, 15 nt, Pseudomonas aeruginosa PA01
caggacggcaggguc

SEQ ID NO: 3519160 - RNA, 22 nt, Pseudomonas aeruginosa PA01
caggacgucgaggucgacggcg

SEQ ID NO: 3519161 - RNA, 20 nt, Pseudomonas aeruginosa PA01
caggagaaccuggccaaucc

SEQ ID NO: 3519162 - RNA, 15 nt, Pseudomonas aeruginosa PA01
caggagaagcgccuc

SEQ ID NO: 3519163 - RNA, 18 nt, Pseudomonas aeruginosa PA01
caggagcacggccguccu

SEQ ID NO: 3519164 - RNA, 17 nt, Pseudomonas aeruginosa PA01
caggagcagcuugcgcg

SEQ ID NO: 3519165 - RNA, 18 nt, Pseudomonas aeruginosa PA01
caggagcagcuugcgcga

SEQ ID NO: 3519166 - RNA, 13 nt, Pseudomonas aeruginosa PA01
caggagcagggcg

SEQ ID NO: 3519167 - RNA, 17 nt, Pseudomonas aeruginosa PA01
caggagcagggcgccga

SEQ ID NO: 3519168 - RNA, 19 nt, Pseudomonas aeruginosa PA01
caggagcagggcgccgauc

SEQ ID NO: 3519169 - RNA, 16 nt, Pseudomonas aeruginosa PA01
caggagcaucggcgcg

SEQ ID NO: 3519170 - RNA, 19 nt, Pseudomonas aeruginosa PA01
caggagcaucggcgcggcc

SEQ ID NO: 3519171 - RNA, 21 nt, Pseudomonas aeruginosa PA01
caggagcaugucuucgucgcg

SEQ ID NO: 3519172 - RNA, 22 nt, Pseudomonas aeruginosa PA01
caggagcaugucuucgucgcgc

SEQ ID NO: 3519173 - RNA, 20 nt, Pseudomonas aeruginosa PA01
caggagccaucgcuccagcg

SEQ ID NO: 3519174 - RNA, 11 nt, Pseudomonas aeruginosa PA01
caggagcgcca

SEQ ID NO: 3519175 - RNA, 13 nt, Pseudomonas aeruginosa PA01
caggagcgccagc

SEQ ID NO: 3519176 - RNA, 14 nt, Pseudomonas aeruginosa PA01
caggagcgccagca

SEQ ID NO: 3519177 - RNA, 16 nt, Pseudomonas aeruginosa PA01
caggagcgccagcacc

SEQ ID NO: 3519178 - RNA, 17 nt, Pseudomonas aeruginosa PA01
caggagcgccagcacca

SEQ ID NO: 3519179 - RNA, 23 nt, Pseudomonas aeruginosa PA01
caggagcgccagcaccagcagga

SEQ ID NO: 3519180 - RNA, 20 nt, Pseudomonas aeruginosa PA01
caggagcgccaucagcgacc

SEQ ID NO: 3519181 - RNA, 13 nt, Pseudomonas aeruginosa PA01
caggagcgccgcg

SEQ ID NO: 3519182 - RNA, 15 nt, Pseudomonas aeruginosa PA01
caggagcgccgcgca

SEQ ID NO: 3519183 - RNA, 16 nt, Pseudomonas aeruginosa PA01
caggagcguugcgggc

SEQ ID NO: 3519184 - RNA, 14 nt, Pseudomonas aeruginosa PA01
caggaggaucgcca

SEQ ID NO: 3519185 - RNA, 19 nt, Pseudomonas aeruginosa PA01
caggaggaucgccaggacg

SEQ ID NO: 3519186 - RNA, 14 nt, Pseudomonas aeruginosa PA01
caggaggauucgcc

SEQ ID NO: 3519187 - RNA, 17 nt, Pseudomonas aeruginosa PA01
caggaggauucgccagc

SEQ ID NO: 3519188 - RNA, 20 nt, Pseudomonas aeruginosa PA01
caggaggcccacgggcggcc

SEQ ID NO: 3519189 - RNA, 13 nt, Pseudomonas aeruginosa PA01
caggagggcugcu

SEQ ID NO: 3519190 - RNA, 15 nt, Pseudomonas aeruginosa PA01
caggagggcugcugu

SEQ ID NO: 3519191 - RNA, 21 nt, Pseudomonas aeruginosa PA01
caggagggcugcuguccagcg

SEQ ID NO: 3519192 - RNA, 21 nt, Pseudomonas aeruginosa PA01
caggagugauauuagcgauuc

SEQ ID NO: 3519193 - RNA, 21 nt, Pseudomonas aeruginosa PA01
caggaguggugaagcgcuccg

SEQ ID NO: 3519194 - RNA, 21 nt, Pseudomonas aeruginosa PA01
caggagugugggacaggaaga

SEQ ID NO: 3519195 - RNA, 20 nt, Pseudomonas aeruginosa PA01
caggaguuucaucucggcgc

SEQ ID NO: 3519196 - RNA, 16 nt, Pseudomonas aeruginosa PA01
caggauaucgcccagg

SEQ ID NO: 3519197 - RNA, 19 nt, Pseudomonas aeruginosa PA01
caggauaucgcccagggcc

SEQ ID NO: 3519198 - RNA, 16 nt, Pseudomonas aeruginosa PA01
caggaucacaucgccc

SEQ ID NO: 3519199 - RNA, 20 nt, Pseudomonas aeruginosa PA01
caggaucagguugaagagca

SEQ ID NO: 3519200 - RNA, 16 nt, Pseudomonas aeruginosa PA01
caggaucgaacuggcc

SEQ ID NO: 3519201 - RNA, 18 nt, Pseudomonas aeruginosa PA01
caggaucgaacuggccag

SEQ ID NO: 3519202 - RNA, 17 nt, Pseudomonas aeruginosa PA01
caggaucgacagcagcg

SEQ ID NO: 3519203 - RNA, 18 nt, Pseudomonas aeruginosa PA01
caggaucgacagcagcgc

SEQ ID NO: 3519204 - RNA, 19 nt, Pseudomonas aeruginosa PA01
caggaucgacagcagcgcc

SEQ ID NO: 3519205 - RNA, 19 nt, Pseudomonas aeruginosa PA01
caggaucgaccccgccggg

SEQ ID NO: 3519206 - RNA, 17 nt, Pseudomonas aeruginosa PA01
caggaucgagcccuggu

SEQ ID NO: 3519207 - RNA, 14 nt, Pseudomonas aeruginosa PA01
caggaucgccgggc

SEQ ID NO: 3519208 - RNA, 19 nt, Pseudomonas aeruginosa PA01
caggaucgccuccaccagc

SEQ ID NO: 3519209 - RNA, 21 nt, Pseudomonas aeruginosa PA01
caggaucgccuccaccagcgc

SEQ ID NO: 3519210 - RNA, 19 nt, Pseudomonas aeruginosa PA01
caggaucggagagacccgc

SEQ ID NO: 3519211 - RNA, 17 nt, Pseudomonas aeruginosa PA01
caggaucggcgcccagc

SEQ ID NO: 3519212 - RNA, 20 nt, Pseudomonas aeruginosa PA01
caggaucggcgcccagcacc

SEQ ID NO: 3519213 - RNA, 13 nt, Pseudomonas aeruginosa PA01
caggaucggcgcg

SEQ ID NO: 3519214 - RNA, 19 nt, Pseudomonas aeruginosa PA01
caggaucgucggcccgcau

SEQ ID NO: 3519215 - RNA, 16 nt, Pseudomonas aeruginosa PA01
caggaucuccucggcc

SEQ ID NO: 3519216 - RNA, 18 nt, Pseudomonas aeruginosa PA01
caggaucuccucggccaa

SEQ ID NO: 3519217 - RNA, 20 nt, Pseudomonas aeruginosa PA01
caggaucugcugcaacaugg

SEQ ID NO: 3519218 - RNA, 23 nt, Pseudomonas aeruginosa PA01
caggaucugcugcaacauggcgu

SEQ ID NO: 3519219 - RNA, 14 nt, Pseudomonas aeruginosa PA01
caggaugaccaggc

SEQ ID NO: 3519220 - RNA, 14 nt, Pseudomonas aeruginosa PA01
caggaugcaaccgc

SEQ ID NO: 3519221 - RNA, 14 nt, Pseudomonas aeruginosa PA01
caggaugcccugcu

SEQ ID NO: 3519222 - RNA, 21 nt, Pseudomonas aeruginosa PA01
caggaugcccugcucuuccag

SEQ ID NO: 3519223 - RNA, 15 nt, Pseudomonas aeruginosa PA01
caggaugccgccugc

SEQ ID NO: 3519224 - RNA, 16 nt, Pseudomonas aeruginosa PA01
caggaugcgaugcugu

SEQ ID NO: 3519225 - RNA, 23 nt, Pseudomonas aeruginosa PA01
caggaugcgaugcugucagcgcc

SEQ ID NO: 3519226 - RNA, 22 nt, Pseudomonas aeruginosa PA01
caggaugcgcuuuuccucgacc

SEQ ID NO: 3519227 - RNA, 16 nt, Pseudomonas aeruginosa PA01
caggaugcugcacagc

SEQ ID NO: 3519228 - RNA, 17 nt, Pseudomonas aeruginosa PA01
caggaugcugcacagcc

SEQ ID NO: 3519229 - RNA, 13 nt, Pseudomonas aeruginosa PA01
caggaugggcgaa

SEQ ID NO: 3519230 - RNA, 16 nt, Pseudomonas aeruginosa PA01
caggaugggcgaagcc

SEQ ID NO: 3519231 - RNA, 19 nt, Pseudomonas aeruginosa PA01
caggauguugaacaggcuc

SEQ ID NO: 3519232 - RNA, 21 nt, Pseudomonas aeruginosa PA01
caggauguugacgauggccca

SEQ ID NO: 3519233 - RNA, 15 nt, Pseudomonas aeruginosa PA01
caggcaagcgcauga

SEQ ID NO: 3519234 - RNA, 23 nt, Pseudomonas aeruginosa PA01
caggcaagcgcaugaggcuggcc

SEQ ID NO: 3519235 - RNA, 12 nt, Pseudomonas aeruginosa PA01
caggcacagggc

SEQ ID NO: 3519236 - RNA, 15 nt, Pseudomonas aeruginosa PA01
caggcacagggcgac

SEQ ID NO: 3519237 - RNA, 15 nt, Pseudomonas aeruginosa PA01
caggcacccgcggua

SEQ ID NO: 3519238 - RNA, 19 nt, Pseudomonas aeruginosa PA01
caggcaccgaagcugaggc

SEQ ID NO: 3519239 - RNA, 19 nt, Pseudomonas aeruginosa PA01
caggcaccguaggccaggc

SEQ ID NO: 3519240 - RNA, 20 nt, Pseudomonas aeruginosa PA01
caggcacgaauuuccuggcg

SEQ ID NO: 3519241 - RNA, 22 nt, Pseudomonas aeruginosa PA01
caggcacgaauuuccuggcgcg

SEQ ID NO: 3519242 - RNA, 17 nt, Pseudomonas aeruginosa PA01
caggcacgcugccagca

SEQ ID NO: 3519243 - RNA, 19 nt, Pseudomonas aeruginosa PA01
caggcacgcugccagcagg

SEQ ID NO: 3519244 - RNA, 22 nt, Pseudomonas aeruginosa PA01
caggcacgcugccagcaggccg

SEQ ID NO: 3519245 - RNA, 16 nt, Pseudomonas aeruginosa PA01
caggcacggaagcgcu

SEQ ID NO: 3519246 - RNA, 19 nt, Pseudomonas aeruginosa PA01
caggcacggaagcgcugcu

SEQ ID NO: 3519247 - RNA, 19 nt, Pseudomonas aeruginosa PA01
caggcacggcuucagcgcc

SEQ ID NO: 3519248 - RNA, 18 nt, Pseudomonas aeruginosa PA01
caggcacucgaugaacag

SEQ ID NO: 3519249 - RNA, 23 nt, Pseudomonas aeruginosa PA01
caggcacucgaugaacagcgcga

SEQ ID NO: 3519250 - RNA, 14 nt, Pseudomonas aeruginosa PA01
caggcagaccagcg

SEQ ID NO: 3519251 - RNA, 15 nt, Pseudomonas aeruginosa PA01
caggcagaccagcgc

SEQ ID NO: 3519252 - RNA, 19 nt, Pseudomonas aeruginosa PA01
caggcagaccagcgcaagc

SEQ ID NO: 3519253 - RNA, 14 nt, Pseudomonas aeruginosa PA01
caggcagaccaggc

SEQ ID NO: 3519254 - RNA, 15 nt, Pseudomonas aeruginosa PA01
caggcagaccaggcc

SEQ ID NO: 3519255 - RNA, 17 nt, Pseudomonas aeruginosa PA01
caggcagaccaggccga

SEQ ID NO: 3519256 - RNA, 19 nt, Pseudomonas aeruginosa PA01
caggcagaccaggccgagc

SEQ ID NO: 3519257 - RNA, 21 nt, Pseudomonas aeruginosa PA01
caggcagaccaggccgagcag

SEQ ID NO: 3519258 - RNA, 17 nt, Pseudomonas aeruginosa PA01
caggcagaccugcagca

SEQ ID NO: 3519259 - RNA, 22 nt, Pseudomonas aeruginosa PA01
caggcagaccugcagcaggauc

SEQ ID NO: 3519260 - RNA, 16 nt, Pseudomonas aeruginosa PA01
caggcagaucgcgccg

SEQ ID NO: 3519261 - RNA, 18 nt, Pseudomonas aeruginosa PA01
caggcagaucgcgccgag

SEQ ID NO: 3519262 - RNA, 19 nt, Pseudomonas aeruginosa PA01
caggcagaucgcgccgagc

SEQ ID NO: 3519263 - RNA, 21 nt, Pseudomonas aeruginosa PA01
caggcagcacaugccacgcac

SEQ ID NO: 3519264 - RNA, 19 nt, Pseudomonas aeruginosa PA01
caggcagcgaucgccgcca

SEQ ID NO: 3519265 - RNA, 13 nt, Pseudomonas aeruginosa PA01
caggcagcgccgc

SEQ ID NO: 3519266 - RNA, 14 nt, Pseudomonas aeruginosa PA01
caggcagcgcgcgg

SEQ ID NO: 3519267 - RNA, 16 nt, Pseudomonas aeruginosa PA01
caggcagcgcgcggcc

SEQ ID NO: 3519268 - RNA, 17 nt, Pseudomonas aeruginosa PA01
caggcagcgcgcggcca

SEQ ID NO: 3519269 - RNA, 19 nt, Pseudomonas aeruginosa PA01
caggcagcgcgcggccagu

SEQ ID NO: 3519270 - RNA, 14 nt, Pseudomonas aeruginosa PA01
caggcagcgcgcgu

SEQ ID NO: 3519271 - RNA, 21 nt, Pseudomonas aeruginosa PA01
caggcagcgcgcgucggucag

SEQ ID NO: 3519272 - RNA, 19 nt, Pseudomonas aeruginosa PA01
caggcagcgggccaggcgg

SEQ ID NO: 3519273 - RNA, 14 nt, Pseudomonas aeruginosa PA01
caggcaggcauggu

SEQ ID NO: 3519274 - RNA, 12 nt, Pseudomonas aeruginosa PA01
caggcaggccgg

SEQ ID NO: 3519275 - RNA, 15 nt, Pseudomonas aeruginosa PA01
caggcaggccgggcu

SEQ ID NO: 3519276 - RNA, 16 nt, Pseudomonas aeruginosa PA01
caggcaggccgggcug

SEQ ID NO: 3519277 - RNA, 19 nt, Pseudomonas aeruginosa PA01
caggcaggccgggcuggcc

SEQ ID NO: 3519278 - RNA, 20 nt, Pseudomonas aeruginosa PA01
caggcaggccgggcuggcca

SEQ ID NO: 3519279 - RNA, 21 nt, Pseudomonas aeruginosa PA01
caggcaggcgaugaccgcccc

SEQ ID NO: 3519280 - RNA, 22 nt, Pseudomonas aeruginosa PA01
caggcaggcgaugaccgccccg

SEQ ID NO: 3519281 - RNA, 13 nt, Pseudomonas aeruginosa PA01
caggcaggcgcgg

SEQ ID NO: 3519282 - RNA, 14 nt, Pseudomonas aeruginosa PA01
caggcaggcgcggg

SEQ ID NO: 3519283 - RNA, 20 nt, Pseudomonas aeruginosa PA01
caggcaguccuugagcgcca

SEQ ID NO: 3519284 - RNA, 21 nt, Pseudomonas aeruginosa PA01
caggcaguccuugagcgccag

SEQ ID NO: 3519285 - RNA, 16 nt, Pseudomonas aeruginosa PA01
caggcagugugcaccg

SEQ ID NO: 3519286 - RNA, 13 nt, Pseudomonas aeruginosa PA01
caggcauccagca

SEQ ID NO: 3519287 - RNA, 16 nt, Pseudomonas aeruginosa PA01
caggcauccagcaccg

SEQ ID NO: 3519288 - RNA, 19 nt, Pseudomonas aeruginosa PA01
caggcauccccggaccagg

SEQ ID NO: 3519289 - RNA, 21 nt, Pseudomonas aeruginosa PA01
caggcauccccggaccagggc

SEQ ID NO: 3519290 - RNA, 23 nt, Pseudomonas aeruginosa PA01
caggcauccccggaccagggcgc

SEQ ID NO: 3519291 - RNA, 21 nt, Pseudomonas aeruginosa PA01
caggcaugaacgaaaacgccg

SEQ ID NO: 3519292 - RNA, 16 nt, Pseudomonas aeruginosa PA01
caggcaugcgggcgcg

SEQ ID NO: 3519293 - RNA, 15 nt, Pseudomonas aeruginosa PA01
caggcauuccuccag

SEQ ID NO: 3519294 - RNA, 17 nt, Pseudomonas aeruginosa PA01
caggcauuccuccaggg

SEQ ID NO: 3519295 - RNA, 20 nt, Pseudomonas aeruginosa PA01
caggcauuccuccagggucg

SEQ ID NO: 3519296 - RNA, 15 nt, Pseudomonas aeruginosa PA01
caggcauugccgucc

SEQ ID NO: 3519297 - RNA, 16 nt, Pseudomonas aeruginosa PA01
caggcauugccguccg

SEQ ID NO: 3519298 - RNA, 14 nt, Pseudomonas aeruginosa PA01
caggccaaccaccc

SEQ ID NO: 3519299 - RNA, 16 nt, Pseudomonas aeruginosa PA01
caggccaaccaccccg

SEQ ID NO: 3519300 - RNA, 17 nt, Pseudomonas aeruginosa PA01
caggccaaccaccccga

SEQ ID NO: 3519301 - RNA, 14 nt, Pseudomonas aeruginosa PA01
caggccacccgccu

SEQ ID NO: 3519302 - RNA, 16 nt, Pseudomonas aeruginosa PA01
caggccacccgccucg

SEQ ID NO: 3519303 - RNA, 13 nt, Pseudomonas aeruginosa PA01
caggccaccgcgc

SEQ ID NO: 3519304 - RNA, 19 nt, Pseudomonas aeruginosa PA01
caggccaccgguggacugg

SEQ ID NO: 3519305 - RNA, 14 nt, Pseudomonas aeruginosa PA01
caggccacgcacca

SEQ ID NO: 3519306 - RNA, 21 nt, Pseudomonas aeruginosa PA01
caggccacgcaccagcucccg

SEQ ID NO: 3519307 - RNA, 23 nt, Pseudomonas aeruginosa PA01
caggccacgcaccagcucccggc

SEQ ID NO: 3519308 - RNA, 18 nt, Pseudomonas aeruginosa PA01
caggccacgcccaugccu

SEQ ID NO: 3519309 - RNA, 18 nt, Pseudomonas aeruginosa PA01
caggccacggccgcugcg

SEQ ID NO: 3519310 - RNA, 19 nt, Pseudomonas aeruginosa PA01
caggccacggccggcgagg

SEQ ID NO: 3519311 - RNA, 19 nt, Pseudomonas aeruginosa PA01
caggccagcagguagccug

SEQ ID NO: 3519312 - RNA, 17 nt, Pseudomonas aeruginosa PA01
caggccagccaacugcu

SEQ ID NO: 3519313 - RNA, 23 nt, Pseudomonas aeruginosa PA01
caggccagccaacugcuucaggc

SEQ ID NO: 3519314 - RNA, 13 nt, Pseudomonas aeruginosa PA01
caggccagcgcca

SEQ ID NO: 3519315 - RNA, 23 nt, Pseudomonas aeruginosa PA01
caggccagcgccagguuggccug

SEQ ID NO: 3519316 - RNA, 18 nt, Pseudomonas aeruginosa PA01
caggccagcgggcugucg

SEQ ID NO: 3519317 - RNA, 14 nt, Pseudomonas aeruginosa PA01
caggccagcucgcc

SEQ ID NO: 3519318 - RNA, 15 nt, Pseudomonas aeruginosa PA01
caggccagcucgccc

SEQ ID NO: 3519319 - RNA, 18 nt, Pseudomonas aeruginosa PA01
caggccagcucgcccgcc

SEQ ID NO: 3519320 - RNA, 19 nt, Pseudomonas aeruginosa PA01
caggccagcuuccaggcgc

SEQ ID NO: 3519321 - RNA, 22 nt, Pseudomonas aeruginosa PA01
caggccagcuuccaggcgcgcu

SEQ ID NO: 3519322 - RNA, 12 nt, Pseudomonas aeruginosa PA01
caggccaggccc

SEQ ID NO: 3519323 - RNA, 22 nt, Pseudomonas aeruginosa PA01
caggccaggccccagggccggc

SEQ ID NO: 3519324 - RNA, 13 nt, Pseudomonas aeruginosa PA01
caggccaggcgca

SEQ ID NO: 3519325 - RNA, 14 nt, Pseudomonas aeruginosa PA01
caggccaggcgcag

SEQ ID NO: 3519326 - RNA, 20 nt, Pseudomonas aeruginosa PA01
caggccaggcgcagugccug

SEQ ID NO: 3519327 - RNA, 18 nt, Pseudomonas aeruginosa PA01
caggccauagcgcgccgg

SEQ ID NO: 3519328 - RNA, 19 nt, Pseudomonas aeruginosa PA01
caggccauagcgcgccggg

SEQ ID NO: 3519329 - RNA, 20 nt, Pseudomonas aeruginosa PA01
caggccaugggugucggcga

SEQ ID NO: 3519330 - RNA, 15 nt, Pseudomonas aeruginosa PA01
caggccauugaaggc

SEQ ID NO: 3519331 - RNA, 15 nt, Pseudomonas aeruginosa PA01
caggcccacgccgaa

SEQ ID NO: 3519332 - RNA, 17 nt, Pseudomonas aeruginosa PA01
caggcccagcgcggcgc

SEQ ID NO: 3519333 - RNA, 23 nt, Pseudomonas aeruginosa PA01
caggcccagcuucuuggcccggu

SEQ ID NO: 3519334 - RNA, 23 nt, Pseudomonas aeruginosa PA01
caggcccauuucguagcccaggc

SEQ ID NO: 3519335 - RNA, 12 nt, Pseudomonas aeruginosa PA01
caggccccaggc

SEQ ID NO: 3519336 - RNA, 13 nt, Pseudomonas aeruginosa PA01
caggccccaggcc

SEQ ID NO: 3519337 - RNA, 14 nt, Pseudomonas aeruginosa PA01
caggccccaggcga

SEQ ID NO: 3519338 - RNA, 17 nt, Pseudomonas aeruginosa PA01
caggccccaggcgaucc

SEQ ID NO: 3519339 - RNA, 13 nt, Pseudomonas aeruginosa PA01
caggccccagggc

SEQ ID NO: 3519340 - RNA, 15 nt, Pseudomonas aeruginosa PA01
caggccccagggccg

SEQ ID NO: 3519341 - RNA, 18 nt, Pseudomonas aeruginosa PA01
caggccccagggccggcg

SEQ ID NO: 3519342 - RNA, 16 nt, Pseudomonas aeruginosa PA01
caggccccuugcgcug

SEQ ID NO: 3519343 - RNA, 13 nt, Pseudomonas aeruginosa PA01
caggcccgccgcg

SEQ ID NO: 3519344 - RNA, 14 nt, Pseudomonas aeruginosa PA01
caggcccgccgguc

SEQ ID NO: 3519345 - RNA, 14 nt, Pseudomonas aeruginosa PA01
caggcccggccgcc

SEQ ID NO: 3519346 - RNA, 14 nt, Pseudomonas aeruginosa PA01
caggcccucggcga

SEQ ID NO: 3519347 - RNA, 18 nt, Pseudomonas aeruginosa PA01
caggcccucggcgaccaa

SEQ ID NO: 3519348 - RNA, 20 nt, Pseudomonas aeruginosa PA01
caggcccucggcgaccaaca

SEQ ID NO: 3519349 - RNA, 22 nt, Pseudomonas aeruginosa PA01
caggcccucggcgaccaacagg

SEQ ID NO: 3519350 - RNA, 17 nt, Pseudomonas aeruginosa PA01
caggcccugcagcgcca

SEQ ID NO: 3519351 - RNA, 14 nt, Pseudomonas aeruginosa PA01
caggcccugccagu

SEQ ID NO: 3519352 - RNA, 15 nt, Pseudomonas aeruginosa PA01
caggcccugcuccuc

SEQ ID NO: 3519353 - RNA, 15 nt, Pseudomonas aeruginosa PA01
caggcccuggaucac

SEQ ID NO: 3519354 - RNA, 16 nt, Pseudomonas aeruginosa PA01
caggcccuggaucacc

SEQ ID NO: 3519355 - RNA, 18 nt, Pseudomonas aeruginosa PA01
caggcccuggaucaccgc

SEQ ID NO: 3519356 - RNA, 23 nt, Pseudomonas aeruginosa PA01
caggcccuggaucaccgcggcgc

SEQ ID NO: 3519357 - RNA, 18 nt, Pseudomonas aeruginosa PA01
caggcccugggcggcggg

SEQ ID NO: 3519358 - RNA, 19 nt, Pseudomonas aeruginosa PA01
caggcccugggcggcgggc

SEQ ID NO: 3519359 - RNA, 19 nt, Pseudomonas aeruginosa PA01
caggcccuugaacaggcug

SEQ ID NO: 3519360 - RNA, 20 nt, Pseudomonas aeruginosa PA01
caggcccuugaacaggcugg

SEQ ID NO: 3519361 - RNA, 17 nt, Pseudomonas aeruginosa PA01
caggcccuugagggccu

SEQ ID NO: 3519362 - RNA, 22 nt, Pseudomonas aeruginosa PA01
caggcccuugagggccucggcg

SEQ ID NO: 3519363 - RNA, 17 nt, Pseudomonas aeruginosa PA01
caggcccuugauggugu

SEQ ID NO: 3519364 - RNA, 17 nt, Pseudomonas aeruginosa PA01
caggcccuuggucaggc

SEQ ID NO: 3519365 - RNA, 19 nt, Pseudomonas aeruginosa PA01
caggcccuuuuccaccggc

SEQ ID NO: 3519366 - RNA, 22 nt, Pseudomonas aeruginosa PA01
caggcccuuuuccaccggccgc

SEQ ID NO: 3519367 - RNA, 23 nt, Pseudomonas aeruginosa PA01
caggcccuuuuccaccggccgcg

SEQ ID NO: 3519368 - RNA, 16 nt, Pseudomonas aeruginosa PA01
caggccgaacgggaag

SEQ ID NO: 3519369 - RNA, 17 nt, Pseudomonas aeruginosa PA01
caggccgaacgggaagu

SEQ ID NO: 3519370 - RNA, 24 nt, Pseudomonas aeruginosa PA01
caggccgaacucacggaugccggg

SEQ ID NO: 3519371 - RNA, 22 nt, Pseudomonas aeruginosa PA01
caggccgaagcgugggcggccg

SEQ ID NO: 3519372 - RNA, 19 nt, Pseudomonas aeruginosa PA01
caggccgaagcugucgagc

SEQ ID NO: 3519373 - RNA, 14 nt, Pseudomonas aeruginosa PA01
caggccgaaggcca

SEQ ID NO: 3519374 - RNA, 17 nt, Pseudomonas aeruginosa PA01
caggccgaaggccagga

SEQ ID NO: 3519375 - RNA, 18 nt, Pseudomonas aeruginosa PA01
caggccgaaggccaggac

SEQ ID NO: 3519376 - RNA, 18 nt, Pseudomonas aeruginosa PA01
caggccgaaggccuggcc

SEQ ID NO: 3519377 - RNA, 19 nt, Pseudomonas aeruginosa PA01
caggccgaaguagccggcg

SEQ ID NO: 3519378 - RNA, 16 nt, Pseudomonas aeruginosa PA01
caggccgaauccgccg

SEQ ID NO: 3519379 - RNA, 22 nt, Pseudomonas aeruginosa PA01
caggccgaauccgccggcgaug

SEQ ID NO: 3519380 - RNA, 21 nt, Pseudomonas aeruginosa PA01
caggccgacagcggcuggcgc

SEQ ID NO: 3519381 - RNA, 15 nt, Pseudomonas aeruginosa PA01
caggccgaccagcag

SEQ ID NO: 3519382 - RNA, 16 nt, Pseudomonas aeruginosa PA01
caggccgaccagcagg

SEQ ID NO: 3519383 - RNA, 23 nt, Pseudomonas aeruginosa PA01
caggccgaccagcagggccagca

SEQ ID NO: 3519384 - RNA, 16 nt, Pseudomonas aeruginosa PA01
caggccgacccgcagg

SEQ ID NO: 3519385 - RNA, 17 nt, Pseudomonas aeruginosa PA01
caggccgacccgcaggc

SEQ ID NO: 3519386 - RNA, 17 nt, Pseudomonas aeruginosa PA01
caggccgacgaagaccu

SEQ ID NO: 3519387 - RNA, 18 nt, Pseudomonas aeruginosa PA01
caggccgacgaagaccuu

SEQ ID NO: 3519388 - RNA, 16 nt, Pseudomonas aeruginosa PA01
caggccgacggcgcgc

SEQ ID NO: 3519389 - RNA, 21 nt, Pseudomonas aeruginosa PA01
caggccgacguccaucagcgu

SEQ ID NO: 3519390 - RNA, 17 nt, Pseudomonas aeruginosa PA01
caggccgagaaaccgcc

SEQ ID NO: 3519391 - RNA, 20 nt, Pseudomonas aeruginosa PA01
caggccgagaaaccgccauc

SEQ ID NO: 3519392 - RNA, 23 nt, Pseudomonas aeruginosa PA01
caggccgagaagguucucggcca

SEQ ID NO: 3519393 - RNA, 15 nt, Pseudomonas aeruginosa PA01
caggccgagaccgca

SEQ ID NO: 3519394 - RNA, 21 nt, Pseudomonas aeruginosa PA01
caggccgagaccgcagcccag

SEQ ID NO: 3519395 - RNA, 14 nt, Pseudomonas aeruginosa PA01
caggccgagcaccg

SEQ ID NO: 3519396 - RNA, 17 nt, Pseudomonas aeruginosa PA01
caggccgagcaccggca

SEQ ID NO: 3519397 - RNA, 19 nt, Pseudomonas aeruginosa PA01
caggccgagcaccggcagg

SEQ ID NO: 3519398 - RNA, 20 nt, Pseudomonas aeruginosa PA01
caggccgagcaccggcagga

SEQ ID NO: 3519399 - RNA, 18 nt, Pseudomonas aeruginosa PA01
caggccgagcagcgccag

SEQ ID NO: 3519400 - RNA, 22 nt, Pseudomonas aeruginosa PA01
caggccgagcagcgccagccag

SEQ ID NO: 3519401 - RNA, 23 nt, Pseudomonas aeruginosa PA01
caggccgagcagcgccagccagg

SEQ ID NO: 3519402 - RNA, 14 nt, Pseudomonas aeruginosa PA01
caggccgagcagga

SEQ ID NO: 3519403 - RNA, 15 nt, Pseudomonas aeruginosa PA01
caggccgagcccgag

SEQ ID NO: 3519404 - RNA, 14 nt, Pseudomonas aeruginosa PA01
caggccgagcgcca

SEQ ID NO: 3519405 - RNA, 20 nt, Pseudomonas aeruginosa PA01
caggccgagcgccagggcca

SEQ ID NO: 3519406 - RNA, 16 nt, Pseudomonas aeruginosa PA01
caggccgagcgcgccg

SEQ ID NO: 3519407 - RNA, 23 nt, Pseudomonas aeruginosa PA01
caggccgagcgcgccgccgaucu

SEQ ID NO: 3519408 - RNA, 20 nt, Pseudomonas aeruginosa PA01
caggccgaggaugcucgccu

SEQ ID NO: 3519409 - RNA, 23 nt, Pseudomonas aeruginosa PA01
caggccgaggaugcucgccuggu

SEQ ID NO: 3519410 - RNA, 14 nt, Pseudomonas aeruginosa PA01
caggccgaggccgg

SEQ ID NO: 3519411 - RNA, 16 nt, Pseudomonas aeruginosa PA01
caggccgaggccggcg

SEQ ID NO: 3519412 - RNA, 13 nt, Pseudomonas aeruginosa PA01
caggccgaggcgc

SEQ ID NO: 3519413 - RNA, 16 nt, Pseudomonas aeruginosa PA01
caggccgaggcgcuuc

SEQ ID NO: 3519414 - RNA, 21 nt, Pseudomonas aeruginosa PA01
caggccgaggcgcuucugcuc

SEQ ID NO: 3519415 - RNA, 12 nt, Pseudomonas aeruginosa PA01
caggccgagggc

SEQ ID NO: 3519416 - RNA, 18 nt, Pseudomonas aeruginosa PA01
caggccgagggcugccgc

SEQ ID NO: 3519417 - RNA, 21 nt, Pseudomonas aeruginosa PA01
caggccgagggcugccgcccg

SEQ ID NO: 3519418 - RNA, 19 nt, Pseudomonas aeruginosa PA01
caggccgaggucggcggcg

SEQ ID NO: 3519419 - RNA, 23 nt, Pseudomonas aeruginosa PA01
caggccgaguccgcgcgcgcgcu

SEQ ID NO: 3519420 - RNA, 18 nt, Pseudomonas aeruginosa PA01
caggccgaucaccaccag

SEQ ID NO: 3519421 - RNA, 18 nt, Pseudomonas aeruginosa PA01
caggccgaucaccagcgc

SEQ ID NO: 3519422 - RNA, 22 nt, Pseudomonas aeruginosa PA01
caggccgaucaccagcgccagg

SEQ ID NO: 3519423 - RNA, 17 nt, Pseudomonas aeruginosa PA01
caggccgaucagcggcg

SEQ ID NO: 3519424 - RNA, 13 nt, Pseudomonas aeruginosa PA01
caggccgaucagg

SEQ ID NO: 3519425 - RNA, 14 nt, Pseudomonas aeruginosa PA01
caggccgaucgccu

SEQ ID NO: 3519426 - RNA, 22 nt, Pseudomonas aeruginosa PA01
caggccgaucgccucguucagc

SEQ ID NO: 3519427 - RNA, 20 nt, Pseudomonas aeruginosa PA01
caggccgauggccccggcga

SEQ ID NO: 3519428 - RNA, 17 nt, Pseudomonas aeruginosa PA01
caggccgauguucaggc

SEQ ID NO: 3519429 - RNA, 20 nt, Pseudomonas aeruginosa PA01
caggccgauguucaggccgg

SEQ ID NO: 3519430 - RNA, 14 nt, Pseudomonas aeruginosa PA01
caggccgcaagcgg

SEQ ID NO: 3519431 - RNA, 20 nt, Pseudomonas aeruginosa PA01
caggccgcaaguaccgccgg

SEQ ID NO: 3519432 - RNA, 22 nt, Pseudomonas aeruginosa PA01
caggccgcaaguaccgccggca

SEQ ID NO: 3519433 - RNA, 23 nt, Pseudomonas aeruginosa PA01
caggccgcaaguaccgccggcag

SEQ ID NO: 3519434 - RNA, 14 nt, Pseudomonas aeruginosa PA01
caggccgcagguga

SEQ ID NO: 3519435 - RNA, 13 nt, Pseudomonas aeruginosa PA01
caggccgcagucc

SEQ ID NO: 3519436 - RNA, 12 nt, Pseudomonas aeruginosa PA01
caggccgccaug

SEQ ID NO: 3519437 - RNA, 14 nt, Pseudomonas aeruginosa PA01
caggccgcccagga

SEQ ID NO: 3519438 - RNA, 17 nt, Pseudomonas aeruginosa PA01
caggccgcccaggacaa

SEQ ID NO: 3519439 - RNA, 22 nt, Pseudomonas aeruginosa PA01
caggccgcccuugaccccaccg

SEQ ID NO: 3519440 - RNA, 12 nt, Pseudomonas aeruginosa PA01
caggccgccgaa

SEQ ID NO: 3519441 - RNA, 23 nt, Pseudomonas aeruginosa PA01
caggccgccgaagaacucggcgc

SEQ ID NO: 3519442 - RNA, 13 nt, Pseudomonas aeruginosa PA01
caggccgccgagu

SEQ ID NO: 3519443 - RNA, 18 nt, Pseudomonas aeruginosa PA01
caggccgccgagugugcc

SEQ ID NO: 3519444 - RNA, 21 nt, Pseudomonas aeruginosa PA01
caggccgccgauccaggaacc

SEQ ID NO: 3519445 - RNA, 17 nt, Pseudomonas aeruginosa PA01
caggccgccgccugcuc

SEQ ID NO: 3519446 - RNA, 13 nt, Pseudomonas aeruginosa PA01
caggccgccggcg

SEQ ID NO: 3519447 - RNA, 22 nt, Pseudomonas aeruginosa PA01
caggccgccggcgaccgcgcgc

SEQ ID NO: 3519448 - RNA, 16 nt, Pseudomonas aeruginosa PA01
caggccgccggcggcc

SEQ ID NO: 3519449 - RNA, 20 nt, Pseudomonas aeruginosa PA01
caggccgccggcggccaggg

SEQ ID NO: 3519450 - RNA, 12 nt, Pseudomonas aeruginosa PA01
caggccgccgua

SEQ ID NO: 3519451 - RNA, 14 nt, Pseudomonas aeruginosa PA01
caggccgccguaga

SEQ ID NO: 3519452 - RNA, 14 nt, Pseudomonas aeruginosa PA01
caggccgcgcagca

SEQ ID NO: 3519453 - RNA, 17 nt, Pseudomonas aeruginosa PA01
caggccgcgcagucccg

SEQ ID NO: 3519454 - RNA, 22 nt, Pseudomonas aeruginosa PA01
caggccgcgcagucccgcgcgg

SEQ ID NO: 3519455 - RNA, 14 nt, Pseudomonas aeruginosa PA01
caggccgcgcgaug

SEQ ID NO: 3519456 - RNA, 17 nt, Pseudomonas aeruginosa PA01
caggccgcgcgauggcc

SEQ ID NO: 3519457 - RNA, 18 nt, Pseudomonas aeruginosa PA01
caggccgcgcgauggccg

SEQ ID NO: 3519458 - RNA, 12 nt, Pseudomonas aeruginosa PA01
caggccgcggcc

SEQ ID NO: 3519459 - RNA, 21 nt, Pseudomonas aeruginosa PA01
caggccgcggcccugcgccgc

SEQ ID NO: 3519460 - RNA, 22 nt, Pseudomonas aeruginosa PA01
caggccgcggcccugcgccgca

SEQ ID NO: 3519461 - RNA, 17 nt, Pseudomonas aeruginosa PA01
caggccgcucaccgcca

SEQ ID NO: 3519462 - RNA, 16 nt, Pseudomonas aeruginosa PA01
caggccgcugccgccg

SEQ ID NO: 3519463 - RNA, 17 nt, Pseudomonas aeruginosa PA01
caggccgcugccgccgc

SEQ ID NO: 3519464 - RNA, 20 nt, Pseudomonas aeruginosa PA01
caggccgcugccgccgcgca

SEQ ID NO: 3519465 - RNA, 16 nt, Pseudomonas aeruginosa PA01
caggccgcugccuguc

SEQ ID NO: 3519466 - RNA, 17 nt, Pseudomonas aeruginosa PA01
caggccgcugccugucg

SEQ ID NO: 3519467 - RNA, 18 nt, Pseudomonas aeruginosa PA01
caggccgcuuuccacccg

SEQ ID NO: 3519468 - RNA, 15 nt, Pseudomonas aeruginosa PA01
caggccggagccgcg

SEQ ID NO: 3519469 - RNA, 15 nt, Pseudomonas aeruginosa PA01
caggccggccagccu

SEQ ID NO: 3519470 - RNA, 21 nt, Pseudomonas aeruginosa PA01
caggccggccagccuucccgg

SEQ ID NO: 3519471 - RNA, 16 nt, Pseudomonas aeruginosa PA01
caggccggccuccagc

SEQ ID NO: 3519472 - RNA, 17 nt, Pseudomonas aeruginosa PA01
caggccggccuccagcg

SEQ ID NO: 3519473 - RNA, 18 nt, Pseudomonas aeruginosa PA01
caggccggccuccagcgc

SEQ ID NO: 3519474 - RNA, 19 nt, Pseudomonas aeruginosa PA01
caggccggccuccagcgcc

SEQ ID NO: 3519475 - RNA, 17 nt, Pseudomonas aeruginosa PA01
caggccggcgaccagcg

SEQ ID NO: 3519476 - RNA, 15 nt, Pseudomonas aeruginosa PA01
caggccggcgagcca

SEQ ID NO: 3519477 - RNA, 23 nt, Pseudomonas aeruginosa PA01
caggccggcgagggcggcgaccu

SEQ ID NO: 3519478 - RNA, 18 nt, Pseudomonas aeruginosa PA01
caggccggcgcaucgucg

SEQ ID NO: 3519479 - RNA, 14 nt, Pseudomonas aeruginosa PA01
caggccggcgccga

SEQ ID NO: 3519480 - RNA, 14 nt, Pseudomonas aeruginosa PA01
caggccggcgccgc

SEQ ID NO: 3519481 - RNA, 15 nt, Pseudomonas aeruginosa PA01
caggccggcgccgcc

SEQ ID NO: 3519482 - RNA, 13 nt, Pseudomonas aeruginosa PA01
caggccggcgccu

SEQ ID NO: 3519483 - RNA, 23 nt, Pseudomonas aeruginosa PA01
caggccggcgccuugcgccaggc

SEQ ID NO: 3519484 - RNA, 13 nt, Pseudomonas aeruginosa PA01
caggccggcgcga

SEQ ID NO: 3519485 - RNA, 21 nt, Pseudomonas aeruginosa PA01
caggccggcgcgauccuggcg

SEQ ID NO: 3519486 - RNA, 16 nt, Pseudomonas aeruginosa PA01
caggccggcuaaccgc

SEQ ID NO: 3519487 - RNA, 21 nt, Pseudomonas aeruginosa PA01
caggccggcuaaccgcgaagc

SEQ ID NO: 3519488 - RNA, 18 nt, Pseudomonas aeruginosa PA01
caggccgggaauggagau

SEQ ID NO: 3519489 - RNA, 21 nt, Pseudomonas aeruginosa PA01
caggccgggcaccccgagcgg

SEQ ID NO: 3519490 - RNA, 15 nt, Pseudomonas aeruginosa PA01
caggccgggcaggcc

SEQ ID NO: 3519491 - RNA, 16 nt, Pseudomonas aeruginosa PA01
caggccgggcaggccg

SEQ ID NO: 3519492 - RNA, 18 nt, Pseudomonas aeruginosa PA01
caggccgggcaggccgag

SEQ ID NO: 3519493 - RNA, 11 nt, Pseudomonas aeruginosa PA01
caggccgggcg

SEQ ID NO: 3519494 - RNA, 20 nt, Pseudomonas aeruginosa PA01
caggccgggcggacgcuggg

SEQ ID NO: 3519495 - RNA, 21 nt, Pseudomonas aeruginosa PA01
caggccgggcggacgcugggc

SEQ ID NO: 3519496 - RNA, 22 nt, Pseudomonas aeruginosa PA01
caggccgggcggacgcugggcu

SEQ ID NO: 3519497 - RNA, 14 nt, Pseudomonas aeruginosa PA01
caggccgggcggau

SEQ ID NO: 3519498 - RNA, 16 nt, Pseudomonas aeruginosa PA01
caggccgggcggauga

SEQ ID NO: 3519499 - RNA, 16 nt, Pseudomonas aeruginosa PA01
caggccgggcggcggc

SEQ ID NO: 3519500 - RNA, 17 nt, Pseudomonas aeruginosa PA01
caggccgggcggcggcg

SEQ ID NO: 3519501 - RNA, 18 nt, Pseudomonas aeruginosa PA01
caggccgggcggcggcgc

SEQ ID NO: 3519502 - RNA, 15 nt, Pseudomonas aeruginosa PA01
caggccgggcuggcc

SEQ ID NO: 3519503 - RNA, 21 nt, Pseudomonas aeruginosa PA01
caggccgggcuggccaccgcc

SEQ ID NO: 3519504 - RNA, 22 nt, Pseudomonas aeruginosa PA01
caggccgggcuggccaccgcca

SEQ ID NO: 3519505 - RNA, 16 nt, Pseudomonas aeruginosa PA01
caggccgggucgcagc

SEQ ID NO: 3519506 - RNA, 17 nt, Pseudomonas aeruginosa PA01
caggccgggucgcagcc

SEQ ID NO: 3519507 - RNA, 21 nt, Pseudomonas aeruginosa PA01
caggccggugaucucgcggcg

SEQ ID NO: 3519508 - RNA, 22 nt, Pseudomonas aeruginosa PA01
caggccggugaucucgcggcgc

SEQ ID NO: 3519509 - RNA, 14 nt, Pseudomonas aeruginosa PA01
caggccggugccgc

SEQ ID NO: 3519510 - RNA, 17 nt, Pseudomonas aeruginosa PA01
caggccggugccgccgg

SEQ ID NO: 3519511 - RNA, 21 nt, Pseudomonas aeruginosa PA01
caggccggugccgccggccac

SEQ ID NO: 3519512 - RNA, 13 nt, Pseudomonas aeruginosa PA01
caggccggugguc

SEQ ID NO: 3519513 - RNA, 16 nt, Pseudomonas aeruginosa PA01
caggccguagaccacc

SEQ ID NO: 3519514 - RNA, 22 nt, Pseudomonas aeruginosa PA01
caggccguagaccaccagcagc

SEQ ID NO: 3519515 - RNA, 23 nt, Pseudomonas aeruginosa PA01
caggccguagaccaccagcagca

SEQ ID NO: 3519516 - RNA, 16 nt, Pseudomonas aeruginosa PA01
caggccguagcugcgc

SEQ ID NO: 3519517 - RNA, 14 nt, Pseudomonas aeruginosa PA01
caggccgugccaga

SEQ ID NO: 3519518 - RNA, 17 nt, Pseudomonas aeruginosa PA01
caggccgugggccggcg

SEQ ID NO: 3519519 - RNA, 20 nt, Pseudomonas aeruginosa PA01
caggccgugggccggcgcgc

SEQ ID NO: 3519520 - RNA, 17 nt, Pseudomonas aeruginosa PA01
caggccguucaggcggg

SEQ ID NO: 3519521 - RNA, 15 nt, Pseudomonas aeruginosa PA01
caggccuccagcaac

SEQ ID NO: 3519522 - RNA, 19 nt, Pseudomonas aeruginosa PA01
caggccuccagcaacgccg

SEQ ID NO: 3519523 - RNA, 21 nt, Pseudomonas aeruginosa PA01
caggccuccagcaacgccgcc

SEQ ID NO: 3519524 - RNA, 22 nt, Pseudomonas aeruginosa PA01
caggccuccagcaacgccgccc

SEQ ID NO: 3519525 - RNA, 16 nt, Pseudomonas aeruginosa PA01
caggccucccagccgu

SEQ ID NO: 3519526 - RNA, 18 nt, Pseudomonas aeruginosa PA01
caggccucccagccgugg

SEQ ID NO: 3519527 - RNA, 21 nt, Pseudomonas aeruginosa PA01
caggccucccagccgugggcg

SEQ ID NO: 3519528 - RNA, 13 nt, Pseudomonas aeruginosa PA01
caggccucggcgc

SEQ ID NO: 3519529 - RNA, 16 nt, Pseudomonas aeruginosa PA01
caggccucggcgcggg

SEQ ID NO: 3519530 - RNA, 17 nt, Pseudomonas aeruginosa PA01
caggccucggcgcgggc

SEQ ID NO: 3519531 - RNA, 17 nt, Pseudomonas aeruginosa PA01
caggccuggagcgccuc

SEQ ID NO: 3519532 - RNA, 19 nt, Pseudomonas aeruginosa PA01
caggccuggagcgccucga

SEQ ID NO: 3519533 - RNA, 16 nt, Pseudomonas aeruginosa PA01
caggccuuccacgccu

SEQ ID NO: 3519534 - RNA, 23 nt, Pseudomonas aeruginosa PA01
caggccuuccagaacgccgcgca

SEQ ID NO: 3519535 - RNA, 12 nt, Pseudomonas aeruginosa PA01
caggccuuccgg

SEQ ID NO: 3519536 - RNA, 14 nt, Pseudomonas aeruginosa PA01
caggccuuccggga

SEQ ID NO: 3519537 - RNA, 22 nt, Pseudomonas aeruginosa PA01
caggccuucgacgguucgcgaa

SEQ ID NO: 3519538 - RNA, 21 nt, Pseudomonas aeruginosa PA01
caggccuucgacuucgacgaa

SEQ ID NO: 3519539 - RNA, 14 nt, Pseudomonas aeruginosa PA01
caggccuucggcgc

SEQ ID NO: 3519540 - RNA, 16 nt, Pseudomonas aeruginosa PA01
caggccuucggcgccg

SEQ ID NO: 3519541 - RNA, 17 nt, Pseudomonas aeruginosa PA01
caggccuucggcgccgg

SEQ ID NO: 3519542 - RNA, 14 nt, Pseudomonas aeruginosa PA01
caggccuugcagca

SEQ ID NO: 3519543 - RNA, 22 nt, Pseudomonas aeruginosa PA01
caggccuugcagcaacucgccg

SEQ ID NO: 3519544 - RNA, 17 nt, Pseudomonas aeruginosa PA01
caggccuugcagggccg

SEQ ID NO: 3519545 - RNA, 19 nt, Pseudomonas aeruginosa PA01
caggccuugcagggccgcc

SEQ ID NO: 3519546 - RNA, 22 nt, Pseudomonas aeruginosa PA01
caggccuugcagggccgccagc

SEQ ID NO: 3519547 - RNA, 14 nt, Pseudomonas aeruginosa PA01
caggccuugcgcgg

SEQ ID NO: 3519548 - RNA, 20 nt, Pseudomonas aeruginosa PA01
caggccuugcgcggcgccgg

SEQ ID NO: 3519549 - RNA, 21 nt, Pseudomonas aeruginosa PA01
caggccuugcugaucagguug

SEQ ID NO: 3519550 - RNA, 23 nt, Pseudomonas aeruginosa PA01
caggccuugcugaucagguugcc

SEQ ID NO: 3519551 - RNA, 24 nt, Pseudomonas aeruginosa PA01
caggccuuuugguuuucgcuccuc

SEQ ID NO: 3519552 - RNA, 19 nt, Pseudomonas aeruginosa PA01
caggcgaaagucggcgcga

SEQ ID NO: 3519553 - RNA, 21 nt, Pseudomonas aeruginosa PA01
caggcgaaagucggcgcgacu

SEQ ID NO: 3519554 - RNA, 17 nt, Pseudomonas aeruginosa PA01
caggcgaaccuggagaa

SEQ ID NO: 3519555 - RNA, 15 nt, Pseudomonas aeruginosa PA01
caggcgaacugccga

SEQ ID NO: 3519556 - RNA, 20 nt, Pseudomonas aeruginosa PA01
caggcgaacugccgacggcg

SEQ ID NO: 3519557 - RNA, 20 nt, Pseudomonas aeruginosa PA01
caggcgaagaaagccccugc

SEQ ID NO: 3519558 - RNA, 15 nt, Pseudomonas aeruginosa PA01
caggcgaagcggcug

SEQ ID NO: 3519559 - RNA, 20 nt, Pseudomonas aeruginosa PA01
caggcgaagcggcuggccgc

SEQ ID NO: 3519560 - RNA, 13 nt, Pseudomonas aeruginosa PA01
caggcgacgccgc

SEQ ID NO: 3519561 - RNA, 15 nt, Pseudomonas aeruginosa PA01
caggcgacgccgcgc

SEQ ID NO: 3519562 - RNA, 21 nt, Pseudomonas aeruginosa PA01
caggcgacgccgcgcugcaag

SEQ ID NO: 3519563 - RNA, 21 nt, Pseudomonas aeruginosa PA01
caggcgacgcugaugccggcg

SEQ ID NO: 3519564 - RNA, 21 nt, Pseudomonas aeruginosa PA01
caggcgacggucaggccgagc

SEQ ID NO: 3519565 - RNA, 22 nt, Pseudomonas aeruginosa PA01
caggcgacguuuuucccguggg

SEQ ID NO: 3519566 - RNA, 15 nt, Pseudomonas aeruginosa PA01
caggcgaggaacagc

SEQ ID NO: 3519567 - RNA, 20 nt, Pseudomonas aeruginosa PA01
caggcgaggaacagcgagag

SEQ ID NO: 3519568 - RNA, 23 nt, Pseudomonas aeruginosa PA01
caggcgaggaacagcgagagggg

SEQ ID NO: 3519569 - RNA, 16 nt, Pseudomonas aeruginosa PA01
caggcgauacaccgca

SEQ ID NO: 3519570 - RNA, 17 nt, Pseudomonas aeruginosa PA01
caggcgauacaccgcau

SEQ ID NO: 3519571 - RNA, 16 nt, Pseudomonas aeruginosa PA01
caggcgauagccgacc

SEQ ID NO: 3519572 - RNA, 17 nt, Pseudomonas aeruginosa PA01
caggcgauagccgacca

SEQ ID NO: 3519573 - RNA, 21 nt, Pseudomonas aeruginosa PA01
caggcgauagccgaccaggcc

SEQ ID NO: 3519574 - RNA, 23 nt, Pseudomonas aeruginosa PA01
caggcgauaucccgccgccgcgc

SEQ ID NO: 3519575 - RNA, 18 nt, Pseudomonas aeruginosa PA01
caggcgauccacagcagg

SEQ ID NO: 3519576 - RNA, 15 nt, Pseudomonas aeruginosa PA01
caggcgaugaacggc

SEQ ID NO: 3519577 - RNA, 16 nt, Pseudomonas aeruginosa PA01
caggcgaugaccgccc

SEQ ID NO: 3519578 - RNA, 17 nt, Pseudomonas aeruginosa PA01
caggcgaugaccgcccc

SEQ ID NO: 3519579 - RNA, 18 nt, Pseudomonas aeruginosa PA01
caggcgaugaccgccccg

SEQ ID NO: 3519580 - RNA, 20 nt, Pseudomonas aeruginosa PA01
caggcgaugaccgccccggc

SEQ ID NO: 3519581 - RNA, 15 nt, Pseudomonas aeruginosa PA01
caggcgaugaucagc

SEQ ID NO: 3519582 - RNA, 16 nt, Pseudomonas aeruginosa PA01
caggcgaugaucagcc

SEQ ID NO: 3519583 - RNA, 17 nt, Pseudomonas aeruginosa PA01
caggcgaugaucagccc

SEQ ID NO: 3519584 - RNA, 19 nt, Pseudomonas aeruginosa PA01
caggcgauggugcgcucgc

SEQ ID NO: 3519585 - RNA, 20 nt, Pseudomonas aeruginosa PA01
caggcgcaaccagaccagca

SEQ ID NO: 3519586 - RNA, 23 nt, Pseudomonas aeruginosa PA01
caggcgcaaccagaccagcagga

SEQ ID NO: 3519587 - RNA, 13 nt, Pseudomonas aeruginosa PA01
caggcgcaccagc

SEQ ID NO: 3519588 - RNA, 18 nt, Pseudomonas aeruginosa PA01
caggcgcaccagcaggcg

SEQ ID NO: 3519589 - RNA, 20 nt, Pseudomonas aeruginosa PA01
caggcgcaccagcaggcgca

SEQ ID NO: 3519590 - RNA, 11 nt, Pseudomonas aeruginosa PA01
caggcgcaccu

SEQ ID NO: 3519591 - RNA, 15 nt, Pseudomonas aeruginosa PA01
caggcgcaccuggcg

SEQ ID NO: 3519592 - RNA, 16 nt, Pseudomonas aeruginosa PA01
caggcgcaccuggcgg

SEQ ID NO: 3519593 - RNA, 15 nt, Pseudomonas aeruginosa PA01
caggcgcacgcgcag

SEQ ID NO: 3519594 - RNA, 16 nt, Pseudomonas aeruginosa PA01
caggcgcacgcgcagu

SEQ ID NO: 3519595 - RNA, 17 nt, Pseudomonas aeruginosa PA01
caggcgcacgcgcagua

SEQ ID NO: 3519596 - RNA, 13 nt, Pseudomonas aeruginosa PA01
caggcgcagcagc

SEQ ID NO: 3519597 - RNA, 24 nt, Pseudomonas aeruginosa PA01
caggcgcagcagcgacucgcuggg

SEQ ID NO: 3519598 - RNA, 15 nt, Pseudomonas aeruginosa PA01
caggcgcagccagca

SEQ ID NO: 3519599 - RNA, 17 nt, Pseudomonas aeruginosa PA01
caggcgcagcguccugc

SEQ ID NO: 3519600 - RNA, 20 nt, Pseudomonas aeruginosa PA01
caggcgcagcguccugcccu

SEQ ID NO: 3519601 - RNA, 15 nt, Pseudomonas aeruginosa PA01
caggcgcaggcgagg

SEQ ID NO: 3519602 - RNA, 16 nt, Pseudomonas aeruginosa PA01
caggcgcaggcgagga

SEQ ID NO: 3519603 - RNA, 16 nt, Pseudomonas aeruginosa PA01
caggcgcaggggcgag

SEQ ID NO: 3519604 - RNA, 16 nt, Pseudomonas aeruginosa PA01
caggcgcaggucggcc

SEQ ID NO: 3519605 - RNA, 23 nt, Pseudomonas aeruginosa PA01
caggcgcaggucggccucggcga

SEQ ID NO: 3519606 - RNA, 18 nt, Pseudomonas aeruginosa PA01
caggcgcaguaacgccug

SEQ ID NO: 3519607 - RNA, 17 nt, Pseudomonas aeruginosa PA01
caggcgcaguaggccug

SEQ ID NO: 3519608 - RNA, 21 nt, Pseudomonas aeruginosa PA01
caggcgcaguaggccugguag

SEQ ID NO: 3519609 - RNA, 22 nt, Pseudomonas aeruginosa PA01
caggcgcaucaggccaaagccg

SEQ ID NO: 3519610 - RNA, 17 nt, Pseudomonas aeruginosa PA01
caggcgcaugcccaggg

SEQ ID NO: 3519611 - RNA, 13 nt, Pseudomonas aeruginosa PA01
caggcgcauggcg

SEQ ID NO: 3519612 - RNA, 22 nt, Pseudomonas aeruginosa PA01
caggcgccaaccgggcagcagc

SEQ ID NO: 3519613 - RNA, 12 nt, Pseudomonas aeruginosa PA01
caggcgccagga

SEQ ID NO: 3519614 - RNA, 12 nt, Pseudomonas aeruginosa PA01
caggcgccaggg

SEQ ID NO: 3519615 - RNA, 21 nt, Pseudomonas aeruginosa PA01
caggcgccagggacgcgcagc

SEQ ID NO: 3519616 - RNA, 17 nt, Pseudomonas aeruginosa PA01
caggcgccagggccggg

SEQ ID NO: 3519617 - RNA, 22 nt, Pseudomonas aeruginosa PA01
caggcgccagguagugccgccc

SEQ ID NO: 3519618 - RNA, 14 nt, Pseudomonas aeruginosa PA01
caggcgcccaggca

SEQ ID NO: 3519619 - RNA, 17 nt, Pseudomonas aeruginosa PA01
caggcgcccaggcagca

SEQ ID NO: 3519620 - RNA, 14 nt, Pseudomonas aeruginosa PA01
caggcgccccuggu

SEQ ID NO: 3519621 - RNA, 24 nt, Pseudomonas aeruginosa PA01
caggcgcccgguggaggucugcca

SEQ ID NO: 3519622 - RNA, 21 nt, Pseudomonas aeruginosa PA01
caggcgcccuggccgucggcc

SEQ ID NO: 3519623 - RNA, 22 nt, Pseudomonas aeruginosa PA01
caggcgcccuggccgucggccu

SEQ ID NO: 3519624 - RNA, 13 nt, Pseudomonas aeruginosa PA01
caggcgccgauca

SEQ ID NO: 3519625 - RNA, 20 nt, Pseudomonas aeruginosa PA01
caggcgccgaugcccaggcc

SEQ ID NO: 3519626 - RNA, 23 nt, Pseudomonas aeruginosa PA01
caggcgccgauggcugucggcgc

SEQ ID NO: 3519627 - RNA, 15 nt, Pseudomonas aeruginosa PA01
caggcgccggccggg

SEQ ID NO: 3519628 - RNA, 17 nt, Pseudomonas aeruginosa PA01
caggcgccggccgggcu

SEQ ID NO: 3519629 - RNA, 13 nt, Pseudomonas aeruginosa PA01
caggcgccggccu

SEQ ID NO: 3519630 - RNA, 15 nt, Pseudomonas aeruginosa PA01
caggcgccggccucg

SEQ ID NO: 3519631 - RNA, 15 nt, Pseudomonas aeruginosa PA01
caggcgccggcggau

SEQ ID NO: 3519632 - RNA, 22 nt, Pseudomonas aeruginosa PA01
caggcgccggcggaucagcccg

SEQ ID NO: 3519633 - RNA, 23 nt, Pseudomonas aeruginosa PA01
caggcgcgaacgcucccagccga

SEQ ID NO: 3519634 - RNA, 22 nt, Pseudomonas aeruginosa PA01
caggcgcgacagcucguggcug

SEQ ID NO: 3519635 - RNA, 14 nt, Pseudomonas aeruginosa PA01
caggcgcgccaggc

SEQ ID NO: 3519636 - RNA, 14 nt, Pseudomonas aeruginosa PA01
caggcgcgccugga

SEQ ID NO: 3519637 - RNA, 21 nt, Pseudomonas aeruginosa PA01
caggcgcgccuggaucagcgc

SEQ ID NO: 3519638 - RNA, 23 nt, Pseudomonas aeruginosa PA01
caggcgcgccuggaucagcgccu

SEQ ID NO: 3519639 - RNA, 16 nt, Pseudomonas aeruginosa PA01
caggcgcgccuggccc

SEQ ID NO: 3519640 - RNA, 21 nt, Pseudomonas aeruginosa PA01
caggcgcgccuggcccuggcg

SEQ ID NO: 3519641 - RNA, 17 nt, Pseudomonas aeruginosa PA01
caggcgcgcggccagcg

SEQ ID NO: 3519642 - RNA, 20 nt, Pseudomonas aeruginosa PA01
caggcgcgcucgggaucgcc

SEQ ID NO: 3519643 - RNA, 14 nt, Pseudomonas aeruginosa PA01
caggcgcggcgucg

SEQ ID NO: 3519644 - RNA, 14 nt, Pseudomonas aeruginosa PA01
caggcgcgggcugg

SEQ ID NO: 3519645 - RNA, 17 nt, Pseudomonas aeruginosa PA01
caggcgcgggcuggcca

SEQ ID NO: 3519646 - RNA, 20 nt, Pseudomonas aeruginosa PA01
caggcgcgggcuggccaccg

SEQ ID NO: 3519647 - RNA, 19 nt, Pseudomonas aeruginosa PA01
caggcgcgggucaucggcc

SEQ ID NO: 3519648 - RNA, 22 nt, Pseudomonas aeruginosa PA01
caggcgcgggucaucggcccga

SEQ ID NO: 3519649 - RNA, 11 nt, Pseudomonas aeruginosa PA01
caggcgcgguu

SEQ ID NO: 3519650 - RNA, 19 nt, Pseudomonas aeruginosa PA01
caggcgcgguugccgcugc

SEQ ID NO: 3519651 - RNA, 21 nt, Pseudomonas aeruginosa PA01
caggcgcgguugccgcugcgg

SEQ ID NO: 3519652 - RNA, 17 nt, Pseudomonas aeruginosa PA01
caggcgcgucgcggccu

SEQ ID NO: 3519653 - RNA, 17 nt, Pseudomonas aeruginosa PA01
caggcgcgucuccagcu

SEQ ID NO: 3519654 - RNA, 17 nt, Pseudomonas aeruginosa PA01
caggcgcuauccgccgu

SEQ ID NO: 3519655 - RNA, 18 nt, Pseudomonas aeruginosa PA01
caggcgcuauccgccguu

SEQ ID NO: 3519656 - RNA, 14 nt, Pseudomonas aeruginosa PA01
caggcgcuccagac

SEQ ID NO: 3519657 - RNA, 16 nt, Pseudomonas aeruginosa PA01
caggcgcuccagggca

SEQ ID NO: 3519658 - RNA, 21 nt, Pseudomonas aeruginosa PA01
caggcgcuccgggcuccacca

SEQ ID NO: 3519659 - RNA, 21 nt, Pseudomonas aeruginosa PA01
caggcgcuccuccagcgccgc

SEQ ID NO: 3519660 - RNA, 15 nt, Pseudomonas aeruginosa PA01
caggcgcuccuggug

SEQ ID NO: 3519661 - RNA, 20 nt, Pseudomonas aeruginosa PA01
caggcgcuccuugagcagcu

SEQ ID NO: 3519662 - RNA, 21 nt, Pseudomonas aeruginosa PA01
caggcgcuccuugagcagcuc

SEQ ID NO: 3519663 - RNA, 15 nt, Pseudomonas aeruginosa PA01
caggcgcucgcgggc

SEQ ID NO: 3519664 - RNA, 23 nt, Pseudomonas aeruginosa PA01
caggcgcucggcgaccuugcgca

SEQ ID NO: 3519665 - RNA, 16 nt, Pseudomonas aeruginosa PA01
caggcgcucggcggcg

SEQ ID NO: 3519666 - RNA, 17 nt, Pseudomonas aeruginosa PA01
caggcgcucggcggcgc

SEQ ID NO: 3519667 - RNA, 19 nt, Pseudomonas aeruginosa PA01
caggcgcucggcggcgcgc

SEQ ID NO: 3519668 - RNA, 20 nt, Pseudomonas aeruginosa PA01
caggcgcucggcggcgcgca

SEQ ID NO: 3519669 - RNA, 23 nt, Pseudomonas aeruginosa PA01
caggcgcucggcggcgcgcagcg

SEQ ID NO: 3519670 - RNA, 14 nt, Pseudomonas aeruginosa PA01
caggcgcucgucga

SEQ ID NO: 3519671 - RNA, 21 nt, Pseudomonas aeruginosa PA01
caggcgcucgucgaggaucug

SEQ ID NO: 3519672 - RNA, 13 nt, Pseudomonas aeruginosa PA01
caggcgcugcgcg

SEQ ID NO: 3519673 - RNA, 19 nt, Pseudomonas aeruginosa PA01
caggcgcugcucgauggcc

SEQ ID NO: 3519674 - RNA, 13 nt, Pseudomonas aeruginosa PA01
caggcgcugcugg

SEQ ID NO: 3519675 - RNA, 21 nt, Pseudomonas aeruginosa PA01
caggcgcugcugguggacguc

SEQ ID NO: 3519676 - RNA, 12 nt, Pseudomonas aeruginosa PA01
caggcgcuggcc

SEQ ID NO: 3519677 - RNA, 13 nt, Pseudomonas aeruginosa PA01
caggcgcuggccg

SEQ ID NO: 3519678 - RNA, 15 nt, Pseudomonas aeruginosa PA01
caggcgcuggcgaau

SEQ ID NO: 3519679 - RNA, 15 nt, Pseudomonas aeruginosa PA01
caggcgcuggcgccg

SEQ ID NO: 3519680 - RNA, 16 nt, Pseudomonas aeruginosa PA01
caggcgcuggcgccga

SEQ ID NO: 3519681 - RNA, 17 nt, Pseudomonas aeruginosa PA01
caggcgcuggcgccgau

SEQ ID NO: 3519682 - RNA, 20 nt, Pseudomonas aeruginosa PA01
caggcgcuggcgccgaugcu

SEQ ID NO: 3519683 - RNA, 13 nt, Pseudomonas aeruginosa PA01
caggcgcuggucc

SEQ ID NO: 3519684 - RNA, 19 nt, Pseudomonas aeruginosa PA01
caggcgcuguccuguggcg

SEQ ID NO: 3519685 - RNA, 22 nt, Pseudomonas aeruginosa PA01
caggcgcuguccuguggcgcuu

SEQ ID NO: 3519686 - RNA, 17 nt, Pseudomonas aeruginosa PA01
caggcgcuucagcgccu

SEQ ID NO: 3519687 - RNA, 21 nt, Pseudomonas aeruginosa PA01
caggcgcuucagcgccucgac

SEQ ID NO: 3519688 - RNA, 17 nt, Pseudomonas aeruginosa PA01
caggcgcuucagcucga

SEQ ID NO: 3519689 - RNA, 20 nt, Pseudomonas aeruginosa PA01
caggcgcuucagcucgaggc

SEQ ID NO: 3519690 - RNA, 17 nt, Pseudomonas aeruginosa PA01
caggcgcuuguccaucg

SEQ ID NO: 3519691 - RNA, 23 nt, Pseudomonas aeruginosa PA01
caggcgcuuguccgagaccggca

SEQ ID NO: 3519692 - RNA, 22 nt, Pseudomonas aeruginosa PA01
caggcggaaauacggcuccggc

SEQ ID NO: 3519693 - RNA, 22 nt, Pseudomonas aeruginosa PA01
caggcggaacggcucgcgaccg

SEQ ID NO: 3519694 - RNA, 20 nt, Pseudomonas aeruginosa PA01
caggcggacacgcaggcgcc

SEQ ID NO: 3519695 - RNA, 23 nt, Pseudomonas aeruginosa PA01
caggcggacacgcaggcgccgau

SEQ ID NO: 3519696 - RNA, 20 nt, Pseudomonas aeruginosa PA01
caggcggagauugcggcgaa

SEQ ID NO: 3519697 - RNA, 19 nt, Pseudomonas aeruginosa PA01
caggcggaucgcccggcgc

SEQ ID NO: 3519698 - RNA, 23 nt, Pseudomonas aeruginosa PA01
caggcggaucgcccggcgcucca

SEQ ID NO: 3519699 - RNA, 23 nt, Pseudomonas aeruginosa PA01
caggcggaucucggugucgguga

SEQ ID NO: 3519700 - RNA, 22 nt, Pseudomonas aeruginosa PA01
caggcggauuuccugcggcacg

SEQ ID NO: 3519701 - RNA, 17 nt, Pseudomonas aeruginosa PA01
caggcggcacucggcga

SEQ ID NO: 3519702 - RNA, 16 nt, Pseudomonas aeruginosa PA01
caggcggcagccgcgg

SEQ ID NO: 3519703 - RNA, 19 nt, Pseudomonas aeruginosa PA01
caggcggcagccgcggcug

SEQ ID NO: 3519704 - RNA, 21 nt, Pseudomonas aeruginosa PA01
caggcggccgaauccuccagc

SEQ ID NO: 3519705 - RNA, 13 nt, Pseudomonas aeruginosa PA01
caggcggccgacg

SEQ ID NO: 3519706 - RNA, 14 nt, Pseudomonas aeruginosa PA01
caggcggccgacga

SEQ ID NO: 3519707 - RNA, 17 nt, Pseudomonas aeruginosa PA01
caggcggccgcuggcga

SEQ ID NO: 3519708 - RNA, 18 nt, Pseudomonas aeruginosa PA01
caggcggccguccucggg

SEQ ID NO: 3519709 - RNA, 19 nt, Pseudomonas aeruginosa PA01
caggcggccguccucggga

SEQ ID NO: 3519710 - RNA, 16 nt, Pseudomonas aeruginosa PA01
caggcggccgucggcc

SEQ ID NO: 3519711 - RNA, 18 nt, Pseudomonas aeruginosa PA01
caggcggccgucggccug

SEQ ID NO: 3519712 - RNA, 24 nt, Pseudomonas aeruginosa PA01
caggcggcgggccggcguccagga

SEQ ID NO: 3519713 - RNA, 16 nt, Pseudomonas aeruginosa PA01
caggcggcuggcgcga

SEQ ID NO: 3519714 - RNA, 17 nt, Pseudomonas aeruginosa PA01
caggcggcuggcgcgau

SEQ ID NO: 3519715 - RNA, 22 nt, Pseudomonas aeruginosa PA01
caggcgggcgaaguagaagcgc

SEQ ID NO: 3519716 - RNA, 14 nt, Pseudomonas aeruginosa PA01
caggcgggcgccau

SEQ ID NO: 3519717 - RNA, 19 nt, Pseudomonas aeruginosa PA01
caggcgggcuccgccgccg

SEQ ID NO: 3519718 - RNA, 20 nt, Pseudomonas aeruginosa PA01
caggcgggcuccgccgccgu

SEQ ID NO: 3519719 - RNA, 21 nt, Pseudomonas aeruginosa PA01
caggcggggcguauagcccgg

SEQ ID NO: 3519720 - RNA, 18 nt, Pseudomonas aeruginosa PA01
caggcggggucagagggu

SEQ ID NO: 3519721 - RNA, 16 nt, Pseudomonas aeruginosa PA01
caggcgguagcgccgc

SEQ ID NO: 3519722 - RNA, 17 nt, Pseudomonas aeruginosa PA01
caggcgguagcgccgcg

SEQ ID NO: 3519723 - RNA, 18 nt, Pseudomonas aeruginosa PA01
caggcgguagcgccgcgc

SEQ ID NO: 3519724 - RNA, 16 nt, Pseudomonas aeruginosa PA01
caggcgguaguagggu

SEQ ID NO: 3519725 - RNA, 15 nt, Pseudomonas aeruginosa PA01
caggcggucagcgcg

SEQ ID NO: 3519726 - RNA, 16 nt, Pseudomonas aeruginosa PA01
caggcggucagcgcgu

SEQ ID NO: 3519727 - RNA, 12 nt, Pseudomonas aeruginosa PA01
caggcgguccag

SEQ ID NO: 3519728 - RNA, 17 nt, Pseudomonas aeruginosa PA01
caggcgguccagccaga

SEQ ID NO: 3519729 - RNA, 16 nt, Pseudomonas aeruginosa PA01
caggcggucgccgaac

SEQ ID NO: 3519730 - RNA, 19 nt, Pseudomonas aeruginosa PA01
caggcggucgccgaacagc

SEQ ID NO: 3519731 - RNA, 14 nt, Pseudomonas aeruginosa PA01
caggcggucggcca

SEQ ID NO: 3519732 - RNA, 22 nt, Pseudomonas aeruginosa PA01
caggcggucggccaucuggcug

SEQ ID NO: 3519733 - RNA, 24 nt, Pseudomonas aeruginosa PA01
caggcggucggccaucuggcugcc

SEQ ID NO: 3519734 - RNA, 14 nt, Pseudomonas aeruginosa PA01
caggcgguggagca

SEQ ID NO: 3519735 - RNA, 16 nt, Pseudomonas aeruginosa PA01
caggcgguugcggaac

SEQ ID NO: 3519736 - RNA, 16 nt, Pseudomonas aeruginosa PA01
caggcgguuggcccgc

SEQ ID NO: 3519737 - RNA, 20 nt, Pseudomonas aeruginosa PA01
caggcguaccagcuugucgc

SEQ ID NO: 3519738 - RNA, 23 nt, Pseudomonas aeruginosa PA01
caggcguaccagcuugucgccuu

SEQ ID NO: 3519739 - RNA, 15 nt, Pseudomonas aeruginosa PA01
caggcguacgucgau

SEQ ID NO: 3519740 - RNA, 15 nt, Pseudomonas aeruginosa PA01
caggcgucccauggc

SEQ ID NO: 3519741 - RNA, 20 nt, Pseudomonas aeruginosa PA01
caggcgucccuggagcaggg

SEQ ID NO: 3519742 - RNA, 23 nt, Pseudomonas aeruginosa PA01
caggcgucccuggagcagggcga

SEQ ID NO: 3519743 - RNA, 14 nt, Pseudomonas aeruginosa PA01
caggcguccgcugg

SEQ ID NO: 3519744 - RNA, 17 nt, Pseudomonas aeruginosa PA01
caggcguccgcuggccu

SEQ ID NO: 3519745 - RNA, 17 nt, Pseudomonas aeruginosa PA01
caggcgucgcaccuggg

SEQ ID NO: 3519746 - RNA, 14 nt, Pseudomonas aeruginosa PA01
caggcgucgccgac

SEQ ID NO: 3519747 - RNA, 23 nt, Pseudomonas aeruginosa PA01
caggcgucgccgacuucggcaag

SEQ ID NO: 3519748 - RNA, 15 nt, Pseudomonas aeruginosa PA01
caggcgucgcgccag

SEQ ID NO: 3519749 - RNA, 17 nt, Pseudomonas aeruginosa PA01
caggcgucgcgccagca

SEQ ID NO: 3519750 - RNA, 14 nt, Pseudomonas aeruginosa PA01
caggcgucggcgcc

SEQ ID NO: 3519751 - RNA, 16 nt, Pseudomonas aeruginosa PA01
caggcgucggcgccuu

SEQ ID NO: 3519752 - RNA, 17 nt, Pseudomonas aeruginosa PA01
caggcgucggcgccuuc

SEQ ID NO: 3519753 - RNA, 23 nt, Pseudomonas aeruginosa PA01
caggcgucguuguugcgggcgag

SEQ ID NO: 3519754 - RNA, 16 nt, Pseudomonas aeruginosa PA01
caggcgucuucggcga

SEQ ID NO: 3519755 - RNA, 16 nt, Pseudomonas aeruginosa PA01
caggcgugcugcacgg

SEQ ID NO: 3519756 - RNA, 15 nt, Pseudomonas aeruginosa PA01
caggcgugggccagc

SEQ ID NO: 3519757 - RNA, 16 nt, Pseudomonas aeruginosa PA01
caggcgugggccagcc

SEQ ID NO: 3519758 - RNA, 19 nt, Pseudomonas aeruginosa PA01
caggcgugggccagcccag

SEQ ID NO: 3519759 - RNA, 22 nt, Pseudomonas aeruginosa PA01
caggcgugggccagcccagaac

SEQ ID NO: 3519760 - RNA, 15 nt, Pseudomonas aeruginosa PA01
caggcguggggcgaa

SEQ ID NO: 3519761 - RNA, 17 nt, Pseudomonas aeruginosa PA01
caggcguuauccgccga

SEQ ID NO: 3519762 - RNA, 19 nt, Pseudomonas aeruginosa PA01
caggcguuauccgccgaua

SEQ ID NO: 3519763 - RNA, 17 nt, Pseudomonas aeruginosa PA01
caggcguuauccgccgc

SEQ ID NO: 3519764 - RNA, 18 nt, Pseudomonas aeruginosa PA01
caggcguuauccgccgcc

SEQ ID NO: 3519765 - RNA, 19 nt, Pseudomonas aeruginosa PA01
caggcguuauccgccgccg

SEQ ID NO: 3519766 - RNA, 22 nt, Pseudomonas aeruginosa PA01
caggcguuauccgccgccgacg

SEQ ID NO: 3519767 - RNA, 23 nt, Pseudomonas aeruginosa PA01
caggcguuauccgccgccgacgu

SEQ ID NO: 3519768 - RNA, 16 nt, Pseudomonas aeruginosa PA01
caggcguuccaccagg

SEQ ID NO: 3519769 - RNA, 22 nt, Pseudomonas aeruginosa PA01
caggcguuccaccaggcgucgc

SEQ ID NO: 3519770 - RNA, 17 nt, Pseudomonas aeruginosa PA01
caggcguuccggggugc

SEQ ID NO: 3519771 - RNA, 17 nt, Pseudomonas aeruginosa PA01
caggcguuccucgacga

SEQ ID NO: 3519772 - RNA, 17 nt, Pseudomonas aeruginosa PA01
caggcguuccuuuuccu

SEQ ID NO: 3519773 - RNA, 23 nt, Pseudomonas aeruginosa PA01
caggcguuccuuuuccucgauca

SEQ ID NO: 3519774 - RNA, 14 nt, Pseudomonas aeruginosa PA01
caggcguucggcga

SEQ ID NO: 3519775 - RNA, 13 nt, Pseudomonas aeruginosa PA01
caggcucacgcau

SEQ ID NO: 3519776 - RNA, 19 nt, Pseudomonas aeruginosa PA01
caggcucacgcaucccuuc

SEQ ID NO: 3519777 - RNA, 23 nt, Pseudomonas aeruginosa PA01
caggcucacgcguucggcgaugc

SEQ ID NO: 3519778 - RNA, 13 nt, Pseudomonas aeruginosa PA01
caggcucagcgca

SEQ ID NO: 3519779 - RNA, 18 nt, Pseudomonas aeruginosa PA01
caggcucagcgcaugcgg

SEQ ID NO: 3519780 - RNA, 17 nt, Pseudomonas aeruginosa PA01
caggcucagcucggcga

SEQ ID NO: 3519781 - RNA, 20 nt, Pseudomonas aeruginosa PA01
caggcucagcucggcgaugc

SEQ ID NO: 3519782 - RNA, 16 nt, Pseudomonas aeruginosa PA01
caggcucaggccgggc

SEQ ID NO: 3519783 - RNA, 13 nt, Pseudomonas aeruginosa PA01
caggcucaggguc

SEQ ID NO: 3519784 - RNA, 21 nt, Pseudomonas aeruginosa PA01
caggcucagggucucgcgggc

SEQ ID NO: 3519785 - RNA, 15 nt, Pseudomonas aeruginosa PA01
caggcucaguucggc

SEQ ID NO: 3519786 - RNA, 19 nt, Pseudomonas aeruginosa PA01
caggcucaguucggccagc

SEQ ID NO: 3519787 - RNA, 20 nt, Pseudomonas aeruginosa PA01
caggcucaguucggccagcg

SEQ ID NO: 3519788 - RNA, 23 nt, Pseudomonas aeruginosa PA01
caggcucaguucggccagcggca

SEQ ID NO: 3519789 - RNA, 18 nt, Pseudomonas aeruginosa PA01
caggcucaucgcccgccc

SEQ ID NO: 3519790 - RNA, 13 nt, Pseudomonas aeruginosa PA01
caggcuccgacug

SEQ ID NO: 3519791 - RNA, 20 nt, Pseudomonas aeruginosa PA01
caggcucgaacgguggcccc

SEQ ID NO: 3519792 - RNA, 11 nt, Pseudomonas aeruginosa PA01
caggcucgaca

SEQ ID NO: 3519793 - RNA, 19 nt, Pseudomonas aeruginosa PA01
caggcucgacaggucggcg

SEQ ID NO: 3519794 - RNA, 21 nt, Pseudomonas aeruginosa PA01
caggcucgacaggucggcgaa

SEQ ID NO: 3519795 - RNA, 23 nt, Pseudomonas aeruginosa PA01
caggcucgaggccgagccggcau

SEQ ID NO: 3519796 - RNA, 15 nt, Pseudomonas aeruginosa PA01
caggcucgccccggc

SEQ ID NO: 3519797 - RNA, 18 nt, Pseudomonas aeruginosa PA01
caggcucgccccggcggc

SEQ ID NO: 3519798 - RNA, 19 nt, Pseudomonas aeruginosa PA01
caggcucgccccggcggcg

SEQ ID NO: 3519799 - RNA, 17 nt, Pseudomonas aeruginosa PA01
caggcucgccgccagca

SEQ ID NO: 3519800 - RNA, 19 nt, Pseudomonas aeruginosa PA01
caggcucgccgccagcagg

SEQ ID NO: 3519801 - RNA, 20 nt, Pseudomonas aeruginosa PA01
caggcucgccgccagcagga

SEQ ID NO: 3519802 - RNA, 14 nt, Pseudomonas aeruginosa PA01
caggcucggccugu

SEQ ID NO: 3519803 - RNA, 23 nt, Pseudomonas aeruginosa PA01
caggcucggccuguaccgcuucc

SEQ ID NO: 3519804 - RNA, 21 nt, Pseudomonas aeruginosa PA01
caggcucgguucugcgcacca

SEQ ID NO: 3519805 - RNA, 20 nt, Pseudomonas aeruginosa PA01
caggcucucgcgcagcagga

SEQ ID NO: 3519806 - RNA, 17 nt, Pseudomonas aeruginosa PA01
caggcucuucagcacgc

SEQ ID NO: 3519807 - RNA, 15 nt, Pseudomonas aeruginosa PA01
caggcucuuggucgc

SEQ ID NO: 3519808 - RNA, 23 nt, Pseudomonas aeruginosa PA01
caggcucuuggucgcggucugga

SEQ ID NO: 3519809 - RNA, 18 nt, Pseudomonas aeruginosa PA01
caggcucuuugcgacuga

SEQ ID NO: 3519810 - RNA, 17 nt, Pseudomonas aeruginosa PA01
caggcugaagcggccgc

SEQ ID NO: 3519811 - RNA, 18 nt, Pseudomonas aeruginosa PA01
caggcugaagcggccgcc

SEQ ID NO: 3519812 - RNA, 20 nt, Pseudomonas aeruginosa PA01
caggcugaagcggccgccga

SEQ ID NO: 3519813 - RNA, 13 nt, Pseudomonas aeruginosa PA01
caggcugacccgg

SEQ ID NO: 3519814 - RNA, 21 nt, Pseudomonas aeruginosa PA01
caggcugaccgcgugggccgg

SEQ ID NO: 3519815 - RNA, 22 nt, Pseudomonas aeruginosa PA01
caggcugaccgcgugggccggc

SEQ ID NO: 3519816 - RNA, 17 nt, Pseudomonas aeruginosa PA01
caggcugacgucgacgc

SEQ ID NO: 3519817 - RNA, 23 nt, Pseudomonas aeruginosa PA01
caggcugacgucgacgcagcgcg

SEQ ID NO: 3519818 - RNA, 18 nt, Pseudomonas aeruginosa PA01
caggcugaucagcccgcu

SEQ ID NO: 3519819 - RNA, 14 nt, Pseudomonas aeruginosa PA01
caggcugaucggcg

SEQ ID NO: 3519820 - RNA, 16 nt, Pseudomonas aeruginosa PA01
caggcugaucggcgcg

SEQ ID NO: 3519821 - RNA, 21 nt, Pseudomonas aeruginosa PA01
caggcugaucggcgcgccggc

SEQ ID NO: 3519822 - RNA, 22 nt, Pseudomonas aeruginosa PA01
caggcugaucggcgcgccggcc

SEQ ID NO: 3519823 - RNA, 21 nt, Pseudomonas aeruginosa PA01
caggcugaucuugccgcuggu

SEQ ID NO: 3519824 - RNA, 23 nt, Pseudomonas aeruginosa PA01
caggcugaucuugccgcugguga

SEQ ID NO: 3519825 - RNA, 22 nt, Pseudomonas aeruginosa PA01
caggcugcccagguagccggcg

SEQ ID NO: 3519826 - RNA, 19 nt, Pseudomonas aeruginosa PA01
caggcugccgagcaggguc

SEQ ID NO: 3519827 - RNA, 13 nt, Pseudomonas aeruginosa PA01
caggcugccgccg

SEQ ID NO: 3519828 - RNA, 14 nt, Pseudomonas aeruginosa PA01
caggcugccgccgc

SEQ ID NO: 3519829 - RNA, 22 nt, Pseudomonas aeruginosa PA01
caggcugccgccgccgucgaca

SEQ ID NO: 3519830 - RNA, 15 nt, Pseudomonas aeruginosa PA01
caggcugccgccgua

SEQ ID NO: 3519831 - RNA, 17 nt, Pseudomonas aeruginosa PA01
caggcugccgccguaga

SEQ ID NO: 3519832 - RNA, 19 nt, Pseudomonas aeruginosa PA01
caggcugccgccguagaag

SEQ ID NO: 3519833 - RNA, 23 nt, Pseudomonas aeruginosa PA01
caggcugccgccuucgcgggcca

SEQ ID NO: 3519834 - RNA, 15 nt, Pseudomonas aeruginosa PA01
caggcugccggacgc

SEQ ID NO: 3519835 - RNA, 16 nt, Pseudomonas aeruginosa PA01
caggcugccggacgcg

SEQ ID NO: 3519836 - RNA, 13 nt, Pseudomonas aeruginosa PA01
caggcugccggcc

SEQ ID NO: 3519837 - RNA, 21 nt, Pseudomonas aeruginosa PA01
caggcugccggccagguagcg

SEQ ID NO: 3519838 - RNA, 17 nt, Pseudomonas aeruginosa PA01
caggcugccguccaggc

SEQ ID NO: 3519839 - RNA, 19 nt, Pseudomonas aeruginosa PA01
caggcugccguccaggcgc

SEQ ID NO: 3519840 - RNA, 22 nt, Pseudomonas aeruginosa PA01
caggcugccguugcggcccuuc

SEQ ID NO: 3519841 - RNA, 14 nt, Pseudomonas aeruginosa PA01
caggcugcgcaccu

SEQ ID NO: 3519842 - RNA, 16 nt, Pseudomonas aeruginosa PA01
caggcugcgcaccucg

SEQ ID NO: 3519843 - RNA, 20 nt, Pseudomonas aeruginosa PA01
caggcugcgcaccucggcca

SEQ ID NO: 3519844 - RNA, 22 nt, Pseudomonas aeruginosa PA01
caggcugcgcaccucggccagg

SEQ ID NO: 3519845 - RNA, 13 nt, Pseudomonas aeruginosa PA01
caggcugcgccgc

SEQ ID NO: 3519846 - RNA, 16 nt, Pseudomonas aeruginosa PA01
caggcugcgccgcugc

SEQ ID NO: 3519847 - RNA, 13 nt, Pseudomonas aeruginosa PA01
caggcugcgcuug

SEQ ID NO: 3519848 - RNA, 17 nt, Pseudomonas aeruginosa PA01
caggcugcgcuugcugc

SEQ ID NO: 3519849 - RNA, 18 nt, Pseudomonas aeruginosa PA01
caggcugcgcuugcugcc

SEQ ID NO: 3519850 - RNA, 22 nt, Pseudomonas aeruginosa PA01
caggcugcgcuugcugccaugg

SEQ ID NO: 3519851 - RNA, 13 nt, Pseudomonas aeruginosa PA01
caggcugcggcgg

SEQ ID NO: 3519852 - RNA, 18 nt, Pseudomonas aeruginosa PA01
caggcugcggcggaaggc

SEQ ID NO: 3519853 - RNA, 22 nt, Pseudomonas aeruginosa PA01
caggcugcggcggaaggcggcg

SEQ ID NO: 3519854 - RNA, 21 nt, Pseudomonas aeruginosa PA01
caggcugcgggcgacaaggcu

SEQ ID NO: 3519855 - RNA, 15 nt, Pseudomonas aeruginosa PA01
caggcugcugcugcg

SEQ ID NO: 3519856 - RNA, 17 nt, Pseudomonas aeruginosa PA01
caggcugcugucgaggg

SEQ ID NO: 3519857 - RNA, 17 nt, Pseudomonas aeruginosa PA01
caggcuggccacgaaca

SEQ ID NO: 3519858 - RNA, 14 nt, Pseudomonas aeruginosa PA01
caggcuggccagaa

SEQ ID NO: 3519859 - RNA, 13 nt, Pseudomonas aeruginosa PA01
caggcuggccccg

SEQ ID NO: 3519860 - RNA, 14 nt, Pseudomonas aeruginosa PA01
caggcuggccccgg

SEQ ID NO: 3519861 - RNA, 17 nt, Pseudomonas aeruginosa PA01
caggcuggccccgguga

SEQ ID NO: 3519862 - RNA, 17 nt, Pseudomonas aeruginosa PA01
caggcuggccgagcgcc

SEQ ID NO: 3519863 - RNA, 11 nt, Pseudomonas aeruginosa PA01
caggcuggccu

SEQ ID NO: 3519864 - RNA, 15 nt, Pseudomonas aeruginosa PA01
caggcuggcggcauc

SEQ ID NO: 3519865 - RNA, 16 nt, Pseudomonas aeruginosa PA01
caggcuggcggcaucg

SEQ ID NO: 3519866 - RNA, 21 nt, Pseudomonas aeruginosa PA01
caggcuggcggcaucggcgcc

SEQ ID NO: 3519867 - RNA, 15 nt, Pseudomonas aeruginosa PA01
caggcuggcggccag

SEQ ID NO: 3519868 - RNA, 16 nt, Pseudomonas aeruginosa PA01
caggcuggcggccagg

SEQ ID NO: 3519869 - RNA, 17 nt, Pseudomonas aeruginosa PA01
caggcuggcggccaggg

SEQ ID NO: 3519870 - RNA, 21 nt, Pseudomonas aeruginosa PA01
caggcuggcggccagggcaug

SEQ ID NO: 3519871 - RNA, 22 nt, Pseudomonas aeruginosa PA01
caggcuggcggccagggcaugg

SEQ ID NO: 3519872 - RNA, 12 nt, Pseudomonas aeruginosa PA01
caggcuggcgua

SEQ ID NO: 3519873 - RNA, 23 nt, Pseudomonas aeruginosa PA01
caggcuggcguacuugggcauca

SEQ ID NO: 3519874 - RNA, 22 nt, Pseudomonas aeruginosa PA01
caggcuggcgucgacgccgaag

SEQ ID NO: 3519875 - RNA, 14 nt, Pseudomonas aeruginosa PA01
caggcuggcguuga

SEQ ID NO: 3519876 - RNA, 12 nt, Pseudomonas aeruginosa PA01
caggcuggcucc

SEQ ID NO: 3519877 - RNA, 12 nt, Pseudomonas aeruginosa PA01
caggcuggcugg

SEQ ID NO: 3519878 - RNA, 13 nt, Pseudomonas aeruginosa PA01
caggcuggcuggu

SEQ ID NO: 3519879 - RNA, 16 nt, Pseudomonas aeruginosa PA01
caggcugggccgaacc

SEQ ID NO: 3519880 - RNA, 23 nt, Pseudomonas aeruginosa PA01
caggcugggguugcggcgcccgc

SEQ ID NO: 3519881 - RNA, 19 nt, Pseudomonas aeruginosa PA01
caggcugguaugcagcaac

SEQ ID NO: 3519882 - RNA, 17 nt, Pseudomonas aeruginosa PA01
caggcugguggucaccg

SEQ ID NO: 3519883 - RNA, 20 nt, Pseudomonas aeruginosa PA01
caggcugguggucaccgcca

SEQ ID NO: 3519884 - RNA, 23 nt, Pseudomonas aeruginosa PA01
caggcuguacagcaggagcgcca

SEQ ID NO: 3519885 - RNA, 17 nt, Pseudomonas aeruginosa PA01
caggcugucagggcgca

SEQ ID NO: 3519886 - RNA, 21 nt, Pseudomonas aeruginosa PA01
caggcuguccacgccgaaguc

SEQ ID NO: 3519887 - RNA, 13 nt, Pseudomonas aeruginosa PA01
caggcugucggcc

SEQ ID NO: 3519888 - RNA, 16 nt, Pseudomonas aeruginosa PA01
caggcugucggccagc

SEQ ID NO: 3519889 - RNA, 17 nt, Pseudomonas aeruginosa PA01
caggcugucggccagcc

SEQ ID NO: 3519890 - RNA, 18 nt, Pseudomonas aeruginosa PA01
caggcugucggccagccc

SEQ ID NO: 3519891 - RNA, 20 nt, Pseudomonas aeruginosa PA01
caggcugucggccagccccu

SEQ ID NO: 3519892 - RNA, 16 nt, Pseudomonas aeruginosa PA01
caggcugucggccauc

SEQ ID NO: 3519893 - RNA, 20 nt, Pseudomonas aeruginosa PA01
caggcugugcaggaaggcga

SEQ ID NO: 3519894 - RNA, 17 nt, Pseudomonas aeruginosa PA01
caggcuguggcgcggcu

SEQ ID NO: 3519895 - RNA, 17 nt, Pseudomonas aeruginosa PA01
caggcuguugcccuggg

SEQ ID NO: 3519896 - RNA, 12 nt, Pseudomonas aeruginosa PA01
caggcuucgagc

SEQ ID NO: 3519897 - RNA, 21 nt, Pseudomonas aeruginosa PA01
caggcuucgagcacuucccag

SEQ ID NO: 3519898 - RNA, 14 nt, Pseudomonas aeruginosa PA01
caggcuuggucagg

SEQ ID NO: 3519899 - RNA, 15 nt, Pseudomonas aeruginosa PA01
caggcuuggucaggg

SEQ ID NO: 3519900 - RNA, 20 nt, Pseudomonas aeruginosa PA01
caggcuuuccaccgccagca

SEQ ID NO: 3519901 - RNA, 21 nt, Pseudomonas aeruginosa PA01
caggcuuuccaccgccagcac

SEQ ID NO: 3519902 - RNA, 23 nt, Pseudomonas aeruginosa PA01
caggcuuuccaccgccagcaccc

SEQ ID NO: 3519903 - RNA, 17 nt, Pseudomonas aeruginosa PA01
caggcuuuccagcccgg

SEQ ID NO: 3519904 - RNA, 20 nt, Pseudomonas aeruginosa PA01
caggcuuuccagcccggcgu

SEQ ID NO: 3519905 - RNA, 17 nt, Pseudomonas aeruginosa PA01
caggcuuuccgccgagc

SEQ ID NO: 3519906 - RNA, 15 nt, Pseudomonas aeruginosa PA01
caggcuuugcggcaa

SEQ ID NO: 3519907 - RNA, 21 nt, Pseudomonas aeruginosa PA01
cagggaagaugcacaccagcu

SEQ ID NO: 3519908 - RNA, 18 nt, Pseudomonas aeruginosa PA01
cagggaagcgcgcgccag

SEQ ID NO: 3519909 - RNA, 23 nt, Pseudomonas aeruginosa PA01
cagggaagcgcgcgccagucccg

SEQ ID NO: 3519910 - RNA, 21 nt, Pseudomonas aeruginosa PA01
cagggaaggcgcgcucagcgc

SEQ ID NO: 3519911 - RNA, 19 nt, Pseudomonas aeruginosa PA01
cagggaaucgucacggcgu

SEQ ID NO: 3519912 - RNA, 20 nt, Pseudomonas aeruginosa PA01
cagggaauggaugcgcggca

SEQ ID NO: 3519913 - RNA, 23 nt, Pseudomonas aeruginosa PA01
cagggaauggaugcgcggcagca

SEQ ID NO: 3519914 - RNA, 16 nt, Pseudomonas aeruginosa PA01
cagggacgcgcagcgg

SEQ ID NO: 3519915 - RNA, 19 nt, Pseudomonas aeruginosa PA01
cagggacgcgcagcggcgc

SEQ ID NO: 3519916 - RNA, 20 nt, Pseudomonas aeruginosa PA01
cagggacgcgcagcggcgcc

SEQ ID NO: 3519917 - RNA, 12 nt, Pseudomonas aeruginosa PA01
cagggagaacag

SEQ ID NO: 3519918 - RNA, 13 nt, Pseudomonas aeruginosa PA01
cagggagaacagc

SEQ ID NO: 3519919 - RNA, 17 nt, Pseudomonas aeruginosa PA01
cagggagaacagcaggg

SEQ ID NO: 3519920 - RNA, 15 nt, Pseudomonas aeruginosa PA01
cagggagaaccaggc

SEQ ID NO: 3519921 - RNA, 14 nt, Pseudomonas aeruginosa PA01
cagggagcgcucgc

SEQ ID NO: 3519922 - RNA, 16 nt, Pseudomonas aeruginosa PA01
cagggaggagggcgag

SEQ ID NO: 3519923 - RNA, 19 nt, Pseudomonas aeruginosa PA01
cagggaggcgcuggccagc

SEQ ID NO: 3519924 - RNA, 16 nt, Pseudomonas aeruginosa PA01
cagggaguccgccagc

SEQ ID NO: 3519925 - RNA, 17 nt, Pseudomonas aeruginosa PA01
cagggaguccgccagcc

SEQ ID NO: 3519926 - RNA, 19 nt, Pseudomonas aeruginosa PA01
cagggauacucaugcaggc

SEQ ID NO: 3519927 - RNA, 20 nt, Pseudomonas aeruginosa PA01
cagggauacucaugcaggcg

SEQ ID NO: 3519928 - RNA, 20 nt, Pseudomonas aeruginosa PA01
cagggauuccuuggucaggu

SEQ ID NO: 3519929 - RNA, 17 nt, Pseudomonas aeruginosa PA01
cagggcaaacagcuccg

SEQ ID NO: 3519930 - RNA, 18 nt, Pseudomonas aeruginosa PA01
cagggcaaacagcuccgg

SEQ ID NO: 3519931 - RNA, 12 nt, Pseudomonas aeruginosa PA01
cagggcaccgcc

SEQ ID NO: 3519932 - RNA, 16 nt, Pseudomonas aeruginosa PA01
cagggcaccgccgagg

SEQ ID NO: 3519933 - RNA, 17 nt, Pseudomonas aeruginosa PA01
cagggcaccgccgagga

SEQ ID NO: 3519934 - RNA, 20 nt, Pseudomonas aeruginosa PA01
cagggcaccgccgaggaaca

SEQ ID NO: 3519935 - RNA, 21 nt, Pseudomonas aeruginosa PA01
cagggcaccgccgaggaacau

SEQ ID NO: 3519936 - RNA, 12 nt, Pseudomonas aeruginosa PA01
cagggcagcagg

SEQ ID NO: 3519937 - RNA, 13 nt, Pseudomonas aeruginosa PA01
cagggcagcaggu

SEQ ID NO: 3519938 - RNA, 14 nt, Pseudomonas aeruginosa PA01
cagggcagcagguc

SEQ ID NO: 3519939 - RNA, 16 nt, Pseudomonas aeruginosa PA01
cagggcagcaggucgc

SEQ ID NO: 3519940 - RNA, 16 nt, Pseudomonas aeruginosa PA01
cagggcagccgccgcg

SEQ ID NO: 3519941 - RNA, 12 nt, Pseudomonas aeruginosa PA01
cagggcagcgcg

SEQ ID NO: 3519942 - RNA, 13 nt, Pseudomonas aeruginosa PA01
cagggcagcgcga

SEQ ID NO: 3519943 - RNA, 21 nt, Pseudomonas aeruginosa PA01
cagggcagggaguccgccagc

SEQ ID NO: 3519944 - RNA, 22 nt, Pseudomonas aeruginosa PA01
cagggcagggaguccgccagcc

SEQ ID NO: 3519945 - RNA, 23 nt, Pseudomonas aeruginosa PA01
cagggcagggaguccgccagccg

SEQ ID NO: 3519946 - RNA, 24 nt, Pseudomonas aeruginosa PA01
cagggcagggaguccgccagccgg

SEQ ID NO: 3519947 - RNA, 18 nt, Pseudomonas aeruginosa PA01
cagggcauagaugccgcc

SEQ ID NO: 3519948 - RNA, 20 nt, Pseudomonas aeruginosa PA01
cagggcauauucauagccgu

SEQ ID NO: 3519949 - RNA, 14 nt, Pseudomonas aeruginosa PA01
cagggcauggguca

SEQ ID NO: 3519950 - RNA, 20 nt, Pseudomonas aeruginosa PA01
cagggcaugggucagcgcca

SEQ ID NO: 3519951 - RNA, 23 nt, Pseudomonas aeruginosa PA01
cagggcaugggucagcgccagca

SEQ ID NO: 3519952 - RNA, 14 nt, Pseudomonas aeruginosa PA01
cagggcauuggcca

SEQ ID NO: 3519953 - RNA, 13 nt, Pseudomonas aeruginosa PA01
cagggccagcaac

SEQ ID NO: 3519954 - RNA, 16 nt, Pseudomonas aeruginosa PA01
cagggccagcagcgcu

SEQ ID NO: 3519955 - RNA, 15 nt, Pseudomonas aeruginosa PA01
cagggccagcagcgg

SEQ ID NO: 3519956 - RNA, 17 nt, Pseudomonas aeruginosa PA01
cagggccagcagcggcg

SEQ ID NO: 3519957 - RNA, 18 nt, Pseudomonas aeruginosa PA01
cagggccagcagcggcgg

SEQ ID NO: 3519958 - RNA, 15 nt, Pseudomonas aeruginosa PA01
cagggccagcgccug

SEQ ID NO: 3519959 - RNA, 19 nt, Pseudomonas aeruginosa PA01
cagggccagcgccuggcgc

SEQ ID NO: 3519960 - RNA, 19 nt, Pseudomonas aeruginosa PA01
cagggccagcggguugauc

SEQ ID NO: 3519961 - RNA, 23 nt, Pseudomonas aeruginosa PA01
cagggccaggaugaccaggcuga

SEQ ID NO: 3519962 - RNA, 14 nt, Pseudomonas aeruginosa PA01
cagggccaggccga

SEQ ID NO: 3519963 - RNA, 15 nt, Pseudomonas aeruginosa PA01
cagggccaggccgag

SEQ ID NO: 3519964 - RNA, 16 nt, Pseudomonas aeruginosa PA01
cagggccaggccgagc

SEQ ID NO: 3519965 - RNA, 18 nt, Pseudomonas aeruginosa PA01
cagggccaggccgagcaa

SEQ ID NO: 3519966 - RNA, 22 nt, Pseudomonas aeruginosa PA01
cagggccaggccgagcgcgccg

SEQ ID NO: 3519967 - RNA, 13 nt, Pseudomonas aeruginosa PA01
cagggccagggaa

SEQ ID NO: 3519968 - RNA, 16 nt, Pseudomonas aeruginosa PA01
cagggccagggaaauc

SEQ ID NO: 3519969 - RNA, 19 nt, Pseudomonas aeruginosa PA01
cagggccagggaggcgcug

SEQ ID NO: 3519970 - RNA, 20 nt, Pseudomonas aeruginosa PA01
cagggccagggaggcgcugg

SEQ ID NO: 3519971 - RNA, 16 nt, Pseudomonas aeruginosa PA01
cagggccagggcgagg

SEQ ID NO: 3519972 - RNA, 22 nt, Pseudomonas aeruginosa PA01
cagggcccagagcagcaccagc

SEQ ID NO: 3519973 - RNA, 23 nt, Pseudomonas aeruginosa PA01
cagggcccagagcagcaccagca

SEQ ID NO: 3519974 - RNA, 20 nt, Pseudomonas aeruginosa PA01
cagggcccauuccacgugcu

SEQ ID NO: 3519975 - RNA, 16 nt, Pseudomonas aeruginosa PA01
cagggccgagcgcagc

SEQ ID NO: 3519976 - RNA, 17 nt, Pseudomonas aeruginosa PA01
cagggccgagcgcagcg

SEQ ID NO: 3519977 - RNA, 19 nt, Pseudomonas aeruginosa PA01
cagggccgagcgcagcgcc

SEQ ID NO: 3519978 - RNA, 15 nt, Pseudomonas aeruginosa PA01
cagggccgccagccg

SEQ ID NO: 3519979 - RNA, 16 nt, Pseudomonas aeruginosa PA01
cagggccgccagccgc

SEQ ID NO: 3519980 - RNA, 16 nt, Pseudomonas aeruginosa PA01
cagggccgcgccgagc

SEQ ID NO: 3519981 - RNA, 14 nt, Pseudomonas aeruginosa PA01
cagggccgcggcgg

SEQ ID NO: 3519982 - RNA, 22 nt, Pseudomonas aeruginosa PA01
cagggccgcucgagggcgaccg

SEQ ID NO: 3519983 - RNA, 18 nt, Pseudomonas aeruginosa PA01
cagggccggaucggccuu

SEQ ID NO: 3519984 - RNA, 23 nt, Pseudomonas aeruginosa PA01
cagggccggaucggccuuggcga

SEQ ID NO: 3519985 - RNA, 20 nt, Pseudomonas aeruginosa PA01
cagggccggaugccaccgcu

SEQ ID NO: 3519986 - RNA, 14 nt, Pseudomonas aeruginosa PA01
cagggccucgccac

SEQ ID NO: 3519987 - RNA, 21 nt, Pseudomonas aeruginosa PA01
cagggccucggggccguccgc

SEQ ID NO: 3519988 - RNA, 22 nt, Pseudomonas aeruginosa PA01
cagggccucuucgcaacggccg

SEQ ID NO: 3519989 - RNA, 16 nt, Pseudomonas aeruginosa PA01
cagggccugcuccagc

SEQ ID NO: 3519990 - RNA, 18 nt, Pseudomonas aeruginosa PA01
cagggccugcuccagcgg

SEQ ID NO: 3519991 - RNA, 13 nt, Pseudomonas aeruginosa PA01
cagggccuggcgc

SEQ ID NO: 3519992 - RNA, 16 nt, Pseudomonas aeruginosa PA01
cagggccuggcgcacg

SEQ ID NO: 3519993 - RNA, 19 nt, Pseudomonas aeruginosa PA01
cagggccuggcgcacggcc

SEQ ID NO: 3519994 - RNA, 20 nt, Pseudomonas aeruginosa PA01
cagggccuggcgcacggccu

SEQ ID NO: 3519995 - RNA, 19 nt, Pseudomonas aeruginosa PA01
cagggccuugccgcgaccg

SEQ ID NO: 3519996 - RNA, 16 nt, Pseudomonas aeruginosa PA01
cagggcgaacagcgcc

SEQ ID NO: 3519997 - RNA, 19 nt, Pseudomonas aeruginosa PA01
cagggcgaacagcgccgcg

SEQ ID NO: 3519998 - RNA, 13 nt, Pseudomonas aeruginosa PA01
cagggcgaaccac

SEQ ID NO: 3519999 - RNA, 19 nt, Pseudomonas aeruginosa PA01
cagggcgaaggccaccauc

SEQ ID NO: 3520000 - RNA, 18 nt, Pseudomonas aeruginosa PA01
cagggcgaagucggcgcg

SEQ ID NO: 3520001 - RNA, 21 nt, Pseudomonas aeruginosa PA01
cagggcgaagucggcgcgcca

SEQ ID NO: 3520002 - RNA, 18 nt, Pseudomonas aeruginosa PA01
cagggcgaauaccagugc

SEQ ID NO: 3520003 - RNA, 16 nt, Pseudomonas aeruginosa PA01
cagggcgaccagaagg

SEQ ID NO: 3520004 - RNA, 15 nt, Pseudomonas aeruginosa PA01
cagggcgacgccgau

SEQ ID NO: 3520005 - RNA, 18 nt, Pseudomonas aeruginosa PA01
cagggcgacgccgaugcu

SEQ ID NO: 3520006 - RNA, 16 nt, Pseudomonas aeruginosa PA01
cagggcgagcagggca

SEQ ID NO: 3520007 - RNA, 16 nt, Pseudomonas aeruginosa PA01
cagggcgagcagggcg

SEQ ID NO: 3520008 - RNA, 15 nt, Pseudomonas aeruginosa PA01
cagggcgaggaucac

SEQ ID NO: 3520009 - RNA, 15 nt, Pseudomonas aeruginosa PA01
cagggcgaggccgcu

SEQ ID NO: 3520010 - RNA, 22 nt, Pseudomonas aeruginosa PA01
cagggcgaggccgcucuucugg

SEQ ID NO: 3520011 - RNA, 16 nt, Pseudomonas aeruginosa PA01
cagggcgauccagaag

SEQ ID NO: 3520012 - RNA, 18 nt, Pseudomonas aeruginosa PA01
cagggcgauccgcccgca

SEQ ID NO: 3520013 - RNA, 18 nt, Pseudomonas aeruginosa PA01
cagggcgaugaacaccgc

SEQ ID NO: 3520014 - RNA, 15 nt, Pseudomonas aeruginosa PA01
cagggcgcaaccugg

SEQ ID NO: 3520015 - RNA, 20 nt, Pseudomonas aeruginosa PA01
cagggcgcaauugcaccgcu

SEQ ID NO: 3520016 - RNA, 14 nt, Pseudomonas aeruginosa PA01
cagggcgcccgccc

SEQ ID NO: 3520017 - RNA, 15 nt, Pseudomonas aeruginosa PA01
cagggcgcccgcccg

SEQ ID NO: 3520018 - RNA, 18 nt, Pseudomonas aeruginosa PA01
cagggcgcccgcccggca

SEQ ID NO: 3520019 - RNA, 12 nt, Pseudomonas aeruginosa PA01
cagggcgccggg

SEQ ID NO: 3520020 - RNA, 23 nt, Pseudomonas aeruginosa PA01
cagggcgccgucgggggcgcgua

SEQ ID NO: 3520021 - RNA, 17 nt, Pseudomonas aeruginosa PA01
cagggcgcgguagggau

SEQ ID NO: 3520022 - RNA, 17 nt, Pseudomonas aeruginosa PA01
cagggcgcguccagcuc

SEQ ID NO: 3520023 - RNA, 22 nt, Pseudomonas aeruginosa PA01
cagggcgcguccagcuccacca

SEQ ID NO: 3520024 - RNA, 16 nt, Pseudomonas aeruginosa PA01
cagggcgcugaccagg

SEQ ID NO: 3520025 - RNA, 15 nt, Pseudomonas aeruginosa PA01
cagggcgcugagcgc

SEQ ID NO: 3520026 - RNA, 13 nt, Pseudomonas aeruginosa PA01
cagggcgcugccg

SEQ ID NO: 3520027 - RNA, 14 nt, Pseudomonas aeruginosa PA01
cagggcgcugccga

SEQ ID NO: 3520028 - RNA, 21 nt, Pseudomonas aeruginosa PA01
cagggcgcugccgaucagcca

SEQ ID NO: 3520029 - RNA, 22 nt, Pseudomonas aeruginosa PA01
cagggcggauaaucgcagcgcg

SEQ ID NO: 3520030 - RNA, 23 nt, Pseudomonas aeruginosa PA01
cagggcggauaaucgcagcgcgg

SEQ ID NO: 3520031 - RNA, 13 nt, Pseudomonas aeruginosa PA01
cagggcggcagcg

SEQ ID NO: 3520032 - RNA, 16 nt, Pseudomonas aeruginosa PA01
cagggcggcgagcugg

SEQ ID NO: 3520033 - RNA, 13 nt, Pseudomonas aeruginosa PA01
cagggcggcgccg

SEQ ID NO: 3520034 - RNA, 16 nt, Pseudomonas aeruginosa PA01
cagggcggcgccgaac

SEQ ID NO: 3520035 - RNA, 15 nt, Pseudomonas aeruginosa PA01
cagggcggcgccugg

SEQ ID NO: 3520036 - RNA, 16 nt, Pseudomonas aeruginosa PA01
cagggcggcgccugga

SEQ ID NO: 3520037 - RNA, 18 nt, Pseudomonas aeruginosa PA01
cagggcggcgccuggagc

SEQ ID NO: 3520038 - RNA, 19 nt, Pseudomonas aeruginosa PA01
cagggcggcgccuggagca

SEQ ID NO: 3520039 - RNA, 14 nt, Pseudomonas aeruginosa PA01
cagggcggcgcgga

SEQ ID NO: 3520040 - RNA, 14 nt, Pseudomonas aeruginosa PA01
cagggcggcggcga

SEQ ID NO: 3520041 - RNA, 15 nt, Pseudomonas aeruginosa PA01
cagggcgggccgcuc

SEQ ID NO: 3520042 - RNA, 21 nt, Pseudomonas aeruginosa PA01
cagggcgggccgcucgcgcgg

SEQ ID NO: 3520043 - RNA, 23 nt, Pseudomonas aeruginosa PA01
cagggcgggccgcucgcgcggca

SEQ ID NO: 3520044 - RNA, 17 nt, Pseudomonas aeruginosa PA01
cagggcgguacgccgcg

SEQ ID NO: 3520045 - RNA, 14 nt, Pseudomonas aeruginosa PA01
cagggcggucggcc

SEQ ID NO: 3520046 - RNA, 22 nt, Pseudomonas aeruginosa PA01
cagggcggugagguugccgccg

SEQ ID NO: 3520047 - RNA, 14 nt, Pseudomonas aeruginosa PA01
cagggcguagcgga

SEQ ID NO: 3520048 - RNA, 18 nt, Pseudomonas aeruginosa PA01
cagggcguagcggaagcc

SEQ ID NO: 3520049 - RNA, 21 nt, Pseudomonas aeruginosa PA01
cagggcguagcggaagccguc

SEQ ID NO: 3520050 - RNA, 19 nt, Pseudomonas aeruginosa PA01
cagggcguaggcgucgcga

SEQ ID NO: 3520051 - RNA, 17 nt, Pseudomonas aeruginosa PA01
cagggcguagugcuccu

SEQ ID NO: 3520052 - RNA, 17 nt, Pseudomonas aeruginosa PA01
cagggcguccaguagcg

SEQ ID NO: 3520053 - RNA, 19 nt, Pseudomonas aeruginosa PA01
cagggcgucccguuccggc

SEQ ID NO: 3520054 - RNA, 14 nt, Pseudomonas aeruginosa PA01
cagggcgucgccgg

SEQ ID NO: 3520055 - RNA, 16 nt, Pseudomonas aeruginosa PA01
cagggcgucgccggga

SEQ ID NO: 3520056 - RNA, 17 nt, Pseudomonas aeruginosa PA01
cagggcgucggagagau

SEQ ID NO: 3520057 - RNA, 13 nt, Pseudomonas aeruginosa PA01
cagggcgucggcg

SEQ ID NO: 3520058 - RNA, 14 nt, Pseudomonas aeruginosa PA01
cagggcgucggcgu

SEQ ID NO: 3520059 - RNA, 19 nt, Pseudomonas aeruginosa PA01
cagggcgucggcgugcugg

SEQ ID NO: 3520060 - RNA, 17 nt, Pseudomonas aeruginosa PA01
cagggcgucgucgaggc

SEQ ID NO: 3520061 - RNA, 17 nt, Pseudomonas aeruginosa PA01
cagggcguggucggcgg

SEQ ID NO: 3520062 - RNA, 20 nt, Pseudomonas aeruginosa PA01
cagggcguggucggcggccu

SEQ ID NO: 3520063 - RNA, 21 nt, Pseudomonas aeruginosa PA01
cagggcguggucggcggccuc

SEQ ID NO: 3520064 - RNA, 22 nt, Pseudomonas aeruginosa PA01
cagggcuccgaugaagcaggcg

SEQ ID NO: 3520065 - RNA, 23 nt, Pseudomonas aeruginosa PA01
cagggcucgugccaucaggccgc

SEQ ID NO: 3520066 - RNA, 15 nt, Pseudomonas aeruginosa PA01
cagggcuucccaggc

SEQ ID NO: 3520067 - RNA, 21 nt, Pseudomonas aeruginosa PA01
cagggcuucccaggccagcgg

SEQ ID NO: 3520068 - RNA, 22 nt, Pseudomonas aeruginosa PA01
cagggcuucccaggccagcggg

SEQ ID NO: 3520069 - RNA, 23 nt, Pseudomonas aeruginosa PA01
cagggcuucccaggccagcgggc

SEQ ID NO: 3520070 - RNA, 16 nt, Pseudomonas aeruginosa PA01
cagggcuugcgcgcca

SEQ ID NO: 3520071 - RNA, 19 nt, Pseudomonas aeruginosa PA01
cagggcuugcgcgccacca

SEQ ID NO: 3520072 - RNA, 15 nt, Pseudomonas aeruginosa PA01
cagggcuugugcaga

SEQ ID NO: 3520073 - RNA, 18 nt, Pseudomonas aeruginosa PA01
cagggcuugugcagagag

SEQ ID NO: 3520074 - RNA, 22 nt, Pseudomonas aeruginosa PA01
cagggcuugugcagagaggcug

SEQ ID NO: 3520075 - RNA, 19 nt, Pseudomonas aeruginosa PA01
caggggagcgccggcgcgg

SEQ ID NO: 3520076 - RNA, 17 nt, Pseudomonas aeruginosa PA01
caggggauggucgguga

SEQ ID NO: 3520077 - RNA, 17 nt, Pseudomonas aeruginosa PA01
caggggcacgcuggcga

SEQ ID NO: 3520078 - RNA, 20 nt, Pseudomonas aeruginosa PA01
caggggcacgcuggcgagaa

SEQ ID NO: 3520079 - RNA, 19 nt, Pseudomonas aeruginosa PA01
caggggcauguccaccgcc

SEQ ID NO: 3520080 - RNA, 20 nt, Pseudomonas aeruginosa PA01
caggggcauguccaccgccg

SEQ ID NO: 3520081 - RNA, 18 nt, Pseudomonas aeruginosa PA01
caggggccgacgcgcugc

SEQ ID NO: 3520082 - RNA, 19 nt, Pseudomonas aeruginosa PA01
caggggccgaugccgggca

SEQ ID NO: 3520083 - RNA, 13 nt, Pseudomonas aeruginosa PA01
caggggcgcgccg

SEQ ID NO: 3520084 - RNA, 15 nt, Pseudomonas aeruginosa PA01
caggggcgcgccggc

SEQ ID NO: 3520085 - RNA, 14 nt, Pseudomonas aeruginosa PA01
caggggcgcggcgc

SEQ ID NO: 3520086 - RNA, 16 nt, Pseudomonas aeruginosa PA01
caggggcuagucgcgc

SEQ ID NO: 3520087 - RNA, 17 nt, Pseudomonas aeruginosa PA01
caggggcuagucgcgca

SEQ ID NO: 3520088 - RNA, 19 nt, Pseudomonas aeruginosa PA01
caggggcuagucgcgcagc

SEQ ID NO: 3520089 - RNA, 20 nt, Pseudomonas aeruginosa PA01
caggggcuagucgcgcagcg

SEQ ID NO: 3520090 - RNA, 14 nt, Pseudomonas aeruginosa PA01
caggggcucggcga

SEQ ID NO: 3520091 - RNA, 15 nt, Pseudomonas aeruginosa PA01
caggggcugaacagc

SEQ ID NO: 3520092 - RNA, 19 nt, Pseudomonas aeruginosa PA01
caggggcugaacagcgcca

SEQ ID NO: 3520093 - RNA, 21 nt, Pseudomonas aeruginosa PA01
cagggggcgacauagcggcug

SEQ ID NO: 3520094 - RNA, 14 nt, Pseudomonas aeruginosa PA01
caggggguagggcg

SEQ ID NO: 3520095 - RNA, 17 nt, Pseudomonas aeruginosa PA01
caggggguagggcgaau

SEQ ID NO: 3520096 - RNA, 18 nt, Pseudomonas aeruginosa PA01
caggggucgacgcagggc

SEQ ID NO: 3520097 - RNA, 22 nt, Pseudomonas aeruginosa PA01
caggggucgacgcagggcggcg

SEQ ID NO: 3520098 - RNA, 16 nt, Pseudomonas aeruginosa PA01
cagggguucgaguccc

SEQ ID NO: 3520099 - RNA, 19 nt, Pseudomonas aeruginosa PA01
cagggguucgaguccccua

SEQ ID NO: 3520100 - RNA, 14 nt, Pseudomonas aeruginosa PA01
caggguagccacgc

SEQ ID NO: 3520101 - RNA, 24 nt, Pseudomonas aeruginosa PA01
caggguagcgccgcgggccagccg

SEQ ID NO: 3520102 - RNA, 18 nt, Pseudomonas aeruginosa PA01
caggguauagguggugcu

SEQ ID NO: 3520103 - RNA, 19 nt, Pseudomonas aeruginosa PA01
caggguauuuuccagcagg

SEQ ID NO: 3520104 - RNA, 20 nt, Pseudomonas aeruginosa PA01
caggguauuuuccagcaggc

SEQ ID NO: 3520105 - RNA, 22 nt, Pseudomonas aeruginosa PA01
caggguauuuuccagcaggcag

SEQ ID NO: 3520106 - RNA, 14 nt, Pseudomonas aeruginosa PA01
cagggucacgccag

SEQ ID NO: 3520107 - RNA, 22 nt, Pseudomonas aeruginosa PA01
cagggucacgccgaucaccccg

SEQ ID NO: 3520108 - RNA, 18 nt, Pseudomonas aeruginosa PA01
cagggucacgccgcggcu

SEQ ID NO: 3520109 - RNA, 19 nt, Pseudomonas aeruginosa PA01
cagggucacgccgcggcug

SEQ ID NO: 3520110 - RNA, 20 nt, Pseudomonas aeruginosa PA01
cagggucacgcugggcaggu

SEQ ID NO: 3520111 - RNA, 16 nt, Pseudomonas aeruginosa PA01
cagggucagcagcgcc

SEQ ID NO: 3520112 - RNA, 17 nt, Pseudomonas aeruginosa PA01
cagggucagcagcgcca

SEQ ID NO: 3520113 - RNA, 16 nt, Pseudomonas aeruginosa PA01
cagggucagcucgaca

SEQ ID NO: 3520114 - RNA, 15 nt, Pseudomonas aeruginosa PA01
cagggucaggcccuu

SEQ ID NO: 3520115 - RNA, 20 nt, Pseudomonas aeruginosa PA01
cagggucaggcccuugagga

SEQ ID NO: 3520116 - RNA, 17 nt, Pseudomonas aeruginosa PA01
cagggucagguugccgg

SEQ ID NO: 3520117 - RNA, 16 nt, Pseudomonas aeruginosa PA01
cagggucagucgagca

SEQ ID NO: 3520118 - RNA, 23 nt, Pseudomonas aeruginosa PA01
cagggucgagucgggucuucggg

SEQ ID NO: 3520119 - RNA, 12 nt, Pseudomonas aeruginosa PA01
cagggucgccag

SEQ ID NO: 3520120 - RNA, 17 nt, Pseudomonas aeruginosa PA01
cagggucgccagcaggu

SEQ ID NO: 3520121 - RNA, 16 nt, Pseudomonas aeruginosa PA01
cagggucgcccgugcc

SEQ ID NO: 3520122 - RNA, 22 nt, Pseudomonas aeruginosa PA01
cagggucgcccgugccucggcg

SEQ ID NO: 3520123 - RNA, 23 nt, Pseudomonas aeruginosa PA01
cagggucgcccgugccucggcgg

SEQ ID NO: 3520124 - RNA, 22 nt, Pseudomonas aeruginosa PA01
cagggucgcguagaccaucgcc

SEQ ID NO: 3520125 - RNA, 14 nt, Pseudomonas aeruginosa PA01
cagggucggcaccg

SEQ ID NO: 3520126 - RNA, 16 nt, Pseudomonas aeruginosa PA01
cagggucggcaccgag

SEQ ID NO: 3520127 - RNA, 19 nt, Pseudomonas aeruginosa PA01
cagggucggcaccgagccg

SEQ ID NO: 3520128 - RNA, 17 nt, Pseudomonas aeruginosa PA01
cagggucggcaccugca

SEQ ID NO: 3520129 - RNA, 22 nt, Pseudomonas aeruginosa PA01
cagggucggcaccugcagacgg

SEQ ID NO: 3520130 - RNA, 18 nt, Pseudomonas aeruginosa PA01
cagggucggcaggaccga

SEQ ID NO: 3520131 - RNA, 15 nt, Pseudomonas aeruginosa PA01
cagggucgggccgcg

SEQ ID NO: 3520132 - RNA, 19 nt, Pseudomonas aeruginosa PA01
cagggucgguucgcggcgc

SEQ ID NO: 3520133 - RNA, 14 nt, Pseudomonas aeruginosa PA01
cagggucuccagga

SEQ ID NO: 3520134 - RNA, 17 nt, Pseudomonas aeruginosa PA01
cagggucuccaggacca

SEQ ID NO: 3520135 - RNA, 14 nt, Pseudomonas aeruginosa PA01
cagggucucgcggg

SEQ ID NO: 3520136 - RNA, 15 nt, Pseudomonas aeruginosa PA01
cagggucucgcgggc

SEQ ID NO: 3520137 - RNA, 16 nt, Pseudomonas aeruginosa PA01
cagggucuucaggccg

SEQ ID NO: 3520138 - RNA, 16 nt, Pseudomonas aeruginosa PA01
cagggucuucaggcgc

SEQ ID NO: 3520139 - RNA, 19 nt, Pseudomonas aeruginosa PA01
cagggucuucagugcacgu

SEQ ID NO: 3520140 - RNA, 14 nt, Pseudomonas aeruginosa PA01
cagggucuugccga

SEQ ID NO: 3520141 - RNA, 18 nt, Pseudomonas aeruginosa PA01
cagggugaagcugcggcu

SEQ ID NO: 3520142 - RNA, 23 nt, Pseudomonas aeruginosa PA01
cagggugacgcucuucaccucga

SEQ ID NO: 3520143 - RNA, 23 nt, Pseudomonas aeruginosa PA01
cagggugacggugaucgccgcga

SEQ ID NO: 3520144 - RNA, 14 nt, Pseudomonas aeruginosa PA01
cagggugccgacca

SEQ ID NO: 3520145 - RNA, 22 nt, Pseudomonas aeruginosa PA01
cagggugcgauggaugcgcggc

SEQ ID NO: 3520146 - RNA, 23 nt, Pseudomonas aeruginosa PA01
cagggugcgauggaugcgcggca

SEQ ID NO: 3520147 - RNA, 13 nt, Pseudomonas aeruginosa PA01
cagggugcgccgg

SEQ ID NO: 3520148 - RNA, 15 nt, Pseudomonas aeruginosa PA01
cagggugcgccgggg

SEQ ID NO: 3520149 - RNA, 21 nt, Pseudomonas aeruginosa PA01
cagggugcggauggcgaucga

SEQ ID NO: 3520150 - RNA, 15 nt, Pseudomonas aeruginosa PA01
cagggugcggcugcu

SEQ ID NO: 3520151 - RNA, 22 nt, Pseudomonas aeruginosa PA01
cagggugcggcugcucauguuc

SEQ ID NO: 3520152 - RNA, 18 nt, Pseudomonas aeruginosa PA01
cagggugcgggcgcgggc

SEQ ID NO: 3520153 - RNA, 20 nt, Pseudomonas aeruginosa PA01
cagggugcguacggucaugc

SEQ ID NO: 3520154 - RNA, 19 nt, Pseudomonas aeruginosa PA01
caggguggcgaccgccgua

SEQ ID NO: 3520155 - RNA, 16 nt, Pseudomonas aeruginosa PA01
caggguggcgaucacg

SEQ ID NO: 3520156 - RNA, 17 nt, Pseudomonas aeruginosa PA01
caggguggcgcgcacca

SEQ ID NO: 3520157 - RNA, 14 nt, Pseudomonas aeruginosa PA01
caggguggcgcugc

SEQ ID NO: 3520158 - RNA, 23 nt, Pseudomonas aeruginosa PA01
caggguggcgcugccuucgaagc

SEQ ID NO: 3520159 - RNA, 14 nt, Pseudomonas aeruginosa PA01
caggguggcggcgg

SEQ ID NO: 3520160 - RNA, 17 nt, Pseudomonas aeruginosa PA01
caggguggcggcggcga

SEQ ID NO: 3520161 - RNA, 18 nt, Pseudomonas aeruginosa PA01
caggguggcggcggcgag

SEQ ID NO: 3520162 - RNA, 15 nt, Pseudomonas aeruginosa PA01
caggguggcgggcgg

SEQ ID NO: 3520163 - RNA, 19 nt, Pseudomonas aeruginosa PA01
caggguggcgggcggcccc

SEQ ID NO: 3520164 - RNA, 23 nt, Pseudomonas aeruginosa PA01
caggguguagguauccgccggcc

SEQ ID NO: 3520165 - RNA, 17 nt, Pseudomonas aeruginosa PA01
caggguucggggaacag

SEQ ID NO: 3520166 - RNA, 14 nt, Pseudomonas aeruginosa PA01
caggguuuccagca

SEQ ID NO: 3520167 - RNA, 15 nt, Pseudomonas aeruginosa PA01
caggguuuccagcag

SEQ ID NO: 3520168 - RNA, 18 nt, Pseudomonas aeruginosa PA01
caggguuuccagcagcac

SEQ ID NO: 3520169 - RNA, 21 nt, Pseudomonas aeruginosa PA01
caggguuuccagcagcacccg

SEQ ID NO: 3520170 - RNA, 16 nt, Pseudomonas aeruginosa PA01
caggguuuccugguac

SEQ ID NO: 3520171 - RNA, 17 nt, Pseudomonas aeruginosa PA01
cagguaacccgcggcga

SEQ ID NO: 3520172 - RNA, 14 nt, Pseudomonas aeruginosa PA01
cagguaagcggcgu

SEQ ID NO: 3520173 - RNA, 23 nt, Pseudomonas aeruginosa PA01
cagguaaggcaccaccgccgcca

SEQ ID NO: 3520174 - RNA, 13 nt, Pseudomonas aeruginosa PA01
cagguacaccagg

SEQ ID NO: 3520175 - RNA, 19 nt, Pseudomonas aeruginosa PA01
cagguacagcagcuucagu

SEQ ID NO: 3520176 - RNA, 14 nt, Pseudomonas aeruginosa PA01
cagguacagccgca

SEQ ID NO: 3520177 - RNA, 22 nt, Pseudomonas aeruginosa PA01
cagguacagcgacucgcugccg

SEQ ID NO: 3520178 - RNA, 14 nt, Pseudomonas aeruginosa PA01
cagguacggcgccg

SEQ ID NO: 3520179 - RNA, 15 nt, Pseudomonas aeruginosa PA01
cagguacucggcccg

SEQ ID NO: 3520180 - RNA, 18 nt, Pseudomonas aeruginosa PA01
cagguacucggcccgggc

SEQ ID NO: 3520181 - RNA, 19 nt, Pseudomonas aeruginosa PA01
cagguacucggcccgggcc

SEQ ID NO: 3520182 - RNA, 22 nt, Pseudomonas aeruginosa PA01
cagguacucggcccgggccugg

SEQ ID NO: 3520183 - RNA, 23 nt, Pseudomonas aeruginosa PA01
cagguacucggcccgggccuggu

SEQ ID NO: 3520184 - RNA, 18 nt, Pseudomonas aeruginosa PA01
cagguacuuggccacgcc

SEQ ID NO: 3520185 - RNA, 20 nt, Pseudomonas aeruginosa PA01
cagguagaccacgcaggcca

SEQ ID NO: 3520186 - RNA, 22 nt, Pseudomonas aeruginosa PA01
cagguagaccacgcaggccagc

SEQ ID NO: 3520187 - RNA, 21 nt, Pseudomonas aeruginosa PA01
cagguagaccuugccguugcu

SEQ ID NO: 3520188 - RNA, 22 nt, Pseudomonas aeruginosa PA01
cagguagacgcaggugcccugg

SEQ ID NO: 3520189 - RNA, 13 nt, Pseudomonas aeruginosa PA01
cagguagagcagc

SEQ ID NO: 3520190 - RNA, 18 nt, Pseudomonas aeruginosa PA01
cagguagagcagcccggg

SEQ ID NO: 3520191 - RNA, 14 nt, Pseudomonas aeruginosa PA01
cagguagagggcgu

SEQ ID NO: 3520192 - RNA, 16 nt, Pseudomonas aeruginosa PA01
cagguagauguucagu

SEQ ID NO: 3520193 - RNA, 19 nt, Pseudomonas aeruginosa PA01
cagguagccaggggucagg

SEQ ID NO: 3520194 - RNA, 15 nt, Pseudomonas aeruginosa PA01
cagguagcccaccuc

SEQ ID NO: 3520195 - RNA, 15 nt, Pseudomonas aeruginosa PA01
cagguagccccggcc

SEQ ID NO: 3520196 - RNA, 21 nt, Pseudomonas aeruginosa PA01
cagguagccccggcccggcgu

SEQ ID NO: 3520197 - RNA, 15 nt, Pseudomonas aeruginosa PA01
cagguagccgcgccg

SEQ ID NO: 3520198 - RNA, 16 nt, Pseudomonas aeruginosa PA01
cagguagccgcgccgg

SEQ ID NO: 3520199 - RNA, 14 nt, Pseudomonas aeruginosa PA01
cagguagccggcga

SEQ ID NO: 3520200 - RNA, 16 nt, Pseudomonas aeruginosa PA01
cagguagccggcgagc

SEQ ID NO: 3520201 - RNA, 22 nt, Pseudomonas aeruginosa PA01
cagguagccggcgagcgccugg

SEQ ID NO: 3520202 - RNA, 18 nt, Pseudomonas aeruginosa PA01
cagguagccugcggccag

SEQ ID NO: 3520203 - RNA, 21 nt, Pseudomonas aeruginosa PA01
cagguagccugcggccagcgc

SEQ ID NO: 3520204 - RNA, 13 nt, Pseudomonas aeruginosa PA01
cagguagccugga

SEQ ID NO: 3520205 - RNA, 18 nt, Pseudomonas aeruginosa PA01
cagguagcgcugcgccag

SEQ ID NO: 3520206 - RNA, 20 nt, Pseudomonas aeruginosa PA01
cagguagcgcugcgccaggc

SEQ ID NO: 3520207 - RNA, 23 nt, Pseudomonas aeruginosa PA01
cagguagcgcugcgccaggcuuu

SEQ ID NO: 3520208 - RNA, 18 nt, Pseudomonas aeruginosa PA01
cagguagcgcugcgcccg

SEQ ID NO: 3520209 - RNA, 20 nt, Pseudomonas aeruginosa PA01
cagguagcgcugcgcccgcu

SEQ ID NO: 3520210 - RNA, 13 nt, Pseudomonas aeruginosa PA01
cagguagcggcga

SEQ ID NO: 3520211 - RNA, 21 nt, Pseudomonas aeruginosa PA01
cagguagcguuguguagucau

SEQ ID NO: 3520212 - RNA, 18 nt, Pseudomonas aeruginosa PA01
cagguagcucaucggcga

SEQ ID NO: 3520213 - RNA, 15 nt, Pseudomonas aeruginosa PA01
cagguagcugagcag

SEQ ID NO: 3520214 - RNA, 17 nt, Pseudomonas aeruginosa PA01
cagguagcugagcaggc

SEQ ID NO: 3520215 - RNA, 18 nt, Pseudomonas aeruginosa PA01
cagguagcugagcaggcc

SEQ ID NO: 3520216 - RNA, 22 nt, Pseudomonas aeruginosa PA01
cagguagcugagcaggccgacg

SEQ ID NO: 3520217 - RNA, 19 nt, Pseudomonas aeruginosa PA01
cagguagcugcuccagccc

SEQ ID NO: 3520218 - RNA, 13 nt, Pseudomonas aeruginosa PA01
cagguagcuggaa

SEQ ID NO: 3520219 - RNA, 13 nt, Pseudomonas aeruginosa PA01
cagguaggagagg

SEQ ID NO: 3520220 - RNA, 21 nt, Pseudomonas aeruginosa PA01
cagguaggagagggucagcag

SEQ ID NO: 3520221 - RNA, 23 nt, Pseudomonas aeruginosa PA01
cagguaggcaucgacgccagcgg

SEQ ID NO: 3520222 - RNA, 20 nt, Pseudomonas aeruginosa PA01
cagguaggcgaugcgcgugg

SEQ ID NO: 3520223 - RNA, 21 nt, Pseudomonas aeruginosa PA01
cagguaggcgaugcgcguggu

SEQ ID NO: 3520224 - RNA, 14 nt, Pseudomonas aeruginosa PA01
cagguaggcgcccu

SEQ ID NO: 3520225 - RNA, 16 nt, Pseudomonas aeruginosa PA01
cagguaggcgccgugc

SEQ ID NO: 3520226 - RNA, 13 nt, Pseudomonas aeruginosa PA01
cagguaggcgcgg

SEQ ID NO: 3520227 - RNA, 15 nt, Pseudomonas aeruginosa PA01
cagguaggcgcgggc

SEQ ID NO: 3520228 - RNA, 14 nt, Pseudomonas aeruginosa PA01
cagguaggcggugg

SEQ ID NO: 3520229 - RNA, 23 nt, Pseudomonas aeruginosa PA01
cagguaggggucguugccgucga

SEQ ID NO: 3520230 - RNA, 21 nt, Pseudomonas aeruginosa PA01
cagguaguccagccagugcau

SEQ ID NO: 3520231 - RNA, 15 nt, Pseudomonas aeruginosa PA01
cagguaguccagcgg

SEQ ID NO: 3520232 - RNA, 20 nt, Pseudomonas aeruginosa PA01
cagguaguccagcuccucga

SEQ ID NO: 3520233 - RNA, 22 nt, Pseudomonas aeruginosa PA01
cagguagucgcucauggcgccg

SEQ ID NO: 3520234 - RNA, 14 nt, Pseudomonas aeruginosa PA01
cagguagucggcga

SEQ ID NO: 3520235 - RNA, 14 nt, Pseudomonas aeruginosa PA01
cagguagugcaaca

SEQ ID NO: 3520236 - RNA, 20 nt, Pseudomonas aeruginosa PA01
cagguagugcaacaccuggc

SEQ ID NO: 3520237 - RNA, 21 nt, Pseudomonas aeruginosa PA01
cagguagugcaacaccuggcg

SEQ ID NO: 3520238 - RNA, 15 nt, Pseudomonas aeruginosa PA01
cagguagugcggcgg

SEQ ID NO: 3520239 - RNA, 16 nt, Pseudomonas aeruginosa PA01
cagguagugcggcggg

SEQ ID NO: 3520240 - RNA, 23 nt, Pseudomonas aeruginosa PA01
cagguagugcggcgggcgcccgc

SEQ ID NO: 3520241 - RNA, 22 nt, Pseudomonas aeruginosa PA01
cagguaguggcccucgauguag

SEQ ID NO: 3520242 - RNA, 17 nt, Pseudomonas aeruginosa PA01
cagguaguucuccaggc

SEQ ID NO: 3520243 - RNA, 19 nt, Pseudomonas aeruginosa PA01
cagguaguucuccaggccc

SEQ ID NO: 3520244 - RNA, 20 nt, Pseudomonas aeruginosa PA01
cagguaguucuccaggccca

SEQ ID NO: 3520245 - RNA, 19 nt, Pseudomonas aeruginosa PA01
cagguauucgcgcucggcg

SEQ ID NO: 3520246 - RNA, 16 nt, Pseudomonas aeruginosa PA01
caggucagccaccugc

SEQ ID NO: 3520247 - RNA, 18 nt, Pseudomonas aeruginosa PA01
caggucaugaaggaaacc

SEQ ID NO: 3520248 - RNA, 23 nt, Pseudomonas aeruginosa PA01
caggucaugaaggaaaccggcca

SEQ ID NO: 3520249 - RNA, 15 nt, Pseudomonas aeruginosa PA01
caggucaugcccugg

SEQ ID NO: 3520250 - RNA, 18 nt, Pseudomonas aeruginosa PA01
caggucaugcccuggccg

SEQ ID NO: 3520251 - RNA, 23 nt, Pseudomonas aeruginosa PA01
caggucaugcccuggccgacgcu

SEQ ID NO: 3520252 - RNA, 15 nt, Pseudomonas aeruginosa PA01
cagguccaccagcca

SEQ ID NO: 3520253 - RNA, 14 nt, Pseudomonas aeruginosa PA01
cagguccagcaagg

SEQ ID NO: 3520254 - RNA, 20 nt, Pseudomonas aeruginosa PA01
cagguccgaacagaggaagg

SEQ ID NO: 3520255 - RNA, 23 nt, Pseudomonas aeruginosa PA01
cagguccgcaccguagcggcugc

SEQ ID NO: 3520256 - RNA, 14 nt, Pseudomonas aeruginosa PA01
cagguccgcgccuc

SEQ ID NO: 3520257 - RNA, 17 nt, Pseudomonas aeruginosa PA01
cagguccgcgccucgcg

SEQ ID NO: 3520258 - RNA, 14 nt, Pseudomonas aeruginosa PA01
cagguccggcagcg

SEQ ID NO: 3520259 - RNA, 16 nt, Pseudomonas aeruginosa PA01
cagguccggcagcgcc

SEQ ID NO: 3520260 - RNA, 13 nt, Pseudomonas aeruginosa PA01
cagguccuggaac

SEQ ID NO: 3520261 - RNA, 14 nt, Pseudomonas aeruginosa PA01
cagguccuggaaca

SEQ ID NO: 3520262 - RNA, 16 nt, Pseudomonas aeruginosa PA01
cagguccuggaacagg

SEQ ID NO: 3520263 - RNA, 23 nt, Pseudomonas aeruginosa PA01
cagguccuggguauagaccagca

SEQ ID NO: 3520264 - RNA, 15 nt, Pseudomonas aeruginosa PA01
cagguccuugaucac

SEQ ID NO: 3520265 - RNA, 19 nt, Pseudomonas aeruginosa PA01
cagguccuuguuccugggc

SEQ ID NO: 3520266 - RNA, 16 nt, Pseudomonas aeruginosa PA01
caggucgaacagcggc

SEQ ID NO: 3520267 - RNA, 20 nt, Pseudomonas aeruginosa PA01
caggucgacaugcaccaggc

SEQ ID NO: 3520268 - RNA, 21 nt, Pseudomonas aeruginosa PA01
caggucgacaugcaccaggcc

SEQ ID NO: 3520269 - RNA, 23 nt, Pseudomonas aeruginosa PA01
caggucgacaugcaccaggccgc

SEQ ID NO: 3520270 - RNA, 22 nt, Pseudomonas aeruginosa PA01
caggucgacgaccuugcccacc

SEQ ID NO: 3520271 - RNA, 14 nt, Pseudomonas aeruginosa PA01
caggucgacgccau

SEQ ID NO: 3520272 - RNA, 16 nt, Pseudomonas aeruginosa PA01
caggucgacgccaugg

SEQ ID NO: 3520273 - RNA, 18 nt, Pseudomonas aeruginosa PA01
caggucgacgccauggcg

SEQ ID NO: 3520274 - RNA, 16 nt, Pseudomonas aeruginosa PA01
caggucgacgccgccg

SEQ ID NO: 3520275 - RNA, 19 nt, Pseudomonas aeruginosa PA01
caggucgacgccgccgagc

SEQ ID NO: 3520276 - RNA, 17 nt, Pseudomonas aeruginosa PA01
caggucgacggcccuga

SEQ ID NO: 3520277 - RNA, 23 nt, Pseudomonas aeruginosa PA01
caggucgagacgcgggcccagcg

SEQ ID NO: 3520278 - RNA, 13 nt, Pseudomonas aeruginosa PA01
caggucgagcagu

SEQ ID NO: 3520279 - RNA, 14 nt, Pseudomonas aeruginosa PA01
caggucgaggacga

SEQ ID NO: 3520280 - RNA, 17 nt, Pseudomonas aeruginosa PA01
caggucgaggcgcucca

SEQ ID NO: 3520281 - RNA, 15 nt, Pseudomonas aeruginosa PA01
caggucgagggugau

SEQ ID NO: 3520282 - RNA, 20 nt, Pseudomonas aeruginosa PA01
caggucgagguucuccaggc

SEQ ID NO: 3520283 - RNA, 21 nt, Pseudomonas aeruginosa PA01
caggucgagguuguagcccug

SEQ ID NO: 3520284 - RNA, 23 nt, Pseudomonas aeruginosa PA01
caggucgagguuguagcccuggg

SEQ ID NO: 3520285 - RNA, 16 nt, Pseudomonas aeruginosa PA01
caggucgaucagcagc

SEQ ID NO: 3520286 - RNA, 17 nt, Pseudomonas aeruginosa PA01
caggucgaucagcagca

SEQ ID NO: 3520287 - RNA, 23 nt, Pseudomonas aeruginosa PA01
caggucgaucagcagcagcgcca

SEQ ID NO: 3520288 - RNA, 17 nt, Pseudomonas aeruginosa PA01
caggucgauccccaacc

SEQ ID NO: 3520289 - RNA, 21 nt, Pseudomonas aeruginosa PA01
caggucgauccugaccccggc

SEQ ID NO: 3520290 - RNA, 15 nt, Pseudomonas aeruginosa PA01
caggucgaugcccag

SEQ ID NO: 3520291 - RNA, 19 nt, Pseudomonas aeruginosa PA01
caggucgccagcgccuucg

SEQ ID NO: 3520292 - RNA, 19 nt, Pseudomonas aeruginosa PA01
caggucgccaugcccgucg

SEQ ID NO: 3520293 - RNA, 14 nt, Pseudomonas aeruginosa PA01
caggucgcccaccu

SEQ ID NO: 3520294 - RNA, 17 nt, Pseudomonas aeruginosa PA01
caggucgcccaccuugc

SEQ ID NO: 3520295 - RNA, 20 nt, Pseudomonas aeruginosa PA01
caggucgccgcacaccgcgc

SEQ ID NO: 3520296 - RNA, 17 nt, Pseudomonas aeruginosa PA01
caggucgccgccgccgg

SEQ ID NO: 3520297 - RNA, 17 nt, Pseudomonas aeruginosa PA01
caggucgcgcagggcca

SEQ ID NO: 3520298 - RNA, 18 nt, Pseudomonas aeruginosa PA01
caggucgcgcaguucguc

SEQ ID NO: 3520299 - RNA, 23 nt, Pseudomonas aeruginosa PA01
caggucgcgcggcgccugcugcg

SEQ ID NO: 3520300 - RNA, 13 nt, Pseudomonas aeruginosa PA01
caggucgcggaag

SEQ ID NO: 3520301 - RNA, 14 nt, Pseudomonas aeruginosa PA01
caggucgcggauca

SEQ ID NO: 3520302 - RNA, 19 nt, Pseudomonas aeruginosa PA01
caggucgcugcccucgacc

SEQ ID NO: 3520303 - RNA, 23 nt, Pseudomonas aeruginosa PA01
caggucgcugcccucgaccaggu

SEQ ID NO: 3520304 - RNA, 23 nt, Pseudomonas aeruginosa PA01
caggucgcuggcaccggccaggc

SEQ ID NO: 3520305 - RNA, 23 nt, Pseudomonas aeruginosa PA01
caggucgcuggcgucgaccgccu

SEQ ID NO: 3520306 - RNA, 22 nt, Pseudomonas aeruginosa PA01
caggucgcuguccuccagcggc

SEQ ID NO: 3520307 - RNA, 19 nt, Pseudomonas aeruginosa PA01
caggucgcuuucgcgcaga

SEQ ID NO: 3520308 - RNA, 13 nt, Pseudomonas aeruginosa PA01
caggucggacagg

SEQ ID NO: 3520309 - RNA, 23 nt, Pseudomonas aeruginosa PA01
caggucggacaggcauuccgggc

SEQ ID NO: 3520310 - RNA, 14 nt, Pseudomonas aeruginosa PA01
caggucggcagcgu

SEQ ID NO: 3520311 - RNA, 12 nt, Pseudomonas aeruginosa PA01
caggucggccgg

SEQ ID NO: 3520312 - RNA, 17 nt, Pseudomonas aeruginosa PA01
caggucggccggcagcu

SEQ ID NO: 3520313 - RNA, 13 nt, Pseudomonas aeruginosa PA01
caggucggccucg

SEQ ID NO: 3520314 - RNA, 17 nt, Pseudomonas aeruginosa PA01
caggucggccucggcga

SEQ ID NO: 3520315 - RNA, 15 nt, Pseudomonas aeruginosa PA01
caggucggccugcug

SEQ ID NO: 3520316 - RNA, 18 nt, Pseudomonas aeruginosa PA01
caggucggcgaaauccuc

SEQ ID NO: 3520317 - RNA, 19 nt, Pseudomonas aeruginosa PA01
caggucggcgaaauccucg

SEQ ID NO: 3520318 - RNA, 22 nt, Pseudomonas aeruginosa PA01
caggucggcgaaauccucgcgc

SEQ ID NO: 3520319 - RNA, 11 nt, Pseudomonas aeruginosa PA01
caggucggcgc

SEQ ID NO: 3520320 - RNA, 15 nt, Pseudomonas aeruginosa PA01
caggucggcgccggu

SEQ ID NO: 3520321 - RNA, 16 nt, Pseudomonas aeruginosa PA01
caggucggcgccggug

SEQ ID NO: 3520322 - RNA, 12 nt, Pseudomonas aeruginosa PA01
caggucggcgcg

SEQ ID NO: 3520323 - RNA, 14 nt, Pseudomonas aeruginosa PA01
caggucggcgcgac

SEQ ID NO: 3520324 - RNA, 14 nt, Pseudomonas aeruginosa PA01
caggucggcgcgcg

SEQ ID NO: 3520325 - RNA, 15 nt, Pseudomonas aeruginosa PA01
caggucggcggcacg

SEQ ID NO: 3520326 - RNA, 22 nt, Pseudomonas aeruginosa PA01
caggucggcgggcaccgccagc

SEQ ID NO: 3520327 - RNA, 23 nt, Pseudomonas aeruginosa PA01
caggucggcgggcaccgccagcc
